United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 117

SEQ ID NO: 4957928 - DNA, 14 bp, Homo sapiens
agtaacttggcttt

SEQ ID NO: 4957929 - DNA, 16 bp, Homo sapiens
agtaactttatgtgta

SEQ ID NO: 4957930 - DNA, 13 bp, Homo sapiens
agtaagaaaagtg

SEQ ID NO: 4957931 - DNA, 17 bp, Homo sapiens
agtaagttcagcacttg

SEQ ID NO: 4957932 - DNA, 13 bp, Homo sapiens
agtaatagagcaa

SEQ ID NO: 4957933 - DNA, 19 bp, Homo sapiens
agtaataggagcttccagc

SEQ ID NO: 4957934 - DNA, 15 bp, Homo sapiens
agtaatatattctga

SEQ ID NO: 4957935 - DNA, 14 bp, Homo sapiens
agtaatcaataaag

SEQ ID NO: 4957936 - DNA, 18 bp, Homo sapiens
agtaatcaataaagaaaa

SEQ ID NO: 4957937 - DNA, 19 bp, Homo sapiens
agtaatctaatatggccac

SEQ ID NO: 4957938 - DNA, 14 bp, Homo sapiens
agtaatctgtacat

SEQ ID NO: 4957939 - DNA, 23 bp, Homo sapiens
agtaatctgtacattttgttgta

SEQ ID NO: 4957940 - DNA, 15 bp, Homo sapiens
agtaatgatctcaaa

SEQ ID NO: 4957941 - DNA, 18 bp, Homo sapiens
agtaatgtggaagaaaat

SEQ ID NO: 4957942 - DNA, 21 bp, Homo sapiens
agtaatgttattttcttctaa

SEQ ID NO: 4957943 - DNA, 15 bp, Homo sapiens
agtaatttgaggaca

SEQ ID NO: 4957944 - DNA, 13 bp, Homo sapiens
agtacaatgtgtt

SEQ ID NO: 4957945 - DNA, 17 bp, Homo sapiens
agtacaatgtgtttttc

SEQ ID NO: 4957946 - DNA, 18 bp, Homo sapiens
agtacaatgtgtttttct

SEQ ID NO: 4957947 - DNA, 16 bp, Homo sapiens
agtacacaataagcaa

SEQ ID NO: 4957948 - DNA, 17 bp, Homo sapiens
agtacacaataagcaaa

SEQ ID NO: 4957949 - DNA, 22 bp, Homo sapiens
agtacacaataagcaaaaacaa

SEQ ID NO: 4957950 - DNA, 15 bp, Homo sapiens
agtacagcatgtgcc

SEQ ID NO: 4957951 - DNA, 22 bp, Homo sapiens
agtacatgataaatgatagaca

SEQ ID NO: 4957952 - DNA, 19 bp, Homo sapiens
agtacatttggagacacaa

SEQ ID NO: 4957953 - DNA, 18 bp, Homo sapiens
agtaccaaagttttatca

SEQ ID NO: 4957954 - DNA, 21 bp, Homo sapiens
agtaccagcgctctaaaagca

SEQ ID NO: 4957955 - DNA, 14 bp, Homo sapiens
agtacctgaaaagt

SEQ ID NO: 4957956 - DNA, 22 bp, Homo sapiens
agtactacacatttttaaattg

SEQ ID NO: 4957957 - DNA, 17 bp, Homo sapiens
agtactgctcttgtttc

SEQ ID NO: 4957958 - DNA, 18 bp, Homo sapiens
agtactgtaataatacct

SEQ ID NO: 4957959 - DNA, 23 bp, Homo sapiens
agtactgtaataatacctcaatg

SEQ ID NO: 4957960 - DNA, 15 bp, Homo sapiens
agtactgtgtactgt

SEQ ID NO: 4957961 - DNA, 20 bp, Homo sapiens
agtacttgagtgtaatgttt

SEQ ID NO: 4957962 - DNA, 18 bp, Homo sapiens
agtacttgtgaaacacag

SEQ ID NO: 4957963 - DNA, 23 bp, Homo sapiens
agtacttgtgaaacacagctgtt

SEQ ID NO: 4957964 - DNA, 19 bp, Homo sapiens
agtagaaataaaagtgaat

SEQ ID NO: 4957965 - DNA, 18 bp, Homo sapiens
agtagaaataatatgcat

SEQ ID NO: 4957966 - DNA, 14 bp, Homo sapiens
agtagaattgcatt

SEQ ID NO: 4957967 - DNA, 19 bp, Homo sapiens
agtagacaatcattgtttt

SEQ ID NO: 4957968 - DNA, 15 bp, Homo sapiens
agtagacacatttaa

SEQ ID NO: 4957969 - DNA, 12 bp, Homo sapiens
agtagagacagg

SEQ ID NO: 4957970 - DNA, 15 bp, Homo sapiens
agtagagccagcttg

SEQ ID NO: 4957971 - DNA, 18 bp, Homo sapiens
agtagaggtactagaatg

SEQ ID NO: 4957972 - DNA, 16 bp, Homo sapiens
agtagatattacttta

SEQ ID NO: 4957973 - DNA, 21 bp, Homo sapiens
agtagatattactttatcact

SEQ ID NO: 4957974 - DNA, 15 bp, Homo sapiens
agtagccctttctgt

SEQ ID NO: 4957975 - DNA, 16 bp, Homo sapiens
agtagccctttctgtg

SEQ ID NO: 4957976 - DNA, 17 bp, Homo sapiens
agtagccctttctgtgt

SEQ ID NO: 4957977 - DNA, 21 bp, Homo sapiens
agtagccctttctgtgtgcac

SEQ ID NO: 4957978 - DNA, 19 bp, Homo sapiens
agtagcgttttttaaatgt

SEQ ID NO: 4957979 - DNA, 20 bp, Homo sapiens
agtagcgttttttaaatgta

SEQ ID NO: 4957980 - DNA, 21 bp, Homo sapiens
agtagctgggactacaggcac

SEQ ID NO: 4957981 - DNA, 22 bp, Homo sapiens
agtagctgggactacaggcacc

SEQ ID NO: 4957982 - DNA, 23 bp, Homo sapiens
agtagcttgctccctgtgtccac

SEQ ID NO: 4957983 - DNA, 12 bp, Homo sapiens
agtagtttgtat

SEQ ID NO: 4957984 - DNA, 21 bp, Homo sapiens
agtataaccatatgatactat

SEQ ID NO: 4957985 - DNA, 19 bp, Homo sapiens
agtatacaatatataaaaa

SEQ ID NO: 4957986 - DNA, 17 bp, Homo sapiens
agtatagcctatggcag

SEQ ID NO: 4957987 - DNA, 18 bp, Homo sapiens
agtatcaggtctcccacg

SEQ ID NO: 4957988 - DNA, 17 bp, Homo sapiens
agttaagagaaacttta

SEQ ID NO: 4957989 - DNA, 19 bp, Homo sapiens
agttaagagaaactttata

SEQ ID NO: 4957990 - DNA, 13 bp, Homo sapiens
agttaatttatct

SEQ ID NO: 4957991 - DNA, 15 bp, Homo sapiens
agttagaatctattt

SEQ ID NO: 4957992 - DNA, 17 bp, Homo sapiens
agttagaatctattttc

SEQ ID NO: 4957993 - DNA, 12 bp, Homo sapiens
agttaggaaata

SEQ ID NO: 4957994 - DNA, 14 bp, Homo sapiens
agttaggaaataaa

SEQ ID NO: 4957995 - DNA, 15 bp, Homo sapiens
agttaggaaataaaa

SEQ ID NO: 4957996 - DNA, 17 bp, Homo sapiens
agttagtttttaggtca

SEQ ID NO: 4957997 - DNA, 18 bp, Homo sapiens
agttatagtttcagatat

SEQ ID NO: 4957998 - DNA, 12 bp, Homo sapiens
agttatgaatca

SEQ ID NO: 4957999 - DNA, 21 bp, Homo sapiens
agttatggcctatacactatt

SEQ ID NO: 4958000 - DNA, 14 bp, Homo sapiens
agttatgttaaaat

SEQ ID NO: 4958001 - DNA, 18 bp, Homo sapiens
agttattccttgatcatt

SEQ ID NO: 4958002 - DNA, 22 bp, Homo sapiens
agttattgtacagctgtttaag

SEQ ID NO: 4958003 - DNA, 15 bp, Homo sapiens
agttcaatctcccgc

SEQ ID NO: 4958004 - DNA, 18 bp, Homo sapiens
agttcacaccctgcaagg

SEQ ID NO: 4958005 - DNA, 23 bp, Homo sapiens
agttcacaccctgcaaggcccac

SEQ ID NO: 4958006 - DNA, 17 bp, Homo sapiens
agttcagcaccacccta

SEQ ID NO: 4958007 - DNA, 14 bp, Homo sapiens
agttcagcacttgt

SEQ ID NO: 4958008 - DNA, 16 bp, Homo sapiens
agttcaggagtcccaa

SEQ ID NO: 4958009 - DNA, 19 bp, Homo sapiens
agttcaggagtcccaagga

SEQ ID NO: 4958010 - DNA, 19 bp, Homo sapiens
agttcaggtaacaggcaga

SEQ ID NO: 4958011 - DNA, 19 bp, Homo sapiens
agttcatattccatattta

SEQ ID NO: 4958012 - DNA, 18 bp, Homo sapiens
agttcatcccagccccaa

SEQ ID NO: 4958013 - DNA, 13 bp, Homo sapiens
agttcatgagaat

SEQ ID NO: 4958014 - DNA, 17 bp, Homo sapiens
agttcatgtttgcttca

SEQ ID NO: 4958015 - DNA, 13 bp, Homo sapiens
agttccaagagtc

SEQ ID NO: 4958016 - DNA, 20 bp, Homo sapiens
agttccaagtccaataagac

SEQ ID NO: 4958017 - DNA, 18 bp, Homo sapiens
agttccctctgctcagcc

SEQ ID NO: 4958018 - DNA, 19 bp, Homo sapiens
agttccctctgctcagcca

SEQ ID NO: 4958019 - DNA, 15 bp, Homo sapiens
agttcccttggcctc

SEQ ID NO: 4958020 - DNA, 16 bp, Homo sapiens
agttcccttggcctca

SEQ ID NO: 4958021 - DNA, 23 bp, Homo sapiens
agttctaagactcaaatgttcta

SEQ ID NO: 4958022 - DNA, 15 bp, Homo sapiens
agttctaagattcta

SEQ ID NO: 4958023 - DNA, 18 bp, Homo sapiens
agttctaagattctaatg

SEQ ID NO: 4958024 - DNA, 19 bp, Homo sapiens
agttctaagattctaatga

SEQ ID NO: 4958025 - DNA, 16 bp, Homo sapiens
agttctaataatttct

SEQ ID NO: 4958026 - DNA, 20 bp, Homo sapiens
agttctaataatttctaatg

SEQ ID NO: 4958027 - DNA, 20 bp, Homo sapiens
agttctacctcaggcagctc

SEQ ID NO: 4958028 - DNA, 23 bp, Homo sapiens
agttctacctcaggcagctcaag

SEQ ID NO: 4958029 - DNA, 10 bp, Homo sapiens
agttctagac

SEQ ID NO: 4958030 - DNA, 14 bp, Homo sapiens
agttctaggcactg

SEQ ID NO: 4958031 - DNA, 22 bp, Homo sapiens
agttctaggcactgtagttcta

SEQ ID NO: 4958032 - DNA, 15 bp, Homo sapiens
agttctcaatgtgaa

SEQ ID NO: 4958033 - DNA, 13 bp, Homo sapiens
agttctgaagaat

SEQ ID NO: 4958034 - DNA, 18 bp, Homo sapiens
agttctgtgtttaatttc

SEQ ID NO: 4958035 - DNA, 22 bp, Homo sapiens
agttctgtgtttaatttcttca

SEQ ID NO: 4958036 - DNA, 23 bp, Homo sapiens
agttcttggtccctccagaacca

SEQ ID NO: 4958037 - DNA, 14 bp, Homo sapiens
agttcttgtgccat

SEQ ID NO: 4958038 - DNA, 15 bp, Homo sapiens
agttgaagtttagga

SEQ ID NO: 4958039 - DNA, 17 bp, Homo sapiens
agttgacttatagtaca

SEQ ID NO: 4958040 - DNA, 18 bp, Homo sapiens
agttgaggaactgtacag

SEQ ID NO: 4958041 - DNA, 20 bp, Homo sapiens
agttgagtcgtcatcacttt

SEQ ID NO: 4958042 - DNA, 14 bp, Homo sapiens
agttgccaagacaa

SEQ ID NO: 4958043 - DNA, 17 bp, Homo sapiens
agttgccaagacaaatc

SEQ ID NO: 4958044 - DNA, 14 bp, Homo sapiens
agttgccaccacct

SEQ ID NO: 4958045 - DNA, 14 bp, Homo sapiens
agttggaaatattc

SEQ ID NO: 4958046 - DNA, 21 bp, Homo sapiens
agttgggtggatgcctggtgg

SEQ ID NO: 4958047 - DNA, 18 bp, Homo sapiens
agttgtaacttatattga

SEQ ID NO: 4958048 - DNA, 18 bp, Homo sapiens
agttgtagcagattgttt

SEQ ID NO: 4958049 - DNA, 20 bp, Homo sapiens
agttgtccatattttcacag

SEQ ID NO: 4958050 - DNA, 14 bp, Homo sapiens
agttgtctctcttc

SEQ ID NO: 4958051 - DNA, 21 bp, Homo sapiens
agttgtctctcttcagactct

SEQ ID NO: 4958052 - DNA, 18 bp, Homo sapiens
agttgtttgtttttgctt

SEQ ID NO: 4958053 - DNA, 12 bp, Homo sapiens
agtttaaagcaa

SEQ ID NO: 4958054 - DNA, 12 bp, Homo sapiens
agtttaacacaa

SEQ ID NO: 4958055 - DNA, 22 bp, Homo sapiens
agtttaacacaagtcctgtgaa

SEQ ID NO: 4958056 - DNA, 15 bp, Homo sapiens
agtttacaagtgtat

SEQ ID NO: 4958057 - DNA, 23 bp, Homo sapiens
agtttacaagtgtatatcagaaa

SEQ ID NO: 4958058 - DNA, 17 bp, Homo sapiens
agtttacattgtaaata

SEQ ID NO: 4958059 - DNA, 21 bp, Homo sapiens
agtttacatttttatttatga

SEQ ID NO: 4958060 - DNA, 22 bp, Homo sapiens
agtttacatttttatttatgaa

SEQ ID NO: 4958061 - DNA, 15 bp, Homo sapiens
agtttatcatgaagc

SEQ ID NO: 4958062 - DNA, 19 bp, Homo sapiens
agtttatcatgaagcctgt

SEQ ID NO: 4958063 - DNA, 15 bp, Homo sapiens
agtttattctcattt

SEQ ID NO: 4958064 - DNA, 20 bp, Homo sapiens
agtttatttttaaagataga

SEQ ID NO: 4958065 - DNA, 19 bp, Homo sapiens
agtttcaaacttactattt

SEQ ID NO: 4958066 - DNA, 14 bp, Homo sapiens
agtttcaatgtgat

SEQ ID NO: 4958067 - DNA, 15 bp, Homo sapiens
agtttcaatgtgatt

SEQ ID NO: 4958068 - DNA, 15 bp, Homo sapiens
agtttcagatatata

SEQ ID NO: 4958069 - DNA, 17 bp, Homo sapiens
agtttcagcttaaaata

SEQ ID NO: 4958070 - DNA, 21 bp, Homo sapiens
agtttcagcttaaaataaaca

SEQ ID NO: 4958071 - DNA, 14 bp, Homo sapiens
agtttctaagattc

SEQ ID NO: 4958072 - DNA, 19 bp, Homo sapiens
agtttctaagattctaaag

SEQ ID NO: 4958073 - DNA, 13 bp, Homo sapiens
agtttctcagctc

SEQ ID NO: 4958074 - DNA, 15 bp, Homo sapiens
agtttctcagctccc

SEQ ID NO: 4958075 - DNA, 14 bp, Homo sapiens
agtttctcttttca

SEQ ID NO: 4958076 - DNA, 18 bp, Homo sapiens
agtttctgtttgattctt

SEQ ID NO: 4958077 - DNA, 19 bp, Homo sapiens
agtttctgtttgattcttt

SEQ ID NO: 4958078 - DNA, 15 bp, Homo sapiens
agtttgaaggaaaca

SEQ ID NO: 4958079 - DNA, 14 bp, Homo sapiens
agtttgctattaga

SEQ ID NO: 4958080 - DNA, 13 bp, Homo sapiens
agtttgcttagaa

SEQ ID NO: 4958081 - DNA, 21 bp, Homo sapiens
agtttggagagtcagatcttt

SEQ ID NO: 4958082 - DNA, 16 bp, Homo sapiens
agtttggtctggactg

SEQ ID NO: 4958083 - DNA, 14 bp, Homo sapiens
agtttgtaaatgtt

SEQ ID NO: 4958084 - DNA, 17 bp, Homo sapiens
agtttgtaaatgttatt

SEQ ID NO: 4958085 - DNA, 22 bp, Homo sapiens
agtttgtaaatgttatttctgc

SEQ ID NO: 4958086 - DNA, 15 bp, Homo sapiens
agtttgtacatgcat

SEQ ID NO: 4958087 - DNA, 19 bp, Homo sapiens
agtttgtaggtaaaatgta

SEQ ID NO: 4958088 - DNA, 22 bp, Homo sapiens
agtttgtaggtaaaatgtattt

SEQ ID NO: 4958089 - DNA, 15 bp, Homo sapiens
agtttgtccatttgt

SEQ ID NO: 4958090 - DNA, 13 bp, Homo sapiens
agtttgtctattt

SEQ ID NO: 4958091 - DNA, 14 bp, Homo sapiens
agtttgtctatttt

SEQ ID NO: 4958092 - DNA, 22 bp, Homo sapiens
agtttgtgtgtcttaattatta

SEQ ID NO: 4958093 - DNA, 20 bp, Homo sapiens
agtttgtgtgttgtcttgaa

SEQ ID NO: 4958094 - DNA, 20 bp, Homo sapiens
agtttgtttaatgtgaactt

SEQ ID NO: 4958095 - DNA, 14 bp, Homo sapiens
agttttagttttct

SEQ ID NO: 4958096 - DNA, 15 bp, Homo sapiens
agttttagttttctc

SEQ ID NO: 4958097 - DNA, 14 bp, Homo sapiens
agttttatgctctt

SEQ ID NO: 4958098 - DNA, 13 bp, Homo sapiens
atagaatgctgca

SEQ ID NO: 4958099 - DNA, 14 bp, Homo sapiens
atagacaattgagg

SEQ ID NO: 4958100 - DNA, 16 bp, Homo sapiens
atagacagtttgtaaa

SEQ ID NO: 4958101 - DNA, 22 bp, Homo sapiens
atagagcaaaattgatgtgttt

SEQ ID NO: 4958102 - DNA, 15 bp, Homo sapiens
atagagtatatgcac

SEQ ID NO: 4958103 - DNA, 22 bp, Homo sapiens
atagagtgactccaagaacaat

SEQ ID NO: 4958104 - DNA, 21 bp, Homo sapiens
atagagtgtacttaactattc

SEQ ID NO: 4958105 - DNA, 23 bp, Homo sapiens
atagagtgtagtttacagaaaaa

SEQ ID NO: 4958106 - DNA, 16 bp, Homo sapiens
atagagtttaacacaa

SEQ ID NO: 4958107 - DNA, 21 bp, Homo sapiens
atagatcttctgaaatgaaac

SEQ ID NO: 4958108 - DNA, 22 bp, Homo sapiens
atagatgttttggtagattaaa

SEQ ID NO: 4958109 - DNA, 23 bp, Homo sapiens
atagatgttttggtagattaaat

SEQ ID NO: 4958110 - DNA, 19 bp, Homo sapiens
atagattaatggcactgat

SEQ ID NO: 4958111 - DNA, 12 bp, Homo sapiens
atagattctaaa

SEQ ID NO: 4958112 - DNA, 14 bp, Homo sapiens
atagattctaaaga

SEQ ID NO: 4958113 - DNA, 19 bp, Homo sapiens
atagattctcttgtataag

SEQ ID NO: 4958114 - DNA, 22 bp, Homo sapiens
atagatttatttttcagttcca

SEQ ID NO: 4958115 - DNA, 22 bp, Homo sapiens
atagcaacttttgtgtaatgaa

SEQ ID NO: 4958116 - DNA, 12 bp, Homo sapiens
atagcactttga

SEQ ID NO: 4958117 - DNA, 14 bp, Homo sapiens
atagcactttgaaa

SEQ ID NO: 4958118 - DNA, 22 bp, Homo sapiens
atagcactttgaaatacctcat

SEQ ID NO: 4958119 - DNA, 18 bp, Homo sapiens
atagcatggatagagtat

SEQ ID NO: 4958120 - DNA, 21 bp, Homo sapiens
atagccacatttggaatactt

SEQ ID NO: 4958121 - DNA, 21 bp, Homo sapiens
atagccattgatcataaactg

SEQ ID NO: 4958122 - DNA, 16 bp, Homo sapiens
atagcccatccctgcc

SEQ ID NO: 4958123 - DNA, 17 bp, Homo sapiens
atagcccatccctgcct

SEQ ID NO: 4958124 - DNA, 22 bp, Homo sapiens
atagctaacattttaaataaaa

SEQ ID NO: 4958125 - DNA, 23 bp, Homo sapiens
atagctaacattttaaataaaag

SEQ ID NO: 4958126 - DNA, 14 bp, Homo sapiens
atagctaagtacac

SEQ ID NO: 4958127 - DNA, 17 bp, Homo sapiens
atagctaataatgttaa

SEQ ID NO: 4958128 - DNA, 19 bp, Homo sapiens
atagctcaggtgtccctgc

SEQ ID NO: 4958129 - DNA, 12 bp, Homo sapiens
atagctgggact

SEQ ID NO: 4958130 - DNA, 17 bp, Homo sapiens
atagcttgtatagtgta

SEQ ID NO: 4958131 - DNA, 20 bp, Homo sapiens
atagcttgtatagtgtaaaa

SEQ ID NO: 4958132 - DNA, 18 bp, Homo sapiens
atagcttttattgtataa

SEQ ID NO: 4958133 - DNA, 13 bp, Homo sapiens
ataggaattcatc

SEQ ID NO: 4958134 - DNA, 17 bp, Homo sapiens
ataggaccttgggccaa

SEQ ID NO: 4958135 - DNA, 14 bp, Homo sapiens
ataggagaggatga

SEQ ID NO: 4958136 - DNA, 13 bp, Homo sapiens
ataggagcctgct

SEQ ID NO: 4958137 - DNA, 20 bp, Homo sapiens
atagggctgggcaaggaaaa

SEQ ID NO: 4958138 - DNA, 18 bp, Homo sapiens
ataggggatatttaaggt

SEQ ID NO: 4958139 - DNA, 13 bp, Homo sapiens
ataggtctcttct

SEQ ID NO: 4958140 - DNA, 20 bp, Homo sapiens
ataggtctcttctcccagaa

SEQ ID NO: 4958141 - DNA, 19 bp, Homo sapiens
atagtaacttcttatggaa

SEQ ID NO: 4958142 - DNA, 21 bp, Homo sapiens
atagtaacttcttatggaatt

SEQ ID NO: 4958143 - DNA, 13 bp, Homo sapiens
atagtagtatgat

SEQ ID NO: 4958144 - DNA, 15 bp, Homo sapiens
atagtatggtggctg

SEQ ID NO: 4958145 - DNA, 20 bp, Homo sapiens
atagtatttgagagttctaa

SEQ ID NO: 4958146 - DNA, 20 bp, Homo sapiens
atagtgcaactatgaatgta

SEQ ID NO: 4958147 - DNA, 17 bp, Homo sapiens
atagtgcacaaaatgaa

SEQ ID NO: 4958148 - DNA, 16 bp, Homo sapiens
atagtgctatatatat

SEQ ID NO: 4958149 - DNA, 20 bp, Homo sapiens
atagtgctatatatataaat

SEQ ID NO: 4958150 - DNA, 22 bp, Homo sapiens
atagtgctatatatataaatat

SEQ ID NO: 4958151 - DNA, 20 bp, Homo sapiens
atagtgctgggatggagggg

SEQ ID NO: 4958152 - DNA, 18 bp, Homo sapiens
atagtggaaaaacacatg

SEQ ID NO: 4958153 - DNA, 14 bp, Homo sapiens
atagtgtaaaataa

SEQ ID NO: 4958154 - DNA, 15 bp, Homo sapiens
atagttagaacctgg

SEQ ID NO: 4958155 - DNA, 18 bp, Homo sapiens
atagttcctaagaagctt

SEQ ID NO: 4958156 - DNA, 12 bp, Homo sapiens
atagttctagac

SEQ ID NO: 4958157 - DNA, 12 bp, Homo sapiens
atagttctaggc

SEQ ID NO: 4958158 - DNA, 22 bp, Homo sapiens
atagttggctaggacccctcca

SEQ ID NO: 4958159 - DNA, 21 bp, Homo sapiens
atagtttcagatatatatcat

SEQ ID NO: 4958160 - DNA, 16 bp, Homo sapiens
atagtttgtctatttt

SEQ ID NO: 4958161 - DNA, 17 bp, Homo sapiens
atataaaaatatatata

SEQ ID NO: 4958162 - DNA, 17 bp, Homo sapiens
atataaaacaaataaaa

SEQ ID NO: 4958163 - DNA, 21 bp, Homo sapiens
atataaaaggcaaatgtgtac

SEQ ID NO: 4958164 - DNA, 14 bp, Homo sapiens
atataaaatagttg

SEQ ID NO: 4958165 - DNA, 21 bp, Homo sapiens
atataaaatagttgtccatat

SEQ ID NO: 4958166 - DNA, 13 bp, Homo sapiens
atataaagaatat

SEQ ID NO: 4958167 - DNA, 18 bp, Homo sapiens
atataaagaatatatata

SEQ ID NO: 4958168 - DNA, 21 bp, Homo sapiens
atataaagggggagggaaata

SEQ ID NO: 4958169 - DNA, 13 bp, Homo sapiens
atataaagtatag

SEQ ID NO: 4958170 - DNA, 12 bp, Homo sapiens
atataaattctg

SEQ ID NO: 4958171 - DNA, 23 bp, Homo sapiens
atataaccacaaagcacagtttg

SEQ ID NO: 4958172 - DNA, 21 bp, Homo sapiens
atataacttaaaaatgtaaat

SEQ ID NO: 4958173 - DNA, 12 bp, Homo sapiens
atataagatttt

SEQ ID NO: 4958174 - DNA, 22 bp, Homo sapiens
atataataaaatgtgttgaaac

SEQ ID NO: 4958175 - DNA, 20 bp, Homo sapiens
atataatatatatatatatc

SEQ ID NO: 4958176 - DNA, 18 bp, Homo sapiens
atataattcactcaagca

SEQ ID NO: 4958177 - DNA, 12 bp, Homo sapiens
atataattctgt

SEQ ID NO: 4958178 - DNA, 16 bp, Homo sapiens
atataattctgtaaat

SEQ ID NO: 4958179 - DNA, 13 bp, Homo sapiens
atatacagaggaa

SEQ ID NO: 4958180 - DNA, 13 bp, Homo sapiens
atatacagatgaa

SEQ ID NO: 4958181 - DNA, 16 bp, Homo sapiens
atatacagatgaaaat

SEQ ID NO: 4958182 - DNA, 16 bp, Homo sapiens
atatacagtaacttta

SEQ ID NO: 4958183 - DNA, 12 bp, Homo sapiens
atatacatacac

SEQ ID NO: 4958184 - DNA, 14 bp, Homo sapiens
atatacatatgtag

SEQ ID NO: 4958185 - DNA, 19 bp, Homo sapiens
atatacatgaaaattttaa

SEQ ID NO: 4958186 - DNA, 15 bp, Homo sapiens
atatacatgtgtgta

SEQ ID NO: 4958187 - DNA, 16 bp, Homo sapiens
atatacatgtgtgtat

SEQ ID NO: 4958188 - DNA, 17 bp, Homo sapiens
atatacatgtgtgtata

SEQ ID NO: 4958189 - DNA, 21 bp, Homo sapiens
atatacatgtgtgtatatatg

SEQ ID NO: 4958190 - DNA, 14 bp, Homo sapiens
atataccatttatc

SEQ ID NO: 4958191 - DNA, 17 bp, Homo sapiens
atatacctataatgtgt

SEQ ID NO: 4958192 - DNA, 20 bp, Homo sapiens
atatacctataatgtgtgta

SEQ ID NO: 4958193 - DNA, 16 bp, Homo sapiens
atatacgaacaaaaca

SEQ ID NO: 4958194 - DNA, 13 bp, Homo sapiens
atatactgtgtgc

SEQ ID NO: 4958195 - DNA, 22 bp, Homo sapiens
atatacttgtggttttcaaatt

SEQ ID NO: 4958196 - DNA, 14 bp, Homo sapiens
atatactttgtgga

SEQ ID NO: 4958197 - DNA, 20 bp, Homo sapiens
atatacttttttttctttaa

SEQ ID NO: 4958198 - DNA, 14 bp, Homo sapiens
atatagaaatatat

SEQ ID NO: 4958199 - DNA, 13 bp, Homo sapiens
atatagattagaa

SEQ ID NO: 4958200 - DNA, 16 bp, Homo sapiens
atatagattagaaaaa

SEQ ID NO: 4958201 - DNA, 17 bp, Homo sapiens
atatagattagaaaaat

SEQ ID NO: 4958202 - DNA, 21 bp, Homo sapiens
atataggtctcttctcccaga

SEQ ID NO: 4958203 - DNA, 16 bp, Homo sapiens
atatagttcctaagaa

SEQ ID NO: 4958204 - DNA, 21 bp, Homo sapiens
atatagttcctaagaagcttc

SEQ ID NO: 4958205 - DNA, 15 bp, Homo sapiens
atatataaagaatat

SEQ ID NO: 4958206 - DNA, 16 bp, Homo sapiens
atatataaagaatata

SEQ ID NO: 4958207 - DNA, 19 bp, Homo sapiens
atatataaagaatatatat

SEQ ID NO: 4958208 - DNA, 20 bp, Homo sapiens
atcagtgtgtctaaatttga

SEQ ID NO: 4958209 - DNA, 17 bp, Homo sapiens
atcagtgttttaaattc

SEQ ID NO: 4958210 - DNA, 14 bp, Homo sapiens
atcagttattcatt

SEQ ID NO: 4958211 - DNA, 17 bp, Homo sapiens
atcagttcctttgtgtg

SEQ ID NO: 4958212 - DNA, 14 bp, Homo sapiens
atcataaagttaga

SEQ ID NO: 4958213 - DNA, 16 bp, Homo sapiens
atcataaagttagaat

SEQ ID NO: 4958214 - DNA, 17 bp, Homo sapiens
atcataagtgaatttat

SEQ ID NO: 4958215 - DNA, 14 bp, Homo sapiens
atcatagttaacat

SEQ ID NO: 4958216 - DNA, 13 bp, Homo sapiens
atcatatgtgatc

SEQ ID NO: 4958217 - DNA, 17 bp, Homo sapiens
atcatattgatgaaaag

SEQ ID NO: 4958218 - DNA, 18 bp, Homo sapiens
atcatattgatgaaaaga

SEQ ID NO: 4958219 - DNA, 21 bp, Homo sapiens
atcatattggtattcactaat

SEQ ID NO: 4958220 - DNA, 20 bp, Homo sapiens
atcatcatgcagctcaactt

SEQ ID NO: 4958221 - DNA, 21 bp, Homo sapiens
atcatccactgtgccatgtgc

SEQ ID NO: 4958222 - DNA, 23 bp, Homo sapiens
atcatccactgtgccatgtgcca

SEQ ID NO: 4958223 - DNA, 17 bp, Homo sapiens
atcatcctgcagacaga

SEQ ID NO: 4958224 - DNA, 15 bp, Homo sapiens
atcatctattttgat

SEQ ID NO: 4958225 - DNA, 16 bp, Homo sapiens
atcatctattttgatg

SEQ ID NO: 4958226 - DNA, 23 bp, Homo sapiens
atcatctattttgatgcagcatt

SEQ ID NO: 4958227 - DNA, 13 bp, Homo sapiens
atcatctgtgtga

SEQ ID NO: 4958228 - DNA, 19 bp, Homo sapiens
atcatctgtgtgaaaatgg

SEQ ID NO: 4958229 - DNA, 11 bp, Homo sapiens
atcatgaagcc

SEQ ID NO: 4958230 - DNA, 13 bp, Homo sapiens
atcatgaagcctg

SEQ ID NO: 4958231 - DNA, 19 bp, Homo sapiens
atcatgaatctttgtttca

SEQ ID NO: 4958232 - DNA, 23 bp, Homo sapiens
atcatgcccggtcccacccctcc

SEQ ID NO: 4958233 - DNA, 22 bp, Homo sapiens
atcatggtagagaatctctccc

SEQ ID NO: 4958234 - DNA, 14 bp, Homo sapiens
atcatggtgtaata

SEQ ID NO: 4958235 - DNA, 16 bp, Homo sapiens
atcatggtgtaataag

SEQ ID NO: 4958236 - DNA, 20 bp, Homo sapiens
atcattacccttccctgcac

SEQ ID NO: 4958237 - DNA, 19 bp, Homo sapiens
atcattgcttcctcctccc

SEQ ID NO: 4958238 - DNA, 15 bp, Homo sapiens
atcatttattggatg

SEQ ID NO: 4958239 - DNA, 14 bp, Homo sapiens
atcatttgaggaat

SEQ ID NO: 4958240 - DNA, 13 bp, Homo sapiens
atcatttgctttt

SEQ ID NO: 4958241 - DNA, 20 bp, Homo sapiens
atccaaattgtgcttctccc

SEQ ID NO: 4958242 - DNA, 23 bp, Homo sapiens
atccaaattgtgcttctccccag

SEQ ID NO: 4958243 - DNA, 16 bp, Homo sapiens
atccaactccagcaac

SEQ ID NO: 4958244 - DNA, 14 bp, Homo sapiens
atccaactccagga

SEQ ID NO: 4958245 - DNA, 15 bp, Homo sapiens
atccaagcctccaca

SEQ ID NO: 4958246 - DNA, 18 bp, Homo sapiens
atccaagcctccacagcg

SEQ ID NO: 4958247 - DNA, 21 bp, Homo sapiens
atccaagcctccacagcgagg

SEQ ID NO: 4958248 - DNA, 15 bp, Homo sapiens
atccaagctccctgc

SEQ ID NO: 4958249 - DNA, 12 bp, Homo sapiens
atccaatgttag

SEQ ID NO: 4958250 - DNA, 14 bp, Homo sapiens
atccaccacctccc

SEQ ID NO: 4958251 - DNA, 20 bp, Homo sapiens
atccacccaaccctatctcc

SEQ ID NO: 4958252 - DNA, 13 bp, Homo sapiens
atccacctgtctc

SEQ ID NO: 4958253 - DNA, 18 bp, Homo sapiens
atccactctaccctccca

SEQ ID NO: 4958254 - DNA, 20 bp, Homo sapiens
atccactctaccctcccacc

SEQ ID NO: 4958255 - DNA, 21 bp, Homo sapiens
atccactctaccctcccaccc

SEQ ID NO: 4958256 - DNA, 23 bp, Homo sapiens
atccactctaccctcccaccccc

SEQ ID NO: 4958257 - DNA, 18 bp, Homo sapiens
atccagacatcatgaatt

SEQ ID NO: 4958258 - DNA, 22 bp, Homo sapiens
atccagacatcatgaattttac

SEQ ID NO: 4958259 - DNA, 15 bp, Homo sapiens
atccagacccggctg

SEQ ID NO: 4958260 - DNA, 15 bp, Homo sapiens
atccaggttcagctt

SEQ ID NO: 4958261 - DNA, 13 bp, Homo sapiens
atccataaaaaaa

SEQ ID NO: 4958262 - DNA, 18 bp, Homo sapiens
atccatattgagtcaaat

SEQ ID NO: 4958263 - DNA, 13 bp, Homo sapiens
atccatcaggcca

SEQ ID NO: 4958264 - DNA, 22 bp, Homo sapiens
atccatgacaggcctgaagata

SEQ ID NO: 4958265 - DNA, 24 bp, Homo sapiens
atccatgacaggcctgaagatatt

SEQ ID NO: 4958266 - DNA, 19 bp, Homo sapiens
atccatgagtttgccctgg

SEQ ID NO: 4958267 - DNA, 15 bp, Homo sapiens
atccatgcaccaaac

SEQ ID NO: 4958268 - DNA, 17 bp, Homo sapiens
atccattcccaagaaat

SEQ ID NO: 4958269 - DNA, 13 bp, Homo sapiens
atccatttgtaat

SEQ ID NO: 4958270 - DNA, 13 bp, Homo sapiens
atcccaaaagtca

SEQ ID NO: 4958271 - DNA, 15 bp, Homo sapiens
atcccaacagccatg

SEQ ID NO: 4958272 - DNA, 16 bp, Homo sapiens
atcccaaccagtgcca

SEQ ID NO: 4958273 - DNA, 20 bp, Homo sapiens
atcccaaccagtgccaagga

SEQ ID NO: 4958274 - DNA, 22 bp, Homo sapiens
atcccacatccaactccagcaa

SEQ ID NO: 4958275 - DNA, 14 bp, Homo sapiens
atcccacccacatg

SEQ ID NO: 4958276 - DNA, 20 bp, Homo sapiens
atcccacccacatgtgacac

SEQ ID NO: 4958277 - DNA, 22 bp, Homo sapiens
atcccagccggccaatggaaac

SEQ ID NO: 4958278 - DNA, 17 bp, Homo sapiens
atcccaggggcccaagg

SEQ ID NO: 4958279 - DNA, 19 bp, Homo sapiens
atcccatgagaccctggtg

SEQ ID NO: 4958280 - DNA, 13 bp, Homo sapiens
atcccatgagcct

SEQ ID NO: 4958281 - DNA, 18 bp, Homo sapiens
atcccatgagcctcagca

SEQ ID NO: 4958282 - DNA, 19 bp, Homo sapiens
atccccgttcctgacatca

SEQ ID NO: 4958283 - DNA, 19 bp, Homo sapiens
atcccctccctgtcaaagc

SEQ ID NO: 4958284 - DNA, 12 bp, Homo sapiens
atcccctgagcc

SEQ ID NO: 4958285 - DNA, 18 bp, Homo sapiens
atcccctggactgggagg

SEQ ID NO: 4958286 - DNA, 13 bp, Homo sapiens
atcccgagtctgg

SEQ ID NO: 4958287 - DNA, 16 bp, Homo sapiens
atcccgagtctgggac

SEQ ID NO: 4958288 - DNA, 16 bp, Homo sapiens
atcccggaggaaatct

SEQ ID NO: 4958289 - DNA, 17 bp, Homo sapiens
atcccggaggaaatctg

SEQ ID NO: 4958290 - DNA, 21 bp, Homo sapiens
atccctcacacatccagacat

SEQ ID NO: 4958291 - DNA, 16 bp, Homo sapiens
atccctccccagttca

SEQ ID NO: 4958292 - DNA, 14 bp, Homo sapiens
atccctgcctggtc

SEQ ID NO: 4958293 - DNA, 15 bp, Homo sapiens
atccctgtttaatat

SEQ ID NO: 4958294 - DNA, 16 bp, Homo sapiens
atccctgtttaatatt

SEQ ID NO: 4958295 - DNA, 17 bp, Homo sapiens
atcccttctcacagcac

SEQ ID NO: 4958296 - DNA, 13 bp, Homo sapiens
atccctttattac

SEQ ID NO: 4958297 - DNA, 14 bp, Homo sapiens
atccctttattacc

SEQ ID NO: 4958298 - DNA, 22 bp, Homo sapiens
atccctttattaccccctcctt

SEQ ID NO: 4958299 - DNA, 15 bp, Homo sapiens
atccgccttttgtat

SEQ ID NO: 4958300 - DNA, 12 bp, Homo sapiens
atccgctctctt

SEQ ID NO: 4958301 - DNA, 13 bp, Homo sapiens
atccgctctcttc

SEQ ID NO: 4958302 - DNA, 17 bp, Homo sapiens
atccgctctcttcctgc

SEQ ID NO: 4958303 - DNA, 14 bp, Homo sapiens
atcctaaaacaaat

SEQ ID NO: 4958304 - DNA, 16 bp, Homo sapiens
atcctaagaaatatgt

SEQ ID NO: 4958305 - DNA, 20 bp, Homo sapiens
atcctaagaaatatgtgaga

SEQ ID NO: 4958306 - DNA, 14 bp, Homo sapiens
atcctaagacacaa

SEQ ID NO: 4958307 - DNA, 19 bp, Homo sapiens
atcctaagggtcgaaagct

SEQ ID NO: 4958308 - DNA, 18 bp, Homo sapiens
atcctagtttcctctcct

SEQ ID NO: 4958309 - DNA, 13 bp, Homo sapiens
atcctatatagaa

SEQ ID NO: 4958310 - DNA, 15 bp, Homo sapiens
atcctcccacctcag

SEQ ID NO: 4958311 - DNA, 19 bp, Homo sapiens
atcctcccacctcagcctc

SEQ ID NO: 4958312 - DNA, 14 bp, Homo sapiens
atcctcctggaacc

SEQ ID NO: 4958313 - DNA, 23 bp, Homo sapiens
atcctcctggaaccttgctgtcc

SEQ ID NO: 4958314 - DNA, 14 bp, Homo sapiens
atcctctcctttga

SEQ ID NO: 4958315 - DNA, 16 bp, Homo sapiens
atcctgaaatttcaga

SEQ ID NO: 4958316 - DNA, 14 bp, Homo sapiens
atcctgactctgcc

SEQ ID NO: 4958317 - DNA, 17 bp, Homo sapiens
atcctgactctgccccc

SEQ ID NO: 4958318 - DNA, 23 bp, Homo sapiens
atcctgacttctaatatcattca

SEQ ID NO: 4958319 - DNA, 22 bp, Homo sapiens
atgagaacaaagctgttaaact

SEQ ID NO: 4958320 - DNA, 18 bp, Homo sapiens
atgagactctagggtcca

SEQ ID NO: 4958321 - DNA, 14 bp, Homo sapiens
atgagagcccagag

SEQ ID NO: 4958322 - DNA, 16 bp, Homo sapiens
atgagagcccagaggt

SEQ ID NO: 4958323 - DNA, 22 bp, Homo sapiens
atgagagcccagaggtaacaga

SEQ ID NO: 4958324 - DNA, 12 bp, Homo sapiens
atgagatgtgtg

SEQ ID NO: 4958325 - DNA, 16 bp, Homo sapiens
atgagcatcctgagcc

SEQ ID NO: 4958326 - DNA, 20 bp, Homo sapiens
atgagcatcctgagccccgc

SEQ ID NO: 4958327 - DNA, 16 bp, Homo sapiens
atgagcccagagaaca

SEQ ID NO: 4958328 - DNA, 12 bp, Homo sapiens
atgagcctcagc

SEQ ID NO: 4958329 - DNA, 15 bp, Homo sapiens
atgagcctcagcatc

SEQ ID NO: 4958330 - DNA, 17 bp, Homo sapiens
atgagcctcagcatcct

SEQ ID NO: 4958331 - DNA, 18 bp, Homo sapiens
atgagcctcagcatcctg

SEQ ID NO: 4958332 - DNA, 17 bp, Homo sapiens
atgagctattaaaactc

SEQ ID NO: 4958333 - DNA, 22 bp, Homo sapiens
atgaggaactgtagatgatgta

SEQ ID NO: 4958334 - DNA, 21 bp, Homo sapiens
atgaggaggatgtccctgggc

SEQ ID NO: 4958335 - DNA, 24 bp, Homo sapiens
atgaggaggatgtccctgggccag

SEQ ID NO: 4958336 - DNA, 20 bp, Homo sapiens
atgaggcaacctgattgtaa

SEQ ID NO: 4958337 - DNA, 21 bp, Homo sapiens
atgaggcaatgtcaggaacag

SEQ ID NO: 4958338 - DNA, 15 bp, Homo sapiens
atgaggtcccaggca

SEQ ID NO: 4958339 - DNA, 15 bp, Homo sapiens
atgaggtctgtttaa

SEQ ID NO: 4958340 - DNA, 21 bp, Homo sapiens
atgagtatacaatatataaaa

SEQ ID NO: 4958341 - DNA, 17 bp, Homo sapiens
atgagtctagatgttta

SEQ ID NO: 4958342 - DNA, 19 bp, Homo sapiens
atgagtctgttgtgtgtca

SEQ ID NO: 4958343 - DNA, 17 bp, Homo sapiens
atgagttatgagttatt

SEQ ID NO: 4958344 - DNA, 17 bp, Homo sapiens
atgataagtaaatgcta

SEQ ID NO: 4958345 - DNA, 15 bp, Homo sapiens
atgataatagattct

SEQ ID NO: 4958346 - DNA, 13 bp, Homo sapiens
atgatacaatgaa

SEQ ID NO: 4958347 - DNA, 22 bp, Homo sapiens
atgataccctgaatttggcctg

SEQ ID NO: 4958348 - DNA, 15 bp, Homo sapiens
atgatcacggctcac

SEQ ID NO: 4958349 - DNA, 19 bp, Homo sapiens
atgatcacggctcactgca

SEQ ID NO: 4958350 - DNA, 23 bp, Homo sapiens
atgatcttgagtataagaaatgc

SEQ ID NO: 4958351 - DNA, 19 bp, Homo sapiens
atgatctttgcagacaggc

SEQ ID NO: 4958352 - DNA, 21 bp, Homo sapiens
atgatctttgcagacaggcaa

SEQ ID NO: 4958353 - DNA, 12 bp, Homo sapiens
atgatgaaaatt

SEQ ID NO: 4958354 - DNA, 23 bp, Homo sapiens
atgatgaaatgaggtcagagcct

SEQ ID NO: 4958355 - DNA, 20 bp, Homo sapiens
atgatgatcaattatagttt

SEQ ID NO: 4958356 - DNA, 22 bp, Homo sapiens
atgatgcagtctcctctttaaa

SEQ ID NO: 4958357 - DNA, 19 bp, Homo sapiens
atgatgccctgctccaggg

SEQ ID NO: 4958358 - DNA, 19 bp, Homo sapiens
atgatggatgccaatatta

SEQ ID NO: 4958359 - DNA, 20 bp, Homo sapiens
atgatgtgaaacactttgcc

SEQ ID NO: 4958360 - DNA, 15 bp, Homo sapiens
atgatgtgttgtgat

SEQ ID NO: 4958361 - DNA, 18 bp, Homo sapiens
atgattaaataagattct

SEQ ID NO: 4958362 - DNA, 19 bp, Homo sapiens
atgattaaataagattcta

SEQ ID NO: 4958363 - DNA, 20 bp, Homo sapiens
atgattaaataagattctaa

SEQ ID NO: 4958364 - DNA, 15 bp, Homo sapiens
atgattattttcatt

SEQ ID NO: 4958365 - DNA, 18 bp, Homo sapiens
atgattattttcattaca

SEQ ID NO: 4958366 - DNA, 14 bp, Homo sapiens
atgattgtaaaata

SEQ ID NO: 4958367 - DNA, 20 bp, Homo sapiens
atgattgtttctcaaatctt

SEQ ID NO: 4958368 - DNA, 20 bp, Homo sapiens
atgatttcatgctatctctg

SEQ ID NO: 4958369 - DNA, 15 bp, Homo sapiens
atgatttccttgaat

SEQ ID NO: 4958370 - DNA, 18 bp, Homo sapiens
atgatttccttgaatgtg

SEQ ID NO: 4958371 - DNA, 15 bp, Homo sapiens
atgattttcataact

SEQ ID NO: 4958372 - DNA, 22 bp, Homo sapiens
atgattttcataacttattgct

SEQ ID NO: 4958373 - DNA, 15 bp, Homo sapiens
atgatttttgtcatc

SEQ ID NO: 4958374 - DNA, 17 bp, Homo sapiens
atgattttttaaaagaa

SEQ ID NO: 4958375 - DNA, 13 bp, Homo sapiens
atgcaaaatggaa

SEQ ID NO: 4958376 - DNA, 15 bp, Homo sapiens
atgcaaagaaaatca

SEQ ID NO: 4958377 - DNA, 18 bp, Homo sapiens
atgcaaagtacaatgtgt

SEQ ID NO: 4958378 - DNA, 20 bp, Homo sapiens
atgcaacacgcatggtcaac

SEQ ID NO: 4958379 - DNA, 20 bp, Homo sapiens
atgcaaggaaggaaagaaag

SEQ ID NO: 4958380 - DNA, 14 bp, Homo sapiens
atgcaaggaccagg

SEQ ID NO: 4958381 - DNA, 21 bp, Homo sapiens
atgcaaggcactgtactaggc

SEQ ID NO: 4958382 - DNA, 21 bp, Homo sapiens
atgcaattaggtttttcctta

SEQ ID NO: 4958383 - DNA, 17 bp, Homo sapiens
atgcaatttgattgact

SEQ ID NO: 4958384 - DNA, 10 bp, Homo sapiens
atgcacacac

SEQ ID NO: 4958385 - DNA, 12 bp, Homo sapiens
atgcacacacac

SEQ ID NO: 4958386 - DNA, 13 bp, Homo sapiens
atgcacagatata

SEQ ID NO: 4958387 - DNA, 16 bp, Homo sapiens
atgcacagatatactt

SEQ ID NO: 4958388 - DNA, 18 bp, Homo sapiens
atgcacagatatactttg

SEQ ID NO: 4958389 - DNA, 21 bp, Homo sapiens
atgcacatatggactctgcac

SEQ ID NO: 4958390 - DNA, 17 bp, Homo sapiens
atgcacatccattccca

SEQ ID NO: 4958391 - DNA, 15 bp, Homo sapiens
atgcacggcctcgcg

SEQ ID NO: 4958392 - DNA, 17 bp, Homo sapiens
atgcactgacccttcca

SEQ ID NO: 4958393 - DNA, 16 bp, Homo sapiens
atgcagagagccattt

SEQ ID NO: 4958394 - DNA, 19 bp, Homo sapiens
atgcagagagccattttgt

SEQ ID NO: 4958395 - DNA, 21 bp, Homo sapiens
atgcagagagccattttgtga

SEQ ID NO: 4958396 - DNA, 23 bp, Homo sapiens
atgcagagagccattttgtgaat

SEQ ID NO: 4958397 - DNA, 17 bp, Homo sapiens
atgcagatagaatcaat

SEQ ID NO: 4958398 - DNA, 19 bp, Homo sapiens
atgcagcaaggccctgctg

SEQ ID NO: 4958399 - DNA, 15 bp, Homo sapiens
atgcagcatttgata

SEQ ID NO: 4958400 - DNA, 21 bp, Homo sapiens
atgcagcccatgcccacctgc

SEQ ID NO: 4958401 - DNA, 22 bp, Homo sapiens
atgcagcccatgcccacctgcc

SEQ ID NO: 4958402 - DNA, 23 bp, Homo sapiens
atgcagctcaactttctgttgga

SEQ ID NO: 4958403 - DNA, 21 bp, Homo sapiens
atgcaggcacttattgtaaat

SEQ ID NO: 4958404 - DNA, 22 bp, Homo sapiens
atgcaggcacttattgtaaatt

SEQ ID NO: 4958405 - DNA, 12 bp, Homo sapiens
atgcaggccctt

SEQ ID NO: 4958406 - DNA, 16 bp, Homo sapiens
atgcagggggctcctg

SEQ ID NO: 4958407 - DNA, 16 bp, Homo sapiens
atgcagtaaattatct

SEQ ID NO: 4958408 - DNA, 15 bp, Homo sapiens
atgcagtctcctctt

SEQ ID NO: 4958409 - DNA, 21 bp, Homo sapiens
atgcagtgatatggcagaaga

SEQ ID NO: 4958410 - DNA, 22 bp, Homo sapiens
atgcatatgtcactagaatgga

SEQ ID NO: 4958411 - DNA, 12 bp, Homo sapiens
atgcatgaacaa

SEQ ID NO: 4958412 - DNA, 13 bp, Homo sapiens
atgcatgaacaag

SEQ ID NO: 4958413 - DNA, 23 bp, Homo sapiens
atgcatggaaacctgaaaaaaag

SEQ ID NO: 4958414 - DNA, 22 bp, Homo sapiens
atgcattataggatcatttgtt

SEQ ID NO: 4958415 - DNA, 14 bp, Homo sapiens
atgcatttgcattt

SEQ ID NO: 4958416 - DNA, 17 bp, Homo sapiens
atgccaatattaaatct

SEQ ID NO: 4958417 - DNA, 16 bp, Homo sapiens
atgccaattattgtta

SEQ ID NO: 4958418 - DNA, 12 bp, Homo sapiens
atgccaggacac

SEQ ID NO: 4958419 - DNA, 18 bp, Homo sapiens
atgccagggccgaccaga

SEQ ID NO: 4958420 - DNA, 13 bp, Homo sapiens
atgccatcctctt

SEQ ID NO: 4958421 - DNA, 15 bp, Homo sapiens
atgccatcctctttc

SEQ ID NO: 4958422 - DNA, 19 bp, Homo sapiens
atgcccacctgcccatcac

SEQ ID NO: 4958423 - DNA, 21 bp, Homo sapiens
atgcccacctgcccatcacag

SEQ ID NO: 4958424 - DNA, 15 bp, Homo sapiens
atgccccagagctgt

SEQ ID NO: 4958425 - DNA, 17 bp, Homo sapiens
atgccccggccacctct

SEQ ID NO: 4958426 - DNA, 20 bp, Homo sapiens
atgccccggccacctctgcg

SEQ ID NO: 4958427 - DNA, 17 bp, Homo sapiens
atgcccggctaattttt

SEQ ID NO: 4958428 - DNA, 16 bp, Homo sapiens
attaaagcctttagta

SEQ ID NO: 4958429 - DNA, 21 bp, Homo sapiens
attaaagtgctaaggttctaa

SEQ ID NO: 4958430 - DNA, 19 bp, Homo sapiens
attaaataaaatcaatttt

SEQ ID NO: 4958431 - DNA, 21 bp, Homo sapiens
attaaataaaatcaattttta

SEQ ID NO: 4958432 - DNA, 15 bp, Homo sapiens
attaaataagattct

SEQ ID NO: 4958433 - DNA, 16 bp, Homo sapiens
attaaataagattcta

SEQ ID NO: 4958434 - DNA, 17 bp, Homo sapiens
attaaatagttatataa

SEQ ID NO: 4958435 - DNA, 14 bp, Homo sapiens
attaaatatagatt

SEQ ID NO: 4958436 - DNA, 13 bp, Homo sapiens
attaaatgaatat

SEQ ID NO: 4958437 - DNA, 19 bp, Homo sapiens
attaaatgaatattttgat

SEQ ID NO: 4958438 - DNA, 13 bp, Homo sapiens
attaaatgtttga

SEQ ID NO: 4958439 - DNA, 13 bp, Homo sapiens
attaaattcacaa

SEQ ID NO: 4958440 - DNA, 14 bp, Homo sapiens
attaaattcacaaa

SEQ ID NO: 4958441 - DNA, 18 bp, Homo sapiens
attaaattttgagttcta

SEQ ID NO: 4958442 - DNA, 20 bp, Homo sapiens
attaaattttgagttctaca

SEQ ID NO: 4958443 - DNA, 19 bp, Homo sapiens
attaaattttttttacatt

SEQ ID NO: 4958444 - DNA, 15 bp, Homo sapiens
attaacaaatatgct

SEQ ID NO: 4958445 - DNA, 17 bp, Homo sapiens
attaacaaatatgctaa

SEQ ID NO: 4958446 - DNA, 13 bp, Homo sapiens
attaacacaaagg

SEQ ID NO: 4958447 - DNA, 17 bp, Homo sapiens
attaactacatttatga

SEQ ID NO: 4958448 - DNA, 21 bp, Homo sapiens
attaactacatttatgagtaa

SEQ ID NO: 4958449 - DNA, 15 bp, Homo sapiens
attaacttatttaga

SEQ ID NO: 4958450 - DNA, 15 bp, Homo sapiens
attaagaaggcaaaa

SEQ ID NO: 4958451 - DNA, 22 bp, Homo sapiens
attaagaaggcaaaaatgtaaa

SEQ ID NO: 4958452 - DNA, 21 bp, Homo sapiens
attaagaatatgtttccttgt

SEQ ID NO: 4958453 - DNA, 21 bp, Homo sapiens
attaagaatgttggtttactt

SEQ ID NO: 4958454 - DNA, 17 bp, Homo sapiens
attaagatacaaattaa

SEQ ID NO: 4958455 - DNA, 16 bp, Homo sapiens
attaaggtgatgtgat

SEQ ID NO: 4958456 - DNA, 17 bp, Homo sapiens
attaaggtgatgtgatt

SEQ ID NO: 4958457 - DNA, 20 bp, Homo sapiens
attaagttctcaatgtgaaa

SEQ ID NO: 4958458 - DNA, 19 bp, Homo sapiens
attaataaaaaatggaaag

SEQ ID NO: 4958459 - DNA, 16 bp, Homo sapiens
attaatactaaaatat

SEQ ID NO: 4958460 - DNA, 16 bp, Homo sapiens
attaatatatgtatta

SEQ ID NO: 4958461 - DNA, 21 bp, Homo sapiens
attaatatatgtattatttat

SEQ ID NO: 4958462 - DNA, 18 bp, Homo sapiens
attaatattaattttcta

SEQ ID NO: 4958463 - DNA, 15 bp, Homo sapiens
attaatcttggatag

SEQ ID NO: 4958464 - DNA, 21 bp, Homo sapiens
attaatcttggatagctaata

SEQ ID NO: 4958465 - DNA, 14 bp, Homo sapiens
attaatggcactga

SEQ ID NO: 4958466 - DNA, 16 bp, Homo sapiens
attaatgtacttgttt

SEQ ID NO: 4958467 - DNA, 12 bp, Homo sapiens
attaatgtgttg

SEQ ID NO: 4958468 - DNA, 16 bp, Homo sapiens
attaatgtttctatct

SEQ ID NO: 4958469 - DNA, 22 bp, Homo sapiens
attaatgtttctatctgatttt

SEQ ID NO: 4958470 - DNA, 13 bp, Homo sapiens
attaattaaacat

SEQ ID NO: 4958471 - DNA, 13 bp, Homo sapiens
attaattctataa

SEQ ID NO: 4958472 - DNA, 19 bp, Homo sapiens
attaattgttttgcacttt

SEQ ID NO: 4958473 - DNA, 20 bp, Homo sapiens
attaattgttttgcactttt

SEQ ID NO: 4958474 - DNA, 16 bp, Homo sapiens
attaatttgattaaca

SEQ ID NO: 4958475 - DNA, 18 bp, Homo sapiens
attaatttgattaacaaa

SEQ ID NO: 4958476 - DNA, 20 bp, Homo sapiens
attaatttgattaacaaata

SEQ ID NO: 4958477 - DNA, 22 bp, Homo sapiens
attaatttgattaacaaatatg

SEQ ID NO: 4958478 - DNA, 12 bp, Homo sapiens
attacaatggaa

SEQ ID NO: 4958479 - DNA, 15 bp, Homo sapiens
attacacatttgtac

SEQ ID NO: 4958480 - DNA, 15 bp, Homo sapiens
attacagaggaagtt

SEQ ID NO: 4958481 - DNA, 15 bp, Homo sapiens
attacagctggagaa

SEQ ID NO: 4958482 - DNA, 18 bp, Homo sapiens
attaccccctccttcaga

SEQ ID NO: 4958483 - DNA, 20 bp, Homo sapiens
attactaattttacacatta

SEQ ID NO: 4958484 - DNA, 14 bp, Homo sapiens
attactcctatttt

SEQ ID NO: 4958485 - DNA, 15 bp, Homo sapiens
attactgggccttag

SEQ ID NO: 4958486 - DNA, 18 bp, Homo sapiens
attactgtttatttctgt

SEQ ID NO: 4958487 - DNA, 15 bp, Homo sapiens
attacttatttttga

SEQ ID NO: 4958488 - DNA, 19 bp, Homo sapiens
attacttgattaagatttt

SEQ ID NO: 4958489 - DNA, 16 bp, Homo sapiens
attactttatcacttt

SEQ ID NO: 4958490 - DNA, 23 bp, Homo sapiens
attactttatcactttttgaact

SEQ ID NO: 4958491 - DNA, 17 bp, Homo sapiens
attagaaattggctgga

SEQ ID NO: 4958492 - DNA, 21 bp, Homo sapiens
attagaattagtgccagaatt

SEQ ID NO: 4958493 - DNA, 13 bp, Homo sapiens
attagaattattt

SEQ ID NO: 4958494 - DNA, 14 bp, Homo sapiens
attagaattattta

SEQ ID NO: 4958495 - DNA, 15 bp, Homo sapiens
attagactcctcctc

SEQ ID NO: 4958496 - DNA, 14 bp, Homo sapiens
attagagcattgaa

SEQ ID NO: 4958497 - DNA, 21 bp, Homo sapiens
attagagggaggagaatgagc

SEQ ID NO: 4958498 - DNA, 18 bp, Homo sapiens
attagattttattttact

SEQ ID NO: 4958499 - DNA, 22 bp, Homo sapiens
attagattttattttactattg

SEQ ID NO: 4958500 - DNA, 15 bp, Homo sapiens
attagcacagatttt

SEQ ID NO: 4958501 - DNA, 16 bp, Homo sapiens
attagcacagatttta

SEQ ID NO: 4958502 - DNA, 15 bp, Homo sapiens
attagccaggatcat

SEQ ID NO: 4958503 - DNA, 22 bp, Homo sapiens
attagccaggatcatggtgtaa

SEQ ID NO: 4958504 - DNA, 15 bp, Homo sapiens
attagtaaatgtctt

SEQ ID NO: 4958505 - DNA, 20 bp, Homo sapiens
attagtaaatgtctttgtaa

SEQ ID NO: 4958506 - DNA, 19 bp, Homo sapiens
attagtgccagaattttag

SEQ ID NO: 4958507 - DNA, 22 bp, Homo sapiens
attagtgccagaattttaggaa

SEQ ID NO: 4958508 - DNA, 17 bp, Homo sapiens
attataagcattgaaat

SEQ ID NO: 4958509 - DNA, 13 bp, Homo sapiens
attatagattcta

SEQ ID NO: 4958510 - DNA, 17 bp, Homo sapiens
attataggagccttaat

SEQ ID NO: 4958511 - DNA, 17 bp, Homo sapiens
attataggatcatttgt

SEQ ID NO: 4958512 - DNA, 19 bp, Homo sapiens
attatagtttctgaggctt

SEQ ID NO: 4958513 - DNA, 13 bp, Homo sapiens
attatataggttg

SEQ ID NO: 4958514 - DNA, 23 bp, Homo sapiens
attatataggttgtgcaaattaa

SEQ ID NO: 4958515 - DNA, 23 bp, Homo sapiens
attatatcattggaacaactgat

SEQ ID NO: 4958516 - DNA, 19 bp, Homo sapiens
attatcaatatctaatata

SEQ ID NO: 4958517 - DNA, 23 bp, Homo sapiens
attatgatgaaaacctacatatt

SEQ ID NO: 4958518 - DNA, 22 bp, Homo sapiens
attatgcaattagcctcatagt

SEQ ID NO: 4958519 - DNA, 23 bp, Homo sapiens
attatgggttaggcattaatgtt

SEQ ID NO: 4958520 - DNA, 19 bp, Homo sapiens
attatgtccactgtgtata

SEQ ID NO: 4958521 - DNA, 17 bp, Homo sapiens
attatgtggttttagat

SEQ ID NO: 4958522 - DNA, 11 bp, Homo sapiens
attatgtgtgc

SEQ ID NO: 4958523 - DNA, 19 bp, Homo sapiens
attatgtgtgcatgtgtgt

SEQ ID NO: 4958524 - DNA, 20 bp, Homo sapiens
attattacttatttttgaca

SEQ ID NO: 4958525 - DNA, 12 bp, Homo sapiens
attattagaaat

SEQ ID NO: 4958526 - DNA, 15 bp, Homo sapiens
attattagtactgct

SEQ ID NO: 4958527 - DNA, 15 bp, Homo sapiens
attattataaaaggg

SEQ ID NO: 4958528 - DNA, 14 bp, Homo sapiens
attattatctttaa

SEQ ID NO: 4958529 - DNA, 12 bp, Homo sapiens
attattctcttt

SEQ ID NO: 4958530 - DNA, 21 bp, Homo sapiens
attattctcttttatctgttt

SEQ ID NO: 4958531 - DNA, 15 bp, Homo sapiens
attattgatagtact

SEQ ID NO: 4958532 - DNA, 13 bp, Homo sapiens
attattgatatat

SEQ ID NO: 4958533 - DNA, 21 bp, Homo sapiens
attatttaataaaaaaacaat

SEQ ID NO: 4958534 - DNA, 23 bp, Homo sapiens
attatttattcagcttcatttgt

SEQ ID NO: 4958535 - DNA, 14 bp, Homo sapiens
attatttatttaat

SEQ ID NO: 4958536 - DNA, 15 bp, Homo sapiens
attatttatttattt

SEQ ID NO: 4958537 - DNA, 18 bp, Homo sapiens
attatttggcagtttggt

SEQ ID NO: 4958538 - DNA, 16 bp, Homo sapiens
atttcatatgctgtat

SEQ ID NO: 4958539 - DNA, 14 bp, Homo sapiens
atttcatcattgtt

SEQ ID NO: 4958540 - DNA, 17 bp, Homo sapiens
atttcatcattgtttct

SEQ ID NO: 4958541 - DNA, 18 bp, Homo sapiens
atttcatcattgtttctg

SEQ ID NO: 4958542 - DNA, 17 bp, Homo sapiens
atttcatgctctgcaaa

SEQ ID NO: 4958543 - DNA, 16 bp, Homo sapiens
atttcatgtggctgta

SEQ ID NO: 4958544 - DNA, 12 bp, Homo sapiens
atttcattccat

SEQ ID NO: 4958545 - DNA, 14 bp, Homo sapiens
atttcattgcctgt

SEQ ID NO: 4958546 - DNA, 15 bp, Homo sapiens
atttcattgtatgat

SEQ ID NO: 4958547 - DNA, 17 bp, Homo sapiens
atttcattgtatgatgt

SEQ ID NO: 4958548 - DNA, 13 bp, Homo sapiens
atttccaaataaa

SEQ ID NO: 4958549 - DNA, 17 bp, Homo sapiens
atttccaaataaaatga

SEQ ID NO: 4958550 - DNA, 18 bp, Homo sapiens
atttccaaataaaatgag

SEQ ID NO: 4958551 - DNA, 21 bp, Homo sapiens
atttccaacaccacagacaca

SEQ ID NO: 4958552 - DNA, 21 bp, Homo sapiens
atttcccatttgtgccagagg

SEQ ID NO: 4958553 - DNA, 18 bp, Homo sapiens
atttcctatcacctattt

SEQ ID NO: 4958554 - DNA, 13 bp, Homo sapiens
atttcctcctggc

SEQ ID NO: 4958555 - DNA, 21 bp, Homo sapiens
atttctaaaaaacagaggcca

SEQ ID NO: 4958556 - DNA, 14 bp, Homo sapiens
atttctaaaatctt

SEQ ID NO: 4958557 - DNA, 23 bp, Homo sapiens
atttctgcatatgttgaatactt

SEQ ID NO: 4958558 - DNA, 18 bp, Homo sapiens
atttctgggtcttttgct

SEQ ID NO: 4958559 - DNA, 16 bp, Homo sapiens
atttctggttctgatg

SEQ ID NO: 4958560 - DNA, 16 bp, Homo sapiens
atttctgtaaatacca

SEQ ID NO: 4958561 - DNA, 13 bp, Homo sapiens
atttctgtcagaa

SEQ ID NO: 4958562 - DNA, 21 bp, Homo sapiens
atttctgtcattcaaatgggt

SEQ ID NO: 4958563 - DNA, 14 bp, Homo sapiens
atttctgtttctca

SEQ ID NO: 4958564 - DNA, 19 bp, Homo sapiens
atttcttcaaaatgtatat

SEQ ID NO: 4958565 - DNA, 22 bp, Homo sapiens
atttcttcaaaatgtatatatt

SEQ ID NO: 4958566 - DNA, 23 bp, Homo sapiens
atttcttcagtcagaaaacttta

SEQ ID NO: 4958567 - DNA, 22 bp, Homo sapiens
atttctttatatttatccacta

SEQ ID NO: 4958568 - DNA, 23 bp, Homo sapiens
atttctttgttatcaaacttcag

SEQ ID NO: 4958569 - DNA, 13 bp, Homo sapiens
atttgaacactgg

SEQ ID NO: 4958570 - DNA, 17 bp, Homo sapiens
atttgaagtgtacctgt

SEQ ID NO: 4958571 - DNA, 22 bp, Homo sapiens
atttgaagtgtacctgtgtaca

SEQ ID NO: 4958572 - DNA, 13 bp, Homo sapiens
atttgaatgttaa

SEQ ID NO: 4958573 - DNA, 19 bp, Homo sapiens
atttgaatgttaagcagat

SEQ ID NO: 4958574 - DNA, 15 bp, Homo sapiens
atttgaattaaaact

SEQ ID NO: 4958575 - DNA, 20 bp, Homo sapiens
atttgaattttaaatctaaa

SEQ ID NO: 4958576 - DNA, 17 bp, Homo sapiens
atttgactattctgtat

SEQ ID NO: 4958577 - DNA, 19 bp, Homo sapiens
atttgacttgcatgaagag

SEQ ID NO: 4958578 - DNA, 14 bp, Homo sapiens
atttgagactattt

SEQ ID NO: 4958579 - DNA, 17 bp, Homo sapiens
atttgagcagggctcag

SEQ ID NO: 4958580 - DNA, 19 bp, Homo sapiens
atttgatacataataaaaa

SEQ ID NO: 4958581 - DNA, 13 bp, Homo sapiens
atttgatacttat

SEQ ID NO: 4958582 - DNA, 14 bp, Homo sapiens
atttgatacttata

SEQ ID NO: 4958583 - DNA, 22 bp, Homo sapiens
atttgatacttatattttcgta

SEQ ID NO: 4958584 - DNA, 16 bp, Homo sapiens
atttgatgctgtttga

SEQ ID NO: 4958585 - DNA, 16 bp, Homo sapiens
atttgattaacaaata

SEQ ID NO: 4958586 - DNA, 17 bp, Homo sapiens
atttgattaacaaatat

SEQ ID NO: 4958587 - DNA, 18 bp, Homo sapiens
atttgatttttgtctcaa

SEQ ID NO: 4958588 - DNA, 14 bp, Homo sapiens
atttgcaacattta

SEQ ID NO: 4958589 - DNA, 21 bp, Homo sapiens
atttgcatggctccagaaatg

SEQ ID NO: 4958590 - DNA, 16 bp, Homo sapiens
atttgcattgaacaca

SEQ ID NO: 4958591 - DNA, 13 bp, Homo sapiens
atttgccttgcag

SEQ ID NO: 4958592 - DNA, 14 bp, Homo sapiens
atttgccttgcaga

SEQ ID NO: 4958593 - DNA, 18 bp, Homo sapiens
atttgccttgcagaactg

SEQ ID NO: 4958594 - DNA, 18 bp, Homo sapiens
atttgctaatcaaagcca

SEQ ID NO: 4958595 - DNA, 14 bp, Homo sapiens
atttggaaatccta

SEQ ID NO: 4958596 - DNA, 13 bp, Homo sapiens
atttggaatactt

SEQ ID NO: 4958597 - DNA, 14 bp, Homo sapiens
atttggaatacttt

SEQ ID NO: 4958598 - DNA, 15 bp, Homo sapiens
atttggcagtttggt

SEQ ID NO: 4958599 - DNA, 15 bp, Homo sapiens
atttggcttaaatat

SEQ ID NO: 4958600 - DNA, 17 bp, Homo sapiens
atttggcttaaatatag

SEQ ID NO: 4958601 - DNA, 21 bp, Homo sapiens
atttgggagggaaaagggaag

SEQ ID NO: 4958602 - DNA, 23 bp, Homo sapiens
atttggggaaacctagagaagat

SEQ ID NO: 4958603 - DNA, 12 bp, Homo sapiens
atttggtacttt

SEQ ID NO: 4958604 - DNA, 14 bp, Homo sapiens
atttggtctctatt

SEQ ID NO: 4958605 - DNA, 21 bp, Homo sapiens
atttgtaagtttcaggtgaca

SEQ ID NO: 4958606 - DNA, 23 bp, Homo sapiens
atttgtactgaaaaatggtaatt

SEQ ID NO: 4958607 - DNA, 19 bp, Homo sapiens
atttgtagtggaaacattt

SEQ ID NO: 4958608 - DNA, 20 bp, Homo sapiens
atttgtatctctgaagcatg

SEQ ID NO: 4958609 - DNA, 17 bp, Homo sapiens
atttgtattttgtgtga

SEQ ID NO: 4958610 - DNA, 23 bp, Homo sapiens
atttgtattttgtgtgaccaact

SEQ ID NO: 4958611 - DNA, 15 bp, Homo sapiens
atttgtctttcagga

SEQ ID NO: 4958612 - DNA, 14 bp, Homo sapiens
atttgtgccagagg

SEQ ID NO: 4958613 - DNA, 21 bp, Homo sapiens
atttgtgtcacaaagaattta

SEQ ID NO: 4958614 - DNA, 14 bp, Homo sapiens
atttgttacagcca

SEQ ID NO: 4958615 - DNA, 17 bp, Homo sapiens
atttgttattttcagta

SEQ ID NO: 4958616 - DNA, 13 bp, Homo sapiens
atttgttggaatg

SEQ ID NO: 4958617 - DNA, 14 bp, Homo sapiens
attttaaaaaatga

SEQ ID NO: 4958618 - DNA, 15 bp, Homo sapiens
attttaaaaatacat

SEQ ID NO: 4958619 - DNA, 18 bp, Homo sapiens
attttaaaaatacatatc

SEQ ID NO: 4958620 - DNA, 17 bp, Homo sapiens
attttaaacaaaataga

SEQ ID NO: 4958621 - DNA, 22 bp, Homo sapiens
attttaaacaaaggttgagatg

SEQ ID NO: 4958622 - DNA, 15 bp, Homo sapiens
attttaaataaaaga

SEQ ID NO: 4958623 - DNA, 16 bp, Homo sapiens
attttaaataaaagaa

SEQ ID NO: 4958624 - DNA, 21 bp, Homo sapiens
attttaaatctaaatctattt

SEQ ID NO: 4958625 - DNA, 14 bp, Homo sapiens
attttaagcactct

SEQ ID NO: 4958626 - DNA, 21 bp, Homo sapiens
attttaagcactcttaaagca

SEQ ID NO: 4958627 - DNA, 22 bp, Homo sapiens
attttaagcactcttaaagcaa

SEQ ID NO: 4958628 - DNA, 22 bp, Homo sapiens
attttaatgcagttgcttacta

SEQ ID NO: 4958629 - DNA, 19 bp, Homo sapiens
attttaatggattgttaat

SEQ ID NO: 4958630 - DNA, 20 bp, Homo sapiens
attttaatggattgttaatt

SEQ ID NO: 4958631 - DNA, 22 bp, Homo sapiens
attttaatgtaaagatttgctt

SEQ ID NO: 4958632 - DNA, 16 bp, Homo sapiens
attttaatgtgatgat

SEQ ID NO: 4958633 - DNA, 22 bp, Homo sapiens
attttaatgtgatgatgtaatt

SEQ ID NO: 4958634 - DNA, 24 bp, Homo sapiens
attttaatgtgatgatgtaattga

SEQ ID NO: 4958635 - DNA, 14 bp, Homo sapiens
attttaattgtcat

SEQ ID NO: 4958636 - DNA, 22 bp, Homo sapiens
attttacaaaagaggagcactt

SEQ ID NO: 4958637 - DNA, 15 bp, Homo sapiens
attttacacagaaac

SEQ ID NO: 4958638 - DNA, 18 bp, Homo sapiens
attttacacagaaacact

SEQ ID NO: 4958639 - DNA, 20 bp, Homo sapiens
attttacacagaaacactgc

SEQ ID NO: 4958640 - DNA, 23 bp, Homo sapiens
attttacacagaaacactgcctt

SEQ ID NO: 4958641 - DNA, 13 bp, Homo sapiens
attttacacatta

SEQ ID NO: 4958642 - DNA, 21 bp, Homo sapiens
attttactttaaaaggagcca

SEQ ID NO: 4958643 - DNA, 23 bp, Homo sapiens
attttagctctattgatactctt

SEQ ID NO: 4958644 - DNA, 20 bp, Homo sapiens
attttaggagctaaggctct

SEQ ID NO: 4958645 - DNA, 20 bp, Homo sapiens
attttagtattcattctgca

SEQ ID NO: 4958646 - DNA, 19 bp, Homo sapiens
attttataagcaaatttca

SEQ ID NO: 4958647 - DNA, 21 bp, Homo sapiens
caaatctggctcctttacaaa

SEQ ID NO: 4958648 - DNA, 12 bp, Homo sapiens
caaatcttgaaa

SEQ ID NO: 4958649 - DNA, 21 bp, Homo sapiens
caaatcttggcaatattcctt

SEQ ID NO: 4958650 - DNA, 10 bp, Homo sapiens
caaatgacat

SEQ ID NO: 4958651 - DNA, 15 bp, Homo sapiens
caaatgacatgcact

SEQ ID NO: 4958652 - DNA, 19 bp, Homo sapiens
caaatgacatgcactgacc

SEQ ID NO: 4958653 - DNA, 21 bp, Homo sapiens
caaatgacatgcactgaccct

SEQ ID NO: 4958654 - DNA, 17 bp, Homo sapiens
caaatgccttaaaatgg

SEQ ID NO: 4958655 - DNA, 22 bp, Homo sapiens
caaatggaaagtaactcatttg

SEQ ID NO: 4958656 - DNA, 21 bp, Homo sapiens
caaatggcgtctggaagtcca

SEQ ID NO: 4958657 - DNA, 18 bp, Homo sapiens
caaatgggttttccacgc

SEQ ID NO: 4958658 - DNA, 18 bp, Homo sapiens
caaatgtcctccagaagc

SEQ ID NO: 4958659 - DNA, 19 bp, Homo sapiens
caaatgtcctccagaagcc

SEQ ID NO: 4958660 - DNA, 23 bp, Homo sapiens
caaatgtgtacatggcagagttt

SEQ ID NO: 4958661 - DNA, 14 bp, Homo sapiens
caaatgttctaagt

SEQ ID NO: 4958662 - DNA, 21 bp, Homo sapiens
caaatgttctaagtttctaag

SEQ ID NO: 4958663 - DNA, 14 bp, Homo sapiens
caaattagggcaat

SEQ ID NO: 4958664 - DNA, 21 bp, Homo sapiens
caaattagggcaattggaaca

SEQ ID NO: 4958665 - DNA, 14 bp, Homo sapiens
caaattatttgtgt

SEQ ID NO: 4958666 - DNA, 15 bp, Homo sapiens
caaattctcaccaaa

SEQ ID NO: 4958667 - DNA, 22 bp, Homo sapiens
caaattgtgcttctccccagaa

SEQ ID NO: 4958668 - DNA, 23 bp, Homo sapiens
caaattgtgcttctccccagaat

SEQ ID NO: 4958669 - DNA, 13 bp, Homo sapiens
caaatttatcaaa

SEQ ID NO: 4958670 - DNA, 19 bp, Homo sapiens
caaatttatcaaagcatag

SEQ ID NO: 4958671 - DNA, 14 bp, Homo sapiens
caaatttgattgat

SEQ ID NO: 4958672 - DNA, 23 bp, Homo sapiens
caaatttttattttttagtgcat

SEQ ID NO: 4958673 - DNA, 14 bp, Homo sapiens
caacaaagaaatat

SEQ ID NO: 4958674 - DNA, 13 bp, Homo sapiens
caacaacatccat

SEQ ID NO: 4958675 - DNA, 14 bp, Homo sapiens
caacaagagtttat

SEQ ID NO: 4958676 - DNA, 13 bp, Homo sapiens
caacaagatttcc

SEQ ID NO: 4958677 - DNA, 13 bp, Homo sapiens
caacaataacact

SEQ ID NO: 4958678 - DNA, 13 bp, Homo sapiens
caacacagcctgg

SEQ ID NO: 4958679 - DNA, 15 bp, Homo sapiens
caacacagcctgggc

SEQ ID NO: 4958680 - DNA, 22 bp, Homo sapiens
caacacagcctgggccccagct

SEQ ID NO: 4958681 - DNA, 13 bp, Homo sapiens
caacaccacagac

SEQ ID NO: 4958682 - DNA, 17 bp, Homo sapiens
caacaccacagacacac

SEQ ID NO: 4958683 - DNA, 20 bp, Homo sapiens
caacacgcatggtcaaccct

SEQ ID NO: 4958684 - DNA, 13 bp, Homo sapiens
caacactggtgtg

SEQ ID NO: 4958685 - DNA, 18 bp, Homo sapiens
caacactggtgtgacctg

SEQ ID NO: 4958686 - DNA, 12 bp, Homo sapiens
caacagaagcag

SEQ ID NO: 4958687 - DNA, 17 bp, Homo sapiens
caacagaagcatttgta

SEQ ID NO: 4958688 - DNA, 23 bp, Homo sapiens
caacagaagcatttgtattttgt

SEQ ID NO: 4958689 - DNA, 22 bp, Homo sapiens
caacagaagtcatgaagcccaa

SEQ ID NO: 4958690 - DNA, 19 bp, Homo sapiens
caacaggaatcaagagctg

SEQ ID NO: 4958691 - DNA, 21 bp, Homo sapiens
caacaggaatcaagagctgcc

SEQ ID NO: 4958692 - DNA, 23 bp, Homo sapiens
caacaggaatcaagagctgccct

SEQ ID NO: 4958693 - DNA, 21 bp, Homo sapiens
caacaggctgttctgcactga

SEQ ID NO: 4958694 - DNA, 16 bp, Homo sapiens
caacataacccacttg

SEQ ID NO: 4958695 - DNA, 15 bp, Homo sapiens
caacatcctgccagc

SEQ ID NO: 4958696 - DNA, 16 bp, Homo sapiens
caacatcctgccagcc

SEQ ID NO: 4958697 - DNA, 17 bp, Homo sapiens
caacattgcttgtgcca

SEQ ID NO: 4958698 - DNA, 22 bp, Homo sapiens
caacattttagctctattgata

SEQ ID NO: 4958699 - DNA, 18 bp, Homo sapiens
caaccaagtcatgtgcat

SEQ ID NO: 4958700 - DNA, 20 bp, Homo sapiens
caaccaagtcatgtgcattt

SEQ ID NO: 4958701 - DNA, 12 bp, Homo sapiens
caaccagtgcca

SEQ ID NO: 4958702 - DNA, 13 bp, Homo sapiens
caaccatggactt

SEQ ID NO: 4958703 - DNA, 14 bp, Homo sapiens
caaccatggacttt

SEQ ID NO: 4958704 - DNA, 15 bp, Homo sapiens
caaccatggacttta

SEQ ID NO: 4958705 - DNA, 17 bp, Homo sapiens
caaccatggactttata

SEQ ID NO: 4958706 - DNA, 13 bp, Homo sapiens
caaccattccaga

SEQ ID NO: 4958707 - DNA, 16 bp, Homo sapiens
caaccattccagactg

SEQ ID NO: 4958708 - DNA, 14 bp, Homo sapiens
caacccccacccca

SEQ ID NO: 4958709 - DNA, 18 bp, Homo sapiens
caacccccaccccacact

SEQ ID NO: 4958710 - DNA, 15 bp, Homo sapiens
caacccccagcctgc

SEQ ID NO: 4958711 - DNA, 17 bp, Homo sapiens
caacccccagcctgcta

SEQ ID NO: 4958712 - DNA, 14 bp, Homo sapiens
caaccccttcgctc

SEQ ID NO: 4958713 - DNA, 16 bp, Homo sapiens
caaccccttcgctcct

SEQ ID NO: 4958714 - DNA, 19 bp, Homo sapiens
caaccccttcgctcctgtg

SEQ ID NO: 4958715 - DNA, 20 bp, Homo sapiens
caaccctatctcctgacaga

SEQ ID NO: 4958716 - DNA, 22 bp, Homo sapiens
caaccctatctcctgacagaag

SEQ ID NO: 4958717 - DNA, 18 bp, Homo sapiens
caaccctcagagccaccc

SEQ ID NO: 4958718 - DNA, 21 bp, Homo sapiens
caaccctcagagccaccccta

SEQ ID NO: 4958719 - DNA, 19 bp, Homo sapiens
caaccctggcattatgtcc

SEQ ID NO: 4958720 - DNA, 19 bp, Homo sapiens
caacccttaccccttagcc

SEQ ID NO: 4958721 - DNA, 21 bp, Homo sapiens
caaccgcttccctatttattt

SEQ ID NO: 4958722 - DNA, 14 bp, Homo sapiens
caacctcattgaca

SEQ ID NO: 4958723 - DNA, 15 bp, Homo sapiens
caacctccctcttgt

SEQ ID NO: 4958724 - DNA, 18 bp, Homo sapiens
caacctccctcttgtttt

SEQ ID NO: 4958725 - DNA, 17 bp, Homo sapiens
caacctcttctggctca

SEQ ID NO: 4958726 - DNA, 16 bp, Homo sapiens
caacctggtcacagga

SEQ ID NO: 4958727 - DNA, 21 bp, Homo sapiens
caacctttcacctttgtgtat

SEQ ID NO: 4958728 - DNA, 12 bp, Homo sapiens
caacgaccaggg

SEQ ID NO: 4958729 - DNA, 12 bp, Homo sapiens
caacgcagccct

SEQ ID NO: 4958730 - DNA, 14 bp, Homo sapiens
caacgccgtgggct

SEQ ID NO: 4958731 - DNA, 18 bp, Homo sapiens
caacggccctgcagccag

SEQ ID NO: 4958732 - DNA, 19 bp, Homo sapiens
caacggccctgcagccagc

SEQ ID NO: 4958733 - DNA, 20 bp, Homo sapiens
caacggccctgcagccagct

SEQ ID NO: 4958734 - DNA, 23 bp, Homo sapiens
caacgtggctttttttttttccc

SEQ ID NO: 4958735 - DNA, 15 bp, Homo sapiens
caacgttactcaggg

SEQ ID NO: 4958736 - DNA, 18 bp, Homo sapiens
caacgttactcagggctc

SEQ ID NO: 4958737 - DNA, 23 bp, Homo sapiens
caacgtttacaccgactagccag

SEQ ID NO: 4958738 - DNA, 16 bp, Homo sapiens
caactatggatcagaa

SEQ ID NO: 4958739 - DNA, 15 bp, Homo sapiens
caactatttttccaa

SEQ ID NO: 4958740 - DNA, 13 bp, Homo sapiens
caactgacacagg

SEQ ID NO: 4958741 - DNA, 14 bp, Homo sapiens
caactgacacagga

SEQ ID NO: 4958742 - DNA, 16 bp, Homo sapiens
caactgacacaggaaa

SEQ ID NO: 4958743 - DNA, 19 bp, Homo sapiens
caactgaccagcctccatg

SEQ ID NO: 4958744 - DNA, 13 bp, Homo sapiens
caactgcctgcct

SEQ ID NO: 4958745 - DNA, 12 bp, Homo sapiens
caactgtatata

SEQ ID NO: 4958746 - DNA, 18 bp, Homo sapiens
caactgtcttatttaatg

SEQ ID NO: 4958747 - DNA, 14 bp, Homo sapiens
caactgtgttgtat

SEQ ID NO: 4958748 - DNA, 15 bp, Homo sapiens
caactgtgttgtatt

SEQ ID NO: 4958749 - DNA, 16 bp, Homo sapiens
caactgtgttgtatta

SEQ ID NO: 4958750 - DNA, 19 bp, Homo sapiens
caactgtgttgtattaaca

SEQ ID NO: 4958751 - DNA, 21 bp, Homo sapiens
caactgtgttgtattaacaaa

SEQ ID NO: 4958752 - DNA, 19 bp, Homo sapiens
caactgttgtaactaggct

SEQ ID NO: 4958753 - DNA, 16 bp, Homo sapiens
caacttaacatgggct

SEQ ID NO: 4958754 - DNA, 23 bp, Homo sapiens
caacttcccagttcaggagtccc

SEQ ID NO: 4958755 - DNA, 23 bp, Homo sapiens
caacttgaaattatatctgtggt

SEQ ID NO: 4958756 - DNA, 24 bp, Homo sapiens
caacttgaaattatatctgtggtc

SEQ ID NO: 4958757 - DNA, 19 bp, Homo sapiens
cacaaaggccaaactgctg

SEQ ID NO: 4958758 - DNA, 21 bp, Homo sapiens
cacaaaggccaaactgctgga

SEQ ID NO: 4958759 - DNA, 22 bp, Homo sapiens
cacaaaggggatcataaagtta

SEQ ID NO: 4958760 - DNA, 18 bp, Homo sapiens
cacaaccttctgtggctc

SEQ ID NO: 4958761 - DNA, 23 bp, Homo sapiens
cacaaccttctgtggctcacaga

SEQ ID NO: 4958762 - DNA, 14 bp, Homo sapiens
cacaactatttttc

SEQ ID NO: 4958763 - DNA, 19 bp, Homo sapiens
cacaactatttttccaaaa

SEQ ID NO: 4958764 - DNA, 16 bp, Homo sapiens
cacaactgacacagga

SEQ ID NO: 4958765 - DNA, 18 bp, Homo sapiens
cacaactgacacaggaaa

SEQ ID NO: 4958766 - DNA, 17 bp, Homo sapiens
cacaacttagtgtaata

SEQ ID NO: 4958767 - DNA, 23 bp, Homo sapiens
cacaagcagagtgcacagctgtc

SEQ ID NO: 4958768 - DNA, 16 bp, Homo sapiens
cacaaggattgaaaat

SEQ ID NO: 4958769 - DNA, 12 bp, Homo sapiens
cacaagggctct

SEQ ID NO: 4958770 - DNA, 17 bp, Homo sapiens
cacaaggtgcaaatcaa

SEQ ID NO: 4958771 - DNA, 13 bp, Homo sapiens
cacaagtcttcca

SEQ ID NO: 4958772 - DNA, 14 bp, Homo sapiens
cacaagtcttccag

SEQ ID NO: 4958773 - DNA, 14 bp, Homo sapiens
cacaatttttaatg

SEQ ID NO: 4958774 - DNA, 16 bp, Homo sapiens
cacaatttttaatggc

SEQ ID NO: 4958775 - DNA, 22 bp, Homo sapiens
cacaatttttaatggcagcaga

SEQ ID NO: 4958776 - DNA, 10 bp, Homo sapiens
cacacacaca

SEQ ID NO: 4958777 - DNA, 13 bp, Homo sapiens
cacacacacacaa

SEQ ID NO: 4958778 - DNA, 13 bp, Homo sapiens
cacacacacacac

SEQ ID NO: 4958779 - DNA, 14 bp, Homo sapiens
cacacacacacatg

SEQ ID NO: 4958780 - DNA, 13 bp, Homo sapiens
cacacacacatac

SEQ ID NO: 4958781 - DNA, 15 bp, Homo sapiens
cacacacacatacac

SEQ ID NO: 4958782 - DNA, 13 bp, Homo sapiens
cacacacatgcac

SEQ ID NO: 4958783 - DNA, 14 bp, Homo sapiens
cacacacatgcaca

SEQ ID NO: 4958784 - DNA, 18 bp, Homo sapiens
cacacacatgctaggatg

SEQ ID NO: 4958785 - DNA, 15 bp, Homo sapiens
cacacaccagagccc

SEQ ID NO: 4958786 - DNA, 14 bp, Homo sapiens
cacacacctcacca

SEQ ID NO: 4958787 - DNA, 17 bp, Homo sapiens
cacacacgcacgcacac

SEQ ID NO: 4958788 - DNA, 20 bp, Homo sapiens
cacacacgcgcgcgcacaca

SEQ ID NO: 4958789 - DNA, 22 bp, Homo sapiens
cacacagaaatatatatacata

SEQ ID NO: 4958790 - DNA, 15 bp, Homo sapiens
cacacagctctgtcc

SEQ ID NO: 4958791 - DNA, 22 bp, Homo sapiens
cacacaggggaggtgatagcat

SEQ ID NO: 4958792 - DNA, 15 bp, Homo sapiens
cacacatacacacac

SEQ ID NO: 4958793 - DNA, 20 bp, Homo sapiens
cacaccaaagggagagttcc

SEQ ID NO: 4958794 - DNA, 22 bp, Homo sapiens
cacaccagagcccaccttggct

SEQ ID NO: 4958795 - DNA, 14 bp, Homo sapiens
cacacccagcctca

SEQ ID NO: 4958796 - DNA, 21 bp, Homo sapiens
cacaccctgaggtcagggagt

SEQ ID NO: 4958797 - DNA, 15 bp, Homo sapiens
cacaccctgcaaggc

SEQ ID NO: 4958798 - DNA, 17 bp, Homo sapiens
cacaccgggcactcaga

SEQ ID NO: 4958799 - DNA, 17 bp, Homo sapiens
cacacctcagttccctt

SEQ ID NO: 4958800 - DNA, 22 bp, Homo sapiens
cacaccttttattgacacagaa

SEQ ID NO: 4958801 - DNA, 15 bp, Homo sapiens
cacacgcacgcacac

SEQ ID NO: 4958802 - DNA, 14 bp, Homo sapiens
cacacgcgcgcaca

SEQ ID NO: 4958803 - DNA, 18 bp, Homo sapiens
cacacgcgcgcacacaca

SEQ ID NO: 4958804 - DNA, 14 bp, Homo sapiens
cacactgatgctta

SEQ ID NO: 4958805 - DNA, 19 bp, Homo sapiens
cacactggtacttagagtt

SEQ ID NO: 4958806 - DNA, 18 bp, Homo sapiens
cacacttcaggctcttct

SEQ ID NO: 4958807 - DNA, 22 bp, Homo sapiens
cacacttcaggctcttctcctt

SEQ ID NO: 4958808 - DNA, 22 bp, Homo sapiens
cacacttctgtgagacccccac

SEQ ID NO: 4958809 - DNA, 22 bp, Homo sapiens
cacacttgtaggataagtgaaa

SEQ ID NO: 4958810 - DNA, 15 bp, Homo sapiens
cacacttgttccagc

SEQ ID NO: 4958811 - DNA, 18 bp, Homo sapiens
cacacttgttccagctct

SEQ ID NO: 4958812 - DNA, 19 bp, Homo sapiens
cacacttgttccagctctt

SEQ ID NO: 4958813 - DNA, 18 bp, Homo sapiens
cacagaaacactgccttt

SEQ ID NO: 4958814 - DNA, 12 bp, Homo sapiens
cacagagaaagt

SEQ ID NO: 4958815 - DNA, 13 bp, Homo sapiens
cacagagaagctg

SEQ ID NO: 4958816 - DNA, 15 bp, Homo sapiens
cacagagaagctggg

SEQ ID NO: 4958817 - DNA, 21 bp, Homo sapiens
cacagagcactaggttcaatt

SEQ ID NO: 4958818 - DNA, 16 bp, Homo sapiens
cacagatacacacaca

SEQ ID NO: 4958819 - DNA, 19 bp, Homo sapiens
cacagatatactttgtgga

SEQ ID NO: 4958820 - DNA, 15 bp, Homo sapiens
cacagattttaattg

SEQ ID NO: 4958821 - DNA, 17 bp, Homo sapiens
cacagcacagctccctg

SEQ ID NO: 4958822 - DNA, 13 bp, Homo sapiens
cacagcacatgct

SEQ ID NO: 4958823 - DNA, 15 bp, Homo sapiens
cacagcagcattttt

SEQ ID NO: 4958824 - DNA, 21 bp, Homo sapiens
cacagcagcctccaacacaag

SEQ ID NO: 4958825 - DNA, 13 bp, Homo sapiens
cacagcagcttca

SEQ ID NO: 4958826 - DNA, 13 bp, Homo sapiens
cacagcaggtcct

SEQ ID NO: 4958827 - DNA, 15 bp, Homo sapiens
cacagcctcctctgt

SEQ ID NO: 4958828 - DNA, 21 bp, Homo sapiens
cacagcctcctctgtctgccc

SEQ ID NO: 4958829 - DNA, 13 bp, Homo sapiens
cacagcctctgac

SEQ ID NO: 4958830 - DNA, 14 bp, Homo sapiens
cacagcctctgacc

SEQ ID NO: 4958831 - DNA, 18 bp, Homo sapiens
cacagcgagggcagctgc

SEQ ID NO: 4958832 - DNA, 20 bp, Homo sapiens
cacagctacttggtttgtgt

SEQ ID NO: 4958833 - DNA, 13 bp, Homo sapiens
cacagctcaggag

SEQ ID NO: 4958834 - DNA, 10 bp, Homo sapiens
cacagctcct

SEQ ID NO: 4958835 - DNA, 15 bp, Homo sapiens
cacagctcctcccac

SEQ ID NO: 4958836 - DNA, 11 bp, Homo sapiens
cacagctctgt

SEQ ID NO: 4958837 - DNA, 14 bp, Homo sapiens
cacagctctgtcct

SEQ ID NO: 4958838 - DNA, 18 bp, Homo sapiens
cacagctctgtcctggga

SEQ ID NO: 4958839 - DNA, 14 bp, Homo sapiens
cacagctctgtgtt

SEQ ID NO: 4958840 - DNA, 10 bp, Homo sapiens
cacagctctt

SEQ ID NO: 4958841 - DNA, 19 bp, Homo sapiens
cacagctcttctccaggct

SEQ ID NO: 4958842 - DNA, 22 bp, Homo sapiens
cacagcttcatttcctgtgtct

SEQ ID NO: 4958843 - DNA, 22 bp, Homo sapiens
cacaggaagcctgcagtcctgg

SEQ ID NO: 4958844 - DNA, 16 bp, Homo sapiens
cacaggactctgcctc

SEQ ID NO: 4958845 - DNA, 15 bp, Homo sapiens
cacaggagacactgt

SEQ ID NO: 4958846 - DNA, 21 bp, Homo sapiens
cacaggagacactgtgctata

SEQ ID NO: 4958847 - DNA, 12 bp, Homo sapiens
cacaggatcagt

SEQ ID NO: 4958848 - DNA, 16 bp, Homo sapiens
cacaggatcagtctga

SEQ ID NO: 4958849 - DNA, 17 bp, Homo sapiens
cacaggatcagtctgat

SEQ ID NO: 4958850 - DNA, 16 bp, Homo sapiens
cacaggatgctggcct

SEQ ID NO: 4958851 - DNA, 16 bp, Homo sapiens
cacaggatgctgtgtt

SEQ ID NO: 4958852 - DNA, 15 bp, Homo sapiens
cacaggcagctttct

SEQ ID NO: 4958853 - DNA, 16 bp, Homo sapiens
cacaggcagctttcta

SEQ ID NO: 4958854 - DNA, 10 bp, Homo sapiens
cacaggcagg

SEQ ID NO: 4958855 - DNA, 14 bp, Homo sapiens
cacaggcaggtcca

SEQ ID NO: 4958856 - DNA, 16 bp, Homo sapiens
cacaggcccggctcca

SEQ ID NO: 4958857 - DNA, 18 bp, Homo sapiens
cacaggcccttcctctcc

SEQ ID NO: 4958858 - DNA, 19 bp, Homo sapiens
cacaggcccttcctctcca

SEQ ID NO: 4958859 - DNA, 21 bp, Homo sapiens
cacaggcccttcctctccact

SEQ ID NO: 4958860 - DNA, 22 bp, Homo sapiens
cacaggcccttcctctccactg

SEQ ID NO: 4958861 - DNA, 20 bp, Homo sapiens
cacagggcatgccccggcca

SEQ ID NO: 4958862 - DNA, 17 bp, Homo sapiens
cacaggggaggtgatag

SEQ ID NO: 4958863 - DNA, 14 bp, Homo sapiens
cacagggttgggcc

SEQ ID NO: 4958864 - DNA, 16 bp, Homo sapiens
cacagggttgggccca

SEQ ID NO: 4958865 - DNA, 22 bp, Homo sapiens
cacagggttgggcccagatctg

SEQ ID NO: 4958866 - DNA, 12 bp, Homo sapiens
cacaggtcccac

SEQ ID NO: 4958867 - DNA, 14 bp, Homo sapiens
cacaggtcccacct

SEQ ID NO: 4958868 - DNA, 13 bp, Homo sapiens
cactccagtgcca

SEQ ID NO: 4958869 - DNA, 17 bp, Homo sapiens
cactccagtgccagcaa

SEQ ID NO: 4958870 - DNA, 20 bp, Homo sapiens
cactccccaaggaagagcca

SEQ ID NO: 4958871 - DNA, 19 bp, Homo sapiens
cactccccatgccacgttc

SEQ ID NO: 4958872 - DNA, 21 bp, Homo sapiens
cactccccctaaacccctgtc

SEQ ID NO: 4958873 - DNA, 22 bp, Homo sapiens
cactccccctaaacccctgtcc

SEQ ID NO: 4958874 - DNA, 21 bp, Homo sapiens
cactcccttggtggcaagagc

SEQ ID NO: 4958875 - DNA, 12 bp, Homo sapiens
cactcctagaga

SEQ ID NO: 4958876 - DNA, 22 bp, Homo sapiens
cactcctagagaacgcagccct

SEQ ID NO: 4958877 - DNA, 16 bp, Homo sapiens
cactcctcagggcagc

SEQ ID NO: 4958878 - DNA, 20 bp, Homo sapiens
cactcgcttcccccatagcc

SEQ ID NO: 4958879 - DNA, 11 bp, Homo sapiens
cactctagatt

SEQ ID NO: 4958880 - DNA, 13 bp, Homo sapiens
cactctccatcac

SEQ ID NO: 4958881 - DNA, 13 bp, Homo sapiens
cactctctggaag

SEQ ID NO: 4958882 - DNA, 17 bp, Homo sapiens
cactctcttccctttcc

SEQ ID NO: 4958883 - DNA, 20 bp, Homo sapiens
cactctgggcacactctgcc

SEQ ID NO: 4958884 - DNA, 20 bp, Homo sapiens
cactctgtcgcccagtctgg

SEQ ID NO: 4958885 - DNA, 13 bp, Homo sapiens
cactctgttattt

SEQ ID NO: 4958886 - DNA, 17 bp, Homo sapiens
cactctgttatttagac

SEQ ID NO: 4958887 - DNA, 14 bp, Homo sapiens
cactcttaaagcaa

SEQ ID NO: 4958888 - DNA, 14 bp, Homo sapiens
cactgaaaaacaac

SEQ ID NO: 4958889 - DNA, 21 bp, Homo sapiens
cactgaaaaggttcttcatcc

SEQ ID NO: 4958890 - DNA, 22 bp, Homo sapiens
cactgaaaaggttcttcatccc

SEQ ID NO: 4958891 - DNA, 16 bp, Homo sapiens
cactgaaatatgtgaa

SEQ ID NO: 4958892 - DNA, 22 bp, Homo sapiens
cactgaacaaactaaaggtgca

SEQ ID NO: 4958893 - DNA, 13 bp, Homo sapiens
cactgaatttata

SEQ ID NO: 4958894 - DNA, 13 bp, Homo sapiens
cactgacagcctc

SEQ ID NO: 4958895 - DNA, 20 bp, Homo sapiens
cactgacagcctcccacccc

SEQ ID NO: 4958896 - DNA, 15 bp, Homo sapiens
cactgacccttccag

SEQ ID NO: 4958897 - DNA, 16 bp, Homo sapiens
cactgacccttccaga

SEQ ID NO: 4958898 - DNA, 21 bp, Homo sapiens
cactgacccttccagacatac

SEQ ID NO: 4958899 - DNA, 17 bp, Homo sapiens
cactgatgctgttctct

SEQ ID NO: 4958900 - DNA, 16 bp, Homo sapiens
cactgatgcttagatg

SEQ ID NO: 4958901 - DNA, 16 bp, Homo sapiens
cactgcaatcctgtct

SEQ ID NO: 4958902 - DNA, 22 bp, Homo sapiens
cactgcacagtgcatctcagcc

SEQ ID NO: 4958903 - DNA, 14 bp, Homo sapiens
cactgcaccgggcc

SEQ ID NO: 4958904 - DNA, 19 bp, Homo sapiens
cactgcactatagcctagg

SEQ ID NO: 4958905 - DNA, 17 bp, Homo sapiens
cactgcactcaacctta

SEQ ID NO: 4958906 - DNA, 21 bp, Homo sapiens
cactgcagcctcaacctcctg

SEQ ID NO: 4958907 - DNA, 19 bp, Homo sapiens
cactgcatggctcccacag

SEQ ID NO: 4958908 - DNA, 18 bp, Homo sapiens
cactgccactttgcacat

SEQ ID NO: 4958909 - DNA, 12 bp, Homo sapiens
cactgccagcag

SEQ ID NO: 4958910 - DNA, 13 bp, Homo sapiens
cactgccagcagc

SEQ ID NO: 4958911 - DNA, 19 bp, Homo sapiens
cactgccagcagcagcagg

SEQ ID NO: 4958912 - DNA, 20 bp, Homo sapiens
cactgccatcttagtttgga

SEQ ID NO: 4958913 - DNA, 18 bp, Homo sapiens
cactgcccgcacaccctc

SEQ ID NO: 4958914 - DNA, 15 bp, Homo sapiens
cactgcctctgcctt

SEQ ID NO: 4958915 - DNA, 16 bp, Homo sapiens
cactgcctctgcctta

SEQ ID NO: 4958916 - DNA, 23 bp, Homo sapiens
cactgcctctgccttagaggagc

SEQ ID NO: 4958917 - DNA, 12 bp, Homo sapiens
cactgcctgggc

SEQ ID NO: 4958918 - DNA, 13 bp, Homo sapiens
cactgcctgggct

SEQ ID NO: 4958919 - DNA, 20 bp, Homo sapiens
cactgccttcgatacaccgg

SEQ ID NO: 4958920 - DNA, 22 bp, Homo sapiens
cactgccttcgatacaccgggc

SEQ ID NO: 4958921 - DNA, 11 bp, Homo sapiens
cactgctccct

SEQ ID NO: 4958922 - DNA, 12 bp, Homo sapiens
cactgctcccta

SEQ ID NO: 4958923 - DNA, 21 bp, Homo sapiens
cactgctccctaagccagcct

SEQ ID NO: 4958924 - DNA, 14 bp, Homo sapiens
cactgctggctgcc

SEQ ID NO: 4958925 - DNA, 23 bp, Homo sapiens
cactgcttgatgaagcaaggaag

SEQ ID NO: 4958926 - DNA, 20 bp, Homo sapiens
cactgggatgagccgctgtg

SEQ ID NO: 4958927 - DNA, 21 bp, Homo sapiens
cactggtacttagagtttctg

SEQ ID NO: 4958928 - DNA, 22 bp, Homo sapiens
cactggtacttagagtttctgt

SEQ ID NO: 4958929 - DNA, 18 bp, Homo sapiens
cactggtgtttaggtgaa

SEQ ID NO: 4958930 - DNA, 20 bp, Homo sapiens
cactgtacaaggtacccctt

SEQ ID NO: 4958931 - DNA, 20 bp, Homo sapiens
cactgtagttctaagactca

SEQ ID NO: 4958932 - DNA, 15 bp, Homo sapiens
cactgtataaatagg

SEQ ID NO: 4958933 - DNA, 17 bp, Homo sapiens
cactgtataaataggag

SEQ ID NO: 4958934 - DNA, 16 bp, Homo sapiens
cactgtgaccttgact

SEQ ID NO: 4958935 - DNA, 14 bp, Homo sapiens
cactgtgccatgtg

SEQ ID NO: 4958936 - DNA, 23 bp, Homo sapiens
cactgtggaactaataaatacat

SEQ ID NO: 4958937 - DNA, 17 bp, Homo sapiens
cactgttgaaaattatt

SEQ ID NO: 4958938 - DNA, 18 bp, Homo sapiens
cactgttgaaaattattt

SEQ ID NO: 4958939 - DNA, 17 bp, Homo sapiens
cactgttgaattttctc

SEQ ID NO: 4958940 - DNA, 17 bp, Homo sapiens
cactgttgatgtatctg

SEQ ID NO: 4958941 - DNA, 14 bp, Homo sapiens
cactgttgcccagg

SEQ ID NO: 4958942 - DNA, 17 bp, Homo sapiens
cactgttgcccaggctg

SEQ ID NO: 4958943 - DNA, 23 bp, Homo sapiens
cactgttgcccaggctggcgtgc

SEQ ID NO: 4958944 - DNA, 18 bp, Homo sapiens
cactgtttctcttgagct

SEQ ID NO: 4958945 - DNA, 17 bp, Homo sapiens
cactgtttcttgcttgt

SEQ ID NO: 4958946 - DNA, 17 bp, Homo sapiens
cacttaaggcactctgt

SEQ ID NO: 4958947 - DNA, 20 bp, Homo sapiens
cacttattccccattcttcc

SEQ ID NO: 4958948 - DNA, 16 bp, Homo sapiens
cacttattgtaaattt

SEQ ID NO: 4958949 - DNA, 16 bp, Homo sapiens
cacttcagaattccat

SEQ ID NO: 4958950 - DNA, 16 bp, Homo sapiens
cacttcaggctcttct

SEQ ID NO: 4958951 - DNA, 20 bp, Homo sapiens
cacttcaggctcttctcctt

SEQ ID NO: 4958952 - DNA, 12 bp, Homo sapiens
cacttccagggg

SEQ ID NO: 4958953 - DNA, 14 bp, Homo sapiens
cacttccaggggaa

SEQ ID NO: 4958954 - DNA, 23 bp, Homo sapiens
cacttcctacaagagcagcctgt

SEQ ID NO: 4958955 - DNA, 17 bp, Homo sapiens
cacttctaaatagcaat

SEQ ID NO: 4958956 - DNA, 21 bp, Homo sapiens
cacttctcacatcttatgcta

SEQ ID NO: 4958957 - DNA, 12 bp, Homo sapiens
cacttcttcctt

SEQ ID NO: 4958958 - DNA, 17 bp, Homo sapiens
cacttgaaattctttca

SEQ ID NO: 4958959 - DNA, 23 bp, Homo sapiens
cacttgatgatacaatgaacact

SEQ ID NO: 4958960 - DNA, 14 bp, Homo sapiens
cacttgattccttg

SEQ ID NO: 4958961 - DNA, 18 bp, Homo sapiens
cacttgcagactctacag

SEQ ID NO: 4958962 - DNA, 15 bp, Homo sapiens
cacttgtataaatgt

SEQ ID NO: 4958963 - DNA, 13 bp, Homo sapiens
cacttgtatatac

SEQ ID NO: 4958964 - DNA, 21 bp, Homo sapiens
cacttgtatatacgcatctat

SEQ ID NO: 4958965 - DNA, 19 bp, Homo sapiens
cacttgtatcctctggttc

SEQ ID NO: 4958966 - DNA, 22 bp, Homo sapiens
cacttgtctcattttaatgtaa

SEQ ID NO: 4958967 - DNA, 19 bp, Homo sapiens
cacttgtgattataaaatt

SEQ ID NO: 4958968 - DNA, 20 bp, Homo sapiens
cacttgtgctttgctcttgt

SEQ ID NO: 4958969 - DNA, 18 bp, Homo sapiens
cacttgtgttatgaagca

SEQ ID NO: 4958970 - DNA, 18 bp, Homo sapiens
cactttaagagagaaatc

SEQ ID NO: 4958971 - DNA, 17 bp, Homo sapiens
cactttacccacctaga

SEQ ID NO: 4958972 - DNA, 19 bp, Homo sapiens
cactttacccacctagaac

SEQ ID NO: 4958973 - DNA, 20 bp, Homo sapiens
cactttataagtcattgtat

SEQ ID NO: 4958974 - DNA, 13 bp, Homo sapiens
cactttccacttc

SEQ ID NO: 4958975 - DNA, 17 bp, Homo sapiens
cactttccacttcttcc

SEQ ID NO: 4958976 - DNA, 18 bp, Homo sapiens
cactttccacttcttcct

SEQ ID NO: 4958977 - DNA, 19 bp, Homo sapiens
cactttccacttcttcctt

SEQ ID NO: 4958978 - DNA, 14 bp, Homo sapiens
cagcacggacaata

SEQ ID NO: 4958979 - DNA, 18 bp, Homo sapiens
cagcacggacaataaacc

SEQ ID NO: 4958980 - DNA, 10 bp, Homo sapiens
cagcactaac

SEQ ID NO: 4958981 - DNA, 15 bp, Homo sapiens
cagcagaagacaaaa

SEQ ID NO: 4958982 - DNA, 21 bp, Homo sapiens
cagcagaatggtgatcactcc

SEQ ID NO: 4958983 - DNA, 13 bp, Homo sapiens
cagcagcagcagg

SEQ ID NO: 4958984 - DNA, 15 bp, Homo sapiens
cagcagcagcaggtg

SEQ ID NO: 4958985 - DNA, 13 bp, Homo sapiens
cagcagcccctgc

SEQ ID NO: 4958986 - DNA, 22 bp, Homo sapiens
cagcagccgccttaagctgatc

SEQ ID NO: 4958987 - DNA, 17 bp, Homo sapiens
cagcagcttcaccagag

SEQ ID NO: 4958988 - DNA, 21 bp, Homo sapiens
cagcaggagtggtgcagacag

SEQ ID NO: 4958989 - DNA, 15 bp, Homo sapiens
cagcaggcagcgcca

SEQ ID NO: 4958990 - DNA, 21 bp, Homo sapiens
cagcaggtgattggaccaggc

SEQ ID NO: 4958991 - DNA, 22 bp, Homo sapiens
cagcagtgttccccatctgggt

SEQ ID NO: 4958992 - DNA, 13 bp, Homo sapiens
cagcatcactccc

SEQ ID NO: 4958993 - DNA, 14 bp, Homo sapiens
cagcatcactcccc

SEQ ID NO: 4958994 - DNA, 17 bp, Homo sapiens
cagcatcactccccaag

SEQ ID NO: 4958995 - DNA, 22 bp, Homo sapiens
cagcatcactccccaaggaaga

SEQ ID NO: 4958996 - DNA, 15 bp, Homo sapiens
cagcatcctggcacc

SEQ ID NO: 4958997 - DNA, 21 bp, Homo sapiens
cagcatgacataacagtgcag

SEQ ID NO: 4958998 - DNA, 15 bp, Homo sapiens
cagcatgaggacaga

SEQ ID NO: 4958999 - DNA, 22 bp, Homo sapiens
cagcatgaggacagaccacaga

SEQ ID NO: 4959000 - DNA, 19 bp, Homo sapiens
gccgtgcattagcacagat

SEQ ID NO: 4959001 - DNA, 15 bp, Homo sapiens
gccgtggcttcccgc

SEQ ID NO: 4959002 - DNA, 21 bp, Homo sapiens
gccgtggcttcccgctcagcc

SEQ ID NO: 4959003 - DNA, 22 bp, Homo sapiens
gccgtggcttcccgctcagccc

SEQ ID NO: 4959004 - DNA, 18 bp, Homo sapiens
gccgtgtgagtgtgacag

SEQ ID NO: 4959005 - DNA, 19 bp, Homo sapiens
gccgtgtgagtgtgacagg

SEQ ID NO: 4959006 - DNA, 22 bp, Homo sapiens
gccgtgtgagtgtgacagggcc

SEQ ID NO: 4959007 - DNA, 13 bp, Homo sapiens
gcctaaaatcttg

SEQ ID NO: 4959008 - DNA, 19 bp, Homo sapiens
gcctaaatttaatgctgcc

SEQ ID NO: 4959009 - DNA, 18 bp, Homo sapiens
gcctaagtattaaaacat

SEQ ID NO: 4959010 - DNA, 22 bp, Homo sapiens
gcctacagctttgatccctgac

SEQ ID NO: 4959011 - DNA, 14 bp, Homo sapiens
gcctacctgctctc

SEQ ID NO: 4959012 - DNA, 17 bp, Homo sapiens
gcctagaagctggtggc

SEQ ID NO: 4959013 - DNA, 14 bp, Homo sapiens
gcctagcccaccct

SEQ ID NO: 4959014 - DNA, 18 bp, Homo sapiens
gcctagcccaccctgctg

SEQ ID NO: 4959015 - DNA, 22 bp, Homo sapiens
gcctagcccaccctgctgcctt

SEQ ID NO: 4959016 - DNA, 14 bp, Homo sapiens
gcctaggtgacaga

SEQ ID NO: 4959017 - DNA, 15 bp, Homo sapiens
gcctaggtgacagag

SEQ ID NO: 4959018 - DNA, 16 bp, Homo sapiens
gcctagtttactgttt

SEQ ID NO: 4959019 - DNA, 22 bp, Homo sapiens
gcctatgagcatcctgagcccc

SEQ ID NO: 4959020 - DNA, 20 bp, Homo sapiens
gcctatttacctgcaggctg

SEQ ID NO: 4959021 - DNA, 15 bp, Homo sapiens
gcctcaaaggcccgc

SEQ ID NO: 4959022 - DNA, 18 bp, Homo sapiens
gcctcaacctcctgggct

SEQ ID NO: 4959023 - DNA, 24 bp, Homo sapiens
gcctcaagtgattctcctgcctca

SEQ ID NO: 4959024 - DNA, 14 bp, Homo sapiens
gcctcacccttgcg

SEQ ID NO: 4959025 - DNA, 17 bp, Homo sapiens
gcctcaccgcttccctc

SEQ ID NO: 4959026 - DNA, 17 bp, Homo sapiens
gcctcacctctacccaa

SEQ ID NO: 4959027 - DNA, 17 bp, Homo sapiens
gcctcagcatcctggca

SEQ ID NO: 4959028 - DNA, 18 bp, Homo sapiens
gcctcagcatcctggcac

SEQ ID NO: 4959029 - DNA, 14 bp, Homo sapiens
gcctcagcctccca

SEQ ID NO: 4959030 - DNA, 15 bp, Homo sapiens
gcctcagctgcctca

SEQ ID NO: 4959031 - DNA, 16 bp, Homo sapiens
gcctcagctgcctcac

SEQ ID NO: 4959032 - DNA, 19 bp, Homo sapiens
gcctcagctgcctcacttc

SEQ ID NO: 4959033 - DNA, 22 bp, Homo sapiens
gcctcagtcctcccctcacagc

SEQ ID NO: 4959034 - DNA, 14 bp, Homo sapiens
gcctcagtgccact

SEQ ID NO: 4959035 - DNA, 12 bp, Homo sapiens
gcctccacagcg

SEQ ID NO: 4959036 - DNA, 15 bp, Homo sapiens
gcctccacagcgagg

SEQ ID NO: 4959037 - DNA, 20 bp, Homo sapiens
gcctccacagcgagggcagc

SEQ ID NO: 4959038 - DNA, 23 bp, Homo sapiens
gcctccacagcgagggcagctgc

SEQ ID NO: 4959039 - DNA, 12 bp, Homo sapiens
gcctccagaact

SEQ ID NO: 4959040 - DNA, 13 bp, Homo sapiens
gcctcccaaagtg

SEQ ID NO: 4959041 - DNA, 13 bp, Homo sapiens
gcctcccagcctg

SEQ ID NO: 4959042 - DNA, 19 bp, Homo sapiens
gcctcccgaatagctggga

SEQ ID NO: 4959043 - DNA, 23 bp, Homo sapiens
gcctcccgaatagctgggactac

SEQ ID NO: 4959044 - DNA, 17 bp, Homo sapiens
gcctcccgagtagctgg

SEQ ID NO: 4959045 - DNA, 18 bp, Homo sapiens
gcctcccgagtagctggg

SEQ ID NO: 4959046 - DNA, 16 bp, Homo sapiens
gcctccctctctcttc

SEQ ID NO: 4959047 - DNA, 23 bp, Homo sapiens
gcctccctctctcttctgctcca

SEQ ID NO: 4959048 - DNA, 22 bp, Homo sapiens
gcctccctgaaaatgtttttct

SEQ ID NO: 4959049 - DNA, 21 bp, Homo sapiens
gcctcctcacccccagctttg

SEQ ID NO: 4959050 - DNA, 17 bp, Homo sapiens
gcctcctcatcccgtgt

SEQ ID NO: 4959051 - DNA, 19 bp, Homo sapiens
gcctcctctgtctgccctt

SEQ ID NO: 4959052 - DNA, 13 bp, Homo sapiens
gcctcctcttcac

SEQ ID NO: 4959053 - DNA, 23 bp, Homo sapiens
gcctcctgcctgcccctctcccg

SEQ ID NO: 4959054 - DNA, 19 bp, Homo sapiens
gcctcctgtgtgtgcgcct

SEQ ID NO: 4959055 - DNA, 16 bp, Homo sapiens
gcctcgaaacacagaa

SEQ ID NO: 4959056 - DNA, 17 bp, Homo sapiens
gcctcgaactggctgca

SEQ ID NO: 4959057 - DNA, 22 bp, Homo sapiens
gcctcgaactggctgcaaaggg

SEQ ID NO: 4959058 - DNA, 21 bp, Homo sapiens
gcctctgacacacagctctgt

SEQ ID NO: 4959059 - DNA, 20 bp, Homo sapiens
gcctctgacccctcctcact

SEQ ID NO: 4959060 - DNA, 18 bp, Homo sapiens
gcctctgatatgggactg

SEQ ID NO: 4959061 - DNA, 12 bp, Homo sapiens
gcctctgcattc

SEQ ID NO: 4959062 - DNA, 10 bp, Homo sapiens
gcctctgcct

SEQ ID NO: 4959063 - DNA, 18 bp, Homo sapiens
gcctctgcctctgacaca

SEQ ID NO: 4959064 - DNA, 21 bp, Homo sapiens
gcctctggctagaggccagcc

SEQ ID NO: 4959065 - DNA, 22 bp, Homo sapiens
gcctctgtcccggaagagtcat

SEQ ID NO: 4959066 - DNA, 14 bp, Homo sapiens
gcctctgtgtcctt

SEQ ID NO: 4959067 - DNA, 23 bp, Homo sapiens
gcctcttaaagctgcctgtagtt

SEQ ID NO: 4959068 - DNA, 12 bp, Homo sapiens
gcctcttttctc

SEQ ID NO: 4959069 - DNA, 18 bp, Homo sapiens
gcctcttttctctgtgct

SEQ ID NO: 4959070 - DNA, 13 bp, Homo sapiens
gcctgacagaaac

SEQ ID NO: 4959071 - DNA, 22 bp, Homo sapiens
gcctgagccctactccctgcag

SEQ ID NO: 4959072 - DNA, 17 bp, Homo sapiens
gcctgagctcactcggc

SEQ ID NO: 4959073 - DNA, 20 bp, Homo sapiens
gcctgagtcagggcccagag

SEQ ID NO: 4959074 - DNA, 10 bp, Homo sapiens
gcctgccatg

SEQ ID NO: 4959075 - DNA, 20 bp, Homo sapiens
gcctgccatgtacctcccct

SEQ ID NO: 4959076 - DNA, 20 bp, Homo sapiens
gcctgcccaagcccaggcca

SEQ ID NO: 4959077 - DNA, 13 bp, Homo sapiens
gcctgcccaggcc

SEQ ID NO: 4959078 - DNA, 19 bp, Homo sapiens
gcctgcccaggcccctgcc

SEQ ID NO: 4959079 - DNA, 17 bp, Homo sapiens
gcctgcccctctcccgc

SEQ ID NO: 4959080 - DNA, 20 bp, Homo sapiens
gcctgcccgcacagcagcct

SEQ ID NO: 4959081 - DNA, 21 bp, Homo sapiens
gcctgccctcatggcccctct

SEQ ID NO: 4959082 - DNA, 19 bp, Homo sapiens
gcctgcgttggtccagagc

SEQ ID NO: 4959083 - DNA, 20 bp, Homo sapiens
gcctgcgttggtccagagcg

SEQ ID NO: 4959084 - DNA, 20 bp, Homo sapiens
gcctgcgttttggaagctct

SEQ ID NO: 4959085 - DNA, 17 bp, Homo sapiens
gcctgctaattccccag

SEQ ID NO: 4959086 - DNA, 11 bp, Homo sapiens
gcctgctgcat

SEQ ID NO: 4959087 - DNA, 18 bp, Homo sapiens
gcctgctgcatggggtgg

SEQ ID NO: 4959088 - DNA, 13 bp, Homo sapiens
gcctgctgcccag

SEQ ID NO: 4959089 - DNA, 17 bp, Homo sapiens
gcctgctggtcacagcc

SEQ ID NO: 4959090 - DNA, 21 bp, Homo sapiens
gcctgctggtcacagcctcct

SEQ ID NO: 4959091 - DNA, 22 bp, Homo sapiens
gcctgcttcccacctccctgcc

SEQ ID NO: 4959092 - DNA, 22 bp, Homo sapiens
gcctggacagtatcccacatcc

SEQ ID NO: 4959093 - DNA, 11 bp, Homo sapiens
gcctggacctg

SEQ ID NO: 4959094 - DNA, 14 bp, Homo sapiens
gcctggacctgcct

SEQ ID NO: 4959095 - DNA, 19 bp, Homo sapiens
gcctggacctgcctcctgc

SEQ ID NO: 4959096 - DNA, 24 bp, Homo sapiens
gcctggagacccaccccacctgca

SEQ ID NO: 4959097 - DNA, 21 bp, Homo sapiens
gcctggatattattcttgtag

SEQ ID NO: 4959098 - DNA, 22 bp, Homo sapiens
gcctggatttctggttctgatg

SEQ ID NO: 4959099 - DNA, 14 bp, Homo sapiens
gcctggcacacatc

SEQ ID NO: 4959100 - DNA, 14 bp, Homo sapiens
gcctggcacagggc

SEQ ID NO: 4959101 - DNA, 12 bp, Homo sapiens
gcctggcagccg

SEQ ID NO: 4959102 - DNA, 20 bp, Homo sapiens
gcctggcagccgtgccttca

SEQ ID NO: 4959103 - DNA, 19 bp, Homo sapiens
gcctggcagggaggtcagg

SEQ ID NO: 4959104 - DNA, 16 bp, Homo sapiens
gcctggccacctctct

SEQ ID NO: 4959105 - DNA, 18 bp, Homo sapiens
gcctggccacctctctcc

SEQ ID NO: 4959106 - DNA, 16 bp, Homo sapiens
gcctggccagatgcac

SEQ ID NO: 4959107 - DNA, 15 bp, Homo sapiens
gcctggccaggcaga

SEQ ID NO: 4959108 - DNA, 15 bp, Homo sapiens
gcctggccctgccct

SEQ ID NO: 4959109 - DNA, 10 bp, Homo sapiens
gcctggctct

SEQ ID NO: 4959110 - DNA, 13 bp, Homo sapiens
gcctgggcagcat

SEQ ID NO: 4959111 - DNA, 12 bp, Homo sapiens
gcctgggctagg

SEQ ID NO: 4959112 - DNA, 16 bp, Homo sapiens
gcctggggcctgagag

SEQ ID NO: 4959113 - DNA, 17 bp, Homo sapiens
gcctggggcctgagaga

SEQ ID NO: 4959114 - DNA, 13 bp, Homo sapiens
gcctggggcctgg

SEQ ID NO: 4959115 - DNA, 14 bp, Homo sapiens
gcctggggcctggc

SEQ ID NO: 4959116 - DNA, 21 bp, Homo sapiens
gcctgggtcacacacggaggc

SEQ ID NO: 4959117 - DNA, 19 bp, Homo sapiens
gcctgggtggatcggcctc

SEQ ID NO: 4959118 - DNA, 17 bp, Homo sapiens
gcctggtatggctgcag

SEQ ID NO: 4959119 - DNA, 20 bp, Homo sapiens
gcctggtgcttccaaatatt

SEQ ID NO: 4959120 - DNA, 21 bp, Homo sapiens
gcctggtggcagctgcggtcc

SEQ ID NO: 4959121 - DNA, 14 bp, Homo sapiens
gcctgtagcagtga

SEQ ID NO: 4959122 - DNA, 17 bp, Homo sapiens
gcctgtagttaggaaat

SEQ ID NO: 4959123 - DNA, 18 bp, Homo sapiens
gcctgtagttaggaaata

SEQ ID NO: 4959124 - DNA, 23 bp, Homo sapiens
gcctgtagttaggaaataaaacc

SEQ ID NO: 4959125 - DNA, 17 bp, Homo sapiens
gcctgtatactttagta

SEQ ID NO: 4959126 - DNA, 19 bp, Homo sapiens
gcctgtctcatccccaggg

SEQ ID NO: 4959127 - DNA, 13 bp, Homo sapiens
gcctgtgcacaca

SEQ ID NO: 4959128 - DNA, 15 bp, Homo sapiens
gcctgtgcacacaca

SEQ ID NO: 4959129 - DNA, 23 bp, Homo sapiens
gcctgtgcacacacacacacatg

SEQ ID NO: 4959130 - DNA, 19 bp, Homo sapiens
gcctgtgcctcctcacccc

SEQ ID NO: 4959131 - DNA, 17 bp, Homo sapiens
gcctgtggaatgagtgt

SEQ ID NO: 4959132 - DNA, 19 bp, Homo sapiens
gcctgtggagctcagcccc

SEQ ID NO: 4959133 - DNA, 20 bp, Homo sapiens
gcctgttaggagaagctgca

SEQ ID NO: 4959134 - DNA, 16 bp, Homo sapiens
gcctgttcagctccag

SEQ ID NO: 4959135 - DNA, 23 bp, Homo sapiens
gcctgttcccattcttgcatggc

SEQ ID NO: 4959136 - DNA, 14 bp, Homo sapiens
gcctgttgcccttt

SEQ ID NO: 4959137 - DNA, 13 bp, Homo sapiens
gccttaaaatgga

SEQ ID NO: 4959138 - DNA, 14 bp, Homo sapiens
gccttaaaatggaa

SEQ ID NO: 4959139 - DNA, 14 bp, Homo sapiens
gccttaagctgatc

SEQ ID NO: 4959140 - DNA, 15 bp, Homo sapiens
gccttacatttgtga

SEQ ID NO: 4959141 - DNA, 20 bp, Homo sapiens
gccttagaaatgtaaactgc

SEQ ID NO: 4959142 - DNA, 16 bp, Homo sapiens
gccttagaacctttct

SEQ ID NO: 4959143 - DNA, 17 bp, Homo sapiens
gccttagaagtcacaca

SEQ ID NO: 4959144 - DNA, 15 bp, Homo sapiens
gccttagaggagccc

SEQ ID NO: 4959145 - DNA, 22 bp, Homo sapiens
gccttagggaagctggcctgag

SEQ ID NO: 4959146 - DNA, 14 bp, Homo sapiens
gccttagtgggcca

SEQ ID NO: 4959147 - DNA, 17 bp, Homo sapiens
gccttccagctgctgtc

SEQ ID NO: 4959148 - DNA, 12 bp, Homo sapiens
gccttcccctca

SEQ ID NO: 4959149 - DNA, 11 bp, Homo sapiens
gccttccttcc

SEQ ID NO: 4959150 - DNA, 17 bp, Homo sapiens
gccttcctttctccagg

SEQ ID NO: 4959151 - DNA, 15 bp, Homo sapiens
gccttctctgaagga

SEQ ID NO: 4959152 - DNA, 14 bp, Homo sapiens
gccttctgatgtct

SEQ ID NO: 4959153 - DNA, 14 bp, Homo sapiens
gccttcttccatcc

SEQ ID NO: 4959154 - DNA, 22 bp, Homo sapiens
gccttcttccatcccaggacac

SEQ ID NO: 4959155 - DNA, 11 bp, Homo sapiens
gccttctttga

SEQ ID NO: 4959156 - DNA, 13 bp, Homo sapiens
gccttctttgaag

SEQ ID NO: 4959157 - DNA, 21 bp, Homo sapiens
gccttgacatcagttcctttg

SEQ ID NO: 4959158 - DNA, 12 bp, Homo sapiens
gccttggctcag

SEQ ID NO: 4959159 - DNA, 14 bp, Homo sapiens
gccttggctcagac

SEQ ID NO: 4959160 - DNA, 15 bp, Homo sapiens
gccttgggctgctcc

SEQ ID NO: 4959161 - DNA, 18 bp, Homo sapiens
gccttgggctgctcctca

SEQ ID NO: 4959162 - DNA, 22 bp, Homo sapiens
gccttgggctgctcctcatggt

SEQ ID NO: 4959163 - DNA, 20 bp, Homo sapiens
gccttgtctcctactcctga

SEQ ID NO: 4959164 - DNA, 21 bp, Homo sapiens
gcctttaatggacttatttct

SEQ ID NO: 4959165 - DNA, 21 bp, Homo sapiens
gcctttcccaccgccctccct

SEQ ID NO: 4959166 - DNA, 18 bp, Homo sapiens
gcctttcctctctcctgt

SEQ ID NO: 4959167 - DNA, 19 bp, Homo sapiens
gcctttctgcagtttttca

SEQ ID NO: 4959168 - DNA, 17 bp, Homo sapiens
gcctttgatgttacaga

SEQ ID NO: 4959169 - DNA, 18 bp, Homo sapiens
gcctttgcaaatcagtgt

SEQ ID NO: 4959170 - DNA, 13 bp, Homo sapiens
gcctttggctctg

SEQ ID NO: 4959171 - DNA, 16 bp, Homo sapiens
gccttttaacattttg

SEQ ID NO: 4959172 - DNA, 20 bp, Homo sapiens
gccttttaacattttgttct

SEQ ID NO: 4959173 - DNA, 21 bp, Homo sapiens
gccttttaacattttgttctt

SEQ ID NO: 4959174 - DNA, 18 bp, Homo sapiens
gcctttttaaaacacatg

SEQ ID NO: 4959175 - DNA, 22 bp, Homo sapiens
gcctttttaaaacacatgtttt

SEQ ID NO: 4959176 - DNA, 21 bp, Homo sapiens
gcctttttcctagcctgtttc

SEQ ID NO: 4959177 - DNA, 11 bp, Homo sapiens
gcgaaaatagt

SEQ ID NO: 4959178 - DNA, 15 bp, Homo sapiens
gcgaatccaagctcc

SEQ ID NO: 4959179 - DNA, 22 bp, Homo sapiens
gcgaatccaagctccctgcccc

SEQ ID NO: 4959180 - DNA, 18 bp, Homo sapiens
gcgacatagcccatccct

SEQ ID NO: 4959181 - DNA, 21 bp, Homo sapiens
gcgactaatttcaaaatgctt

SEQ ID NO: 4959182 - DNA, 23 bp, Homo sapiens
gcgactaatttcaaaatgctttt

SEQ ID NO: 4959183 - DNA, 16 bp, Homo sapiens
gcgagagaggagccag

SEQ ID NO: 4959184 - DNA, 17 bp, Homo sapiens
gcgagccctggtggcag

SEQ ID NO: 4959185 - DNA, 13 bp, Homo sapiens
gcgaggcaggccg

SEQ ID NO: 4959186 - DNA, 13 bp, Homo sapiens
gcgagggcagctg

SEQ ID NO: 4959187 - DNA, 14 bp, Homo sapiens
gcgagggcagctgc

SEQ ID NO: 4959188 - DNA, 19 bp, Homo sapiens
gcgatatacagatgaaaat

SEQ ID NO: 4959189 - DNA, 22 bp, Homo sapiens
gcgattcttctgcttcagcctc

SEQ ID NO: 4959190 - DNA, 20 bp, Homo sapiens
gcgcaagatagatttggaat

SEQ ID NO: 4959191 - DNA, 13 bp, Homo sapiens
gcgcacacacaca

SEQ ID NO: 4959192 - DNA, 16 bp, Homo sapiens
gcgcacacacacacat

SEQ ID NO: 4959193 - DNA, 21 bp, Homo sapiens
gcgcatccaatctcaaggaat

SEQ ID NO: 4959194 - DNA, 22 bp, Homo sapiens
gcgcccgcccctgcagcacgga

SEQ ID NO: 4959195 - DNA, 12 bp, Homo sapiens
gcgccctttccc

SEQ ID NO: 4959196 - DNA, 23 bp, Homo sapiens
gcgccctttccccgacgcccacc

SEQ ID NO: 4959197 - DNA, 20 bp, Homo sapiens
gcgcctacaggagtgagcac

SEQ ID NO: 4959198 - DNA, 21 bp, Homo sapiens
gcgcctacaggagtgagcact

SEQ ID NO: 4959199 - DNA, 16 bp, Homo sapiens
gcgcctgtgcacacac

SEQ ID NO: 4959200 - DNA, 20 bp, Homo sapiens
gcgcgagggcctcaaaggcc

SEQ ID NO: 4959201 - DNA, 14 bp, Homo sapiens
gcgcgccactcgct

SEQ ID NO: 4959202 - DNA, 13 bp, Homo sapiens
gcgcggccagccc

SEQ ID NO: 4959203 - DNA, 23 bp, Homo sapiens
gcgcggccagccccggccctggg

SEQ ID NO: 4959204 - DNA, 16 bp, Homo sapiens
gcgctacccacttcta

SEQ ID NO: 4959205 - DNA, 14 bp, Homo sapiens
gcgctattacaaat

SEQ ID NO: 4959206 - DNA, 17 bp, Homo sapiens
gcgctgggtattggaaa

SEQ ID NO: 4959207 - DNA, 22 bp, Homo sapiens
gcgctgtttttgttgtgtgtgc

SEQ ID NO: 4959208 - DNA, 14 bp, Homo sapiens
gcgcttcccagcac

SEQ ID NO: 4959209 - DNA, 20 bp, Homo sapiens
gcggaacaaggagtcagaca

SEQ ID NO: 4959210 - DNA, 19 bp, Homo sapiens
gcggactcctcctttctcc

SEQ ID NO: 4959211 - DNA, 19 bp, Homo sapiens
gcggagacggagtcccacc

SEQ ID NO: 4959212 - DNA, 20 bp, Homo sapiens
gcggccagccccggccctgg

SEQ ID NO: 4959213 - DNA, 21 bp, Homo sapiens
gcggccagccccggccctggg

SEQ ID NO: 4959214 - DNA, 13 bp, Homo sapiens
gcggcccctcccg

SEQ ID NO: 4959215 - DNA, 14 bp, Homo sapiens
gcggcgggcggctg

SEQ ID NO: 4959216 - DNA, 21 bp, Homo sapiens
gcgggagcggtggccctgtcc

SEQ ID NO: 4959217 - DNA, 20 bp, Homo sapiens
gcgggaggatgttctgggac

SEQ ID NO: 4959218 - DNA, 21 bp, Homo sapiens
gcgggaggatgttctgggaca

SEQ ID NO: 4959219 - DNA, 15 bp, Homo sapiens
gctcagccctccctg

SEQ ID NO: 4959220 - DNA, 17 bp, Homo sapiens
gctcagccctccctgcc

SEQ ID NO: 4959221 - DNA, 19 bp, Homo sapiens
gctcagccctccctgcccc

SEQ ID NO: 4959222 - DNA, 21 bp, Homo sapiens
gctcagccctccctgcccctc

SEQ ID NO: 4959223 - DNA, 15 bp, Homo sapiens
gctcagcggggacag

SEQ ID NO: 4959224 - DNA, 19 bp, Homo sapiens
gctcagcggggacagctcc

SEQ ID NO: 4959225 - DNA, 19 bp, Homo sapiens
gctcagctcggggagcctt

SEQ ID NO: 4959226 - DNA, 22 bp, Homo sapiens
gctcaggcgatccacctgtctc

SEQ ID NO: 4959227 - DNA, 12 bp, Homo sapiens
gctcaggctgca

SEQ ID NO: 4959228 - DNA, 15 bp, Homo sapiens
gctcaggggcagctc

SEQ ID NO: 4959229 - DNA, 14 bp, Homo sapiens
gctcaggtgtccct

SEQ ID NO: 4959230 - DNA, 18 bp, Homo sapiens
gctcatattttgtatata

SEQ ID NO: 4959231 - DNA, 13 bp, Homo sapiens
gctcatctgttgt

SEQ ID NO: 4959232 - DNA, 12 bp, Homo sapiens
gctcatttaagt

SEQ ID NO: 4959233 - DNA, 18 bp, Homo sapiens
gctccaagacctaggctc

SEQ ID NO: 4959234 - DNA, 17 bp, Homo sapiens
gctccaagattctagat

SEQ ID NO: 4959235 - DNA, 20 bp, Homo sapiens
gctccaccagcatcacctgc

SEQ ID NO: 4959236 - DNA, 23 bp, Homo sapiens
gctccaccagcatcacctgcctg

SEQ ID NO: 4959237 - DNA, 14 bp, Homo sapiens
gctccacccttggc

SEQ ID NO: 4959238 - DNA, 15 bp, Homo sapiens
gctccacccttggcc

SEQ ID NO: 4959239 - DNA, 16 bp, Homo sapiens
gctccacccttggcct

SEQ ID NO: 4959240 - DNA, 19 bp, Homo sapiens
gctccacccttggcctgtc

SEQ ID NO: 4959241 - DNA, 22 bp, Homo sapiens
gctccacccttggcctgtctca

SEQ ID NO: 4959242 - DNA, 12 bp, Homo sapiens
gctccactgtca

SEQ ID NO: 4959243 - DNA, 21 bp, Homo sapiens
gctccagaatttggaaatcct

SEQ ID NO: 4959244 - DNA, 23 bp, Homo sapiens
gctccagcaacacagcctgggcc

SEQ ID NO: 4959245 - DNA, 14 bp, Homo sapiens
gctccagctcacca

SEQ ID NO: 4959246 - DNA, 18 bp, Homo sapiens
gctccagctcaccagccc

SEQ ID NO: 4959247 - DNA, 20 bp, Homo sapiens
gctccagctcaccagcccca

SEQ ID NO: 4959248 - DNA, 21 bp, Homo sapiens
gctccagctcaccagccccag

SEQ ID NO: 4959249 - DNA, 24 bp, Homo sapiens
gctccaggctcctttagcgcccag

SEQ ID NO: 4959250 - DNA, 20 bp, Homo sapiens
gctccagggaatccaagcct

SEQ ID NO: 4959251 - DNA, 21 bp, Homo sapiens
gctccagggaatccaagcctc

SEQ ID NO: 4959252 - DNA, 16 bp, Homo sapiens
gctccaggtggctctg

SEQ ID NO: 4959253 - DNA, 15 bp, Homo sapiens
gctcccacaggccct

SEQ ID NO: 4959254 - DNA, 17 bp, Homo sapiens
gctcccacaggcccttc

SEQ ID NO: 4959255 - DNA, 21 bp, Homo sapiens
gctcccacaggcccttcctct

SEQ ID NO: 4959256 - DNA, 16 bp, Homo sapiens
gctcccacattctgat

SEQ ID NO: 4959257 - DNA, 15 bp, Homo sapiens
gctccccagccctgg

SEQ ID NO: 4959258 - DNA, 21 bp, Homo sapiens
gctccccagccctggctctgc

SEQ ID NO: 4959259 - DNA, 20 bp, Homo sapiens
gctccctcccctgccctggt

SEQ ID NO: 4959260 - DNA, 13 bp, Homo sapiens
gctccctgaagcc

SEQ ID NO: 4959261 - DNA, 16 bp, Homo sapiens
gctccctgaagccagc

SEQ ID NO: 4959262 - DNA, 22 bp, Homo sapiens
gctccctgtgacaaaattttat

SEQ ID NO: 4959263 - DNA, 15 bp, Homo sapiens
gctcccttcagcccc

SEQ ID NO: 4959264 - DNA, 19 bp, Homo sapiens
gctcccttcagcccccagc

SEQ ID NO: 4959265 - DNA, 23 bp, Homo sapiens
gctcccttcagcccccagcccct

SEQ ID NO: 4959266 - DNA, 20 bp, Homo sapiens
gctccgcccttagtccccca

SEQ ID NO: 4959267 - DNA, 15 bp, Homo sapiens
gctccgctgccgtgc

SEQ ID NO: 4959268 - DNA, 23 bp, Homo sapiens
gctccgctttctacccagcgagc

SEQ ID NO: 4959269 - DNA, 14 bp, Homo sapiens
gctcctcactgccc

SEQ ID NO: 4959270 - DNA, 23 bp, Homo sapiens
gctcctcactgcccgcacaccct

SEQ ID NO: 4959271 - DNA, 16 bp, Homo sapiens
gctcctcccggtgccc

SEQ ID NO: 4959272 - DNA, 15 bp, Homo sapiens
gctcctctccccagc

SEQ ID NO: 4959273 - DNA, 19 bp, Homo sapiens
gctcctctccccagcaagt

SEQ ID NO: 4959274 - DNA, 18 bp, Homo sapiens
gctcctctcctggaggat

SEQ ID NO: 4959275 - DNA, 17 bp, Homo sapiens
gctcctctgtcctgctt

SEQ ID NO: 4959276 - DNA, 19 bp, Homo sapiens
gctcctctgtcctgcttct

SEQ ID NO: 4959277 - DNA, 18 bp, Homo sapiens
gctcctgaggggcatctg

SEQ ID NO: 4959278 - DNA, 21 bp, Homo sapiens
gctcctgaggggcatctgccc

SEQ ID NO: 4959279 - DNA, 13 bp, Homo sapiens
gctcctgtcctcc

SEQ ID NO: 4959280 - DNA, 13 bp, Homo sapiens
gctccttcccatc

SEQ ID NO: 4959281 - DNA, 19 bp, Homo sapiens
gctccttggcttacctgac

SEQ ID NO: 4959282 - DNA, 20 bp, Homo sapiens
gctcgatccaaattgtgctt

SEQ ID NO: 4959283 - DNA, 18 bp, Homo sapiens
gctcggaggctgcccccg

SEQ ID NO: 4959284 - DNA, 22 bp, Homo sapiens
gctctacagctaatcagcattc

SEQ ID NO: 4959285 - DNA, 17 bp, Homo sapiens
gctctacatcttctgcc

SEQ ID NO: 4959286 - DNA, 19 bp, Homo sapiens
gctctacatcttctgcctt

SEQ ID NO: 4959287 - DNA, 20 bp, Homo sapiens
gctctacatcttctgcctta

SEQ ID NO: 4959288 - DNA, 20 bp, Homo sapiens
gctctagatcataaggcttc

SEQ ID NO: 4959289 - DNA, 22 bp, Homo sapiens
gctctagatcataaggcttcaa

SEQ ID NO: 4959290 - DNA, 23 bp, Homo sapiens
gctctagattgagagaagagaca

SEQ ID NO: 4959291 - DNA, 21 bp, Homo sapiens
gctctagggttgctggagcct

SEQ ID NO: 4959292 - DNA, 23 bp, Homo sapiens
gctctagggttgctggagcctga

SEQ ID NO: 4959293 - DNA, 18 bp, Homo sapiens
gctctatctctcaaaact

SEQ ID NO: 4959294 - DNA, 14 bp, Homo sapiens
gctctatgagtcta

SEQ ID NO: 4959295 - DNA, 21 bp, Homo sapiens
gctctatgagtctagatgttt

SEQ ID NO: 4959296 - DNA, 19 bp, Homo sapiens
gctctcccctgccctgctg

SEQ ID NO: 4959297 - DNA, 11 bp, Homo sapiens
gctctctgctg

SEQ ID NO: 4959298 - DNA, 14 bp, Homo sapiens
gctctcttcctgcc

SEQ ID NO: 4959299 - DNA, 15 bp, Homo sapiens
gctctcttcctgccc

SEQ ID NO: 4959300 - DNA, 18 bp, Homo sapiens
gctctcttcctgcccctc

SEQ ID NO: 4959301 - DNA, 20 bp, Homo sapiens
gctctcttcctgcccctctt

SEQ ID NO: 4959302 - DNA, 22 bp, Homo sapiens
gctctgaagtcacatcacagga

SEQ ID NO: 4959303 - DNA, 23 bp, Homo sapiens
gctctgaagtcacatcacaggac

SEQ ID NO: 4959304 - DNA, 14 bp, Homo sapiens
gctctgagagtcta

SEQ ID NO: 4959305 - DNA, 21 bp, Homo sapiens
gctctgagagtctagattctc

SEQ ID NO: 4959306 - DNA, 22 bp, Homo sapiens
gctctgatcatccactgtgcca

SEQ ID NO: 4959307 - DNA, 15 bp, Homo sapiens
gctctgcacccctct

SEQ ID NO: 4959308 - DNA, 13 bp, Homo sapiens
gctctgctcctct

SEQ ID NO: 4959309 - DNA, 18 bp, Homo sapiens
gctctgctgacagacaca

SEQ ID NO: 4959310 - DNA, 15 bp, Homo sapiens
gctctgtcctgggag

SEQ ID NO: 4959311 - DNA, 12 bp, Homo sapiens
gctcttcaggcc

SEQ ID NO: 4959312 - DNA, 18 bp, Homo sapiens
gctcttcaggcctccctc

SEQ ID NO: 4959313 - DNA, 14 bp, Homo sapiens
gctcttctccaggc

SEQ ID NO: 4959314 - DNA, 17 bp, Homo sapiens
gctcttgatacccccct

SEQ ID NO: 4959315 - DNA, 20 bp, Homo sapiens
gctcttgatacccccctctg

SEQ ID NO: 4959316 - DNA, 22 bp, Homo sapiens
gctcttgatacccccctctgtc

SEQ ID NO: 4959317 - DNA, 17 bp, Homo sapiens
gctctttcgtcaccctt

SEQ ID NO: 4959318 - DNA, 23 bp, Homo sapiens
gctctttgaaatagtctgtgtga

SEQ ID NO: 4959319 - DNA, 18 bp, Homo sapiens
gctctttggtagaaaagg

SEQ ID NO: 4959320 - DNA, 17 bp, Homo sapiens
gctcttttttactcatt

SEQ ID NO: 4959321 - DNA, 21 bp, Homo sapiens
gctcttttttactcattgaaa

SEQ ID NO: 4959322 - DNA, 20 bp, Homo sapiens
gctcttttttgtttgtttct

SEQ ID NO: 4959323 - DNA, 12 bp, Homo sapiens
gctgaaaatata

SEQ ID NO: 4959324 - DNA, 13 bp, Homo sapiens
gctgaaagttctt

SEQ ID NO: 4959325 - DNA, 13 bp, Homo sapiens
gctgaatgcctcc

SEQ ID NO: 4959326 - DNA, 14 bp, Homo sapiens
gctgaatgcctcct

SEQ ID NO: 4959327 - DNA, 15 bp, Homo sapiens
gctgacagacacagg

SEQ ID NO: 4959328 - DNA, 16 bp, Homo sapiens
gctttaaactcaggga

SEQ ID NO: 4959329 - DNA, 18 bp, Homo sapiens
gctttaaactcagggaca

SEQ ID NO: 4959330 - DNA, 21 bp, Homo sapiens
gctttatgataatagattctc

SEQ ID NO: 4959331 - DNA, 23 bp, Homo sapiens
gctttatgttcatttgtttgttt

SEQ ID NO: 4959332 - DNA, 17 bp, Homo sapiens
gctttattccagaatgc

SEQ ID NO: 4959333 - DNA, 21 bp, Homo sapiens
gctttatttgttttttttgtt

SEQ ID NO: 4959334 - DNA, 19 bp, Homo sapiens
gctttcgtgtaaattatgt

SEQ ID NO: 4959335 - DNA, 13 bp, Homo sapiens
gctttctacccag

SEQ ID NO: 4959336 - DNA, 19 bp, Homo sapiens
gctttctacccagcgagcc

SEQ ID NO: 4959337 - DNA, 12 bp, Homo sapiens
gctttctagaag

SEQ ID NO: 4959338 - DNA, 14 bp, Homo sapiens
gctttctcttttct

SEQ ID NO: 4959339 - DNA, 19 bp, Homo sapiens
gctttctcttttctctttt

SEQ ID NO: 4959340 - DNA, 20 bp, Homo sapiens
gctttcttgctcccttcagc

SEQ ID NO: 4959341 - DNA, 21 bp, Homo sapiens
gctttcttgctcccttcagcc

SEQ ID NO: 4959342 - DNA, 19 bp, Homo sapiens
gctttctttgattctcctt

SEQ ID NO: 4959343 - DNA, 22 bp, Homo sapiens
gctttgagaagccttcagctcc

SEQ ID NO: 4959344 - DNA, 15 bp, Homo sapiens
gctttgagtccccca

SEQ ID NO: 4959345 - DNA, 21 bp, Homo sapiens
gctttgctcttgtcccacgtg

SEQ ID NO: 4959346 - DNA, 17 bp, Homo sapiens
gctttggatttgacatt

SEQ ID NO: 4959347 - DNA, 14 bp, Homo sapiens
gctttgggctgccc

SEQ ID NO: 4959348 - DNA, 16 bp, Homo sapiens
gctttgggctgccctg

SEQ ID NO: 4959349 - DNA, 18 bp, Homo sapiens
gctttgggctgccctggt

SEQ ID NO: 4959350 - DNA, 19 bp, Homo sapiens
gctttgggctgccctggtg

SEQ ID NO: 4959351 - DNA, 18 bp, Homo sapiens
gctttggggtgtcttttt

SEQ ID NO: 4959352 - DNA, 15 bp, Homo sapiens
gctttgtatgcactt

SEQ ID NO: 4959353 - DNA, 19 bp, Homo sapiens
gctttgtgtttggtttaca

SEQ ID NO: 4959354 - DNA, 20 bp, Homo sapiens
gctttgtgtttggtttacat

SEQ ID NO: 4959355 - DNA, 14 bp, Homo sapiens
gcttttcactgctg

SEQ ID NO: 4959356 - DNA, 18 bp, Homo sapiens
gcttttcactgctggctg

SEQ ID NO: 4959357 - DNA, 17 bp, Homo sapiens
gcttttccctcttttct

SEQ ID NO: 4959358 - DNA, 20 bp, Homo sapiens
gctttttaattgttgtttct

SEQ ID NO: 4959359 - DNA, 21 bp, Homo sapiens
gctttttatttctgcatatgt

SEQ ID NO: 4959360 - DNA, 13 bp, Homo sapiens
gctttttcacagt

SEQ ID NO: 4959361 - DNA, 15 bp, Homo sapiens
gctttttcacagtca

SEQ ID NO: 4959362 - DNA, 13 bp, Homo sapiens
gctttttccagag

SEQ ID NO: 4959363 - DNA, 14 bp, Homo sapiens
gctttttgaaatga

SEQ ID NO: 4959364 - DNA, 17 bp, Homo sapiens
gcttttttttttccagc

SEQ ID NO: 4959365 - DNA, 19 bp, Homo sapiens
ggaaaaaaatcatctattt

SEQ ID NO: 4959366 - DNA, 17 bp, Homo sapiens
ggaaaaaaatgaatgag

SEQ ID NO: 4959367 - DNA, 13 bp, Homo sapiens
ggaaaaagaaaat

SEQ ID NO: 4959368 - DNA, 20 bp, Homo sapiens
ggaaaaagaaaataaagaca

SEQ ID NO: 4959369 - DNA, 23 bp, Homo sapiens
ggaaaaagctccatgtgcctctt

SEQ ID NO: 4959370 - DNA, 14 bp, Homo sapiens
ggaaaagaaaaaaa

SEQ ID NO: 4959371 - DNA, 20 bp, Homo sapiens
ggaaaagctgctgacagtgt

SEQ ID NO: 4959372 - DNA, 22 bp, Homo sapiens
ggaaataaaacctttcaaattt

SEQ ID NO: 4959373 - DNA, 18 bp, Homo sapiens
ggaaatacccttctttta

SEQ ID NO: 4959374 - DNA, 20 bp, Homo sapiens
ggaaatcctagtttcctctc

SEQ ID NO: 4959375 - DNA, 22 bp, Homo sapiens
ggaaatcctagtttcctctcct

SEQ ID NO: 4959376 - DNA, 18 bp, Homo sapiens
ggaaatctcaccccatcc

SEQ ID NO: 4959377 - DNA, 18 bp, Homo sapiens
ggaaatctgtaacaggta

SEQ ID NO: 4959378 - DNA, 17 bp, Homo sapiens
ggaaatgtcaacaagta

SEQ ID NO: 4959379 - DNA, 23 bp, Homo sapiens
ggaaattcaggtgaaaatgttca

SEQ ID NO: 4959380 - DNA, 17 bp, Homo sapiens
ggaacaaaaaaaccaca

SEQ ID NO: 4959381 - DNA, 13 bp, Homo sapiens
ggaacagaaggat

SEQ ID NO: 4959382 - DNA, 20 bp, Homo sapiens
ggaacagacaacagaagtca

SEQ ID NO: 4959383 - DNA, 15 bp, Homo sapiens
ggaacatcctttgca

SEQ ID NO: 4959384 - DNA, 20 bp, Homo sapiens
ggaacatcctttgcagggca

SEQ ID NO: 4959385 - DNA, 15 bp, Homo sapiens
ggaaccaagcaggag

SEQ ID NO: 4959386 - DNA, 15 bp, Homo sapiens
ggaacctctgtctca

SEQ ID NO: 4959387 - DNA, 22 bp, Homo sapiens
ggaacctgtcctaaggaacctt

SEQ ID NO: 4959388 - DNA, 20 bp, Homo sapiens
ggaaccttccttcctgcttg

SEQ ID NO: 4959389 - DNA, 16 bp, Homo sapiens
ggaaccttgctgtcct

SEQ ID NO: 4959390 - DNA, 13 bp, Homo sapiens
ggaacgcagatga

SEQ ID NO: 4959391 - DNA, 22 bp, Homo sapiens
ggaacggtgaaggtgacagcag

SEQ ID NO: 4959392 - DNA, 13 bp, Homo sapiens
ggaactccttggc

SEQ ID NO: 4959393 - DNA, 17 bp, Homo sapiens
ggaactccttggcctag

SEQ ID NO: 4959394 - DNA, 18 bp, Homo sapiens
ggaactctatctgggcct

SEQ ID NO: 4959395 - DNA, 21 bp, Homo sapiens
ggaactctatctgggcctggg

SEQ ID NO: 4959396 - DNA, 16 bp, Homo sapiens
ggaactctgacaaggg

SEQ ID NO: 4959397 - DNA, 15 bp, Homo sapiens
ggaactgtccagaga

SEQ ID NO: 4959398 - DNA, 17 bp, Homo sapiens
ggaactgtccagagagc

SEQ ID NO: 4959399 - DNA, 23 bp, Homo sapiens
ggaagaaaaaaatcttctccaga

SEQ ID NO: 4959400 - DNA, 14 bp, Homo sapiens
ggaagaaaatggtt

SEQ ID NO: 4959401 - DNA, 20 bp, Homo sapiens
ggaagaaaatggtttatttt

SEQ ID NO: 4959402 - DNA, 19 bp, Homo sapiens
ggaagaaacactttctctt

SEQ ID NO: 4959403 - DNA, 15 bp, Homo sapiens
ggaagacatttcttt

SEQ ID NO: 4959404 - DNA, 23 bp, Homo sapiens
ggaagacatttcttttcttttta

SEQ ID NO: 4959405 - DNA, 15 bp, Homo sapiens
ggaagacgcctgagc

SEQ ID NO: 4959406 - DNA, 16 bp, Homo sapiens
ggaagacgcctgagct

SEQ ID NO: 4959407 - DNA, 14 bp, Homo sapiens
ggaagatatacatg

SEQ ID NO: 4959408 - DNA, 17 bp, Homo sapiens
ggaagcacagcttcatt

SEQ ID NO: 4959409 - DNA, 16 bp, Homo sapiens
ggaagcgctcagaaca

SEQ ID NO: 4959410 - DNA, 17 bp, Homo sapiens
ggaagcgctcagaacag

SEQ ID NO: 4959411 - DNA, 16 bp, Homo sapiens
ggaagctaatttgcat

SEQ ID NO: 4959412 - DNA, 10 bp, Homo sapiens
ggaagctgca

SEQ ID NO: 4959413 - DNA, 12 bp, Homo sapiens
ggaagctgcagc

SEQ ID NO: 4959414 - DNA, 13 bp, Homo sapiens
ggaagctgcagct

SEQ ID NO: 4959415 - DNA, 18 bp, Homo sapiens
ggaagctgcagcttggga

SEQ ID NO: 4959416 - DNA, 15 bp, Homo sapiens
ggaagctggcctgag

SEQ ID NO: 4959417 - DNA, 19 bp, Homo sapiens
ggaaggaaagaaagaagga

SEQ ID NO: 4959418 - DNA, 13 bp, Homo sapiens
ggaaggattgtaa

SEQ ID NO: 4959419 - DNA, 22 bp, Homo sapiens
ggaaggcagacagcaggcagcg

SEQ ID NO: 4959420 - DNA, 22 bp, Homo sapiens
ggaaggccaaggggagtcacct

SEQ ID NO: 4959421 - DNA, 21 bp, Homo sapiens
ggaagggggggctacattata

SEQ ID NO: 4959422 - DNA, 15 bp, Homo sapiens
ggaagtccaatgtgg

SEQ ID NO: 4959423 - DNA, 16 bp, Homo sapiens
ggaagtccaatgtggc

SEQ ID NO: 4959424 - DNA, 20 bp, Homo sapiens
ggaagtggtggctgtggaag

SEQ ID NO: 4959425 - DNA, 14 bp, Homo sapiens
ggaataaaaggctt

SEQ ID NO: 4959426 - DNA, 17 bp, Homo sapiens
ggaataaaaggcttgaa

SEQ ID NO: 4959427 - DNA, 20 bp, Homo sapiens
ggaataagaagcaaataaat

SEQ ID NO: 4959428 - DNA, 16 bp, Homo sapiens
ggaatcaagagctgcc

SEQ ID NO: 4959429 - DNA, 17 bp, Homo sapiens
ggaatcaagagctgccc

SEQ ID NO: 4959430 - DNA, 23 bp, Homo sapiens
ggaatcaagagctgccctccttg

SEQ ID NO: 4959431 - DNA, 19 bp, Homo sapiens
ggaatcatgtcaggcctgt

SEQ ID NO: 4959432 - DNA, 16 bp, Homo sapiens
ggaatccagacccggc

SEQ ID NO: 4959433 - DNA, 22 bp, Homo sapiens
ggaatcctatatagaatgctgc

SEQ ID NO: 4959434 - DNA, 13 bp, Homo sapiens
ggaatcctggcag

SEQ ID NO: 4959435 - DNA, 17 bp, Homo sapiens
ggaattgatttgcattg

SEQ ID NO: 4959436 - DNA, 13 bp, Homo sapiens
ggacaataaacct

SEQ ID NO: 4959437 - DNA, 21 bp, Homo sapiens
ggacaatcatgaaatatgcat

SEQ ID NO: 4959438 - DNA, 18 bp, Homo sapiens
ggagctggttagaaatgc

SEQ ID NO: 4959439 - DNA, 15 bp, Homo sapiens
ggagcttgggaatgg

SEQ ID NO: 4959440 - DNA, 19 bp, Homo sapiens
ggagctttgttttgggggt

SEQ ID NO: 4959441 - DNA, 11 bp, Homo sapiens
ggaggaaggat

SEQ ID NO: 4959442 - DNA, 13 bp, Homo sapiens
ggaggaaggattg

SEQ ID NO: 4959443 - DNA, 14 bp, Homo sapiens
ggaggacaaaactt

SEQ ID NO: 4959444 - DNA, 22 bp, Homo sapiens
ggaggacaggcgggaggaggtg

SEQ ID NO: 4959445 - DNA, 22 bp, Homo sapiens
ggaggacctgaccctactccct

SEQ ID NO: 4959446 - DNA, 13 bp, Homo sapiens
ggaggacctgggg

SEQ ID NO: 4959447 - DNA, 18 bp, Homo sapiens
ggaggatcagttttttgt

SEQ ID NO: 4959448 - DNA, 20 bp, Homo sapiens
ggaggatgtccctgggccag

SEQ ID NO: 4959449 - DNA, 21 bp, Homo sapiens
ggaggatgtccctgggccagg

SEQ ID NO: 4959450 - DNA, 18 bp, Homo sapiens
ggaggatgttctgggaca

SEQ ID NO: 4959451 - DNA, 21 bp, Homo sapiens
ggaggatgttctgggacacag

SEQ ID NO: 4959452 - DNA, 20 bp, Homo sapiens
ggaggattgcttgagcccag

SEQ ID NO: 4959453 - DNA, 22 bp, Homo sapiens
ggaggattgcttgagcccagga

SEQ ID NO: 4959454 - DNA, 12 bp, Homo sapiens
ggaggcagagtt

SEQ ID NO: 4959455 - DNA, 21 bp, Homo sapiens
ggaggcagagtttgccttcct

SEQ ID NO: 4959456 - DNA, 11 bp, Homo sapiens
ggaggcagcct

SEQ ID NO: 4959457 - DNA, 16 bp, Homo sapiens
ggaggcatggccctgg

SEQ ID NO: 4959458 - DNA, 17 bp, Homo sapiens
ggaggcatggccctggg

SEQ ID NO: 4959459 - DNA, 19 bp, Homo sapiens
ggaggccttccagctgctg

SEQ ID NO: 4959460 - DNA, 13 bp, Homo sapiens
ggaggctgccccc

SEQ ID NO: 4959461 - DNA, 22 bp, Homo sapiens
ggaggctgcccccggccccctg

SEQ ID NO: 4959462 - DNA, 13 bp, Homo sapiens
ggaggctggcagg

SEQ ID NO: 4959463 - DNA, 18 bp, Homo sapiens
ggaggggcctggcagccg

SEQ ID NO: 4959464 - DNA, 22 bp, Homo sapiens
ggaggggcgcccacctccccac

SEQ ID NO: 4959465 - DNA, 15 bp, Homo sapiens
ggagggggagaaaag

SEQ ID NO: 4959466 - DNA, 13 bp, Homo sapiens
ggaggtgcctgga

SEQ ID NO: 4959467 - DNA, 16 bp, Homo sapiens
ggaggtgggagcagga

SEQ ID NO: 4959468 - DNA, 17 bp, Homo sapiens
ggagtatgtctgatgga

SEQ ID NO: 4959469 - DNA, 22 bp, Homo sapiens
ggagtcaccttcccttgccact

SEQ ID NO: 4959470 - DNA, 16 bp, Homo sapiens
ggagtcccaaggaaag

SEQ ID NO: 4959471 - DNA, 15 bp, Homo sapiens
ggagtcccctcacct

SEQ ID NO: 4959472 - DNA, 18 bp, Homo sapiens
ggagtctgtcctgtgacg

SEQ ID NO: 4959473 - DNA, 18 bp, Homo sapiens
ggagtgacagaggcagcc

SEQ ID NO: 4959474 - DNA, 19 bp, Homo sapiens
ggagtgacagaggcagccc

SEQ ID NO: 4959475 - DNA, 18 bp, Homo sapiens
ggagtgctggctcacagt

SEQ ID NO: 4959476 - DNA, 20 bp, Homo sapiens
ggagtgggtgacaagagcct

SEQ ID NO: 4959477 - DNA, 16 bp, Homo sapiens
ggagttctatgctctc

SEQ ID NO: 4959478 - DNA, 12 bp, Homo sapiens
ggagtttctaag

SEQ ID NO: 4959479 - DNA, 14 bp, Homo sapiens
ggataggagcctgc

SEQ ID NO: 4959480 - DNA, 15 bp, Homo sapiens
ggatcagagcaggac

SEQ ID NO: 4959481 - DNA, 17 bp, Homo sapiens
ggatcagagcaggacct

SEQ ID NO: 4959482 - DNA, 21 bp, Homo sapiens
ggatcagttaactattgcatt

SEQ ID NO: 4959483 - DNA, 13 bp, Homo sapiens
ggatcataaagtt

SEQ ID NO: 4959484 - DNA, 19 bp, Homo sapiens
ggatcatcaacaagatttc

SEQ ID NO: 4959485 - DNA, 16 bp, Homo sapiens
ggatctcagctttgag

SEQ ID NO: 4959486 - DNA, 16 bp, Homo sapiens
ggatgagagcccagag

SEQ ID NO: 4959487 - DNA, 20 bp, Homo sapiens
ggatgaggtggtggagtgga

SEQ ID NO: 4959488 - DNA, 16 bp, Homo sapiens
ggatgattcagaaatt

SEQ ID NO: 4959489 - DNA, 21 bp, Homo sapiens
ggatgcaacacgcatggtcaa

SEQ ID NO: 4959490 - DNA, 13 bp, Homo sapiens
ggatgcctggtgg

SEQ ID NO: 4959491 - DNA, 18 bp, Homo sapiens
ggatgcctggtggcagct

SEQ ID NO: 4959492 - DNA, 22 bp, Homo sapiens
ggatgtccctgggccagggtct

SEQ ID NO: 4959493 - DNA, 18 bp, Homo sapiens
ggatgtgattgtggaatg

SEQ ID NO: 4959494 - DNA, 15 bp, Homo sapiens
ggatgtgggagggag

SEQ ID NO: 4959495 - DNA, 19 bp, Homo sapiens
ggattatttaataacatta

SEQ ID NO: 4959496 - DNA, 21 bp, Homo sapiens
ggattcaggaatgtgtggcct

SEQ ID NO: 4959497 - DNA, 15 bp, Homo sapiens
ggattcaggctgctt

SEQ ID NO: 4959498 - DNA, 12 bp, Homo sapiens
ggattccatgct

SEQ ID NO: 4959499 - DNA, 20 bp, Homo sapiens
ggattgaacttctttgaatt

SEQ ID NO: 4959500 - DNA, 19 bp, Homo sapiens
ggattgcaatatctgaagc

SEQ ID NO: 4959501 - DNA, 22 bp, Homo sapiens
ggattgtaaaaaaaaatgcctt

SEQ ID NO: 4959502 - DNA, 16 bp, Homo sapiens
ggattgttaatttcag

SEQ ID NO: 4959503 - DNA, 13 bp, Homo sapiens
ggattgtttatac

SEQ ID NO: 4959504 - DNA, 14 bp, Homo sapiens
ggatttaatttcca

SEQ ID NO: 4959505 - DNA, 16 bp, Homo sapiens
ggcaaaatccttgctt

SEQ ID NO: 4959506 - DNA, 11 bp, Homo sapiens
ggcaaatctgc

SEQ ID NO: 4959507 - DNA, 21 bp, Homo sapiens
ggcaaatgacatgcactgacc

SEQ ID NO: 4959508 - DNA, 21 bp, Homo sapiens
ggcaaatttttattttttagt

SEQ ID NO: 4959509 - DNA, 12 bp, Homo sapiens
ggcaacagagca

SEQ ID NO: 4959510 - DNA, 16 bp, Homo sapiens
ggcaaccactaagaat

SEQ ID NO: 4959511 - DNA, 17 bp, Homo sapiens
ggcaacctgattgtaaa

SEQ ID NO: 4959512 - DNA, 18 bp, Homo sapiens
ggcaacctgattgtaaac

SEQ ID NO: 4959513 - DNA, 17 bp, Homo sapiens
ggcaagcacctcctgcc

SEQ ID NO: 4959514 - DNA, 18 bp, Homo sapiens
ggcaagcacctcctgcct

SEQ ID NO: 4959515 - DNA, 23 bp, Homo sapiens
ggcaagctgtgacttctccaggt

SEQ ID NO: 4959516 - DNA, 12 bp, Homo sapiens
ggcaaggaaaaa

SEQ ID NO: 4959517 - DNA, 13 bp, Homo sapiens
ggcaagtgtgggc

SEQ ID NO: 4959518 - DNA, 14 bp, Homo sapiens
ggcaatgctggctg

SEQ ID NO: 4959519 - DNA, 23 bp, Homo sapiens
ggcaatgctggctgttggctggg

SEQ ID NO: 4959520 - DNA, 19 bp, Homo sapiens
ggcaattccaatatttctg

SEQ ID NO: 4959521 - DNA, 23 bp, Homo sapiens
ggcacaagtcctggatgttgtgt

SEQ ID NO: 4959522 - DNA, 18 bp, Homo sapiens
ggcacaccgggcactcag

SEQ ID NO: 4959523 - DNA, 22 bp, Homo sapiens
ggcacaggactgattctgggat

SEQ ID NO: 4959524 - DNA, 14 bp, Homo sapiens
ggcacaggccccct

SEQ ID NO: 4959525 - DNA, 15 bp, Homo sapiens
ggcacaggccccctt

SEQ ID NO: 4959526 - DNA, 14 bp, Homo sapiens
ggcacagggagaag

SEQ ID NO: 4959527 - DNA, 14 bp, Homo sapiens
ggcacagtccagga

SEQ ID NO: 4959528 - DNA, 16 bp, Homo sapiens
ggcaccaaagatgcag

SEQ ID NO: 4959529 - DNA, 17 bp, Homo sapiens
ggcaccaaagatgcagc

SEQ ID NO: 4959530 - DNA, 20 bp, Homo sapiens
ggcacccaccatcatgtctg

SEQ ID NO: 4959531 - DNA, 17 bp, Homo sapiens
ggcacccggcccctgct

SEQ ID NO: 4959532 - DNA, 19 bp, Homo sapiens
ggcaccctgtggccctggc

SEQ ID NO: 4959533 - DNA, 23 bp, Homo sapiens
ggcactaacgttgagcccctgga

SEQ ID NO: 4959534 - DNA, 20 bp, Homo sapiens
ggcactagcctttggctctg

SEQ ID NO: 4959535 - DNA, 19 bp, Homo sapiens
ggcactcagaagacactga

SEQ ID NO: 4959536 - DNA, 20 bp, Homo sapiens
ggcactcagaagacactgat

SEQ ID NO: 4959537 - DNA, 23 bp, Homo sapiens
ggcactcagaagacactgatggg

SEQ ID NO: 4959538 - DNA, 13 bp, Homo sapiens
ggcactggcccag

SEQ ID NO: 4959539 - DNA, 14 bp, Homo sapiens
ggcactggcccagg

SEQ ID NO: 4959540 - DNA, 20 bp, Homo sapiens
ggcactgggatgagccgctg

SEQ ID NO: 4959541 - DNA, 21 bp, Homo sapiens
ggcactgggatgagccgctgt

SEQ ID NO: 4959542 - DNA, 20 bp, Homo sapiens
ggcactgtagttctaagact

SEQ ID NO: 4959543 - DNA, 16 bp, Homo sapiens
ggcacttgattccttg

SEQ ID NO: 4959544 - DNA, 14 bp, Homo sapiens
ggcacttgcctggg

SEQ ID NO: 4959545 - DNA, 15 bp, Homo sapiens
ggcagaagacaccag

SEQ ID NO: 4959546 - DNA, 18 bp, Homo sapiens
ggcagaataagaaaacaa

SEQ ID NO: 4959547 - DNA, 19 bp, Homo sapiens
ggcagaataatctttgggt

SEQ ID NO: 4959548 - DNA, 15 bp, Homo sapiens
ggccctgcagtgttc

SEQ ID NO: 4959549 - DNA, 23 bp, Homo sapiens
ggccctgcagtgttcgcttggct

SEQ ID NO: 4959550 - DNA, 13 bp, Homo sapiens
ggccctgctgccc

SEQ ID NO: 4959551 - DNA, 18 bp, Homo sapiens
ggccctgggctcggaggc

SEQ ID NO: 4959552 - DNA, 21 bp, Homo sapiens
ggccctgggctcggaggctgc

SEQ ID NO: 4959553 - DNA, 22 bp, Homo sapiens
ggccctggtgcgaatggacttt

SEQ ID NO: 4959554 - DNA, 20 bp, Homo sapiens
ggccctgtccctcccacctc

SEQ ID NO: 4959555 - DNA, 13 bp, Homo sapiens
ggcccttcctctc

SEQ ID NO: 4959556 - DNA, 17 bp, Homo sapiens
ggcccttcctctccact

SEQ ID NO: 4959557 - DNA, 18 bp, Homo sapiens
ggccctttgaagcctcag

SEQ ID NO: 4959558 - DNA, 20 bp, Homo sapiens
ggccctttgaagcctcagct

SEQ ID NO: 4959559 - DNA, 14 bp, Homo sapiens
ggccgatggagaca

SEQ ID NO: 4959560 - DNA, 20 bp, Homo sapiens
ggccgatttgggaaccaagc

SEQ ID NO: 4959561 - DNA, 19 bp, Homo sapiens
ggccggctgtgctcagaga

SEQ ID NO: 4959562 - DNA, 16 bp, Homo sapiens
ggccgtgggggttgag

SEQ ID NO: 4959563 - DNA, 18 bp, Homo sapiens
ggcctaaaactggcctga

SEQ ID NO: 4959564 - DNA, 20 bp, Homo sapiens
ggcctacagctttgatccct

SEQ ID NO: 4959565 - DNA, 16 bp, Homo sapiens
ggcctagcccaccctg

SEQ ID NO: 4959566 - DNA, 13 bp, Homo sapiens
ggcctaggattct

SEQ ID NO: 4959567 - DNA, 20 bp, Homo sapiens
ggcctatgcacatatggact

SEQ ID NO: 4959568 - DNA, 18 bp, Homo sapiens
ggcctcaaaggcccgctc

SEQ ID NO: 4959569 - DNA, 18 bp, Homo sapiens
ggcctcaccgagtggggg

SEQ ID NO: 4959570 - DNA, 21 bp, Homo sapiens
ggcctcctcttcaccccggca

SEQ ID NO: 4959571 - DNA, 22 bp, Homo sapiens
ggcctcctcttcaccccggcag

SEQ ID NO: 4959572 - DNA, 22 bp, Homo sapiens
ggcctcgggacacctgccctgc

SEQ ID NO: 4959573 - DNA, 16 bp, Homo sapiens
ggcctcgggacctcag

SEQ ID NO: 4959574 - DNA, 14 bp, Homo sapiens
ggcctctctccctc

SEQ ID NO: 4959575 - DNA, 20 bp, Homo sapiens
ggcctctgtgtccttccctg

SEQ ID NO: 4959576 - DNA, 13 bp, Homo sapiens
ggcctgagagaat

SEQ ID NO: 4959577 - DNA, 21 bp, Homo sapiens
ggcctgagcgtccagaaatgg

SEQ ID NO: 4959578 - DNA, 17 bp, Homo sapiens
ggcctgatgctccctcc

SEQ ID NO: 4959579 - DNA, 23 bp, Homo sapiens
ggcctgatgctccctcccctgcc

SEQ ID NO: 4959580 - DNA, 13 bp, Homo sapiens
ggcctgcacacaa

SEQ ID NO: 4959581 - DNA, 14 bp, Homo sapiens
ggcctgcacacaag

SEQ ID NO: 4959582 - DNA, 13 bp, Homo sapiens
ggcctgcactaat

SEQ ID NO: 4959583 - DNA, 19 bp, Homo sapiens
ggcctgcagcaggagtggt

SEQ ID NO: 4959584 - DNA, 20 bp, Homo sapiens
ggcctgcagcaggagtggtg

SEQ ID NO: 4959585 - DNA, 12 bp, Homo sapiens
ggcctgcctggc

SEQ ID NO: 4959586 - DNA, 14 bp, Homo sapiens
ggcctggccacctc

SEQ ID NO: 4959587 - DNA, 16 bp, Homo sapiens
ggcctggccacctctc

SEQ ID NO: 4959588 - DNA, 17 bp, Homo sapiens
ggcctggccacctctct

SEQ ID NO: 4959589 - DNA, 16 bp, Homo sapiens
ggcctggccagatgca

SEQ ID NO: 4959590 - DNA, 21 bp, Homo sapiens
ggcctggccagatgcaccagc

SEQ ID NO: 4959591 - DNA, 16 bp, Homo sapiens
ggcctggccaggagct

SEQ ID NO: 4959592 - DNA, 14 bp, Homo sapiens
ggcctggcctggcc

SEQ ID NO: 4959593 - DNA, 13 bp, Homo sapiens
ggcctgggctagg

SEQ ID NO: 4959594 - DNA, 17 bp, Homo sapiens
ggcctgggctaggggac

SEQ ID NO: 4959595 - DNA, 15 bp, Homo sapiens
ggcctggggcctgag

SEQ ID NO: 4959596 - DNA, 16 bp, Homo sapiens
ggcctggggcctgaga

SEQ ID NO: 4959597 - DNA, 18 bp, Homo sapiens
ggcctggggcctgagaga

SEQ ID NO: 4959598 - DNA, 17 bp, Homo sapiens
ggcctgtctcatcccca

SEQ ID NO: 4959599 - DNA, 19 bp, Homo sapiens
ggcctgtctcatccccagg

SEQ ID NO: 4959600 - DNA, 20 bp, Homo sapiens
ggcctgtctcatccccaggg

SEQ ID NO: 4959601 - DNA, 22 bp, Homo sapiens
ggcctgtgtgtgaaaggaagct

SEQ ID NO: 4959602 - DNA, 16 bp, Homo sapiens
ggccttagtgggccag

SEQ ID NO: 4959603 - DNA, 15 bp, Homo sapiens
ggccttctctgaagg

SEQ ID NO: 4959604 - DNA, 23 bp, Homo sapiens
ggccttgacatcagttcctttgt

SEQ ID NO: 4959605 - DNA, 12 bp, Homo sapiens
ggcctttcctct

SEQ ID NO: 4959606 - DNA, 13 bp, Homo sapiens
ggcctttcctctc

SEQ ID NO: 4959607 - DNA, 15 bp, Homo sapiens
ggcgagagaggagcc

SEQ ID NO: 4959608 - DNA, 17 bp, Homo sapiens
ggcgatccacctgtctc

SEQ ID NO: 4959609 - DNA, 18 bp, Homo sapiens
ggcgatccacctgtctca

SEQ ID NO: 4959610 - DNA, 11 bp, Homo sapiens
ggcgcaggagg

SEQ ID NO: 4959611 - DNA, 14 bp, Homo sapiens
ggcgcccacctccc

SEQ ID NO: 4959612 - DNA, 16 bp, Homo sapiens
ggcgcggccagccccg

SEQ ID NO: 4959613 - DNA, 16 bp, Homo sapiens
ggcgctattacaaata

SEQ ID NO: 4959614 - DNA, 22 bp, Homo sapiens
ggcggaaagcctgtaagcctgc

SEQ ID NO: 4959615 - DNA, 16 bp, Homo sapiens
ggcgtggcaaatataa

SEQ ID NO: 4959616 - DNA, 22 bp, Homo sapiens
ggcgtgtatctggtatatgtaa

SEQ ID NO: 4959617 - DNA, 15 bp, Homo sapiens
ggctactgcagcttt

SEQ ID NO: 4959618 - DNA, 18 bp, Homo sapiens
ggctagaggccagcccca

SEQ ID NO: 4959619 - DNA, 18 bp, Homo sapiens
ggctagagtcctcactcc

SEQ ID NO: 4959620 - DNA, 15 bp, Homo sapiens
ggctagttgggcttc

SEQ ID NO: 4959621 - DNA, 19 bp, Homo sapiens
ggctatagctacaggaagc

SEQ ID NO: 4959622 - DNA, 17 bp, Homo sapiens
ggctatggacacagggt

SEQ ID NO: 4959623 - DNA, 19 bp, Homo sapiens
ggctatgggggcactgagg

SEQ ID NO: 4959624 - DNA, 17 bp, Homo sapiens
ggctcactgcagcctca

SEQ ID NO: 4959625 - DNA, 15 bp, Homo sapiens
ggctcagagggggac

SEQ ID NO: 4959626 - DNA, 21 bp, Homo sapiens
ggctcagagggggactgctgc

SEQ ID NO: 4959627 - DNA, 19 bp, Homo sapiens
ggctcagcggggacagctc

SEQ ID NO: 4959628 - DNA, 20 bp, Homo sapiens
ggctcagcggggacagctcc

SEQ ID NO: 4959629 - DNA, 22 bp, Homo sapiens
ggctcagcggggacagctcctt

SEQ ID NO: 4959630 - DNA, 16 bp, Homo sapiens
ggctcaggtcacataa

SEQ ID NO: 4959631 - DNA, 18 bp, Homo sapiens
ggctccaagacctaggct

SEQ ID NO: 4959632 - DNA, 13 bp, Homo sapiens
ggctccaggctcc

SEQ ID NO: 4959633 - DNA, 15 bp, Homo sapiens
ggctccaggctcctt

SEQ ID NO: 4959634 - DNA, 17 bp, Homo sapiens
ggctcccacaggccctt

SEQ ID NO: 4959635 - DNA, 18 bp, Homo sapiens
ggctcccacaggcccttc

SEQ ID NO: 4959636 - DNA, 15 bp, Homo sapiens
ggctccgaacaccct

SEQ ID NO: 4959637 - DNA, 22 bp, Homo sapiens
ggctccgcccttagtcccccaa

SEQ ID NO: 4959638 - DNA, 17 bp, Homo sapiens
ggctcctcccggtgccc

SEQ ID NO: 4959639 - DNA, 21 bp, Homo sapiens
ggctcgagcagtcctgcctca

SEQ ID NO: 4959640 - DNA, 16 bp, Homo sapiens
ggctcggaggctgccc

SEQ ID NO: 4959641 - DNA, 22 bp, Homo sapiens
ggctctagatcataaggcttca

SEQ ID NO: 4959642 - DNA, 23 bp, Homo sapiens
ggctctatgagtctagatgttta

SEQ ID NO: 4959643 - DNA, 19 bp, Homo sapiens
ggctctcagctcagcgcca

SEQ ID NO: 4959644 - DNA, 18 bp, Homo sapiens
ggctctgagagtctagat

SEQ ID NO: 4959645 - DNA, 18 bp, Homo sapiens
ggctctggactctaaaga

SEQ ID NO: 4959646 - DNA, 16 bp, Homo sapiens
ggctctggagacagcc

SEQ ID NO: 4959647 - DNA, 15 bp, Homo sapiens
ggctctggagagaaa

SEQ ID NO: 4959648 - DNA, 12 bp, Homo sapiens
ggctcttctcct

SEQ ID NO: 4959649 - DNA, 23 bp, Homo sapiens
ggctcttctcctttcacaacctt

SEQ ID NO: 4959650 - DNA, 20 bp, Homo sapiens
ggctcttgatacccccctct

SEQ ID NO: 4959651 - DNA, 23 bp, Homo sapiens
ggctcttgtgctggatggagccc

SEQ ID NO: 4959652 - DNA, 17 bp, Homo sapiens
ggctgacctgcctctca

SEQ ID NO: 4959653 - DNA, 23 bp, Homo sapiens
ggctgacctgcctctcacacaca

SEQ ID NO: 4959654 - DNA, 23 bp, Homo sapiens
ggctgacgtgtgagggaggacag

SEQ ID NO: 4959655 - DNA, 14 bp, Homo sapiens
ggctgagggcagct

SEQ ID NO: 4959656 - DNA, 16 bp, Homo sapiens
ggctgcagctggacag

SEQ ID NO: 4959657 - DNA, 19 bp, Homo sapiens
ggctgcagctggacagagg

SEQ ID NO: 4959658 - DNA, 23 bp, Homo sapiens
gggcacaccgggcactcagaaga

SEQ ID NO: 4959659 - DNA, 15 bp, Homo sapiens
gggcacactctgcca

SEQ ID NO: 4959660 - DNA, 15 bp, Homo sapiens
gggcacagtccagga

SEQ ID NO: 4959661 - DNA, 16 bp, Homo sapiens
gggcactcagaagaca

SEQ ID NO: 4959662 - DNA, 14 bp, Homo sapiens
gggcactggcccag

SEQ ID NO: 4959663 - DNA, 21 bp, Homo sapiens
gggcagagcccccaggaagcc

SEQ ID NO: 4959664 - DNA, 13 bp, Homo sapiens
gggcagccaggct

SEQ ID NO: 4959665 - DNA, 18 bp, Homo sapiens
gggcagcctcccccggct

SEQ ID NO: 4959666 - DNA, 18 bp, Homo sapiens
gggcaggaaggagagcct

SEQ ID NO: 4959667 - DNA, 12 bp, Homo sapiens
gggcaggctggg

SEQ ID NO: 4959668 - DNA, 13 bp, Homo sapiens
gggcaggctgggc

SEQ ID NO: 4959669 - DNA, 14 bp, Homo sapiens
gggcagggtgaccc

SEQ ID NO: 4959670 - DNA, 23 bp, Homo sapiens
gggcagtgctagtgagctgggca

SEQ ID NO: 4959671 - DNA, 23 bp, Homo sapiens
gggcatatcggctcacaaagaga

SEQ ID NO: 4959672 - DNA, 14 bp, Homo sapiens
gggcatgccttgtg

SEQ ID NO: 4959673 - DNA, 15 bp, Homo sapiens
gggcatggccaggtg

SEQ ID NO: 4959674 - DNA, 20 bp, Homo sapiens
gggcatggtaccagccctgg

SEQ ID NO: 4959675 - DNA, 13 bp, Homo sapiens
gggccaaaaggaa

SEQ ID NO: 4959676 - DNA, 23 bp, Homo sapiens
gggccaaatccgctctcttcctg

SEQ ID NO: 4959677 - DNA, 17 bp, Homo sapiens
gggccaagacttggcaa

SEQ ID NO: 4959678 - DNA, 23 bp, Homo sapiens
gggccacagagaaagtacttctc

SEQ ID NO: 4959679 - DNA, 19 bp, Homo sapiens
gggccaccaaagctgccca

SEQ ID NO: 4959680 - DNA, 20 bp, Homo sapiens
gggccactgtggtggcagtg

SEQ ID NO: 4959681 - DNA, 22 bp, Homo sapiens
gggccagaggaactgtccagag

SEQ ID NO: 4959682 - DNA, 23 bp, Homo sapiens
gggccagaggaactgtccagaga

SEQ ID NO: 4959683 - DNA, 13 bp, Homo sapiens
gggccaggcaggt

SEQ ID NO: 4959684 - DNA, 23 bp, Homo sapiens
gggccaggcaggtgcctggacat

SEQ ID NO: 4959685 - DNA, 20 bp, Homo sapiens
gggccagggctgccctgaga

SEQ ID NO: 4959686 - DNA, 22 bp, Homo sapiens
gggccagtcctgcctggccagg

SEQ ID NO: 4959687 - DNA, 17 bp, Homo sapiens
gggccagtggggcctgt

SEQ ID NO: 4959688 - DNA, 16 bp, Homo sapiens
gggccatgtccaaaga

SEQ ID NO: 4959689 - DNA, 14 bp, Homo sapiens
gggcccagaggctg

SEQ ID NO: 4959690 - DNA, 22 bp, Homo sapiens
gggccccccagctcaggggcag

SEQ ID NO: 4959691 - DNA, 21 bp, Homo sapiens
gggccctccgaccacttccag

SEQ ID NO: 4959692 - DNA, 19 bp, Homo sapiens
gggccctgccctggcaggg

SEQ ID NO: 4959693 - DNA, 13 bp, Homo sapiens
gggccgaccagag

SEQ ID NO: 4959694 - DNA, 14 bp, Homo sapiens
gggcctcagtgcca

SEQ ID NO: 4959695 - DNA, 15 bp, Homo sapiens
gggcctcagtgccac

SEQ ID NO: 4959696 - DNA, 14 bp, Homo sapiens
gggcctccagaact

SEQ ID NO: 4959697 - DNA, 14 bp, Homo sapiens
gggcctcgggacct

SEQ ID NO: 4959698 - DNA, 10 bp, Homo sapiens
gggcctggca

SEQ ID NO: 4959699 - DNA, 13 bp, Homo sapiens
gggcctggggcct

SEQ ID NO: 4959700 - DNA, 17 bp, Homo sapiens
gggcctggggcctgaga

SEQ ID NO: 4959701 - DNA, 19 bp, Homo sapiens
gggcctggggcctgagaga

SEQ ID NO: 4959702 - DNA, 22 bp, Homo sapiens
gggcctgtggaatgagtgtgca

SEQ ID NO: 4959703 - DNA, 17 bp, Homo sapiens
gggccttagtgggccag

SEQ ID NO: 4959704 - DNA, 18 bp, Homo sapiens
gggccttagtgggccagg

SEQ ID NO: 4959705 - DNA, 20 bp, Homo sapiens
gggccttagtgggccagggc

SEQ ID NO: 4959706 - DNA, 12 bp, Homo sapiens
gggcgaggcagg

SEQ ID NO: 4959707 - DNA, 13 bp, Homo sapiens
gggcgcccacctc

SEQ ID NO: 4959708 - DNA, 18 bp, Homo sapiens
gggcgcgatcccacacag

SEQ ID NO: 4959709 - DNA, 16 bp, Homo sapiens
gggctatggacacagg

SEQ ID NO: 4959710 - DNA, 14 bp, Homo sapiens
gggctcctcccagc

SEQ ID NO: 4959711 - DNA, 14 bp, Homo sapiens
gggctcctgcaggc

SEQ ID NO: 4959712 - DNA, 18 bp, Homo sapiens
gggctcctggcagaaggg

SEQ ID NO: 4959713 - DNA, 19 bp, Homo sapiens
gggctctctgctgtacata

SEQ ID NO: 4959714 - DNA, 20 bp, Homo sapiens
gggctctgcaattcccctct

SEQ ID NO: 4959715 - DNA, 15 bp, Homo sapiens
gggctctgccccagt

SEQ ID NO: 4959716 - DNA, 20 bp, Homo sapiens
gggctgactagaagggccag

SEQ ID NO: 4959717 - DNA, 23 bp, Homo sapiens
gggctgagctggggacctggtac

SEQ ID NO: 4959718 - DNA, 21 bp, Homo sapiens
gggctgccctggtgctgccac

SEQ ID NO: 4959719 - DNA, 14 bp, Homo sapiens
gggctgctcctcat

SEQ ID NO: 4959720 - DNA, 17 bp, Homo sapiens
gggctggccagttggaa

SEQ ID NO: 4959721 - DNA, 22 bp, Homo sapiens
gggctggccccagggcaccctg

SEQ ID NO: 4959722 - DNA, 20 bp, Homo sapiens
gggcttataataaaggactg

SEQ ID NO: 4959723 - DNA, 19 bp, Homo sapiens
gggcttcagtggcagctgc

SEQ ID NO: 4959724 - DNA, 23 bp, Homo sapiens
ggggaacatttctgtaaatacca

SEQ ID NO: 4959725 - DNA, 21 bp, Homo sapiens
ggggaacctgccatgccagga

SEQ ID NO: 4959726 - DNA, 18 bp, Homo sapiens
ggggaagaagcagagaga

SEQ ID NO: 4959727 - DNA, 19 bp, Homo sapiens
ggggaagctgcagcttggg

SEQ ID NO: 4959728 - DNA, 21 bp, Homo sapiens
ggggaaggagggtacagctgg

SEQ ID NO: 4959729 - DNA, 22 bp, Homo sapiens
ggggaaggagggtacagctggg

SEQ ID NO: 4959730 - DNA, 17 bp, Homo sapiens
ggggaaggccaagggga

SEQ ID NO: 4959731 - DNA, 22 bp, Homo sapiens
ggggacagaggcctgcccgggc

SEQ ID NO: 4959732 - DNA, 12 bp, Homo sapiens
ggggacaggcct

SEQ ID NO: 4959733 - DNA, 11 bp, Homo sapiens
ggggagaaagt

SEQ ID NO: 4959734 - DNA, 23 bp, Homo sapiens
ggggaggacctgaccctactccc

SEQ ID NO: 4959735 - DNA, 18 bp, Homo sapiens
ggggatgtgggagggagc

SEQ ID NO: 4959736 - DNA, 15 bp, Homo sapiens
ggggcaggctgggcc

SEQ ID NO: 4959737 - DNA, 16 bp, Homo sapiens
ggggcaggctgggcca

SEQ ID NO: 4959738 - DNA, 14 bp, Homo sapiens
ggggcatctgcccc

SEQ ID NO: 4959739 - DNA, 20 bp, Homo sapiens
ggggcatctgcccctccccc

SEQ ID NO: 4959740 - DNA, 15 bp, Homo sapiens
ggggcatgaccagat

SEQ ID NO: 4959741 - DNA, 14 bp, Homo sapiens
ggggccaccaaagc

SEQ ID NO: 4959742 - DNA, 19 bp, Homo sapiens
ggggccaccaaagctgccc

SEQ ID NO: 4959743 - DNA, 13 bp, Homo sapiens
ggggccgggcaca

SEQ ID NO: 4959744 - DNA, 15 bp, Homo sapiens
ggggcctggacctgc

SEQ ID NO: 4959745 - DNA, 11 bp, Homo sapiens
ggggcctggca

SEQ ID NO: 4959746 - DNA, 14 bp, Homo sapiens
ggggcgaggcaggc

SEQ ID NO: 4959747 - DNA, 19 bp, Homo sapiens
ggggcgcccacctccccac

SEQ ID NO: 4959748 - DNA, 15 bp, Homo sapiens
ggggctacaagaggg

SEQ ID NO: 4959749 - DNA, 23 bp, Homo sapiens
ggggctctagggttgctggagcc

SEQ ID NO: 4959750 - DNA, 17 bp, Homo sapiens
ggggctctggagagaaa

SEQ ID NO: 4959751 - DNA, 18 bp, Homo sapiens
ggggctgttgaagtcacc

SEQ ID NO: 4959752 - DNA, 18 bp, Homo sapiens
gggggaacgatgtgtctg

SEQ ID NO: 4959753 - DNA, 18 bp, Homo sapiens
gggggaaggccaagggga

SEQ ID NO: 4959754 - DNA, 20 bp, Homo sapiens
gggggactctgagcgggagg

SEQ ID NO: 4959755 - DNA, 21 bp, Homo sapiens
gggggactctgagcgggaggc

SEQ ID NO: 4959756 - DNA, 19 bp, Homo sapiens
gggggactgctgctgcctg

SEQ ID NO: 4959757 - DNA, 20 bp, Homo sapiens
gggggcaagaagtagcagtg

SEQ ID NO: 4959758 - DNA, 15 bp, Homo sapiens
ggggggccaaaagga

SEQ ID NO: 4959759 - DNA, 20 bp, Homo sapiens
gggggtcaggcagccagtga

SEQ ID NO: 4959760 - DNA, 16 bp, Homo sapiens
gggtaatgagaggtgg

SEQ ID NO: 4959761 - DNA, 13 bp, Homo sapiens
gggtacccactgc

SEQ ID NO: 4959762 - DNA, 21 bp, Homo sapiens
gggtcatgtttgcaggggtga

SEQ ID NO: 4959763 - DNA, 13 bp, Homo sapiens
gggtcctggctcc

SEQ ID NO: 4959764 - DNA, 22 bp, Homo sapiens
gggtcgtttgcttttcagggtt

SEQ ID NO: 4959765 - DNA, 22 bp, Homo sapiens
gggtctcactatgttgcccagg

SEQ ID NO: 4959766 - DNA, 12 bp, Homo sapiens
gggtctcactct

SEQ ID NO: 4959767 - DNA, 14 bp, Homo sapiens
gggtctcactctgt

SEQ ID NO: 4959768 - DNA, 24 bp, Homo sapiens
gggtctgtgtgaatgtgggcactg

SEQ ID NO: 4959769 - DNA, 23 bp, Homo sapiens
gggtcttccctacctcaggcagg

SEQ ID NO: 4959770 - DNA, 16 bp, Homo sapiens
gggtgacaagagcctg

SEQ ID NO: 4959771 - DNA, 22 bp, Homo sapiens
gggtgacagtcatcatcagggc

SEQ ID NO: 4959772 - DNA, 13 bp, Homo sapiens
gggtgacggccct

SEQ ID NO: 4959773 - DNA, 20 bp, Homo sapiens
gggtgagatgctggagaaga

SEQ ID NO: 4959774 - DNA, 15 bp, Homo sapiens
gggtgcagctgagaa

SEQ ID NO: 4959775 - DNA, 12 bp, Homo sapiens
gggtgctcagaa

SEQ ID NO: 4959776 - DNA, 13 bp, Homo sapiens
gggtgctcagaat

SEQ ID NO: 4959777 - DNA, 21 bp, Homo sapiens
gggtggacaaactggagtctg

SEQ ID NO: 4959778 - DNA, 11 bp, Homo sapiens
gggtggcctcg

SEQ ID NO: 4959779 - DNA, 21 bp, Homo sapiens
gggtgggggccacctgcctgc

SEQ ID NO: 4959780 - DNA, 20 bp, Homo sapiens
gggtgtctttttttggtgat

SEQ ID NO: 4959781 - DNA, 18 bp, Homo sapiens
gggttccctttccttcca

SEQ ID NO: 4959782 - DNA, 12 bp, Homo sapiens
gggttgaaaatt

SEQ ID NO: 4959783 - DNA, 15 bp, Homo sapiens
gggttgctggagcct

SEQ ID NO: 4959784 - DNA, 15 bp, Homo sapiens
gggttgggctggtgt

SEQ ID NO: 4959785 - DNA, 15 bp, Homo sapiens
gggttggggtgacag

SEQ ID NO: 4959786 - DNA, 15 bp, Homo sapiens
gggttgtgtgtctgt

SEQ ID NO: 4959787 - DNA, 17 bp, Homo sapiens
gggtttgccatttgata

SEQ ID NO: 4959788 - DNA, 22 bp, Homo sapiens
ggtaatcaatgaatattgaagt

SEQ ID NO: 4959789 - DNA, 15 bp, Homo sapiens
ggtaccaatgctgca

SEQ ID NO: 4959790 - DNA, 18 bp, Homo sapiens
ggtaccagccctggggct

SEQ ID NO: 4959791 - DNA, 11 bp, Homo sapiens
ggtacccactg

SEQ ID NO: 4959792 - DNA, 19 bp, Homo sapiens
ggtacccctttctggctct

SEQ ID NO: 4959793 - DNA, 21 bp, Homo sapiens
ggtacttagagtttctgtttg

SEQ ID NO: 4959794 - DNA, 21 bp, Homo sapiens
ggtacttgtggacacagctct

SEQ ID NO: 4959795 - DNA, 17 bp, Homo sapiens
ggtagagccacaaaaga

SEQ ID NO: 4959796 - DNA, 14 bp, Homo sapiens
ggtagcttttccct

SEQ ID NO: 4959797 - DNA, 15 bp, Homo sapiens
ggtagggaggcagcc

SEQ ID NO: 4959798 - DNA, 23 bp, Homo sapiens
ggtatatctgggctggccagttg

SEQ ID NO: 4959799 - DNA, 12 bp, Homo sapiens
ggtatgtttaat

SEQ ID NO: 4959800 - DNA, 16 bp, Homo sapiens
ggtattttgaatacca

SEQ ID NO: 4959801 - DNA, 21 bp, Homo sapiens
ggtatttttttgtaattgctt

SEQ ID NO: 4959802 - DNA, 23 bp, Homo sapiens
ggtcaacatcttttacattctgc

SEQ ID NO: 4959803 - DNA, 14 bp, Homo sapiens
ggtcaatgctattt

SEQ ID NO: 4959804 - DNA, 15 bp, Homo sapiens
ggtcacagcctcctc

SEQ ID NO: 4959805 - DNA, 19 bp, Homo sapiens
ggtcagaagagttgtgcac

SEQ ID NO: 4959806 - DNA, 12 bp, Homo sapiens
ggtcagagcctg

SEQ ID NO: 4959807 - DNA, 14 bp, Homo sapiens
ggtcagagcctgca

SEQ ID NO: 4959808 - DNA, 16 bp, Homo sapiens
ggtcagagcctgcagt

SEQ ID NO: 4959809 - DNA, 14 bp, Homo sapiens
ggtcaggcagccag

SEQ ID NO: 4959810 - DNA, 13 bp, Homo sapiens
ggtcaggccctgg

SEQ ID NO: 4959811 - DNA, 17 bp, Homo sapiens
ggtcaggccctggaact

SEQ ID NO: 4959812 - DNA, 23 bp, Homo sapiens
ggtcagggagtgctggctcacag

SEQ ID NO: 4959813 - DNA, 14 bp, Homo sapiens
ggtcaggtttaaca

SEQ ID NO: 4959814 - DNA, 15 bp, Homo sapiens
ggtcaggtttaacat

SEQ ID NO: 4959815 - DNA, 17 bp, Homo sapiens
ggtcaggtttaacattt

SEQ ID NO: 4959816 - DNA, 18 bp, Homo sapiens
ggtcaggtttaacatttg

SEQ ID NO: 4959817 - DNA, 18 bp, Homo sapiens
ggtcatgtgggtcttcca

SEQ ID NO: 4959818 - DNA, 14 bp, Homo sapiens
ggtcatgtttgcag

SEQ ID NO: 4959819 - DNA, 12 bp, Homo sapiens
ggtccacccagg

SEQ ID NO: 4959820 - DNA, 13 bp, Homo sapiens
ggtccacccagga

SEQ ID NO: 4959821 - DNA, 22 bp, Homo sapiens
ggtccagcctcgttggaagagg

SEQ ID NO: 4959822 - DNA, 21 bp, Homo sapiens
ggtccagggaagctggccgag

SEQ ID NO: 4959823 - DNA, 16 bp, Homo sapiens
ggtccatcagcccctc

SEQ ID NO: 4959824 - DNA, 22 bp, Homo sapiens
ggtcccacctccagcccgggag

SEQ ID NO: 4959825 - DNA, 14 bp, Homo sapiens
ggtcccactcagtc

SEQ ID NO: 4959826 - DNA, 17 bp, Homo sapiens
ggtccctccccttctct

SEQ ID NO: 4959827 - DNA, 23 bp, Homo sapiens
ggtcccttgcagctagttttcta

SEQ ID NO: 4959828 - DNA, 18 bp, Homo sapiens
ggtccggacactcctaga

SEQ ID NO: 4959829 - DNA, 16 bp, Homo sapiens
ggtcctaaaagcaaaa

SEQ ID NO: 4959830 - DNA, 14 bp, Homo sapiens
ggtcctcagagaat

SEQ ID NO: 4959831 - DNA, 13 bp, Homo sapiens
ggtcctctggagc

SEQ ID NO: 4959832 - DNA, 15 bp, Homo sapiens
ggtcctggctcctga

SEQ ID NO: 4959833 - DNA, 20 bp, Homo sapiens
ggtcgaccccaaagcccctt

SEQ ID NO: 4959834 - DNA, 21 bp, Homo sapiens
ggtctacactgcaatcatatg

SEQ ID NO: 4959835 - DNA, 14 bp, Homo sapiens
ggtctatggggaga

SEQ ID NO: 4959836 - DNA, 16 bp, Homo sapiens
ggtctcactctgtcgc

SEQ ID NO: 4959837 - DNA, 21 bp, Homo sapiens
ggtctcaggatatccttatca

SEQ ID NO: 4959838 - DNA, 19 bp, Homo sapiens
ggtctctctctctctacaa

SEQ ID NO: 4959839 - DNA, 20 bp, Homo sapiens
ggtctcttactttcctttcc

SEQ ID NO: 4959840 - DNA, 15 bp, Homo sapiens
ggtctcttctcccag

SEQ ID NO: 4959841 - DNA, 17 bp, Homo sapiens
ggtctcttctcccagaa

SEQ ID NO: 4959842 - DNA, 14 bp, Homo sapiens
ggtctgacccactg

SEQ ID NO: 4959843 - DNA, 15 bp, Homo sapiens
ggtctgacccactgc

SEQ ID NO: 4959844 - DNA, 15 bp, Homo sapiens
ggtctgtttaaagtg

SEQ ID NO: 4959845 - DNA, 22 bp, Homo sapiens
ggtcttccctacctcaggcagg

SEQ ID NO: 4959846 - DNA, 13 bp, Homo sapiens
ggtcttgatctcc

SEQ ID NO: 4959847 - DNA, 12 bp, Homo sapiens
ggtctttgtaag

SEQ ID NO: 4959848 - DNA, 13 bp, Homo sapiens
ggtctttgtaaga

SEQ ID NO: 4959849 - DNA, 20 bp, Homo sapiens
ggtctttgtaagagtgtaga

SEQ ID NO: 4959850 - DNA, 17 bp, Homo sapiens
ggtctttttatgcattt

SEQ ID NO: 4959851 - DNA, 13 bp, Homo sapiens
ggtgaaagggagc

SEQ ID NO: 4959852 - DNA, 18 bp, Homo sapiens
ggtgaaccacttcattct

SEQ ID NO: 4959853 - DNA, 18 bp, Homo sapiens
ggtgaatggccttccttc

SEQ ID NO: 4959854 - DNA, 13 bp, Homo sapiens
ggtgacaagagcc

SEQ ID NO: 4959855 - DNA, 21 bp, Homo sapiens
ggtgacagagtgagactctgt

SEQ ID NO: 4959856 - DNA, 12 bp, Homo sapiens
ggtgacagtcat

SEQ ID NO: 4959857 - DNA, 21 bp, Homo sapiens
ggtgacctctgcctgaagtca

SEQ ID NO: 4959858 - DNA, 16 bp, Homo sapiens
ggtgacggttgggagc

SEQ ID NO: 4959859 - DNA, 12 bp, Homo sapiens
ggtgagaaaaaa

SEQ ID NO: 4959860 - DNA, 14 bp, Homo sapiens
ggtgagatgctgga

SEQ ID NO: 4959861 - DNA, 23 bp, Homo sapiens
ggtgagatgctggagaagagagg

SEQ ID NO: 4959862 - DNA, 18 bp, Homo sapiens
ggtgatccacccacctca

SEQ ID NO: 4959863 - DNA, 22 bp, Homo sapiens
ggtgcaacccaaggactgaggg

SEQ ID NO: 4959864 - DNA, 13 bp, Homo sapiens
ggtgcaaggaaaa

SEQ ID NO: 4959865 - DNA, 13 bp, Homo sapiens
ggtgcaatttcaa

SEQ ID NO: 4959866 - DNA, 18 bp, Homo sapiens
ggtgcatagaactgggta

SEQ ID NO: 4959867 - DNA, 16 bp, Homo sapiens
ggtgccactttaccca

SEQ ID NO: 4959868 - DNA, 19 bp, Homo sapiens
ggtgccactttacccacct

SEQ ID NO: 4959869 - DNA, 21 bp, Homo sapiens
ggtgcccacaccggggacagg

SEQ ID NO: 4959870 - DNA, 20 bp, Homo sapiens
ggtgctaaatggtcgcccag

SEQ ID NO: 4959871 - DNA, 20 bp, Homo sapiens
ggtgctcaccatgcttccag

SEQ ID NO: 4959872 - DNA, 21 bp, Homo sapiens
ggtgctgccatccaggttcag

SEQ ID NO: 4959873 - DNA, 21 bp, Homo sapiens
ggtgctggaggtgggagcagg

SEQ ID NO: 4959874 - DNA, 17 bp, Homo sapiens
ggtggacttagaaagca

SEQ ID NO: 4959875 - DNA, 18 bp, Homo sapiens
ggtggacttagaaagcag

SEQ ID NO: 4959876 - DNA, 19 bp, Homo sapiens
ggtggacttagaaagcagg

SEQ ID NO: 4959877 - DNA, 20 bp, Homo sapiens
ggtggacttagaaagcaggg

SEQ ID NO: 4959878 - DNA, 22 bp, Homo sapiens
gtcactcattgctgagcctctg

SEQ ID NO: 4959879 - DNA, 23 bp, Homo sapiens
gtcactcattgctgagcctctgc

SEQ ID NO: 4959880 - DNA, 16 bp, Homo sapiens
gtcactgacacaaagg

SEQ ID NO: 4959881 - DNA, 20 bp, Homo sapiens
gtcactgcacagtgcatctc

SEQ ID NO: 4959882 - DNA, 20 bp, Homo sapiens
gtcactgtactgacttgagg

SEQ ID NO: 4959883 - DNA, 17 bp, Homo sapiens
gtcactgttccttgtca

SEQ ID NO: 4959884 - DNA, 18 bp, Homo sapiens
gtcacttcgcgtgccctc

SEQ ID NO: 4959885 - DNA, 24 bp, Homo sapiens
gtcacttcgcgtgccctcgctgct

SEQ ID NO: 4959886 - DNA, 13 bp, Homo sapiens
gtcagaaactgtt

SEQ ID NO: 4959887 - DNA, 15 bp, Homo sapiens
gtcagaatgctattg

SEQ ID NO: 4959888 - DNA, 18 bp, Homo sapiens
gtcagacatccatgtttg

SEQ ID NO: 4959889 - DNA, 14 bp, Homo sapiens
gtcagagcctgcag

SEQ ID NO: 4959890 - DNA, 15 bp, Homo sapiens
gtcagatgagaacaa

SEQ ID NO: 4959891 - DNA, 21 bp, Homo sapiens
gtcagatgagaacaaagctgt

SEQ ID NO: 4959892 - DNA, 16 bp, Homo sapiens
gtcagcaatttaacta

SEQ ID NO: 4959893 - DNA, 14 bp, Homo sapiens
gtcaggcagccagt

SEQ ID NO: 4959894 - DNA, 20 bp, Homo sapiens
gtcaggcagccagtgagatg

SEQ ID NO: 4959895 - DNA, 13 bp, Homo sapiens
gtcaggcctgtgt

SEQ ID NO: 4959896 - DNA, 23 bp, Homo sapiens
gtcaggcctgtgtgtgaaaggaa

SEQ ID NO: 4959897 - DNA, 13 bp, Homo sapiens
gtcagggagtgct

SEQ ID NO: 4959898 - DNA, 22 bp, Homo sapiens
gtcagggagtgctggctcacag

SEQ ID NO: 4959899 - DNA, 16 bp, Homo sapiens
gtcaggtggggcagct

SEQ ID NO: 4959900 - DNA, 18 bp, Homo sapiens
gtcaggtggggcagcttg

SEQ ID NO: 4959901 - DNA, 16 bp, Homo sapiens
gtcaggtttaacattt

SEQ ID NO: 4959902 - DNA, 14 bp, Homo sapiens
gtcagtatccaggc

SEQ ID NO: 4959903 - DNA, 19 bp, Homo sapiens
gtcagtcatgatggcacca

SEQ ID NO: 4959904 - DNA, 14 bp, Homo sapiens
gtcagtgttgagat

SEQ ID NO: 4959905 - DNA, 22 bp, Homo sapiens
gtcatagaaattacacccaaag

SEQ ID NO: 4959906 - DNA, 17 bp, Homo sapiens
gtcatcatcagggcctg

SEQ ID NO: 4959907 - DNA, 23 bp, Homo sapiens
gtcatcatcagggcctggggcct

SEQ ID NO: 4959908 - DNA, 23 bp, Homo sapiens
gtcatcgctcgtgtgttctatcc

SEQ ID NO: 4959909 - DNA, 14 bp, Homo sapiens
gtcatgaagcccaa

SEQ ID NO: 4959910 - DNA, 15 bp, Homo sapiens
gtcatgatggcacca

SEQ ID NO: 4959911 - DNA, 17 bp, Homo sapiens
gtcatgtgggtcttcca

SEQ ID NO: 4959912 - DNA, 21 bp, Homo sapiens
gtcatgtgggtcttccagggg

SEQ ID NO: 4959913 - DNA, 15 bp, Homo sapiens
gtcatgtttgcaggg

SEQ ID NO: 4959914 - DNA, 23 bp, Homo sapiens
gtcatgtttgcaggggtgacggc

SEQ ID NO: 4959915 - DNA, 11 bp, Homo sapiens
gtcattaaatg

SEQ ID NO: 4959916 - DNA, 21 bp, Homo sapiens
gtcattatgggttaggcatta

SEQ ID NO: 4959917 - DNA, 15 bp, Homo sapiens
gtcattgtatgttat

SEQ ID NO: 4959918 - DNA, 16 bp, Homo sapiens
gtcatttattttaaaa

SEQ ID NO: 4959919 - DNA, 21 bp, Homo sapiens
gtcatttattttaaaaaatga

SEQ ID NO: 4959920 - DNA, 20 bp, Homo sapiens
gtcatttcattccattgcct

SEQ ID NO: 4959921 - DNA, 22 bp, Homo sapiens
gtcatttgagcagggctcagcg

SEQ ID NO: 4959922 - DNA, 21 bp, Homo sapiens
gtcatttgttgtgatgtcttt

SEQ ID NO: 4959923 - DNA, 16 bp, Homo sapiens
gtccaaaggaggctgg

SEQ ID NO: 4959924 - DNA, 12 bp, Homo sapiens
gtccaataagac

SEQ ID NO: 4959925 - DNA, 12 bp, Homo sapiens
gtccaatgtggc

SEQ ID NO: 4959926 - DNA, 12 bp, Homo sapiens
gtccacccagga

SEQ ID NO: 4959927 - DNA, 13 bp, Homo sapiens
gtccacctgtggg

SEQ ID NO: 4959928 - DNA, 11 bp, Homo sapiens
gtccagcctgg

SEQ ID NO: 4959929 - DNA, 12 bp, Homo sapiens
gtccagctggcc

SEQ ID NO: 4959930 - DNA, 17 bp, Homo sapiens
gtccagctggcctggac

SEQ ID NO: 4959931 - DNA, 12 bp, Homo sapiens
gtccaggaacaa

SEQ ID NO: 4959932 - DNA, 18 bp, Homo sapiens
gtccaggaacaagctaat

SEQ ID NO: 4959933 - DNA, 15 bp, Homo sapiens
gtccagggaagctgg

SEQ ID NO: 4959934 - DNA, 16 bp, Homo sapiens
gtccatattttcacag

SEQ ID NO: 4959935 - DNA, 19 bp, Homo sapiens
gtccatgtggttcttcaaa

SEQ ID NO: 4959936 - DNA, 22 bp, Homo sapiens
gtccatttatatatgaaaacta

SEQ ID NO: 4959937 - DNA, 16 bp, Homo sapiens
gtccatttgtaaaact

SEQ ID NO: 4959938 - DNA, 15 bp, Homo sapiens
gtcccaacttgtaaa

SEQ ID NO: 4959939 - DNA, 20 bp, Homo sapiens
gtcccaatggtcctgacttt

SEQ ID NO: 4959940 - DNA, 14 bp, Homo sapiens
gtcccacccccacc

SEQ ID NO: 4959941 - DNA, 17 bp, Homo sapiens
gtcccaccttggctgca

SEQ ID NO: 4959942 - DNA, 18 bp, Homo sapiens
gtcccaccttggctgcag

SEQ ID NO: 4959943 - DNA, 21 bp, Homo sapiens
gtcccaccttggctgcaggga

SEQ ID NO: 4959944 - DNA, 14 bp, Homo sapiens
gtcccacgtgtctt

SEQ ID NO: 4959945 - DNA, 21 bp, Homo sapiens
gtcccacgtgtcttccacttt

SEQ ID NO: 4959946 - DNA, 16 bp, Homo sapiens
gtcccagccaccccgg

SEQ ID NO: 4959947 - DNA, 21 bp, Homo sapiens
gtcccagccaccccgggctct

SEQ ID NO: 4959948 - DNA, 13 bp, Homo sapiens
gtcccatgtggtg

SEQ ID NO: 4959949 - DNA, 14 bp, Homo sapiens
gtccccagcccttc

SEQ ID NO: 4959950 - DNA, 19 bp, Homo sapiens
gtccccatggcaccctgct

SEQ ID NO: 4959951 - DNA, 16 bp, Homo sapiens
gtcccccaactctgag

SEQ ID NO: 4959952 - DNA, 15 bp, Homo sapiens
gtcccccaacttgag

SEQ ID NO: 4959953 - DNA, 18 bp, Homo sapiens
gtccccctatccttggca

SEQ ID NO: 4959954 - DNA, 23 bp, Homo sapiens
gtcccctgtcgagttcggctctg

SEQ ID NO: 4959955 - DNA, 17 bp, Homo sapiens
gtccctaaagaaaaaaa

SEQ ID NO: 4959956 - DNA, 21 bp, Homo sapiens
gtccctaccgagtctcttctc

SEQ ID NO: 4959957 - DNA, 13 bp, Homo sapiens
gtccctcccacct

SEQ ID NO: 4959958 - DNA, 17 bp, Homo sapiens
gtccctgggccagggtc

SEQ ID NO: 4959959 - DNA, 15 bp, Homo sapiens
gtcccttcacctcct

SEQ ID NO: 4959960 - DNA, 14 bp, Homo sapiens
gtcccttcccctcc

SEQ ID NO: 4959961 - DNA, 17 bp, Homo sapiens
gtcccttcccctccctg

SEQ ID NO: 4959962 - DNA, 19 bp, Homo sapiens
gtcccttcccctccctggc

SEQ ID NO: 4959963 - DNA, 18 bp, Homo sapiens
gtcccttgatgcacagag

SEQ ID NO: 4959964 - DNA, 13 bp, Homo sapiens
gtcccttgcagct

SEQ ID NO: 4959965 - DNA, 21 bp, Homo sapiens
gtccgaaagggacttggaagc

SEQ ID NO: 4959966 - DNA, 22 bp, Homo sapiens
gtccgaaagggacttggaagct

SEQ ID NO: 4959967 - DNA, 18 bp, Homo sapiens
gtccggacactcctagag

SEQ ID NO: 4959968 - DNA, 15 bp, Homo sapiens
gtccggtgttctaag

SEQ ID NO: 4959969 - DNA, 17 bp, Homo sapiens
gtccggtgttctaagat

SEQ ID NO: 4959970 - DNA, 16 bp, Homo sapiens
gtcctacccaccctcc

SEQ ID NO: 4959971 - DNA, 13 bp, Homo sapiens
gtcctatgtgtga

SEQ ID NO: 4959972 - DNA, 21 bp, Homo sapiens
gtcctcacccctgtcctcact

SEQ ID NO: 4959973 - DNA, 16 bp, Homo sapiens
gtcctcactcccagtc

SEQ ID NO: 4959974 - DNA, 17 bp, Homo sapiens
gtcctcactcccagtcc

SEQ ID NO: 4959975 - DNA, 18 bp, Homo sapiens
gtcctcactcccagtcca

SEQ ID NO: 4959976 - DNA, 13 bp, Homo sapiens
gtcctcagggagc

SEQ ID NO: 4959977 - DNA, 21 bp, Homo sapiens
gtcctccagaagcctctggct

SEQ ID NO: 4959978 - DNA, 23 bp, Homo sapiens
gtcctccatcccaacagccatgc

SEQ ID NO: 4959979 - DNA, 20 bp, Homo sapiens
gtcctcccatcccctggact

SEQ ID NO: 4959980 - DNA, 12 bp, Homo sapiens
gtcctcccctca

SEQ ID NO: 4959981 - DNA, 21 bp, Homo sapiens
gtcctcccctcacagcctctg

SEQ ID NO: 4959982 - DNA, 20 bp, Homo sapiens
gtcctctcccctccagcctt

SEQ ID NO: 4959983 - DNA, 21 bp, Homo sapiens
gtcctctcccctccagccttt

SEQ ID NO: 4959984 - DNA, 14 bp, Homo sapiens
gtcctcttttctga

SEQ ID NO: 4959985 - DNA, 21 bp, Homo sapiens
gtcctgagggtccccacctgg

SEQ ID NO: 4959986 - DNA, 15 bp, Homo sapiens
gtcctgatctgtgat

SEQ ID NO: 4959987 - DNA, 17 bp, Homo sapiens
gtcctgcctgcaatatt

SEQ ID NO: 4959988 - DNA, 18 bp, Homo sapiens
taagtattaaaacattgg

SEQ ID NO: 4959989 - DNA, 13 bp, Homo sapiens
taagtcagtgttg

SEQ ID NO: 4959990 - DNA, 15 bp, Homo sapiens
taagtcagtgttgag

SEQ ID NO: 4959991 - DNA, 11 bp, Homo sapiens
taagtctctgt

SEQ ID NO: 4959992 - DNA, 17 bp, Homo sapiens
taagtgcacacagaaat

SEQ ID NO: 4959993 - DNA, 19 bp, Homo sapiens
taagtgcacacagaaatat

SEQ ID NO: 4959994 - DNA, 22 bp, Homo sapiens
taagtgcacacagaaatatata

SEQ ID NO: 4959995 - DNA, 17 bp, Homo sapiens
taagtgcgtgtgtagag

SEQ ID NO: 4959996 - DNA, 18 bp, Homo sapiens
taagtgcgtgtgtagagt

SEQ ID NO: 4959997 - DNA, 13 bp, Homo sapiens
taagttcacatta

SEQ ID NO: 4959998 - DNA, 20 bp, Homo sapiens
taagtttcaaacttactatt

SEQ ID NO: 4959999 - DNA, 23 bp, Homo sapiens
taagtttcaaacttactattttg

SEQ ID NO: 4960000 - DNA, 16 bp, Homo sapiens
taagtttcaggtgaca

SEQ ID NO: 4960001 - DNA, 20 bp, Homo sapiens
taagtttcaggtgacatgtg

SEQ ID NO: 4960002 - DNA, 12 bp, Homo sapiens
taagtttctaag

SEQ ID NO: 4960003 - DNA, 13 bp, Homo sapiens
taagtttctaaga

SEQ ID NO: 4960004 - DNA, 19 bp, Homo sapiens
taagtttctaagattctaa

SEQ ID NO: 4960005 - DNA, 14 bp, Homo sapiens
taataaaaaatgga

SEQ ID NO: 4960006 - DNA, 20 bp, Homo sapiens
taataaaaaatggaaagaat

SEQ ID NO: 4960007 - DNA, 22 bp, Homo sapiens
taataaaacttaacttccaatg

SEQ ID NO: 4960008 - DNA, 13 bp, Homo sapiens
taataaaataatt

SEQ ID NO: 4960009 - DNA, 16 bp, Homo sapiens
taataaaataattcta

SEQ ID NO: 4960010 - DNA, 22 bp, Homo sapiens
taataaaatgtgttgaaactgc

SEQ ID NO: 4960011 - DNA, 15 bp, Homo sapiens
taataaacataatga

SEQ ID NO: 4960012 - DNA, 22 bp, Homo sapiens
taataaacatccttcaagaact

SEQ ID NO: 4960013 - DNA, 13 bp, Homo sapiens
taataaattgaaa

SEQ ID NO: 4960014 - DNA, 20 bp, Homo sapiens
taataaattgaaattgtgaa

SEQ ID NO: 4960015 - DNA, 15 bp, Homo sapiens
taataacattacctt

SEQ ID NO: 4960016 - DNA, 19 bp, Homo sapiens
taataagaatggttgcctt

SEQ ID NO: 4960017 - DNA, 14 bp, Homo sapiens
taataagacataac

SEQ ID NO: 4960018 - DNA, 17 bp, Homo sapiens
taataagacataacgtt

SEQ ID NO: 4960019 - DNA, 13 bp, Homo sapiens
taataatacctca

SEQ ID NO: 4960020 - DNA, 14 bp, Homo sapiens
taataatacctcaa

SEQ ID NO: 4960021 - DNA, 19 bp, Homo sapiens
taataatattgtttttctt

SEQ ID NO: 4960022 - DNA, 23 bp, Homo sapiens
taataatgagctattaaaactca

SEQ ID NO: 4960023 - DNA, 22 bp, Homo sapiens
taataatgttaaccaaggaaat

SEQ ID NO: 4960024 - DNA, 16 bp, Homo sapiens
taataatttctaatgt

SEQ ID NO: 4960025 - DNA, 22 bp, Homo sapiens
taatacactaattcctttctat

SEQ ID NO: 4960026 - DNA, 11 bp, Homo sapiens
taatacctcaa

SEQ ID NO: 4960027 - DNA, 12 bp, Homo sapiens
taatagagcaaa

SEQ ID NO: 4960028 - DNA, 21 bp, Homo sapiens
taatagagcaaaattgatgtg

SEQ ID NO: 4960029 - DNA, 22 bp, Homo sapiens
taatagcgggttactttcacat

SEQ ID NO: 4960030 - DNA, 13 bp, Homo sapiens
taatagtttgtct

SEQ ID NO: 4960031 - DNA, 20 bp, Homo sapiens
taatagtttgtctattttaa

SEQ ID NO: 4960032 - DNA, 21 bp, Homo sapiens
taatataaaaagcttccatga

SEQ ID NO: 4960033 - DNA, 13 bp, Homo sapiens
taatataatggaa

SEQ ID NO: 4960034 - DNA, 14 bp, Homo sapiens
taatatatatatat

SEQ ID NO: 4960035 - DNA, 14 bp, Homo sapiens
taatatatatgaat

SEQ ID NO: 4960036 - DNA, 16 bp, Homo sapiens
taatatatatgaataa

SEQ ID NO: 4960037 - DNA, 17 bp, Homo sapiens
taatatatcccagaaat

SEQ ID NO: 4960038 - DNA, 20 bp, Homo sapiens
taatatatgtattatttata

SEQ ID NO: 4960039 - DNA, 21 bp, Homo sapiens
taatatattctgaagcaacat

SEQ ID NO: 4960040 - DNA, 14 bp, Homo sapiens
taatatctttgtga

SEQ ID NO: 4960041 - DNA, 18 bp, Homo sapiens
taatatggctatgcttaa

SEQ ID NO: 4960042 - DNA, 22 bp, Homo sapiens
taatattactgtttatttctgt

SEQ ID NO: 4960043 - DNA, 18 bp, Homo sapiens
taatattgttgtataatt

SEQ ID NO: 4960044 - DNA, 19 bp, Homo sapiens
taatattgttgtataattt

SEQ ID NO: 4960045 - DNA, 19 bp, Homo sapiens
taatattgtttttctttct

SEQ ID NO: 4960046 - DNA, 13 bp, Homo sapiens
taatatttaaaca

SEQ ID NO: 4960047 - DNA, 21 bp, Homo sapiens
taatatttaaacagcagtgtt

SEQ ID NO: 4960048 - DNA, 14 bp, Homo sapiens
taatcaataaagaa

SEQ ID NO: 4960049 - DNA, 17 bp, Homo sapiens
taatcaatcatctgtgt

SEQ ID NO: 4960050 - DNA, 18 bp, Homo sapiens
taatcagaaatttttatc

SEQ ID NO: 4960051 - DNA, 14 bp, Homo sapiens
taatcagcctctta

SEQ ID NO: 4960052 - DNA, 18 bp, Homo sapiens
taatcagtgtgtctaaat

SEQ ID NO: 4960053 - DNA, 18 bp, Homo sapiens
taatccaggcacagctga

SEQ ID NO: 4960054 - DNA, 16 bp, Homo sapiens
taatcccagcactttg

SEQ ID NO: 4960055 - DNA, 18 bp, Homo sapiens
taatcctttgttttctga

SEQ ID NO: 4960056 - DNA, 14 bp, Homo sapiens
taatctagaacaca

SEQ ID NO: 4960057 - DNA, 15 bp, Homo sapiens
taatctagtttacag

SEQ ID NO: 4960058 - DNA, 18 bp, Homo sapiens
taatctagtttacagaaa

SEQ ID NO: 4960059 - DNA, 20 bp, Homo sapiens
taatctagtttacagaaaaa

SEQ ID NO: 4960060 - DNA, 17 bp, Homo sapiens
taatctcatacctctga

SEQ ID NO: 4960061 - DNA, 17 bp, Homo sapiens
taatctctctgcagctg

SEQ ID NO: 4960062 - DNA, 19 bp, Homo sapiens
taatctctctgcagctgcc

SEQ ID NO: 4960063 - DNA, 17 bp, Homo sapiens
taatctctgttatgtac

SEQ ID NO: 4960064 - DNA, 22 bp, Homo sapiens
taatctgaaattctaaagagca

SEQ ID NO: 4960065 - DNA, 18 bp, Homo sapiens
taatctggactcctctgt

SEQ ID NO: 4960066 - DNA, 22 bp, Homo sapiens
taatctggactcctctgtccag

SEQ ID NO: 4960067 - DNA, 13 bp, Homo sapiens
taatctgtacatt

SEQ ID NO: 4960068 - DNA, 17 bp, Homo sapiens
taatctgtcaaaacact

SEQ ID NO: 4960069 - DNA, 12 bp, Homo sapiens
taatctttgggt

SEQ ID NO: 4960070 - DNA, 18 bp, Homo sapiens
taatgaaaatgaatatct

SEQ ID NO: 4960071 - DNA, 18 bp, Homo sapiens
taatgagctattaaaact

SEQ ID NO: 4960072 - DNA, 15 bp, Homo sapiens
taatgcatacagaaa

SEQ ID NO: 4960073 - DNA, 14 bp, Homo sapiens
taatgcttcagata

SEQ ID NO: 4960074 - DNA, 17 bp, Homo sapiens
taatgctttcacaacat

SEQ ID NO: 4960075 - DNA, 20 bp, Homo sapiens
taatggattgttaatttcag

SEQ ID NO: 4960076 - DNA, 17 bp, Homo sapiens
taatggcacttatcatt

SEQ ID NO: 4960077 - DNA, 14 bp, Homo sapiens
taatggtgttttaa

SEQ ID NO: 4960078 - DNA, 14 bp, Homo sapiens
taatgtaaaatgat

SEQ ID NO: 4960079 - DNA, 23 bp, Homo sapiens
taatgtagcgtgtttacatgtgt

SEQ ID NO: 4960080 - DNA, 18 bp, Homo sapiens
taatgtcacaggcaggtc

SEQ ID NO: 4960081 - DNA, 19 bp, Homo sapiens
taatgtcttcatttcattg

SEQ ID NO: 4960082 - DNA, 12 bp, Homo sapiens
taatgtgaactt

SEQ ID NO: 4960083 - DNA, 19 bp, Homo sapiens
taatgtgatgatgtaattg

SEQ ID NO: 4960084 - DNA, 15 bp, Homo sapiens
taatgtggaagaaaa

SEQ ID NO: 4960085 - DNA, 16 bp, Homo sapiens
taatgtggaagaaaat

SEQ ID NO: 4960086 - DNA, 17 bp, Homo sapiens
taatgtggaagaaaatg

SEQ ID NO: 4960087 - DNA, 22 bp, Homo sapiens
taatgtggaagaaaatggttta

SEQ ID NO: 4960088 - DNA, 18 bp, Homo sapiens
taatgtgtggtggcctca

SEQ ID NO: 4960089 - DNA, 18 bp, Homo sapiens
taatgtgtgtatgtgtat

SEQ ID NO: 4960090 - DNA, 19 bp, Homo sapiens
taatgtgtgtatgtgtatt

SEQ ID NO: 4960091 - DNA, 13 bp, Homo sapiens
taattaatttgat

SEQ ID NO: 4960092 - DNA, 22 bp, Homo sapiens
taattaatttgattaacaaata

SEQ ID NO: 4960093 - DNA, 21 bp, Homo sapiens
taattaggcaaggctatgtga

SEQ ID NO: 4960094 - DNA, 22 bp, Homo sapiens
taattaggcaaggctatgtgat

SEQ ID NO: 4960095 - DNA, 13 bp, Homo sapiens
taattcaagaaaa

SEQ ID NO: 4960096 - DNA, 15 bp, Homo sapiens
taattcatattcttc

SEQ ID NO: 4960097 - DNA, 19 bp, Homo sapiens
taattccaatatgatgact

SEQ ID NO: 4960098 - DNA, 15 bp, Homo sapiens
tagaattgcattgac

SEQ ID NO: 4960099 - DNA, 19 bp, Homo sapiens
tagacaaatatttggaggg

SEQ ID NO: 4960100 - DNA, 14 bp, Homo sapiens
tagacaagatattg

SEQ ID NO: 4960101 - DNA, 21 bp, Homo sapiens
tagacaagatattgtacataa

SEQ ID NO: 4960102 - DNA, 20 bp, Homo sapiens
tagacaatcattgttttgaa

SEQ ID NO: 4960103 - DNA, 18 bp, Homo sapiens
tagacaccaaagttctaa

SEQ ID NO: 4960104 - DNA, 21 bp, Homo sapiens
tagacaccaaagttctaataa

SEQ ID NO: 4960105 - DNA, 18 bp, Homo sapiens
tagacacccattttcaca

SEQ ID NO: 4960106 - DNA, 10 bp, Homo sapiens
tagacagagt

SEQ ID NO: 4960107 - DNA, 21 bp, Homo sapiens
tagacagagtctcactgttgc

SEQ ID NO: 4960108 - DNA, 18 bp, Homo sapiens
tagacagtctcactttgt

SEQ ID NO: 4960109 - DNA, 18 bp, Homo sapiens
tagacagtttgtaaatgt

SEQ ID NO: 4960110 - DNA, 14 bp, Homo sapiens
tagaccaaggaaca

SEQ ID NO: 4960111 - DNA, 17 bp, Homo sapiens
tagaccaggatttctaa

SEQ ID NO: 4960112 - DNA, 19 bp, Homo sapiens
tagactatatacatgtgtg

SEQ ID NO: 4960113 - DNA, 18 bp, Homo sapiens
tagactcatcttactgta

SEQ ID NO: 4960114 - DNA, 17 bp, Homo sapiens
tagactgccgtgcatta

SEQ ID NO: 4960115 - DNA, 17 bp, Homo sapiens
tagactgcctgggttcc

SEQ ID NO: 4960116 - DNA, 19 bp, Homo sapiens
tagactggaaaaaatgagc

SEQ ID NO: 4960117 - DNA, 16 bp, Homo sapiens
tagactggaagttcat

SEQ ID NO: 4960118 - DNA, 17 bp, Homo sapiens
tagagaacgcagcccta

SEQ ID NO: 4960119 - DNA, 19 bp, Homo sapiens
tagagaacgcagccctaga

SEQ ID NO: 4960120 - DNA, 21 bp, Homo sapiens
tagagacttttttctagtaca

SEQ ID NO: 4960121 - DNA, 17 bp, Homo sapiens
tagagaggaagattgaa

SEQ ID NO: 4960122 - DNA, 19 bp, Homo sapiens
tagagatgtttttaaaagt

SEQ ID NO: 4960123 - DNA, 14 bp, Homo sapiens
tagagcaaaattga

SEQ ID NO: 4960124 - DNA, 14 bp, Homo sapiens
tagagcagcccaaa

SEQ ID NO: 4960125 - DNA, 17 bp, Homo sapiens
tagagcctgcctggagc

SEQ ID NO: 4960126 - DNA, 18 bp, Homo sapiens
tagagcctgcctggagcg

SEQ ID NO: 4960127 - DNA, 22 bp, Homo sapiens
tagagccttctgatgtctctaa

SEQ ID NO: 4960128 - DNA, 15 bp, Homo sapiens
tagagcttctggcac

SEQ ID NO: 4960129 - DNA, 19 bp, Homo sapiens
tagaggtcctctggagccc

SEQ ID NO: 4960130 - DNA, 20 bp, Homo sapiens
tagaggtcctctggagccct

SEQ ID NO: 4960131 - DNA, 18 bp, Homo sapiens
tagagtaaatacaggtag

SEQ ID NO: 4960132 - DNA, 15 bp, Homo sapiens
tagagttaagaagct

SEQ ID NO: 4960133 - DNA, 23 bp, Homo sapiens
tagagttaagaagctgttgtaca

SEQ ID NO: 4960134 - DNA, 13 bp, Homo sapiens
tagagtttctgtt

SEQ ID NO: 4960135 - DNA, 21 bp, Homo sapiens
tagagtttctgtttgattctt

SEQ ID NO: 4960136 - DNA, 19 bp, Homo sapiens
tagataaatatttgacttg

SEQ ID NO: 4960137 - DNA, 19 bp, Homo sapiens
tagataacgcttaaaggaa

SEQ ID NO: 4960138 - DNA, 13 bp, Homo sapiens
tagatatttggct

SEQ ID NO: 4960139 - DNA, 19 bp, Homo sapiens
tagatatttggcttaaata

SEQ ID NO: 4960140 - DNA, 21 bp, Homo sapiens
tagatatttggcttaaatata

SEQ ID NO: 4960141 - DNA, 19 bp, Homo sapiens
tagatcagatgctccaaga

SEQ ID NO: 4960142 - DNA, 20 bp, Homo sapiens
tagatcagatgctccaagat

SEQ ID NO: 4960143 - DNA, 23 bp, Homo sapiens
tagatcagatgctccaagattct

SEQ ID NO: 4960144 - DNA, 14 bp, Homo sapiens
tagatcataaggct

SEQ ID NO: 4960145 - DNA, 15 bp, Homo sapiens
tagatcttctgaaat

SEQ ID NO: 4960146 - DNA, 16 bp, Homo sapiens
tagatgaagttttaca

SEQ ID NO: 4960147 - DNA, 20 bp, Homo sapiens
tagatgattaaataagattc

SEQ ID NO: 4960148 - DNA, 14 bp, Homo sapiens
tagatgttgccatg

SEQ ID NO: 4960149 - DNA, 15 bp, Homo sapiens
tagatgttgccatgt

SEQ ID NO: 4960150 - DNA, 21 bp, Homo sapiens
tagatgtttattcttctagag

SEQ ID NO: 4960151 - DNA, 13 bp, Homo sapiens
tagatgtttcaca

SEQ ID NO: 4960152 - DNA, 16 bp, Homo sapiens
tagatgttttggtaga

SEQ ID NO: 4960153 - DNA, 20 bp, Homo sapiens
tagatgttttggtagattaa

SEQ ID NO: 4960154 - DNA, 14 bp, Homo sapiens
tagattaaataaaa

SEQ ID NO: 4960155 - DNA, 13 bp, Homo sapiens
tagattaaatata

SEQ ID NO: 4960156 - DNA, 18 bp, Homo sapiens
tagattaatggcactgat

SEQ ID NO: 4960157 - DNA, 16 bp, Homo sapiens
tagattagaaaaattc

SEQ ID NO: 4960158 - DNA, 16 bp, Homo sapiens
tagattcaaaggttct

SEQ ID NO: 4960159 - DNA, 20 bp, Homo sapiens
tagattccattggtccaaga

SEQ ID NO: 4960160 - DNA, 14 bp, Homo sapiens
tagattctaaagat

SEQ ID NO: 4960161 - DNA, 15 bp, Homo sapiens
tagattctaaagatt

SEQ ID NO: 4960162 - DNA, 18 bp, Homo sapiens
tagattctaaagattcta

SEQ ID NO: 4960163 - DNA, 22 bp, Homo sapiens
tagatttatttttcagttccaa

SEQ ID NO: 4960164 - DNA, 14 bp, Homo sapiens
tagattttctggtt

SEQ ID NO: 4960165 - DNA, 22 bp, Homo sapiens
tagattttctggttctaacatt

SEQ ID NO: 4960166 - DNA, 12 bp, Homo sapiens
tagcaaacagag

SEQ ID NO: 4960167 - DNA, 17 bp, Homo sapiens
tagcaagacacatccct

SEQ ID NO: 4960168 - DNA, 13 bp, Homo sapiens
tagcaagctggcc

SEQ ID NO: 4960169 - DNA, 17 bp, Homo sapiens
tagcacataaactttgg

SEQ ID NO: 4960170 - DNA, 14 bp, Homo sapiens
tagcactaggcacc

SEQ ID NO: 4960171 - DNA, 21 bp, Homo sapiens
tagcactttgaaatacctcat

SEQ ID NO: 4960172 - DNA, 23 bp, Homo sapiens
tagcagagaatgaaagggcccag

SEQ ID NO: 4960173 - DNA, 22 bp, Homo sapiens
tagcagaggggtaagagaggat

SEQ ID NO: 4960174 - DNA, 18 bp, Homo sapiens
tagcagcaaaaatataaa

SEQ ID NO: 4960175 - DNA, 20 bp, Homo sapiens
tagcagcaaaaatataaaat

SEQ ID NO: 4960176 - DNA, 21 bp, Homo sapiens
tagcagcaaaaatataaaata

SEQ ID NO: 4960177 - DNA, 22 bp, Homo sapiens
tagcagccccgggagggcggca

SEQ ID NO: 4960178 - DNA, 22 bp, Homo sapiens
tagcagcggaacaaggagtcag

SEQ ID NO: 4960179 - DNA, 11 bp, Homo sapiens
tagcagggaaa

SEQ ID NO: 4960180 - DNA, 22 bp, Homo sapiens
tagcatattcttttctgcaaaa

SEQ ID NO: 4960181 - DNA, 15 bp, Homo sapiens
tagcatcatcctgca

SEQ ID NO: 4960182 - DNA, 15 bp, Homo sapiens
tagcatcctaagaaa

SEQ ID NO: 4960183 - DNA, 18 bp, Homo sapiens
tagcatcctaagaaatat

SEQ ID NO: 4960184 - DNA, 19 bp, Homo sapiens
tagcatcctaagaaatatg

SEQ ID NO: 4960185 - DNA, 22 bp, Homo sapiens
tagcatcctaagaaatatgtga

SEQ ID NO: 4960186 - DNA, 23 bp, Homo sapiens
tagcatcctaagaaatatgtgag

SEQ ID NO: 4960187 - DNA, 22 bp, Homo sapiens
tagcatctcaggagatttcatg

SEQ ID NO: 4960188 - DNA, 17 bp, Homo sapiens
tagcatggatagagtat

SEQ ID NO: 4960189 - DNA, 22 bp, Homo sapiens
tagcattatgcaattaggtttt

SEQ ID NO: 4960190 - DNA, 21 bp, Homo sapiens
tagccacatttggaatacttt

SEQ ID NO: 4960191 - DNA, 19 bp, Homo sapiens
tagccaccccagaaatggt

SEQ ID NO: 4960192 - DNA, 13 bp, Homo sapiens
tagccaggatcat

SEQ ID NO: 4960193 - DNA, 18 bp, Homo sapiens
tagccaggatcatggtgt

SEQ ID NO: 4960194 - DNA, 23 bp, Homo sapiens
tagccaggatcatggtgtaataa

SEQ ID NO: 4960195 - DNA, 22 bp, Homo sapiens
tagccagggggactagcccctg

SEQ ID NO: 4960196 - DNA, 13 bp, Homo sapiens
tagcccaccctgc

SEQ ID NO: 4960197 - DNA, 15 bp, Homo sapiens
tagcccaccctgctg

SEQ ID NO: 4960198 - DNA, 17 bp, Homo sapiens
tagcccagcgctctgcc

SEQ ID NO: 4960199 - DNA, 13 bp, Homo sapiens
tagcccaggagag

SEQ ID NO: 4960200 - DNA, 14 bp, Homo sapiens
tagcccaggagaga

SEQ ID NO: 4960201 - DNA, 16 bp, Homo sapiens
tagcccatccctgcct

SEQ ID NO: 4960202 - DNA, 17 bp, Homo sapiens
tagcccatccctgcctg

SEQ ID NO: 4960203 - DNA, 18 bp, Homo sapiens
tagcccatccctgcctgg

SEQ ID NO: 4960204 - DNA, 19 bp, Homo sapiens
tagccgcccatgcactggg

SEQ ID NO: 4960205 - DNA, 14 bp, Homo sapiens
tagcctcatagtta

SEQ ID NO: 4960206 - DNA, 12 bp, Homo sapiens
tagcctccctga

SEQ ID NO: 4960207 - DNA, 17 bp, Homo sapiens
tatctctgaagcatgtt

SEQ ID NO: 4960208 - DNA, 23 bp, Homo sapiens
tatctgagttgccaagacaaatc

SEQ ID NO: 4960209 - DNA, 22 bp, Homo sapiens
tatctgattttgtgcaaaagct

SEQ ID NO: 4960210 - DNA, 20 bp, Homo sapiens
tatctgcttcagtggagaat

SEQ ID NO: 4960211 - DNA, 19 bp, Homo sapiens
tatctggaagtaaccattt

SEQ ID NO: 4960212 - DNA, 22 bp, Homo sapiens
tatctggccccaggtagaaact

SEQ ID NO: 4960213 - DNA, 18 bp, Homo sapiens
tatctggcctaaaatctt

SEQ ID NO: 4960214 - DNA, 21 bp, Homo sapiens
tatctgtcatttgagcagggc

SEQ ID NO: 4960215 - DNA, 12 bp, Homo sapiens
tatctgttcttg

SEQ ID NO: 4960216 - DNA, 15 bp, Homo sapiens
tatcttaaagaaaca

SEQ ID NO: 4960217 - DNA, 20 bp, Homo sapiens
tatcttaaagaaacagcttt

SEQ ID NO: 4960218 - DNA, 15 bp, Homo sapiens
tatcttcacatagtt

SEQ ID NO: 4960219 - DNA, 13 bp, Homo sapiens
tatcttccaaatg

SEQ ID NO: 4960220 - DNA, 15 bp, Homo sapiens
tatcttctcaagttc

SEQ ID NO: 4960221 - DNA, 18 bp, Homo sapiens
tatcttctcaagttctaa

SEQ ID NO: 4960222 - DNA, 16 bp, Homo sapiens
tatcttgtgttgtcct

SEQ ID NO: 4960223 - DNA, 18 bp, Homo sapiens
tatcttgtgttgtccttt

SEQ ID NO: 4960224 - DNA, 18 bp, Homo sapiens
tatctttgtgataattta

SEQ ID NO: 4960225 - DNA, 14 bp, Homo sapiens
tatcttttatgttt

SEQ ID NO: 4960226 - DNA, 17 bp, Homo sapiens
tatcttttatgtttgaa

SEQ ID NO: 4960227 - DNA, 15 bp, Homo sapiens
tatcttttttcaaaa

SEQ ID NO: 4960228 - DNA, 17 bp, Homo sapiens
tatgaaaactatacaac

SEQ ID NO: 4960229 - DNA, 23 bp, Homo sapiens
tatgaaagaatatatttatttaa

SEQ ID NO: 4960230 - DNA, 14 bp, Homo sapiens
tatgaaagattgtg

SEQ ID NO: 4960231 - DNA, 22 bp, Homo sapiens
tatgaacccttcctgagcttta

SEQ ID NO: 4960232 - DNA, 23 bp, Homo sapiens
tatgaacccttcctgagctttat

SEQ ID NO: 4960233 - DNA, 18 bp, Homo sapiens
tatgaaccctttgtttct

SEQ ID NO: 4960234 - DNA, 19 bp, Homo sapiens
tatgaaccctttgtttctt

SEQ ID NO: 4960235 - DNA, 21 bp, Homo sapiens
tatgaaccctttgtttcttgt

SEQ ID NO: 4960236 - DNA, 18 bp, Homo sapiens
tatgaagtttaaaacagt

SEQ ID NO: 4960237 - DNA, 23 bp, Homo sapiens
tatgaatcagtgggcaggataaa

SEQ ID NO: 4960238 - DNA, 23 bp, Homo sapiens
tatgaatgtactgcatgttacca

SEQ ID NO: 4960239 - DNA, 17 bp, Homo sapiens
tatgaatttaaatataa

SEQ ID NO: 4960240 - DNA, 15 bp, Homo sapiens
tatgacgctgataca

SEQ ID NO: 4960241 - DNA, 22 bp, Homo sapiens
tatgacgctgatacataactaa

SEQ ID NO: 4960242 - DNA, 13 bp, Homo sapiens
tatgagcagaagg

SEQ ID NO: 4960243 - DNA, 15 bp, Homo sapiens
tatgagcagaaggaa

SEQ ID NO: 4960244 - DNA, 22 bp, Homo sapiens
tatgagcatcctgagccccgcc

SEQ ID NO: 4960245 - DNA, 21 bp, Homo sapiens
tatgagccgtgaactgtgcat

SEQ ID NO: 4960246 - DNA, 22 bp, Homo sapiens
tatgaggcaacctgattgtaaa

SEQ ID NO: 4960247 - DNA, 17 bp, Homo sapiens
tatgagtacaaatgcct

SEQ ID NO: 4960248 - DNA, 15 bp, Homo sapiens
tatgagtatacaata

SEQ ID NO: 4960249 - DNA, 16 bp, Homo sapiens
tatgagtatacaatat

SEQ ID NO: 4960250 - DNA, 17 bp, Homo sapiens
tatgatttaataaaata

SEQ ID NO: 4960251 - DNA, 19 bp, Homo sapiens
tatgattttcataacttat

SEQ ID NO: 4960252 - DNA, 18 bp, Homo sapiens
tatgattttttaaaagaa

SEQ ID NO: 4960253 - DNA, 13 bp, Homo sapiens
tatgcaaaatgga

SEQ ID NO: 4960254 - DNA, 20 bp, Homo sapiens
tatgcaaggaaggaaagaaa

SEQ ID NO: 4960255 - DNA, 19 bp, Homo sapiens
tatgcacatatggactctg

SEQ ID NO: 4960256 - DNA, 22 bp, Homo sapiens
tatgcagtgatatggcagaaga

SEQ ID NO: 4960257 - DNA, 15 bp, Homo sapiens
tatgccccaaatata

SEQ ID NO: 4960258 - DNA, 15 bp, Homo sapiens
tatggaacttctaat

SEQ ID NO: 4960259 - DNA, 17 bp, Homo sapiens
tatggaacttctaatat

SEQ ID NO: 4960260 - DNA, 13 bp, Homo sapiens
tatggaatcaatt

SEQ ID NO: 4960261 - DNA, 18 bp, Homo sapiens
tatggaattacatgtaaa

SEQ ID NO: 4960262 - DNA, 14 bp, Homo sapiens
tatggacacagggt

SEQ ID NO: 4960263 - DNA, 12 bp, Homo sapiens
tatggactctgc

SEQ ID NO: 4960264 - DNA, 13 bp, Homo sapiens
tatggagcctggc

SEQ ID NO: 4960265 - DNA, 22 bp, Homo sapiens
tatggcagaaaaaatgtctgta

SEQ ID NO: 4960266 - DNA, 13 bp, Homo sapiens
tatggcagaagac

SEQ ID NO: 4960267 - DNA, 14 bp, Homo sapiens
tatggcagaagaca

SEQ ID NO: 4960268 - DNA, 19 bp, Homo sapiens
tatggccacatttaatatc

SEQ ID NO: 4960269 - DNA, 22 bp, Homo sapiens
tatgggttagatgttgccatgt

SEQ ID NO: 4960270 - DNA, 22 bp, Homo sapiens
tatggttgatagtttacctgaa

SEQ ID NO: 4960271 - DNA, 18 bp, Homo sapiens
tatgtaaagtatgtaaac

SEQ ID NO: 4960272 - DNA, 20 bp, Homo sapiens
tatgtaaagtatgtaaacag

SEQ ID NO: 4960273 - DNA, 16 bp, Homo sapiens
tatgtaatgaagtaaa

SEQ ID NO: 4960274 - DNA, 18 bp, Homo sapiens
tatgtacgtttgtatgtg

SEQ ID NO: 4960275 - DNA, 22 bp, Homo sapiens
tatgtacgtttgtatgtgtgta

SEQ ID NO: 4960276 - DNA, 19 bp, Homo sapiens
tatgtactagtactgtgta

SEQ ID NO: 4960277 - DNA, 20 bp, Homo sapiens
tatgtactcctctttacact

SEQ ID NO: 4960278 - DNA, 18 bp, Homo sapiens
tatgtagactatatacat

SEQ ID NO: 4960279 - DNA, 19 bp, Homo sapiens
tatgtagactatatacatg

SEQ ID NO: 4960280 - DNA, 22 bp, Homo sapiens
tatgtagactatatacatgtgt

SEQ ID NO: 4960281 - DNA, 16 bp, Homo sapiens
tatgtagatatttggc

SEQ ID NO: 4960282 - DNA, 22 bp, Homo sapiens
tatgtagatatttggcttaaat

SEQ ID NO: 4960283 - DNA, 21 bp, Homo sapiens
tatgtagcaggaaataaagta

SEQ ID NO: 4960284 - DNA, 17 bp, Homo sapiens
tatgtagtaattgacat

SEQ ID NO: 4960285 - DNA, 22 bp, Homo sapiens
tatgtattgtaaacatgtgttt

SEQ ID NO: 4960286 - DNA, 15 bp, Homo sapiens
tatgtcactagaatg

SEQ ID NO: 4960287 - DNA, 13 bp, Homo sapiens
tatgtctgtttaa

SEQ ID NO: 4960288 - DNA, 14 bp, Homo sapiens
tatgtcttggacac

SEQ ID NO: 4960289 - DNA, 17 bp, Homo sapiens
tatgtcttggacactgt

SEQ ID NO: 4960290 - DNA, 19 bp, Homo sapiens
tatgtcttggacactgtac

SEQ ID NO: 4960291 - DNA, 21 bp, Homo sapiens
tatgtgacattttacattaaa

SEQ ID NO: 4960292 - DNA, 19 bp, Homo sapiens
tatgtgagattttttattg

SEQ ID NO: 4960293 - DNA, 18 bp, Homo sapiens
tatgtgctttcatcacaa

SEQ ID NO: 4960294 - DNA, 19 bp, Homo sapiens
tatgtggttttagattttc

SEQ ID NO: 4960295 - DNA, 17 bp, Homo sapiens
tatgtgtatatatacat

SEQ ID NO: 4960296 - DNA, 21 bp, Homo sapiens
tatgtgtatatatacatacac

SEQ ID NO: 4960297 - DNA, 12 bp, Homo sapiens
tatgtgtatgta

SEQ ID NO: 4960298 - DNA, 18 bp, Homo sapiens
tatgtgtatgtgccattt

SEQ ID NO: 4960299 - DNA, 17 bp, Homo sapiens
tatgtgtgcatgtgtgt

SEQ ID NO: 4960300 - DNA, 18 bp, Homo sapiens
tatgtgtgcatgtgtgta

SEQ ID NO: 4960301 - DNA, 18 bp, Homo sapiens
tatgtgttgaaaaccaaa

SEQ ID NO: 4960302 - DNA, 19 bp, Homo sapiens
tatgtgttgaaaaccaaaa

SEQ ID NO: 4960303 - DNA, 16 bp, Homo sapiens
tatgtgtttactttaa

SEQ ID NO: 4960304 - DNA, 12 bp, Homo sapiens
tatgttactatt

SEQ ID NO: 4960305 - DNA, 13 bp, Homo sapiens
tatgttcatttgt

SEQ ID NO: 4960306 - DNA, 14 bp, Homo sapiens
tatgttcatttgtt

SEQ ID NO: 4960307 - DNA, 12 bp, Homo sapiens
tatgttgaatac

SEQ ID NO: 4960308 - DNA, 16 bp, Homo sapiens
tatgttgcccaggcag

SEQ ID NO: 4960309 - DNA, 19 bp, Homo sapiens
tatgttgcccaggcaggtc

SEQ ID NO: 4960310 - DNA, 18 bp, Homo sapiens
tatgttgcctttatggtt

SEQ ID NO: 4960311 - DNA, 18 bp, Homo sapiens
tatgtttatttactaatt

SEQ ID NO: 4960312 - DNA, 22 bp, Homo sapiens
tattaaaactcagcctgggaca

SEQ ID NO: 4960313 - DNA, 14 bp, Homo sapiens
tattaaataaaatc

SEQ ID NO: 4960314 - DNA, 13 bp, Homo sapiens
tattaacaaaagt

SEQ ID NO: 4960315 - DNA, 18 bp, Homo sapiens
tattaacaaaagttccct

SEQ ID NO: 4960316 - DNA, 19 bp, Homo sapiens
tcacattgtttgctgctat

SEQ ID NO: 4960317 - DNA, 18 bp, Homo sapiens
tcacatttattctgctca

SEQ ID NO: 4960318 - DNA, 19 bp, Homo sapiens
tcacatttattctgctcac

SEQ ID NO: 4960319 - DNA, 17 bp, Homo sapiens
tcacattttttatgggc

SEQ ID NO: 4960320 - DNA, 13 bp, Homo sapiens
tcaccaagcccag

SEQ ID NO: 4960321 - DNA, 15 bp, Homo sapiens
tcaccagccccactg

SEQ ID NO: 4960322 - DNA, 13 bp, Homo sapiens
tcaccagtgtccc

SEQ ID NO: 4960323 - DNA, 19 bp, Homo sapiens
tcacccaagagattgttgt

SEQ ID NO: 4960324 - DNA, 23 bp, Homo sapiens
tcaccccaagtagtctgctcaca

SEQ ID NO: 4960325 - DNA, 13 bp, Homo sapiens
tcaccccatccca

SEQ ID NO: 4960326 - DNA, 21 bp, Homo sapiens
tcaccccgctgtaagctcctt

SEQ ID NO: 4960327 - DNA, 15 bp, Homo sapiens
tcaccccggcaggcc

SEQ ID NO: 4960328 - DNA, 17 bp, Homo sapiens
tcaccccggcaggccct

SEQ ID NO: 4960329 - DNA, 20 bp, Homo sapiens
tcaccccggcaggccctgca

SEQ ID NO: 4960330 - DNA, 22 bp, Homo sapiens
tcaccccggcaggccctgcagt

SEQ ID NO: 4960331 - DNA, 17 bp, Homo sapiens
tcaccccgttacagctc

SEQ ID NO: 4960332 - DNA, 14 bp, Homo sapiens
tcacccctccagga

SEQ ID NO: 4960333 - DNA, 14 bp, Homo sapiens
tcacccctgtcctc

SEQ ID NO: 4960334 - DNA, 20 bp, Homo sapiens
tcacccctgtcctcactgct

SEQ ID NO: 4960335 - DNA, 15 bp, Homo sapiens
tcaccctacctgtgc

SEQ ID NO: 4960336 - DNA, 19 bp, Homo sapiens
tcacctaagtctctgtgaa

SEQ ID NO: 4960337 - DNA, 15 bp, Homo sapiens
tcacctagagccaga

SEQ ID NO: 4960338 - DNA, 16 bp, Homo sapiens
tcacctctaacacgca

SEQ ID NO: 4960339 - DNA, 12 bp, Homo sapiens
tcaccttccctt

SEQ ID NO: 4960340 - DNA, 16 bp, Homo sapiens
tcaccttcccttgcca

SEQ ID NO: 4960341 - DNA, 14 bp, Homo sapiens
tcacctttgtgtat

SEQ ID NO: 4960342 - DNA, 16 bp, Homo sapiens
tcacgacgctgcagag

SEQ ID NO: 4960343 - DNA, 14 bp, Homo sapiens
tcacgccactgcac

SEQ ID NO: 4960344 - DNA, 16 bp, Homo sapiens
tcacgccactgcacta

SEQ ID NO: 4960345 - DNA, 15 bp, Homo sapiens
tcacggctcactgca

SEQ ID NO: 4960346 - DNA, 19 bp, Homo sapiens
tcacgggcatgggcactcc

SEQ ID NO: 4960347 - DNA, 13 bp, Homo sapiens
tcactaaacttta

SEQ ID NO: 4960348 - DNA, 20 bp, Homo sapiens
tcactaccctattctctctt

SEQ ID NO: 4960349 - DNA, 17 bp, Homo sapiens
tcactagaatggataaa

SEQ ID NO: 4960350 - DNA, 15 bp, Homo sapiens
tcactagctttgcct

SEQ ID NO: 4960351 - DNA, 17 bp, Homo sapiens
tcactatgttgcccagg

SEQ ID NO: 4960352 - DNA, 18 bp, Homo sapiens
tcactatgttgcccaggc

SEQ ID NO: 4960353 - DNA, 19 bp, Homo sapiens
tcactatgttgcccaggca

SEQ ID NO: 4960354 - DNA, 15 bp, Homo sapiens
tcactcaagcactga

SEQ ID NO: 4960355 - DNA, 16 bp, Homo sapiens
tcactcactgtcaatg

SEQ ID NO: 4960356 - DNA, 15 bp, Homo sapiens
tcactcattgctgag

SEQ ID NO: 4960357 - DNA, 17 bp, Homo sapiens
tcactccccaaggaaga

SEQ ID NO: 4960358 - DNA, 21 bp, Homo sapiens
tcactctgccagggcagtgct

SEQ ID NO: 4960359 - DNA, 14 bp, Homo sapiens
tcactctgctgctt

SEQ ID NO: 4960360 - DNA, 17 bp, Homo sapiens
tcactcttattgcccac

SEQ ID NO: 4960361 - DNA, 23 bp, Homo sapiens
tcactcttattgcccacgctgga

SEQ ID NO: 4960362 - DNA, 21 bp, Homo sapiens
tcactctttatagtgcacaaa

SEQ ID NO: 4960363 - DNA, 23 bp, Homo sapiens
tcactgaacaaactaaaggtgca

SEQ ID NO: 4960364 - DNA, 14 bp, Homo sapiens
tcactgaatttata

SEQ ID NO: 4960365 - DNA, 12 bp, Homo sapiens
tcactgacacaa

SEQ ID NO: 4960366 - DNA, 14 bp, Homo sapiens
tcactgatgtacaa

SEQ ID NO: 4960367 - DNA, 21 bp, Homo sapiens
tcactgatgtacaattaaaaa

SEQ ID NO: 4960368 - DNA, 16 bp, Homo sapiens
tcactgcaaccttcac

SEQ ID NO: 4960369 - DNA, 15 bp, Homo sapiens
tcactgcacagtgca

SEQ ID NO: 4960370 - DNA, 13 bp, Homo sapiens
tcactgcagcctc

SEQ ID NO: 4960371 - DNA, 15 bp, Homo sapiens
tcactgcagcctcaa

SEQ ID NO: 4960372 - DNA, 18 bp, Homo sapiens
tcactgcattattctctt

SEQ ID NO: 4960373 - DNA, 19 bp, Homo sapiens
tcactgccacactctccat

SEQ ID NO: 4960374 - DNA, 15 bp, Homo sapiens
tcactgccactttgc

SEQ ID NO: 4960375 - DNA, 22 bp, Homo sapiens
tcactgcccgcacaccctcact

SEQ ID NO: 4960376 - DNA, 20 bp, Homo sapiens
tcactgctccctgaagccag

SEQ ID NO: 4960377 - DNA, 13 bp, Homo sapiens
tcactgctggctg

SEQ ID NO: 4960378 - DNA, 17 bp, Homo sapiens
tcactgctggctgcctt

SEQ ID NO: 4960379 - DNA, 18 bp, Homo sapiens
tcactggaccactgggca

SEQ ID NO: 4960380 - DNA, 20 bp, Homo sapiens
tcactgggccaattcaatac

SEQ ID NO: 4960381 - DNA, 23 bp, Homo sapiens
tcactgtataaataggagaggat

SEQ ID NO: 4960382 - DNA, 19 bp, Homo sapiens
tcactgttgaaaattattt

SEQ ID NO: 4960383 - DNA, 14 bp, Homo sapiens
tcactgttgcccag

SEQ ID NO: 4960384 - DNA, 22 bp, Homo sapiens
tcacttcgcgtgccctcgctgc

SEQ ID NO: 4960385 - DNA, 23 bp, Homo sapiens
tcacttcgggctgtgtaaacaca

SEQ ID NO: 4960386 - DNA, 14 bp, Homo sapiens
tcacttgatgatac

SEQ ID NO: 4960387 - DNA, 20 bp, Homo sapiens
tcacttgatgatacaatgaa

SEQ ID NO: 4960388 - DNA, 13 bp, Homo sapiens
tcacttttcagtg

SEQ ID NO: 4960389 - DNA, 15 bp, Homo sapiens
tcactttttgaacta

SEQ ID NO: 4960390 - DNA, 19 bp, Homo sapiens
tcactttttgaactaagaa

SEQ ID NO: 4960391 - DNA, 18 bp, Homo sapiens
tcactttttttttttgtt

SEQ ID NO: 4960392 - DNA, 22 bp, Homo sapiens
tcagaaaactttaaaaaatatt

SEQ ID NO: 4960393 - DNA, 22 bp, Homo sapiens
tcagaaatttttatcagtttcc

SEQ ID NO: 4960394 - DNA, 13 bp, Homo sapiens
tcagaacccaggg

SEQ ID NO: 4960395 - DNA, 20 bp, Homo sapiens
tcagaacccagggctctgcc

SEQ ID NO: 4960396 - DNA, 13 bp, Homo sapiens
tcagaagacactg

SEQ ID NO: 4960397 - DNA, 19 bp, Homo sapiens
tcagaagtttctcagctcc

SEQ ID NO: 4960398 - DNA, 17 bp, Homo sapiens
tcagaagtttggcaata

SEQ ID NO: 4960399 - DNA, 19 bp, Homo sapiens
tcagaatgctattgaaaat

SEQ ID NO: 4960400 - DNA, 20 bp, Homo sapiens
tcagaattatttttaaaaag

SEQ ID NO: 4960401 - DNA, 22 bp, Homo sapiens
tcagacaccctcaacctcttct

SEQ ID NO: 4960402 - DNA, 23 bp, Homo sapiens
tcagacagaacttgaatgtgtca

SEQ ID NO: 4960403 - DNA, 15 bp, Homo sapiens
tcagacataaagcca

SEQ ID NO: 4960404 - DNA, 21 bp, Homo sapiens
tcagacatccatgtttgtaaa

SEQ ID NO: 4960405 - DNA, 20 bp, Homo sapiens
tcagacatgttttccgtgaa

SEQ ID NO: 4960406 - DNA, 17 bp, Homo sapiens
tcagactctcagcccag

SEQ ID NO: 4960407 - DNA, 15 bp, Homo sapiens
tcagacttttgtaca

SEQ ID NO: 4960408 - DNA, 12 bp, Homo sapiens
tcagagaatttc

SEQ ID NO: 4960409 - DNA, 15 bp, Homo sapiens
tcagagacagctgat

SEQ ID NO: 4960410 - DNA, 12 bp, Homo sapiens
tcagagagcagc

SEQ ID NO: 4960411 - DNA, 19 bp, Homo sapiens
tcagagatttatataaatg

SEQ ID NO: 4960412 - DNA, 21 bp, Homo sapiens
tcagagccacccctaaagaga

SEQ ID NO: 4960413 - DNA, 20 bp, Homo sapiens
tcagagcccctacagcattg

SEQ ID NO: 4960414 - DNA, 18 bp, Homo sapiens
tcagagcctgcagttatt

SEQ ID NO: 4960415 - DNA, 14 bp, Homo sapiens
tcagaggacctgta

SEQ ID NO: 4960416 - DNA, 21 bp, Homo sapiens
tcagaggacctgtatttaagc

SEQ ID NO: 4960417 - DNA, 22 bp, Homo sapiens
tcagaggacctgtatttaagca

SEQ ID NO: 4960418 - DNA, 22 bp, Homo sapiens
tcagagggggactgctgctgcc

SEQ ID NO: 4960419 - DNA, 13 bp, Homo sapiens
tcagagtagaaat

SEQ ID NO: 4960420 - DNA, 17 bp, Homo sapiens
tcagagtccttaaaatg

SEQ ID NO: 4960421 - DNA, 12 bp, Homo sapiens
tcagatacatca

SEQ ID NO: 4960422 - DNA, 17 bp, Homo sapiens
tcagatacatcactgct

SEQ ID NO: 4960423 - DNA, 13 bp, Homo sapiens
tcagatctgtctg

SEQ ID NO: 4960424 - DNA, 18 bp, Homo sapiens
tcagatctttctccttga

SEQ ID NO: 4960425 - DNA, 21 bp, Homo sapiens
tcagatgaactcttagaaatg

SEQ ID NO: 4960426 - DNA, 14 bp, Homo sapiens
tccaccgctgctcc

SEQ ID NO: 4960427 - DNA, 23 bp, Homo sapiens
tccacctggtactccctctcagg

SEQ ID NO: 4960428 - DNA, 13 bp, Homo sapiens
tccacctgtctca

SEQ ID NO: 4960429 - DNA, 17 bp, Homo sapiens
tccacgatcctgccacc

SEQ ID NO: 4960430 - DNA, 13 bp, Homo sapiens
tccactactccgt

SEQ ID NO: 4960431 - DNA, 13 bp, Homo sapiens
tccactgcctctg

SEQ ID NO: 4960432 - DNA, 17 bp, Homo sapiens
tccactgcctctgcctt

SEQ ID NO: 4960433 - DNA, 18 bp, Homo sapiens
tccactgcctctgcctta

SEQ ID NO: 4960434 - DNA, 19 bp, Homo sapiens
tccactgcctctgccttag

SEQ ID NO: 4960435 - DNA, 21 bp, Homo sapiens
tccactgtgccatgtgccagg

SEQ ID NO: 4960436 - DNA, 12 bp, Homo sapiens
tccactgtgtat

SEQ ID NO: 4960437 - DNA, 18 bp, Homo sapiens
tccacttcttcctttctc

SEQ ID NO: 4960438 - DNA, 22 bp, Homo sapiens
tccagaactcactggggcctac

SEQ ID NO: 4960439 - DNA, 15 bp, Homo sapiens
tccagaagaagagaa

SEQ ID NO: 4960440 - DNA, 21 bp, Homo sapiens
tccagaagaagagaagctgct

SEQ ID NO: 4960441 - DNA, 22 bp, Homo sapiens
tccagaagaagagaagctgctg

SEQ ID NO: 4960442 - DNA, 23 bp, Homo sapiens
tccagaagaagagaagctgctga

SEQ ID NO: 4960443 - DNA, 16 bp, Homo sapiens
tccagaagcctctggc

SEQ ID NO: 4960444 - DNA, 17 bp, Homo sapiens
tccagaagcctctggct

SEQ ID NO: 4960445 - DNA, 16 bp, Homo sapiens
tccagaatgctgtaca

SEQ ID NO: 4960446 - DNA, 22 bp, Homo sapiens
tccagaatttggaaatcctagt

SEQ ID NO: 4960447 - DNA, 16 bp, Homo sapiens
tccagacccctggctt

SEQ ID NO: 4960448 - DNA, 18 bp, Homo sapiens
tccagacccctggctttt

SEQ ID NO: 4960449 - DNA, 18 bp, Homo sapiens
tccagacccggctgcgtg

SEQ ID NO: 4960450 - DNA, 19 bp, Homo sapiens
tccagacttccttgagaca

SEQ ID NO: 4960451 - DNA, 21 bp, Homo sapiens
tccagagcggaggctgtgtgc

SEQ ID NO: 4960452 - DNA, 23 bp, Homo sapiens
tccagagcggaggctgtgtgcct

SEQ ID NO: 4960453 - DNA, 20 bp, Homo sapiens
tccagcaacacagcctgggc

SEQ ID NO: 4960454 - DNA, 21 bp, Homo sapiens
tccagcaacacagcctgggcc

SEQ ID NO: 4960455 - DNA, 11 bp, Homo sapiens
tccagcccatc

SEQ ID NO: 4960456 - DNA, 23 bp, Homo sapiens
tccagcccgggagcctaggacca

SEQ ID NO: 4960457 - DNA, 16 bp, Homo sapiens
tccagccgccattgcc

SEQ ID NO: 4960458 - DNA, 18 bp, Homo sapiens
tccagccgccattgccac

SEQ ID NO: 4960459 - DNA, 22 bp, Homo sapiens
tccagccgccattgccaccagg

SEQ ID NO: 4960460 - DNA, 13 bp, Homo sapiens
tccagcctgggca

SEQ ID NO: 4960461 - DNA, 22 bp, Homo sapiens
tccagcctgggcagccaggctg

SEQ ID NO: 4960462 - DNA, 15 bp, Homo sapiens
tccagctcaccagcc

SEQ ID NO: 4960463 - DNA, 18 bp, Homo sapiens
tccagctcagaacccagg

SEQ ID NO: 4960464 - DNA, 12 bp, Homo sapiens
tccagctgctgt

SEQ ID NO: 4960465 - DNA, 11 bp, Homo sapiens
tccagctggcc

SEQ ID NO: 4960466 - DNA, 12 bp, Homo sapiens
tccagctggcct

SEQ ID NO: 4960467 - DNA, 13 bp, Homo sapiens
tccagctggcctg

SEQ ID NO: 4960468 - DNA, 13 bp, Homo sapiens
tccaggagcctgg

SEQ ID NO: 4960469 - DNA, 15 bp, Homo sapiens
tccaggagcctgtgc

SEQ ID NO: 4960470 - DNA, 15 bp, Homo sapiens
tccaggcacagctga

SEQ ID NO: 4960471 - DNA, 17 bp, Homo sapiens
tccaggcacagctgagt

SEQ ID NO: 4960472 - DNA, 13 bp, Homo sapiens
tccaggcacagga

SEQ ID NO: 4960473 - DNA, 20 bp, Homo sapiens
tccaggcctgcagcaggagt

SEQ ID NO: 4960474 - DNA, 10 bp, Homo sapiens
tccaggctcc

SEQ ID NO: 4960475 - DNA, 12 bp, Homo sapiens
tccaggctcctt

SEQ ID NO: 4960476 - DNA, 21 bp, Homo sapiens
tccaggctgtatcccatgagc

SEQ ID NO: 4960477 - DNA, 16 bp, Homo sapiens
tccagggaagctggcc

SEQ ID NO: 4960478 - DNA, 19 bp, Homo sapiens
tccagggaatccaagcctc

SEQ ID NO: 4960479 - DNA, 15 bp, Homo sapiens
tccagggagcctaga

SEQ ID NO: 4960480 - DNA, 21 bp, Homo sapiens
tccagggagcctagaagctgg

SEQ ID NO: 4960481 - DNA, 18 bp, Homo sapiens
tccaggtgttactgtaat

SEQ ID NO: 4960482 - DNA, 15 bp, Homo sapiens
tccagtaatctaata

SEQ ID NO: 4960483 - DNA, 19 bp, Homo sapiens
tccagtattcttgtcaaaa

SEQ ID NO: 4960484 - DNA, 14 bp, Homo sapiens
tccagtgccagcaa

SEQ ID NO: 4960485 - DNA, 22 bp, Homo sapiens
tccagtggaggtttgtcgggca

SEQ ID NO: 4960486 - DNA, 13 bp, Homo sapiens
tccagtggttctg

SEQ ID NO: 4960487 - DNA, 13 bp, Homo sapiens
tccagtgtacata

SEQ ID NO: 4960488 - DNA, 17 bp, Homo sapiens
tccagttaaccaagtca

SEQ ID NO: 4960489 - DNA, 22 bp, Homo sapiens
tccagttaaggaccgtggccct

SEQ ID NO: 4960490 - DNA, 22 bp, Homo sapiens
tccataatctggactcctctgt

SEQ ID NO: 4960491 - DNA, 23 bp, Homo sapiens
tccataatctggactcctctgtc

SEQ ID NO: 4960492 - DNA, 16 bp, Homo sapiens
tccataatgctactgt

SEQ ID NO: 4960493 - DNA, 18 bp, Homo sapiens
tccataatgctactgtct

SEQ ID NO: 4960494 - DNA, 15 bp, Homo sapiens
tccataccagctcgc

SEQ ID NO: 4960495 - DNA, 18 bp, Homo sapiens
tccatagtagtatgatga

SEQ ID NO: 4960496 - DNA, 13 bp, Homo sapiens
tccatatttggaa

SEQ ID NO: 4960497 - DNA, 18 bp, Homo sapiens
tccatattttcacaggtg

SEQ ID NO: 4960498 - DNA, 14 bp, Homo sapiens
tccatcaggccact

SEQ ID NO: 4960499 - DNA, 22 bp, Homo sapiens
tccatcccaaccagtgccaagg

SEQ ID NO: 4960500 - DNA, 21 bp, Homo sapiens
tccatcccaggacaccacacc

SEQ ID NO: 4960501 - DNA, 23 bp, Homo sapiens
tccatctcccgaattcgctgtta

SEQ ID NO: 4960502 - DNA, 20 bp, Homo sapiens
tccatgacaggcctgaagat

SEQ ID NO: 4960503 - DNA, 12 bp, Homo sapiens
tccatgattcta

SEQ ID NO: 4960504 - DNA, 13 bp, Homo sapiens
tccatgcaccaaa

SEQ ID NO: 4960505 - DNA, 17 bp, Homo sapiens
tccatgcatgacagcct

SEQ ID NO: 4960506 - DNA, 20 bp, Homo sapiens
tccatgctcctcactgcccg

SEQ ID NO: 4960507 - DNA, 17 bp, Homo sapiens
tccatgtcctatgtgtg

SEQ ID NO: 4960508 - DNA, 17 bp, Homo sapiens
tccatgtcgcctctgca

SEQ ID NO: 4960509 - DNA, 19 bp, Homo sapiens
tccattaaagtctgaatca

SEQ ID NO: 4960510 - DNA, 20 bp, Homo sapiens
tccattcccaactagacatt

SEQ ID NO: 4960511 - DNA, 18 bp, Homo sapiens
tccattggtccaagattc

SEQ ID NO: 4960512 - DNA, 17 bp, Homo sapiens
tccatttatatatgaaa

SEQ ID NO: 4960513 - DNA, 19 bp, Homo sapiens
tccatttatatatgaaaac

SEQ ID NO: 4960514 - DNA, 23 bp, Homo sapiens
tccattttcctacaggcagtctc

SEQ ID NO: 4960515 - DNA, 18 bp, Homo sapiens
tcccaaagtgctgagatt

SEQ ID NO: 4960516 - DNA, 20 bp, Homo sapiens
tcccaaagtgctgagattac

SEQ ID NO: 4960517 - DNA, 14 bp, Homo sapiens
tcccaaagtgctgg

SEQ ID NO: 4960518 - DNA, 16 bp, Homo sapiens
tcccaaagtgctggga

SEQ ID NO: 4960519 - DNA, 19 bp, Homo sapiens
tcccaaatttgattgattt

SEQ ID NO: 4960520 - DNA, 20 bp, Homo sapiens
tcccaaatttgattgatttg

SEQ ID NO: 4960521 - DNA, 22 bp, Homo sapiens
tcccaaatttgattgatttgaa

SEQ ID NO: 4960522 - DNA, 19 bp, Homo sapiens
tcccaacaacatccatgtc

SEQ ID NO: 4960523 - DNA, 15 bp, Homo sapiens
tcccaacagccatgc

SEQ ID NO: 4960524 - DNA, 23 bp, Homo sapiens
tcccaaccagtgccaaggacctc

SEQ ID NO: 4960525 - DNA, 14 bp, Homo sapiens
tcccaacttgtaaa

SEQ ID NO: 4960526 - DNA, 14 bp, Homo sapiens
tcccaagccttcgg

SEQ ID NO: 4960527 - DNA, 12 bp, Homo sapiens
tcccaagctctg

SEQ ID NO: 4960528 - DNA, 22 bp, Homo sapiens
tcccaaggaaagccccagcact

SEQ ID NO: 4960529 - DNA, 17 bp, Homo sapiens
tcccaaggagaacaaat

SEQ ID NO: 4960530 - DNA, 18 bp, Homo sapiens
tcccaaggctctgagcaa

SEQ ID NO: 4960531 - DNA, 20 bp, Homo sapiens
tcccaagtagctgggattac

SEQ ID NO: 4960532 - DNA, 22 bp, Homo sapiens
tcccaatagcaacgtagcttct

SEQ ID NO: 4960533 - DNA, 13 bp, Homo sapiens
tcccaatcagcac

SEQ ID NO: 4960534 - DNA, 15 bp, Homo sapiens
tcccaatcagcactg

SEQ ID NO: 4960535 - DNA, 14 bp, Homo sapiens
tcccaatgcacatc

SEQ ID NO: 4960536 - DNA, 13 bp, Homo sapiens
tcctcactggcca

SEQ ID NO: 4960537 - DNA, 15 bp, Homo sapiens
tcctcatccacccca

SEQ ID NO: 4960538 - DNA, 22 bp, Homo sapiens
tcctcatcccgtgttctccttt

SEQ ID NO: 4960539 - DNA, 23 bp, Homo sapiens
tcctccaaaggccccctacgcca

SEQ ID NO: 4960540 - DNA, 15 bp, Homo sapiens
tcctccagctgcacc

SEQ ID NO: 4960541 - DNA, 13 bp, Homo sapiens
tcctcccacctca

SEQ ID NO: 4960542 - DNA, 19 bp, Homo sapiens
tcctcccaggcgccccttc

SEQ ID NO: 4960543 - DNA, 18 bp, Homo sapiens
tcctcccctcacagcctc

SEQ ID NO: 4960544 - DNA, 19 bp, Homo sapiens
tcctcccctcacagcctct

SEQ ID NO: 4960545 - DNA, 19 bp, Homo sapiens
tcctccctttccttcctaa

SEQ ID NO: 4960546 - DNA, 18 bp, Homo sapiens
tcctccgtccagccgcca

SEQ ID NO: 4960547 - DNA, 12 bp, Homo sapiens
tcctcctctttc

SEQ ID NO: 4960548 - DNA, 13 bp, Homo sapiens
tcctcctctttct

SEQ ID NO: 4960549 - DNA, 15 bp, Homo sapiens
tcctcctctttctct

SEQ ID NO: 4960550 - DNA, 16 bp, Homo sapiens
tcctcctctttctctc

SEQ ID NO: 4960551 - DNA, 18 bp, Homo sapiens
tcctcctggaaccttgct

SEQ ID NO: 4960552 - DNA, 20 bp, Homo sapiens
tcctcctggaaccttgctgt

SEQ ID NO: 4960553 - DNA, 19 bp, Homo sapiens
tcctccttggtgcctggcc

SEQ ID NO: 4960554 - DNA, 21 bp, Homo sapiens
tcctctagctgtgggggtgag

SEQ ID NO: 4960555 - DNA, 21 bp, Homo sapiens
tcctctatacatctctcccca

SEQ ID NO: 4960556 - DNA, 15 bp, Homo sapiens
tcctctccactgcct

SEQ ID NO: 4960557 - DNA, 16 bp, Homo sapiens
tcctctccactgcctt

SEQ ID NO: 4960558 - DNA, 17 bp, Homo sapiens
tcctctcccaagtccac

SEQ ID NO: 4960559 - DNA, 13 bp, Homo sapiens
tcctctcccctcc

SEQ ID NO: 4960560 - DNA, 15 bp, Homo sapiens
tcctctcctggagga

SEQ ID NO: 4960561 - DNA, 14 bp, Homo sapiens
tcctctctccagat

SEQ ID NO: 4960562 - DNA, 13 bp, Homo sapiens
tcctctggggctc

SEQ ID NO: 4960563 - DNA, 19 bp, Homo sapiens
tcctctgtcctgcttctga

SEQ ID NO: 4960564 - DNA, 18 bp, Homo sapiens
tcctctgtctgcccttca

SEQ ID NO: 4960565 - DNA, 15 bp, Homo sapiens
tcctctttctctccc

SEQ ID NO: 4960566 - DNA, 17 bp, Homo sapiens
tcctctttctctcccca

SEQ ID NO: 4960567 - DNA, 20 bp, Homo sapiens
tcctgaaccgcacagctcag

SEQ ID NO: 4960568 - DNA, 19 bp, Homo sapiens
tcctgaactcttctgcaaa

SEQ ID NO: 4960569 - DNA, 16 bp, Homo sapiens
tcctgacagaaggtgc

SEQ ID NO: 4960570 - DNA, 17 bp, Homo sapiens
tcctgacagaaggtgcc

SEQ ID NO: 4960571 - DNA, 18 bp, Homo sapiens
tcctgacatcacagcagc

SEQ ID NO: 4960572 - DNA, 17 bp, Homo sapiens
tcctgactctgccccct

SEQ ID NO: 4960573 - DNA, 22 bp, Homo sapiens
tcctgactgtaacatattctgt

SEQ ID NO: 4960574 - DNA, 13 bp, Homo sapiens
tcctgacttctaa

SEQ ID NO: 4960575 - DNA, 13 bp, Homo sapiens
tcctgagccccgc

SEQ ID NO: 4960576 - DNA, 16 bp, Homo sapiens
tcctgaggctttggat

SEQ ID NO: 4960577 - DNA, 20 bp, Homo sapiens
tcctgaggggcatctgcccc

SEQ ID NO: 4960578 - DNA, 21 bp, Homo sapiens
tcctgaggggcatctgcccct

SEQ ID NO: 4960579 - DNA, 22 bp, Homo sapiens
tcctgaggggcatctgcccctc

SEQ ID NO: 4960580 - DNA, 17 bp, Homo sapiens
tcctgagggtccccacc

SEQ ID NO: 4960581 - DNA, 19 bp, Homo sapiens
tcctgagggtccccacctg

SEQ ID NO: 4960582 - DNA, 17 bp, Homo sapiens
tcctgagtggccaggga

SEQ ID NO: 4960583 - DNA, 18 bp, Homo sapiens
tcctgataaagcacagct

SEQ ID NO: 4960584 - DNA, 14 bp, Homo sapiens
tcctgatctgtgat

SEQ ID NO: 4960585 - DNA, 23 bp, Homo sapiens
tcctgatggtacaggaaagctca

SEQ ID NO: 4960586 - DNA, 16 bp, Homo sapiens
tcctgcaattttctaa

SEQ ID NO: 4960587 - DNA, 17 bp, Homo sapiens
tcctgcagcatggtccc

SEQ ID NO: 4960588 - DNA, 14 bp, Homo sapiens
tcctgccagcccca

SEQ ID NO: 4960589 - DNA, 15 bp, Homo sapiens
tcctgccagccccac

SEQ ID NO: 4960590 - DNA, 22 bp, Homo sapiens
tcctgccagccccacacagcta

SEQ ID NO: 4960591 - DNA, 16 bp, Homo sapiens
tcctgcctcagcctcc

SEQ ID NO: 4960592 - DNA, 17 bp, Homo sapiens
tcctgcctcagcctccc

SEQ ID NO: 4960593 - DNA, 12 bp, Homo sapiens
tcctgcctgtgc

SEQ ID NO: 4960594 - DNA, 12 bp, Homo sapiens
tcctgcctttta

SEQ ID NO: 4960595 - DNA, 20 bp, Homo sapiens
tcctgctccagaatttggaa

SEQ ID NO: 4960596 - DNA, 19 bp, Homo sapiens
tcctggaaccttgctgtcc

SEQ ID NO: 4960597 - DNA, 20 bp, Homo sapiens
tcctggaaccttgctgtcct

SEQ ID NO: 4960598 - DNA, 17 bp, Homo sapiens
tcctggacactcagacc

SEQ ID NO: 4960599 - DNA, 16 bp, Homo sapiens
tcctggagaagcctcg

SEQ ID NO: 4960600 - DNA, 18 bp, Homo sapiens
tcctggatgttgtgtgta

SEQ ID NO: 4960601 - DNA, 19 bp, Homo sapiens
tcctggcacccggcccctg

SEQ ID NO: 4960602 - DNA, 21 bp, Homo sapiens
tcctggcacccggcccctgct

SEQ ID NO: 4960603 - DNA, 23 bp, Homo sapiens
tcctggcacccggcccctgctgg

SEQ ID NO: 4960604 - DNA, 13 bp, Homo sapiens
tcctggcagccca

SEQ ID NO: 4960605 - DNA, 16 bp, Homo sapiens
tcctggcagcccagag

SEQ ID NO: 4960606 - DNA, 20 bp, Homo sapiens
tcctggccagatggcccgga

SEQ ID NO: 4960607 - DNA, 14 bp, Homo sapiens
tcctggcccctcaa

SEQ ID NO: 4960608 - DNA, 18 bp, Homo sapiens
tcctggcccctcaacctc

SEQ ID NO: 4960609 - DNA, 13 bp, Homo sapiens
tcctggctcctga

SEQ ID NO: 4960610 - DNA, 22 bp, Homo sapiens
tcctggctgcggcgtctgtctg

SEQ ID NO: 4960611 - DNA, 15 bp, Homo sapiens
tcctgggagacccat

SEQ ID NO: 4960612 - DNA, 14 bp, Homo sapiens
tcctgggagtgagc

SEQ ID NO: 4960613 - DNA, 12 bp, Homo sapiens
tcctgggctcag

SEQ ID NO: 4960614 - DNA, 13 bp, Homo sapiens
tcctgggctcagg

SEQ ID NO: 4960615 - DNA, 22 bp, Homo sapiens
tcctgggggttctttcttcctc

SEQ ID NO: 4960616 - DNA, 14 bp, Homo sapiens
tcctgggtaatgag

SEQ ID NO: 4960617 - DNA, 21 bp, Homo sapiens
tcctggttcccgtttctccac

SEQ ID NO: 4960618 - DNA, 21 bp, Homo sapiens
tcctgtaagccaaagaaatga

SEQ ID NO: 4960619 - DNA, 23 bp, Homo sapiens
tcctgtagttgcgtggactctgc

SEQ ID NO: 4960620 - DNA, 11 bp, Homo sapiens
tcctgtcctcc

SEQ ID NO: 4960621 - DNA, 18 bp, Homo sapiens
tcctgtctttaaggaaaa

SEQ ID NO: 4960622 - DNA, 18 bp, Homo sapiens
tcctgtgacttcagctct

SEQ ID NO: 4960623 - DNA, 21 bp, Homo sapiens
tcctgtgatccacccaaccct

SEQ ID NO: 4960624 - DNA, 18 bp, Homo sapiens
tcctgtggaacccagcag

SEQ ID NO: 4960625 - DNA, 15 bp, Homo sapiens
tcctgtgtactgtgt

SEQ ID NO: 4960626 - DNA, 13 bp, Homo sapiens
tcctgtgtgtgcg

SEQ ID NO: 4960627 - DNA, 14 bp, Homo sapiens
tcctgtgtgtgcgc

SEQ ID NO: 4960628 - DNA, 16 bp, Homo sapiens
tcctgtttttctgggt

SEQ ID NO: 4960629 - DNA, 18 bp, Homo sapiens
tccttaaaatgtaagatt

SEQ ID NO: 4960630 - DNA, 22 bp, Homo sapiens
tccttatcagagctaagggtgg

SEQ ID NO: 4960631 - DNA, 20 bp, Homo sapiens
tccttatttgcttcattgta

SEQ ID NO: 4960632 - DNA, 15 bp, Homo sapiens
tccttcaaaatcctt

SEQ ID NO: 4960633 - DNA, 20 bp, Homo sapiens
tccttcaagaactctgggct

SEQ ID NO: 4960634 - DNA, 21 bp, Homo sapiens
tccttcaagaactctgggctg

SEQ ID NO: 4960635 - DNA, 13 bp, Homo sapiens
tccttcagacacc

SEQ ID NO: 4960636 - DNA, 23 bp, Homo sapiens
tccttcagacaccctcaacctct

SEQ ID NO: 4960637 - DNA, 20 bp, Homo sapiens
tccttcctaatttcccttct

SEQ ID NO: 4960638 - DNA, 13 bp, Homo sapiens
tccttcctaccct

SEQ ID NO: 4960639 - DNA, 17 bp, Homo sapiens
tccttcgtatcccgagt

SEQ ID NO: 4960640 - DNA, 20 bp, Homo sapiens
tccttctctgaacacaggca

SEQ ID NO: 4960641 - DNA, 22 bp, Homo sapiens
tccttctctgaacacaggcagc

SEQ ID NO: 4960642 - DNA, 13 bp, Homo sapiens
tccttctggcctt

SEQ ID NO: 4960643 - DNA, 20 bp, Homo sapiens
tccttctgtgaaagtacatt

SEQ ID NO: 4960644 - DNA, 19 bp, Homo sapiens
tccttctttgataatgtta

SEQ ID NO: 4960645 - DNA, 22 bp, Homo sapiens
tccttctttgataatgttaaat

SEQ ID NO: 4960646 - DNA, 23 bp, Homo sapiens
tctctgttctacccgttccaaaa

SEQ ID NO: 4960647 - DNA, 18 bp, Homo sapiens
tctcttaaacttgtgaat

SEQ ID NO: 4960648 - DNA, 19 bp, Homo sapiens
tctcttcagactctcagcc

SEQ ID NO: 4960649 - DNA, 18 bp, Homo sapiens
tctcttcctgcccctctt

SEQ ID NO: 4960650 - DNA, 17 bp, Homo sapiens
tctcttctgctccaccc

SEQ ID NO: 4960651 - DNA, 15 bp, Homo sapiens
tctcttgagctggcc

SEQ ID NO: 4960652 - DNA, 22 bp, Homo sapiens
tctctttaagggcatgccttgt

SEQ ID NO: 4960653 - DNA, 15 bp, Homo sapiens
tctctttctctcttc

SEQ ID NO: 4960654 - DNA, 17 bp, Homo sapiens
tctctttctctcttccc

SEQ ID NO: 4960655 - DNA, 21 bp, Homo sapiens
tctcttttcctgttgtattga

SEQ ID NO: 4960656 - DNA, 12 bp, Homo sapiens
tctgaaaactgg

SEQ ID NO: 4960657 - DNA, 21 bp, Homo sapiens
tctgaaacacactgaaagctc

SEQ ID NO: 4960658 - DNA, 12 bp, Homo sapiens
tctgaaattcta

SEQ ID NO: 4960659 - DNA, 13 bp, Homo sapiens
tctgaactttgga

SEQ ID NO: 4960660 - DNA, 15 bp, Homo sapiens
tctgaactttggaga

SEQ ID NO: 4960661 - DNA, 17 bp, Homo sapiens
tctgaactttggagagt

SEQ ID NO: 4960662 - DNA, 15 bp, Homo sapiens
tctgaagcatgtttc

SEQ ID NO: 4960663 - DNA, 22 bp, Homo sapiens
tctgaaggacattgcggacagc

SEQ ID NO: 4960664 - DNA, 20 bp, Homo sapiens
tctgaagtcacatcacagga

SEQ ID NO: 4960665 - DNA, 22 bp, Homo sapiens
tctgaagtcacatcacaggaca

SEQ ID NO: 4960666 - DNA, 16 bp, Homo sapiens
tctgaagtcactgcac

SEQ ID NO: 4960667 - DNA, 13 bp, Homo sapiens
tctgaatgctgcc

SEQ ID NO: 4960668 - DNA, 14 bp, Homo sapiens
tctgacaaactgtg

SEQ ID NO: 4960669 - DNA, 13 bp, Homo sapiens
tctgacaagggct

SEQ ID NO: 4960670 - DNA, 16 bp, Homo sapiens
tctgacaagggctgac

SEQ ID NO: 4960671 - DNA, 23 bp, Homo sapiens
tctgacaagggctgacctgcctc

SEQ ID NO: 4960672 - DNA, 13 bp, Homo sapiens
tctgacacacagc

SEQ ID NO: 4960673 - DNA, 21 bp, Homo sapiens
tctgacaggcaatgctggctg

SEQ ID NO: 4960674 - DNA, 14 bp, Homo sapiens
tctgacccactgct

SEQ ID NO: 4960675 - DNA, 13 bp, Homo sapiens
tctgacccctcct

SEQ ID NO: 4960676 - DNA, 15 bp, Homo sapiens
tctgacccctcctca

SEQ ID NO: 4960677 - DNA, 18 bp, Homo sapiens
tctgacctgcactgggga

SEQ ID NO: 4960678 - DNA, 13 bp, Homo sapiens
tctgacggccctg

SEQ ID NO: 4960679 - DNA, 14 bp, Homo sapiens
tctgacggccctgc

SEQ ID NO: 4960680 - DNA, 14 bp, Homo sapiens
tctgactactttgc

SEQ ID NO: 4960681 - DNA, 15 bp, Homo sapiens
tctgagaagaggagc

SEQ ID NO: 4960682 - DNA, 19 bp, Homo sapiens
tctgagaagaggagccctc

SEQ ID NO: 4960683 - DNA, 23 bp, Homo sapiens
tctgagaagaggagccctcatct

SEQ ID NO: 4960684 - DNA, 14 bp, Homo sapiens
tctgagagtctaga

SEQ ID NO: 4960685 - DNA, 19 bp, Homo sapiens
tctgagagtctagattctc

SEQ ID NO: 4960686 - DNA, 15 bp, Homo sapiens
tctgagcacacttta

SEQ ID NO: 4960687 - DNA, 21 bp, Homo sapiens
tctgagccacagcagcatttt

SEQ ID NO: 4960688 - DNA, 23 bp, Homo sapiens
tctgagcccatgttctgccccca

SEQ ID NO: 4960689 - DNA, 22 bp, Homo sapiens
tctgagcgggaggcagagtttg

SEQ ID NO: 4960690 - DNA, 16 bp, Homo sapiens
tctgaggaatccagac

SEQ ID NO: 4960691 - DNA, 20 bp, Homo sapiens
tctgaggacactaaccacgc

SEQ ID NO: 4960692 - DNA, 23 bp, Homo sapiens
tctgaggacactaaccacgctgg

SEQ ID NO: 4960693 - DNA, 19 bp, Homo sapiens
tctgagttgccaagacaaa

SEQ ID NO: 4960694 - DNA, 15 bp, Homo sapiens
tctgagtttcattct

SEQ ID NO: 4960695 - DNA, 22 bp, Homo sapiens
tctgagtttcattctcctgcct

SEQ ID NO: 4960696 - DNA, 24 bp, Homo sapiens
tctgagtttcattctcctgcctgt

SEQ ID NO: 4960697 - DNA, 15 bp, Homo sapiens
tctgatatgggactg

SEQ ID NO: 4960698 - DNA, 18 bp, Homo sapiens
tctgatggaccttctaga

SEQ ID NO: 4960699 - DNA, 14 bp, Homo sapiens
tctgatgtctctaa

SEQ ID NO: 4960700 - DNA, 15 bp, Homo sapiens
tctgattagctttgt

SEQ ID NO: 4960701 - DNA, 16 bp, Homo sapiens
tctgattagctttgtg

SEQ ID NO: 4960702 - DNA, 18 bp, Homo sapiens
tctgattagctttgtgtt

SEQ ID NO: 4960703 - DNA, 20 bp, Homo sapiens
tctgattcccaagctctgct

SEQ ID NO: 4960704 - DNA, 23 bp, Homo sapiens
tctgattcccaagctctgctcct

SEQ ID NO: 4960705 - DNA, 17 bp, Homo sapiens
tctgattggcttgtaga

SEQ ID NO: 4960706 - DNA, 23 bp, Homo sapiens
tctgattggcttgtagaattgtt

SEQ ID NO: 4960707 - DNA, 17 bp, Homo sapiens
tctgatttgcatattca

SEQ ID NO: 4960708 - DNA, 13 bp, Homo sapiens
tctgattttagga

SEQ ID NO: 4960709 - DNA, 22 bp, Homo sapiens
tctgattttaggagctaaggct

SEQ ID NO: 4960710 - DNA, 21 bp, Homo sapiens
tctgattttgtgcaaaagctt

SEQ ID NO: 4960711 - DNA, 14 bp, Homo sapiens
tctgatttttatga

SEQ ID NO: 4960712 - DNA, 16 bp, Homo sapiens
tctgcaaaaggagaga

SEQ ID NO: 4960713 - DNA, 20 bp, Homo sapiens
tctgcaattcccctctgctg

SEQ ID NO: 4960714 - DNA, 23 bp, Homo sapiens
tctgcacatgaatcccacccaca

SEQ ID NO: 4960715 - DNA, 12 bp, Homo sapiens
tctgcacatgtc

SEQ ID NO: 4960716 - DNA, 15 bp, Homo sapiens
tctgcacatgtcttg

SEQ ID NO: 4960717 - DNA, 17 bp, Homo sapiens
tctgcacatgtcttgta

SEQ ID NO: 4960718 - DNA, 23 bp, Homo sapiens
tctgcaccctggggcctggacct

SEQ ID NO: 4960719 - DNA, 24 bp, Homo sapiens
tctgcaccctggggcctggacctg

SEQ ID NO: 4960720 - DNA, 13 bp, Homo sapiens
tctgcactgaaaa

SEQ ID NO: 4960721 - DNA, 16 bp, Homo sapiens
tctgcactgaaaaggt

SEQ ID NO: 4960722 - DNA, 12 bp, Homo sapiens
tctgcagctgcc

SEQ ID NO: 4960723 - DNA, 19 bp, Homo sapiens
tctgcagggggtgtgtctg

SEQ ID NO: 4960724 - DNA, 19 bp, Homo sapiens
tctgcatcccagcacctgc

SEQ ID NO: 4960725 - DNA, 17 bp, Homo sapiens
tctgcattttcacccca

SEQ ID NO: 4960726 - DNA, 21 bp, Homo sapiens
tctgcattttcaccccaccct

SEQ ID NO: 4960727 - DNA, 15 bp, Homo sapiens
tctgccacactctga

SEQ ID NO: 4960728 - DNA, 17 bp, Homo sapiens
tctgccagcaaagagga

SEQ ID NO: 4960729 - DNA, 13 bp, Homo sapiens
tctgccagggagc

SEQ ID NO: 4960730 - DNA, 14 bp, Homo sapiens
tctgccagggagct

SEQ ID NO: 4960731 - DNA, 11 bp, Homo sapiens
tctgccagggc

SEQ ID NO: 4960732 - DNA, 18 bp, Homo sapiens
tctgccatattctgttgg

SEQ ID NO: 4960733 - DNA, 22 bp, Homo sapiens
tctgccatattctgttggccag

SEQ ID NO: 4960734 - DNA, 19 bp, Homo sapiens
tctgcccaaaaatatggtt

SEQ ID NO: 4960735 - DNA, 16 bp, Homo sapiens
tctgcccccagcccaa

SEQ ID NO: 4960736 - DNA, 14 bp, Homo sapiens
tctgccccctgctg

SEQ ID NO: 4960737 - DNA, 14 bp, Homo sapiens
tctgcccctccccc

SEQ ID NO: 4960738 - DNA, 18 bp, Homo sapiens
tctgcccctcccccaacc

SEQ ID NO: 4960739 - DNA, 21 bp, Homo sapiens
tctgcctcaccgcttccctcc

SEQ ID NO: 4960740 - DNA, 20 bp, Homo sapiens
tctgcctccatgctgcagtg

SEQ ID NO: 4960741 - DNA, 15 bp, Homo sapiens
tctgcctcctcttca

SEQ ID NO: 4960742 - DNA, 18 bp, Homo sapiens
tctgcctctgacacacag

SEQ ID NO: 4960743 - DNA, 21 bp, Homo sapiens
tctgcctgcccaggcccctgc

SEQ ID NO: 4960744 - DNA, 22 bp, Homo sapiens
tctgcctgcccaggcccctgcc

SEQ ID NO: 4960745 - DNA, 12 bp, Homo sapiens
tctgcctgtctc

SEQ ID NO: 4960746 - DNA, 19 bp, Homo sapiens
tctgccttagtctcagttt

SEQ ID NO: 4960747 - DNA, 14 bp, Homo sapiens
tctgcggaccccag

SEQ ID NO: 4960748 - DNA, 16 bp, Homo sapiens
tctgcgtgggtcagaa

SEQ ID NO: 4960749 - DNA, 22 bp, Homo sapiens
tctgcgtggttcctttctcagc

SEQ ID NO: 4960750 - DNA, 17 bp, Homo sapiens
tctgctcacagtaaccc

SEQ ID NO: 4960751 - DNA, 16 bp, Homo sapiens
tctgctcacatatctg

SEQ ID NO: 4960752 - DNA, 15 bp, Homo sapiens
tctgctcagccaagc

SEQ ID NO: 4960753 - DNA, 14 bp, Homo sapiens
tctgctccaccaca

SEQ ID NO: 4960754 - DNA, 18 bp, Homo sapiens
tctgctccacccttggcc

SEQ ID NO: 4960755 - DNA, 19 bp, Homo sapiens
tctgctccacccttggcct

SEQ ID NO: 4960756 - DNA, 22 bp, Homo sapiens
tcttgtccatgtggttcttcaa

SEQ ID NO: 4960757 - DNA, 19 bp, Homo sapiens
tcttgtgctagaatacttt

SEQ ID NO: 4960758 - DNA, 21 bp, Homo sapiens
tcttgtgctagaatacttttt

SEQ ID NO: 4960759 - DNA, 22 bp, Homo sapiens
tcttgtgctggatggagcccag

SEQ ID NO: 4960760 - DNA, 18 bp, Homo sapiens
tcttgtgtgattaactta

SEQ ID NO: 4960761 - DNA, 15 bp, Homo sapiens
tcttgttagaaaaca

SEQ ID NO: 4960762 - DNA, 17 bp, Homo sapiens
tcttgttagaaaacaaa

SEQ ID NO: 4960763 - DNA, 21 bp, Homo sapiens
tcttgtttctccagattttta

SEQ ID NO: 4960764 - DNA, 14 bp, Homo sapiens
tcttgttttgtttg

SEQ ID NO: 4960765 - DNA, 17 bp, Homo sapiens
tcttgttttgtttgtct

SEQ ID NO: 4960766 - DNA, 17 bp, Homo sapiens
tcttgtttttattaatt

SEQ ID NO: 4960767 - DNA, 21 bp, Homo sapiens
tcttgtttttattaatttata

SEQ ID NO: 4960768 - DNA, 18 bp, Homo sapiens
tcttgttttttttttcca

SEQ ID NO: 4960769 - DNA, 15 bp, Homo sapiens
tctttaaaacaaaac

SEQ ID NO: 4960770 - DNA, 14 bp, Homo sapiens
tctttaaaagagag

SEQ ID NO: 4960771 - DNA, 14 bp, Homo sapiens
tctttaaaggccca

SEQ ID NO: 4960772 - DNA, 12 bp, Homo sapiens
tctttaaataga

SEQ ID NO: 4960773 - DNA, 19 bp, Homo sapiens
tctttaagggcatgccttg

SEQ ID NO: 4960774 - DNA, 22 bp, Homo sapiens
tctttaagggcatgccttgtgc

SEQ ID NO: 4960775 - DNA, 18 bp, Homo sapiens
tctttaatgtcacaggca

SEQ ID NO: 4960776 - DNA, 20 bp, Homo sapiens
tctttaatgtcacaggcagg

SEQ ID NO: 4960777 - DNA, 22 bp, Homo sapiens
tctttaatgtcacaggcaggtc

SEQ ID NO: 4960778 - DNA, 22 bp, Homo sapiens
tctttaatttctgtcagaatgc

SEQ ID NO: 4960779 - DNA, 16 bp, Homo sapiens
tctttactcccaagac

SEQ ID NO: 4960780 - DNA, 17 bp, Homo sapiens
tctttatagtgcacaaa

SEQ ID NO: 4960781 - DNA, 19 bp, Homo sapiens
tctttcacagctcctccca

SEQ ID NO: 4960782 - DNA, 20 bp, Homo sapiens
tctttcacagctcctcccac

SEQ ID NO: 4960783 - DNA, 15 bp, Homo sapiens
tctttcgtcaccctt

SEQ ID NO: 4960784 - DNA, 14 bp, Homo sapiens
tctttctaatgctg

SEQ ID NO: 4960785 - DNA, 18 bp, Homo sapiens
tctttctaatgtgtgaat

SEQ ID NO: 4960786 - DNA, 19 bp, Homo sapiens
tctttctaatgtgtgaatc

SEQ ID NO: 4960787 - DNA, 22 bp, Homo sapiens
tctttctagtggtctttgtaag

SEQ ID NO: 4960788 - DNA, 15 bp, Homo sapiens
tctttctattccaaa

SEQ ID NO: 4960789 - DNA, 17 bp, Homo sapiens
tctttctccaaagttat

SEQ ID NO: 4960790 - DNA, 24 bp, Homo sapiens
tctttctccttgaatatctttcga

SEQ ID NO: 4960791 - DNA, 13 bp, Homo sapiens
tctttctggagtc

SEQ ID NO: 4960792 - DNA, 15 bp, Homo sapiens
tctttcttcctctgc

SEQ ID NO: 4960793 - DNA, 22 bp, Homo sapiens
tctttcttttgattcttcctaa

SEQ ID NO: 4960794 - DNA, 14 bp, Homo sapiens
tctttgaatgcttt

SEQ ID NO: 4960795 - DNA, 19 bp, Homo sapiens
tctttgagggactgcctct

SEQ ID NO: 4960796 - DNA, 22 bp, Homo sapiens
tctttgagggactgcctctgcc

SEQ ID NO: 4960797 - DNA, 23 bp, Homo sapiens
tctttgagggactgcctctgcca

SEQ ID NO: 4960798 - DNA, 13 bp, Homo sapiens
tctttgataatgt

SEQ ID NO: 4960799 - DNA, 13 bp, Homo sapiens
tctttgcagacag

SEQ ID NO: 4960800 - DNA, 10 bp, Homo sapiens
tctttggggt

SEQ ID NO: 4960801 - DNA, 16 bp, Homo sapiens
tctttggggtgcccct

SEQ ID NO: 4960802 - DNA, 22 bp, Homo sapiens
tctttgtaagtcagtgttgaga

SEQ ID NO: 4960803 - DNA, 22 bp, Homo sapiens
tctttgtgataatttaagagct

SEQ ID NO: 4960804 - DNA, 23 bp, Homo sapiens
tctttgtgataatttaagagcta

SEQ ID NO: 4960805 - DNA, 14 bp, Homo sapiens
tctttgtggcttcc

SEQ ID NO: 4960806 - DNA, 13 bp, Homo sapiens
tctttgtggggct

SEQ ID NO: 4960807 - DNA, 18 bp, Homo sapiens
tcttttaaaaattcaaat

SEQ ID NO: 4960808 - DNA, 21 bp, Homo sapiens
tcttttaaagtgttacttttt

SEQ ID NO: 4960809 - DNA, 22 bp, Homo sapiens
tcttttatatttgtatcgatgt

SEQ ID NO: 4960810 - DNA, 21 bp, Homo sapiens
tcttttatgtttgaatatgga

SEQ ID NO: 4960811 - DNA, 16 bp, Homo sapiens
tcttttctgtacttcc

SEQ ID NO: 4960812 - DNA, 19 bp, Homo sapiens
tcttttcttactcctcctc

SEQ ID NO: 4960813 - DNA, 14 bp, Homo sapiens
tcttttctttttac

SEQ ID NO: 4960814 - DNA, 16 bp, Homo sapiens
tcttttctttttacat

SEQ ID NO: 4960815 - DNA, 14 bp, Homo sapiens
tcttttgaattgtt

SEQ ID NO: 4960816 - DNA, 18 bp, Homo sapiens
tcttttgttactgttctt

SEQ ID NO: 4960817 - DNA, 16 bp, Homo sapiens
tctttttaagtaatgt

SEQ ID NO: 4960818 - DNA, 12 bp, Homo sapiens
tctttttacata

SEQ ID NO: 4960819 - DNA, 17 bp, Homo sapiens
tcttttttaataaacta

SEQ ID NO: 4960820 - DNA, 22 bp, Homo sapiens
tcttttttactcattgaaatgt

SEQ ID NO: 4960821 - DNA, 14 bp, Homo sapiens
tctttttttgtgat

SEQ ID NO: 4960822 - DNA, 16 bp, Homo sapiens
tgaaaaaaacttcatt

SEQ ID NO: 4960823 - DNA, 13 bp, Homo sapiens
tgaaaaaagctca

SEQ ID NO: 4960824 - DNA, 22 bp, Homo sapiens
tgaaaaagacctttggagcaaa

SEQ ID NO: 4960825 - DNA, 16 bp, Homo sapiens
tgaaaaagtaaagtgt

SEQ ID NO: 4960826 - DNA, 19 bp, Homo sapiens
tgaaaaattcctttgtgtt

SEQ ID NO: 4960827 - DNA, 15 bp, Homo sapiens
tgaaaaccaaaatga

SEQ ID NO: 4960828 - DNA, 17 bp, Homo sapiens
tgaaaaccaaaatgaca

SEQ ID NO: 4960829 - DNA, 15 bp, Homo sapiens
tgaaaacctacatat

SEQ ID NO: 4960830 - DNA, 21 bp, Homo sapiens
tgaaaactggaataagaagca

SEQ ID NO: 4960831 - DNA, 19 bp, Homo sapiens
tgaaaagacaagaaaatca

SEQ ID NO: 4960832 - DNA, 16 bp, Homo sapiens
tgaaaagatgtacctg

SEQ ID NO: 4960833 - DNA, 14 bp, Homo sapiens
tgaaaagattcttc

SEQ ID NO: 4960834 - DNA, 13 bp, Homo sapiens
tgaaaagctatta

SEQ ID NO: 4960835 - DNA, 21 bp, Homo sapiens
tgaaaaggttcttcatccctt

SEQ ID NO: 4960836 - DNA, 12 bp, Homo sapiens
tgaaaagtcgtt

SEQ ID NO: 4960837 - DNA, 16 bp, Homo sapiens
tgaaaataagaataga

SEQ ID NO: 4960838 - DNA, 17 bp, Homo sapiens
tgaaaatatatgatggc

SEQ ID NO: 4960839 - DNA, 20 bp, Homo sapiens
tgaaaatatgatgtttcaca

SEQ ID NO: 4960840 - DNA, 15 bp, Homo sapiens
tgaaaatctaatatt

SEQ ID NO: 4960841 - DNA, 12 bp, Homo sapiens
tgaaaatgtact

SEQ ID NO: 4960842 - DNA, 13 bp, Homo sapiens
tgaaaatgttcat

SEQ ID NO: 4960843 - DNA, 13 bp, Homo sapiens
tgaaaatgttttt

SEQ ID NO: 4960844 - DNA, 21 bp, Homo sapiens
tgaaaattattttaaacaaaa

SEQ ID NO: 4960845 - DNA, 19 bp, Homo sapiens
tgaaaattcaaaaagtgtt

SEQ ID NO: 4960846 - DNA, 21 bp, Homo sapiens
tgaaaattttaaaaatacata

SEQ ID NO: 4960847 - DNA, 18 bp, Homo sapiens
tgaaacaaataatcacat

SEQ ID NO: 4960848 - DNA, 13 bp, Homo sapiens
tgaaacacagctg

SEQ ID NO: 4960849 - DNA, 15 bp, Homo sapiens
tgaaacacagctgtt

SEQ ID NO: 4960850 - DNA, 19 bp, Homo sapiens
tgaaacacagctgttcttc

SEQ ID NO: 4960851 - DNA, 17 bp, Homo sapiens
tgaaacacgaaacttgt

SEQ ID NO: 4960852 - DNA, 13 bp, Homo sapiens
tgaaacagaaaca

SEQ ID NO: 4960853 - DNA, 16 bp, Homo sapiens
tgaaactcacaaatga

SEQ ID NO: 4960854 - DNA, 18 bp, Homo sapiens
tgaaagaatatatttatt

SEQ ID NO: 4960855 - DNA, 13 bp, Homo sapiens
tgaaagacaccat

SEQ ID NO: 4960856 - DNA, 23 bp, Homo sapiens
tgaaagatggctgtgcctctgcc

SEQ ID NO: 4960857 - DNA, 21 bp, Homo sapiens
tgaaagattcaggtatgttgc

SEQ ID NO: 4960858 - DNA, 14 bp, Homo sapiens
tgaaagattgtggg

SEQ ID NO: 4960859 - DNA, 20 bp, Homo sapiens
tgaaagcagggaatttctat

SEQ ID NO: 4960860 - DNA, 22 bp, Homo sapiens
tgaaagccttagggaagctggc

SEQ ID NO: 4960861 - DNA, 17 bp, Homo sapiens
tgaaagctctgttgcaa

SEQ ID NO: 4960862 - DNA, 20 bp, Homo sapiens
tgaaagctgagaactcctga

SEQ ID NO: 4960863 - DNA, 18 bp, Homo sapiens
tgaaaggaagctccactg

SEQ ID NO: 4960864 - DNA, 15 bp, Homo sapiens
tgaaagggcccagag

SEQ ID NO: 4960865 - DNA, 16 bp, Homo sapiens
tgaaagggcccagaga

SEQ ID NO: 4960866 - DNA, 18 bp, Homo sapiens
tgaggtcagggagtgctg

SEQ ID NO: 4960867 - DNA, 17 bp, Homo sapiens
tgaggtctgtttaaagt

SEQ ID NO: 4960868 - DNA, 16 bp, Homo sapiens
tgaggtgaaagggagc

SEQ ID NO: 4960869 - DNA, 17 bp, Homo sapiens
tgaggtgaaagggagct

SEQ ID NO: 4960870 - DNA, 16 bp, Homo sapiens
tgaggtgcctgtccca

SEQ ID NO: 4960871 - DNA, 15 bp, Homo sapiens
tgaggtttcaccctt

SEQ ID NO: 4960872 - DNA, 15 bp, Homo sapiens
tgagtaaatattgag

SEQ ID NO: 4960873 - DNA, 20 bp, Homo sapiens
tgagtaaatattgaggcttt

SEQ ID NO: 4960874 - DNA, 17 bp, Homo sapiens
tgagtacaaatgcctta

SEQ ID NO: 4960875 - DNA, 21 bp, Homo sapiens
tgagtacaaatgccttaaaat

SEQ ID NO: 4960876 - DNA, 19 bp, Homo sapiens
tgagtagacacatttaagg

SEQ ID NO: 4960877 - DNA, 18 bp, Homo sapiens
tgagtagatattacttta

SEQ ID NO: 4960878 - DNA, 20 bp, Homo sapiens
tgagtagatattactttatc

SEQ ID NO: 4960879 - DNA, 19 bp, Homo sapiens
tgagtataaaaacttgaaa

SEQ ID NO: 4960880 - DNA, 23 bp, Homo sapiens
tgagtatggagcagcctggagac

SEQ ID NO: 4960881 - DNA, 20 bp, Homo sapiens
tgagtcaccctacctgtgcc

SEQ ID NO: 4960882 - DNA, 16 bp, Homo sapiens
tgagtcagggcccaga

SEQ ID NO: 4960883 - DNA, 18 bp, Homo sapiens
tgagtccttgaaaatatt

SEQ ID NO: 4960884 - DNA, 14 bp, Homo sapiens
tgagtcgaggacag

SEQ ID NO: 4960885 - DNA, 22 bp, Homo sapiens
tgagtctctggggcaggctgct

SEQ ID NO: 4960886 - DNA, 18 bp, Homo sapiens
tgagtctttggttctaag

SEQ ID NO: 4960887 - DNA, 19 bp, Homo sapiens
tgagtgagcctggctcttg

SEQ ID NO: 4960888 - DNA, 17 bp, Homo sapiens
tgagtgggagaaggcag

SEQ ID NO: 4960889 - DNA, 13 bp, Homo sapiens
tgagtgtaatgtt

SEQ ID NO: 4960890 - DNA, 18 bp, Homo sapiens
tgagtgtgtgtgtgcatg

SEQ ID NO: 4960891 - DNA, 19 bp, Homo sapiens
tgagttgccaagacaaatc

SEQ ID NO: 4960892 - DNA, 13 bp, Homo sapiens
tgagtttgcttat

SEQ ID NO: 4960893 - DNA, 18 bp, Homo sapiens
tgataaaagggcaaatct

SEQ ID NO: 4960894 - DNA, 16 bp, Homo sapiens
tgataagtaaatgcta

SEQ ID NO: 4960895 - DNA, 23 bp, Homo sapiens
tgataagttcctttccttttctt

SEQ ID NO: 4960896 - DNA, 23 bp, Homo sapiens
tgataataaattgaaattgtgaa

SEQ ID NO: 4960897 - DNA, 15 bp, Homo sapiens
tgataatagattctc

SEQ ID NO: 4960898 - DNA, 13 bp, Homo sapiens
tgataatgttaaa

SEQ ID NO: 4960899 - DNA, 14 bp, Homo sapiens
tgataatgttaaat

SEQ ID NO: 4960900 - DNA, 16 bp, Homo sapiens
tgatacaagattagaa

SEQ ID NO: 4960901 - DNA, 16 bp, Homo sapiens
tgatacataactaaat

SEQ ID NO: 4960902 - DNA, 17 bp, Homo sapiens
tgatacataactaaatt

SEQ ID NO: 4960903 - DNA, 19 bp, Homo sapiens
tgatacataactaaatttg

SEQ ID NO: 4960904 - DNA, 13 bp, Homo sapiens
tgatacataataa

SEQ ID NO: 4960905 - DNA, 18 bp, Homo sapiens
tgataccagaagggaaag

SEQ ID NO: 4960906 - DNA, 21 bp, Homo sapiens
tgataccagaagggaaagctt

SEQ ID NO: 4960907 - DNA, 14 bp, Homo sapiens
tgatacttatattt

SEQ ID NO: 4960908 - DNA, 13 bp, Homo sapiens
tgatacttcattt

SEQ ID NO: 4960909 - DNA, 16 bp, Homo sapiens
tgatacttcatttaaa

SEQ ID NO: 4960910 - DNA, 15 bp, Homo sapiens
tgatacttttaagag

SEQ ID NO: 4960911 - DNA, 17 bp, Homo sapiens
tgatatgagtatacaat

SEQ ID NO: 4960912 - DNA, 16 bp, Homo sapiens
tgatatggcagaagac

SEQ ID NO: 4960913 - DNA, 17 bp, Homo sapiens
tgatatggcagaagaca

SEQ ID NO: 4960914 - DNA, 20 bp, Homo sapiens
tgatatggcagaagacacca

SEQ ID NO: 4960915 - DNA, 22 bp, Homo sapiens
tgatatgggtttataattttct

SEQ ID NO: 4960916 - DNA, 16 bp, Homo sapiens
tgatattttgtacttt

SEQ ID NO: 4960917 - DNA, 18 bp, Homo sapiens
tgatcaattatagtttct

SEQ ID NO: 4960918 - DNA, 16 bp, Homo sapiens
tgatcaattttgactt

SEQ ID NO: 4960919 - DNA, 15 bp, Homo sapiens
tgatcacgcctggct

SEQ ID NO: 4960920 - DNA, 13 bp, Homo sapiens
tgatcacggctca

SEQ ID NO: 4960921 - DNA, 18 bp, Homo sapiens
tgatcacggctcactgca

SEQ ID NO: 4960922 - DNA, 15 bp, Homo sapiens
tgatcactagcctgt

SEQ ID NO: 4960923 - DNA, 16 bp, Homo sapiens
tgatcactagcctgtc

SEQ ID NO: 4960924 - DNA, 19 bp, Homo sapiens
tgatcataggtatttcaaa

SEQ ID NO: 4960925 - DNA, 20 bp, Homo sapiens
tgatcataggtatttcaaaa

SEQ ID NO: 4960926 - DNA, 24 bp, Homo sapiens
tgatcatccactgtgccatgtgcc

SEQ ID NO: 4960927 - DNA, 23 bp, Homo sapiens
tgatcatcccatctaagctgcag

SEQ ID NO: 4960928 - DNA, 17 bp, Homo sapiens
tgatcattttcccccca

SEQ ID NO: 4960929 - DNA, 18 bp, Homo sapiens
tgatcattttccccccac

SEQ ID NO: 4960930 - DNA, 19 bp, Homo sapiens
tgatcattttccccccact

SEQ ID NO: 4960931 - DNA, 22 bp, Homo sapiens
tgatcattttccccccactctc

SEQ ID NO: 4960932 - DNA, 13 bp, Homo sapiens
tgatccaagctgg

SEQ ID NO: 4960933 - DNA, 14 bp, Homo sapiens
tgatccaagctggt

SEQ ID NO: 4960934 - DNA, 21 bp, Homo sapiens
tgatccaagctggtcccactc

SEQ ID NO: 4960935 - DNA, 21 bp, Homo sapiens
tgatccacccaaccctatctc

SEQ ID NO: 4960936 - DNA, 22 bp, Homo sapiens
tgatccacccacctcagcctcc

SEQ ID NO: 4960937 - DNA, 21 bp, Homo sapiens
tgatccatgagtttgccctgg

SEQ ID NO: 4960938 - DNA, 18 bp, Homo sapiens
tgatccccaagtgtgaac

SEQ ID NO: 4960939 - DNA, 22 bp, Homo sapiens
tgatcctcccacctcagcctcc

SEQ ID NO: 4960940 - DNA, 13 bp, Homo sapiens
tgatcctgcggag

SEQ ID NO: 4960941 - DNA, 21 bp, Homo sapiens
tgatcctgcggagaacaccct

SEQ ID NO: 4960942 - DNA, 15 bp, Homo sapiens
tgatctacatgagga

SEQ ID NO: 4960943 - DNA, 14 bp, Homo sapiens
tgatctgtcttgta

SEQ ID NO: 4960944 - DNA, 20 bp, Homo sapiens
tgatctgtgatagttcaccc

SEQ ID NO: 4960945 - DNA, 20 bp, Homo sapiens
tgatcttctgggagcaggaa

SEQ ID NO: 4960946 - DNA, 19 bp, Homo sapiens
tgatctttgcagacaggca

SEQ ID NO: 4960947 - DNA, 15 bp, Homo sapiens
tgatcttttaaagtg

SEQ ID NO: 4960948 - DNA, 17 bp, Homo sapiens
tgatcttttaaagtgtt

SEQ ID NO: 4960949 - DNA, 21 bp, Homo sapiens
tgatcttttaaagtgttactt

SEQ ID NO: 4960950 - DNA, 15 bp, Homo sapiens
tgatgaaaagattta

SEQ ID NO: 4960951 - DNA, 22 bp, Homo sapiens
tgatgaaatgaggtcagagcct

SEQ ID NO: 4960952 - DNA, 13 bp, Homo sapiens
tgatgaactttct

SEQ ID NO: 4960953 - DNA, 15 bp, Homo sapiens
tgatgaactttctct

SEQ ID NO: 4960954 - DNA, 16 bp, Homo sapiens
tgatgaagcaaggaag

SEQ ID NO: 4960955 - DNA, 24 bp, Homo sapiens
tgatgaagcaaggaagatatacat

SEQ ID NO: 4960956 - DNA, 19 bp, Homo sapiens
tgatgatctttgcagacag

SEQ ID NO: 4960957 - DNA, 23 bp, Homo sapiens
tgatgatctttgcagacaggcaa

SEQ ID NO: 4960958 - DNA, 20 bp, Homo sapiens
tgatgatgaaatgaggtcag

SEQ ID NO: 4960959 - DNA, 12 bp, Homo sapiens
tgatgcagcatt

SEQ ID NO: 4960960 - DNA, 18 bp, Homo sapiens
tgatgcagcatttgataa

SEQ ID NO: 4960961 - DNA, 21 bp, Homo sapiens
tgatgcaggcacttattgtaa

SEQ ID NO: 4960962 - DNA, 14 bp, Homo sapiens
tgatgcagtctcct

SEQ ID NO: 4960963 - DNA, 15 bp, Homo sapiens
tgatgcagtctcctc

SEQ ID NO: 4960964 - DNA, 18 bp, Homo sapiens
tgatgccctgctccaggg

SEQ ID NO: 4960965 - DNA, 20 bp, Homo sapiens
tgatgccctgctccagggag

SEQ ID NO: 4960966 - DNA, 15 bp, Homo sapiens
tgatgctccctcccc

SEQ ID NO: 4960967 - DNA, 16 bp, Homo sapiens
tgatgctccctcccct

SEQ ID NO: 4960968 - DNA, 21 bp, Homo sapiens
tgatgctccctcccctgccct

SEQ ID NO: 4960969 - DNA, 14 bp, Homo sapiens
tgatgctgagattc

SEQ ID NO: 4960970 - DNA, 18 bp, Homo sapiens
tgatgctgttctcttctt

SEQ ID NO: 4960971 - DNA, 23 bp, Homo sapiens
tgatggaccttctagaattataa

SEQ ID NO: 4960972 - DNA, 22 bp, Homo sapiens
tgatggcacttagctatcagaa

SEQ ID NO: 4960973 - DNA, 16 bp, Homo sapiens
tgatgggcacttgaga

SEQ ID NO: 4960974 - DNA, 15 bp, Homo sapiens
tgatggtgacttcct

SEQ ID NO: 4960975 - DNA, 21 bp, Homo sapiens
tgccaccagagaccgtcctca

SEQ ID NO: 4960976 - DNA, 22 bp, Homo sapiens
tgccaccagagaccgtcctcac

SEQ ID NO: 4960977 - DNA, 23 bp, Homo sapiens
tgccaccagagaccgtcctcacc

SEQ ID NO: 4960978 - DNA, 16 bp, Homo sapiens
tgccaccccaccctcc

SEQ ID NO: 4960979 - DNA, 17 bp, Homo sapiens
tgccaccccaccctccc

SEQ ID NO: 4960980 - DNA, 23 bp, Homo sapiens
tgccaccccaccctccctggagt

SEQ ID NO: 4960981 - DNA, 14 bp, Homo sapiens
tgccacgttccaca

SEQ ID NO: 4960982 - DNA, 19 bp, Homo sapiens
tgccacgttccacagttgc

SEQ ID NO: 4960983 - DNA, 20 bp, Homo sapiens
tgccacgttccacagttgcc

SEQ ID NO: 4960984 - DNA, 17 bp, Homo sapiens
tgccactcattcctgta

SEQ ID NO: 4960985 - DNA, 18 bp, Homo sapiens
tgccactcattcctgtag

SEQ ID NO: 4960986 - DNA, 20 bp, Homo sapiens
tgccactttacccacctaga

SEQ ID NO: 4960987 - DNA, 18 bp, Homo sapiens
tgccagaagatcccctca

SEQ ID NO: 4960988 - DNA, 21 bp, Homo sapiens
tgccagaagatcccctcagga

SEQ ID NO: 4960989 - DNA, 14 bp, Homo sapiens
tgccagaggggaag

SEQ ID NO: 4960990 - DNA, 22 bp, Homo sapiens
tgccagcaatgacatctcaggg

SEQ ID NO: 4960991 - DNA, 22 bp, Homo sapiens
tgccaggaacctgtcctaagga

SEQ ID NO: 4960992 - DNA, 17 bp, Homo sapiens
tgccagggcaatgatga

SEQ ID NO: 4960993 - DNA, 22 bp, Homo sapiens
tgccagggcaatgatgaatgag

SEQ ID NO: 4960994 - DNA, 18 bp, Homo sapiens
tgccaggtttttggtctg

SEQ ID NO: 4960995 - DNA, 20 bp, Homo sapiens
tgccagtccccctgccccag

SEQ ID NO: 4960996 - DNA, 23 bp, Homo sapiens
tgccatacatcagttattcattc

SEQ ID NO: 4960997 - DNA, 15 bp, Homo sapiens
tgccatactttgtct

SEQ ID NO: 4960998 - DNA, 22 bp, Homo sapiens
tgccatactttgtctgaaaaat

SEQ ID NO: 4960999 - DNA, 13 bp, Homo sapiens
tgccatagagttt

SEQ ID NO: 4961000 - DNA, 21 bp, Homo sapiens
tgccatagagtttaacacaag

SEQ ID NO: 4961001 - DNA, 18 bp, Homo sapiens
tgccatagtcacatggcc

SEQ ID NO: 4961002 - DNA, 21 bp, Homo sapiens
tgccatatataacagatacat

SEQ ID NO: 4961003 - DNA, 21 bp, Homo sapiens
tgccatattctgttggccagt

SEQ ID NO: 4961004 - DNA, 21 bp, Homo sapiens
tgccatcaactactattcaaa

SEQ ID NO: 4961005 - DNA, 20 bp, Homo sapiens
tgccatccaggttcagcttg

SEQ ID NO: 4961006 - DNA, 13 bp, Homo sapiens
tgccatcctcttt

SEQ ID NO: 4961007 - DNA, 18 bp, Homo sapiens
tgccatgggcttcactgt

SEQ ID NO: 4961008 - DNA, 23 bp, Homo sapiens
tgccatgggcttcactgtataaa

SEQ ID NO: 4961009 - DNA, 14 bp, Homo sapiens
tgccatgtacctcc

SEQ ID NO: 4961010 - DNA, 14 bp, Homo sapiens
tgccatgtgccagg

SEQ ID NO: 4961011 - DNA, 16 bp, Homo sapiens
tgccatgttggccagg

SEQ ID NO: 4961012 - DNA, 18 bp, Homo sapiens
tgccattattttctgtca

SEQ ID NO: 4961013 - DNA, 14 bp, Homo sapiens
tgccatttgatacc

SEQ ID NO: 4961014 - DNA, 18 bp, Homo sapiens
tgccatttgatttttcta

SEQ ID NO: 4961015 - DNA, 19 bp, Homo sapiens
tgcccaaaaatatggttga

SEQ ID NO: 4961016 - DNA, 23 bp, Homo sapiens
tgcccaacctgctctcctcttgc

SEQ ID NO: 4961017 - DNA, 21 bp, Homo sapiens
tgcccaagaatagatgctgac

SEQ ID NO: 4961018 - DNA, 22 bp, Homo sapiens
tgcccaagaatagatgctgact

SEQ ID NO: 4961019 - DNA, 18 bp, Homo sapiens
tgcccaagcccaggccac

SEQ ID NO: 4961020 - DNA, 14 bp, Homo sapiens
tgcccacaggatca

SEQ ID NO: 4961021 - DNA, 15 bp, Homo sapiens
tgcccacctgcccat

SEQ ID NO: 4961022 - DNA, 19 bp, Homo sapiens
tgcccacctgcccatcaca

SEQ ID NO: 4961023 - DNA, 21 bp, Homo sapiens
tgcccactgtttctcttgagc

SEQ ID NO: 4961024 - DNA, 18 bp, Homo sapiens
tgcccagaacttccctga

SEQ ID NO: 4961025 - DNA, 20 bp, Homo sapiens
tgcccaggcaggtcttgaac

SEQ ID NO: 4961026 - DNA, 22 bp, Homo sapiens
tgcccaggcccctgccaccctg

SEQ ID NO: 4961027 - DNA, 20 bp, Homo sapiens
tgcccaggccggccagcctc

SEQ ID NO: 4961028 - DNA, 23 bp, Homo sapiens
tgcccaggctggcgtgcagtggt

SEQ ID NO: 4961029 - DNA, 23 bp, Homo sapiens
tgcccatcacagggttgggccca

SEQ ID NO: 4961030 - DNA, 19 bp, Homo sapiens
tgcccattcaccaaaatta

SEQ ID NO: 4961031 - DNA, 14 bp, Homo sapiens
tgccccaaacaaat

SEQ ID NO: 4961032 - DNA, 20 bp, Homo sapiens
tgccccaaacaaatatgcaa

SEQ ID NO: 4961033 - DNA, 20 bp, Homo sapiens
tgccccaaataacttcagtc

SEQ ID NO: 4961034 - DNA, 16 bp, Homo sapiens
tgccccaacctgctga

SEQ ID NO: 4961035 - DNA, 23 bp, Homo sapiens
tgccccagagctgtttatggcct

SEQ ID NO: 4961036 - DNA, 23 bp, Homo sapiens
tgccccatgcctgtccagcctgg

SEQ ID NO: 4961037 - DNA, 14 bp, Homo sapiens
tgcccccagcccaa

SEQ ID NO: 4961038 - DNA, 14 bp, Homo sapiens
tgccccccagcctc

SEQ ID NO: 4961039 - DNA, 19 bp, Homo sapiens
tgccccccagcctctggca

SEQ ID NO: 4961040 - DNA, 13 bp, Homo sapiens
tgccccctgctgg

SEQ ID NO: 4961041 - DNA, 16 bp, Homo sapiens
tgccccctgctggctc

SEQ ID NO: 4961042 - DNA, 18 bp, Homo sapiens
tgccccggccacctctgc

SEQ ID NO: 4961043 - DNA, 12 bp, Homo sapiens
tgcccctccccc

SEQ ID NO: 4961044 - DNA, 23 bp, Homo sapiens
tgcccctcccccaacccccaccc

SEQ ID NO: 4961045 - DNA, 13 bp, Homo sapiens
tgcccctctttct

SEQ ID NO: 4961046 - DNA, 21 bp, Homo sapiens
tgcccctctttctctttcttc

SEQ ID NO: 4961047 - DNA, 13 bp, Homo sapiens
tgcccgcacagca

SEQ ID NO: 4961048 - DNA, 15 bp, Homo sapiens
tgcccgcacagcagc

SEQ ID NO: 4961049 - DNA, 17 bp, Homo sapiens
tgcccgcacagcagcct

SEQ ID NO: 4961050 - DNA, 19 bp, Homo sapiens
tgcccgcacagcagcctgc

SEQ ID NO: 4961051 - DNA, 21 bp, Homo sapiens
tgcccgggaaggtcaccagca

SEQ ID NO: 4961052 - DNA, 23 bp, Homo sapiens
tgccctaactgtacatttcacag

SEQ ID NO: 4961053 - DNA, 16 bp, Homo sapiens
tgccctagatgagccc

SEQ ID NO: 4961054 - DNA, 23 bp, Homo sapiens
tgccctcattactgggccttagt

SEQ ID NO: 4961055 - DNA, 22 bp, Homo sapiens
tgccctccttgtccacccacct

SEQ ID NO: 4961056 - DNA, 13 bp, Homo sapiens
tgccctcgctgct

SEQ ID NO: 4961057 - DNA, 14 bp, Homo sapiens
tgccctcgctgctt

SEQ ID NO: 4961058 - DNA, 15 bp, Homo sapiens
tgccctcgctgcttc

SEQ ID NO: 4961059 - DNA, 17 bp, Homo sapiens
tgccctcgctgcttctg

SEQ ID NO: 4961060 - DNA, 23 bp, Homo sapiens
tgccctgctgccgcctcccagcc

SEQ ID NO: 4961061 - DNA, 18 bp, Homo sapiens
tgccctggatccatcagg

SEQ ID NO: 4961062 - DNA, 21 bp, Homo sapiens
tgccctggtccagggaagctg

SEQ ID NO: 4961063 - DNA, 21 bp, Homo sapiens
tgccctggtgctgccacactt

SEQ ID NO: 4961064 - DNA, 15 bp, Homo sapiens
tgcccttaaatcata

SEQ ID NO: 4961065 - DNA, 14 bp, Homo sapiens
tgcccttcacccca

SEQ ID NO: 4961066 - DNA, 17 bp, Homo sapiens
tgccgaggagccaggca

SEQ ID NO: 4961067 - DNA, 17 bp, Homo sapiens
tgccgccccctcctgaa

SEQ ID NO: 4961068 - DNA, 18 bp, Homo sapiens
tgccgccccctcctgaac

SEQ ID NO: 4961069 - DNA, 16 bp, Homo sapiens
tgccgcctcccagcct

SEQ ID NO: 4961070 - DNA, 18 bp, Homo sapiens
tgccgcctcccagcctgg

SEQ ID NO: 4961071 - DNA, 16 bp, Homo sapiens
tgccgtgtgagtgtga

SEQ ID NO: 4961072 - DNA, 20 bp, Homo sapiens
tgccgtgtgagtgtgacagg

SEQ ID NO: 4961073 - DNA, 21 bp, Homo sapiens
tgccgtgtgagtgtgacaggg

SEQ ID NO: 4961074 - DNA, 22 bp, Homo sapiens
tgccgtgtgagtgtgacagggc

SEQ ID NO: 4961075 - DNA, 23 bp, Homo sapiens
tgccgtgtgagtgtgacagggcc

SEQ ID NO: 4961076 - DNA, 19 bp, Homo sapiens
tgcctaagcattgcctggc

SEQ ID NO: 4961077 - DNA, 19 bp, Homo sapiens
tgcctaagtattaaaacat

SEQ ID NO: 4961078 - DNA, 21 bp, Homo sapiens
tgcctaagtattaaaacattg

SEQ ID NO: 4961079 - DNA, 22 bp, Homo sapiens
tgcctaagtattaaaacattgg

SEQ ID NO: 4961080 - DNA, 23 bp, Homo sapiens
tgcctaagtattaaaacattgga

SEQ ID NO: 4961081 - DNA, 15 bp, Homo sapiens
tgcctcaccgcttcc

SEQ ID NO: 4961082 - DNA, 16 bp, Homo sapiens
tgcctcaccgcttccc

SEQ ID NO: 4961083 - DNA, 21 bp, Homo sapiens
tggagacagccccagagcagg

SEQ ID NO: 4961084 - DNA, 19 bp, Homo sapiens
tggagaccagggagccttt

SEQ ID NO: 4961085 - DNA, 19 bp, Homo sapiens
tggagacctctccttccta

SEQ ID NO: 4961086 - DNA, 14 bp, Homo sapiens
tggagactgtctca

SEQ ID NO: 4961087 - DNA, 16 bp, Homo sapiens
tggagagtgagctaca

SEQ ID NO: 4961088 - DNA, 19 bp, Homo sapiens
tggagcagcctggagaccc

SEQ ID NO: 4961089 - DNA, 22 bp, Homo sapiens
tggagcaggcggtggggagaga

SEQ ID NO: 4961090 - DNA, 13 bp, Homo sapiens
tggagccagctcc

SEQ ID NO: 4961091 - DNA, 13 bp, Homo sapiens
tggagcccaggcg

SEQ ID NO: 4961092 - DNA, 18 bp, Homo sapiens
tggagcccaggcgggagc

SEQ ID NO: 4961093 - DNA, 21 bp, Homo sapiens
tggagcctggcacaggactga

SEQ ID NO: 4961094 - DNA, 23 bp, Homo sapiens
tggagcgagcatcccccaaagtt

SEQ ID NO: 4961095 - DNA, 23 bp, Homo sapiens
tggaggaaaaccaagccgtggct

SEQ ID NO: 4961096 - DNA, 20 bp, Homo sapiens
tggaggaaggattgtaaaaa

SEQ ID NO: 4961097 - DNA, 17 bp, Homo sapiens
tggaggccttccagctg

SEQ ID NO: 4961098 - DNA, 14 bp, Homo sapiens
tggaggggtgtggc

SEQ ID NO: 4961099 - DNA, 13 bp, Homo sapiens
tggaggtgggagc

SEQ ID NO: 4961100 - DNA, 20 bp, Homo sapiens
tggaggtgggagcaggagat

SEQ ID NO: 4961101 - DNA, 21 bp, Homo sapiens
tggaggtggggcgaggcaggc

SEQ ID NO: 4961102 - DNA, 13 bp, Homo sapiens
tggaggttctaag

SEQ ID NO: 4961103 - DNA, 18 bp, Homo sapiens
tggagtatgtctgatgga

SEQ ID NO: 4961104 - DNA, 15 bp, Homo sapiens
tggagtcccctcacc

SEQ ID NO: 4961105 - DNA, 21 bp, Homo sapiens
tggagtttcatgtacaagatg

SEQ ID NO: 4961106 - DNA, 14 bp, Homo sapiens
tggagtttctaagg

SEQ ID NO: 4961107 - DNA, 16 bp, Homo sapiens
tggagtttctaaggtc

SEQ ID NO: 4961108 - DNA, 23 bp, Homo sapiens
tggagtttttgtttggagagcac

SEQ ID NO: 4961109 - DNA, 21 bp, Homo sapiens
tggataacttaggtggcaagc

SEQ ID NO: 4961110 - DNA, 14 bp, Homo sapiens
tggatactacatct

SEQ ID NO: 4961111 - DNA, 13 bp, Homo sapiens
tggatagctaata

SEQ ID NO: 4961112 - DNA, 16 bp, Homo sapiens
tggatcagatgaactc

SEQ ID NO: 4961113 - DNA, 14 bp, Homo sapiens
tggatccaatgtta

SEQ ID NO: 4961114 - DNA, 22 bp, Homo sapiens
tggatccaatgttagagacttt

SEQ ID NO: 4961115 - DNA, 20 bp, Homo sapiens
tggatcccctctgtctacaa

SEQ ID NO: 4961116 - DNA, 18 bp, Homo sapiens
tggatcccgaagaatgga

SEQ ID NO: 4961117 - DNA, 22 bp, Homo sapiens
tggatgccagggccgaccagag

SEQ ID NO: 4961118 - DNA, 20 bp, Homo sapiens
tggatgcctggtggcagctg

SEQ ID NO: 4961119 - DNA, 23 bp, Homo sapiens
tggatgcctggtggcagctgcgg

SEQ ID NO: 4961120 - DNA, 15 bp, Homo sapiens
tggatggagcccagg

SEQ ID NO: 4961121 - DNA, 14 bp, Homo sapiens
tggattcattgtct

SEQ ID NO: 4961122 - DNA, 15 bp, Homo sapiens
tggattccatgctaa

SEQ ID NO: 4961123 - DNA, 17 bp, Homo sapiens
tggattcttatgtagca

SEQ ID NO: 4961124 - DNA, 17 bp, Homo sapiens
tggattggattatttaa

SEQ ID NO: 4961125 - DNA, 18 bp, Homo sapiens
tggattgttaatttcagt

SEQ ID NO: 4961126 - DNA, 21 bp, Homo sapiens
tggattgttaatttcagtcct

SEQ ID NO: 4961127 - DNA, 19 bp, Homo sapiens
tggatttctggttctgatg

SEQ ID NO: 4961128 - DNA, 14 bp, Homo sapiens
tggatttgacattg

SEQ ID NO: 4961129 - DNA, 13 bp, Homo sapiens
tggatttgatgct

SEQ ID NO: 4961130 - DNA, 17 bp, Homo sapiens
tggcaaaaatggctaga

SEQ ID NO: 4961131 - DNA, 21 bp, Homo sapiens
tggcaaaagccttgtgtatat

SEQ ID NO: 4961132 - DNA, 14 bp, Homo sapiens
tggcaaatataaaa

SEQ ID NO: 4961133 - DNA, 19 bp, Homo sapiens
tggcaagaaagctggtaaa

SEQ ID NO: 4961134 - DNA, 16 bp, Homo sapiens
tggcaagtcacatgcg

SEQ ID NO: 4961135 - DNA, 23 bp, Homo sapiens
tggcaagttttgatatgagtata

SEQ ID NO: 4961136 - DNA, 19 bp, Homo sapiens
tggcaatctcagatgcagt

SEQ ID NO: 4961137 - DNA, 17 bp, Homo sapiens
tggcaattccaatattt

SEQ ID NO: 4961138 - DNA, 14 bp, Homo sapiens
tggcaattgtctat

SEQ ID NO: 4961139 - DNA, 16 bp, Homo sapiens
tggcaattgtctattt

SEQ ID NO: 4961140 - DNA, 18 bp, Homo sapiens
tggcaattgtctatttat

SEQ ID NO: 4961141 - DNA, 14 bp, Homo sapiens
tggcaattttgtaa

SEQ ID NO: 4961142 - DNA, 15 bp, Homo sapiens
tggcaattttgtaac

SEQ ID NO: 4961143 - DNA, 19 bp, Homo sapiens
tggcaccaaagatgcagcc

SEQ ID NO: 4961144 - DNA, 15 bp, Homo sapiens
tggcacccggcccct

SEQ ID NO: 4961145 - DNA, 18 bp, Homo sapiens
tggcacccggcccctgct

SEQ ID NO: 4961146 - DNA, 19 bp, Homo sapiens
tggcacccggcccctgctg

SEQ ID NO: 4961147 - DNA, 19 bp, Homo sapiens
tggcacggtggctcaggcc

SEQ ID NO: 4961148 - DNA, 22 bp, Homo sapiens
tggcactaacgttgagcccctg

SEQ ID NO: 4961149 - DNA, 10 bp, Homo sapiens
tggcactgat

SEQ ID NO: 4961150 - DNA, 16 bp, Homo sapiens
tggcacttgcctgggt

SEQ ID NO: 4961151 - DNA, 11 bp, Homo sapiens
tggcactttga

SEQ ID NO: 4961152 - DNA, 13 bp, Homo sapiens
tggcagaagacac

SEQ ID NO: 4961153 - DNA, 14 bp, Homo sapiens
tggcagaagacacc

SEQ ID NO: 4961154 - DNA, 20 bp, Homo sapiens
tggcagaagacaccagagca

SEQ ID NO: 4961155 - DNA, 22 bp, Homo sapiens
tggcagaagacaccagagcaga

SEQ ID NO: 4961156 - DNA, 14 bp, Homo sapiens
tggcagattcaaat

SEQ ID NO: 4961157 - DNA, 11 bp, Homo sapiens
tggcagcccag

SEQ ID NO: 4961158 - DNA, 22 bp, Homo sapiens
tggcagccgtgccttcagctct

SEQ ID NO: 4961159 - DNA, 13 bp, Homo sapiens
tggcagccttggc

SEQ ID NO: 4961160 - DNA, 13 bp, Homo sapiens
tggcagctgcttt

SEQ ID NO: 4961161 - DNA, 21 bp, Homo sapiens
tggcagggaggtcaggccctg

SEQ ID NO: 4961162 - DNA, 19 bp, Homo sapiens
tggcagtgagtgagcctgg

SEQ ID NO: 4961163 - DNA, 21 bp, Homo sapiens
tggcagtgagtgagcctggct

SEQ ID NO: 4961164 - DNA, 13 bp, Homo sapiens
tggcagtgggagc

SEQ ID NO: 4961165 - DNA, 16 bp, Homo sapiens
tggcagtgggagctgc

SEQ ID NO: 4961166 - DNA, 22 bp, Homo sapiens
tggcatacgcctgtagtcctag

SEQ ID NO: 4961167 - DNA, 14 bp, Homo sapiens
tggcatagacatgg

SEQ ID NO: 4961168 - DNA, 16 bp, Homo sapiens
tggcatctttgccttg

SEQ ID NO: 4961169 - DNA, 22 bp, Homo sapiens
tggcatgttttgtgcatttgta

SEQ ID NO: 4961170 - DNA, 17 bp, Homo sapiens
tggccacagtagtcttg

SEQ ID NO: 4961171 - DNA, 20 bp, Homo sapiens
tggccacctctctcctttgc

SEQ ID NO: 4961172 - DNA, 20 bp, Homo sapiens
tggccactccagacccctgg

SEQ ID NO: 4961173 - DNA, 22 bp, Homo sapiens
tggccactccagacccctggct

SEQ ID NO: 4961174 - DNA, 14 bp, Homo sapiens
tggccactgctccc

SEQ ID NO: 4961175 - DNA, 19 bp, Homo sapiens
tggccactgctccctaagc

SEQ ID NO: 4961176 - DNA, 20 bp, Homo sapiens
tggccactgctccctaagcc

SEQ ID NO: 4961177 - DNA, 14 bp, Homo sapiens
tggccagagctggg

SEQ ID NO: 4961178 - DNA, 24 bp, Homo sapiens
tggccagagctgggaggcatggcc

SEQ ID NO: 4961179 - DNA, 17 bp, Homo sapiens
tggccagatggcccgga

SEQ ID NO: 4961180 - DNA, 20 bp, Homo sapiens
tggccagcctggggcctggc

SEQ ID NO: 4961181 - DNA, 21 bp, Homo sapiens
tggccagcctggggcctggca

SEQ ID NO: 4961182 - DNA, 22 bp, Homo sapiens
tggccagcctggggcctggcag

SEQ ID NO: 4961183 - DNA, 15 bp, Homo sapiens
tggccaggagctctt

SEQ ID NO: 4961184 - DNA, 23 bp, Homo sapiens
tggccaggagctcttcaggcctc

SEQ ID NO: 4961185 - DNA, 12 bp, Homo sapiens
tggccaggcaga

SEQ ID NO: 4961186 - DNA, 13 bp, Homo sapiens
tggccaggctggt

SEQ ID NO: 4961187 - DNA, 17 bp, Homo sapiens
tggccatccctgtgagg

SEQ ID NO: 4961188 - DNA, 15 bp, Homo sapiens
tggccatttgctttt

SEQ ID NO: 4961189 - DNA, 22 bp, Homo sapiens
tggcccatagaaacatgacact

SEQ ID NO: 4961190 - DNA, 16 bp, Homo sapiens
tggcccctctgacctg

SEQ ID NO: 4961191 - DNA, 14 bp, Homo sapiens
tggcccctgaacaa

SEQ ID NO: 4961192 - DNA, 15 bp, Homo sapiens
tggcccctgcccggc

SEQ ID NO: 4961193 - DNA, 19 bp, Homo sapiens
tggtccggacactcctaga

SEQ ID NO: 4961194 - DNA, 16 bp, Homo sapiens
tggtcctaaaagcaaa

SEQ ID NO: 4961195 - DNA, 23 bp, Homo sapiens
tggtcctaaaagcaaaataaaaa

SEQ ID NO: 4961196 - DNA, 16 bp, Homo sapiens
tggtcctgtccccgca

SEQ ID NO: 4961197 - DNA, 15 bp, Homo sapiens
tggtcgcccaggaga

SEQ ID NO: 4961198 - DNA, 23 bp, Homo sapiens
tggtctcaggatatccttatcag

SEQ ID NO: 4961199 - DNA, 19 bp, Homo sapiens
tggtcttcaaattgtcttt

SEQ ID NO: 4961200 - DNA, 16 bp, Homo sapiens
tggtcttgtggaattg

SEQ ID NO: 4961201 - DNA, 21 bp, Homo sapiens
tggtctttgtaagagtgtaga

SEQ ID NO: 4961202 - DNA, 19 bp, Homo sapiens
tggtgaaatttattagtta

SEQ ID NO: 4961203 - DNA, 17 bp, Homo sapiens
tggtgaatggccttcct

SEQ ID NO: 4961204 - DNA, 13 bp, Homo sapiens
tggtgacctctgc

SEQ ID NO: 4961205 - DNA, 22 bp, Homo sapiens
tggtgacctctgcctgaagtca

SEQ ID NO: 4961206 - DNA, 19 bp, Homo sapiens
tggtgagaaatttctgtga

SEQ ID NO: 4961207 - DNA, 13 bp, Homo sapiens
tggtgcctccaga

SEQ ID NO: 4961208 - DNA, 13 bp, Homo sapiens
tggtgcctggcct

SEQ ID NO: 4961209 - DNA, 19 bp, Homo sapiens
tggtgcctggcctggcaca

SEQ ID NO: 4961210 - DNA, 22 bp, Homo sapiens
tggtgcctggcctggcacacat

SEQ ID NO: 4961211 - DNA, 23 bp, Homo sapiens
tggtgcctggcctggcacacatc

SEQ ID NO: 4961212 - DNA, 19 bp, Homo sapiens
tggtgcttaagttccagca

SEQ ID NO: 4961213 - DNA, 13 bp, Homo sapiens
tggtggcagctgc

SEQ ID NO: 4961214 - DNA, 19 bp, Homo sapiens
tggtggcagtggaggtggg

SEQ ID NO: 4961215 - DNA, 13 bp, Homo sapiens
tggtggcagtggg

SEQ ID NO: 4961216 - DNA, 12 bp, Homo sapiens
tggtggcctcag

SEQ ID NO: 4961217 - DNA, 12 bp, Homo sapiens
tggtgggagggg

SEQ ID NO: 4961218 - DNA, 21 bp, Homo sapiens
tggtgggaggggcgcccacct

SEQ ID NO: 4961219 - DNA, 19 bp, Homo sapiens
tggtgtaataagacataac

SEQ ID NO: 4961220 - DNA, 12 bp, Homo sapiens
tggtgtgatctt

SEQ ID NO: 4961221 - DNA, 14 bp, Homo sapiens
tggtgtgctgaggt

SEQ ID NO: 4961222 - DNA, 14 bp, Homo sapiens
tggtgtgttggaca

SEQ ID NO: 4961223 - DNA, 22 bp, Homo sapiens
tggttaaaactgtacatttaaa

SEQ ID NO: 4961224 - DNA, 14 bp, Homo sapiens
tggttaagagtcca

SEQ ID NO: 4961225 - DNA, 18 bp, Homo sapiens
tggttatacaagttcttg

SEQ ID NO: 4961226 - DNA, 20 bp, Homo sapiens
tggttcagggttggcccctg

SEQ ID NO: 4961227 - DNA, 16 bp, Homo sapiens
tggttcattaattcta

SEQ ID NO: 4961228 - DNA, 18 bp, Homo sapiens
tggttcccgtttctccac

SEQ ID NO: 4961229 - DNA, 15 bp, Homo sapiens
tggttcctctctggt

SEQ ID NO: 4961230 - DNA, 17 bp, Homo sapiens
tggttcctttctcagcc

SEQ ID NO: 4961231 - DNA, 19 bp, Homo sapiens
tggttggggccctgccctg

SEQ ID NO: 4961232 - DNA, 19 bp, Homo sapiens
tggttgggtggcaattcca

SEQ ID NO: 4961233 - DNA, 21 bp, Homo sapiens
tggttgttagttatagatgtc

SEQ ID NO: 4961234 - DNA, 11 bp, Homo sapiens
tggtttacatt

SEQ ID NO: 4961235 - DNA, 11 bp, Homo sapiens
tggtttataga

SEQ ID NO: 4961236 - DNA, 22 bp, Homo sapiens
tggtttattttgtattgtggta

SEQ ID NO: 4961237 - DNA, 16 bp, Homo sapiens
tggtttcactggccca

SEQ ID NO: 4961238 - DNA, 17 bp, Homo sapiens
tggtttcccccttctac

SEQ ID NO: 4961239 - DNA, 17 bp, Homo sapiens
tggtttggttcctctct

SEQ ID NO: 4961240 - DNA, 13 bp, Homo sapiens
tggttttagattt

SEQ ID NO: 4961241 - DNA, 10 bp, Homo sapiens
tggttttttt

SEQ ID NO: 4961242 - DNA, 18 bp, Homo sapiens
tgtaaaaaaaaatgcctt

SEQ ID NO: 4961243 - DNA, 16 bp, Homo sapiens
tgtaaaaacactgaaa

SEQ ID NO: 4961244 - DNA, 14 bp, Homo sapiens
tgtaaaatagcttg

SEQ ID NO: 4961245 - DNA, 12 bp, Homo sapiens
tgtaaactgcca

SEQ ID NO: 4961246 - DNA, 13 bp, Homo sapiens
tgtaaactgccat

SEQ ID NO: 4961247 - DNA, 13 bp, Homo sapiens
tgtaaagaaatgt

SEQ ID NO: 4961248 - DNA, 18 bp, Homo sapiens
tgtaaagccaacaccctg

SEQ ID NO: 4961249 - DNA, 21 bp, Homo sapiens
tgtaaaggagtcaaaactaca

SEQ ID NO: 4961250 - DNA, 20 bp, Homo sapiens
tgtaaataccagactgcagg

SEQ ID NO: 4961251 - DNA, 16 bp, Homo sapiens
tgtaaatgttatttct

SEQ ID NO: 4961252 - DNA, 16 bp, Homo sapiens
tgtaaattatgtaatg

SEQ ID NO: 4961253 - DNA, 20 bp, Homo sapiens
tgtaaattatgtaatgcaaa

SEQ ID NO: 4961254 - DNA, 14 bp, Homo sapiens
tgtaacaagccacc

SEQ ID NO: 4961255 - DNA, 17 bp, Homo sapiens
tgtaacaagccacccca

SEQ ID NO: 4961256 - DNA, 23 bp, Homo sapiens
tgtaacacagctgagagactttt

SEQ ID NO: 4961257 - DNA, 20 bp, Homo sapiens
tgtaacttatattgaagaca

SEQ ID NO: 4961258 - DNA, 16 bp, Homo sapiens
tgtaacttatgtagat

SEQ ID NO: 4961259 - DNA, 22 bp, Homo sapiens
tgtaacttatgtagatatttgg

SEQ ID NO: 4961260 - DNA, 16 bp, Homo sapiens
tgtaacttttgtaaga

SEQ ID NO: 4961261 - DNA, 22 bp, Homo sapiens
tgtaagaataggcattaacaca

SEQ ID NO: 4961262 - DNA, 20 bp, Homo sapiens
tgtaagacaaaggttttcct

SEQ ID NO: 4961263 - DNA, 19 bp, Homo sapiens
tgtaagattatagattcta

SEQ ID NO: 4961264 - DNA, 20 bp, Homo sapiens
tgtaagattatagattctaa

SEQ ID NO: 4961265 - DNA, 13 bp, Homo sapiens
tgtaagccaaaga

SEQ ID NO: 4961266 - DNA, 15 bp, Homo sapiens
tgtaagcctgcaagc

SEQ ID NO: 4961267 - DNA, 15 bp, Homo sapiens
tgtaaggctctagat

SEQ ID NO: 4961268 - DNA, 18 bp, Homo sapiens
tgtaaggctctagatcat

SEQ ID NO: 4961269 - DNA, 21 bp, Homo sapiens
tgtaagtaacttcacattaaa

SEQ ID NO: 4961270 - DNA, 16 bp, Homo sapiens
tgtaagtcagtgttga

SEQ ID NO: 4961271 - DNA, 22 bp, Homo sapiens
tgtaagtgctacataaattggc

SEQ ID NO: 4961272 - DNA, 15 bp, Homo sapiens
tgtaagtttcaggtg

SEQ ID NO: 4961273 - DNA, 23 bp, Homo sapiens
tgtaagtttcaggtgacatgtga

SEQ ID NO: 4961274 - DNA, 14 bp, Homo sapiens
tgtaataactgtga

SEQ ID NO: 4961275 - DNA, 22 bp, Homo sapiens
tgtaataactgtgaagtttaca

SEQ ID NO: 4961276 - DNA, 12 bp, Homo sapiens
tgtaataagaca

SEQ ID NO: 4961277 - DNA, 13 bp, Homo sapiens
tgtaataagacat

SEQ ID NO: 4961278 - DNA, 18 bp, Homo sapiens
tgtaataagacataacgt

SEQ ID NO: 4961279 - DNA, 21 bp, Homo sapiens
tgtaataagacttagattgtg

SEQ ID NO: 4961280 - DNA, 21 bp, Homo sapiens
tgtaataatacctcaatgttt

SEQ ID NO: 4961281 - DNA, 14 bp, Homo sapiens
tgtaatattttgta

SEQ ID NO: 4961282 - DNA, 23 bp, Homo sapiens
tgtaatattttgtattattgctg

SEQ ID NO: 4961283 - DNA, 18 bp, Homo sapiens
tgtaatctctctgcagct

SEQ ID NO: 4961284 - DNA, 22 bp, Homo sapiens
tgtaatctctctgcagctgccg

SEQ ID NO: 4961285 - DNA, 15 bp, Homo sapiens
tgtaatgaaaatgaa

SEQ ID NO: 4961286 - DNA, 15 bp, Homo sapiens
tgtaatgaagtaaag

SEQ ID NO: 4961287 - DNA, 12 bp, Homo sapiens
tgtaatgcaaaa

SEQ ID NO: 4961288 - DNA, 18 bp, Homo sapiens
tgtaatgctgcacttcct

SEQ ID NO: 4961289 - DNA, 19 bp, Homo sapiens
tgtaatgctgcacttcctg

SEQ ID NO: 4961290 - DNA, 21 bp, Homo sapiens
tgtaatgtagcgtgtttacat

SEQ ID NO: 4961291 - DNA, 22 bp, Homo sapiens
tgtaatgtccctttcagagaca

SEQ ID NO: 4961292 - DNA, 19 bp, Homo sapiens
tgtaatgtgtgaaaaagat

SEQ ID NO: 4961293 - DNA, 23 bp, Homo sapiens
tgtaatgtgtgaaaaagatgcca

SEQ ID NO: 4961294 - DNA, 18 bp, Homo sapiens
tgtaatgtgtggtggcct

SEQ ID NO: 4961295 - DNA, 21 bp, Homo sapiens
tgtaatgtgtggtggcctcag

SEQ ID NO: 4961296 - DNA, 17 bp, Homo sapiens
tgtaattaaattatggt

SEQ ID NO: 4961297 - DNA, 23 bp, Homo sapiens
tgtaattgacggttttttattat

SEQ ID NO: 4961298 - DNA, 21 bp, Homo sapiens
tgtaatttagggtactaaatt

SEQ ID NO: 4961299 - DNA, 16 bp, Homo sapiens
tgtaatttataaaatt

SEQ ID NO: 4961300 - DNA, 22 bp, Homo sapiens
tgtacaaaataaacaaataaca

SEQ ID NO: 4961301 - DNA, 16 bp, Homo sapiens
tgtacaagatgaagga

SEQ ID NO: 4961302 - DNA, 16 bp, Homo sapiens
tgtacaattaaaaacc

SEQ ID NO: 4961303 - DNA, 15 bp, Homo sapiens
tgtgctctggacagg

SEQ ID NO: 4961304 - DNA, 19 bp, Homo sapiens
tgtgctggatggagcccag

SEQ ID NO: 4961305 - DNA, 21 bp, Homo sapiens
tgtgctggatggagcccaggc

SEQ ID NO: 4961306 - DNA, 11 bp, Homo sapiens
tgtgctggggg

SEQ ID NO: 4961307 - DNA, 24 bp, Homo sapiens
tgtgctgggggaatgagcccagag

SEQ ID NO: 4961308 - DNA, 12 bp, Homo sapiens
tgtgctgtgact

SEQ ID NO: 4961309 - DNA, 17 bp, Homo sapiens
tgtgctgtggaagcaac

SEQ ID NO: 4961310 - DNA, 15 bp, Homo sapiens
tgtgcttcacagtag

SEQ ID NO: 4961311 - DNA, 23 bp, Homo sapiens
tgtgcttcacagtagagccagct

SEQ ID NO: 4961312 - DNA, 19 bp, Homo sapiens
tgtgcttgttttataaaat

SEQ ID NO: 4961313 - DNA, 16 bp, Homo sapiens
tgtgctttgctcttgt

SEQ ID NO: 4961314 - DNA, 18 bp, Homo sapiens
tgtgctttgctcttgtcc

SEQ ID NO: 4961315 - DNA, 21 bp, Homo sapiens
tgtggaacataaaaaggacat

SEQ ID NO: 4961316 - DNA, 20 bp, Homo sapiens
tgtggaactaataaatacat

SEQ ID NO: 4961317 - DNA, 13 bp, Homo sapiens
tgtggacacagct

SEQ ID NO: 4961318 - DNA, 18 bp, Homo sapiens
tgtggacacagctcttct

SEQ ID NO: 4961319 - DNA, 15 bp, Homo sapiens
tgtggaccaattatt

SEQ ID NO: 4961320 - DNA, 17 bp, Homo sapiens
tgtggaccaattattga

SEQ ID NO: 4961321 - DNA, 13 bp, Homo sapiens
tgtggagactggg

SEQ ID NO: 4961322 - DNA, 14 bp, Homo sapiens
tgtggaggaaggat

SEQ ID NO: 4961323 - DNA, 17 bp, Homo sapiens
tgtggaggaaggattgt

SEQ ID NO: 4961324 - DNA, 16 bp, Homo sapiens
tgtggatcttttcatt

SEQ ID NO: 4961325 - DNA, 21 bp, Homo sapiens
tgtggatgcctgtggaagagt

SEQ ID NO: 4961326 - DNA, 18 bp, Homo sapiens
tgtggcacttgcctgggt

SEQ ID NO: 4961327 - DNA, 17 bp, Homo sapiens
tgtggcatctttgcctt

SEQ ID NO: 4961328 - DNA, 22 bp, Homo sapiens
tgtggcccctgaacaagaattg

SEQ ID NO: 4961329 - DNA, 12 bp, Homo sapiens
tgtggccctggc

SEQ ID NO: 4961330 - DNA, 18 bp, Homo sapiens
tgtggccctggctctgct

SEQ ID NO: 4961331 - DNA, 11 bp, Homo sapiens
tgtggcctgca

SEQ ID NO: 4961332 - DNA, 17 bp, Homo sapiens
tgtggcctgcacagtga

SEQ ID NO: 4961333 - DNA, 10 bp, Homo sapiens
tgtggctcac

SEQ ID NO: 4961334 - DNA, 18 bp, Homo sapiens
tgtggctgggggcaggag

SEQ ID NO: 4961335 - DNA, 19 bp, Homo sapiens
tgtggcttgctagctatgt

SEQ ID NO: 4961336 - DNA, 21 bp, Homo sapiens
tgtgggagggagcagacagga

SEQ ID NO: 4961337 - DNA, 14 bp, Homo sapiens
tgtgggcactggcc

SEQ ID NO: 4961338 - DNA, 18 bp, Homo sapiens
tgtggggcttggcgtgga

SEQ ID NO: 4961339 - DNA, 17 bp, Homo sapiens
tgtggtaggccttttaa

SEQ ID NO: 4961340 - DNA, 14 bp, Homo sapiens
tgtggtctcaggat

SEQ ID NO: 4961341 - DNA, 14 bp, Homo sapiens
tgtggtggcctcag

SEQ ID NO: 4961342 - DNA, 14 bp, Homo sapiens
tgtgtaaaatgtga

SEQ ID NO: 4961343 - DNA, 19 bp, Homo sapiens
tgtgtaacctcttcacctt

SEQ ID NO: 4961344 - DNA, 19 bp, Homo sapiens
tgtgtacatggcagagttt

SEQ ID NO: 4961345 - DNA, 19 bp, Homo sapiens
tgtgtactgtatagacagt

SEQ ID NO: 4961346 - DNA, 14 bp, Homo sapiens
tgtgtactgtgtca

SEQ ID NO: 4961347 - DNA, 21 bp, Homo sapiens
tgtgtagacaaatatttggag

SEQ ID NO: 4961348 - DNA, 18 bp, Homo sapiens
tgtgtagagttaagaagc

SEQ ID NO: 4961349 - DNA, 21 bp, Homo sapiens
tgtgtagagttaagaagctgt

SEQ ID NO: 4961350 - DNA, 14 bp, Homo sapiens
tgtgtagcctatgt

SEQ ID NO: 4961351 - DNA, 22 bp, Homo sapiens
tgtgtagttgtctctcttcaga

SEQ ID NO: 4961352 - DNA, 17 bp, Homo sapiens
tgtgtataagtgcacac

SEQ ID NO: 4961353 - DNA, 16 bp, Homo sapiens
tgtgtatacagccctg

SEQ ID NO: 4961354 - DNA, 23 bp, Homo sapiens
tgtgtatatatgtgtatatatac

SEQ ID NO: 4961355 - DNA, 15 bp, Homo sapiens
tgtgtatattatttg

SEQ ID NO: 4961356 - DNA, 16 bp, Homo sapiens
tgtgtatattatttgg

SEQ ID NO: 4961357 - DNA, 21 bp, Homo sapiens
tgtgtatcgtaaccagccaga

SEQ ID NO: 4961358 - DNA, 17 bp, Homo sapiens
tgtgtatctctttcaca

SEQ ID NO: 4961359 - DNA, 16 bp, Homo sapiens
tgtgtcaatgggcaat

SEQ ID NO: 4961360 - DNA, 17 bp, Homo sapiens
tgtgtcacttgtgcttt

SEQ ID NO: 4961361 - DNA, 19 bp, Homo sapiens
tgtgtcaggtggggcagct

SEQ ID NO: 4961362 - DNA, 14 bp, Homo sapiens
tgtgtcatgccagt

SEQ ID NO: 4961363 - DNA, 19 bp, Homo sapiens
tgtgtccacctgtgggtgt

SEQ ID NO: 4961364 - DNA, 16 bp, Homo sapiens
tgtgtccttccctgca

SEQ ID NO: 4961365 - DNA, 19 bp, Homo sapiens
tgtgtctaaatttgaatgt

SEQ ID NO: 4961366 - DNA, 15 bp, Homo sapiens
tgtgtctaagattct

SEQ ID NO: 4961367 - DNA, 17 bp, Homo sapiens
tgtgtctaagattctag

SEQ ID NO: 4961368 - DNA, 21 bp, Homo sapiens
tgtgtctgtacacgtgtcctg

SEQ ID NO: 4961369 - DNA, 17 bp, Homo sapiens
tgtgtgaggagctgctg

SEQ ID NO: 4961370 - DNA, 13 bp, Homo sapiens
tgtgtgcagtgaa

SEQ ID NO: 4961371 - DNA, 24 bp, Homo sapiens
tgtgtgccatagagtttaacacaa

SEQ ID NO: 4961372 - DNA, 22 bp, Homo sapiens
tgtgtgctcatgtatgtgcgaa

SEQ ID NO: 4961373 - DNA, 16 bp, Homo sapiens
tgtgtggtggcctcag

SEQ ID NO: 4961374 - DNA, 9 bp, Homo sapiens
tgtgtgtgt

SEQ ID NO: 4961375 - DNA, 13 bp, Homo sapiens
tgtgtgtgtgtat

SEQ ID NO: 4961376 - DNA, 16 bp, Homo sapiens
tgtgtgtgtgtatgtg

SEQ ID NO: 4961377 - DNA, 12 bp, Homo sapiens
tgtgtgtgtgtg

SEQ ID NO: 4961378 - DNA, 14 bp, Homo sapiens
tgtgtgtgtgtgta

SEQ ID NO: 4961379 - DNA, 19 bp, Homo sapiens
tgtgtgttccaagtttcca

SEQ ID NO: 4961380 - DNA, 14 bp, Homo sapiens
tgtgtgttgtctga

SEQ ID NO: 4961381 - DNA, 15 bp, Homo sapiens
tgtgtgtttgtgctg

SEQ ID NO: 4961382 - DNA, 13 bp, Homo sapiens
tgtgttgaaaacc

SEQ ID NO: 4961383 - DNA, 14 bp, Homo sapiens
tgtgttgaaaacca

SEQ ID NO: 4961384 - DNA, 19 bp, Homo sapiens
tgtgttggacagagaaggg

SEQ ID NO: 4961385 - DNA, 14 bp, Homo sapiens
tgtgttgtcttgaa

SEQ ID NO: 4961386 - DNA, 17 bp, Homo sapiens
tgtgtttggtttacatt

SEQ ID NO: 4961387 - DNA, 12 bp, Homo sapiens
tgttaaaatcta

SEQ ID NO: 4961388 - DNA, 21 bp, Homo sapiens
tgttaaaattatcaatatcta

SEQ ID NO: 4961389 - DNA, 14 bp, Homo sapiens
tgttaaatttgtaa

SEQ ID NO: 4961390 - DNA, 18 bp, Homo sapiens
tgttaaatttgtaagttt

SEQ ID NO: 4961391 - DNA, 16 bp, Homo sapiens
tgttaaatttttctga

SEQ ID NO: 4961392 - DNA, 15 bp, Homo sapiens
tgttaacattccaag

SEQ ID NO: 4961393 - DNA, 16 bp, Homo sapiens
tgttaacattccaaga

SEQ ID NO: 4961394 - DNA, 20 bp, Homo sapiens
tgttaacattccaagactct

SEQ ID NO: 4961395 - DNA, 15 bp, Homo sapiens
tgttaagaattgacc

SEQ ID NO: 4961396 - DNA, 20 bp, Homo sapiens
tgttaagcgtgtctgtattt

SEQ ID NO: 4961397 - DNA, 17 bp, Homo sapiens
tgttaaggaaactctta

SEQ ID NO: 4961398 - DNA, 21 bp, Homo sapiens
tgttaaggaaactcttatctc

SEQ ID NO: 4961399 - DNA, 15 bp, Homo sapiens
tgttaagtatgtgta

SEQ ID NO: 4961400 - DNA, 21 bp, Homo sapiens
tgttaatctctgttatgtact

SEQ ID NO: 4961401 - DNA, 12 bp, Homo sapiens
tgttaatgtatt

SEQ ID NO: 4961402 - DNA, 19 bp, Homo sapiens
tgttaatgtatttgttcat

SEQ ID NO: 4961403 - DNA, 15 bp, Homo sapiens
tgttaattacaccat

SEQ ID NO: 4961404 - DNA, 18 bp, Homo sapiens
tgttaattataggagcct

SEQ ID NO: 4961405 - DNA, 14 bp, Homo sapiens
tgttaccattcaca

SEQ ID NO: 4961406 - DNA, 15 bp, Homo sapiens
tgttaccattcacaa

SEQ ID NO: 4961407 - DNA, 22 bp, Homo sapiens
tgttactattttctacaattaa

SEQ ID NO: 4961408 - DNA, 9 bp, Homo sapiens
tgttactgt

SEQ ID NO: 4961409 - DNA, 14 bp, Homo sapiens
tgttactgtaattc

SEQ ID NO: 4961410 - DNA, 17 bp, Homo sapiens
tgttactgttaaccatt

SEQ ID NO: 4961411 - DNA, 12 bp, Homo sapiens
tgttactgttct

SEQ ID NO: 4961412 - DNA, 17 bp, Homo sapiens
tgttactgttcttgctg

SEQ ID NO: 4961413 - DNA, 19 bp, Homo sapiens
tgttactgttcttgctgct

SEQ ID NO: 4961414 - DNA, 18 bp, Homo sapiens
ttaccacacatctatgat

SEQ ID NO: 4961415 - DNA, 12 bp, Homo sapiens
ttaccactcagg

SEQ ID NO: 4961416 - DNA, 22 bp, Homo sapiens
ttaccagcaagaataaaaaaga

SEQ ID NO: 4961417 - DNA, 23 bp, Homo sapiens
ttaccagtggcgttgttgcatgt

SEQ ID NO: 4961418 - DNA, 18 bp, Homo sapiens
ttaccagttaattactca

SEQ ID NO: 4961419 - DNA, 14 bp, Homo sapiens
ttaccattcacaat

SEQ ID NO: 4961420 - DNA, 14 bp, Homo sapiens
ttacccaatttccc

SEQ ID NO: 4961421 - DNA, 17 bp, Homo sapiens
ttacccctggctgtttg

SEQ ID NO: 4961422 - DNA, 14 bp, Homo sapiens
ttaccccttagcct

SEQ ID NO: 4961423 - DNA, 17 bp, Homo sapiens
ttacccggtttcttttt

SEQ ID NO: 4961424 - DNA, 23 bp, Homo sapiens
ttaccctgtacatatgtaaacat

SEQ ID NO: 4961425 - DNA, 16 bp, Homo sapiens
ttacctaaagtatttt

SEQ ID NO: 4961426 - DNA, 18 bp, Homo sapiens
ttacctccaacagaacta

SEQ ID NO: 4961427 - DNA, 19 bp, Homo sapiens
ttacctccaacagaactaa

SEQ ID NO: 4961428 - DNA, 22 bp, Homo sapiens
ttacctccaacagaactaaatg

SEQ ID NO: 4961429 - DNA, 12 bp, Homo sapiens
ttacctctttaa

SEQ ID NO: 4961430 - DNA, 13 bp, Homo sapiens
ttacctgacacaa

SEQ ID NO: 4961431 - DNA, 19 bp, Homo sapiens
ttacctgacctcttgctgt

SEQ ID NO: 4961432 - DNA, 21 bp, Homo sapiens
ttacctgacctcttgctgtct

SEQ ID NO: 4961433 - DNA, 23 bp, Homo sapiens
ttacctgacctcttgctgtctct

SEQ ID NO: 4961434 - DNA, 22 bp, Homo sapiens
ttacctgtacactgacttgaga

SEQ ID NO: 4961435 - DNA, 17 bp, Homo sapiens
ttacctgtcacattgca

SEQ ID NO: 4961436 - DNA, 20 bp, Homo sapiens
ttaccttttaccagctttta

SEQ ID NO: 4961437 - DNA, 22 bp, Homo sapiens
ttactaaacatatgatttcact

SEQ ID NO: 4961438 - DNA, 16 bp, Homo sapiens
ttactaatgtaaaatg

SEQ ID NO: 4961439 - DNA, 19 bp, Homo sapiens
ttactattcattaaatgtt

SEQ ID NO: 4961440 - DNA, 17 bp, Homo sapiens
ttactattttctacaat

SEQ ID NO: 4961441 - DNA, 18 bp, Homo sapiens
ttactcagggctcctccc

SEQ ID NO: 4961442 - DNA, 21 bp, Homo sapiens
ttactcagggctcctcccagc

SEQ ID NO: 4961443 - DNA, 16 bp, Homo sapiens
ttactcattgaaatgt

SEQ ID NO: 4961444 - DNA, 17 bp, Homo sapiens
ttactcctcctctttct

SEQ ID NO: 4961445 - DNA, 12 bp, Homo sapiens
ttactctaagat

SEQ ID NO: 4961446 - DNA, 21 bp, Homo sapiens
ttactctatgccccaaatata

SEQ ID NO: 4961447 - DNA, 21 bp, Homo sapiens
ttactgccaaagggaaatatc

SEQ ID NO: 4961448 - DNA, 19 bp, Homo sapiens
ttactgccggtttgaaaat

SEQ ID NO: 4961449 - DNA, 15 bp, Homo sapiens
ttactgtaattcctc

SEQ ID NO: 4961450 - DNA, 12 bp, Homo sapiens
ttactgttcttg

SEQ ID NO: 4961451 - DNA, 17 bp, Homo sapiens
ttactgttcttgctgct

SEQ ID NO: 4961452 - DNA, 20 bp, Homo sapiens
ttactgttcttgctgctaga

SEQ ID NO: 4961453 - DNA, 16 bp, Homo sapiens
ttactgtttatttctg

SEQ ID NO: 4961454 - DNA, 16 bp, Homo sapiens
ttactttaaacttgtc

SEQ ID NO: 4961455 - DNA, 11 bp, Homo sapiens
ttactttccct

SEQ ID NO: 4961456 - DNA, 17 bp, Homo sapiens
ttagaaaaattcctaag

SEQ ID NO: 4961457 - DNA, 12 bp, Homo sapiens
ttagaaaatgtg

SEQ ID NO: 4961458 - DNA, 17 bp, Homo sapiens
ttagaaattgcatttcc

SEQ ID NO: 4961459 - DNA, 13 bp, Homo sapiens
ttagaacctttct

SEQ ID NO: 4961460 - DNA, 18 bp, Homo sapiens
ttagaagatagatgcact

SEQ ID NO: 4961461 - DNA, 16 bp, Homo sapiens
ttagaagtcacacagt

SEQ ID NO: 4961462 - DNA, 16 bp, Homo sapiens
ttagaataaattccca

SEQ ID NO: 4961463 - DNA, 21 bp, Homo sapiens
ttagaatcagccttgaaacat

SEQ ID NO: 4961464 - DNA, 14 bp, Homo sapiens
ttagaatctatttt

SEQ ID NO: 4961465 - DNA, 15 bp, Homo sapiens
ttagaatctattttc

SEQ ID NO: 4961466 - DNA, 16 bp, Homo sapiens
ttagaatctattttct

SEQ ID NO: 4961467 - DNA, 17 bp, Homo sapiens
ttagaatctattttcta

SEQ ID NO: 4961468 - DNA, 12 bp, Homo sapiens
ttagaattattt

SEQ ID NO: 4961469 - DNA, 20 bp, Homo sapiens
ttagacagagtctcactgtt

SEQ ID NO: 4961470 - DNA, 14 bp, Homo sapiens
ttagactacattta

SEQ ID NO: 4961471 - DNA, 14 bp, Homo sapiens
ttagactgtagcct

SEQ ID NO: 4961472 - DNA, 20 bp, Homo sapiens
ttagactgtagcctggatat

SEQ ID NO: 4961473 - DNA, 21 bp, Homo sapiens
ttagagcttccgagaatagct

SEQ ID NO: 4961474 - DNA, 18 bp, Homo sapiens
ttagagggaggagaatga

SEQ ID NO: 4961475 - DNA, 16 bp, Homo sapiens
ttagagtttctgtttg

SEQ ID NO: 4961476 - DNA, 17 bp, Homo sapiens
ttagatagctgcatgtg

SEQ ID NO: 4961477 - DNA, 21 bp, Homo sapiens
ttagatgttccagtaatctaa

SEQ ID NO: 4961478 - DNA, 20 bp, Homo sapiens
ttagattctctgtgtctaag

SEQ ID NO: 4961479 - DNA, 21 bp, Homo sapiens
ttagcaaggtcatttcttcag

SEQ ID NO: 4961480 - DNA, 14 bp, Homo sapiens
ttagcactgttgat

SEQ ID NO: 4961481 - DNA, 23 bp, Homo sapiens
ttagcaggccaaggtctgagcca

SEQ ID NO: 4961482 - DNA, 17 bp, Homo sapiens
ttagcatcctaagaaat

SEQ ID NO: 4961483 - DNA, 18 bp, Homo sapiens
ttagcatcctaagaaata

SEQ ID NO: 4961484 - DNA, 17 bp, Homo sapiens
ttagccaggatcatggt

SEQ ID NO: 4961485 - DNA, 17 bp, Homo sapiens
ttagccgcccatgcact

SEQ ID NO: 4961486 - DNA, 15 bp, Homo sapiens
ttagcctccctgaaa

SEQ ID NO: 4961487 - DNA, 21 bp, Homo sapiens
ttagctaaacggattccaaag

SEQ ID NO: 4961488 - DNA, 16 bp, Homo sapiens
ttagctggcattacag

SEQ ID NO: 4961489 - DNA, 15 bp, Homo sapiens
ttagctgtctgctca

SEQ ID NO: 4961490 - DNA, 17 bp, Homo sapiens
ttagctgtctgctcaga

SEQ ID NO: 4961491 - DNA, 20 bp, Homo sapiens
ttagctttgtgtttggttta

SEQ ID NO: 4961492 - DNA, 20 bp, Homo sapiens
ttagctttttaaaacattag

SEQ ID NO: 4961493 - DNA, 18 bp, Homo sapiens
ttagctttttaattgttg

SEQ ID NO: 4961494 - DNA, 11 bp, Homo sapiens
ttaggaaataa

SEQ ID NO: 4961495 - DNA, 17 bp, Homo sapiens
ttaggaaataaaacctt

SEQ ID NO: 4961496 - DNA, 18 bp, Homo sapiens
ttaggaaataaaaccttt

SEQ ID NO: 4961497 - DNA, 19 bp, Homo sapiens
ttaggaaataaaacctttc

SEQ ID NO: 4961498 - DNA, 21 bp, Homo sapiens
ttaggaaataaaacctttcaa

SEQ ID NO: 4961499 - DNA, 17 bp, Homo sapiens
ttaggaacttcagagat

SEQ ID NO: 4961500 - DNA, 17 bp, Homo sapiens
ttaggaagttttctgta

SEQ ID NO: 4961501 - DNA, 19 bp, Homo sapiens
ttaggaattaagttatctt

SEQ ID NO: 4961502 - DNA, 14 bp, Homo sapiens
ttaggcctacctga

SEQ ID NO: 4961503 - DNA, 15 bp, Homo sapiens
ttagggccaggcagg

SEQ ID NO: 4961504 - DNA, 15 bp, Homo sapiens
ttagggtacatttat

SEQ ID NO: 4961505 - DNA, 15 bp, Homo sapiens
ttagggtgaaccact

SEQ ID NO: 4961506 - DNA, 14 bp, Homo sapiens
ttaggtagaaaaac

SEQ ID NO: 4961507 - DNA, 15 bp, Homo sapiens
ttaggtagaaaaaca

SEQ ID NO: 4961508 - DNA, 14 bp, Homo sapiens
ttaggttctaaagt

SEQ ID NO: 4961509 - DNA, 16 bp, Homo sapiens
ttaggttctaaagttc

SEQ ID NO: 4961510 - DNA, 19 bp, Homo sapiens
ttaggttctaaagttctaa

SEQ ID NO: 4961511 - DNA, 13 bp, Homo sapiens
ttagtaatctgta

SEQ ID NO: 4961512 - DNA, 15 bp, Homo sapiens
ttagtaatctgtaca

SEQ ID NO: 4961513 - DNA, 21 bp, Homo sapiens
ttagtaatctgtacattttgt

SEQ ID NO: 4961514 - DNA, 14 bp, Homo sapiens
ttagtagagacagg

SEQ ID NO: 4961515 - DNA, 19 bp, Homo sapiens
ttagtatcagtgttttaaa

SEQ ID NO: 4961516 - DNA, 14 bp, Homo sapiens
ttagtattcattct

SEQ ID NO: 4961517 - DNA, 20 bp, Homo sapiens
ttagtatttatttatgtact

SEQ ID NO: 4961518 - DNA, 21 bp, Homo sapiens
ttagtctcagtttgtgtgtct

SEQ ID NO: 4961519 - DNA, 23 bp, Homo sapiens
ttagtctcagtttgtgtgtctta

SEQ ID NO: 4961520 - DNA, 17 bp, Homo sapiens
ttagtgatcttagcata

SEQ ID NO: 4961521 - DNA, 14 bp, Homo sapiens
ttagtgcatccagt

SEQ ID NO: 4961522 - DNA, 22 bp, Homo sapiens
ttagttatagtttcagatatat

SEQ ID NO: 4961523 - DNA, 22 bp, Homo sapiens
ttataaaagggggtccgtggaa

SEQ ID NO: 4961524 - DNA, 14 bp, Homo sapiens
ttcagattcccaga

SEQ ID NO: 4961525 - DNA, 19 bp, Homo sapiens
ttcagcacttgtctcattt

SEQ ID NO: 4961526 - DNA, 17 bp, Homo sapiens
ttcagcattccctccca

SEQ ID NO: 4961527 - DNA, 15 bp, Homo sapiens
ttcagcccccagccc

SEQ ID NO: 4961528 - DNA, 14 bp, Homo sapiens
ttcagctaagctag

SEQ ID NO: 4961529 - DNA, 20 bp, Homo sapiens
ttcagctaagctaggaatga

SEQ ID NO: 4961530 - DNA, 23 bp, Homo sapiens
ttcagctaagggaagacatttct

SEQ ID NO: 4961531 - DNA, 19 bp, Homo sapiens
ttcagctagcttttaggaa

SEQ ID NO: 4961532 - DNA, 20 bp, Homo sapiens
ttcagctagcttttaggaaa

SEQ ID NO: 4961533 - DNA, 15 bp, Homo sapiens
ttcagctctctgtat

SEQ ID NO: 4961534 - DNA, 16 bp, Homo sapiens
ttcagctctctgtata

SEQ ID NO: 4961535 - DNA, 21 bp, Homo sapiens
ttcagctctctgtataaacat

SEQ ID NO: 4961536 - DNA, 13 bp, Homo sapiens
ttcagctcttttt

SEQ ID NO: 4961537 - DNA, 16 bp, Homo sapiens
ttcagctgtcctccct

SEQ ID NO: 4961538 - DNA, 14 bp, Homo sapiens
ttcagcttcatttg

SEQ ID NO: 4961539 - DNA, 14 bp, Homo sapiens
ttcaggagcgcaag

SEQ ID NO: 4961540 - DNA, 19 bp, Homo sapiens
ttcaggagcgcaagataga

SEQ ID NO: 4961541 - DNA, 17 bp, Homo sapiens
ttcaggggactcagccc

SEQ ID NO: 4961542 - DNA, 19 bp, Homo sapiens
ttcagggttggcccctgcc

SEQ ID NO: 4961543 - DNA, 14 bp, Homo sapiens
ttcaggtgaaaatg

SEQ ID NO: 4961544 - DNA, 14 bp, Homo sapiens
ttcaggtgacatgt

SEQ ID NO: 4961545 - DNA, 19 bp, Homo sapiens
ttcagtaaacataaagcca

SEQ ID NO: 4961546 - DNA, 20 bp, Homo sapiens
ttcagtaataaactgtgttt

SEQ ID NO: 4961547 - DNA, 21 bp, Homo sapiens
ttcagtaccctctcagctcca

SEQ ID NO: 4961548 - DNA, 18 bp, Homo sapiens
ttcagtattttggagaaa

SEQ ID NO: 4961549 - DNA, 20 bp, Homo sapiens
ttcagtcagaaaactttaaa

SEQ ID NO: 4961550 - DNA, 12 bp, Homo sapiens
ttcagtcctgct

SEQ ID NO: 4961551 - DNA, 18 bp, Homo sapiens
ttcagtcctgctccagaa

SEQ ID NO: 4961552 - DNA, 22 bp, Homo sapiens
ttcagtcctgggagacccatgt

SEQ ID NO: 4961553 - DNA, 20 bp, Homo sapiens
ttcagtctgaatgctgccac

SEQ ID NO: 4961554 - DNA, 14 bp, Homo sapiens
ttcagtcttgcctt

SEQ ID NO: 4961555 - DNA, 13 bp, Homo sapiens
ttcagtggcagct

SEQ ID NO: 4961556 - DNA, 16 bp, Homo sapiens
ttcagtggcagctgct

SEQ ID NO: 4961557 - DNA, 17 bp, Homo sapiens
ttcagtggcagctgctt

SEQ ID NO: 4961558 - DNA, 19 bp, Homo sapiens
ttcagtgtagttaatttat

SEQ ID NO: 4961559 - DNA, 23 bp, Homo sapiens
ttcagttgtttgtttttgcttgt

SEQ ID NO: 4961560 - DNA, 17 bp, Homo sapiens
ttcagtttcttctgcgc

SEQ ID NO: 4961561 - DNA, 12 bp, Homo sapiens
ttcataaatgaa

SEQ ID NO: 4961562 - DNA, 13 bp, Homo sapiens
ttcataacttatt

SEQ ID NO: 4961563 - DNA, 18 bp, Homo sapiens
ttcataacttattgctga

SEQ ID NO: 4961564 - DNA, 14 bp, Homo sapiens
ttcatacctaagta

SEQ ID NO: 4961565 - DNA, 19 bp, Homo sapiens
ttcatacctaagtactgta

SEQ ID NO: 4961566 - DNA, 22 bp, Homo sapiens
ttcatacctaagtactgtaata

SEQ ID NO: 4961567 - DNA, 21 bp, Homo sapiens
ttcatatatgaggacttgtgt

SEQ ID NO: 4961568 - DNA, 13 bp, Homo sapiens
ttcatatgctgta

SEQ ID NO: 4961569 - DNA, 22 bp, Homo sapiens
ttcatattcttcatatccttct

SEQ ID NO: 4961570 - DNA, 14 bp, Homo sapiens
ttcatattgtgcca

SEQ ID NO: 4961571 - DNA, 22 bp, Homo sapiens
ttcatattgtgccaatatgtat

SEQ ID NO: 4961572 - DNA, 22 bp, Homo sapiens
ttcatccaggcccaactgtgag

SEQ ID NO: 4961573 - DNA, 14 bp, Homo sapiens
ttcatcccagcccc

SEQ ID NO: 4961574 - DNA, 22 bp, Homo sapiens
ttcatcttttgaggcttctgtt

SEQ ID NO: 4961575 - DNA, 12 bp, Homo sapiens
ttcatgatgcag

SEQ ID NO: 4961576 - DNA, 20 bp, Homo sapiens
ttcatggaccactgtttctt

SEQ ID NO: 4961577 - DNA, 20 bp, Homo sapiens
ttcatgtagagaaaagcaca

SEQ ID NO: 4961578 - DNA, 16 bp, Homo sapiens
ttcatgttttgtgact

SEQ ID NO: 4961579 - DNA, 17 bp, Homo sapiens
ttcatgttttgtgacta

SEQ ID NO: 4961580 - DNA, 18 bp, Homo sapiens
ttcatgttttgtgactat

SEQ ID NO: 4961581 - DNA, 13 bp, Homo sapiens
ttcattaaagcat

SEQ ID NO: 4961582 - DNA, 14 bp, Homo sapiens
ttcattagctgtga

SEQ ID NO: 4961583 - DNA, 16 bp, Homo sapiens
ttcattcaatattgac

SEQ ID NO: 4961584 - DNA, 15 bp, Homo sapiens
ttcattcacttctct

SEQ ID NO: 4961585 - DNA, 12 bp, Homo sapiens
ttcattctcctt

SEQ ID NO: 4961586 - DNA, 14 bp, Homo sapiens
ttcattctgcattg

SEQ ID NO: 4961587 - DNA, 17 bp, Homo sapiens
ttcattctgtgatcatt

SEQ ID NO: 4961588 - DNA, 19 bp, Homo sapiens
ttcattgagagttttgtct

SEQ ID NO: 4961589 - DNA, 16 bp, Homo sapiens
ttcattgtatgatgtg

SEQ ID NO: 4961590 - DNA, 15 bp, Homo sapiens
ttcattgtccctctt

SEQ ID NO: 4961591 - DNA, 21 bp, Homo sapiens
ttcatttagctaaacggattc

SEQ ID NO: 4961592 - DNA, 12 bp, Homo sapiens
ttcatttcattg

SEQ ID NO: 4961593 - DNA, 13 bp, Homo sapiens
ttcatttcattgt

SEQ ID NO: 4961594 - DNA, 15 bp, Homo sapiens
ttcatttcattgtat

SEQ ID NO: 4961595 - DNA, 22 bp, Homo sapiens
ttcatttggttcattaattcta

SEQ ID NO: 4961596 - DNA, 13 bp, Homo sapiens
ttcatttgtgtca

SEQ ID NO: 4961597 - DNA, 13 bp, Homo sapiens
ttcattttccaat

SEQ ID NO: 4961598 - DNA, 15 bp, Homo sapiens
ttccaaaaattatta

SEQ ID NO: 4961599 - DNA, 15 bp, Homo sapiens
ttccaaaagccaatg

SEQ ID NO: 4961600 - DNA, 16 bp, Homo sapiens
ttccaaaagccaatgg

SEQ ID NO: 4961601 - DNA, 13 bp, Homo sapiens
ttccaaaataatt

SEQ ID NO: 4961602 - DNA, 22 bp, Homo sapiens
ttccaaagagtagaattgcatt

SEQ ID NO: 4961603 - DNA, 16 bp, Homo sapiens
ttccaaagtctctaat

SEQ ID NO: 4961604 - DNA, 19 bp, Homo sapiens
ttccaaataataaagtcta

SEQ ID NO: 4961605 - DNA, 18 bp, Homo sapiens
ttccaacaccacagacac

SEQ ID NO: 4961606 - DNA, 22 bp, Homo sapiens
ttccaactgtatatattcccaa

SEQ ID NO: 4961607 - DNA, 21 bp, Homo sapiens
ttccaagactctagagtccaa

SEQ ID NO: 4961608 - DNA, 13 bp, Homo sapiens
ttccaaggcttct

SEQ ID NO: 4961609 - DNA, 19 bp, Homo sapiens
ttccaagtaatataatgga

SEQ ID NO: 4961610 - DNA, 15 bp, Homo sapiens
ttccaatatttctgc

SEQ ID NO: 4961611 - DNA, 22 bp, Homo sapiens
ttccacaccttttattgacaca

SEQ ID NO: 4961612 - DNA, 18 bp, Homo sapiens
ttccacagttgccaccac

SEQ ID NO: 4961613 - DNA, 17 bp, Homo sapiens
ttccactgcctctgcct

SEQ ID NO: 4961614 - DNA, 20 bp, Homo sapiens
ttccactgtcaagaaagagc

SEQ ID NO: 4961615 - DNA, 14 bp, Homo sapiens
ttccacttcttcct

SEQ ID NO: 4961616 - DNA, 16 bp, Homo sapiens
ttccagaagaagagaa

SEQ ID NO: 4961617 - DNA, 18 bp, Homo sapiens
ttccagaagaagagaagc

SEQ ID NO: 4961618 - DNA, 18 bp, Homo sapiens
ttccagataaccagctgt

SEQ ID NO: 4961619 - DNA, 23 bp, Homo sapiens
ttccagataaccagctgtaacac

SEQ ID NO: 4961620 - DNA, 22 bp, Homo sapiens
ttccagcagaagacaaaaagac

SEQ ID NO: 4961621 - DNA, 11 bp, Homo sapiens
ttccagctcct

SEQ ID NO: 4961622 - DNA, 19 bp, Homo sapiens
ttccagctctaataaaaca

SEQ ID NO: 4961623 - DNA, 15 bp, Homo sapiens
ttccagctgctgtct

SEQ ID NO: 4961624 - DNA, 13 bp, Homo sapiens
ttccaggacccct

SEQ ID NO: 4961625 - DNA, 14 bp, Homo sapiens
ttccaggggaacct

SEQ ID NO: 4961626 - DNA, 14 bp, Homo sapiens
ttccagtctcaaaa

SEQ ID NO: 4961627 - DNA, 19 bp, Homo sapiens
ttccataatctggactcct

SEQ ID NO: 4961628 - DNA, 15 bp, Homo sapiens
ttccatatcttgcga

SEQ ID NO: 4961629 - DNA, 14 bp, Homo sapiens
ttccatatttggaa

SEQ ID NO: 4961630 - DNA, 22 bp, Homo sapiens
ttccatcacccgtacaggcaat

SEQ ID NO: 4961631 - DNA, 21 bp, Homo sapiens
ttccatccctaccccctaaga

SEQ ID NO: 4961632 - DNA, 18 bp, Homo sapiens
ttccatctttacaaaact

SEQ ID NO: 4961633 - DNA, 16 bp, Homo sapiens
ttccatgtcgcctctg

SEQ ID NO: 4961634 - DNA, 11 bp, Homo sapiens
ttgaaaaaagc

SEQ ID NO: 4961635 - DNA, 13 bp, Homo sapiens
ttgaaaaaagctc

SEQ ID NO: 4961636 - DNA, 14 bp, Homo sapiens
ttgaaaaaagctca

SEQ ID NO: 4961637 - DNA, 20 bp, Homo sapiens
ttgaaaaaagctcatttcat

SEQ ID NO: 4961638 - DNA, 17 bp, Homo sapiens
ttgaaaaccaaaatgac

SEQ ID NO: 4961639 - DNA, 19 bp, Homo sapiens
ttgaaaaccaaaatgacat

SEQ ID NO: 4961640 - DNA, 23 bp, Homo sapiens
ttgaaaagatgtacctggtggat

SEQ ID NO: 4961641 - DNA, 13 bp, Homo sapiens
ttgaaaagctatt

SEQ ID NO: 4961642 - DNA, 14 bp, Homo sapiens
ttgaaaagctatta

SEQ ID NO: 4961643 - DNA, 17 bp, Homo sapiens
ttgaaaagcttcttaat

SEQ ID NO: 4961644 - DNA, 22 bp, Homo sapiens
ttgaaaattattttaaacaaaa

SEQ ID NO: 4961645 - DNA, 20 bp, Homo sapiens
ttgaaaattcaaaaagtgtt

SEQ ID NO: 4961646 - DNA, 16 bp, Homo sapiens
ttgaaacctgctctgt

SEQ ID NO: 4961647 - DNA, 15 bp, Homo sapiens
ttgaaagattcaggt

SEQ ID NO: 4961648 - DNA, 17 bp, Homo sapiens
ttgaaagggatcatcat

SEQ ID NO: 4961649 - DNA, 22 bp, Homo sapiens
ttgaaagtgaataaacttcagc

SEQ ID NO: 4961650 - DNA, 19 bp, Homo sapiens
ttgaaatcaatgcaagagt

SEQ ID NO: 4961651 - DNA, 14 bp, Homo sapiens
ttgaaatgaaattt

SEQ ID NO: 4961652 - DNA, 14 bp, Homo sapiens
ttgaaatgtcacgt

SEQ ID NO: 4961653 - DNA, 11 bp, Homo sapiens
ttgaaattata

SEQ ID NO: 4961654 - DNA, 17 bp, Homo sapiens
ttgaaattatgtgacat

SEQ ID NO: 4961655 - DNA, 12 bp, Homo sapiens
ttgaaattttaa

SEQ ID NO: 4961656 - DNA, 15 bp, Homo sapiens
ttgaaattttgcaaa

SEQ ID NO: 4961657 - DNA, 17 bp, Homo sapiens
ttgaacaaaatctgttg

SEQ ID NO: 4961658 - DNA, 20 bp, Homo sapiens
ttgaacacaaactgtaaata

SEQ ID NO: 4961659 - DNA, 21 bp, Homo sapiens
ttgaacacaaactgtaaataa

SEQ ID NO: 4961660 - DNA, 16 bp, Homo sapiens
ttgaaccatccactta

SEQ ID NO: 4961661 - DNA, 21 bp, Homo sapiens
ttgaaccatccacttacatat

SEQ ID NO: 4961662 - DNA, 22 bp, Homo sapiens
ttgaactaagaaacttttgtaa

SEQ ID NO: 4961663 - DNA, 12 bp, Homo sapiens
ttgaagacaatt

SEQ ID NO: 4961664 - DNA, 19 bp, Homo sapiens
ttgaagacaatttgataca

SEQ ID NO: 4961665 - DNA, 23 bp, Homo sapiens
ttgaagacaatttgatacataat

SEQ ID NO: 4961666 - DNA, 21 bp, Homo sapiens
ttgaagagagatatatctgaa

SEQ ID NO: 4961667 - DNA, 11 bp, Homo sapiens
ttgaaggaaac

SEQ ID NO: 4961668 - DNA, 19 bp, Homo sapiens
ttgaagtcaccttgtgtgt

SEQ ID NO: 4961669 - DNA, 16 bp, Homo sapiens
ttgaagtcttgtataa

SEQ ID NO: 4961670 - DNA, 15 bp, Homo sapiens
ttgaagtttacattt

SEQ ID NO: 4961671 - DNA, 19 bp, Homo sapiens
ttgaagtttacatttttat

SEQ ID NO: 4961672 - DNA, 16 bp, Homo sapiens
ttgaataaaagtgcac

SEQ ID NO: 4961673 - DNA, 23 bp, Homo sapiens
ttgaatattactcctatttttgt

SEQ ID NO: 4961674 - DNA, 12 bp, Homo sapiens
ttgaatattgtg

SEQ ID NO: 4961675 - DNA, 21 bp, Homo sapiens
ttgaatgacaacagaagcttc

SEQ ID NO: 4961676 - DNA, 13 bp, Homo sapiens
ttgaatgctgcca

SEQ ID NO: 4961677 - DNA, 15 bp, Homo sapiens
ttgaatgctgccagt

SEQ ID NO: 4961678 - DNA, 23 bp, Homo sapiens
ttgaatgctgccagtgtggagtg

SEQ ID NO: 4961679 - DNA, 15 bp, Homo sapiens
ttgaatgctttttga

SEQ ID NO: 4961680 - DNA, 23 bp, Homo sapiens
ttgaatgctttttgaatgttatt

SEQ ID NO: 4961681 - DNA, 12 bp, Homo sapiens
ttgaatgtcttt

SEQ ID NO: 4961682 - DNA, 17 bp, Homo sapiens
ttgaatgtcttttgaat

SEQ ID NO: 4961683 - DNA, 19 bp, Homo sapiens
ttgaatgtggcttgagaaa

SEQ ID NO: 4961684 - DNA, 13 bp, Homo sapiens
ttgaatgtgtcag

SEQ ID NO: 4961685 - DNA, 16 bp, Homo sapiens
ttgaatgttaagaatt

SEQ ID NO: 4961686 - DNA, 14 bp, Homo sapiens
ttgaatgttaagca

SEQ ID NO: 4961687 - DNA, 12 bp, Homo sapiens
ttgaattaaaac

SEQ ID NO: 4961688 - DNA, 14 bp, Homo sapiens
ttgaattaaaactt

SEQ ID NO: 4961689 - DNA, 17 bp, Homo sapiens
ttgaattaaaacttctt

SEQ ID NO: 4961690 - DNA, 18 bp, Homo sapiens
ttgacaaaattttctcat

SEQ ID NO: 4961691 - DNA, 17 bp, Homo sapiens
ttgacaaatctgtgtat

SEQ ID NO: 4961692 - DNA, 20 bp, Homo sapiens
ttgacaaatctgtgtatatt

SEQ ID NO: 4961693 - DNA, 16 bp, Homo sapiens
ttgacaactgtgactg

SEQ ID NO: 4961694 - DNA, 18 bp, Homo sapiens
ttgacacaagtggacctt

SEQ ID NO: 4961695 - DNA, 15 bp, Homo sapiens
ttgacacaattggaa

SEQ ID NO: 4961696 - DNA, 23 bp, Homo sapiens
ttgacacatccgccttttgtata

SEQ ID NO: 4961697 - DNA, 10 bp, Homo sapiens
ttgacagggc

SEQ ID NO: 4961698 - DNA, 19 bp, Homo sapiens
ttgacagggcacaccgggc

SEQ ID NO: 4961699 - DNA, 14 bp, Homo sapiens
ttgacattgcgttt

SEQ ID NO: 4961700 - DNA, 18 bp, Homo sapiens
ttgacattgcgtttgacc

SEQ ID NO: 4961701 - DNA, 15 bp, Homo sapiens
ttgacctcaggtgat

SEQ ID NO: 4961702 - DNA, 21 bp, Homo sapiens
ttgacctcaggtgatccaccc

SEQ ID NO: 4961703 - DNA, 16 bp, Homo sapiens
ttgacctgctccgctg

SEQ ID NO: 4961704 - DNA, 21 bp, Homo sapiens
ttgaccttttatgtagtaatt

SEQ ID NO: 4961705 - DNA, 18 bp, Homo sapiens
ttgacttatagtacatga

SEQ ID NO: 4961706 - DNA, 21 bp, Homo sapiens
ttgagaagccttcagctccag

SEQ ID NO: 4961707 - DNA, 16 bp, Homo sapiens
ttgagaaggagagaaa

SEQ ID NO: 4961708 - DNA, 22 bp, Homo sapiens
ttgagacacggagcccagccct

SEQ ID NO: 4961709 - DNA, 17 bp, Homo sapiens
ttgagacagtttcttag

SEQ ID NO: 4961710 - DNA, 22 bp, Homo sapiens
ttgagacagtttcttagctttt

SEQ ID NO: 4961711 - DNA, 13 bp, Homo sapiens
ttgagaccagcct

SEQ ID NO: 4961712 - DNA, 15 bp, Homo sapiens
ttgagaccagcctgg

SEQ ID NO: 4961713 - DNA, 16 bp, Homo sapiens
ttgagactatttaaac

SEQ ID NO: 4961714 - DNA, 17 bp, Homo sapiens
ttgagagaagagacaaa

SEQ ID NO: 4961715 - DNA, 18 bp, Homo sapiens
ttgagagttttgtcttga

SEQ ID NO: 4961716 - DNA, 18 bp, Homo sapiens
ttgagatactttttcttt

SEQ ID NO: 4961717 - DNA, 22 bp, Homo sapiens
ttgagatactttttcttttgta

SEQ ID NO: 4961718 - DNA, 19 bp, Homo sapiens
ttgagattgccccaggtct

SEQ ID NO: 4961719 - DNA, 13 bp, Homo sapiens
ttgagcccaggag

SEQ ID NO: 4961720 - DNA, 11 bp, Homo sapiens
ttgagctggcc

SEQ ID NO: 4961721 - DNA, 15 bp, Homo sapiens
ttgaggaactgtaca

SEQ ID NO: 4961722 - DNA, 21 bp, Homo sapiens
ttgaggagcatgttttgtata

SEQ ID NO: 4961723 - DNA, 23 bp, Homo sapiens
ttgaggagcatgttttgtataca

SEQ ID NO: 4961724 - DNA, 13 bp, Homo sapiens
ttgaggcaagtgt

SEQ ID NO: 4961725 - DNA, 17 bp, Homo sapiens
ttgaggctttgtgttgt

SEQ ID NO: 4961726 - DNA, 17 bp, Homo sapiens
ttgagggactgcctctg

SEQ ID NO: 4961727 - DNA, 16 bp, Homo sapiens
ttgagggcccagagca

SEQ ID NO: 4961728 - DNA, 16 bp, Homo sapiens
ttgaggtaaagatatg

SEQ ID NO: 4961729 - DNA, 15 bp, Homo sapiens
ttgagtagacacatt

SEQ ID NO: 4961730 - DNA, 13 bp, Homo sapiens
ttgagtagatatt

SEQ ID NO: 4961731 - DNA, 19 bp, Homo sapiens
ttgagtagatattacttta

SEQ ID NO: 4961732 - DNA, 20 bp, Homo sapiens
ttgagtagatattactttat

SEQ ID NO: 4961733 - DNA, 17 bp, Homo sapiens
ttgagtataagaaatgc

SEQ ID NO: 4961734 - DNA, 23 bp, Homo sapiens
ttgagtggggttatctctgtgtt

SEQ ID NO: 4961735 - DNA, 18 bp, Homo sapiens
ttgagttctgtagagcct

SEQ ID NO: 4961736 - DNA, 14 bp, Homo sapiens
ttgataatgataaa

SEQ ID NO: 4961737 - DNA, 14 bp, Homo sapiens
ttgataatgttaaa

SEQ ID NO: 4961738 - DNA, 19 bp, Homo sapiens
ttgataatgttaaatttgt

SEQ ID NO: 4961739 - DNA, 13 bp, Homo sapiens
ttgatacccctgg

SEQ ID NO: 4961740 - DNA, 20 bp, Homo sapiens
ttgatacccctggggaacat

SEQ ID NO: 4961741 - DNA, 23 bp, Homo sapiens
ttgatacccctggggaacatttc

SEQ ID NO: 4961742 - DNA, 20 bp, Homo sapiens
ttgatactctttctaatgct

SEQ ID NO: 4961743 - DNA, 13 bp, Homo sapiens
ttgatatgagtat

SEQ ID NO: 4961744 - DNA, 23 bp, Homo sapiens
ttgtagcatataggtgatgtttg

SEQ ID NO: 4961745 - DNA, 13 bp, Homo sapiens
ttgtaggtaaaat

SEQ ID NO: 4961746 - DNA, 19 bp, Homo sapiens
ttgtataaatgtatataca

SEQ ID NO: 4961747 - DNA, 16 bp, Homo sapiens
ttgtataactaacagc

SEQ ID NO: 4961748 - DNA, 14 bp, Homo sapiens
ttgtataacttctt

SEQ ID NO: 4961749 - DNA, 13 bp, Homo sapiens
ttgtatacaaata

SEQ ID NO: 4961750 - DNA, 16 bp, Homo sapiens
ttgtatacaaatatat

SEQ ID NO: 4961751 - DNA, 22 bp, Homo sapiens
ttgtatacaaatatattgttaa

SEQ ID NO: 4961752 - DNA, 15 bp, Homo sapiens
ttgtatacatcctgg

SEQ ID NO: 4961753 - DNA, 16 bp, Homo sapiens
ttgtatagtgtaaaat

SEQ ID NO: 4961754 - DNA, 13 bp, Homo sapiens
ttgtatatatctg

SEQ ID NO: 4961755 - DNA, 19 bp, Homo sapiens
ttgtatatatctgcttcag

SEQ ID NO: 4961756 - DNA, 13 bp, Homo sapiens
ttgtatattgtgt

SEQ ID NO: 4961757 - DNA, 15 bp, Homo sapiens
ttgtatattgtgttt

SEQ ID NO: 4961758 - DNA, 19 bp, Homo sapiens
ttgtatattgtgtttgtgt

SEQ ID NO: 4961759 - DNA, 20 bp, Homo sapiens
ttgtatctctgaagcatgtt

SEQ ID NO: 4961760 - DNA, 20 bp, Homo sapiens
ttgtatggggaggcaagtgt

SEQ ID NO: 4961761 - DNA, 15 bp, Homo sapiens
ttgtatgtatctatt

SEQ ID NO: 4961762 - DNA, 17 bp, Homo sapiens
ttgtatgtgtgtagaca

SEQ ID NO: 4961763 - DNA, 19 bp, Homo sapiens
ttgtattgtggtattgaat

SEQ ID NO: 4961764 - DNA, 14 bp, Homo sapiens
ttgtcagacataaa

SEQ ID NO: 4961765 - DNA, 13 bp, Homo sapiens
ttgtcatgtggct

SEQ ID NO: 4961766 - DNA, 19 bp, Homo sapiens
ttgtccaattgttgacagt

SEQ ID NO: 4961767 - DNA, 16 bp, Homo sapiens
ttgtcccccaacttga

SEQ ID NO: 4961768 - DNA, 15 bp, Homo sapiens
ttgtccccgtggtct

SEQ ID NO: 4961769 - DNA, 18 bp, Homo sapiens
ttgtccgtgttcatacat

SEQ ID NO: 4961770 - DNA, 22 bp, Homo sapiens
ttgtcgaaaagagtcttccaat

SEQ ID NO: 4961771 - DNA, 15 bp, Homo sapiens
ttgtctaactcagaa

SEQ ID NO: 4961772 - DNA, 14 bp, Homo sapiens
ttgtctatgggact

SEQ ID NO: 4961773 - DNA, 11 bp, Homo sapiens
ttgtctatttt

SEQ ID NO: 4961774 - DNA, 17 bp, Homo sapiens
ttgtctatttttgtctt

SEQ ID NO: 4961775 - DNA, 11 bp, Homo sapiens
ttgtctcagaa

SEQ ID NO: 4961776 - DNA, 13 bp, Homo sapiens
ttgtctctccttt

SEQ ID NO: 4961777 - DNA, 22 bp, Homo sapiens
ttgtctctccttttcttttgtt

SEQ ID NO: 4961778 - DNA, 14 bp, Homo sapiens
ttgtctctcttcag

SEQ ID NO: 4961779 - DNA, 21 bp, Homo sapiens
ttgtctgaagtcactgcacag

SEQ ID NO: 4961780 - DNA, 17 bp, Homo sapiens
ttgtctgtttgtttcaa

SEQ ID NO: 4961781 - DNA, 20 bp, Homo sapiens
ttgtctgtttgtttcaagaa

SEQ ID NO: 4961782 - DNA, 13 bp, Homo sapiens
ttgtcttgaaaga

SEQ ID NO: 4961783 - DNA, 15 bp, Homo sapiens
ttgtcttgaatgtct

SEQ ID NO: 4961784 - DNA, 18 bp, Homo sapiens
ttgtcttttcaaaatatt

SEQ ID NO: 4961785 - DNA, 18 bp, Homo sapiens
ttgtgaaacacagctgtt

SEQ ID NO: 4961786 - DNA, 23 bp, Homo sapiens
ttgtgaaatggccaggatcctct

SEQ ID NO: 4961787 - DNA, 13 bp, Homo sapiens
ttgtgaaggcagg

SEQ ID NO: 4961788 - DNA, 16 bp, Homo sapiens
ttgtgaatgcttctca

SEQ ID NO: 4961789 - DNA, 15 bp, Homo sapiens
ttgtgaatggattgg

SEQ ID NO: 4961790 - DNA, 21 bp, Homo sapiens
ttgtgactatatagagatgtt

SEQ ID NO: 4961791 - DNA, 22 bp, Homo sapiens
ttgtgactatatagagatgttt

SEQ ID NO: 4961792 - DNA, 18 bp, Homo sapiens
ttgtgatgtcccaacttg

SEQ ID NO: 4961793 - DNA, 22 bp, Homo sapiens
ttgtgatgtcccaacttgtaaa

SEQ ID NO: 4961794 - DNA, 21 bp, Homo sapiens
ttgtgcaaaatatttgactat

SEQ ID NO: 4961795 - DNA, 13 bp, Homo sapiens
ttgtgccagagga

SEQ ID NO: 4961796 - DNA, 21 bp, Homo sapiens
ttgtgccagaggaatcctggc

SEQ ID NO: 4961797 - DNA, 14 bp, Homo sapiens
ttgtgctacagatg

SEQ ID NO: 4961798 - DNA, 14 bp, Homo sapiens
ttgtgctagaatac

SEQ ID NO: 4961799 - DNA, 14 bp, Homo sapiens
ttgtgctgccattt

SEQ ID NO: 4961800 - DNA, 16 bp, Homo sapiens
ttgtgcttctccccag

SEQ ID NO: 4961801 - DNA, 18 bp, Homo sapiens
ttgtgcttctccccagaa

SEQ ID NO: 4961802 - DNA, 19 bp, Homo sapiens
ttgtgcttctccccagaat

SEQ ID NO: 4961803 - DNA, 16 bp, Homo sapiens
ttgtgcttttcctatt

SEQ ID NO: 4961804 - DNA, 22 bp, Homo sapiens
ttgtggaatggagattcagttt

SEQ ID NO: 4961805 - DNA, 17 bp, Homo sapiens
ttgtggaccaattattg

SEQ ID NO: 4961806 - DNA, 18 bp, Homo sapiens
ttgtggaccaattattga

SEQ ID NO: 4961807 - DNA, 14 bp, Homo sapiens
ttgtggctgggggc

SEQ ID NO: 4961808 - DNA, 20 bp, Homo sapiens
ttgtgggacttattacaatt

SEQ ID NO: 4961809 - DNA, 14 bp, Homo sapiens
ttgtgtatatttgt

SEQ ID NO: 4961810 - DNA, 21 bp, Homo sapiens
ttgtgtatcgtaaccagccag

SEQ ID NO: 4961811 - DNA, 23 bp, Homo sapiens
ttgtgtatttacgctttgattca

SEQ ID NO: 4961812 - DNA, 13 bp, Homo sapiens
ttgtgtctgtaca

SEQ ID NO: 4961813 - DNA, 15 bp, Homo sapiens
ttgtgtctgtacacg

SEQ ID NO: 4961814 - DNA, 21 bp, Homo sapiens
ttgtgtgaccaactgtgttgt

SEQ ID NO: 4961815 - DNA, 13 bp, Homo sapiens
ttgtgtgtactca

SEQ ID NO: 4961816 - DNA, 15 bp, Homo sapiens
ttgtgtgttccaagt

SEQ ID NO: 4961817 - DNA, 20 bp, Homo sapiens
ttgtgttaagtatgtgtaaa

SEQ ID NO: 4961818 - DNA, 19 bp, Homo sapiens
ttgtgttcttcttcatatt

SEQ ID NO: 4961819 - DNA, 16 bp, Homo sapiens
ttgtgttgacattaag

SEQ ID NO: 4961820 - DNA, 11 bp, Homo sapiens
ttgtgttgtca

SEQ ID NO: 4961821 - DNA, 13 bp, Homo sapiens
ttgtgttgtgaat

SEQ ID NO: 4961822 - DNA, 16 bp, Homo sapiens
ttgtgtttggtttaca

SEQ ID NO: 4961823 - DNA, 18 bp, Homo sapiens
ttgtgtttggtttacatt

SEQ ID NO: 4961824 - DNA, 20 bp, Homo sapiens
ttgttaaaattatgaatctg

SEQ ID NO: 4961825 - DNA, 22 bp, Homo sapiens
ttgttaatctctgttatgtact

SEQ ID NO: 4961826 - DNA, 17 bp, Homo sapiens
ttgttaatttcagtcct

SEQ ID NO: 4961827 - DNA, 23 bp, Homo sapiens
ttgttacctccaacagaactaaa

SEQ ID NO: 4961828 - DNA, 15 bp, Homo sapiens
ttgttactcttacga

SEQ ID NO: 4961829 - DNA, 11 bp, Homo sapiens
ttgttactgtt

SEQ ID NO: 4961830 - DNA, 15 bp, Homo sapiens
ttgttactgttcttg

SEQ ID NO: 4961831 - DNA, 19 bp, Homo sapiens
ttgttactgttcttgctgc

SEQ ID NO: 4961832 - DNA, 12 bp, Homo sapiens
ttgttatgctat

SEQ ID NO: 4961833 - DNA, 15 bp, Homo sapiens
ttgttattttggaaa

SEQ ID NO: 4961834 - DNA, 16 bp, Homo sapiens
ttgttcaaacaatatc

SEQ ID NO: 4961835 - DNA, 20 bp, Homo sapiens
ttgttcaataataaatattt

SEQ ID NO: 4961836 - DNA, 22 bp, Homo sapiens
ttgttcaataataaatattttt

SEQ ID NO: 4961837 - DNA, 14 bp, Homo sapiens
ttgttccctctccc

SEQ ID NO: 4961838 - DNA, 18 bp, Homo sapiens
ttgttgacagttctgaag

SEQ ID NO: 4961839 - DNA, 17 bp, Homo sapiens
ttgttgcatgtttgaaa

SEQ ID NO: 4961840 - DNA, 18 bp, Homo sapiens
ttgttgctccctgtgaca

SEQ ID NO: 4961841 - DNA, 20 bp, Homo sapiens
ttgttgtataatttcgagat

SEQ ID NO: 4961842 - DNA, 22 bp, Homo sapiens
ttgtttatcagatacatcactg

SEQ ID NO: 4961843 - DNA, 18 bp, Homo sapiens
ttgtttcaagaacctgga

SEQ ID NO: 4961844 - DNA, 20 bp, Homo sapiens
ttgtttcaagaacctggaaa

SEQ ID NO: 4961845 - DNA, 15 bp, Homo sapiens
ttgtttgccatactt

SEQ ID NO: 4961846 - DNA, 14 bp, Homo sapiens
ttgtttgctgctat

SEQ ID NO: 4961847 - DNA, 19 bp, Homo sapiens
ttgtttgtctctccttttc

SEQ ID NO: 4961848 - DNA, 15 bp, Homo sapiens
ttgtttgtttttgct

SEQ ID NO: 4961849 - DNA, 17 bp, Homo sapiens
ttgttttctgactaatt

SEQ ID NO: 4961850 - DNA, 10 bp, Homo sapiens
ttgttttgtt

SEQ ID NO: 4961851 - DNA, 14 bp, Homo sapiens
ttgttttgttttaa

SEQ ID NO: 4961852 - DNA, 15 bp, Homo sapiens
ttgtttttctttcta

SEQ ID NO: 4961853 - DNA, 19 bp, Homo sapiens
ttgttttttttttccactt

SEQ ID NO: 4961854 - DNA, 13 bp, Homo sapiens
tttaaaaaaagaa

SEQ ID NO: 4961855 - DNA, 13 bp, Homo sapiens
tttcttgtttctc

SEQ ID NO: 4961856 - DNA, 15 bp, Homo sapiens
tttctttaaaaaaca

SEQ ID NO: 4961857 - DNA, 14 bp, Homo sapiens
tttctttaaagatg

SEQ ID NO: 4961858 - DNA, 18 bp, Homo sapiens
tttctttatatttatcca

SEQ ID NO: 4961859 - DNA, 20 bp, Homo sapiens
tttctttatatttatccact

SEQ ID NO: 4961860 - DNA, 13 bp, Homo sapiens
tttctttcaactt

SEQ ID NO: 4961861 - DNA, 12 bp, Homo sapiens
tttctttctagt

SEQ ID NO: 4961862 - DNA, 16 bp, Homo sapiens
tttctttgaatgcttt

SEQ ID NO: 4961863 - DNA, 13 bp, Homo sapiens
tttctttgtggct

SEQ ID NO: 4961864 - DNA, 15 bp, Homo sapiens
tttctttgtgtagct

SEQ ID NO: 4961865 - DNA, 16 bp, Homo sapiens
tttctttgttatcaaa

SEQ ID NO: 4961866 - DNA, 13 bp, Homo sapiens
tttgaaaagctat

SEQ ID NO: 4961867 - DNA, 14 bp, Homo sapiens
tttgaaaagctatt

SEQ ID NO: 4961868 - DNA, 17 bp, Homo sapiens
tttgaaaagcttcttaa

SEQ ID NO: 4961869 - DNA, 22 bp, Homo sapiens
tttgaaaagcttcttaattaat

SEQ ID NO: 4961870 - DNA, 13 bp, Homo sapiens
tttgaaatacctc

SEQ ID NO: 4961871 - DNA, 15 bp, Homo sapiens
tttgaaatacctcat

SEQ ID NO: 4961872 - DNA, 20 bp, Homo sapiens
tttgaaatacctcatgttta

SEQ ID NO: 4961873 - DNA, 21 bp, Homo sapiens
tttgaaatgaggtctgtttaa

SEQ ID NO: 4961874 - DNA, 17 bp, Homo sapiens
tttgaaattatgtgaca

SEQ ID NO: 4961875 - DNA, 19 bp, Homo sapiens
tttgaacacgaaagaaatg

SEQ ID NO: 4961876 - DNA, 14 bp, Homo sapiens
tttgaacactggct

SEQ ID NO: 4961877 - DNA, 17 bp, Homo sapiens
tttgaactaagaaactt

SEQ ID NO: 4961878 - DNA, 21 bp, Homo sapiens
tttgaactaagaaacttttgt

SEQ ID NO: 4961879 - DNA, 22 bp, Homo sapiens
tttgaactaagaaacttttgta

SEQ ID NO: 4961880 - DNA, 21 bp, Homo sapiens
tttgaactcagatctgtctga

SEQ ID NO: 4961881 - DNA, 17 bp, Homo sapiens
tttgaagaacatgtgag

SEQ ID NO: 4961882 - DNA, 13 bp, Homo sapiens
tttgaaggaaaca

SEQ ID NO: 4961883 - DNA, 20 bp, Homo sapiens
tttgaaggaaacagttaata

SEQ ID NO: 4961884 - DNA, 13 bp, Homo sapiens
tttgaagtcttgt

SEQ ID NO: 4961885 - DNA, 15 bp, Homo sapiens
tttgaagtcttgtat

SEQ ID NO: 4961886 - DNA, 16 bp, Homo sapiens
tttgaatattactcct

SEQ ID NO: 4961887 - DNA, 16 bp, Homo sapiens
tttgaattgttttctt

SEQ ID NO: 4961888 - DNA, 18 bp, Homo sapiens
tttgaattgttttcttta

SEQ ID NO: 4961889 - DNA, 19 bp, Homo sapiens
tttgaccttttatgtagta

SEQ ID NO: 4961890 - DNA, 15 bp, Homo sapiens
tttgagacagtttct

SEQ ID NO: 4961891 - DNA, 19 bp, Homo sapiens
tttgagaccagcctgggca

SEQ ID NO: 4961892 - DNA, 14 bp, Homo sapiens
tttgagagttctaa

SEQ ID NO: 4961893 - DNA, 15 bp, Homo sapiens
tttgagcagggctca

SEQ ID NO: 4961894 - DNA, 17 bp, Homo sapiens
tttgaggagcatgtttt

SEQ ID NO: 4961895 - DNA, 18 bp, Homo sapiens
tttgagggactgcctctg

SEQ ID NO: 4961896 - DNA, 19 bp, Homo sapiens
tttgagttgattgagaaga

SEQ ID NO: 4961897 - DNA, 20 bp, Homo sapiens
tttgataactgtttatatgt

SEQ ID NO: 4961898 - DNA, 15 bp, Homo sapiens
tttgataatgataaa

SEQ ID NO: 4961899 - DNA, 15 bp, Homo sapiens
tttgataatgttaaa

SEQ ID NO: 4961900 - DNA, 19 bp, Homo sapiens
tttgataatgttaaatttg

SEQ ID NO: 4961901 - DNA, 23 bp, Homo sapiens
tttgataatgttaaatttgtaag

SEQ ID NO: 4961902 - DNA, 13 bp, Homo sapiens
tttgatacataat

SEQ ID NO: 4961903 - DNA, 17 bp, Homo sapiens
tttgatacataataaaa

SEQ ID NO: 4961904 - DNA, 20 bp, Homo sapiens
tttgatgcagcatttgataa

SEQ ID NO: 4961905 - DNA, 21 bp, Homo sapiens
tttgatgcagcatttgataat

SEQ ID NO: 4961906 - DNA, 16 bp, Homo sapiens
tttgatgccaagaaag

SEQ ID NO: 4961907 - DNA, 16 bp, Homo sapiens
tttgatgtcatgtgtt

SEQ ID NO: 4961908 - DNA, 12 bp, Homo sapiens
tttgattctcct

SEQ ID NO: 4961909 - DNA, 15 bp, Homo sapiens
tttgattgatttgaa

SEQ ID NO: 4961910 - DNA, 12 bp, Homo sapiens
tttgatttatgc

SEQ ID NO: 4961911 - DNA, 13 bp, Homo sapiens
tttgatttctatt

SEQ ID NO: 4961912 - DNA, 13 bp, Homo sapiens
tttgcaacattta

SEQ ID NO: 4961913 - DNA, 12 bp, Homo sapiens
tttgcacagctc

SEQ ID NO: 4961914 - DNA, 14 bp, Homo sapiens
tttgcactaaatca

SEQ ID NO: 4961915 - DNA, 20 bp, Homo sapiens
tttgcactggagttctatgc

SEQ ID NO: 4961916 - DNA, 16 bp, Homo sapiens
tttgcagggcagcccc

SEQ ID NO: 4961917 - DNA, 14 bp, Homo sapiens
tttgcatctgaaat

SEQ ID NO: 4961918 - DNA, 18 bp, Homo sapiens
tttgcattaaattcacaa

SEQ ID NO: 4961919 - DNA, 20 bp, Homo sapiens
tttgccactaattttagtat

SEQ ID NO: 4961920 - DNA, 13 bp, Homo sapiens
tttgcctctgcct

SEQ ID NO: 4961921 - DNA, 13 bp, Homo sapiens
tttgctaattaaa

SEQ ID NO: 4961922 - DNA, 24 bp, Homo sapiens
tttgctactgtacataaacaatga

SEQ ID NO: 4961923 - DNA, 20 bp, Homo sapiens
tttgctagcagtaaaagatg

SEQ ID NO: 4961924 - DNA, 24 bp, Homo sapiens
tttgctagcagtaaaagatgaagt

SEQ ID NO: 4961925 - DNA, 14 bp, Homo sapiens
tttgctccgaagct

SEQ ID NO: 4961926 - DNA, 17 bp, Homo sapiens
tttgctcttgtcccacg

SEQ ID NO: 4961927 - DNA, 10 bp, Homo sapiens
tttgctgcca

SEQ ID NO: 4961928 - DNA, 16 bp, Homo sapiens
tttgcttagaaaagaa

SEQ ID NO: 4961929 - DNA, 15 bp, Homo sapiens
tttggaaaaatgttt

SEQ ID NO: 4961930 - DNA, 20 bp, Homo sapiens
tttggaagaaaaaaatcttc

SEQ ID NO: 4961931 - DNA, 22 bp, Homo sapiens
tttggaagaaaaaaatcttctc

SEQ ID NO: 4961932 - DNA, 13 bp, Homo sapiens
tttggaataaagt

SEQ ID NO: 4961933 - DNA, 13 bp, Homo sapiens
tttggaatacttt

SEQ ID NO: 4961934 - DNA, 17 bp, Homo sapiens
tttggaatactttttgt

SEQ ID NO: 4961935 - DNA, 21 bp, Homo sapiens
tttggactttgtatactttaa

SEQ ID NO: 4961936 - DNA, 13 bp, Homo sapiens
tttggatgtaatt

SEQ ID NO: 4961937 - DNA, 15 bp, Homo sapiens
tttggatgtaattta

SEQ ID NO: 4961938 - DNA, 18 bp, Homo sapiens
tttggattcttatgtagc

SEQ ID NO: 4961939 - DNA, 20 bp, Homo sapiens
tttggattcttatgtagcag

SEQ ID NO: 4961940 - DNA, 16 bp, Homo sapiens
tttggatttgacattg

SEQ ID NO: 4961941 - DNA, 17 bp, Homo sapiens
tttggcgctattacaaa

SEQ ID NO: 4961942 - DNA, 19 bp, Homo sapiens
tttggcgctattacaaata

SEQ ID NO: 4961943 - DNA, 22 bp, Homo sapiens
tttgggaagtgaagactggaag

SEQ ID NO: 4961944 - DNA, 23 bp, Homo sapiens
tttggggacagattcagtcttgc

SEQ ID NO: 4961945 - DNA, 15 bp, Homo sapiens
tttgggggtcaggca

SEQ ID NO: 4961946 - DNA, 21 bp, Homo sapiens
tttggggtacccactgctctg

SEQ ID NO: 4961947 - DNA, 14 bp, Homo sapiens
tttggtgattcaaa

SEQ ID NO: 4961948 - DNA, 18 bp, Homo sapiens
tttggtgcatagaactgg

SEQ ID NO: 4961949 - DNA, 22 bp, Homo sapiens
tttggtgcatagaactgggtaa

SEQ ID NO: 4961950 - DNA, 20 bp, Homo sapiens
tttggttcattaattctata

SEQ ID NO: 4961951 - DNA, 17 bp, Homo sapiens
tttggttcctctctggt

SEQ ID NO: 4961952 - DNA, 11 bp, Homo sapiens
tttggttctaa

SEQ ID NO: 4961953 - DNA, 12 bp, Homo sapiens
tttggtttacat

SEQ ID NO: 4961954 - DNA, 20 bp, Homo sapiens
tttggtttgctttggtttat

SEQ ID NO: 4961955 - DNA, 16 bp, Homo sapiens
tttgtaaactcaaaat

SEQ ID NO: 4961956 - DNA, 18 bp, Homo sapiens
tttgtaaagaaatttact

SEQ ID NO: 4961957 - DNA, 23 bp, Homo sapiens
tttgtaaagaaatttactatata

SEQ ID NO: 4961958 - DNA, 22 bp, Homo sapiens
tttgtaaattaaacataaaaca

SEQ ID NO: 4961959 - DNA, 12 bp, Homo sapiens
tttgtaagagtg

SEQ ID NO: 4961960 - DNA, 19 bp, Homo sapiens
tttgtaagagtgtagaagc

SEQ ID NO: 4961961 - DNA, 23 bp, Homo sapiens
tttgtaagagtgtagaagcattc

SEQ ID NO: 4961962 - DNA, 21 bp, Homo sapiens
tttgtaagtcagtgttgagat

SEQ ID NO: 4961963 - DNA, 22 bp, Homo sapiens
tttgtaattaaattatggtatt

SEQ ID NO: 4961964 - DNA, 13 bp, Homo sapiens
tttgtaattgctt

SEQ ID NO: 4961965 - DNA, 18 bp, Homo sapiens
tttttactgtgttttata

SEQ ID NO: 4961966 - DNA, 20 bp, Homo sapiens
tttttatacaaacctaccaa

SEQ ID NO: 4961967 - DNA, 14 bp, Homo sapiens
tttttattaattta

SEQ ID NO: 4961968 - DNA, 12 bp, Homo sapiens
tttttattgcta

SEQ ID NO: 4961969 - DNA, 18 bp, Homo sapiens
tttttattgctagtattt

SEQ ID NO: 4961970 - DNA, 12 bp, Homo sapiens
tttttatttctg

SEQ ID NO: 4961971 - DNA, 11 bp, Homo sapiens
tttttcaatgt

SEQ ID NO: 4961972 - DNA, 17 bp, Homo sapiens
tttttcattttccaata

SEQ ID NO: 4961973 - DNA, 14 bp, Homo sapiens
tttttccaactgtg

SEQ ID NO: 4961974 - DNA, 15 bp, Homo sapiens
tttttcctagcctgt

SEQ ID NO: 4961975 - DNA, 21 bp, Homo sapiens
tttttcctagcctgtttcttc

SEQ ID NO: 4961976 - DNA, 11 bp, Homo sapiens
tttttcctttt

SEQ ID NO: 4961977 - DNA, 15 bp, Homo sapiens
tttttctccagtgct

SEQ ID NO: 4961978 - DNA, 16 bp, Homo sapiens
tttttctgattagctt

SEQ ID NO: 4961979 - DNA, 17 bp, Homo sapiens
tttttctgttgtaactt

SEQ ID NO: 4961980 - DNA, 18 bp, Homo sapiens
tttttctgttgtaactta

SEQ ID NO: 4961981 - DNA, 13 bp, Homo sapiens
tttttcttttgta

SEQ ID NO: 4961982 - DNA, 16 bp, Homo sapiens
tttttgaaatgaaatt

SEQ ID NO: 4961983 - DNA, 23 bp, Homo sapiens
tttttgaactaagaaacttttgt

SEQ ID NO: 4961984 - DNA, 22 bp, Homo sapiens
tttttggtgtatagaagtttgt

SEQ ID NO: 4961985 - DNA, 23 bp, Homo sapiens
tttttgtaaactggaattaaaag

SEQ ID NO: 4961986 - DNA, 20 bp, Homo sapiens
tttttgtagagccagggtct

SEQ ID NO: 4961987 - DNA, 11 bp, Homo sapiens
tttttgtagta

SEQ ID NO: 4961988 - DNA, 13 bp, Homo sapiens
tttttgtctcaat

SEQ ID NO: 4961989 - DNA, 16 bp, Homo sapiens
ttttttaaacaaacat

SEQ ID NO: 4961990 - DNA, 15 bp, Homo sapiens
ttttttaaataaact

SEQ ID NO: 4961991 - DNA, 16 bp, Homo sapiens
ttttttaaataaactt

SEQ ID NO: 4961992 - DNA, 11 bp, Homo sapiens
ttttttacatt

SEQ ID NO: 4961993 - DNA, 12 bp, Homo sapiens
ttttttacattt

SEQ ID NO: 4961994 - DNA, 21 bp, Homo sapiens
ttttttagtatttatttatgt

SEQ ID NO: 4961995 - DNA, 13 bp, Homo sapiens
ttttttccactta

SEQ ID NO: 4961996 - DNA, 12 bp, Homo sapiens
ttttttcttcta

SEQ ID NO: 4961997 - DNA, 16 bp, Homo sapiens
ttttttgggcagcaat

SEQ ID NO: 4961998 - DNA, 12 bp, Homo sapiens
ttttttgtagtt

SEQ ID NO: 4961999 - DNA, 18 bp, Homo sapiens
ttttttgttttacaatgt

SEQ ID NO: 4962000 - DNA, 13 bp, Homo sapiens
tttttttccagca

SEQ ID NO: 4962001 - DNA, 10 bp, Homo sapiens
tttttttggc

SEQ ID NO: 4962002 - DNA, 13 bp, Homo sapiens
ttttttttgaaaa

SEQ ID NO: 4962003 - DNA, 16 bp, Homo sapiens
cagcatgtgccctcct

SEQ ID NO: 4962004 - DNA, 13 bp, Homo sapiens
cagcatgtgcctt

SEQ ID NO: 4962005 - DNA, 14 bp, Homo sapiens
cagcattctcactc

SEQ ID NO: 4962006 - DNA, 11 bp, Homo sapiens
cagcatttgat

SEQ ID NO: 4962007 - DNA, 14 bp, Homo sapiens
cagcatttgataat

SEQ ID NO: 4962008 - DNA, 17 bp, Homo sapiens
cagccaaaccctgtctg

SEQ ID NO: 4962009 - DNA, 13 bp, Homo sapiens
cagccaactcatt

SEQ ID NO: 4962010 - DNA, 13 bp, Homo sapiens
cagccaagcttgt

SEQ ID NO: 4962011 - DNA, 14 bp, Homo sapiens
cagccacacttgaa

SEQ ID NO: 4962012 - DNA, 20 bp, Homo sapiens
cagccaccccgggctctctg

SEQ ID NO: 4962013 - DNA, 22 bp, Homo sapiens
cagccaccccgggctctctgct

SEQ ID NO: 4962014 - DNA, 21 bp, Homo sapiens
cagccacttcggccaggtcac

SEQ ID NO: 4962015 - DNA, 12 bp, Homo sapiens
cagccaggctgc

SEQ ID NO: 4962016 - DNA, 20 bp, Homo sapiens
cagccagggaggacaagcag

SEQ ID NO: 4962017 - DNA, 23 bp, Homo sapiens
cagcccaaaggggacaggcctca

SEQ ID NO: 4962018 - DNA, 18 bp, Homo sapiens
cagcccacttctgccata

SEQ ID NO: 4962019 - DNA, 15 bp, Homo sapiens
cagcccatgcccacc

SEQ ID NO: 4962020 - DNA, 24 bp, Homo sapiens
cagcccatgcccacctgcccatca

SEQ ID NO: 4962021 - DNA, 14 bp, Homo sapiens
cagccccacacagc

SEQ ID NO: 4962022 - DNA, 21 bp, Homo sapiens
cagccccacccaggagggagg

SEQ ID NO: 4962023 - DNA, 14 bp, Homo sapiens
cagccccactgcca

SEQ ID NO: 4962024 - DNA, 20 bp, Homo sapiens
cagccccactgccagcagca

SEQ ID NO: 4962025 - DNA, 21 bp, Homo sapiens
cagccccactgccagcagcag

SEQ ID NO: 4962026 - DNA, 22 bp, Homo sapiens
cagccccactgccagcagcagc

SEQ ID NO: 4962027 - DNA, 17 bp, Homo sapiens
cagccccagtgcccaca

SEQ ID NO: 4962028 - DNA, 14 bp, Homo sapiens
cagccccattctgc

SEQ ID NO: 4962029 - DNA, 20 bp, Homo sapiens
cagccccattctgcctgccc

SEQ ID NO: 4962030 - DNA, 14 bp, Homo sapiens
cagcccccagcccc

SEQ ID NO: 4962031 - DNA, 16 bp, Homo sapiens
cagccccgagctgtcc

SEQ ID NO: 4962032 - DNA, 15 bp, Homo sapiens
cagccccggccctgg

SEQ ID NO: 4962033 - DNA, 16 bp, Homo sapiens
cagccccggccctggg

SEQ ID NO: 4962034 - DNA, 19 bp, Homo sapiens
cagccccggccctgggctc

SEQ ID NO: 4962035 - DNA, 24 bp, Homo sapiens
cagcccctagaaacccaagctcct

SEQ ID NO: 4962036 - DNA, 12 bp, Homo sapiens
cagcccctagcc

SEQ ID NO: 4962037 - DNA, 15 bp, Homo sapiens
cagcccctagcccag

SEQ ID NO: 4962038 - DNA, 24 bp, Homo sapiens
cagcccctagcccaggagagagaa

SEQ ID NO: 4962039 - DNA, 12 bp, Homo sapiens
cagcccctagga

SEQ ID NO: 4962040 - DNA, 18 bp, Homo sapiens
cagcccggaccttggcag

SEQ ID NO: 4962041 - DNA, 20 bp, Homo sapiens
cagcccgggagcctaggacc

SEQ ID NO: 4962042 - DNA, 12 bp, Homo sapiens
cagccctagagc

SEQ ID NO: 4962043 - DNA, 22 bp, Homo sapiens
cagccctagagcctgcctggag

SEQ ID NO: 4962044 - DNA, 12 bp, Homo sapiens
cagccctgaggt

SEQ ID NO: 4962045 - DNA, 14 bp, Homo sapiens
cagccctggggctg

SEQ ID NO: 4962046 - DNA, 18 bp, Homo sapiens
cagccctggggctgggcc

SEQ ID NO: 4962047 - DNA, 19 bp, Homo sapiens
cagccctggggctgggccc

SEQ ID NO: 4962048 - DNA, 15 bp, Homo sapiens
cagcccttagcaggg

SEQ ID NO: 4962049 - DNA, 16 bp, Homo sapiens
cagcccttagcaggga

SEQ ID NO: 4962050 - DNA, 18 bp, Homo sapiens
cagccgccattgccacca

SEQ ID NO: 4962051 - DNA, 23 bp, Homo sapiens
cagccgccattgccaccaggaga

SEQ ID NO: 4962052 - DNA, 14 bp, Homo sapiens
cagccgccttcctt

SEQ ID NO: 4962053 - DNA, 14 bp, Homo sapiens
cagccgcttctgac

SEQ ID NO: 4962054 - DNA, 16 bp, Homo sapiens
cagccggccaatggaa

SEQ ID NO: 4962055 - DNA, 20 bp, Homo sapiens
cagccggccaatggaaacct

SEQ ID NO: 4962056 - DNA, 21 bp, Homo sapiens
cagccggcgtggcaaatataa

SEQ ID NO: 4962057 - DNA, 18 bp, Homo sapiens
cagccgtgccttcagctc

SEQ ID NO: 4962058 - DNA, 21 bp, Homo sapiens
cagcctagggctgagctgggg

SEQ ID NO: 4962059 - DNA, 19 bp, Homo sapiens
cagcctatgagcatcctga

SEQ ID NO: 4962060 - DNA, 22 bp, Homo sapiens
cagcctatgagcatcctgagcc

SEQ ID NO: 4962061 - DNA, 19 bp, Homo sapiens
cagcctcaacctcctgggc

SEQ ID NO: 4962062 - DNA, 20 bp, Homo sapiens
cagcctcaacctcctgggct

SEQ ID NO: 4962063 - DNA, 16 bp, Homo sapiens
cagcctcagtcctccc

SEQ ID NO: 4962064 - DNA, 19 bp, Homo sapiens
cagcctcagtcctcccctc

SEQ ID NO: 4962065 - DNA, 21 bp, Homo sapiens
cagcctcagtcctcccctcac

SEQ ID NO: 4962066 - DNA, 22 bp, Homo sapiens
cagcctcagtcctcccctcaca

SEQ ID NO: 4962067 - DNA, 23 bp, Homo sapiens
cagcctcagtcctcccctcacag

SEQ ID NO: 4962068 - DNA, 20 bp, Homo sapiens
cagcctccaacacaaggctc

SEQ ID NO: 4962069 - DNA, 15 bp, Homo sapiens
cagcctccagcctgc

SEQ ID NO: 4962070 - DNA, 15 bp, Homo sapiens
cagcctccatgctgc

SEQ ID NO: 4962071 - DNA, 17 bp, Homo sapiens
cagcctccatgctgcct

SEQ ID NO: 4962072 - DNA, 14 bp, Homo sapiens
cagcctcccaaagt

SEQ ID NO: 4962073 - DNA, 18 bp, Homo sapiens
cagcctcgttggaagagg

SEQ ID NO: 4962074 - DNA, 22 bp, Homo sapiens
cagcctcgttggaagaggaaca

SEQ ID NO: 4962075 - DNA, 13 bp, Homo sapiens
cagcctctgaccc

SEQ ID NO: 4962076 - DNA, 15 bp, Homo sapiens
cagcctctgacccct

SEQ ID NO: 4962077 - DNA, 18 bp, Homo sapiens
cagcctctgacccctcct

SEQ ID NO: 4962078 - DNA, 21 bp, Homo sapiens
cagcctctgacccctcctcac

SEQ ID NO: 4962079 - DNA, 15 bp, Homo sapiens
cagcctgaccttcct

SEQ ID NO: 4962080 - DNA, 23 bp, Homo sapiens
cagcctgaggcagccacttcggc

SEQ ID NO: 4962081 - DNA, 21 bp, Homo sapiens
cagcctgcccaagcccaggcc

SEQ ID NO: 4962082 - DNA, 14 bp, Homo sapiens
cagcctgctgccca

SEQ ID NO: 4962083 - DNA, 17 bp, Homo sapiens
cagcctggagacccacc

SEQ ID NO: 4962084 - DNA, 21 bp, Homo sapiens
cagcctggcacagggcagtgg

SEQ ID NO: 4962085 - DNA, 23 bp, Homo sapiens
cagcctgggacagtttatcatga

SEQ ID NO: 4962086 - DNA, 20 bp, Homo sapiens
cagcctgggcaacagagcaa

SEQ ID NO: 4962087 - DNA, 17 bp, Homo sapiens
caggaaggagagcctgc

SEQ ID NO: 4962088 - DNA, 21 bp, Homo sapiens
caggaagggcaggaaggagag

SEQ ID NO: 4962089 - DNA, 18 bp, Homo sapiens
caggaatcaaaaattgaa

SEQ ID NO: 4962090 - DNA, 16 bp, Homo sapiens
caggaatcaagagctg

SEQ ID NO: 4962091 - DNA, 21 bp, Homo sapiens
caggaatgtgtggcctgcaca

SEQ ID NO: 4962092 - DNA, 21 bp, Homo sapiens
caggacaccacacccagcctc

SEQ ID NO: 4962093 - DNA, 23 bp, Homo sapiens
caggacaccacacccagcctcag

SEQ ID NO: 4962094 - DNA, 15 bp, Homo sapiens
caggacacggggcag

SEQ ID NO: 4962095 - DNA, 16 bp, Homo sapiens
caggaccatcttcccg

SEQ ID NO: 4962096 - DNA, 13 bp, Homo sapiens
caggacccctggg

SEQ ID NO: 4962097 - DNA, 13 bp, Homo sapiens
caggactcacagg

SEQ ID NO: 4962098 - DNA, 19 bp, Homo sapiens
caggactccctcctcacct

SEQ ID NO: 4962099 - DNA, 16 bp, Homo sapiens
caggactctgcctcct

SEQ ID NO: 4962100 - DNA, 14 bp, Homo sapiens
caggactgtgactc

SEQ ID NO: 4962101 - DNA, 17 bp, Homo sapiens
caggagaaccactacat

SEQ ID NO: 4962102 - DNA, 12 bp, Homo sapiens
caggagagagaa

SEQ ID NO: 4962103 - DNA, 13 bp, Homo sapiens
caggagagagaaa

SEQ ID NO: 4962104 - DNA, 19 bp, Homo sapiens
caggagagagaaagccagg

SEQ ID NO: 4962105 - DNA, 12 bp, Homo sapiens
caggagagtaga

SEQ ID NO: 4962106 - DNA, 16 bp, Homo sapiens
caggagattgagaagg

SEQ ID NO: 4962107 - DNA, 20 bp, Homo sapiens
caggagattgagaaggagag

SEQ ID NO: 4962108 - DNA, 23 bp, Homo sapiens
caggagattgagaaggagagaaa

SEQ ID NO: 4962109 - DNA, 16 bp, Homo sapiens
caggagccccgaggcc

SEQ ID NO: 4962110 - DNA, 20 bp, Homo sapiens
caggagccccgaggccttct

SEQ ID NO: 4962111 - DNA, 15 bp, Homo sapiens
caggagctcttcagg

SEQ ID NO: 4962112 - DNA, 20 bp, Homo sapiens
caggagctcttcaggcctcc

SEQ ID NO: 4962113 - DNA, 23 bp, Homo sapiens
caggaggaatcatgtcaggcctg

SEQ ID NO: 4962114 - DNA, 15 bp, Homo sapiens
caggaggctgaggca

SEQ ID NO: 4962115 - DNA, 16 bp, Homo sapiens
caggagggcatccata

SEQ ID NO: 4962116 - DNA, 24 bp, Homo sapiens
caggagtcccaaggaaagccccag

SEQ ID NO: 4962117 - DNA, 17 bp, Homo sapiens
caggagtggtgcagaca

SEQ ID NO: 4962118 - DNA, 20 bp, Homo sapiens
caggagtggtgcagacagaa

SEQ ID NO: 4962119 - DNA, 24 bp, Homo sapiens
caggagtggtgcagacagaagtct

SEQ ID NO: 4962120 - DNA, 22 bp, Homo sapiens
caggatatccttatcagagcta

SEQ ID NO: 4962121 - DNA, 17 bp, Homo sapiens
caggatcagttaactat

SEQ ID NO: 4962122 - DNA, 15 bp, Homo sapiens
caggatcatggtgta

SEQ ID NO: 4962123 - DNA, 19 bp, Homo sapiens
caggatcatggtgtaataa

SEQ ID NO: 4962124 - DNA, 22 bp, Homo sapiens
caggatcatggtgtaataagac

SEQ ID NO: 4962125 - DNA, 22 bp, Homo sapiens
caggatcccaggggcccaaggc

SEQ ID NO: 4962126 - DNA, 20 bp, Homo sapiens
caggatcctctcctttgaaa

SEQ ID NO: 4962127 - DNA, 21 bp, Homo sapiens
caggatgggggctggcctctg

SEQ ID NO: 4962128 - DNA, 17 bp, Homo sapiens
caggattcagccggagg

SEQ ID NO: 4962129 - DNA, 12 bp, Homo sapiens
caggatttctaa

SEQ ID NO: 4962130 - DNA, 14 bp, Homo sapiens
caggcaaaatcctt

SEQ ID NO: 4962131 - DNA, 15 bp, Homo sapiens
caggcaagcacctcc

SEQ ID NO: 4962132 - DNA, 15 bp, Homo sapiens
caggcaatgctggct

SEQ ID NO: 4962133 - DNA, 16 bp, Homo sapiens
caggcaatgctggctg

SEQ ID NO: 4962134 - DNA, 20 bp, Homo sapiens
caggcaatgctggctgttgg

SEQ ID NO: 4962135 - DNA, 16 bp, Homo sapiens
caggcactgctgccca

SEQ ID NO: 4962136 - DNA, 17 bp, Homo sapiens
caggcactgctgcccag

SEQ ID NO: 4962137 - DNA, 19 bp, Homo sapiens
caggcagatctgtgcccca

SEQ ID NO: 4962138 - DNA, 12 bp, Homo sapiens
caggcagcgatg

SEQ ID NO: 4962139 - DNA, 18 bp, Homo sapiens
caggcagctttctagaag

SEQ ID NO: 4962140 - DNA, 18 bp, Homo sapiens
caggcaggaagggcagga

SEQ ID NO: 4962141 - DNA, 21 bp, Homo sapiens
caggcaggccaaggccttctc

SEQ ID NO: 4962142 - DNA, 13 bp, Homo sapiens
caggcaggtccag

SEQ ID NO: 4962143 - DNA, 12 bp, Homo sapiens
caggcaggtctt

SEQ ID NO: 4962144 - DNA, 22 bp, Homo sapiens
caggcaggtcttgaactcctgg

SEQ ID NO: 4962145 - DNA, 14 bp, Homo sapiens
caggcaggtgcctg

SEQ ID NO: 4962146 - DNA, 16 bp, Homo sapiens
caggcaggtgcctgga

SEQ ID NO: 4962147 - DNA, 20 bp, Homo sapiens
caggcataaaatagagtaaa

SEQ ID NO: 4962148 - DNA, 14 bp, Homo sapiens
caggcatggggggt

SEQ ID NO: 4962149 - DNA, 19 bp, Homo sapiens
caggcatgttctctgagga

SEQ ID NO: 4962150 - DNA, 14 bp, Homo sapiens
caggcattgaggaa

SEQ ID NO: 4962151 - DNA, 15 bp, Homo sapiens
caggcattgaggaag

SEQ ID NO: 4962152 - DNA, 15 bp, Homo sapiens
caggccacttgatga

SEQ ID NO: 4962153 - DNA, 23 bp, Homo sapiens
caggccagagggagtgacagagg

SEQ ID NO: 4962154 - DNA, 16 bp, Homo sapiens
caggccattctgccgc

SEQ ID NO: 4962155 - DNA, 22 bp, Homo sapiens
caggcccaactgtgagcaagga

SEQ ID NO: 4962156 - DNA, 14 bp, Homo sapiens
caggcccggctcca

SEQ ID NO: 4962157 - DNA, 15 bp, Homo sapiens
caggcccggctccag

SEQ ID NO: 4962158 - DNA, 19 bp, Homo sapiens
caggcccggctccaggctc

SEQ ID NO: 4962159 - DNA, 13 bp, Homo sapiens
caggccctgcagt

SEQ ID NO: 4962160 - DNA, 15 bp, Homo sapiens
caggccctgctcctg

SEQ ID NO: 4962161 - DNA, 17 bp, Homo sapiens
caggccctgctcctgca

SEQ ID NO: 4962162 - DNA, 22 bp, Homo sapiens
caggccctgctcctgcagcatg

SEQ ID NO: 4962163 - DNA, 15 bp, Homo sapiens
caggcccttcctctc

SEQ ID NO: 4962164 - DNA, 21 bp, Homo sapiens
caggccctttgaagcctcagc

SEQ ID NO: 4962165 - DNA, 19 bp, Homo sapiens
caggcctaatctcatacct

SEQ ID NO: 4962166 - DNA, 19 bp, Homo sapiens
caggcctcacctctaccca

SEQ ID NO: 4962167 - DNA, 21 bp, Homo sapiens
caggcctcacctctacccaaa

SEQ ID NO: 4962168 - DNA, 12 bp, Homo sapiens
caggcctccctc

SEQ ID NO: 4962169 - DNA, 13 bp, Homo sapiens
caggcctccctct

SEQ ID NO: 4962170 - DNA, 15 bp, Homo sapiens
caggcctccctctct

SEQ ID NO: 4962171 - DNA, 17 bp, Homo sapiens
caggcctccctctctct

SEQ ID NO: 4962172 - DNA, 18 bp, Homo sapiens
caggcctccctctctctt

SEQ ID NO: 4962173 - DNA, 22 bp, Homo sapiens
caggcctccctctctcttctgc

SEQ ID NO: 4962174 - DNA, 12 bp, Homo sapiens
caggcctgcagc

SEQ ID NO: 4962175 - DNA, 20 bp, Homo sapiens
caggcctgcctgttcccatt

SEQ ID NO: 4962176 - DNA, 15 bp, Homo sapiens
caggcgccccttccc

SEQ ID NO: 4962177 - DNA, 17 bp, Homo sapiens
caggcgctgagtatgga

SEQ ID NO: 4962178 - DNA, 21 bp, Homo sapiens
caggcgggagcggtggccctg

SEQ ID NO: 4962179 - DNA, 23 bp, Homo sapiens
caggcgggagcggtggccctgtc

SEQ ID NO: 4962180 - DNA, 14 bp, Homo sapiens
caggctcctttagc

SEQ ID NO: 4962181 - DNA, 21 bp, Homo sapiens
caggctcctttagcgcccagt

SEQ ID NO: 4962182 - DNA, 12 bp, Homo sapiens
caggctcttctc

SEQ ID NO: 4962183 - DNA, 18 bp, Homo sapiens
caggctcttctcctttca

SEQ ID NO: 4962184 - DNA, 22 bp, Homo sapiens
caggctcttctcctttcacaac

SEQ ID NO: 4962185 - DNA, 15 bp, Homo sapiens
caggctggcgtgcag

SEQ ID NO: 4962186 - DNA, 11 bp, Homo sapiens
caggctgggcc

SEQ ID NO: 4962187 - DNA, 12 bp, Homo sapiens
caggctgggcca

SEQ ID NO: 4962188 - DNA, 13 bp, Homo sapiens
caggctgggccat

SEQ ID NO: 4962189 - DNA, 23 bp, Homo sapiens
caggctgggccatgtccaaagag

SEQ ID NO: 4962190 - DNA, 14 bp, Homo sapiens
caggctgggcttca

SEQ ID NO: 4962191 - DNA, 17 bp, Homo sapiens
caggctgggcttcagtg

SEQ ID NO: 4962192 - DNA, 13 bp, Homo sapiens
caggctggtctca

SEQ ID NO: 4962193 - DNA, 18 bp, Homo sapiens
caggctggtgggaggggc

SEQ ID NO: 4962194 - DNA, 14 bp, Homo sapiens
caggctgtatccca

SEQ ID NO: 4962195 - DNA, 23 bp, Homo sapiens
caggctgtatcccatgagcctca

SEQ ID NO: 4962196 - DNA, 21 bp, Homo sapiens
caggcttcctgcaattttcta

SEQ ID NO: 4962197 - DNA, 17 bp, Homo sapiens
cagggctgccctgagaa

SEQ ID NO: 4962198 - DNA, 18 bp, Homo sapiens
cagggcttacctgtacac

SEQ ID NO: 4962199 - DNA, 23 bp, Homo sapiens
cagggcttacctgtacactgact

SEQ ID NO: 4962200 - DNA, 15 bp, Homo sapiens
caggggactcagccc

SEQ ID NO: 4962201 - DNA, 12 bp, Homo sapiens
caggggcagctc

SEQ ID NO: 4962202 - DNA, 15 bp, Homo sapiens
caggggccagaggaa

SEQ ID NO: 4962203 - DNA, 21 bp, Homo sapiens
caggggcccaaggcggcccct

SEQ ID NO: 4962204 - DNA, 14 bp, Homo sapiens
caggggctctggag

SEQ ID NO: 4962205 - DNA, 16 bp, Homo sapiens
caggggctctggagag

SEQ ID NO: 4962206 - DNA, 17 bp, Homo sapiens
caggggctctggagaga

SEQ ID NO: 4962207 - DNA, 19 bp, Homo sapiens
caggggctctggagagaaa

SEQ ID NO: 4962208 - DNA, 20 bp, Homo sapiens
cagggggaagaagcagagag

SEQ ID NO: 4962209 - DNA, 19 bp, Homo sapiens
cagggggaaggtggggtcc

SEQ ID NO: 4962210 - DNA, 21 bp, Homo sapiens
cagggggtggacaaactggag

SEQ ID NO: 4962211 - DNA, 16 bp, Homo sapiens
cagggggtgtgtctgc

SEQ ID NO: 4962212 - DNA, 21 bp, Homo sapiens
cagggtctcactatgttgccc

SEQ ID NO: 4962213 - DNA, 16 bp, Homo sapiens
cagggtctcactctgt

SEQ ID NO: 4962214 - DNA, 15 bp, Homo sapiens
cagggtctctccctc

SEQ ID NO: 4962215 - DNA, 21 bp, Homo sapiens
cagggtctctccctcaggtgt

SEQ ID NO: 4962216 - DNA, 13 bp, Homo sapiens
cagggtcttccct

SEQ ID NO: 4962217 - DNA, 21 bp, Homo sapiens
cagggtcttccctacctcagg

SEQ ID NO: 4962218 - DNA, 13 bp, Homo sapiens
cagggtgcagagg

SEQ ID NO: 4962219 - DNA, 14 bp, Homo sapiens
cagggttggcccct

SEQ ID NO: 4962220 - DNA, 14 bp, Homo sapiens
cagggttgggccca

SEQ ID NO: 4962221 - DNA, 21 bp, Homo sapiens
cagggttgggcccagatctgg

SEQ ID NO: 4962222 - DNA, 20 bp, Homo sapiens
caggtaacaggcagatacag

SEQ ID NO: 4962223 - DNA, 14 bp, Homo sapiens
caggtatgttgcct

SEQ ID NO: 4962224 - DNA, 15 bp, Homo sapiens
caggtatgttgcctt

SEQ ID NO: 4962225 - DNA, 16 bp, Homo sapiens
caggtatgttgccttt

SEQ ID NO: 4962226 - DNA, 17 bp, Homo sapiens
caggtattaatcttgga

SEQ ID NO: 4962227 - DNA, 15 bp, Homo sapiens
caggtcctcagagaa

SEQ ID NO: 4962228 - DNA, 12 bp, Homo sapiens
caggtctcccac

SEQ ID NO: 4962229 - DNA, 22 bp, Homo sapiens
caggtctcccacgtgggagaca

SEQ ID NO: 4962230 - DNA, 18 bp, Homo sapiens
caggtcttgaactcctgg

SEQ ID NO: 4962231 - DNA, 23 bp, Homo sapiens
caggtcttgaactcctggcctca

SEQ ID NO: 4962232 - DNA, 12 bp, Homo sapiens
caggtgacatgt

SEQ ID NO: 4962233 - DNA, 16 bp, Homo sapiens
caggtgatccacccac

SEQ ID NO: 4962234 - DNA, 20 bp, Homo sapiens
caggtgatgttagtgtttta

SEQ ID NO: 4962235 - DNA, 16 bp, Homo sapiens
caggtgccagcctgag

SEQ ID NO: 4962236 - DNA, 15 bp, Homo sapiens
caggtgcctggacat

SEQ ID NO: 4962237 - DNA, 20 bp, Homo sapiens
caggtgctattgttactctt

SEQ ID NO: 4962238 - DNA, 19 bp, Homo sapiens
caggtgctcaataaatgat

SEQ ID NO: 4962239 - DNA, 14 bp, Homo sapiens
caggtgctcccctg

SEQ ID NO: 4962240 - DNA, 19 bp, Homo sapiens
caggtggccactccagacc

SEQ ID NO: 4962241 - DNA, 15 bp, Homo sapiens
caggtggggcagctt

SEQ ID NO: 4962242 - DNA, 23 bp, Homo sapiens
caggtgtgaaccaccacacccag

SEQ ID NO: 4962243 - DNA, 20 bp, Homo sapiens
caggtgtgtccacctgggca

SEQ ID NO: 4962244 - DNA, 19 bp, Homo sapiens
caggtgttaacattccaag

SEQ ID NO: 4962245 - DNA, 16 bp, Homo sapiens
caggttcaacccacag

SEQ ID NO: 4962246 - DNA, 17 bp, Homo sapiens
caggttcaacccacagc

SEQ ID NO: 4962247 - DNA, 12 bp, Homo sapiens
caggttcagctt

SEQ ID NO: 4962248 - DNA, 13 bp, Homo sapiens
caggttcagcttg

SEQ ID NO: 4962249 - DNA, 15 bp, Homo sapiens
caggttctgcctgct

SEQ ID NO: 4962250 - DNA, 15 bp, Homo sapiens
caggtttaacatttg

SEQ ID NO: 4962251 - DNA, 23 bp, Homo sapiens
caggtttttggtctgacccactg

SEQ ID NO: 4962252 - DNA, 14 bp, Homo sapiens
cagtaaatttgcta

SEQ ID NO: 4962253 - DNA, 15 bp, Homo sapiens
cagtaaatttgctag

SEQ ID NO: 4962254 - DNA, 19 bp, Homo sapiens
cagtaactttatgtgtaaa

SEQ ID NO: 4962255 - DNA, 20 bp, Homo sapiens
cagtaactttatgtgtaaat

SEQ ID NO: 4962256 - DNA, 13 bp, Homo sapiens
cagtaatgttatt

SEQ ID NO: 4962257 - DNA, 19 bp, Homo sapiens
cagtaccctctcagctcca

SEQ ID NO: 4962258 - DNA, 21 bp, Homo sapiens
cagtacttgtgaaacacagct

SEQ ID NO: 4962259 - DNA, 13 bp, Homo sapiens
cagtagagccagc

SEQ ID NO: 4962260 - DNA, 16 bp, Homo sapiens
cagtatatttaaactc

SEQ ID NO: 4962261 - DNA, 19 bp, Homo sapiens
cagtatctatatatgtgta

SEQ ID NO: 4962262 - DNA, 22 bp, Homo sapiens
cagtatctatatatgtgtatgt

SEQ ID NO: 4962263 - DNA, 23 bp, Homo sapiens
cagtatctatatatgtgtatgta

SEQ ID NO: 4962264 - DNA, 18 bp, Homo sapiens
cagtatctttgcactcca

SEQ ID NO: 4962265 - DNA, 21 bp, Homo sapiens
cagtatggtctaacactggca

SEQ ID NO: 4962266 - DNA, 22 bp, Homo sapiens
cagtattaatactaaaatatgt

SEQ ID NO: 4962267 - DNA, 19 bp, Homo sapiens
cagtattcttgtcaaaaaa

SEQ ID NO: 4962268 - DNA, 18 bp, Homo sapiens
cagtatttattttgtaat

SEQ ID NO: 4962269 - DNA, 19 bp, Homo sapiens
cagtatttattttgtaatt

SEQ ID NO: 4962270 - DNA, 13 bp, Homo sapiens
ccctacagcattg

SEQ ID NO: 4962271 - DNA, 21 bp, Homo sapiens
ccctaccgagtctcttctcca

SEQ ID NO: 4962272 - DNA, 14 bp, Homo sapiens
ccctacctgtgcct

SEQ ID NO: 4962273 - DNA, 18 bp, Homo sapiens
ccctactccctgcagatg

SEQ ID NO: 4962274 - DNA, 18 bp, Homo sapiens
ccctacttcttttgctct

SEQ ID NO: 4962275 - DNA, 17 bp, Homo sapiens
ccctagaaacccaagct

SEQ ID NO: 4962276 - DNA, 15 bp, Homo sapiens
ccctagagcctgcct

SEQ ID NO: 4962277 - DNA, 20 bp, Homo sapiens
ccctagagcctgcctggagc

SEQ ID NO: 4962278 - DNA, 18 bp, Homo sapiens
ccctagatagtttattat

SEQ ID NO: 4962279 - DNA, 20 bp, Homo sapiens
ccctagcggcagaaaggaaa

SEQ ID NO: 4962280 - DNA, 20 bp, Homo sapiens
ccctaggagtatatttccgc

SEQ ID NO: 4962281 - DNA, 23 bp, Homo sapiens
ccctaggttccctgttcttcctc

SEQ ID NO: 4962282 - DNA, 19 bp, Homo sapiens
ccctagttctacctcaggc

SEQ ID NO: 4962283 - DNA, 15 bp, Homo sapiens
ccctatctcctgaca

SEQ ID NO: 4962284 - DNA, 16 bp, Homo sapiens
ccctatctcctgacag

SEQ ID NO: 4962285 - DNA, 17 bp, Homo sapiens
ccctatctcctgacaga

SEQ ID NO: 4962286 - DNA, 20 bp, Homo sapiens
ccctatctcctgacagaagg

SEQ ID NO: 4962287 - DNA, 22 bp, Homo sapiens
ccctatctcctgacagaaggtg

SEQ ID NO: 4962288 - DNA, 17 bp, Homo sapiens
ccctcacagcctctgac

SEQ ID NO: 4962289 - DNA, 13 bp, Homo sapiens
ccctcacattcct

SEQ ID NO: 4962290 - DNA, 14 bp, Homo sapiens
ccctcacctcctct

SEQ ID NO: 4962291 - DNA, 16 bp, Homo sapiens
ccctcactctgccagg

SEQ ID NO: 4962292 - DNA, 16 bp, Homo sapiens
ccctcactctggcctc

SEQ ID NO: 4962293 - DNA, 19 bp, Homo sapiens
ccctcagccacacccaggc

SEQ ID NO: 4962294 - DNA, 15 bp, Homo sapiens
ccctcaggggaaaac

SEQ ID NO: 4962295 - DNA, 17 bp, Homo sapiens
ccctcatctatgaggaa

SEQ ID NO: 4962296 - DNA, 21 bp, Homo sapiens
ccctcatcttgaagggcccag

SEQ ID NO: 4962297 - DNA, 16 bp, Homo sapiens
ccctcatggcccctct

SEQ ID NO: 4962298 - DNA, 17 bp, Homo sapiens
ccctcatggcccctctg

SEQ ID NO: 4962299 - DNA, 17 bp, Homo sapiens
ccctccatgtgggctag

SEQ ID NO: 4962300 - DNA, 15 bp, Homo sapiens
ccctcccacctctgt

SEQ ID NO: 4962301 - DNA, 21 bp, Homo sapiens
ccctcccccgccactcctgaa

SEQ ID NO: 4962302 - DNA, 13 bp, Homo sapiens
ccctcccccttgt

SEQ ID NO: 4962303 - DNA, 13 bp, Homo sapiens
ccctcccctgccc

SEQ ID NO: 4962304 - DNA, 16 bp, Homo sapiens
ccctcccctgctgcag

SEQ ID NO: 4962305 - DNA, 13 bp, Homo sapiens
ccctccctggagt

SEQ ID NO: 4962306 - DNA, 16 bp, Homo sapiens
ccctcctcacctctgg

SEQ ID NO: 4962307 - DNA, 23 bp, Homo sapiens
ccctcctcacctctggactggct

SEQ ID NO: 4962308 - DNA, 14 bp, Homo sapiens
ccctcctcactggc

SEQ ID NO: 4962309 - DNA, 22 bp, Homo sapiens
ccctcctgaaccgcacagctca

SEQ ID NO: 4962310 - DNA, 19 bp, Homo sapiens
ccctcctgtgctgggggaa

SEQ ID NO: 4962311 - DNA, 15 bp, Homo sapiens
ccctcgaagcgcgcc

SEQ ID NO: 4962312 - DNA, 16 bp, Homo sapiens
ccctcgatatttttaa

SEQ ID NO: 4962313 - DNA, 13 bp, Homo sapiens
ccctctcagctcc

SEQ ID NO: 4962314 - DNA, 14 bp, Homo sapiens
ccctctcagctcca

SEQ ID NO: 4962315 - DNA, 17 bp, Homo sapiens
ccctctcagctccaggt

SEQ ID NO: 4962316 - DNA, 18 bp, Homo sapiens
ccctctccccacccctac

SEQ ID NO: 4962317 - DNA, 15 bp, Homo sapiens
ccctctccttcctta

SEQ ID NO: 4962318 - DNA, 15 bp, Homo sapiens
ccctctctcttctgc

SEQ ID NO: 4962319 - DNA, 14 bp, Homo sapiens
ccctctgacctgca

SEQ ID NO: 4962320 - DNA, 15 bp, Homo sapiens
ccctctgacctgcac

SEQ ID NO: 4962321 - DNA, 17 bp, Homo sapiens
ccctctgacctgcactg

SEQ ID NO: 4962322 - DNA, 13 bp, Homo sapiens
ccctctgccacca

SEQ ID NO: 4962323 - DNA, 13 bp, Homo sapiens
ccctctgctcagc

SEQ ID NO: 4962324 - DNA, 16 bp, Homo sapiens
ccctctgggaacctcc

SEQ ID NO: 4962325 - DNA, 19 bp, Homo sapiens
ccctctgggaacctcccag

SEQ ID NO: 4962326 - DNA, 22 bp, Homo sapiens
ccctctgggaacctcccagagg

SEQ ID NO: 4962327 - DNA, 13 bp, Homo sapiens
ccctctgtccacc

SEQ ID NO: 4962328 - DNA, 20 bp, Homo sapiens
ccctcttgttttgtttgtct

SEQ ID NO: 4962329 - DNA, 21 bp, Homo sapiens
ccctcttgttttgtttgtctc

SEQ ID NO: 4962330 - DNA, 15 bp, Homo sapiens
ccctctttctctttc

SEQ ID NO: 4962331 - DNA, 23 bp, Homo sapiens
ccctcttttcttactcctcctct

SEQ ID NO: 4962332 - DNA, 24 bp, Homo sapiens
ccctgaaaatgtttttctgccagg

SEQ ID NO: 4962333 - DNA, 19 bp, Homo sapiens
ccctgaaacacgaaacttg

SEQ ID NO: 4962334 - DNA, 20 bp, Homo sapiens
ccctgaagtgagcacagcct

SEQ ID NO: 4962335 - DNA, 23 bp, Homo sapiens
ccctgaatcccccttgccacccc

SEQ ID NO: 4962336 - DNA, 15 bp, Homo sapiens
ccctgacctcactgt

SEQ ID NO: 4962337 - DNA, 17 bp, Homo sapiens
ccctgagatcccctgag

SEQ ID NO: 4962338 - DNA, 16 bp, Homo sapiens
ccctgagcaggaaagt

SEQ ID NO: 4962339 - DNA, 21 bp, Homo sapiens
ccctgaggtcagggagtgctg

SEQ ID NO: 4962340 - DNA, 19 bp, Homo sapiens
ccctgattgacctgctccg

SEQ ID NO: 4962341 - DNA, 24 bp, Homo sapiens
ccctgattgacctgctccgctgct

SEQ ID NO: 4962342 - DNA, 18 bp, Homo sapiens
ccctgcaaacagaacagg

SEQ ID NO: 4962343 - DNA, 22 bp, Homo sapiens
ccctgcaaacagaacagggtca

SEQ ID NO: 4962344 - DNA, 16 bp, Homo sapiens
ccctgcaaggcccaca

SEQ ID NO: 4962345 - DNA, 17 bp, Homo sapiens
ccctgcaaggcccacag

SEQ ID NO: 4962346 - DNA, 18 bp, Homo sapiens
ccctgcaaggcccacagg

SEQ ID NO: 4962347 - DNA, 20 bp, Homo sapiens
ccctgcaatgtatcccttct

SEQ ID NO: 4962348 - DNA, 18 bp, Homo sapiens
ccctgcagatgccaccct

SEQ ID NO: 4962349 - DNA, 20 bp, Homo sapiens
ccctgcagtgttcgcttggc

SEQ ID NO: 4962350 - DNA, 15 bp, Homo sapiens
ccctgccaccctggg

SEQ ID NO: 4962351 - DNA, 17 bp, Homo sapiens
ccctgccaccctgggga

SEQ ID NO: 4962352 - DNA, 15 bp, Homo sapiens
ccctgcccaggccgg

SEQ ID NO: 4962353 - DNA, 13 bp, Homo sapiens
ccctgccccaaat

SEQ ID NO: 4962354 - DNA, 12 bp, Homo sapiens
ccctgcccccca

SEQ ID NO: 4962355 - DNA, 16 bp, Homo sapiens
ccctgccccccagcct

SEQ ID NO: 4962356 - DNA, 17 bp, Homo sapiens
ccctgcccggctgcgga

SEQ ID NO: 4962357 - DNA, 17 bp, Homo sapiens
ccctgccctgaggaagg

SEQ ID NO: 4962358 - DNA, 13 bp, Homo sapiens
ccctgccctgctg

SEQ ID NO: 4962359 - DNA, 13 bp, Homo sapiens
ccctgcctgccat

SEQ ID NO: 4962360 - DNA, 15 bp, Homo sapiens
ccctgctgcaggggc

SEQ ID NO: 4962361 - DNA, 12 bp, Homo sapiens
ccctgctgccca

SEQ ID NO: 4962362 - DNA, 13 bp, Homo sapiens
ccctgctgcccaa

SEQ ID NO: 4962363 - DNA, 21 bp, Homo sapiens
ccctgctgcccaatctccatc

SEQ ID NO: 4962364 - DNA, 19 bp, Homo sapiens
ccctgctgccgcctcccag

SEQ ID NO: 4962365 - DNA, 19 bp, Homo sapiens
ccctgctgccttctgacgg

SEQ ID NO: 4962366 - DNA, 13 bp, Homo sapiens
ccctgctggctct

SEQ ID NO: 4962367 - DNA, 21 bp, Homo sapiens
ccctgctggctcttctgccca

SEQ ID NO: 4962368 - DNA, 19 bp, Homo sapiens
ccctggaacatcctttgca

SEQ ID NO: 4962369 - DNA, 13 bp, Homo sapiens
ccctggactggga

SEQ ID NO: 4962370 - DNA, 23 bp, Homo sapiens
ccctggcattatgtccactgtgt

SEQ ID NO: 4962371 - DNA, 18 bp, Homo sapiens
ccctggcctctgtgcctt

SEQ ID NO: 4962372 - DNA, 19 bp, Homo sapiens
ccctggcctctgtgccttc

SEQ ID NO: 4962373 - DNA, 15 bp, Homo sapiens
ccctggctcccatga

SEQ ID NO: 4962374 - DNA, 23 bp, Homo sapiens
ccctggctcccatgaccatactg

SEQ ID NO: 4962375 - DNA, 17 bp, Homo sapiens
ccctggctgtactgctc

SEQ ID NO: 4962376 - DNA, 18 bp, Homo sapiens
ccctggcttttcactgct

SEQ ID NO: 4962377 - DNA, 15 bp, Homo sapiens
ccctgggaaggcctc

SEQ ID NO: 4962378 - DNA, 14 bp, Homo sapiens
ccctgggagacaga

SEQ ID NO: 4962379 - DNA, 12 bp, Homo sapiens
ccctgggccagg

SEQ ID NO: 4962380 - DNA, 20 bp, Homo sapiens
ccgcaccccgatgtggacct

SEQ ID NO: 4962381 - DNA, 13 bp, Homo sapiens
ccgcagacctccc

SEQ ID NO: 4962382 - DNA, 13 bp, Homo sapiens
ccgcccatgcact

SEQ ID NO: 4962383 - DNA, 12 bp, Homo sapiens
ccgcccccagcc

SEQ ID NO: 4962384 - DNA, 14 bp, Homo sapiens
ccgcccctgcagca

SEQ ID NO: 4962385 - DNA, 16 bp, Homo sapiens
ccgcctagtttactgt

SEQ ID NO: 4962386 - DNA, 14 bp, Homo sapiens
ccgcctgccctcat

SEQ ID NO: 4962387 - DNA, 16 bp, Homo sapiens
ccgcctgccctcatgg

SEQ ID NO: 4962388 - DNA, 22 bp, Homo sapiens
ccgccttccttgaccttcctct

SEQ ID NO: 4962389 - DNA, 12 bp, Homo sapiens
ccgccttttgta

SEQ ID NO: 4962390 - DNA, 19 bp, Homo sapiens
ccgcgtttagaccaaggaa

SEQ ID NO: 4962391 - DNA, 15 bp, Homo sapiens
ccgctcacctagagc

SEQ ID NO: 4962392 - DNA, 16 bp, Homo sapiens
ccgctcacctagagcc

SEQ ID NO: 4962393 - DNA, 18 bp, Homo sapiens
ccgctcacctagagccag

SEQ ID NO: 4962394 - DNA, 19 bp, Homo sapiens
ccgctcagccctccctgcc

SEQ ID NO: 4962395 - DNA, 19 bp, Homo sapiens
ccgctctacatcttctgcc

SEQ ID NO: 4962396 - DNA, 16 bp, Homo sapiens
ccgctctcttcctgcc

SEQ ID NO: 4962397 - DNA, 17 bp, Homo sapiens
ccgctgctccacgcgct

SEQ ID NO: 4962398 - DNA, 18 bp, Homo sapiens
ccgctgctccttggctta

SEQ ID NO: 4962399 - DNA, 14 bp, Homo sapiens
ccgctgctgctgct

SEQ ID NO: 4962400 - DNA, 15 bp, Homo sapiens
ccgctgtgagcccct

SEQ ID NO: 4962401 - DNA, 19 bp, Homo sapiens
ccgctgtgagcccctggtc

SEQ ID NO: 4962402 - DNA, 16 bp, Homo sapiens
ccgcttgtggggaccc

SEQ ID NO: 4962403 - DNA, 17 bp, Homo sapiens
ccgcttgtggggaccca

SEQ ID NO: 4962404 - DNA, 19 bp, Homo sapiens
ccgcttgtggggacccagg

SEQ ID NO: 4962405 - DNA, 23 bp, Homo sapiens
ccgctttctacccagcgagccct

SEQ ID NO: 4962406 - DNA, 19 bp, Homo sapiens
ccgcttttgttctcgcaaa

SEQ ID NO: 4962407 - DNA, 14 bp, Homo sapiens
ccggaggaaatctg

SEQ ID NO: 4962408 - DNA, 17 bp, Homo sapiens
ccggagggaagggacgg

SEQ ID NO: 4962409 - DNA, 14 bp, Homo sapiens
ccggaggggcctgg

SEQ ID NO: 4962410 - DNA, 15 bp, Homo sapiens
ccggaggggcctggc

SEQ ID NO: 4962411 - DNA, 17 bp, Homo sapiens
ccggatcagagcaggac

SEQ ID NO: 4962412 - DNA, 20 bp, Homo sapiens
ccggatcagagcaggacctc

SEQ ID NO: 4962413 - DNA, 21 bp, Homo sapiens
ccggatcagagcaggacctcc

SEQ ID NO: 4962414 - DNA, 11 bp, Homo sapiens
ccggcaggccc

SEQ ID NO: 4962415 - DNA, 17 bp, Homo sapiens
ccggcaggccctgcagt

SEQ ID NO: 4962416 - DNA, 12 bp, Homo sapiens
ccggccacctct

SEQ ID NO: 4962417 - DNA, 15 bp, Homo sapiens
ccggccacctctgcg

SEQ ID NO: 4962418 - DNA, 15 bp, Homo sapiens
ccggcccctgctggt

SEQ ID NO: 4962419 - DNA, 14 bp, Homo sapiens
ccggccctagccca

SEQ ID NO: 4962420 - DNA, 17 bp, Homo sapiens
ccggccgctccaccagc

SEQ ID NO: 4962421 - DNA, 15 bp, Homo sapiens
ccggctccaggctcc

SEQ ID NO: 4962422 - DNA, 23 bp, Homo sapiens
ccggctcgagcagtcctgcctca

SEQ ID NO: 4962423 - DNA, 17 bp, Homo sapiens
ccggctctacgggggcc

SEQ ID NO: 4962424 - DNA, 17 bp, Homo sapiens
ccggctgtgctcagaga

SEQ ID NO: 4962425 - DNA, 17 bp, Homo sapiens
ccgggagcctaggacca

SEQ ID NO: 4962426 - DNA, 23 bp, Homo sapiens
ccgggagcctaggaccactcagc

SEQ ID NO: 4962427 - DNA, 14 bp, Homo sapiens
ccgggctctctgct

SEQ ID NO: 4962428 - DNA, 16 bp, Homo sapiens
ccgggctctctgctgt

SEQ ID NO: 4962429 - DNA, 15 bp, Homo sapiens
ccggggacagaggcc

SEQ ID NO: 4962430 - DNA, 18 bp, Homo sapiens
ccggtagggaggcagcct

SEQ ID NO: 4962431 - DNA, 19 bp, Homo sapiens
ccggtcacctagcaagctg

SEQ ID NO: 4962432 - DNA, 15 bp, Homo sapiens
ccggtccagctggcc

SEQ ID NO: 4962433 - DNA, 21 bp, Homo sapiens
ccggtccagctggcctggaca

SEQ ID NO: 4962434 - DNA, 18 bp, Homo sapiens
ccggtggcggccccagca

SEQ ID NO: 4962435 - DNA, 20 bp, Homo sapiens
ccggtggcggccccagcacc

SEQ ID NO: 4962436 - DNA, 12 bp, Homo sapiens
ccggtgttctaa

SEQ ID NO: 4962437 - DNA, 13 bp, Homo sapiens
ccggtgttctaag

SEQ ID NO: 4962438 - DNA, 19 bp, Homo sapiens
ccgtaataacacccttcct

SEQ ID NO: 4962439 - DNA, 18 bp, Homo sapiens
ccgtacattcaatgttta

SEQ ID NO: 4962440 - DNA, 16 bp, Homo sapiens
ccgtccaggagcctgg

SEQ ID NO: 4962441 - DNA, 18 bp, Homo sapiens
ccgtccaggagcctgtgc

SEQ ID NO: 4962442 - DNA, 24 bp, Homo sapiens
ccgtcctcacccctgtcctcactg

SEQ ID NO: 4962443 - DNA, 23 bp, Homo sapiens
ccgtgaaggcttctctgttctac

SEQ ID NO: 4962444 - DNA, 19 bp, Homo sapiens
ccgtgagcaggaaggcctg

SEQ ID NO: 4962445 - DNA, 20 bp, Homo sapiens
ccgtgagcaggaaggcctgg

SEQ ID NO: 4962446 - DNA, 21 bp, Homo sapiens
ccgtgagcgcctgtgcacaca

SEQ ID NO: 4962447 - DNA, 22 bp, Homo sapiens
ccgtgcattagcacagatttta

SEQ ID NO: 4962448 - DNA, 11 bp, Homo sapiens
ccgtgccaaag

SEQ ID NO: 4962449 - DNA, 20 bp, Homo sapiens
ccgtgccaaagtctcccttc

SEQ ID NO: 4962450 - DNA, 17 bp, Homo sapiens
ccgtgccttcagctcta

SEQ ID NO: 4962451 - DNA, 20 bp, Homo sapiens
ccgtggccatccctgtgagg

SEQ ID NO: 4962452 - DNA, 21 bp, Homo sapiens
ccgtgtgagtgtgacagggcc

SEQ ID NO: 4962453 - DNA, 23 bp, Homo sapiens
ccgttcctgacatcacagcagcc

SEQ ID NO: 4962454 - DNA, 17 bp, Homo sapiens
ccgtttacctagaagaa

SEQ ID NO: 4962455 - DNA, 16 bp, Homo sapiens
cctaaaactggcctga

SEQ ID NO: 4962456 - DNA, 20 bp, Homo sapiens
cctaaaactggcctgacttg

SEQ ID NO: 4962457 - DNA, 22 bp, Homo sapiens
cctaaaagtgggcttgattctg

SEQ ID NO: 4962458 - DNA, 17 bp, Homo sapiens
cctaaacccctgtccca

SEQ ID NO: 4962459 - DNA, 12 bp, Homo sapiens
cctaaagagata

SEQ ID NO: 4962460 - DNA, 13 bp, Homo sapiens
cctaaatttaatg

SEQ ID NO: 4962461 - DNA, 16 bp, Homo sapiens
cctaaatttaatgctg

SEQ ID NO: 4962462 - DNA, 14 bp, Homo sapiens
cctaaccccttcca

SEQ ID NO: 4962463 - DNA, 18 bp, Homo sapiens
cctaaccccttccagatc

SEQ ID NO: 4962464 - DNA, 15 bp, Homo sapiens
cctaagaaatatgtg

SEQ ID NO: 4962465 - DNA, 20 bp, Homo sapiens
cctaagaaatatgtgagatt

SEQ ID NO: 4962466 - DNA, 22 bp, Homo sapiens
cctaagagactgcgttctgcaa

SEQ ID NO: 4962467 - DNA, 14 bp, Homo sapiens
cctaagccagcctg

SEQ ID NO: 4962468 - DNA, 19 bp, Homo sapiens
cctaagccagcctggtcca

SEQ ID NO: 4962469 - DNA, 13 bp, Homo sapiens
cctaaggaacctt

SEQ ID NO: 4962470 - DNA, 22 bp, Homo sapiens
cctaagggtcgaaagctctaga

SEQ ID NO: 4962471 - DNA, 23 bp, Homo sapiens
cctaagggtcgaaagctctagaa

SEQ ID NO: 4962472 - DNA, 18 bp, Homo sapiens
cctaagtactgtaataat

SEQ ID NO: 4962473 - DNA, 16 bp, Homo sapiens
cctaagtattaaaaca

SEQ ID NO: 4962474 - DNA, 19 bp, Homo sapiens
cctaatctcatacctctga

SEQ ID NO: 4962475 - DNA, 17 bp, Homo sapiens
cctaatgtcttcataaa

SEQ ID NO: 4962476 - DNA, 16 bp, Homo sapiens
cctaattaccagtctt

SEQ ID NO: 4962477 - DNA, 18 bp, Homo sapiens
cctacaagagcagcctgt

SEQ ID NO: 4962478 - DNA, 19 bp, Homo sapiens
cctacaagagcagcctgtg

SEQ ID NO: 4962479 - DNA, 19 bp, Homo sapiens
cctacacccagaccccagg

SEQ ID NO: 4962480 - DNA, 13 bp, Homo sapiens
cctacagagctgt

SEQ ID NO: 4962481 - DNA, 19 bp, Homo sapiens
cctacagcactactgggtg

SEQ ID NO: 4962482 - DNA, 20 bp, Homo sapiens
cctacagcactactgggtgt

SEQ ID NO: 4962483 - DNA, 20 bp, Homo sapiens
cctacccacacctctgccag

SEQ ID NO: 4962484 - DNA, 13 bp, Homo sapiens
cctacccctggct

SEQ ID NO: 4962485 - DNA, 19 bp, Homo sapiens
cctaccgagtctcttctcc

SEQ ID NO: 4962486 - DNA, 14 bp, Homo sapiens
cctacctgccctgg

SEQ ID NO: 4962487 - DNA, 14 bp, Homo sapiens
cctacctgtgcctg

SEQ ID NO: 4962488 - DNA, 13 bp, Homo sapiens
cctactccctgca

SEQ ID NO: 4962489 - DNA, 20 bp, Homo sapiens
cctactccctgcagatgcca

SEQ ID NO: 4962490 - DNA, 13 bp, Homo sapiens
cctcccaccccca

SEQ ID NO: 4962491 - DNA, 20 bp, Homo sapiens
cctcccacccccttctctgc

SEQ ID NO: 4962492 - DNA, 15 bp, Homo sapiens
cctcccacctcagcc

SEQ ID NO: 4962493 - DNA, 15 bp, Homo sapiens
cctcccacctccagt

SEQ ID NO: 4962494 - DNA, 11 bp, Homo sapiens
cctcccagagg

SEQ ID NO: 4962495 - DNA, 16 bp, Homo sapiens
cctcccagaggtccag

SEQ ID NO: 4962496 - DNA, 18 bp, Homo sapiens
cctcccagaggtccagcc

SEQ ID NO: 4962497 - DNA, 20 bp, Homo sapiens
cctcccagaggtccagccca

SEQ ID NO: 4962498 - DNA, 20 bp, Homo sapiens
cctcccagcttgtaggagct

SEQ ID NO: 4962499 - DNA, 12 bp, Homo sapiens
cctccccagccc

SEQ ID NO: 4962500 - DNA, 15 bp, Homo sapiens
cctccccagccccta

SEQ ID NO: 4962501 - DNA, 15 bp, Homo sapiens
cctccccgcaccccc

SEQ ID NO: 4962502 - DNA, 21 bp, Homo sapiens
cctccccgcaccccccaagct

SEQ ID NO: 4962503 - DNA, 17 bp, Homo sapiens
cctccccggcaccctct

SEQ ID NO: 4962504 - DNA, 13 bp, Homo sapiens
cctcccctcacag

SEQ ID NO: 4962505 - DNA, 19 bp, Homo sapiens
cctcccctcacagcctctg

SEQ ID NO: 4962506 - DNA, 13 bp, Homo sapiens
cctcccctgccct

SEQ ID NO: 4962507 - DNA, 18 bp, Homo sapiens
cctcccgaatagctggga

SEQ ID NO: 4962508 - DNA, 21 bp, Homo sapiens
cctcccgaatagctgggacta

SEQ ID NO: 4962509 - DNA, 21 bp, Homo sapiens
cctccctagccagcacttgta

SEQ ID NO: 4962510 - DNA, 18 bp, Homo sapiens
cctccctctctcttctgc

SEQ ID NO: 4962511 - DNA, 18 bp, Homo sapiens
cctccctctgatttttca

SEQ ID NO: 4962512 - DNA, 24 bp, Homo sapiens
cctccctgcccctcccttcaacca

SEQ ID NO: 4962513 - DNA, 12 bp, Homo sapiens
cctccctggagt

SEQ ID NO: 4962514 - DNA, 13 bp, Homo sapiens
cctccctggagtg

SEQ ID NO: 4962515 - DNA, 13 bp, Homo sapiens
cctccctggctcc

SEQ ID NO: 4962516 - DNA, 14 bp, Homo sapiens
cctccctggctccc

SEQ ID NO: 4962517 - DNA, 12 bp, Homo sapiens
cctccctgtcaa

SEQ ID NO: 4962518 - DNA, 19 bp, Homo sapiens
cctcccttccgaccctctg

SEQ ID NO: 4962519 - DNA, 20 bp, Homo sapiens
cctccgaccacttccagggg

SEQ ID NO: 4962520 - DNA, 18 bp, Homo sapiens
cctccgccaatgcacggc

SEQ ID NO: 4962521 - DNA, 14 bp, Homo sapiens
cctccgcctcttgg

SEQ ID NO: 4962522 - DNA, 14 bp, Homo sapiens
cctcctcactggcc

SEQ ID NO: 4962523 - DNA, 15 bp, Homo sapiens
cctcctcactggcca

SEQ ID NO: 4962524 - DNA, 23 bp, Homo sapiens
cctcctcatcccgtgttctcctt

SEQ ID NO: 4962525 - DNA, 21 bp, Homo sapiens
cctcctcatgtacataccctg

SEQ ID NO: 4962526 - DNA, 18 bp, Homo sapiens
cctcctcgttcctttctc

SEQ ID NO: 4962527 - DNA, 13 bp, Homo sapiens
cctcctctgtctg

SEQ ID NO: 4962528 - DNA, 20 bp, Homo sapiens
cctcctcttcaccccggcag

SEQ ID NO: 4962529 - DNA, 12 bp, Homo sapiens
cctcctctttct

SEQ ID NO: 4962530 - DNA, 19 bp, Homo sapiens
cctcctgagggaggacctg

SEQ ID NO: 4962531 - DNA, 13 bp, Homo sapiens
cctcctgcctcga

SEQ ID NO: 4962532 - DNA, 17 bp, Homo sapiens
cctcctggaaccttgct

SEQ ID NO: 4962533 - DNA, 13 bp, Homo sapiens
cctcctgggctaa

SEQ ID NO: 4962534 - DNA, 14 bp, Homo sapiens
cctcctgggctaag

SEQ ID NO: 4962535 - DNA, 19 bp, Homo sapiens
cctcctgtggaacccagca

SEQ ID NO: 4962536 - DNA, 20 bp, Homo sapiens
cctcctgtggaacccagcag

SEQ ID NO: 4962537 - DNA, 12 bp, Homo sapiens
cctccttcagac

SEQ ID NO: 4962538 - DNA, 13 bp, Homo sapiens
cctccttcagaca

SEQ ID NO: 4962539 - DNA, 15 bp, Homo sapiens
cctccttcagacacc

SEQ ID NO: 4962540 - DNA, 16 bp, Homo sapiens
cctccttctccctttt

SEQ ID NO: 4962541 - DNA, 16 bp, Homo sapiens
cctccttgtccaccca

SEQ ID NO: 4962542 - DNA, 14 bp, Homo sapiens
cctcctttctgtgc

SEQ ID NO: 4962543 - DNA, 15 bp, Homo sapiens
cctcgaactggctgc

SEQ ID NO: 4962544 - DNA, 14 bp, Homo sapiens
cctcgcctctccca

SEQ ID NO: 4962545 - DNA, 22 bp, Homo sapiens
cctcgcctgtggagctcagccc

SEQ ID NO: 4962546 - DNA, 12 bp, Homo sapiens
cctcgctgcttc

SEQ ID NO: 4962547 - DNA, 21 bp, Homo sapiens
cctcggaaccgctcacctaga

SEQ ID NO: 4962548 - DNA, 23 bp, Homo sapiens
cctcggaaccgctcacctagagc

SEQ ID NO: 4962549 - DNA, 15 bp, Homo sapiens
cctcgtggtccccaa

SEQ ID NO: 4962550 - DNA, 18 bp, Homo sapiens
cctcgtggtccccaacag

SEQ ID NO: 4962551 - DNA, 19 bp, Homo sapiens
cctcgttcctttctcctgt

SEQ ID NO: 4962552 - DNA, 15 bp, Homo sapiens
cctcgttggaagagg

SEQ ID NO: 4962553 - DNA, 20 bp, Homo sapiens
cctcgttggaagaggaacag

SEQ ID NO: 4962554 - DNA, 14 bp, Homo sapiens
cctctaatgagact

SEQ ID NO: 4962555 - DNA, 18 bp, Homo sapiens
cctctactttccaggcta

SEQ ID NO: 4962556 - DNA, 22 bp, Homo sapiens
cctctagaaacgagttggtgtc

SEQ ID NO: 4962557 - DNA, 16 bp, Homo sapiens
cctctatacatctctc

SEQ ID NO: 4962558 - DNA, 17 bp, Homo sapiens
cctctatacatctctcc

SEQ ID NO: 4962559 - DNA, 20 bp, Homo sapiens
cctctatacatctctcccca

SEQ ID NO: 4962560 - DNA, 14 bp, Homo sapiens
cctctcacacacat

SEQ ID NO: 4962561 - DNA, 16 bp, Homo sapiens
cctctcactaaacttt

SEQ ID NO: 4962562 - DNA, 13 bp, Homo sapiens
cctctcagctcca

SEQ ID NO: 4962563 - DNA, 15 bp, Homo sapiens
cctctccccacccct

SEQ ID NO: 4962564 - DNA, 14 bp, Homo sapiens
cctctcccctccag

SEQ ID NO: 4962565 - DNA, 15 bp, Homo sapiens
cctctcccctccagc

SEQ ID NO: 4962566 - DNA, 16 bp, Homo sapiens
cctctcccctccagcc

SEQ ID NO: 4962567 - DNA, 10 bp, Homo sapiens
cctctccctg

SEQ ID NO: 4962568 - DNA, 14 bp, Homo sapiens
cctctctcctttgc

SEQ ID NO: 4962569 - DNA, 18 bp, Homo sapiens
cctctctcttctgctcca

SEQ ID NO: 4962570 - DNA, 19 bp, Homo sapiens
cctctctcttctgctccac

SEQ ID NO: 4962571 - DNA, 21 bp, Homo sapiens
cctctctcttctgctccaccc

SEQ ID NO: 4962572 - DNA, 10 bp, Homo sapiens
cctctctggt

SEQ ID NO: 4962573 - DNA, 17 bp, Homo sapiens
cctctgacacacagctc

SEQ ID NO: 4962574 - DNA, 18 bp, Homo sapiens
cctctgacacacagctct

SEQ ID NO: 4962575 - DNA, 16 bp, Homo sapiens
cctctgacccctcctc

SEQ ID NO: 4962576 - DNA, 17 bp, Homo sapiens
cctctgacccctcctca

SEQ ID NO: 4962577 - DNA, 19 bp, Homo sapiens
cctctgacccctcctcact

SEQ ID NO: 4962578 - DNA, 14 bp, Homo sapiens
cctctgacctgcac

SEQ ID NO: 4962579 - DNA, 23 bp, Homo sapiens
cctctgccctcattactgggcct

SEQ ID NO: 4962580 - DNA, 20 bp, Homo sapiens
cctctgcctctgacacacag

SEQ ID NO: 4962581 - DNA, 15 bp, Homo sapiens
cctctgcctgtctcc

SEQ ID NO: 4962582 - DNA, 20 bp, Homo sapiens
cctctgccttagaggagccc

SEQ ID NO: 4962583 - DNA, 20 bp, Homo sapiens
cctctgcggaccccagctgt

SEQ ID NO: 4962584 - DNA, 17 bp, Homo sapiens
cctctgctcagccaagc

SEQ ID NO: 4962585 - DNA, 20 bp, Homo sapiens
cctctgctgctgtccctccc

SEQ ID NO: 4962586 - DNA, 17 bp, Homo sapiens
cctctggactggctaga

SEQ ID NO: 4962587 - DNA, 20 bp, Homo sapiens
cctctggaggggtgtggctc

SEQ ID NO: 4962588 - DNA, 20 bp, Homo sapiens
cctctggccgcctaggctca

SEQ ID NO: 4962589 - DNA, 22 bp, Homo sapiens
cctctggctagaggccagcccc

SEQ ID NO: 4962590 - DNA, 22 bp, Homo sapiens
cctctgggaacctcccagaggt

SEQ ID NO: 4962591 - DNA, 23 bp, Homo sapiens
cctctgggaacctcccagaggtc

SEQ ID NO: 4962592 - DNA, 18 bp, Homo sapiens
cctctggggctctagggt

SEQ ID NO: 4962593 - DNA, 14 bp, Homo sapiens
cctctgtcatttgt

SEQ ID NO: 4962594 - DNA, 11 bp, Homo sapiens
cctctgtctca

SEQ ID NO: 4962595 - DNA, 13 bp, Homo sapiens
cctctgtctgccc

SEQ ID NO: 4962596 - DNA, 16 bp, Homo sapiens
cctctgtctgcccttc

SEQ ID NO: 4962597 - DNA, 22 bp, Homo sapiens
cctctgtctgcccttcacccca

SEQ ID NO: 4962598 - DNA, 15 bp, Homo sapiens
cctctgtgacctcag

SEQ ID NO: 4962599 - DNA, 23 bp, Homo sapiens
cctctgtgaggaaagcacacagt

SEQ ID NO: 4962600 - DNA, 21 bp, Homo sapiens
cctctgtgccttcttttgatt

SEQ ID NO: 4962601 - DNA, 21 bp, Homo sapiens
cctgccctcatggcccctctg

SEQ ID NO: 4962602 - DNA, 15 bp, Homo sapiens
cctgccctggtccag

SEQ ID NO: 4962603 - DNA, 12 bp, Homo sapiens
cctgcctcagcc

SEQ ID NO: 4962604 - DNA, 14 bp, Homo sapiens
cctgcctcagcctc

SEQ ID NO: 4962605 - DNA, 12 bp, Homo sapiens
cctgcctcctgc

SEQ ID NO: 4962606 - DNA, 12 bp, Homo sapiens
cctgcctgccat

SEQ ID NO: 4962607 - DNA, 13 bp, Homo sapiens
cctgcctgcgtct

SEQ ID NO: 4962608 - DNA, 12 bp, Homo sapiens
cctgcctggagc

SEQ ID NO: 4962609 - DNA, 13 bp, Homo sapiens
cctgcctggagcg

SEQ ID NO: 4962610 - DNA, 11 bp, Homo sapiens
cctgcctggcc

SEQ ID NO: 4962611 - DNA, 12 bp, Homo sapiens
cctgcctggcca

SEQ ID NO: 4962612 - DNA, 18 bp, Homo sapiens
cctgcctggccaggcaga

SEQ ID NO: 4962613 - DNA, 12 bp, Homo sapiens
cctgcctgtgct

SEQ ID NO: 4962614 - DNA, 17 bp, Homo sapiens
cctgccttaggcctacc

SEQ ID NO: 4962615 - DNA, 14 bp, Homo sapiens
cctgccttcatgga

SEQ ID NO: 4962616 - DNA, 19 bp, Homo sapiens
cctgccttggcctcccaag

SEQ ID NO: 4962617 - DNA, 23 bp, Homo sapiens
cctgcgtcttccgcccctgcctg

SEQ ID NO: 4962618 - DNA, 22 bp, Homo sapiens
cctgcgttttggaagctctgaa

SEQ ID NO: 4962619 - DNA, 15 bp, Homo sapiens
cctgctccgctgctc

SEQ ID NO: 4962620 - DNA, 20 bp, Homo sapiens
cctgctccgctgctccttgg

SEQ ID NO: 4962621 - DNA, 13 bp, Homo sapiens
cctgctcctgcag

SEQ ID NO: 4962622 - DNA, 14 bp, Homo sapiens
cctgctcctgcagc

SEQ ID NO: 4962623 - DNA, 16 bp, Homo sapiens
cctgctcctgcagcat

SEQ ID NO: 4962624 - DNA, 17 bp, Homo sapiens
cctgctcctgcagcatg

SEQ ID NO: 4962625 - DNA, 21 bp, Homo sapiens
cctgctctcctcttgccactg

SEQ ID NO: 4962626 - DNA, 15 bp, Homo sapiens
cctgctgcaggggct

SEQ ID NO: 4962627 - DNA, 21 bp, Homo sapiens
cctgctgcaggggctctggag

SEQ ID NO: 4962628 - DNA, 14 bp, Homo sapiens
cctgctgccgcctc

SEQ ID NO: 4962629 - DNA, 15 bp, Homo sapiens
cctgctgccgcctcc

SEQ ID NO: 4962630 - DNA, 19 bp, Homo sapiens
cctgctggctcttctgccc

SEQ ID NO: 4962631 - DNA, 17 bp, Homo sapiens
cctgctgggtaaactgt

SEQ ID NO: 4962632 - DNA, 19 bp, Homo sapiens
cctgctggttcagggttgg

SEQ ID NO: 4962633 - DNA, 12 bp, Homo sapiens
cctgcttcccac

SEQ ID NO: 4962634 - DNA, 14 bp, Homo sapiens
cctgcttcccacct

SEQ ID NO: 4962635 - DNA, 24 bp, Homo sapiens
cctgcttcccacctccctgcccag

SEQ ID NO: 4962636 - DNA, 19 bp, Homo sapiens
cctgctttgggctgccctg

SEQ ID NO: 4962637 - DNA, 22 bp, Homo sapiens
cctgctttgggctgccctggtg

SEQ ID NO: 4962638 - DNA, 16 bp, Homo sapiens
cctgctttttgaaatg

SEQ ID NO: 4962639 - DNA, 17 bp, Homo sapiens
cctgctttttgaaatga

SEQ ID NO: 4962640 - DNA, 22 bp, Homo sapiens
cctgctttttgaaatgaaattt

SEQ ID NO: 4962641 - DNA, 17 bp, Homo sapiens
cctggaaaaattccaga

SEQ ID NO: 4962642 - DNA, 16 bp, Homo sapiens
cctggaaccttgctgt

SEQ ID NO: 4962643 - DNA, 22 bp, Homo sapiens
cctggaactctatctgggcctg

SEQ ID NO: 4962644 - DNA, 17 bp, Homo sapiens
cctggacactcagacct

SEQ ID NO: 4962645 - DNA, 23 bp, Homo sapiens
cctggacctgccctgggccacac

SEQ ID NO: 4962646 - DNA, 14 bp, Homo sapiens
cctggacctgcctc

SEQ ID NO: 4962647 - DNA, 13 bp, Homo sapiens
cctggactgggag

SEQ ID NO: 4962648 - DNA, 18 bp, Homo sapiens
cctggactgggaggtaga

SEQ ID NO: 4962649 - DNA, 14 bp, Homo sapiens
cctggactgttttc

SEQ ID NO: 4962650 - DNA, 12 bp, Homo sapiens
cctggagaacta

SEQ ID NO: 4962651 - DNA, 13 bp, Homo sapiens
cctggagaactag

SEQ ID NO: 4962652 - DNA, 16 bp, Homo sapiens
cctggagaactagaga

SEQ ID NO: 4962653 - DNA, 22 bp, Homo sapiens
cctggagacccaccccacctgc

SEQ ID NO: 4962654 - DNA, 14 bp, Homo sapiens
cctggaggcactga

SEQ ID NO: 4962655 - DNA, 21 bp, Homo sapiens
cctggatcacgacgctgcaga

SEQ ID NO: 4962656 - DNA, 17 bp, Homo sapiens
cctggatgttgtgtgta

SEQ ID NO: 4962657 - DNA, 14 bp, Homo sapiens
cctggatttctggt

SEQ ID NO: 4962658 - DNA, 16 bp, Homo sapiens
cctggcacagggcagt

SEQ ID NO: 4962659 - DNA, 17 bp, Homo sapiens
cctggcacagggcagtg

SEQ ID NO: 4962660 - DNA, 19 bp, Homo sapiens
cctggcacccggcccctgc

SEQ ID NO: 4962661 - DNA, 20 bp, Homo sapiens
cctggcacccggcccctgct

SEQ ID NO: 4962662 - DNA, 11 bp, Homo sapiens
cctggcagccc

SEQ ID NO: 4962663 - DNA, 14 bp, Homo sapiens
cctggcagcccaga

SEQ ID NO: 4962664 - DNA, 18 bp, Homo sapiens
cctggcagcccagagact

SEQ ID NO: 4962665 - DNA, 18 bp, Homo sapiens
cctggcagccgtgccttc

SEQ ID NO: 4962666 - DNA, 22 bp, Homo sapiens
cctggcagggtcatcctgtgct

SEQ ID NO: 4962667 - DNA, 18 bp, Homo sapiens
cctggcattcttgtacag

SEQ ID NO: 4962668 - DNA, 19 bp, Homo sapiens
cctggcattcttgtacagt

SEQ ID NO: 4962669 - DNA, 13 bp, Homo sapiens
cctggccacctct

SEQ ID NO: 4962670 - DNA, 18 bp, Homo sapiens
cctggccacctctctcct

SEQ ID NO: 4962671 - DNA, 20 bp, Homo sapiens
cctggccagatgcaccagcc

SEQ ID NO: 4962672 - DNA, 18 bp, Homo sapiens
cctggccaggagctcttc

SEQ ID NO: 4962673 - DNA, 19 bp, Homo sapiens
cctggccaggagctcttca

SEQ ID NO: 4962674 - DNA, 13 bp, Homo sapiens
cctggcccataga

SEQ ID NO: 4962675 - DNA, 22 bp, Homo sapiens
cctggcccatagaaacatgaca

SEQ ID NO: 4962676 - DNA, 12 bp, Homo sapiens
cctggccctgcc

SEQ ID NO: 4962677 - DNA, 13 bp, Homo sapiens
cctggccctgccc

SEQ ID NO: 4962678 - DNA, 22 bp, Homo sapiens
cctggcctcaagtgattctcct

SEQ ID NO: 4962679 - DNA, 14 bp, Homo sapiens
cctggcctctgtgc

SEQ ID NO: 4962680 - DNA, 12 bp, Homo sapiens
cctggcctggca

SEQ ID NO: 4962681 - DNA, 17 bp, Homo sapiens
cctggcctggccctgcc

SEQ ID NO: 4962682 - DNA, 20 bp, Homo sapiens
cctggcctggccctgccctg

SEQ ID NO: 4962683 - DNA, 16 bp, Homo sapiens
cctggcctttcctggt

SEQ ID NO: 4962684 - DNA, 22 bp, Homo sapiens
cctggctaataaggctttagtg

SEQ ID NO: 4962685 - DNA, 17 bp, Homo sapiens
cctggctcccacaggcc

SEQ ID NO: 4962686 - DNA, 14 bp, Homo sapiens
cctggctcccatga

SEQ ID NO: 4962687 - DNA, 15 bp, Homo sapiens
cctggctcccatgac

SEQ ID NO: 4962688 - DNA, 21 bp, Homo sapiens
cctggctcccatgaccatact

SEQ ID NO: 4962689 - DNA, 15 bp, Homo sapiens
cctggctcctgaggg

SEQ ID NO: 4962690 - DNA, 17 bp, Homo sapiens
cctggctctgctgtccc

SEQ ID NO: 4962691 - DNA, 13 bp, Homo sapiens
cctggctcttgtg

SEQ ID NO: 4962692 - DNA, 22 bp, Homo sapiens
cctggctctttcgtcacccttg

SEQ ID NO: 4962693 - DNA, 19 bp, Homo sapiens
cctggctgtactgctcagg

SEQ ID NO: 4962694 - DNA, 23 bp, Homo sapiens
cctggctgtttggactttgtata

SEQ ID NO: 4962695 - DNA, 22 bp, Homo sapiens
cctgggaaggcctcttggagac

SEQ ID NO: 4962696 - DNA, 23 bp, Homo sapiens
cctgggacagtttatcatgaagc

SEQ ID NO: 4962697 - DNA, 18 bp, Homo sapiens
cctgggagtgggtggagg

SEQ ID NO: 4962698 - DNA, 18 bp, Homo sapiens
cctgggcagccaggctgc

SEQ ID NO: 4962699 - DNA, 23 bp, Homo sapiens
cctgggcatatccaccacctccc

SEQ ID NO: 4962700 - DNA, 14 bp, Homo sapiens
cctgggccccagct

SEQ ID NO: 4962701 - DNA, 13 bp, Homo sapiens
cctggggcctgag

SEQ ID NO: 4962702 - DNA, 14 bp, Homo sapiens
cctggggcctgaga

SEQ ID NO: 4962703 - DNA, 12 bp, Homo sapiens
cctggggcctgg

SEQ ID NO: 4962704 - DNA, 21 bp, Homo sapiens
cctggggcctggacctgcctc

SEQ ID NO: 4962705 - DNA, 14 bp, Homo sapiens
cctggggcctggca

SEQ ID NO: 4962706 - DNA, 14 bp, Homo sapiens
cctggggctgggcc

SEQ ID NO: 4962707 - DNA, 20 bp, Homo sapiens
cctgggggagttttcctcta

SEQ ID NO: 4962708 - DNA, 15 bp, Homo sapiens
cctgggtcagtctgg

SEQ ID NO: 4962709 - DNA, 20 bp, Homo sapiens
cctgggttccaatcctggct

SEQ ID NO: 4962710 - DNA, 13 bp, Homo sapiens
cctggtactccct

SEQ ID NO: 4962711 - DNA, 20 bp, Homo sapiens
cctggtactccctctcagga

SEQ ID NO: 4962712 - DNA, 20 bp, Homo sapiens
ccttcgatacaccgggcctg

SEQ ID NO: 4962713 - DNA, 18 bp, Homo sapiens
ccttcgggcgtctgtgtg

SEQ ID NO: 4962714 - DNA, 22 bp, Homo sapiens
ccttcgtatcccgagtctggga

SEQ ID NO: 4962715 - DNA, 14 bp, Homo sapiens
ccttctactgagcc

SEQ ID NO: 4962716 - DNA, 21 bp, Homo sapiens
ccttctcctccccacccgccc

SEQ ID NO: 4962717 - DNA, 13 bp, Homo sapiens
ccttctctgaaca

SEQ ID NO: 4962718 - DNA, 21 bp, Homo sapiens
ccttctctgaacacaggcagc

SEQ ID NO: 4962719 - DNA, 22 bp, Homo sapiens
ccttctctgctccaccacatcc

SEQ ID NO: 4962720 - DNA, 19 bp, Homo sapiens
ccttctgacggccctgcaa

SEQ ID NO: 4962721 - DNA, 21 bp, Homo sapiens
ccttctgacggccctgcaatg

SEQ ID NO: 4962722 - DNA, 20 bp, Homo sapiens
ccttctgggcagaccttgac

SEQ ID NO: 4962723 - DNA, 21 bp, Homo sapiens
ccttctgtcctactctgtgtc

SEQ ID NO: 4962724 - DNA, 21 bp, Homo sapiens
ccttctgtggctcacagaacc

SEQ ID NO: 4962725 - DNA, 17 bp, Homo sapiens
ccttcttattatatata

SEQ ID NO: 4962726 - DNA, 16 bp, Homo sapiens
ccttcttccatcccag

SEQ ID NO: 4962727 - DNA, 20 bp, Homo sapiens
ccttctttgataatgttaaa

SEQ ID NO: 4962728 - DNA, 24 bp, Homo sapiens
ccttcttttatgagcagaaggaaa

SEQ ID NO: 4962729 - DNA, 19 bp, Homo sapiens
ccttcttttctcatgtgtt

SEQ ID NO: 4962730 - DNA, 17 bp, Homo sapiens
ccttgaacctgtgagta

SEQ ID NO: 4962731 - DNA, 18 bp, Homo sapiens
ccttgaacctgtgagtaa

SEQ ID NO: 4962732 - DNA, 21 bp, Homo sapiens
ccttgaacctgtgagtaaata

SEQ ID NO: 4962733 - DNA, 15 bp, Homo sapiens
ccttgaatgctgcca

SEQ ID NO: 4962734 - DNA, 17 bp, Homo sapiens
ccttgaatgctgccagt

SEQ ID NO: 4962735 - DNA, 18 bp, Homo sapiens
ccttgaatgctgccagtg

SEQ ID NO: 4962736 - DNA, 17 bp, Homo sapiens
ccttgacagggcacacc

SEQ ID NO: 4962737 - DNA, 15 bp, Homo sapiens
ccttgacatcagttc

SEQ ID NO: 4962738 - DNA, 22 bp, Homo sapiens
ccttgaccttcctctggggctc

SEQ ID NO: 4962739 - DNA, 21 bp, Homo sapiens
ccttgagggtgcttgttccct

SEQ ID NO: 4962740 - DNA, 23 bp, Homo sapiens
ccttgagtggggttatctctgtg

SEQ ID NO: 4962741 - DNA, 11 bp, Homo sapiens
ccttgatcatt

SEQ ID NO: 4962742 - DNA, 13 bp, Homo sapiens
ccttgatcatttt

SEQ ID NO: 4962743 - DNA, 15 bp, Homo sapiens
ccttgatgatttaat

SEQ ID NO: 4962744 - DNA, 18 bp, Homo sapiens
ccttgcagaactgccatt

SEQ ID NO: 4962745 - DNA, 20 bp, Homo sapiens
ccttgcagttcagcaccacc

SEQ ID NO: 4962746 - DNA, 13 bp, Homo sapiens
ccttgccacccca

SEQ ID NO: 4962747 - DNA, 19 bp, Homo sapiens
ccttgccaccccaccctcc

SEQ ID NO: 4962748 - DNA, 23 bp, Homo sapiens
ccttgccatcctaaaagccaccc

SEQ ID NO: 4962749 - DNA, 17 bp, Homo sapiens
ccttgctgtcctgatct

SEQ ID NO: 4962750 - DNA, 18 bp, Homo sapiens
ccttgcttatgacatcac

SEQ ID NO: 4962751 - DNA, 15 bp, Homo sapiens
ccttgcttttccctc

SEQ ID NO: 4962752 - DNA, 16 bp, Homo sapiens
ccttgcttttccctct

SEQ ID NO: 4962753 - DNA, 20 bp, Homo sapiens
ccttgcttttccctcttttc

SEQ ID NO: 4962754 - DNA, 19 bp, Homo sapiens
ccttggagagacacagcgt

SEQ ID NO: 4962755 - DNA, 19 bp, Homo sapiens
ccttggcaggtcctggcca

SEQ ID NO: 4962756 - DNA, 20 bp, Homo sapiens
ccttggccggctgtgctcag

SEQ ID NO: 4962757 - DNA, 15 bp, Homo sapiens
ccttggcctagccca

SEQ ID NO: 4962758 - DNA, 22 bp, Homo sapiens
ccttggcctagcccaccctgct

SEQ ID NO: 4962759 - DNA, 14 bp, Homo sapiens
ccttggcctcagaa

SEQ ID NO: 4962760 - DNA, 23 bp, Homo sapiens
ccttggcctgtctcatccccagg

SEQ ID NO: 4962761 - DNA, 12 bp, Homo sapiens
ccttggctcaga

SEQ ID NO: 4962762 - DNA, 16 bp, Homo sapiens
ccttggctgcagggag

SEQ ID NO: 4962763 - DNA, 21 bp, Homo sapiens
ccttggctgttggcagtgagt

SEQ ID NO: 4962764 - DNA, 17 bp, Homo sapiens
ccttggcttacctgacc

SEQ ID NO: 4962765 - DNA, 22 bp, Homo sapiens
ccttggggaggacaaaacttct

SEQ ID NO: 4962766 - DNA, 21 bp, Homo sapiens
ccttgggtatttgcaatattc

SEQ ID NO: 4962767 - DNA, 14 bp, Homo sapiens
ccttgtccacccac

SEQ ID NO: 4962768 - DNA, 16 bp, Homo sapiens
ccttgtgtatatttgt

SEQ ID NO: 4962769 - DNA, 21 bp, Homo sapiens
cctttaaagatgaactctgaa

SEQ ID NO: 4962770 - DNA, 16 bp, Homo sapiens
cctttacaaaagaaat

SEQ ID NO: 4962771 - DNA, 20 bp, Homo sapiens
cctttactttcccttgcttt

SEQ ID NO: 4962772 - DNA, 19 bp, Homo sapiens
cctttagtacctgaaaagt

SEQ ID NO: 4962773 - DNA, 17 bp, Homo sapiens
cctttagtatcagtgtt

SEQ ID NO: 4962774 - DNA, 18 bp, Homo sapiens
cctttagtatcagtgttt

SEQ ID NO: 4962775 - DNA, 21 bp, Homo sapiens
cctttagtatcagtgttttaa

SEQ ID NO: 4962776 - DNA, 16 bp, Homo sapiens
cctttccaaggcttct

SEQ ID NO: 4962777 - DNA, 16 bp, Homo sapiens
cctttccccagcatca

SEQ ID NO: 4962778 - DNA, 23 bp, Homo sapiens
cctttccccagcatcactcccca

SEQ ID NO: 4962779 - DNA, 13 bp, Homo sapiens
cctttccccagcc

SEQ ID NO: 4962780 - DNA, 16 bp, Homo sapiens
cctttccccagcccag

SEQ ID NO: 4962781 - DNA, 18 bp, Homo sapiens
cctttccccagcccaggg

SEQ ID NO: 4962782 - DNA, 14 bp, Homo sapiens
cctttccctcgcta

SEQ ID NO: 4962783 - DNA, 13 bp, Homo sapiens
cctttcccttcct

SEQ ID NO: 4962784 - DNA, 16 bp, Homo sapiens
cctttcccttcctctt

SEQ ID NO: 4962785 - DNA, 17 bp, Homo sapiens
cctttctctttctctct

SEQ ID NO: 4962786 - DNA, 21 bp, Homo sapiens
cctttctctttctctcttccc

SEQ ID NO: 4962787 - DNA, 14 bp, Homo sapiens
cctttctggctctc

SEQ ID NO: 4962788 - DNA, 13 bp, Homo sapiens
cctttctgtgccc

SEQ ID NO: 4962789 - DNA, 19 bp, Homo sapiens
cctttctgtgccctactca

SEQ ID NO: 4962790 - DNA, 20 bp, Homo sapiens
cctttgaagcctcagctacc

SEQ ID NO: 4962791 - DNA, 13 bp, Homo sapiens
cctttgagacagt

SEQ ID NO: 4962792 - DNA, 19 bp, Homo sapiens
cctttgagacagtttctta

SEQ ID NO: 4962793 - DNA, 13 bp, Homo sapiens
cctttgcagggca

SEQ ID NO: 4962794 - DNA, 18 bp, Homo sapiens
cctttgcagggcagcccc

SEQ ID NO: 4962795 - DNA, 13 bp, Homo sapiens
cctttgctctttc

SEQ ID NO: 4962796 - DNA, 19 bp, Homo sapiens
cctttgctgaggcctccag

SEQ ID NO: 4962797 - DNA, 15 bp, Homo sapiens
cctttggccttggct

SEQ ID NO: 4962798 - DNA, 15 bp, Homo sapiens
cctttggctctggag

SEQ ID NO: 4962799 - DNA, 15 bp, Homo sapiens
cctttggttctggcc

SEQ ID NO: 4962800 - DNA, 19 bp, Homo sapiens
cctttgtgtgtactcactg

SEQ ID NO: 4962801 - DNA, 20 bp, Homo sapiens
cctttgtgtgtactcactga

SEQ ID NO: 4962802 - DNA, 13 bp, Homo sapiens
cctttgtgtttct

SEQ ID NO: 4962803 - DNA, 16 bp, Homo sapiens
ccttttaaagtgtttc

SEQ ID NO: 4962804 - DNA, 15 bp, Homo sapiens
ccttttctattcctt

SEQ ID NO: 4962805 - DNA, 16 bp, Homo sapiens
ccttttcttttgttac

SEQ ID NO: 4962806 - DNA, 17 bp, Homo sapiens
ccttttcttttgttact

SEQ ID NO: 4962807 - DNA, 18 bp, Homo sapiens
ccttttcttttgttactg

SEQ ID NO: 4962808 - DNA, 22 bp, Homo sapiens
ccttttcttttgttactgttct

SEQ ID NO: 4962809 - DNA, 23 bp, Homo sapiens
ccttttgaggagccccagctacc

SEQ ID NO: 4962810 - DNA, 12 bp, Homo sapiens
ccttttgtcttc

SEQ ID NO: 4962811 - DNA, 19 bp, Homo sapiens
ccttttgttgagccaggcc

SEQ ID NO: 4962812 - DNA, 17 bp, Homo sapiens
cctttttaaaacacatg

SEQ ID NO: 4962813 - DNA, 19 bp, Homo sapiens
ccttttttaagatttttct

SEQ ID NO: 4962814 - DNA, 14 bp, Homo sapiens
ccttttttgtagtt

SEQ ID NO: 4962815 - DNA, 23 bp, Homo sapiens
ccttttttgtcccccaacttgag

SEQ ID NO: 4962816 - DNA, 14 bp, Homo sapiens
cctttttttccttt

SEQ ID NO: 4962817 - DNA, 23 bp, Homo sapiens
cgaaacacaaaccacaactgaca

SEQ ID NO: 4962818 - DNA, 13 bp, Homo sapiens
cgaaagctctaga

SEQ ID NO: 4962819 - DNA, 19 bp, Homo sapiens
cgaaagggacttggaagct

SEQ ID NO: 4962820 - DNA, 23 bp, Homo sapiens
cgaaagggacttggaagctccgc

SEQ ID NO: 4962821 - DNA, 16 bp, Homo sapiens
ctaaaaagattagcaa

SEQ ID NO: 4962822 - DNA, 11 bp, Homo sapiens
ctaaaaccatt

SEQ ID NO: 4962823 - DNA, 20 bp, Homo sapiens
ctaaaagaatattcagagaa

SEQ ID NO: 4962824 - DNA, 12 bp, Homo sapiens
ctaaaagcacct

SEQ ID NO: 4962825 - DNA, 15 bp, Homo sapiens
ctaaaagccacccca

SEQ ID NO: 4962826 - DNA, 19 bp, Homo sapiens
ctaaaagtgggcttgattc

SEQ ID NO: 4962827 - DNA, 22 bp, Homo sapiens
ctaaaatacatttaaaacttac

SEQ ID NO: 4962828 - DNA, 14 bp, Homo sapiens
ctaaaatatttatt

SEQ ID NO: 4962829 - DNA, 15 bp, Homo sapiens
ctaaaatatttattt

SEQ ID NO: 4962830 - DNA, 17 bp, Homo sapiens
ctaaaatcttatagttc

SEQ ID NO: 4962831 - DNA, 21 bp, Homo sapiens
ctaaaatcttatagttctagg

SEQ ID NO: 4962832 - DNA, 20 bp, Homo sapiens
ctaaaatgtgatgttctaag

SEQ ID NO: 4962833 - DNA, 19 bp, Homo sapiens
ctaaacaatgctgatttgg

SEQ ID NO: 4962834 - DNA, 15 bp, Homo sapiens
ctaaacccaatccaa

SEQ ID NO: 4962835 - DNA, 19 bp, Homo sapiens
ctaaagatggagtttctaa

SEQ ID NO: 4962836 - DNA, 20 bp, Homo sapiens
ctaaagatggagtttctaag

SEQ ID NO: 4962837 - DNA, 22 bp, Homo sapiens
ctaaagattctatagttctaga

SEQ ID NO: 4962838 - DNA, 15 bp, Homo sapiens
ctaaaggtccacagg

SEQ ID NO: 4962839 - DNA, 20 bp, Homo sapiens
ctaaaggtccacaggtctag

SEQ ID NO: 4962840 - DNA, 21 bp, Homo sapiens
ctaaaggtccacaggtctaga

SEQ ID NO: 4962841 - DNA, 23 bp, Homo sapiens
ctaaaggtccacaggtctagact

SEQ ID NO: 4962842 - DNA, 11 bp, Homo sapiens
ctaaagttcta

SEQ ID NO: 4962843 - DNA, 12 bp, Homo sapiens
ctaaagttctaa

SEQ ID NO: 4962844 - DNA, 14 bp, Homo sapiens
ctaaagttctaaga

SEQ ID NO: 4962845 - DNA, 19 bp, Homo sapiens
ctaaagttctaagattctg

SEQ ID NO: 4962846 - DNA, 21 bp, Homo sapiens
ctaaatatgaaccctttgttt

SEQ ID NO: 4962847 - DNA, 16 bp, Homo sapiens
ctaaatctatttatta

SEQ ID NO: 4962848 - DNA, 19 bp, Homo sapiens
ctaaatctatttattaata

SEQ ID NO: 4962849 - DNA, 22 bp, Homo sapiens
ctaaatgaaaatcgtgacaaca

SEQ ID NO: 4962850 - DNA, 17 bp, Homo sapiens
ctaaatgcctagttttt

SEQ ID NO: 4962851 - DNA, 19 bp, Homo sapiens
ctaaatgccttagaaatgt

SEQ ID NO: 4962852 - DNA, 19 bp, Homo sapiens
ctaaatggtcgcccaggag

SEQ ID NO: 4962853 - DNA, 21 bp, Homo sapiens
ctaaattctttatttctgtca

SEQ ID NO: 4962854 - DNA, 15 bp, Homo sapiens
ctaaatttaaattta

SEQ ID NO: 4962855 - DNA, 17 bp, Homo sapiens
ctaaatttaaatttaaa

SEQ ID NO: 4962856 - DNA, 23 bp, Homo sapiens
ctaaatttgatacttatattttc

SEQ ID NO: 4962857 - DNA, 13 bp, Homo sapiens
ctaaatttgggga

SEQ ID NO: 4962858 - DNA, 23 bp, Homo sapiens
ctaaatttggggacagattcagt

SEQ ID NO: 4962859 - DNA, 16 bp, Homo sapiens
ctaacaaaagatgaaa

SEQ ID NO: 4962860 - DNA, 20 bp, Homo sapiens
ctaacactggcatgttcaaa

SEQ ID NO: 4962861 - DNA, 15 bp, Homo sapiens
ctaacattatttatt

SEQ ID NO: 4962862 - DNA, 12 bp, Homo sapiens
ctaaccacgctg

SEQ ID NO: 4962863 - DNA, 20 bp, Homo sapiens
ctaaccacgtctgtcttcac

SEQ ID NO: 4962864 - DNA, 21 bp, Homo sapiens
ctaaccacgtctgtcttcaca

SEQ ID NO: 4962865 - DNA, 14 bp, Homo sapiens
ctaaccccttccag

SEQ ID NO: 4962866 - DNA, 19 bp, Homo sapiens
ctaaccccttccagatcac

SEQ ID NO: 4962867 - DNA, 15 bp, Homo sapiens
ctaaccttatcctgc

SEQ ID NO: 4962868 - DNA, 22 bp, Homo sapiens
ctaaccttatcctgcattgtta

SEQ ID NO: 4962869 - DNA, 12 bp, Homo sapiens
ctaaccttgaat

SEQ ID NO: 4962870 - DNA, 16 bp, Homo sapiens
ctaaccttgaatgctg

SEQ ID NO: 4962871 - DNA, 19 bp, Homo sapiens
ctaaccttgaatgctgcca

SEQ ID NO: 4962872 - DNA, 20 bp, Homo sapiens
ctaaccttgaatgctgccag

SEQ ID NO: 4962873 - DNA, 15 bp, Homo sapiens
ctaacgtaaatacac

SEQ ID NO: 4962874 - DNA, 17 bp, Homo sapiens
ctaacgttgagcccctg

SEQ ID NO: 4962875 - DNA, 15 bp, Homo sapiens
ctaactagacaccaa

SEQ ID NO: 4962876 - DNA, 17 bp, Homo sapiens
ctaagaaaccctctgtc

SEQ ID NO: 4962877 - DNA, 14 bp, Homo sapiens
ctaagaaacttttg

SEQ ID NO: 4962878 - DNA, 18 bp, Homo sapiens
ctaagaaacttttgtaaa

SEQ ID NO: 4962879 - DNA, 20 bp, Homo sapiens
ctaagaaatatgtgagattt

SEQ ID NO: 4962880 - DNA, 15 bp, Homo sapiens
ctaagaaatattcca

SEQ ID NO: 4962881 - DNA, 18 bp, Homo sapiens
ctaagaagcttctaataa

SEQ ID NO: 4962882 - DNA, 17 bp, Homo sapiens
ctaagaattcaaactgg

SEQ ID NO: 4962883 - DNA, 22 bp, Homo sapiens
ctaagacacaaatgcatgaaca

SEQ ID NO: 4962884 - DNA, 21 bp, Homo sapiens
ctaagacacctgaaccctcca

SEQ ID NO: 4962885 - DNA, 17 bp, Homo sapiens
ctaagactcaaatgttc

SEQ ID NO: 4962886 - DNA, 22 bp, Homo sapiens
ctaagactgtgacaactgtcta

SEQ ID NO: 4962887 - DNA, 19 bp, Homo sapiens
ctaagacttactctaagat

SEQ ID NO: 4962888 - DNA, 22 bp, Homo sapiens
ctaagacttactctaagatctt

SEQ ID NO: 4962889 - DNA, 22 bp, Homo sapiens
ctaagagtgctgggcattttta

SEQ ID NO: 4962890 - DNA, 16 bp, Homo sapiens
ctaagatagtaacaat

SEQ ID NO: 4962891 - DNA, 14 bp, Homo sapiens
ctaagatcttagat

SEQ ID NO: 4962892 - DNA, 20 bp, Homo sapiens
ctaagatcttagattctctg

SEQ ID NO: 4962893 - DNA, 20 bp, Homo sapiens
ctaagatgtgatattctaag

SEQ ID NO: 4962894 - DNA, 23 bp, Homo sapiens
ctaagatgtgatattctaagact

SEQ ID NO: 4962895 - DNA, 14 bp, Homo sapiens
ctaagattctaaag

SEQ ID NO: 4962896 - DNA, 16 bp, Homo sapiens
ctaagattctaaaggt

SEQ ID NO: 4962897 - DNA, 15 bp, Homo sapiens
ctaagattctaatga

SEQ ID NO: 4962898 - DNA, 14 bp, Homo sapiens
ctaagattctagat

SEQ ID NO: 4962899 - DNA, 16 bp, Homo sapiens
ctaagattctagatca

SEQ ID NO: 4962900 - DNA, 12 bp, Homo sapiens
ctaagattctga

SEQ ID NO: 4962901 - DNA, 13 bp, Homo sapiens
ctaagcaatttct

SEQ ID NO: 4962902 - DNA, 15 bp, Homo sapiens
ctaagcatctaagtt

SEQ ID NO: 4962903 - DNA, 15 bp, Homo sapiens
ctaagcattgcctgg

SEQ ID NO: 4962904 - DNA, 13 bp, Homo sapiens
ctaagccagcctg

SEQ ID NO: 4962905 - DNA, 18 bp, Homo sapiens
ctaagccagcctggtcca

SEQ ID NO: 4962906 - DNA, 14 bp, Homo sapiens
ctaagcctacctgc

SEQ ID NO: 4962907 - DNA, 17 bp, Homo sapiens
ctaagcctacctgctct

SEQ ID NO: 4962908 - DNA, 14 bp, Homo sapiens
ctaagctaggaatg

SEQ ID NO: 4962909 - DNA, 12 bp, Homo sapiens
ctaagctgcagc

SEQ ID NO: 4962910 - DNA, 13 bp, Homo sapiens
ctaagctgcagct

SEQ ID NO: 4962911 - DNA, 14 bp, Homo sapiens
ctaagctgcagctt

SEQ ID NO: 4962912 - DNA, 16 bp, Homo sapiens
ctaagctgcagcttcc

SEQ ID NO: 4962913 - DNA, 14 bp, Homo sapiens
ctaaggaaccttcc

SEQ ID NO: 4962914 - DNA, 15 bp, Homo sapiens
ctaaggaaccttcct

SEQ ID NO: 4962915 - DNA, 20 bp, Homo sapiens
ctaaggatagcaccgctttt

SEQ ID NO: 4962916 - DNA, 19 bp, Homo sapiens
ctaaggatgtcacagggcc

SEQ ID NO: 4962917 - DNA, 23 bp, Homo sapiens
ctaaggctctatgagtctagatg

SEQ ID NO: 4962918 - DNA, 14 bp, Homo sapiens
ctaaggctctgaga

SEQ ID NO: 4962919 - DNA, 19 bp, Homo sapiens
ctaagggaagacatttctt

SEQ ID NO: 4962920 - DNA, 18 bp, Homo sapiens
ctaagggtcgaaagctct

SEQ ID NO: 4962921 - DNA, 23 bp, Homo sapiens
ctaagggtcgaaagctctagaat

SEQ ID NO: 4962922 - DNA, 22 bp, Homo sapiens
ctaagggtgggtgctcagaata

SEQ ID NO: 4962923 - DNA, 19 bp, Homo sapiens
ctaaggtccggtgttctaa

SEQ ID NO: 4962924 - DNA, 21 bp, Homo sapiens
ctaaggtccggtgttctaaga

SEQ ID NO: 4962925 - DNA, 16 bp, Homo sapiens
ctaaggtgtgctctga

SEQ ID NO: 4962926 - DNA, 11 bp, Homo sapiens
ctaaggttcta

SEQ ID NO: 4962927 - DNA, 13 bp, Homo sapiens
ctaaggttctaag

SEQ ID NO: 4962928 - DNA, 19 bp, Homo sapiens
ctaagtacacaataagcaa

SEQ ID NO: 4962929 - DNA, 20 bp, Homo sapiens
ctaagtacacaataagcaaa

SEQ ID NO: 4962930 - DNA, 21 bp, Homo sapiens
ctaagtactgtaataatacct

SEQ ID NO: 4962931 - DNA, 22 bp, Homo sapiens
ctagaagtttcccttcctccat

SEQ ID NO: 4962932 - DNA, 20 bp, Homo sapiens
ctagacaagatattgtacat

SEQ ID NO: 4962933 - DNA, 13 bp, Homo sapiens
ctagacacagata

SEQ ID NO: 4962934 - DNA, 15 bp, Homo sapiens
ctagacaccaaagtt

SEQ ID NO: 4962935 - DNA, 16 bp, Homo sapiens
ctagacaccaaagttc

SEQ ID NO: 4962936 - DNA, 21 bp, Homo sapiens
ctagacatggaggttctaagg

SEQ ID NO: 4962937 - DNA, 23 bp, Homo sapiens
ctagacatggaggttctaaggcc

SEQ ID NO: 4962938 - DNA, 13 bp, Homo sapiens
ctagacattacca

SEQ ID NO: 4962939 - DNA, 15 bp, Homo sapiens
ctagactctagacaa

SEQ ID NO: 4962940 - DNA, 14 bp, Homo sapiens
ctagactttctgtt

SEQ ID NO: 4962941 - DNA, 16 bp, Homo sapiens
ctagagaacaggtggt

SEQ ID NO: 4962942 - DNA, 22 bp, Homo sapiens
ctagagcagcccaaatttttct

SEQ ID NO: 4962943 - DNA, 14 bp, Homo sapiens
ctagagccagacca

SEQ ID NO: 4962944 - DNA, 12 bp, Homo sapiens
ctagagcctgcc

SEQ ID NO: 4962945 - DNA, 17 bp, Homo sapiens
ctagagcctgcctggag

SEQ ID NO: 4962946 - DNA, 15 bp, Homo sapiens
ctagagtcctcactc

SEQ ID NO: 4962947 - DNA, 15 bp, Homo sapiens
ctagatcagatgctc

SEQ ID NO: 4962948 - DNA, 18 bp, Homo sapiens
ctagatcataaggcttca

SEQ ID NO: 4962949 - DNA, 23 bp, Homo sapiens
ctagatgagcccagccctgttct

SEQ ID NO: 4962950 - DNA, 20 bp, Homo sapiens
ctagatgattaaataagatt

SEQ ID NO: 4962951 - DNA, 21 bp, Homo sapiens
ctagatgattaaataagattc

SEQ ID NO: 4962952 - DNA, 23 bp, Homo sapiens
ctagatgtttattcttctagagt

SEQ ID NO: 4962953 - DNA, 12 bp, Homo sapiens
ctagattcaaag

SEQ ID NO: 4962954 - DNA, 16 bp, Homo sapiens
ctagcaagctggcctc

SEQ ID NO: 4962955 - DNA, 18 bp, Homo sapiens
ctagcaagtgagagagat

SEQ ID NO: 4962956 - DNA, 19 bp, Homo sapiens
ctagcaagtgagagagatg

SEQ ID NO: 4962957 - DNA, 17 bp, Homo sapiens
ctagcacaatttgcact

SEQ ID NO: 4962958 - DNA, 19 bp, Homo sapiens
ctagcactcattttctata

SEQ ID NO: 4962959 - DNA, 16 bp, Homo sapiens
ctagcagtaaaagatg

SEQ ID NO: 4962960 - DNA, 19 bp, Homo sapiens
ctagccagtgctccaggca

SEQ ID NO: 4962961 - DNA, 15 bp, Homo sapiens
ctagcccaccctgct

SEQ ID NO: 4962962 - DNA, 14 bp, Homo sapiens
ctagcccaggagag

SEQ ID NO: 4962963 - DNA, 16 bp, Homo sapiens
ctagcccaggagagag

SEQ ID NO: 4962964 - DNA, 17 bp, Homo sapiens
ctagcccaggagagaga

SEQ ID NO: 4962965 - DNA, 13 bp, Homo sapiens
ctagccctctcac

SEQ ID NO: 4962966 - DNA, 18 bp, Homo sapiens
ctagccctctcacattta

SEQ ID NO: 4962967 - DNA, 19 bp, Homo sapiens
ctagccctctcacatttat

SEQ ID NO: 4962968 - DNA, 21 bp, Homo sapiens
ctagcctatttacctgcaggc

SEQ ID NO: 4962969 - DNA, 22 bp, Homo sapiens
ctagccttagaagtcacacagt

SEQ ID NO: 4962970 - DNA, 16 bp, Homo sapiens
ctagcctttggctctg

SEQ ID NO: 4962971 - DNA, 20 bp, Homo sapiens
ctagcctttggctctggaga

SEQ ID NO: 4962972 - DNA, 23 bp, Homo sapiens
ctagcctttggctctggagacag

SEQ ID NO: 4962973 - DNA, 20 bp, Homo sapiens
ctagctgcctagcaagctgg

SEQ ID NO: 4962974 - DNA, 21 bp, Homo sapiens
ctagctgcctagcaagctggc

SEQ ID NO: 4962975 - DNA, 14 bp, Homo sapiens
ctagcttttaggaa

SEQ ID NO: 4962976 - DNA, 15 bp, Homo sapiens
ctagcttttaggaaa

SEQ ID NO: 4962977 - DNA, 16 bp, Homo sapiens
ctaggaatgaaatcct

SEQ ID NO: 4962978 - DNA, 19 bp, Homo sapiens
ctaggaccactcagcccct

SEQ ID NO: 4962979 - DNA, 21 bp, Homo sapiens
ctaggaccatggttaagagtc

SEQ ID NO: 4962980 - DNA, 20 bp, Homo sapiens
ctaggagaccaaggcgggag

SEQ ID NO: 4962981 - DNA, 18 bp, Homo sapiens
ctaggagggagacactgg

SEQ ID NO: 4962982 - DNA, 19 bp, Homo sapiens
ctaggagtatatttccgca

SEQ ID NO: 4962983 - DNA, 19 bp, Homo sapiens
ctaggcactgtagttctaa

SEQ ID NO: 4962984 - DNA, 17 bp, Homo sapiens
ctaggcatctctgtact

SEQ ID NO: 4962985 - DNA, 15 bp, Homo sapiens
ctaggctcagcggcg

SEQ ID NO: 4962986 - DNA, 17 bp, Homo sapiens
ctagggattcaggctgc

SEQ ID NO: 4962987 - DNA, 20 bp, Homo sapiens
ctagggattcaggctgcttg

SEQ ID NO: 4962988 - DNA, 15 bp, Homo sapiens
ctaggggtcactgta

SEQ ID NO: 4962989 - DNA, 13 bp, Homo sapiens
ctagggtggccct

SEQ ID NO: 4962990 - DNA, 18 bp, Homo sapiens
ctagggttgctggagcct

SEQ ID NO: 4962991 - DNA, 17 bp, Homo sapiens
ctaggtagaaaaagggt

SEQ ID NO: 4962992 - DNA, 18 bp, Homo sapiens
ctaggtgacagagtgaga

SEQ ID NO: 4962993 - DNA, 24 bp, Homo sapiens
ctaggtgacagagtgagactctgt

SEQ ID NO: 4962994 - DNA, 20 bp, Homo sapiens
ctaggttcccggtcccgagt

SEQ ID NO: 4962995 - DNA, 13 bp, Homo sapiens
ctaggtttcaaag

SEQ ID NO: 4962996 - DNA, 12 bp, Homo sapiens
ctagtacaaatt

SEQ ID NO: 4962997 - DNA, 13 bp, Homo sapiens
ctagtacactttt

SEQ ID NO: 4962998 - DNA, 15 bp, Homo sapiens
ctagtacacttttat

SEQ ID NO: 4962999 - DNA, 12 bp, Homo sapiens
ctagtactgtgt

SEQ ID NO: 4963000 - DNA, 13 bp, Homo sapiens
ctagtatttgaat

SEQ ID NO: 4963001 - DNA, 14 bp, Homo sapiens
ctagtatttgaatt

SEQ ID NO: 4963002 - DNA, 17 bp, Homo sapiens
ctagtcaccccaagtag

SEQ ID NO: 4963003 - DNA, 17 bp, Homo sapiens
ctagtcccttcccctcc

SEQ ID NO: 4963004 - DNA, 22 bp, Homo sapiens
ctagtcccttcccctccctggc

SEQ ID NO: 4963005 - DNA, 23 bp, Homo sapiens
ctagtccggacccacctcacccc

SEQ ID NO: 4963006 - DNA, 16 bp, Homo sapiens
ctagtgagctgggcat

SEQ ID NO: 4963007 - DNA, 14 bp, Homo sapiens
ctagtggtctttgt

SEQ ID NO: 4963008 - DNA, 16 bp, Homo sapiens
ctagtggtctttgtaa

SEQ ID NO: 4963009 - DNA, 17 bp, Homo sapiens
ctagtggtctttgtaag

SEQ ID NO: 4963010 - DNA, 18 bp, Homo sapiens
ctagtggtctttgtaaga

SEQ ID NO: 4963011 - DNA, 20 bp, Homo sapiens
ctagtggtctttgtaagagt

SEQ ID NO: 4963012 - DNA, 22 bp, Homo sapiens
ctagtggtctttgtaagagtgt

SEQ ID NO: 4963013 - DNA, 22 bp, Homo sapiens
ctagttccctctgctcagccaa

SEQ ID NO: 4963014 - DNA, 20 bp, Homo sapiens
ctagttgccaaatctggctc

SEQ ID NO: 4963015 - DNA, 21 bp, Homo sapiens
ctagtttacagaaaaatcttg

SEQ ID NO: 4963016 - DNA, 15 bp, Homo sapiens
ctagtttcctctcct

SEQ ID NO: 4963017 - DNA, 18 bp, Homo sapiens
ctagtttcctctccttcg

SEQ ID NO: 4963018 - DNA, 19 bp, Homo sapiens
ctagttttctcctcccagg

SEQ ID NO: 4963019 - DNA, 19 bp, Homo sapiens
ctagtttttagtaatctgt

SEQ ID NO: 4963020 - DNA, 23 bp, Homo sapiens
ctataaagaagaacttgcatgga

SEQ ID NO: 4963021 - DNA, 12 bp, Homo sapiens
ctataacttgat

SEQ ID NO: 4963022 - DNA, 17 bp, Homo sapiens
ctataacttgatgcatg

SEQ ID NO: 4963023 - DNA, 22 bp, Homo sapiens
ctataacttgatgcatgtggtt

SEQ ID NO: 4963024 - DNA, 14 bp, Homo sapiens
ctataatctgtcaa

SEQ ID NO: 4963025 - DNA, 18 bp, Homo sapiens
ctataatctgtcaaaaca

SEQ ID NO: 4963026 - DNA, 19 bp, Homo sapiens
ctataatctgtcaaaacac

SEQ ID NO: 4963027 - DNA, 15 bp, Homo sapiens
ctatacaactggaca

SEQ ID NO: 4963028 - DNA, 16 bp, Homo sapiens
ctatacatctctcccc

SEQ ID NO: 4963029 - DNA, 11 bp, Homo sapiens
ctatacttgaa

SEQ ID NO: 4963030 - DNA, 14 bp, Homo sapiens
ctatacttgaacaa

SEQ ID NO: 4963031 - DNA, 15 bp, Homo sapiens
ctatacttgaacaaa

SEQ ID NO: 4963032 - DNA, 20 bp, Homo sapiens
ctatagactggaaaaaatga

SEQ ID NO: 4963033 - DNA, 18 bp, Homo sapiens
ctatagcctaggtgacag

SEQ ID NO: 4963034 - DNA, 20 bp, Homo sapiens
ctatagcctaggtgacagag

SEQ ID NO: 4963035 - DNA, 11 bp, Homo sapiens
ctatatacatg

SEQ ID NO: 4963036 - DNA, 16 bp, Homo sapiens
ctatatacatgtgtgt

SEQ ID NO: 4963037 - DNA, 13 bp, Homo sapiens
ctatatatataaa

SEQ ID NO: 4963038 - DNA, 16 bp, Homo sapiens
ctatatatataaatat

SEQ ID NO: 4963039 - DNA, 20 bp, Homo sapiens
ctatatgaatttaaatataa

SEQ ID NO: 4963040 - DNA, 13 bp, Homo sapiens
ctatatggcaaga

SEQ ID NO: 4963041 - DNA, 19 bp, Homo sapiens
ctcaccagccccagtgccc

SEQ ID NO: 4963042 - DNA, 19 bp, Homo sapiens
ctcaccccatcccacaccc

SEQ ID NO: 4963043 - DNA, 21 bp, Homo sapiens
ctcaccccatcccacaccctg

SEQ ID NO: 4963044 - DNA, 13 bp, Homo sapiens
ctcaccccggcag

SEQ ID NO: 4963045 - DNA, 20 bp, Homo sapiens
ctcaccccgttacagctccc

SEQ ID NO: 4963046 - DNA, 18 bp, Homo sapiens
ctcacccctgtcctcact

SEQ ID NO: 4963047 - DNA, 20 bp, Homo sapiens
ctcacccctgtcctcactgc

SEQ ID NO: 4963048 - DNA, 17 bp, Homo sapiens
ctcacctagagccagac

SEQ ID NO: 4963049 - DNA, 19 bp, Homo sapiens
ctcacctagagccagacca

SEQ ID NO: 4963050 - DNA, 14 bp, Homo sapiens
ctcacgctgggtcc

SEQ ID NO: 4963051 - DNA, 16 bp, Homo sapiens
ctcacgtccaggttca

SEQ ID NO: 4963052 - DNA, 18 bp, Homo sapiens
ctcactatgttgcccagg

SEQ ID NO: 4963053 - DNA, 15 bp, Homo sapiens
ctcactcccagtcca

SEQ ID NO: 4963054 - DNA, 23 bp, Homo sapiens
ctcactgaagcctgcgttggtcc

SEQ ID NO: 4963055 - DNA, 12 bp, Homo sapiens
ctcactgcagcc

SEQ ID NO: 4963056 - DNA, 18 bp, Homo sapiens
ctcactgcccgcacaccc

SEQ ID NO: 4963057 - DNA, 19 bp, Homo sapiens
ctcactgcccgcacaccct

SEQ ID NO: 4963058 - DNA, 21 bp, Homo sapiens
ctcactggccatccctcgtgg

SEQ ID NO: 4963059 - DNA, 19 bp, Homo sapiens
ctcactgtgtcacccaggc

SEQ ID NO: 4963060 - DNA, 15 bp, Homo sapiens
ctcactgttgaattt

SEQ ID NO: 4963061 - DNA, 16 bp, Homo sapiens
ctcactgttgcccagg

SEQ ID NO: 4963062 - DNA, 19 bp, Homo sapiens
ctcactgttgcccaggctg

SEQ ID NO: 4963063 - DNA, 20 bp, Homo sapiens
ctcactgttgcccaggctgg

SEQ ID NO: 4963064 - DNA, 21 bp, Homo sapiens
ctcactttttttttttgtttg

SEQ ID NO: 4963065 - DNA, 17 bp, Homo sapiens
ctcagacttttgtacat

SEQ ID NO: 4963066 - DNA, 21 bp, Homo sapiens
ctcagagacctgaagtgtgca

SEQ ID NO: 4963067 - DNA, 20 bp, Homo sapiens
ctcagagatgtgcacccatg

SEQ ID NO: 4963068 - DNA, 19 bp, Homo sapiens
ctcagaggtagggctgcca

SEQ ID NO: 4963069 - DNA, 18 bp, Homo sapiens
ctcagatctgtctgatag

SEQ ID NO: 4963070 - DNA, 17 bp, Homo sapiens
ctcagcatcctggcacc

SEQ ID NO: 4963071 - DNA, 18 bp, Homo sapiens
ctcagcatcctggcaccc

SEQ ID NO: 4963072 - DNA, 15 bp, Homo sapiens
ctcagcatttctttt

SEQ ID NO: 4963073 - DNA, 14 bp, Homo sapiens
ctcagccaagcttg

SEQ ID NO: 4963074 - DNA, 13 bp, Homo sapiens
ctcagcccagaag

SEQ ID NO: 4963075 - DNA, 19 bp, Homo sapiens
ctcagccccgagctgtccc

SEQ ID NO: 4963076 - DNA, 15 bp, Homo sapiens
ctcagcccctaggag

SEQ ID NO: 4963077 - DNA, 19 bp, Homo sapiens
ctcagcctcccgaatagct

SEQ ID NO: 4963078 - DNA, 22 bp, Homo sapiens
ctcagcctcccgaatagctggg

SEQ ID NO: 4963079 - DNA, 15 bp, Homo sapiens
ctcagcctgctgccc

SEQ ID NO: 4963080 - DNA, 16 bp, Homo sapiens
ctcagcctgctgccca

SEQ ID NO: 4963081 - DNA, 14 bp, Homo sapiens
ctcagcgaatgaat

SEQ ID NO: 4963082 - DNA, 15 bp, Homo sapiens
ctcagcggggacagc

SEQ ID NO: 4963083 - DNA, 23 bp, Homo sapiens
ctcagcggggacagctccttctg

SEQ ID NO: 4963084 - DNA, 15 bp, Homo sapiens
ctcagctcagcgcca

SEQ ID NO: 4963085 - DNA, 16 bp, Homo sapiens
ctcagctcagcgccag

SEQ ID NO: 4963086 - DNA, 15 bp, Homo sapiens
ctcagctcccaaggc

SEQ ID NO: 4963087 - DNA, 16 bp, Homo sapiens
ctcagcttcctaccca

SEQ ID NO: 4963088 - DNA, 22 bp, Homo sapiens
ctcagctttgagaagccttcag

SEQ ID NO: 4963089 - DNA, 17 bp, Homo sapiens
ctcaggactgcaacagg

SEQ ID NO: 4963090 - DNA, 19 bp, Homo sapiens
ctcaggactgcaacaggct

SEQ ID NO: 4963091 - DNA, 16 bp, Homo sapiens
ctcaggagcctctgct

SEQ ID NO: 4963092 - DNA, 17 bp, Homo sapiens
ctcaggaggctgaggca

SEQ ID NO: 4963093 - DNA, 20 bp, Homo sapiens
ctcaggaggctgaggcagga

SEQ ID NO: 4963094 - DNA, 22 bp, Homo sapiens
ctcaggaggctgaggcaggagg

SEQ ID NO: 4963095 - DNA, 22 bp, Homo sapiens
ctcaggatatccttatcagagc

SEQ ID NO: 4963096 - DNA, 12 bp, Homo sapiens
ctcaggatccaa

SEQ ID NO: 4963097 - DNA, 20 bp, Homo sapiens
ctcaggatccaagctaagca

SEQ ID NO: 4963098 - DNA, 18 bp, Homo sapiens
ctcaggcactagcctttg

SEQ ID NO: 4963099 - DNA, 19 bp, Homo sapiens
ctcaggcactagcctttgg

SEQ ID NO: 4963100 - DNA, 18 bp, Homo sapiens
ctcaggctgcagctggac

SEQ ID NO: 4963101 - DNA, 20 bp, Homo sapiens
ctcaggctgcagctggacag

SEQ ID NO: 4963102 - DNA, 18 bp, Homo sapiens
ctcagggacagagccatg

SEQ ID NO: 4963103 - DNA, 21 bp, Homo sapiens
ctcagggagcagggaaggcct

SEQ ID NO: 4963104 - DNA, 13 bp, Homo sapiens
ctcaggggcagct

SEQ ID NO: 4963105 - DNA, 20 bp, Homo sapiens
ctcaggggccagaggaactg

SEQ ID NO: 4963106 - DNA, 15 bp, Homo sapiens
ctcagggtgcagagg

SEQ ID NO: 4963107 - DNA, 17 bp, Homo sapiens
ctcaggtccctgcaggg

SEQ ID NO: 4963108 - DNA, 20 bp, Homo sapiens
ctcaggtgatccacccacct

SEQ ID NO: 4963109 - DNA, 14 bp, Homo sapiens
ctcaggttgtctga

SEQ ID NO: 4963110 - DNA, 22 bp, Homo sapiens
ctcaggttgtctgaagtcactg

SEQ ID NO: 4963111 - DNA, 18 bp, Homo sapiens
ctcagtatatttaaactc

SEQ ID NO: 4963112 - DNA, 17 bp, Homo sapiens
ctcagtccatagcagag

SEQ ID NO: 4963113 - DNA, 19 bp, Homo sapiens
ctcagtccatttatatatg

SEQ ID NO: 4963114 - DNA, 17 bp, Homo sapiens
ctcagtcctcccctcac

SEQ ID NO: 4963115 - DNA, 18 bp, Homo sapiens
ctcagtcctcccctcaca

SEQ ID NO: 4963116 - DNA, 23 bp, Homo sapiens
ctcagtcctcccctcacagcctc

SEQ ID NO: 4963117 - DNA, 13 bp, Homo sapiens
ctcagtgccacta

SEQ ID NO: 4963118 - DNA, 14 bp, Homo sapiens
ctcagttcccttgg

SEQ ID NO: 4963119 - DNA, 16 bp, Homo sapiens
ctcagttcccttggcc

SEQ ID NO: 4963120 - DNA, 19 bp, Homo sapiens
ctcagttcccttggcctca

SEQ ID NO: 4963121 - DNA, 22 bp, Homo sapiens
ctcagttcccttggcctcagaa

SEQ ID NO: 4963122 - DNA, 13 bp, Homo sapiens
ctcagttggaaat

SEQ ID NO: 4963123 - DNA, 14 bp, Homo sapiens
ctcagttggaaata

SEQ ID NO: 4963124 - DNA, 21 bp, Homo sapiens
ctcagttggaaataataaaag

SEQ ID NO: 4963125 - DNA, 12 bp, Homo sapiens
ctcataattcct

SEQ ID NO: 4963126 - DNA, 21 bp, Homo sapiens
ctcataattcctacagcacta

SEQ ID NO: 4963127 - DNA, 23 bp, Homo sapiens
ctcatagtatggtggctgggttg

SEQ ID NO: 4963128 - DNA, 12 bp, Homo sapiens
ctcatatttaaa

SEQ ID NO: 4963129 - DNA, 15 bp, Homo sapiens
ctcatatttaaagac

SEQ ID NO: 4963130 - DNA, 21 bp, Homo sapiens
ctcatattttgtatatatctg

SEQ ID NO: 4963131 - DNA, 14 bp, Homo sapiens
ctcatcaacaaaga

SEQ ID NO: 4963132 - DNA, 15 bp, Homo sapiens
ctcatcaacaaagaa

SEQ ID NO: 4963133 - DNA, 17 bp, Homo sapiens
ctcatcaatcaaataag

SEQ ID NO: 4963134 - DNA, 16 bp, Homo sapiens
ctcatccccagtccca

SEQ ID NO: 4963135 - DNA, 15 bp, Homo sapiens
ctcatcctcctggaa

SEQ ID NO: 4963136 - DNA, 15 bp, Homo sapiens
ctcatctatgaggaa

SEQ ID NO: 4963137 - DNA, 19 bp, Homo sapiens
ctcatctgcacccttcttt

SEQ ID NO: 4963138 - DNA, 20 bp, Homo sapiens
ctcatctgcacccttctttt

SEQ ID NO: 4963139 - DNA, 13 bp, Homo sapiens
ctcatcttactgt

SEQ ID NO: 4963140 - DNA, 14 bp, Homo sapiens
ctcatctttttact

SEQ ID NO: 4963141 - DNA, 14 bp, Homo sapiens
ctcatggcccctct

SEQ ID NO: 4963142 - DNA, 15 bp, Homo sapiens
ctcatggcccctctg

SEQ ID NO: 4963143 - DNA, 19 bp, Homo sapiens
ctcatggcccctctgacct

SEQ ID NO: 4963144 - DNA, 16 bp, Homo sapiens
ctcatgtacataccct

SEQ ID NO: 4963145 - DNA, 15 bp, Homo sapiens
ctcatgtgtttgcat

SEQ ID NO: 4963146 - DNA, 13 bp, Homo sapiens
ctcatgtttatga

SEQ ID NO: 4963147 - DNA, 16 bp, Homo sapiens
ctcattactgggcctt

SEQ ID NO: 4963148 - DNA, 18 bp, Homo sapiens
ctcattgacaagaactga

SEQ ID NO: 4963149 - DNA, 15 bp, Homo sapiens
ctcattgctgagcct

SEQ ID NO: 4963150 - DNA, 16 bp, Homo sapiens
ctcattgctgagcctc

SEQ ID NO: 4963151 - DNA, 18 bp, Homo sapiens
ctccctcctcacctctgg

SEQ ID NO: 4963152 - DNA, 19 bp, Homo sapiens
ctccctcctcacctctgga

SEQ ID NO: 4963153 - DNA, 21 bp, Homo sapiens
ctccctcctcacctctggact

SEQ ID NO: 4963154 - DNA, 13 bp, Homo sapiens
ctccctctccctg

SEQ ID NO: 4963155 - DNA, 15 bp, Homo sapiens
ctccctctctcttct

SEQ ID NO: 4963156 - DNA, 20 bp, Homo sapiens
ctccctctctcttctgctcc

SEQ ID NO: 4963157 - DNA, 18 bp, Homo sapiens
ctccctctgtccaccagc

SEQ ID NO: 4963158 - DNA, 17 bp, Homo sapiens
ctccctcttgttttgtt

SEQ ID NO: 4963159 - DNA, 15 bp, Homo sapiens
ctccctgaagccagc

SEQ ID NO: 4963160 - DNA, 17 bp, Homo sapiens
ctccctgaagccagcct

SEQ ID NO: 4963161 - DNA, 19 bp, Homo sapiens
ctccctgccagaggggaag

SEQ ID NO: 4963162 - DNA, 14 bp, Homo sapiens
ctccctgcccaggc

SEQ ID NO: 4963163 - DNA, 17 bp, Homo sapiens
ctccctgcccctccctt

SEQ ID NO: 4963164 - DNA, 11 bp, Homo sapiens
ctccctggctc

SEQ ID NO: 4963165 - DNA, 11 bp, Homo sapiens
ctcccttaccc

SEQ ID NO: 4963166 - DNA, 22 bp, Homo sapiens
ctcccttcaaccattccccatg

SEQ ID NO: 4963167 - DNA, 16 bp, Homo sapiens
ctcccttcagccccca

SEQ ID NO: 4963168 - DNA, 14 bp, Homo sapiens
ctcccttccgaccc

SEQ ID NO: 4963169 - DNA, 17 bp, Homo sapiens
ctcccttccgaccctct

SEQ ID NO: 4963170 - DNA, 19 bp, Homo sapiens
ctcccttccgaccctctgg

SEQ ID NO: 4963171 - DNA, 20 bp, Homo sapiens
ctcccttggtggcaagagcc

SEQ ID NO: 4963172 - DNA, 14 bp, Homo sapiens
ctccctttttatat

SEQ ID NO: 4963173 - DNA, 15 bp, Homo sapiens
ctccgaccagacacc

SEQ ID NO: 4963174 - DNA, 18 bp, Homo sapiens
ctccgaggtggttttaaa

SEQ ID NO: 4963175 - DNA, 16 bp, Homo sapiens
ctccgcccccagccta

SEQ ID NO: 4963176 - DNA, 21 bp, Homo sapiens
ctccgctgccgtgccgcctgc

SEQ ID NO: 4963177 - DNA, 12 bp, Homo sapiens
ctccgctgctcc

SEQ ID NO: 4963178 - DNA, 19 bp, Homo sapiens
ctccgctttctacccagcg

SEQ ID NO: 4963179 - DNA, 22 bp, Homo sapiens
ctccgctttctacccagcgagc

SEQ ID NO: 4963180 - DNA, 23 bp, Homo sapiens
ctccgctttctacccagcgagcc

SEQ ID NO: 4963181 - DNA, 19 bp, Homo sapiens
ctccgtccaggagcctggc

SEQ ID NO: 4963182 - DNA, 20 bp, Homo sapiens
ctcctacaagatttagaaaa

SEQ ID NO: 4963183 - DNA, 17 bp, Homo sapiens
ctcctacctgccctgga

SEQ ID NO: 4963184 - DNA, 18 bp, Homo sapiens
ctcctagagaacgcagcc

SEQ ID NO: 4963185 - DNA, 21 bp, Homo sapiens
ctcctagagaacgcagcccta

SEQ ID NO: 4963186 - DNA, 23 bp, Homo sapiens
ctcctagtttgacctcacagtga

SEQ ID NO: 4963187 - DNA, 17 bp, Homo sapiens
ctcctagtttgggagga

SEQ ID NO: 4963188 - DNA, 18 bp, Homo sapiens
ctcctataatctgtcaaa

SEQ ID NO: 4963189 - DNA, 21 bp, Homo sapiens
ctcctcaatttttgtctcaga

SEQ ID NO: 4963190 - DNA, 14 bp, Homo sapiens
ctcctcacccccag

SEQ ID NO: 4963191 - DNA, 21 bp, Homo sapiens
ctcctcacccccagctttgct

SEQ ID NO: 4963192 - DNA, 15 bp, Homo sapiens
ctcctcactgcccgc

SEQ ID NO: 4963193 - DNA, 16 bp, Homo sapiens
ctcctcactgcccgca

SEQ ID NO: 4963194 - DNA, 14 bp, Homo sapiens
ctcctcactggcca

SEQ ID NO: 4963195 - DNA, 20 bp, Homo sapiens
ctcctcactggccatccctc

SEQ ID NO: 4963196 - DNA, 12 bp, Homo sapiens
ctcctcatcccg

SEQ ID NO: 4963197 - DNA, 15 bp, Homo sapiens
ctcctcatcccgtgt

SEQ ID NO: 4963198 - DNA, 20 bp, Homo sapiens
ctcctcatgtacataccctg

SEQ ID NO: 4963199 - DNA, 14 bp, Homo sapiens
ctcctccaaaggcc

SEQ ID NO: 4963200 - DNA, 18 bp, Homo sapiens
ctcctccaaaggccccct

SEQ ID NO: 4963201 - DNA, 17 bp, Homo sapiens
ctcctcccaggcgcccc

SEQ ID NO: 4963202 - DNA, 19 bp, Homo sapiens
ctcctccccaactgtgggg

SEQ ID NO: 4963203 - DNA, 14 bp, Homo sapiens
ctcctcccggtgcc

SEQ ID NO: 4963204 - DNA, 17 bp, Homo sapiens
ctcctcccggtgcccaa

SEQ ID NO: 4963205 - DNA, 12 bp, Homo sapiens
ctcctcctcgga

SEQ ID NO: 4963206 - DNA, 13 bp, Homo sapiens
ctcctcctctttc

SEQ ID NO: 4963207 - DNA, 14 bp, Homo sapiens
ctcctcctctttct

SEQ ID NO: 4963208 - DNA, 15 bp, Homo sapiens
ctcctcctctttctc

SEQ ID NO: 4963209 - DNA, 19 bp, Homo sapiens
ctcctcctctttctctccc

SEQ ID NO: 4963210 - DNA, 19 bp, Homo sapiens
ctcctccttggtgcctggc

SEQ ID NO: 4963211 - DNA, 19 bp, Homo sapiens
ctcctcggaaccgctcacc

SEQ ID NO: 4963212 - DNA, 13 bp, Homo sapiens
ctcctctccccag

SEQ ID NO: 4963213 - DNA, 22 bp, Homo sapiens
ctcctctccccagcaagtgaga

SEQ ID NO: 4963214 - DNA, 13 bp, Homo sapiens
ctcctctcctgga

SEQ ID NO: 4963215 - DNA, 20 bp, Homo sapiens
ctcctctcctggaggattgc

SEQ ID NO: 4963216 - DNA, 15 bp, Homo sapiens
ctcctctgtccaggc

SEQ ID NO: 4963217 - DNA, 17 bp, Homo sapiens
ctcctctgtcctgcttc

SEQ ID NO: 4963218 - DNA, 19 bp, Homo sapiens
ctcctcttcccccttccaa

SEQ ID NO: 4963219 - DNA, 16 bp, Homo sapiens
ctcctcttgccactgc

SEQ ID NO: 4963220 - DNA, 15 bp, Homo sapiens
ctcctctttaaaaca

SEQ ID NO: 4963221 - DNA, 12 bp, Homo sapiens
ctcctctttctc

SEQ ID NO: 4963222 - DNA, 14 bp, Homo sapiens
ctcctctttctctc

SEQ ID NO: 4963223 - DNA, 21 bp, Homo sapiens
ctcctgaaccgcacagctcag

SEQ ID NO: 4963224 - DNA, 18 bp, Homo sapiens
ctcctgacagaaggtgcc

SEQ ID NO: 4963225 - DNA, 20 bp, Homo sapiens
ctcctgacgtctgaagcttg

SEQ ID NO: 4963226 - DNA, 23 bp, Homo sapiens
ctcctgagggaggacctggggca

SEQ ID NO: 4963227 - DNA, 19 bp, Homo sapiens
ctcctgaggggcatctgcc

SEQ ID NO: 4963228 - DNA, 21 bp, Homo sapiens
ctcctgaggggcatctgcccc

SEQ ID NO: 4963229 - DNA, 22 bp, Homo sapiens
ctcctgaggggcatctgcccct

SEQ ID NO: 4963230 - DNA, 14 bp, Homo sapiens
ctcctgcagcatgg

SEQ ID NO: 4963231 - DNA, 18 bp, Homo sapiens
ctcctgccagtgtggaac

SEQ ID NO: 4963232 - DNA, 23 bp, Homo sapiens
ctcctgcctagctgcctagcaag

SEQ ID NO: 4963233 - DNA, 14 bp, Homo sapiens
ctcctgcctcagcc

SEQ ID NO: 4963234 - DNA, 15 bp, Homo sapiens
ctcctgcctcagcct

SEQ ID NO: 4963235 - DNA, 18 bp, Homo sapiens
ctcctgcctcgaactggc

SEQ ID NO: 4963236 - DNA, 20 bp, Homo sapiens
ctcctgcctcgaactggctg

SEQ ID NO: 4963237 - DNA, 14 bp, Homo sapiens
ctcctgcctgtagc

SEQ ID NO: 4963238 - DNA, 14 bp, Homo sapiens
ctcctgcctgtgct

SEQ ID NO: 4963239 - DNA, 18 bp, Homo sapiens
ctcctgcctgtgctgtga

SEQ ID NO: 4963240 - DNA, 21 bp, Homo sapiens
ctcctggaaccttgctgtcct

SEQ ID NO: 4963241 - DNA, 23 bp, Homo sapiens
ctcctggaaccttgctgtcctga

SEQ ID NO: 4963242 - DNA, 23 bp, Homo sapiens
ctcctggcctttcctggttttca

SEQ ID NO: 4963243 - DNA, 22 bp, Homo sapiens
ctcctggctcttgatacccccc

SEQ ID NO: 4963244 - DNA, 16 bp, Homo sapiens
ctcctggggcgtccag

SEQ ID NO: 4963245 - DNA, 14 bp, Homo sapiens
ctcctgggggttct

SEQ ID NO: 4963246 - DNA, 20 bp, Homo sapiens
ctcctgggggttctttcttc

SEQ ID NO: 4963247 - DNA, 20 bp, Homo sapiens
ctcctgtaagccaaagaaat

SEQ ID NO: 4963248 - DNA, 20 bp, Homo sapiens
ctcctgtccatcagccagga

SEQ ID NO: 4963249 - DNA, 20 bp, Homo sapiens
ctcctgtcctcccatcccct

SEQ ID NO: 4963250 - DNA, 13 bp, Homo sapiens
ctcctgtgctggg

SEQ ID NO: 4963251 - DNA, 14 bp, Homo sapiens
ctcctgtgtgtgcg

SEQ ID NO: 4963252 - DNA, 24 bp, Homo sapiens
ctcctgtgtgtgcgcctacaggag

SEQ ID NO: 4963253 - DNA, 12 bp, Homo sapiens
ctccttcagaca

SEQ ID NO: 4963254 - DNA, 16 bp, Homo sapiens
ctccttcccatcgctg

SEQ ID NO: 4963255 - DNA, 20 bp, Homo sapiens
ctccttggcttacctgacct

SEQ ID NO: 4963256 - DNA, 14 bp, Homo sapiens
ctccttggtgcctg

SEQ ID NO: 4963257 - DNA, 22 bp, Homo sapiens
ctccttggtgcctggcctggca

SEQ ID NO: 4963258 - DNA, 16 bp, Homo sapiens
ctccttgtccacccac

SEQ ID NO: 4963259 - DNA, 14 bp, Homo sapiens
ctcctttcagggcc

SEQ ID NO: 4963260 - DNA, 13 bp, Homo sapiens
ctcctttctgtgc

SEQ ID NO: 4963261 - DNA, 20 bp, Homo sapiens
ctctgacttaagcaaaagaa

SEQ ID NO: 4963262 - DNA, 15 bp, Homo sapiens
ctctgagagtctaga

SEQ ID NO: 4963263 - DNA, 22 bp, Homo sapiens
ctctgagatctaaggatgtcac

SEQ ID NO: 4963264 - DNA, 13 bp, Homo sapiens
ctctgagcccatg

SEQ ID NO: 4963265 - DNA, 21 bp, Homo sapiens
ctctgagcccatgttctgccc

SEQ ID NO: 4963266 - DNA, 22 bp, Homo sapiens
ctctgagcccatgttctgcccc

SEQ ID NO: 4963267 - DNA, 13 bp, Homo sapiens
ctctgatatggga

SEQ ID NO: 4963268 - DNA, 14 bp, Homo sapiens
ctctgatatgggac

SEQ ID NO: 4963269 - DNA, 18 bp, Homo sapiens
ctctgattttcaaagctt

SEQ ID NO: 4963270 - DNA, 17 bp, Homo sapiens
ctctgcaatgggcactg

SEQ ID NO: 4963271 - DNA, 16 bp, Homo sapiens
ctctgcaattcccctc

SEQ ID NO: 4963272 - DNA, 17 bp, Homo sapiens
ctctgcaattcccctct

SEQ ID NO: 4963273 - DNA, 20 bp, Homo sapiens
ctctgcaattcccctctgct

SEQ ID NO: 4963274 - DNA, 21 bp, Homo sapiens
ctctgcaattcccctctgctg

SEQ ID NO: 4963275 - DNA, 23 bp, Homo sapiens
ctctgcaattcccctctgctgct

SEQ ID NO: 4963276 - DNA, 13 bp, Homo sapiens
ctctgcacatgtc

SEQ ID NO: 4963277 - DNA, 15 bp, Homo sapiens
ctctgcacatgtctt

SEQ ID NO: 4963278 - DNA, 13 bp, Homo sapiens
ctctgcacccctc

SEQ ID NO: 4963279 - DNA, 16 bp, Homo sapiens
ctctgcagactgctag

SEQ ID NO: 4963280 - DNA, 11 bp, Homo sapiens
ctctgcagctg

SEQ ID NO: 4963281 - DNA, 14 bp, Homo sapiens
ctctgccacactct

SEQ ID NO: 4963282 - DNA, 16 bp, Homo sapiens
ctctgccaccagagac

SEQ ID NO: 4963283 - DNA, 17 bp, Homo sapiens
ctctgccaccagagacc

SEQ ID NO: 4963284 - DNA, 18 bp, Homo sapiens
ctctgccaccagagaccg

SEQ ID NO: 4963285 - DNA, 23 bp, Homo sapiens
ctctgccaccagagaccgtcctc

SEQ ID NO: 4963286 - DNA, 15 bp, Homo sapiens
ctctgccagggcagt

SEQ ID NO: 4963287 - DNA, 19 bp, Homo sapiens
ctctgccagggcagtgcta

SEQ ID NO: 4963288 - DNA, 13 bp, Homo sapiens
ctctgccccagtc

SEQ ID NO: 4963289 - DNA, 17 bp, Homo sapiens
ctctgccccagtcgtta

SEQ ID NO: 4963290 - DNA, 12 bp, Homo sapiens
ctctgccccctg

SEQ ID NO: 4963291 - DNA, 19 bp, Homo sapiens
ctctgcctcaccgcttccc

SEQ ID NO: 4963292 - DNA, 22 bp, Homo sapiens
ctctgcctgaagtcacacagtg

SEQ ID NO: 4963293 - DNA, 15 bp, Homo sapiens
ctctgcctttgacat

SEQ ID NO: 4963294 - DNA, 15 bp, Homo sapiens
ctctgcggaccccag

SEQ ID NO: 4963295 - DNA, 13 bp, Homo sapiens
ctctgctccacca

SEQ ID NO: 4963296 - DNA, 14 bp, Homo sapiens
ctctgctccaccac

SEQ ID NO: 4963297 - DNA, 19 bp, Homo sapiens
ctctgctccaccacatcct

SEQ ID NO: 4963298 - DNA, 18 bp, Homo sapiens
ctctgctcctctccccag

SEQ ID NO: 4963299 - DNA, 17 bp, Homo sapiens
ctctgctcgccctcctt

SEQ ID NO: 4963300 - DNA, 20 bp, Homo sapiens
ctctgctcgccctcctttct

SEQ ID NO: 4963301 - DNA, 17 bp, Homo sapiens
ctctgctgacagacaca

SEQ ID NO: 4963302 - DNA, 22 bp, Homo sapiens
ctctgctgacagacacaggccc

SEQ ID NO: 4963303 - DNA, 23 bp, Homo sapiens
ctctgctgacagacacaggcccg

SEQ ID NO: 4963304 - DNA, 22 bp, Homo sapiens
ctctgctgctgtccctccccct

SEQ ID NO: 4963305 - DNA, 23 bp, Homo sapiens
ctctgctgtacatatttgagact

SEQ ID NO: 4963306 - DNA, 17 bp, Homo sapiens
ctctgcttctctcacct

SEQ ID NO: 4963307 - DNA, 16 bp, Homo sapiens
ctctggacaaagcgtt

SEQ ID NO: 4963308 - DNA, 14 bp, Homo sapiens
ctctggacaggcat

SEQ ID NO: 4963309 - DNA, 14 bp, Homo sapiens
ctctggactggcta

SEQ ID NO: 4963310 - DNA, 15 bp, Homo sapiens
ctctggactggctag

SEQ ID NO: 4963311 - DNA, 19 bp, Homo sapiens
ctctggactggctagagtc

SEQ ID NO: 4963312 - DNA, 15 bp, Homo sapiens
ctctggagacagccc

SEQ ID NO: 4963313 - DNA, 13 bp, Homo sapiens
ctctggagcccta

SEQ ID NO: 4963314 - DNA, 19 bp, Homo sapiens
ctctggcattagaattatt

SEQ ID NO: 4963315 - DNA, 19 bp, Homo sapiens
ctctggctagaggccagcc

SEQ ID NO: 4963316 - DNA, 15 bp, Homo sapiens
ctctgggaacctccc

SEQ ID NO: 4963317 - DNA, 17 bp, Homo sapiens
ctctgggaacctcccag

SEQ ID NO: 4963318 - DNA, 19 bp, Homo sapiens
ctctgggaacctcccagag

SEQ ID NO: 4963319 - DNA, 16 bp, Homo sapiens
ctctgggctatggaca

SEQ ID NO: 4963320 - DNA, 17 bp, Homo sapiens
ctctgggctatggacac

SEQ ID NO: 4963321 - DNA, 14 bp, Homo sapiens
ctctggtgcctcca

SEQ ID NO: 4963322 - DNA, 14 bp, Homo sapiens
ctctggtttctcat

SEQ ID NO: 4963323 - DNA, 23 bp, Homo sapiens
ctctgtaaaaacactgaaaaatt

SEQ ID NO: 4963324 - DNA, 15 bp, Homo sapiens
ctctgtcaatgaaaa

SEQ ID NO: 4963325 - DNA, 12 bp, Homo sapiens
ctctgtccaggc

SEQ ID NO: 4963326 - DNA, 15 bp, Homo sapiens
ctctgtcctgggagt

SEQ ID NO: 4963327 - DNA, 13 bp, Homo sapiens
ctctgtcgcccag

SEQ ID NO: 4963328 - DNA, 18 bp, Homo sapiens
ctctgtcgcccagtctgg

SEQ ID NO: 4963329 - DNA, 22 bp, Homo sapiens
ctctgtctcagacttttgtaca

SEQ ID NO: 4963330 - DNA, 14 bp, Homo sapiens
ctctgtctgccctt

SEQ ID NO: 4963331 - DNA, 14 bp, Homo sapiens
ctctgtgacctcag

SEQ ID NO: 4963332 - DNA, 16 bp, Homo sapiens
ctctgtgacctcaggc

SEQ ID NO: 4963333 - DNA, 14 bp, Homo sapiens
ctctgtgctgacat

SEQ ID NO: 4963334 - DNA, 19 bp, Homo sapiens
ctctgtggcattgaaatga

SEQ ID NO: 4963335 - DNA, 19 bp, Homo sapiens
ctctgtgtcaggtggggca

SEQ ID NO: 4963336 - DNA, 21 bp, Homo sapiens
ctctgtgtcaggtggggcagc

SEQ ID NO: 4963337 - DNA, 19 bp, Homo sapiens
ctctgtgtctaagattcta

SEQ ID NO: 4963338 - DNA, 21 bp, Homo sapiens
ctctgtgtctaagattctaga

SEQ ID NO: 4963339 - DNA, 23 bp, Homo sapiens
ctctgtgtctaagattctagatc

SEQ ID NO: 4963340 - DNA, 15 bp, Homo sapiens
ctctgtgtgcacaaa

SEQ ID NO: 4963341 - DNA, 17 bp, Homo sapiens
ctcttaaacttgtgaat

SEQ ID NO: 4963342 - DNA, 22 bp, Homo sapiens
ctcttaaagttggaatttacca

SEQ ID NO: 4963343 - DNA, 13 bp, Homo sapiens
ctcttagctgtct

SEQ ID NO: 4963344 - DNA, 15 bp, Homo sapiens
ctcttatctcagtca

SEQ ID NO: 4963345 - DNA, 21 bp, Homo sapiens
ctcttatctcagtcatgcata

SEQ ID NO: 4963346 - DNA, 16 bp, Homo sapiens
ctcttcaaaaactgtt

SEQ ID NO: 4963347 - DNA, 16 bp, Homo sapiens
ctcttcaccccccact

SEQ ID NO: 4963348 - DNA, 17 bp, Homo sapiens
ctcttcaccccccactc

SEQ ID NO: 4963349 - DNA, 18 bp, Homo sapiens
ctcttcaccccccactca

SEQ ID NO: 4963350 - DNA, 16 bp, Homo sapiens
ctcttcaccccggcag

SEQ ID NO: 4963351 - DNA, 18 bp, Homo sapiens
ctcttcaccccggcaggc

SEQ ID NO: 4963352 - DNA, 13 bp, Homo sapiens
ctcttcaggcctc

SEQ ID NO: 4963353 - DNA, 17 bp, Homo sapiens
ctcttcaggcctccctc

SEQ ID NO: 4963354 - DNA, 20 bp, Homo sapiens
ctcttcaggcctccctctct

SEQ ID NO: 4963355 - DNA, 16 bp, Homo sapiens
ctcttcccccttccaa

SEQ ID NO: 4963356 - DNA, 14 bp, Homo sapiens
ctcttccctttccc

SEQ ID NO: 4963357 - DNA, 21 bp, Homo sapiens
ctcttccctttccccagcatc

SEQ ID NO: 4963358 - DNA, 20 bp, Homo sapiens
ctcttccgtgacgtcactgg

SEQ ID NO: 4963359 - DNA, 12 bp, Homo sapiens
ctcttcctgccc

SEQ ID NO: 4963360 - DNA, 17 bp, Homo sapiens
ctcttcctgcccctctt

SEQ ID NO: 4963361 - DNA, 13 bp, Homo sapiens
ctcttcctgtgat

SEQ ID NO: 4963362 - DNA, 23 bp, Homo sapiens
ctcttcgcgcccgcccctgcagc

SEQ ID NO: 4963363 - DNA, 17 bp, Homo sapiens
ctcttctccactggatg

SEQ ID NO: 4963364 - DNA, 16 bp, Homo sapiens
ctcttctccaggctgt

SEQ ID NO: 4963365 - DNA, 21 bp, Homo sapiens
ctcttctcccagaatcccagc

SEQ ID NO: 4963366 - DNA, 13 bp, Homo sapiens
ctcttctcctttc

SEQ ID NO: 4963367 - DNA, 18 bp, Homo sapiens
ctcttctgctccaccctt

SEQ ID NO: 4963368 - DNA, 20 bp, Homo sapiens
ctcttctgctccacccttgg

SEQ ID NO: 4963369 - DNA, 21 bp, Homo sapiens
ctcttctgctccacccttggc

SEQ ID NO: 4963370 - DNA, 11 bp, Homo sapiens
ctcttctggct

SEQ ID NO: 4963371 - DNA, 21 bp, Homo sapiens
ctcttctttatactgtaattt

SEQ ID NO: 4963372 - DNA, 22 bp, Homo sapiens
ctcttctttatactgtaattta

SEQ ID NO: 4963373 - DNA, 16 bp, Homo sapiens
ctcttcttttggcttc

SEQ ID NO: 4963374 - DNA, 19 bp, Homo sapiens
ctcttcttttggcttccat

SEQ ID NO: 4963375 - DNA, 16 bp, Homo sapiens
ctcttgccactgcctc

SEQ ID NO: 4963376 - DNA, 18 bp, Homo sapiens
ctcttgccactgcctctt

SEQ ID NO: 4963377 - DNA, 16 bp, Homo sapiens
ctcttgccgaggagcc

SEQ ID NO: 4963378 - DNA, 20 bp, Homo sapiens
ctcttgccgaggagccaggc

SEQ ID NO: 4963379 - DNA, 12 bp, Homo sapiens
ctcttgctgtct

SEQ ID NO: 4963380 - DNA, 15 bp, Homo sapiens
ctcttgctgtctctg

SEQ ID NO: 4963381 - DNA, 18 bp, Homo sapiens
ctcttgctgtctctgctc

SEQ ID NO: 4963382 - DNA, 18 bp, Homo sapiens
ctcttggagaccttaccc

SEQ ID NO: 4963383 - DNA, 19 bp, Homo sapiens
ctcttgggttcaagcgatt

SEQ ID NO: 4963384 - DNA, 21 bp, Homo sapiens
ctcttgtataagatcctagat

SEQ ID NO: 4963385 - DNA, 22 bp, Homo sapiens
ctcttgtcctcagtccatttat

SEQ ID NO: 4963386 - DNA, 23 bp, Homo sapiens
ctcttgtgctggatggagcccag

SEQ ID NO: 4963387 - DNA, 19 bp, Homo sapiens
ctctttaagggcatgcctt

SEQ ID NO: 4963388 - DNA, 20 bp, Homo sapiens
ctctttaatgtcacaggcag

SEQ ID NO: 4963389 - DNA, 13 bp, Homo sapiens
ctctttatagtgc

SEQ ID NO: 4963390 - DNA, 15 bp, Homo sapiens
ctctttcgtcaccct

SEQ ID NO: 4963391 - DNA, 18 bp, Homo sapiens
ctctttcgtcacccttgg

SEQ ID NO: 4963392 - DNA, 14 bp, Homo sapiens
ctctttctctcttc

SEQ ID NO: 4963393 - DNA, 11 bp, Homo sapiens
ctctttctgta

SEQ ID NO: 4963394 - DNA, 13 bp, Homo sapiens
ctctttcttcctt

SEQ ID NO: 4963395 - DNA, 14 bp, Homo sapiens
ctcttttcaaaaca

SEQ ID NO: 4963396 - DNA, 18 bp, Homo sapiens
ctcttttcttactcctcc

SEQ ID NO: 4963397 - DNA, 19 bp, Homo sapiens
ctcttttgttaaataatat

SEQ ID NO: 4963398 - DNA, 18 bp, Homo sapiens
ctctttttagggccaggc

SEQ ID NO: 4963399 - DNA, 15 bp, Homo sapiens
ctcttttttactcat

SEQ ID NO: 4963400 - DNA, 16 bp, Homo sapiens
ctcttttttactcatt

SEQ ID NO: 4963401 - DNA, 17 bp, Homo sapiens
ctcttttttgtttgttt

SEQ ID NO: 4963402 - DNA, 20 bp, Homo sapiens
ctgaaaaaaagtttacaagt

SEQ ID NO: 4963403 - DNA, 21 bp, Homo sapiens
ctgaaaaatggtaattgttgc

SEQ ID NO: 4963404 - DNA, 18 bp, Homo sapiens
ctgaaaaccatctggcct

SEQ ID NO: 4963405 - DNA, 20 bp, Homo sapiens
ctgaaaaccatctggcctgg

SEQ ID NO: 4963406 - DNA, 21 bp, Homo sapiens
ctgaaaaccatctggcctggc

SEQ ID NO: 4963407 - DNA, 19 bp, Homo sapiens
ctgaaaacctaagtccttt

SEQ ID NO: 4963408 - DNA, 23 bp, Homo sapiens
ctgaaaactggaataagaagcaa

SEQ ID NO: 4963409 - DNA, 21 bp, Homo sapiens
ctgaaacttgctgagctgttt

SEQ ID NO: 4963410 - DNA, 13 bp, Homo sapiens
ctgaaagttaccc

SEQ ID NO: 4963411 - DNA, 14 bp, Homo sapiens
ctgaaatctccttt

SEQ ID NO: 4963412 - DNA, 14 bp, Homo sapiens
ctgaaattccaaag

SEQ ID NO: 4963413 - DNA, 16 bp, Homo sapiens
ctgaacaaaaaataaa

SEQ ID NO: 4963414 - DNA, 12 bp, Homo sapiens
ctgaacaagaat

SEQ ID NO: 4963415 - DNA, 21 bp, Homo sapiens
ctgaacaataggctgttccca

SEQ ID NO: 4963416 - DNA, 15 bp, Homo sapiens
ctgaacacaggcagc

SEQ ID NO: 4963417 - DNA, 18 bp, Homo sapiens
ctgaaccgcacagctcag

SEQ ID NO: 4963418 - DNA, 19 bp, Homo sapiens
ctgaaccgcacagctcagg

SEQ ID NO: 4963419 - DNA, 20 bp, Homo sapiens
ctgaaccgcacagctcagga

SEQ ID NO: 4963420 - DNA, 13 bp, Homo sapiens
ctgaactcacttt

SEQ ID NO: 4963421 - DNA, 17 bp, Homo sapiens
ctgaagaattaagatac

SEQ ID NO: 4963422 - DNA, 21 bp, Homo sapiens
ctgaagactcattcttctgta

SEQ ID NO: 4963423 - DNA, 15 bp, Homo sapiens
ctgaagactgaggac

SEQ ID NO: 4963424 - DNA, 22 bp, Homo sapiens
ctgaagagacagttatttatag

SEQ ID NO: 4963425 - DNA, 16 bp, Homo sapiens
ctgaagatgcagctca

SEQ ID NO: 4963426 - DNA, 18 bp, Homo sapiens
ctgaagcatgtttcatgt

SEQ ID NO: 4963427 - DNA, 21 bp, Homo sapiens
ctgaagccctcccaggtgtta

SEQ ID NO: 4963428 - DNA, 15 bp, Homo sapiens
ctgaagcctctggga

SEQ ID NO: 4963429 - DNA, 14 bp, Homo sapiens
ctgaagcttgactc

SEQ ID NO: 4963430 - DNA, 15 bp, Homo sapiens
ctgaagcttgactcc

SEQ ID NO: 4963431 - DNA, 21 bp, Homo sapiens
ctgaaggacattgcggacagc

SEQ ID NO: 4963432 - DNA, 18 bp, Homo sapiens
ctgaagggcattctttcc

SEQ ID NO: 4963433 - DNA, 14 bp, Homo sapiens
ctgaagtcacacag

SEQ ID NO: 4963434 - DNA, 16 bp, Homo sapiens
ctgaagtcacacagtg

SEQ ID NO: 4963435 - DNA, 18 bp, Homo sapiens
ctgaagtcacacagtgag

SEQ ID NO: 4963436 - DNA, 21 bp, Homo sapiens
ctgaagtcacacagtgagtcg

SEQ ID NO: 4963437 - DNA, 21 bp, Homo sapiens
ctgaagtcacatcacaggaca

SEQ ID NO: 4963438 - DNA, 22 bp, Homo sapiens
ctgaagtcacatcacaggacac

SEQ ID NO: 4963439 - DNA, 18 bp, Homo sapiens
ctgaagtgagcacagcct

SEQ ID NO: 4963440 - DNA, 21 bp, Homo sapiens
ctgaagtgagcacagcctagg

SEQ ID NO: 4963441 - DNA, 12 bp, Homo sapiens
ctgaataaatgg

SEQ ID NO: 4963442 - DNA, 15 bp, Homo sapiens
ctgaatagaaatggg

SEQ ID NO: 4963443 - DNA, 19 bp, Homo sapiens
ctgaatcccccttgccacc

SEQ ID NO: 4963444 - DNA, 20 bp, Homo sapiens
ctgaatcccccttgccaccc

SEQ ID NO: 4963445 - DNA, 18 bp, Homo sapiens
ctgaatgcctcctgtggg

SEQ ID NO: 4963446 - DNA, 20 bp, Homo sapiens
ctgaatgcctcctgtgggga

SEQ ID NO: 4963447 - DNA, 22 bp, Homo sapiens
ctgaatgtttaaagatcatgac

SEQ ID NO: 4963448 - DNA, 19 bp, Homo sapiens
ctgaatgtttattccttga

SEQ ID NO: 4963449 - DNA, 21 bp, Homo sapiens
ctgaatttggcctgcactaat

SEQ ID NO: 4963450 - DNA, 13 bp, Homo sapiens
ctgacaagggctg

SEQ ID NO: 4963451 - DNA, 12 bp, Homo sapiens
ctgacacaaagg

SEQ ID NO: 4963452 - DNA, 19 bp, Homo sapiens
ctgacacacagctctgtcc

SEQ ID NO: 4963453 - DNA, 22 bp, Homo sapiens
ctgacacacagctctgtcctgg

SEQ ID NO: 4963454 - DNA, 14 bp, Homo sapiens
ctgacagaaggact

SEQ ID NO: 4963455 - DNA, 16 bp, Homo sapiens
ctgacagaaggtgcca

SEQ ID NO: 4963456 - DNA, 16 bp, Homo sapiens
ctgacagacacaggcc

SEQ ID NO: 4963457 - DNA, 18 bp, Homo sapiens
ctgacagacacaggcccg

SEQ ID NO: 4963458 - DNA, 18 bp, Homo sapiens
ctgacagcatgtgccctc

SEQ ID NO: 4963459 - DNA, 12 bp, Homo sapiens
ctgacagcctcc

SEQ ID NO: 4963460 - DNA, 13 bp, Homo sapiens
ctgacagcctccc

SEQ ID NO: 4963461 - DNA, 20 bp, Homo sapiens
ctgacagcctcccaccccca

SEQ ID NO: 4963462 - DNA, 16 bp, Homo sapiens
ctgacaggcaatgctg

SEQ ID NO: 4963463 - DNA, 20 bp, Homo sapiens
ctgacaggcaatgctggctg

SEQ ID NO: 4963464 - DNA, 15 bp, Homo sapiens
ctgacagtcttgtgc

SEQ ID NO: 4963465 - DNA, 19 bp, Homo sapiens
ctgacatggctctggactc

SEQ ID NO: 4963466 - DNA, 17 bp, Homo sapiens
ctgacattgttggccaa

SEQ ID NO: 4963467 - DNA, 21 bp, Homo sapiens
ctgacattgttggccaaagcc

SEQ ID NO: 4963468 - DNA, 12 bp, Homo sapiens
ctgaccaacagg

SEQ ID NO: 4963469 - DNA, 14 bp, Homo sapiens
ctgaccaattgtgc

SEQ ID NO: 4963470 - DNA, 22 bp, Homo sapiens
ctgaccaattgtgctgccattt

SEQ ID NO: 4963471 - DNA, 23 bp, Homo sapiens
ctgaccagcctccatgctgcctc

SEQ ID NO: 4963472 - DNA, 22 bp, Homo sapiens
ctgaccatattgtgcttcacag

SEQ ID NO: 4963473 - DNA, 22 bp, Homo sapiens
ctgaccatccactctaccctcc

SEQ ID NO: 4963474 - DNA, 23 bp, Homo sapiens
ctgaccatccactctaccctccc

SEQ ID NO: 4963475 - DNA, 13 bp, Homo sapiens
ctgacccactgct

SEQ ID NO: 4963476 - DNA, 14 bp, Homo sapiens
ctgacccactgctt

SEQ ID NO: 4963477 - DNA, 15 bp, Homo sapiens
ctgacccctcctcac

SEQ ID NO: 4963478 - DNA, 15 bp, Homo sapiens
ctgacccttccagac

SEQ ID NO: 4963479 - DNA, 17 bp, Homo sapiens
ctgacctcaagtgatct

SEQ ID NO: 4963480 - DNA, 24 bp, Homo sapiens
ctgcaattcaaaagttccaagagt

SEQ ID NO: 4963481 - DNA, 17 bp, Homo sapiens
ctgcaattcccctctgc

SEQ ID NO: 4963482 - DNA, 18 bp, Homo sapiens
ctgcaatttcatatgctg

SEQ ID NO: 4963483 - DNA, 14 bp, Homo sapiens
ctgcaattttctaa

SEQ ID NO: 4963484 - DNA, 13 bp, Homo sapiens
ctgcacaaagccc

SEQ ID NO: 4963485 - DNA, 18 bp, Homo sapiens
ctgcacaaagcccttcca

SEQ ID NO: 4963486 - DNA, 23 bp, Homo sapiens
ctgcacatgtcttgtacatgtgt

SEQ ID NO: 4963487 - DNA, 18 bp, Homo sapiens
ctgcacccttcttttctc

SEQ ID NO: 4963488 - DNA, 19 bp, Homo sapiens
ctgcacccttcttttctca

SEQ ID NO: 4963489 - DNA, 22 bp, Homo sapiens
ctgcacccttcttttctcatgt

SEQ ID NO: 4963490 - DNA, 20 bp, Homo sapiens
ctgcaccgggccacagagaa

SEQ ID NO: 4963491 - DNA, 22 bp, Homo sapiens
ctgcactaaagccagcctgacc

SEQ ID NO: 4963492 - DNA, 23 bp, Homo sapiens
ctgcactaaagccagcctgacct

SEQ ID NO: 4963493 - DNA, 16 bp, Homo sapiens
ctgcactaatttgatg

SEQ ID NO: 4963494 - DNA, 18 bp, Homo sapiens
ctgcactatagcctaggt

SEQ ID NO: 4963495 - DNA, 20 bp, Homo sapiens
ctgcactatagcctaggtga

SEQ ID NO: 4963496 - DNA, 22 bp, Homo sapiens
ctgcactatagcctaggtgaca

SEQ ID NO: 4963497 - DNA, 23 bp, Homo sapiens
ctgcactatagcctaggtgacag

SEQ ID NO: 4963498 - DNA, 17 bp, Homo sapiens
ctgcactcaaccttaag

SEQ ID NO: 4963499 - DNA, 14 bp, Homo sapiens
ctgcactcctcagg

SEQ ID NO: 4963500 - DNA, 22 bp, Homo sapiens
ctgcactcctcagggcagcctc

SEQ ID NO: 4963501 - DNA, 17 bp, Homo sapiens
ctgcacttgcagactct

SEQ ID NO: 4963502 - DNA, 17 bp, Homo sapiens
ctgcactttgatgtcat

SEQ ID NO: 4963503 - DNA, 18 bp, Homo sapiens
ctgcactttgatgtcatg

SEQ ID NO: 4963504 - DNA, 19 bp, Homo sapiens
ctgcactttgatgtcatgt

SEQ ID NO: 4963505 - DNA, 14 bp, Homo sapiens
ctgcagacacgcct

SEQ ID NO: 4963506 - DNA, 13 bp, Homo sapiens
ctgcagactgcta

SEQ ID NO: 4963507 - DNA, 14 bp, Homo sapiens
ctgcagactgctag

SEQ ID NO: 4963508 - DNA, 21 bp, Homo sapiens
ctgcagatgccaccctagcca

SEQ ID NO: 4963509 - DNA, 23 bp, Homo sapiens
ctgcagcatggtccctgccttag

SEQ ID NO: 4963510 - DNA, 14 bp, Homo sapiens
ctgcagccagctca

SEQ ID NO: 4963511 - DNA, 22 bp, Homo sapiens
ctgcagcctcaacctcctgggc

SEQ ID NO: 4963512 - DNA, 20 bp, Homo sapiens
ctgcagcctttgcctccccg

SEQ ID NO: 4963513 - DNA, 11 bp, Homo sapiens
ctgcagctgcc

SEQ ID NO: 4963514 - DNA, 13 bp, Homo sapiens
ctgcagctggaca

SEQ ID NO: 4963515 - DNA, 13 bp, Homo sapiens
ctgcagctgggct

SEQ ID NO: 4963516 - DNA, 14 bp, Homo sapiens
ctgcagctgggctg

SEQ ID NO: 4963517 - DNA, 11 bp, Homo sapiens
ctgcagcttcc

SEQ ID NO: 4963518 - DNA, 13 bp, Homo sapiens
ctgcagcttcctg

SEQ ID NO: 4963519 - DNA, 14 bp, Homo sapiens
ctgcagctttacat

SEQ ID NO: 4963520 - DNA, 15 bp, Homo sapiens
ctgcaggaatcaaaa

SEQ ID NO: 4963521 - DNA, 16 bp, Homo sapiens
ctgcaggctgagccac

SEQ ID NO: 4963522 - DNA, 17 bp, Homo sapiens
ctgcagggactgccagt

SEQ ID NO: 4963523 - DNA, 22 bp, Homo sapiens
ctgcagggagtccgaaagggac

SEQ ID NO: 4963524 - DNA, 15 bp, Homo sapiens
ctgcagggccaggac

SEQ ID NO: 4963525 - DNA, 17 bp, Homo sapiens
ctgcagggccaggactg

SEQ ID NO: 4963526 - DNA, 11 bp, Homo sapiens
ctgcaggggct

SEQ ID NO: 4963527 - DNA, 15 bp, Homo sapiens
ctgcaggggctctgg

SEQ ID NO: 4963528 - DNA, 16 bp, Homo sapiens
ctgcaggggctctgga

SEQ ID NO: 4963529 - DNA, 20 bp, Homo sapiens
ctgcagggggtggacaaact

SEQ ID NO: 4963530 - DNA, 16 bp, Homo sapiens
ctgcaggttggacccc

SEQ ID NO: 4963531 - DNA, 13 bp, Homo sapiens
ctgcagtcctgga

SEQ ID NO: 4963532 - DNA, 22 bp, Homo sapiens
ctgcagtgttcgcttggctcca

SEQ ID NO: 4963533 - DNA, 14 bp, Homo sapiens
ctgcatatgttgaa

SEQ ID NO: 4963534 - DNA, 21 bp, Homo sapiens
ctgcatatgttgaatactttt

SEQ ID NO: 4963535 - DNA, 17 bp, Homo sapiens
ctgcatcccagcacctg

SEQ ID NO: 4963536 - DNA, 22 bp, Homo sapiens
ctgcatcccaggatgctgggtg

SEQ ID NO: 4963537 - DNA, 23 bp, Homo sapiens
ctgcatcccaggatgctgggtgg

SEQ ID NO: 4963538 - DNA, 20 bp, Homo sapiens
ctgcatgcctggtctttcct

SEQ ID NO: 4963539 - DNA, 15 bp, Homo sapiens
ctgcatgttaccatc

SEQ ID NO: 4963540 - DNA, 12 bp, Homo sapiens
ctgcattagaaa

SEQ ID NO: 4963541 - DNA, 14 bp, Homo sapiens
ctgcattagaaaaa

SEQ ID NO: 4963542 - DNA, 15 bp, Homo sapiens
ctgcattattctctt

SEQ ID NO: 4963543 - DNA, 17 bp, Homo sapiens
ctgcattattctctttt

SEQ ID NO: 4963544 - DNA, 14 bp, Homo sapiens
ctgcatttctgagt

SEQ ID NO: 4963545 - DNA, 13 bp, Homo sapiens
ctgcatttgtgaa

SEQ ID NO: 4963546 - DNA, 22 bp, Homo sapiens
ctgccaaggccagagtggcctg

SEQ ID NO: 4963547 - DNA, 21 bp, Homo sapiens
ctgccacactctccatcaccc

SEQ ID NO: 4963548 - DNA, 15 bp, Homo sapiens
ctgccacactctgac

SEQ ID NO: 4963549 - DNA, 13 bp, Homo sapiens
ctgccacacttca

SEQ ID NO: 4963550 - DNA, 21 bp, Homo sapiens
ctgccaccagagaccgtcctc

SEQ ID NO: 4963551 - DNA, 14 bp, Homo sapiens
ctgccaccctgggg

SEQ ID NO: 4963552 - DNA, 15 bp, Homo sapiens
ctgccaccctgggga

SEQ ID NO: 4963553 - DNA, 16 bp, Homo sapiens
ctgccaccctggggag

SEQ ID NO: 4963554 - DNA, 20 bp, Homo sapiens
ctgccaccctggggagaaag

SEQ ID NO: 4963555 - DNA, 12 bp, Homo sapiens
ctgccacctccc

SEQ ID NO: 4963556 - DNA, 13 bp, Homo sapiens
ctgccacctccct

SEQ ID NO: 4963557 - DNA, 16 bp, Homo sapiens
ctgccacctccctgac

SEQ ID NO: 4963558 - DNA, 18 bp, Homo sapiens
ctgccacctccctgaccc

SEQ ID NO: 4963559 - DNA, 17 bp, Homo sapiens
ctgccacctctccatcc

SEQ ID NO: 4963560 - DNA, 20 bp, Homo sapiens
ctgccactttgcacattttg

SEQ ID NO: 4963561 - DNA, 22 bp, Homo sapiens
ctgccagaagatcccctcagga

SEQ ID NO: 4963562 - DNA, 12 bp, Homo sapiens
ctgccagcagca

SEQ ID NO: 4963563 - DNA, 15 bp, Homo sapiens
ctgccagcagcagca

SEQ ID NO: 4963564 - DNA, 13 bp, Homo sapiens
ctgccagggagct

SEQ ID NO: 4963565 - DNA, 21 bp, Homo sapiens
ctgccagtccccctgccccag

SEQ ID NO: 4963566 - DNA, 21 bp, Homo sapiens
ctgccatattctgttggccag

SEQ ID NO: 4963567 - DNA, 16 bp, Homo sapiens
ctgccatccaggttca

SEQ ID NO: 4963568 - DNA, 19 bp, Homo sapiens
ctgccatccaggttcagct

SEQ ID NO: 4963569 - DNA, 21 bp, Homo sapiens
ctgccatccaggttcagcttg

SEQ ID NO: 4963570 - DNA, 14 bp, Homo sapiens
ctgccatgccagga

SEQ ID NO: 4963571 - DNA, 16 bp, Homo sapiens
ctgccatgccaggaac

SEQ ID NO: 4963572 - DNA, 17 bp, Homo sapiens
ctgccatgccaggaacc

SEQ ID NO: 4963573 - DNA, 17 bp, Homo sapiens
ctgccatgtacctcccc

SEQ ID NO: 4963574 - DNA, 21 bp, Homo sapiens
ctgccatgtacctcccctgcc

SEQ ID NO: 4963575 - DNA, 19 bp, Homo sapiens
ctgccatgtactagtttta

SEQ ID NO: 4963576 - DNA, 13 bp, Homo sapiens
ctgccatttaaaa

SEQ ID NO: 4963577 - DNA, 16 bp, Homo sapiens
ctgcccaattggagga

SEQ ID NO: 4963578 - DNA, 13 bp, Homo sapiens
ctgcccaggcccc

SEQ ID NO: 4963579 - DNA, 15 bp, Homo sapiens
ctgcccaggcccctg

SEQ ID NO: 4963580 - DNA, 16 bp, Homo sapiens
ctgcccaggcccctgc

SEQ ID NO: 4963581 - DNA, 18 bp, Homo sapiens
ctgcccaggcccctgcca

SEQ ID NO: 4963582 - DNA, 18 bp, Homo sapiens
ctgcccaggccggccagc

SEQ ID NO: 4963583 - DNA, 22 bp, Homo sapiens
ctgcccatcacagggttgggcc

SEQ ID NO: 4963584 - DNA, 21 bp, Homo sapiens
ctgccccaaataacttcagtc

SEQ ID NO: 4963585 - DNA, 22 bp, Homo sapiens
ctgccccaaataacttcagtcc

SEQ ID NO: 4963586 - DNA, 19 bp, Homo sapiens
ctgccccccagcctctggc

SEQ ID NO: 4963587 - DNA, 21 bp, Homo sapiens
ctgccccccagcctctggcat

SEQ ID NO: 4963588 - DNA, 16 bp, Homo sapiens
ctgcccccggccccct

SEQ ID NO: 4963589 - DNA, 18 bp, Homo sapiens
ctgcccccggccccctgg

SEQ ID NO: 4963590 - DNA, 15 bp, Homo sapiens
ctgctgacagacaca

SEQ ID NO: 4963591 - DNA, 20 bp, Homo sapiens
ctgctgacagacacaggccc

SEQ ID NO: 4963592 - DNA, 11 bp, Homo sapiens
ctgctgacagt

SEQ ID NO: 4963593 - DNA, 20 bp, Homo sapiens
ctgctgaccaattgtgctgc

SEQ ID NO: 4963594 - DNA, 11 bp, Homo sapiens
ctgctgcaggg

SEQ ID NO: 4963595 - DNA, 19 bp, Homo sapiens
ctgctgcaggggctctgga

SEQ ID NO: 4963596 - DNA, 21 bp, Homo sapiens
ctgctgcaggggctctggaga

SEQ ID NO: 4963597 - DNA, 14 bp, Homo sapiens
ctgctgcccaatct

SEQ ID NO: 4963598 - DNA, 12 bp, Homo sapiens
ctgctgcccagc

SEQ ID NO: 4963599 - DNA, 21 bp, Homo sapiens
ctgctgcctgcccgcacagca

SEQ ID NO: 4963600 - DNA, 23 bp, Homo sapiens
ctgctgcctggccactgctccct

SEQ ID NO: 4963601 - DNA, 12 bp, Homo sapiens
ctgctgctgcct

SEQ ID NO: 4963602 - DNA, 15 bp, Homo sapiens
ctgctgctgcgccct

SEQ ID NO: 4963603 - DNA, 20 bp, Homo sapiens
ctgctgctgcgcccttacct

SEQ ID NO: 4963604 - DNA, 16 bp, Homo sapiens
ctgctgctgctgcgcc

SEQ ID NO: 4963605 - DNA, 16 bp, Homo sapiens
ctgctggcttgcagtg

SEQ ID NO: 4963606 - DNA, 17 bp, Homo sapiens
ctgctggtcacagcctc

SEQ ID NO: 4963607 - DNA, 18 bp, Homo sapiens
ctgctggtcacagcctcc

SEQ ID NO: 4963608 - DNA, 15 bp, Homo sapiens
ctgctggttcagggt

SEQ ID NO: 4963609 - DNA, 18 bp, Homo sapiens
ctgctgtccccttggcag

SEQ ID NO: 4963610 - DNA, 17 bp, Homo sapiens
ctgctgtccctccccct

SEQ ID NO: 4963611 - DNA, 13 bp, Homo sapiens
ctgcttcagcctc

SEQ ID NO: 4963612 - DNA, 22 bp, Homo sapiens
ctgcttcccacctccctgccca

SEQ ID NO: 4963613 - DNA, 22 bp, Homo sapiens
ctgcttccggtagggaggcagc

SEQ ID NO: 4963614 - DNA, 13 bp, Homo sapiens
ctgcttctccaag

SEQ ID NO: 4963615 - DNA, 16 bp, Homo sapiens
ctgcttctccaaggaa

SEQ ID NO: 4963616 - DNA, 15 bp, Homo sapiens
ctgcttctgaatgtg

SEQ ID NO: 4963617 - DNA, 20 bp, Homo sapiens
ctgcttgatgaagcaaggaa

SEQ ID NO: 4963618 - DNA, 21 bp, Homo sapiens
ctgcttgatgaagcaaggaag

SEQ ID NO: 4963619 - DNA, 22 bp, Homo sapiens
ctgctttaaagggcctgcctgg

SEQ ID NO: 4963620 - DNA, 15 bp, Homo sapiens
ctgctttctttgatt

SEQ ID NO: 4963621 - DNA, 19 bp, Homo sapiens
ctgctttgggctgccctgg

SEQ ID NO: 4963622 - DNA, 21 bp, Homo sapiens
ctgcttttgtctatgggactc

SEQ ID NO: 4963623 - DNA, 13 bp, Homo sapiens
ctgctttttgaaa

SEQ ID NO: 4963624 - DNA, 18 bp, Homo sapiens
ctgcttttttttttccag

SEQ ID NO: 4963625 - DNA, 21 bp, Homo sapiens
ctgcttttttttttccagcaa

SEQ ID NO: 4963626 - DNA, 23 bp, Homo sapiens
ctgcttttttttttccagcaagt

SEQ ID NO: 4963627 - DNA, 17 bp, Homo sapiens
ctggaacatcctttgca

SEQ ID NO: 4963628 - DNA, 18 bp, Homo sapiens
ctggaacatcctttgcag

SEQ ID NO: 4963629 - DNA, 17 bp, Homo sapiens
ctggaaccttgctgtcc

SEQ ID NO: 4963630 - DNA, 22 bp, Homo sapiens
ctggaacggtgaaggtgacagc

SEQ ID NO: 4963631 - DNA, 18 bp, Homo sapiens
ctggaagaaaaaaaccac

SEQ ID NO: 4963632 - DNA, 14 bp, Homo sapiens
ctggaagcacagct

SEQ ID NO: 4963633 - DNA, 18 bp, Homo sapiens
ctggaagcacagcttcat

SEQ ID NO: 4963634 - DNA, 14 bp, Homo sapiens
ctggaagccctgga

SEQ ID NO: 4963635 - DNA, 14 bp, Homo sapiens
ctggaatgcagtgg

SEQ ID NO: 4963636 - DNA, 22 bp, Homo sapiens
ctggaatggtacatgtcttcca

SEQ ID NO: 4963637 - DNA, 17 bp, Homo sapiens
ctggacactcagacctg

SEQ ID NO: 4963638 - DNA, 23 bp, Homo sapiens
ctggacaggcatgttctctgagg

SEQ ID NO: 4963639 - DNA, 17 bp, Homo sapiens
ctggacataacattttc

SEQ ID NO: 4963640 - DNA, 15 bp, Homo sapiens
ctggacctgcctcct

SEQ ID NO: 4963641 - DNA, 18 bp, Homo sapiens
ctggacggggactgggga

SEQ ID NO: 4963642 - DNA, 23 bp, Homo sapiens
ctggacggggactggggatgtgg

SEQ ID NO: 4963643 - DNA, 17 bp, Homo sapiens
ctggactcctctgtcca

SEQ ID NO: 4963644 - DNA, 23 bp, Homo sapiens
ctggactcctctgtccaggcact

SEQ ID NO: 4963645 - DNA, 14 bp, Homo sapiens
ctggactctaaaga

SEQ ID NO: 4963646 - DNA, 19 bp, Homo sapiens
ctggactctaaagaccaaa

SEQ ID NO: 4963647 - DNA, 22 bp, Homo sapiens
ctggactcttcaaaaactgttt

SEQ ID NO: 4963648 - DNA, 23 bp, Homo sapiens
ctggactcttcaaaaactgtttt

SEQ ID NO: 4963649 - DNA, 16 bp, Homo sapiens
ctggactgacagcatg

SEQ ID NO: 4963650 - DNA, 16 bp, Homo sapiens
ctggactgggaggtag

SEQ ID NO: 4963651 - DNA, 14 bp, Homo sapiens
ctggagaactagag

SEQ ID NO: 4963652 - DNA, 12 bp, Homo sapiens
ctggagaagaga

SEQ ID NO: 4963653 - DNA, 15 bp, Homo sapiens
ctggagaagagagga

SEQ ID NO: 4963654 - DNA, 19 bp, Homo sapiens
ctggagaagagaggagagg

SEQ ID NO: 4963655 - DNA, 20 bp, Homo sapiens
ctggagaagagaggagagga

SEQ ID NO: 4963656 - DNA, 16 bp, Homo sapiens
ctggagagaagtggaa

SEQ ID NO: 4963657 - DNA, 13 bp, Homo sapiens
ctggagcagacca

SEQ ID NO: 4963658 - DNA, 18 bp, Homo sapiens
ctggagcctgagtcaggg

SEQ ID NO: 4963659 - DNA, 23 bp, Homo sapiens
ctggagcctgagtcagggcccag

SEQ ID NO: 4963660 - DNA, 18 bp, Homo sapiens
ctggagcttcattttggt

SEQ ID NO: 4963661 - DNA, 19 bp, Homo sapiens
ctggaggccttccagctgc

SEQ ID NO: 4963662 - DNA, 20 bp, Homo sapiens
ctggaggccttccagctgct

SEQ ID NO: 4963663 - DNA, 20 bp, Homo sapiens
ctggaggggtgtggctcctt

SEQ ID NO: 4963664 - DNA, 20 bp, Homo sapiens
ctggaggtgggagcaggaga

SEQ ID NO: 4963665 - DNA, 21 bp, Homo sapiens
ctggaggtgggagcaggagat

SEQ ID NO: 4963666 - DNA, 16 bp, Homo sapiens
ctggagtgagcactca

SEQ ID NO: 4963667 - DNA, 14 bp, Homo sapiens
ctggagtgcagtga

SEQ ID NO: 4963668 - DNA, 15 bp, Homo sapiens
ctggagtgcagtgag

SEQ ID NO: 4963669 - DNA, 22 bp, Homo sapiens
ctggagtgcccaccctgggaga

SEQ ID NO: 4963670 - DNA, 22 bp, Homo sapiens
ctggagtttcatgtacaagatg

SEQ ID NO: 4963671 - DNA, 22 bp, Homo sapiens
ctggagtttttgtttggagagc

SEQ ID NO: 4963672 - DNA, 11 bp, Homo sapiens
ctggatggagc

SEQ ID NO: 4963673 - DNA, 15 bp, Homo sapiens
ctggatggagcccag

SEQ ID NO: 4963674 - DNA, 23 bp, Homo sapiens
ctggatggagcccaggcgggagc

SEQ ID NO: 4963675 - DNA, 22 bp, Homo sapiens
ctggcacaggactgattctggg

SEQ ID NO: 4963676 - DNA, 17 bp, Homo sapiens
ctggcacagggcagtgg

SEQ ID NO: 4963677 - DNA, 21 bp, Homo sapiens
ctggcacttggagacttgtat

SEQ ID NO: 4963678 - DNA, 16 bp, Homo sapiens
ctggcagcccagagac

SEQ ID NO: 4963679 - DNA, 20 bp, Homo sapiens
ctggcagccgtgccttcagc

SEQ ID NO: 4963680 - DNA, 18 bp, Homo sapiens
ctggcattagaattattt

SEQ ID NO: 4963681 - DNA, 22 bp, Homo sapiens
ctggcattagaattatttaaac

SEQ ID NO: 4963682 - DNA, 19 bp, Homo sapiens
ctggcattatgtccactgt

SEQ ID NO: 4963683 - DNA, 17 bp, Homo sapiens
ctggcattcttgtacag

SEQ ID NO: 4963684 - DNA, 18 bp, Homo sapiens
ctggccagatggcccgga

SEQ ID NO: 4963685 - DNA, 14 bp, Homo sapiens
ctggccagcctggg

SEQ ID NO: 4963686 - DNA, 17 bp, Homo sapiens
ctggccagcctggggcc

SEQ ID NO: 4963687 - DNA, 19 bp, Homo sapiens
ctggccagcctggggcctg

SEQ ID NO: 4963688 - DNA, 24 bp, Homo sapiens
ctggccagcctggggcctggcagg

SEQ ID NO: 4963689 - DNA, 17 bp, Homo sapiens
ctggccaggagctcttc

SEQ ID NO: 4963690 - DNA, 17 bp, Homo sapiens
ctggcccagccaaaccc

SEQ ID NO: 4963691 - DNA, 20 bp, Homo sapiens
ctggccccaggtagaaactt

SEQ ID NO: 4963692 - DNA, 20 bp, Homo sapiens
ctggccccggatcagagcag

SEQ ID NO: 4963693 - DNA, 21 bp, Homo sapiens
ctggccccggatcagagcagg

SEQ ID NO: 4963694 - DNA, 14 bp, Homo sapiens
ctggcccctcgcct

SEQ ID NO: 4963695 - DNA, 24 bp, Homo sapiens
ctggcccctcgcctgtggagctca

SEQ ID NO: 4963696 - DNA, 17 bp, Homo sapiens
ctggccctgccctgagg

SEQ ID NO: 4963697 - DNA, 13 bp, Homo sapiens
ctggccgccccct

SEQ ID NO: 4963698 - DNA, 14 bp, Homo sapiens
ctggccgccccctg

SEQ ID NO: 4963699 - DNA, 13 bp, Homo sapiens
ctggtcccactca

SEQ ID NO: 4963700 - DNA, 14 bp, Homo sapiens
ctggtcctgtgtgc

SEQ ID NO: 4963701 - DNA, 21 bp, Homo sapiens
ctggtctcaaactcctgggct

SEQ ID NO: 4963702 - DNA, 12 bp, Homo sapiens
ctggtctctggt

SEQ ID NO: 4963703 - DNA, 19 bp, Homo sapiens
ctggtcttgttagaaaaca

SEQ ID NO: 4963704 - DNA, 14 bp, Homo sapiens
ctggtgcctccaga

SEQ ID NO: 4963705 - DNA, 15 bp, Homo sapiens
ctggtgcctccagag

SEQ ID NO: 4963706 - DNA, 15 bp, Homo sapiens
ctggtgcctggctct

SEQ ID NO: 4963707 - DNA, 16 bp, Homo sapiens
ctggtgcgaatggact

SEQ ID NO: 4963708 - DNA, 17 bp, Homo sapiens
ctggtgcttccaaatat

SEQ ID NO: 4963709 - DNA, 14 bp, Homo sapiens
ctggtggcagtggg

SEQ ID NO: 4963710 - DNA, 21 bp, Homo sapiens
ctggtggcccgacagcctggc

SEQ ID NO: 4963711 - DNA, 22 bp, Homo sapiens
ctggtggcccgacagcctggca

SEQ ID NO: 4963712 - DNA, 22 bp, Homo sapiens
ctggtgtttaggtgaattaatt

SEQ ID NO: 4963713 - DNA, 20 bp, Homo sapiens
ctggttaacagcagtccttt

SEQ ID NO: 4963714 - DNA, 14 bp, Homo sapiens
ctggttagaaatgc

SEQ ID NO: 4963715 - DNA, 23 bp, Homo sapiens
ctggttagaaatgcagaatccta

SEQ ID NO: 4963716 - DNA, 13 bp, Homo sapiens
ctggttagcagag

SEQ ID NO: 4963717 - DNA, 20 bp, Homo sapiens
ctggttcagggttggcccct

SEQ ID NO: 4963718 - DNA, 21 bp, Homo sapiens
ctggttcccgtttctccacct

SEQ ID NO: 4963719 - DNA, 16 bp, Homo sapiens
ctggtttacaggccct

SEQ ID NO: 4963720 - DNA, 18 bp, Homo sapiens
ctggtttacaggccctgc

SEQ ID NO: 4963721 - DNA, 21 bp, Homo sapiens
ctggtttacaggccctgctcc

SEQ ID NO: 4963722 - DNA, 22 bp, Homo sapiens
ctggtttacaggccctgctcct

SEQ ID NO: 4963723 - DNA, 22 bp, Homo sapiens
ctgtaaaaacactgaaaaatta

SEQ ID NO: 4963724 - DNA, 16 bp, Homo sapiens
ctgtaaaacgctgtca

SEQ ID NO: 4963725 - DNA, 20 bp, Homo sapiens
ctgtaaacctctcgagggca

SEQ ID NO: 4963726 - DNA, 22 bp, Homo sapiens
ctgtaaactcaaaacttaacat

SEQ ID NO: 4963727 - DNA, 13 bp, Homo sapiens
ctgtaaataccat

SEQ ID NO: 4963728 - DNA, 15 bp, Homo sapiens
ctgtaaataccattg

SEQ ID NO: 4963729 - DNA, 16 bp, Homo sapiens
ctgtaaataccattga

SEQ ID NO: 4963730 - DNA, 21 bp, Homo sapiens
ctgtaacatcactatccatgc

SEQ ID NO: 4963731 - DNA, 14 bp, Homo sapiens
ctgtaaggctctag

SEQ ID NO: 4963732 - DNA, 18 bp, Homo sapiens
ctgtaaggctctagatca

SEQ ID NO: 4963733 - DNA, 15 bp, Homo sapiens
ctgtaataatacctc

SEQ ID NO: 4963734 - DNA, 13 bp, Homo sapiens
ctgtaatttagtt

SEQ ID NO: 4963735 - DNA, 13 bp, Homo sapiens
ctgtacatttaaa

SEQ ID NO: 4963736 - DNA, 19 bp, Homo sapiens
ctgtacatttaaaattgct

SEQ ID NO: 4963737 - DNA, 23 bp, Homo sapiens
ctgtacattttgttgtaaaaaga

SEQ ID NO: 4963738 - DNA, 18 bp, Homo sapiens
ctgtacctcatcccatga

SEQ ID NO: 4963739 - DNA, 23 bp, Homo sapiens
ctgtaccttttgaggagccccag

SEQ ID NO: 4963740 - DNA, 15 bp, Homo sapiens
ctgtacgtctgacag

SEQ ID NO: 4963741 - DNA, 20 bp, Homo sapiens
ctgtacgtctgacaggcaat

SEQ ID NO: 4963742 - DNA, 22 bp, Homo sapiens
ctgtactaaagtaacgcaataa

SEQ ID NO: 4963743 - DNA, 23 bp, Homo sapiens
ctgtactctggggtgctgcctga

SEQ ID NO: 4963744 - DNA, 22 bp, Homo sapiens
ctgtactgctcaggctgcagct

SEQ ID NO: 4963745 - DNA, 15 bp, Homo sapiens
ctgtaggtggtatgt

SEQ ID NO: 4963746 - DNA, 19 bp, Homo sapiens
ctgtagtagccctttctgt

SEQ ID NO: 4963747 - DNA, 22 bp, Homo sapiens
ctgtagtcatttactaaacata

SEQ ID NO: 4963748 - DNA, 23 bp, Homo sapiens
ctgtagtcatttactaaacatat

SEQ ID NO: 4963749 - DNA, 13 bp, Homo sapiens
ctgtagttaggaa

SEQ ID NO: 4963750 - DNA, 15 bp, Homo sapiens
ctgtagttaggaaat

SEQ ID NO: 4963751 - DNA, 17 bp, Homo sapiens
ctgtagttaggaaataa

SEQ ID NO: 4963752 - DNA, 18 bp, Homo sapiens
ctgtagttaggaaataaa

SEQ ID NO: 4963753 - DNA, 22 bp, Homo sapiens
ctgtagttaggaaataaaacct

SEQ ID NO: 4963754 - DNA, 14 bp, Homo sapiens
ctgtagttctaaga

SEQ ID NO: 4963755 - DNA, 16 bp, Homo sapiens
ctgtagttctaagact

SEQ ID NO: 4963756 - DNA, 22 bp, Homo sapiens
ctgtagttttattttatgttta

SEQ ID NO: 4963757 - DNA, 13 bp, Homo sapiens
ctgtataaatagg

SEQ ID NO: 4963758 - DNA, 14 bp, Homo sapiens
ctgtataaatagga

SEQ ID NO: 4963759 - DNA, 20 bp, Homo sapiens
ctgtataaataggagaggat

SEQ ID NO: 4963760 - DNA, 14 bp, Homo sapiens
ctgtataagcactg

SEQ ID NO: 4963761 - DNA, 21 bp, Homo sapiens
ctgtataagcactgaaaaaca

SEQ ID NO: 4963762 - DNA, 19 bp, Homo sapiens
ctgtatacaaccctggcat

SEQ ID NO: 4963763 - DNA, 12 bp, Homo sapiens
ctgtatacttta

SEQ ID NO: 4963764 - DNA, 16 bp, Homo sapiens
ctgtatactttagtat

SEQ ID NO: 4963765 - DNA, 21 bp, Homo sapiens
ctgtatagacagtttgtaaat

SEQ ID NO: 4963766 - DNA, 14 bp, Homo sapiens
ctgtatcccatgag

SEQ ID NO: 4963767 - DNA, 19 bp, Homo sapiens
ctgtatcccatgagcctca

SEQ ID NO: 4963768 - DNA, 12 bp, Homo sapiens
ctgtatgtcaga

SEQ ID NO: 4963769 - DNA, 13 bp, Homo sapiens
ctgtatgttgtcc

SEQ ID NO: 4963770 - DNA, 19 bp, Homo sapiens
ctgtcaaaacaagtttttc

SEQ ID NO: 4963771 - DNA, 19 bp, Homo sapiens
ctgtcaaaacactgtggaa

SEQ ID NO: 4963772 - DNA, 20 bp, Homo sapiens
ctgtcaaaacactgtggaac

SEQ ID NO: 4963773 - DNA, 14 bp, Homo sapiens
ctgtcaagaagatg

SEQ ID NO: 4963774 - DNA, 16 bp, Homo sapiens
ctgtcacaccagccat

SEQ ID NO: 4963775 - DNA, 22 bp, Homo sapiens
ctgtcactcattgctgagcctc

SEQ ID NO: 4963776 - DNA, 20 bp, Homo sapiens
ctgtcagatgagaacaaagc

SEQ ID NO: 4963777 - DNA, 21 bp, Homo sapiens
ctgtcatgaaatcagcaagag

SEQ ID NO: 4963778 - DNA, 17 bp, Homo sapiens
ctgtcattcaaatgggt

SEQ ID NO: 4963779 - DNA, 16 bp, Homo sapiens
ctgtcatttgagcagg

SEQ ID NO: 4963780 - DNA, 18 bp, Homo sapiens
ctgtcatttgttgtgatg

SEQ ID NO: 4963781 - DNA, 22 bp, Homo sapiens
ctgtccaaaggaggctggcagg

SEQ ID NO: 4963782 - DNA, 13 bp, Homo sapiens
ctgtccagcctgg

SEQ ID NO: 4963783 - DNA, 19 bp, Homo sapiens
ctgtccaggcactgctgcc

SEQ ID NO: 4963784 - DNA, 20 bp, Homo sapiens
ctgtccaggcactgctgccc

SEQ ID NO: 4963785 - DNA, 21 bp, Homo sapiens
ctgtccaggcactgctgccca

SEQ ID NO: 4963786 - DNA, 14 bp, Homo sapiens
ctgtccatgcttct

SEQ ID NO: 4963787 - DNA, 14 bp, Homo sapiens
ctgtcccaccccca

SEQ ID NO: 4963788 - DNA, 16 bp, Homo sapiens
ctgtcccacccccacc

SEQ ID NO: 4963789 - DNA, 17 bp, Homo sapiens
ctgtccccgcagccctg

SEQ ID NO: 4963790 - DNA, 23 bp, Homo sapiens
ctgtccccgcagccctggcaggg

SEQ ID NO: 4963791 - DNA, 12 bp, Homo sapiens
ctgtccctcact

SEQ ID NO: 4963792 - DNA, 13 bp, Homo sapiens
ctgtccctcactg

SEQ ID NO: 4963793 - DNA, 13 bp, Homo sapiens
ctgtccctcccac

SEQ ID NO: 4963794 - DNA, 15 bp, Homo sapiens
ctgtccctcccacct

SEQ ID NO: 4963795 - DNA, 15 bp, Homo sapiens
ctgtccctccccctt

SEQ ID NO: 4963796 - DNA, 20 bp, Homo sapiens
ctgtcctactctgtgtcagg

SEQ ID NO: 4963797 - DNA, 21 bp, Homo sapiens
ctgtcctactctgtgtcaggt

SEQ ID NO: 4963798 - DNA, 15 bp, Homo sapiens
ctgtcctccctccac

SEQ ID NO: 4963799 - DNA, 20 bp, Homo sapiens
ctgtcctctcccctccagcc

SEQ ID NO: 4963800 - DNA, 21 bp, Homo sapiens
ctgtcctctcccctccagcct

SEQ ID NO: 4963801 - DNA, 20 bp, Homo sapiens
ctgtcctgggagtgagctgg

SEQ ID NO: 4963802 - DNA, 23 bp, Homo sapiens
ctgtcgagttcggctctgggtgg

SEQ ID NO: 4963803 - DNA, 15 bp, Homo sapiens
ctgtcgtgatggggc

SEQ ID NO: 4963804 - DNA, 18 bp, Homo sapiens
ctgtctagtctctcctgt

SEQ ID NO: 4963805 - DNA, 17 bp, Homo sapiens
ctgtctcagcctcccag

SEQ ID NO: 4963806 - DNA, 14 bp, Homo sapiens
ctgtctcatcccca

SEQ ID NO: 4963807 - DNA, 16 bp, Homo sapiens
ctgtctcatccccagg

SEQ ID NO: 4963808 - DNA, 16 bp, Homo sapiens
cttatggaattgattt

SEQ ID NO: 4963809 - DNA, 12 bp, Homo sapiens
cttattgcccac

SEQ ID NO: 4963810 - DNA, 19 bp, Homo sapiens
cttattgctgattttaatg

SEQ ID NO: 4963811 - DNA, 20 bp, Homo sapiens
cttattttatttccatcatg

SEQ ID NO: 4963812 - DNA, 12 bp, Homo sapiens
cttattttcaag

SEQ ID NO: 4963813 - DNA, 13 bp, Homo sapiens
cttatttttccta

SEQ ID NO: 4963814 - DNA, 20 bp, Homo sapiens
cttcaaaatgttatcttctc

SEQ ID NO: 4963815 - DNA, 17 bp, Homo sapiens
cttcaaattgtcttttg

SEQ ID NO: 4963816 - DNA, 23 bp, Homo sapiens
cttcaacataacccacttgtcac

SEQ ID NO: 4963817 - DNA, 13 bp, Homo sapiens
cttcaacatcctg

SEQ ID NO: 4963818 - DNA, 20 bp, Homo sapiens
cttcaataaatctttggaaa

SEQ ID NO: 4963819 - DNA, 14 bp, Homo sapiens
cttcaatcccagcc

SEQ ID NO: 4963820 - DNA, 17 bp, Homo sapiens
cttcacagtagagccag

SEQ ID NO: 4963821 - DNA, 20 bp, Homo sapiens
cttcacagtagagccagctt

SEQ ID NO: 4963822 - DNA, 21 bp, Homo sapiens
cttcacagtagagccagcttg

SEQ ID NO: 4963823 - DNA, 14 bp, Homo sapiens
cttcacattaaaaa

SEQ ID NO: 4963824 - DNA, 15 bp, Homo sapiens
cttcaccccggcagg

SEQ ID NO: 4963825 - DNA, 17 bp, Homo sapiens
cttcaccccggcaggcc

SEQ ID NO: 4963826 - DNA, 20 bp, Homo sapiens
cttcaccccggcaggccctg

SEQ ID NO: 4963827 - DNA, 18 bp, Homo sapiens
cttcacctaagtctctgt

SEQ ID NO: 4963828 - DNA, 19 bp, Homo sapiens
cttcacctaagtctctgtg

SEQ ID NO: 4963829 - DNA, 17 bp, Homo sapiens
cttcactgtataaatag

SEQ ID NO: 4963830 - DNA, 16 bp, Homo sapiens
cttcactgttgaaaat

SEQ ID NO: 4963831 - DNA, 10 bp, Homo sapiens
cttcagcacc

SEQ ID NO: 4963832 - DNA, 16 bp, Homo sapiens
cttcagcattccctcc

SEQ ID NO: 4963833 - DNA, 21 bp, Homo sapiens
cttcagcattccctcccatca

SEQ ID NO: 4963834 - DNA, 18 bp, Homo sapiens
cttcagcccccagcccct

SEQ ID NO: 4963835 - DNA, 14 bp, Homo sapiens
cttcagcctcccga

SEQ ID NO: 4963836 - DNA, 21 bp, Homo sapiens
cttcagctagcttttaggaaa

SEQ ID NO: 4963837 - DNA, 15 bp, Homo sapiens
cttcagctccaggga

SEQ ID NO: 4963838 - DNA, 19 bp, Homo sapiens
cttcagctgtacttcgtct

SEQ ID NO: 4963839 - DNA, 21 bp, Homo sapiens
cttcaggcatggggggtgggg

SEQ ID NO: 4963840 - DNA, 16 bp, Homo sapiens
cttcaggctcttctcc

SEQ ID NO: 4963841 - DNA, 19 bp, Homo sapiens
cttcaggctcttctccttt

SEQ ID NO: 4963842 - DNA, 19 bp, Homo sapiens
cttcaggggcacttcattg

SEQ ID NO: 4963843 - DNA, 16 bp, Homo sapiens
cttcagtcagaaaact

SEQ ID NO: 4963844 - DNA, 18 bp, Homo sapiens
cttcagtcctgggagacc

SEQ ID NO: 4963845 - DNA, 15 bp, Homo sapiens
cttcagtggcagctg

SEQ ID NO: 4963846 - DNA, 18 bp, Homo sapiens
cttcagtggcagctgctt

SEQ ID NO: 4963847 - DNA, 20 bp, Homo sapiens
cttcagttggttgtgtcttt

SEQ ID NO: 4963848 - DNA, 15 bp, Homo sapiens
cttcatcgaatctac

SEQ ID NO: 4963849 - DNA, 17 bp, Homo sapiens
cttcattccttccacta

SEQ ID NO: 4963850 - DNA, 13 bp, Homo sapiens
cttcattctatca

SEQ ID NO: 4963851 - DNA, 13 bp, Homo sapiens
cttcattctcctt

SEQ ID NO: 4963852 - DNA, 12 bp, Homo sapiens
cttcattctcgt

SEQ ID NO: 4963853 - DNA, 23 bp, Homo sapiens
cttcattgagagttttgtcttga

SEQ ID NO: 4963854 - DNA, 23 bp, Homo sapiens
cttcattgtactacctgtgtata

SEQ ID NO: 4963855 - DNA, 19 bp, Homo sapiens
cttcattgtccctcttcac

SEQ ID NO: 4963856 - DNA, 21 bp, Homo sapiens
cttcattgtccctcttcactc

SEQ ID NO: 4963857 - DNA, 13 bp, Homo sapiens
cttcatttaaaaa

SEQ ID NO: 4963858 - DNA, 14 bp, Homo sapiens
cttcatttcattgt

SEQ ID NO: 4963859 - DNA, 19 bp, Homo sapiens
cttcatttcattgtatgat

SEQ ID NO: 4963860 - DNA, 18 bp, Homo sapiens
cttcatttcctgtgtctt

SEQ ID NO: 4963861 - DNA, 14 bp, Homo sapiens
cttcatttggagat

SEQ ID NO: 4963862 - DNA, 11 bp, Homo sapiens
cttcatttgtg

SEQ ID NO: 4963863 - DNA, 14 bp, Homo sapiens
cttcatttgtgtca

SEQ ID NO: 4963864 - DNA, 22 bp, Homo sapiens
cttcattttattaatatttttc

SEQ ID NO: 4963865 - DNA, 17 bp, Homo sapiens
cttccaaaattcttatt

SEQ ID NO: 4963866 - DNA, 17 bp, Homo sapiens
cttccaaataataaagt

SEQ ID NO: 4963867 - DNA, 16 bp, Homo sapiens
cttccaattaatgctt

SEQ ID NO: 4963868 - DNA, 13 bp, Homo sapiens
cttccactgcctc

SEQ ID NO: 4963869 - DNA, 16 bp, Homo sapiens
cttccactgcctctgc

SEQ ID NO: 4963870 - DNA, 15 bp, Homo sapiens
cttccagatcactgc

SEQ ID NO: 4963871 - DNA, 16 bp, Homo sapiens
cttccaggggaacctg

SEQ ID NO: 4963872 - DNA, 20 bp, Homo sapiens
cttccagggggaaggccaag

SEQ ID NO: 4963873 - DNA, 22 bp, Homo sapiens
cttccataatgctactgtctca

SEQ ID NO: 4963874 - DNA, 16 bp, Homo sapiens
cttccatatttggaag

SEQ ID NO: 4963875 - DNA, 19 bp, Homo sapiens
cttccatatttggaagaaa

SEQ ID NO: 4963876 - DNA, 22 bp, Homo sapiens
cttccatcccaaccagtgccaa

SEQ ID NO: 4963877 - DNA, 14 bp, Homo sapiens
cttccatcccagga

SEQ ID NO: 4963878 - DNA, 12 bp, Homo sapiens
cttccatcccta

SEQ ID NO: 4963879 - DNA, 15 bp, Homo sapiens
cttccatccctaccc

SEQ ID NO: 4963880 - DNA, 16 bp, Homo sapiens
cttccatccctacccc

SEQ ID NO: 4963881 - DNA, 14 bp, Homo sapiens
cttccatgattcta

SEQ ID NO: 4963882 - DNA, 17 bp, Homo sapiens
cttccatgattctattt

SEQ ID NO: 4963883 - DNA, 19 bp, Homo sapiens
cttccatgtatcttttgaa

SEQ ID NO: 4963884 - DNA, 15 bp, Homo sapiens
cttccatgtcgcctc

SEQ ID NO: 4963885 - DNA, 16 bp, Homo sapiens
cttccatgtcgcctct

SEQ ID NO: 4963886 - DNA, 17 bp, Homo sapiens
cttcccaatcagcactg

SEQ ID NO: 4963887 - DNA, 18 bp, Homo sapiens
cttcccaatcagcactga

SEQ ID NO: 4963888 - DNA, 19 bp, Homo sapiens
cttcccaatcagcactgaa

SEQ ID NO: 4963889 - DNA, 16 bp, Homo sapiens
cttcccacctccctgc

SEQ ID NO: 4963890 - DNA, 15 bp, Homo sapiens
cttcccatcgctgtc

SEQ ID NO: 4963891 - DNA, 23 bp, Homo sapiens
cttcccccaccggtccagctggc

SEQ ID NO: 4963892 - DNA, 13 bp, Homo sapiens
cttcccccttcca

SEQ ID NO: 4963893 - DNA, 18 bp, Homo sapiens
cttcccccttttttgtcc

SEQ ID NO: 4963894 - DNA, 18 bp, Homo sapiens
cttcccctccctggctcc

SEQ ID NO: 4963895 - DNA, 16 bp, Homo sapiens
cttcccgctcagccct

SEQ ID NO: 4963896 - DNA, 17 bp, Homo sapiens
cttcccgctcagccctc

SEQ ID NO: 4963897 - DNA, 18 bp, Homo sapiens
cttcccgctcagccctcc

SEQ ID NO: 4963898 - DNA, 15 bp, Homo sapiens
cttccctacctcagg

SEQ ID NO: 4963899 - DNA, 20 bp, Homo sapiens
cttccctacctcaggcagga

SEQ ID NO: 4963900 - DNA, 18 bp, Homo sapiens
cttccctgattgacctgc

SEQ ID NO: 4963901 - DNA, 16 bp, Homo sapiens
cttcccttgccacttt

SEQ ID NO: 4963902 - DNA, 17 bp, Homo sapiens
cttcccttgccactttg

SEQ ID NO: 4963903 - DNA, 13 bp, Homo sapiens
cttccgaccctct

SEQ ID NO: 4963904 - DNA, 17 bp, Homo sapiens
cttccgaccctctggga

SEQ ID NO: 4963905 - DNA, 18 bp, Homo sapiens
cttccgaccctctgggaa

SEQ ID NO: 4963906 - DNA, 22 bp, Homo sapiens
cttccgaccctctgggaacctc

SEQ ID NO: 4963907 - DNA, 14 bp, Homo sapiens
cttccgcccctgcc

SEQ ID NO: 4963908 - DNA, 22 bp, Homo sapiens
cttccgcccctgcctgccatgt

SEQ ID NO: 4963909 - DNA, 16 bp, Homo sapiens
cttccggtagggaggc

SEQ ID NO: 4963910 - DNA, 20 bp, Homo sapiens
cttccggtagggaggcagcc

SEQ ID NO: 4963911 - DNA, 21 bp, Homo sapiens
cttccggtagggaggcagcct

SEQ ID NO: 4963912 - DNA, 21 bp, Homo sapiens
cttcctacaagagcagcctgt

SEQ ID NO: 4963913 - DNA, 19 bp, Homo sapiens
cttcctacccacacctctg

SEQ ID NO: 4963914 - DNA, 22 bp, Homo sapiens
cttcctacccacacctctgcca

SEQ ID NO: 4963915 - DNA, 15 bp, Homo sapiens
cttcctacctatccc

SEQ ID NO: 4963916 - DNA, 17 bp, Homo sapiens
cttcctagttttctcct

SEQ ID NO: 4963917 - DNA, 15 bp, Homo sapiens
cttcctataacttga

SEQ ID NO: 4963918 - DNA, 17 bp, Homo sapiens
cttcctataacttgatg

SEQ ID NO: 4963919 - DNA, 13 bp, Homo sapiens
cttcctcactgcc

SEQ ID NO: 4963920 - DNA, 15 bp, Homo sapiens
cttcctccagctgca

SEQ ID NO: 4963921 - DNA, 20 bp, Homo sapiens
cttcctccagctgcaccaga

SEQ ID NO: 4963922 - DNA, 21 bp, Homo sapiens
cttcctctccactgccttcga

SEQ ID NO: 4963923 - DNA, 16 bp, Homo sapiens
cttcctctctccagat

SEQ ID NO: 4963924 - DNA, 12 bp, Homo sapiens
cttcctctgctg

SEQ ID NO: 4963925 - DNA, 15 bp, Homo sapiens
cttcctgagctttat

SEQ ID NO: 4963926 - DNA, 15 bp, Homo sapiens
cttcctgcaattttc

SEQ ID NO: 4963927 - DNA, 16 bp, Homo sapiens
cttcctgtctagtctc

SEQ ID NO: 4963928 - DNA, 23 bp, Homo sapiens
cttcctgtctagtctctcctgta

SEQ ID NO: 4963929 - DNA, 16 bp, Homo sapiens
cttcctgtgacttcag

SEQ ID NO: 4963930 - DNA, 18 bp, Homo sapiens
cttcctgtgatccaccca

SEQ ID NO: 4963931 - DNA, 15 bp, Homo sapiens
cttcctttaaaaaac

SEQ ID NO: 4963932 - DNA, 16 bp, Homo sapiens
cttcctttaaaaaact

SEQ ID NO: 4963933 - DNA, 17 bp, Homo sapiens
cttcctttactttccct

SEQ ID NO: 4963934 - DNA, 18 bp, Homo sapiens
cttcctttactttccctt

SEQ ID NO: 4963935 - DNA, 15 bp, Homo sapiens
cttcctttctccagg

SEQ ID NO: 4963936 - DNA, 21 bp, Homo sapiens
cttcctttctctttctctctt

SEQ ID NO: 4963937 - DNA, 17 bp, Homo sapiens
cttcgacttttcttaac

SEQ ID NO: 4963938 - DNA, 21 bp, Homo sapiens
cttcgatacaccgggcctgga

SEQ ID NO: 4963939 - DNA, 16 bp, Homo sapiens
cttcgcaggcatgtcc

SEQ ID NO: 4963940 - DNA, 13 bp, Homo sapiens
cttcgctcctgtg

SEQ ID NO: 4963941 - DNA, 15 bp, Homo sapiens
cttcgctcctgtgtc

SEQ ID NO: 4963942 - DNA, 14 bp, Homo sapiens
cttcggaccgcttg

SEQ ID NO: 4963943 - DNA, 21 bp, Homo sapiens
cttcggaccgcttgtggggac

SEQ ID NO: 4963944 - DNA, 21 bp, Homo sapiens
cttcgtatcccgagtctggga

SEQ ID NO: 4963945 - DNA, 22 bp, Homo sapiens
cttcgtatcccgagtctgggac

SEQ ID NO: 4963946 - DNA, 15 bp, Homo sapiens
cttctaataaattat

SEQ ID NO: 4963947 - DNA, 17 bp, Homo sapiens
cttctaataaattatac

SEQ ID NO: 4963948 - DNA, 11 bp, Homo sapiens
cttctaatata

SEQ ID NO: 4963949 - DNA, 12 bp, Homo sapiens
cttctaatatat

SEQ ID NO: 4963950 - DNA, 15 bp, Homo sapiens
cttctaatatatttt

SEQ ID NO: 4963951 - DNA, 17 bp, Homo sapiens
cttctaccatgaacaga

SEQ ID NO: 4963952 - DNA, 15 bp, Homo sapiens
cttctagaattataa

SEQ ID NO: 4963953 - DNA, 23 bp, Homo sapiens
cttctagaattataagtcacaaa

SEQ ID NO: 4963954 - DNA, 17 bp, Homo sapiens
cttctattttgtaaact

SEQ ID NO: 4963955 - DNA, 14 bp, Homo sapiens
cttctcaagttcta

SEQ ID NO: 4963956 - DNA, 18 bp, Homo sapiens
cttctcaagttctaagat

SEQ ID NO: 4963957 - DNA, 23 bp, Homo sapiens
cttctcaagttctaagattctaa

SEQ ID NO: 4963958 - DNA, 16 bp, Homo sapiens
cttctcatcttgtgaa

SEQ ID NO: 4963959 - DNA, 14 bp, Homo sapiens
cttctccaaggaaa

SEQ ID NO: 4963960 - DNA, 14 bp, Homo sapiens
cttctccaccctgc

SEQ ID NO: 4963961 - DNA, 17 bp, Homo sapiens
cttctcctttcacaacc

SEQ ID NO: 4963962 - DNA, 15 bp, Homo sapiens
cttctctccctgcca

SEQ ID NO: 4963963 - DNA, 16 bp, Homo sapiens
cttctctgaacacagg

SEQ ID NO: 4963964 - DNA, 20 bp, Homo sapiens
cttctctgaacacaggcagc

SEQ ID NO: 4963965 - DNA, 13 bp, Homo sapiens
cttctctgaagga

SEQ ID NO: 4963966 - DNA, 23 bp, Homo sapiens
cttctctgcctttgacatttaat

SEQ ID NO: 4963967 - DNA, 14 bp, Homo sapiens
cttctctgctccac

SEQ ID NO: 4963968 - DNA, 14 bp, Homo sapiens
cttctctgtctcag

SEQ ID NO: 4963969 - DNA, 16 bp, Homo sapiens
cttctcttaaacttgt

SEQ ID NO: 4963970 - DNA, 17 bp, Homo sapiens
cttctcttgctttctat

SEQ ID NO: 4963971 - DNA, 21 bp, Homo sapiens
cttctgactgctgattctccc

SEQ ID NO: 4963972 - DNA, 18 bp, Homo sapiens
cttctgccctccctggag

SEQ ID NO: 4963973 - DNA, 19 bp, Homo sapiens
cttctgccttagtctcagt

SEQ ID NO: 4963974 - DNA, 15 bp, Homo sapiens
cttctgcgcctcagg

SEQ ID NO: 4963975 - DNA, 10 bp, Homo sapiens
cttctgctcc

SEQ ID NO: 4963976 - DNA, 13 bp, Homo sapiens
cttctgctccacc

SEQ ID NO: 4963977 - DNA, 23 bp, Homo sapiens
cttctgctccacccttggcctgt

SEQ ID NO: 4963978 - DNA, 16 bp, Homo sapiens
cttctgcttcagcctc

SEQ ID NO: 4963979 - DNA, 18 bp, Homo sapiens
cttctgcttcagcctccc

SEQ ID NO: 4963980 - DNA, 17 bp, Homo sapiens
cttctggcacttggaga

SEQ ID NO: 4963981 - DNA, 22 bp, Homo sapiens
cttctggcctttcctctctcct

SEQ ID NO: 4963982 - DNA, 20 bp, Homo sapiens
cttctggcttccttctctca

SEQ ID NO: 4963983 - DNA, 20 bp, Homo sapiens
cttctggggcaggctgggcc

SEQ ID NO: 4963984 - DNA, 18 bp, Homo sapiens
cttctgtacgtctgacag

SEQ ID NO: 4963985 - DNA, 20 bp, Homo sapiens
cttctgtacgtctgacaggc

SEQ ID NO: 4963986 - DNA, 14 bp, Homo sapiens
cttctgtgtttata

SEQ ID NO: 4963987 - DNA, 16 bp, Homo sapiens
cttcttaattaatttg

SEQ ID NO: 4963988 - DNA, 22 bp, Homo sapiens
cttcttaattaatttgattaac

SEQ ID NO: 4963989 - DNA, 22 bp, Homo sapiens
cttcttagctatcattgcttcc

SEQ ID NO: 4963990 - DNA, 19 bp, Homo sapiens
cttcttatggaattgattt

SEQ ID NO: 4963991 - DNA, 23 bp, Homo sapiens
cttcttatggaattgatttgcat

SEQ ID NO: 4963992 - DNA, 18 bp, Homo sapiens
cttcttccatcccaggac

SEQ ID NO: 4963993 - DNA, 15 bp, Homo sapiens
cttcttcctttctct

SEQ ID NO: 4963994 - DNA, 20 bp, Homo sapiens
cttcttgcatccttcctata

SEQ ID NO: 4963995 - DNA, 22 bp, Homo sapiens
cttcttgcatccttcctataac

SEQ ID NO: 4963996 - DNA, 20 bp, Homo sapiens
cttcttgtcagacataaagc

SEQ ID NO: 4963997 - DNA, 22 bp, Homo sapiens
cttcttgtcagacataaagcca

SEQ ID NO: 4963998 - DNA, 13 bp, Homo sapiens
cttcttgttcccc

SEQ ID NO: 4963999 - DNA, 14 bp, Homo sapiens
cttctttatactgt

SEQ ID NO: 4964000 - DNA, 13 bp, Homo sapiens
cttctttgaagaa

SEQ ID NO: 4964001 - DNA, 14 bp, Homo sapiens
cttcttttctcatg

SEQ ID NO: 4964002 - DNA, 16 bp, Homo sapiens
cttcttttgattatgt

SEQ ID NO: 4964003 - DNA, 13 bp, Homo sapiens
cttcttttgctct

SEQ ID NO: 4964004 - DNA, 16 bp, Homo sapiens
cttcttttttttcatt

SEQ ID NO: 4964005 - DNA, 11 bp, Homo sapiens
cttgaacaaaa

SEQ ID NO: 4964006 - DNA, 15 bp, Homo sapiens
cttgaacaaaagggt

SEQ ID NO: 4964007 - DNA, 19 bp, Homo sapiens
cttgaacaaaagggtcaga

SEQ ID NO: 4964008 - DNA, 17 bp, Homo sapiens
cttgaactcctggcctc

SEQ ID NO: 4964009 - DNA, 19 bp, Homo sapiens
cttgaactcctggcctcaa

SEQ ID NO: 4964010 - DNA, 15 bp, Homo sapiens
cttgaatgctgccag

SEQ ID NO: 4964011 - DNA, 16 bp, Homo sapiens
cttgaatgtagcagcc

SEQ ID NO: 4964012 - DNA, 20 bp, Homo sapiens
cttgaatgtagcagccccgg

SEQ ID NO: 4964013 - DNA, 13 bp, Homo sapiens
cttgaatgtcttt

SEQ ID NO: 4964014 - DNA, 22 bp, Homo sapiens
cttgaatgtggcttgagaaata

SEQ ID NO: 4964015 - DNA, 13 bp, Homo sapiens
cttgacagggcac

SEQ ID NO: 4964016 - DNA, 13 bp, Homo sapiens
cttgaccttcctc

SEQ ID NO: 4964017 - DNA, 22 bp, Homo sapiens
cttgaccttcctctggggctct

SEQ ID NO: 4964018 - DNA, 15 bp, Homo sapiens
cttgactcaggattt

SEQ ID NO: 4964019 - DNA, 12 bp, Homo sapiens
cttgagcccagg

SEQ ID NO: 4964020 - DNA, 15 bp, Homo sapiens
cttgagcccaggagt

SEQ ID NO: 4964021 - DNA, 16 bp, Homo sapiens
cttgagctggcctctc

SEQ ID NO: 4964022 - DNA, 16 bp, Homo sapiens
cttgagggcccagagc

SEQ ID NO: 4964023 - DNA, 18 bp, Homo sapiens
cttgagggcccagagcag

SEQ ID NO: 4964024 - DNA, 17 bp, Homo sapiens
cttgagggttgggctgg

SEQ ID NO: 4964025 - DNA, 21 bp, Homo sapiens
cttgagggttgggctggtgtc

SEQ ID NO: 4964026 - DNA, 18 bp, Homo sapiens
cttgagtataagaaatgc

SEQ ID NO: 4964027 - DNA, 22 bp, Homo sapiens
cttgatactaaaagttcttctc

SEQ ID NO: 4964028 - DNA, 19 bp, Homo sapiens
cttgtgccatagtcacatg

SEQ ID NO: 4964029 - DNA, 20 bp, Homo sapiens
cttgtgcttttcctatttgt

SEQ ID NO: 4964030 - DNA, 17 bp, Homo sapiens
cttgtggggacccaggc

SEQ ID NO: 4964031 - DNA, 18 bp, Homo sapiens
cttgtggggacccaggct

SEQ ID NO: 4964032 - DNA, 15 bp, Homo sapiens
cttgtgtctctgtgc

SEQ ID NO: 4964033 - DNA, 21 bp, Homo sapiens
cttgtgtctctgtgcttttaa

SEQ ID NO: 4964034 - DNA, 21 bp, Homo sapiens
cttgtgtgttccaagtttcca

SEQ ID NO: 4964035 - DNA, 15 bp, Homo sapiens
cttgttattgtgaat

SEQ ID NO: 4964036 - DNA, 18 bp, Homo sapiens
cttgttattgtgaatgat

SEQ ID NO: 4964037 - DNA, 20 bp, Homo sapiens
cttgttccagccctattctg

SEQ ID NO: 4964038 - DNA, 16 bp, Homo sapiens
cttgttccagctcttt

SEQ ID NO: 4964039 - DNA, 21 bp, Homo sapiens
cttgttccccactgacagcct

SEQ ID NO: 4964040 - DNA, 11 bp, Homo sapiens
cttgttttcca

SEQ ID NO: 4964041 - DNA, 23 bp, Homo sapiens
cttgttttgtttgtctctccttt

SEQ ID NO: 4964042 - DNA, 18 bp, Homo sapiens
cttgtttttattaattta

SEQ ID NO: 4964043 - DNA, 20 bp, Homo sapiens
cttgtttttattaatttata

SEQ ID NO: 4964044 - DNA, 19 bp, Homo sapiens
ctttaaaaaaatttaagtg

SEQ ID NO: 4964045 - DNA, 18 bp, Homo sapiens
ctttaaaaaatatttatt

SEQ ID NO: 4964046 - DNA, 19 bp, Homo sapiens
ctttaaaaaatatttatta

SEQ ID NO: 4964047 - DNA, 15 bp, Homo sapiens
ctttaaaagagagag

SEQ ID NO: 4964048 - DNA, 10 bp, Homo sapiens
ctttaaagaa

SEQ ID NO: 4964049 - DNA, 14 bp, Homo sapiens
ctttaaaggcccag

SEQ ID NO: 4964050 - DNA, 15 bp, Homo sapiens
ctttaaaggcccagc

SEQ ID NO: 4964051 - DNA, 18 bp, Homo sapiens
ctttaaaggcccagcccc

SEQ ID NO: 4964052 - DNA, 19 bp, Homo sapiens
ctttaaaggcccagcccct

SEQ ID NO: 4964053 - DNA, 16 bp, Homo sapiens
ctttaaataatttaac

SEQ ID NO: 4964054 - DNA, 15 bp, Homo sapiens
ctttaaatgttttat

SEQ ID NO: 4964055 - DNA, 12 bp, Homo sapiens
ctttaaggaaaa

SEQ ID NO: 4964056 - DNA, 17 bp, Homo sapiens
ctttaatgtcacaggca

SEQ ID NO: 4964057 - DNA, 21 bp, Homo sapiens
ctttaatttctgtcagaatgc

SEQ ID NO: 4964058 - DNA, 14 bp, Homo sapiens
ctttacatgcaatt

SEQ ID NO: 4964059 - DNA, 13 bp, Homo sapiens
ctttactttccct

SEQ ID NO: 4964060 - DNA, 17 bp, Homo sapiens
ctttactttcccttgct

SEQ ID NO: 4964061 - DNA, 22 bp, Homo sapiens
ctttactttcccttgcttttcc

SEQ ID NO: 4964062 - DNA, 17 bp, Homo sapiens
ctttagtacctgaaaag

SEQ ID NO: 4964063 - DNA, 14 bp, Homo sapiens
ctttatacattagt

SEQ ID NO: 4964064 - DNA, 21 bp, Homo sapiens
ctttatagtgcacaaaatgaa

SEQ ID NO: 4964065 - DNA, 12 bp, Homo sapiens
ctttatatttag

SEQ ID NO: 4964066 - DNA, 15 bp, Homo sapiens
ctttatatttatcca

SEQ ID NO: 4964067 - DNA, 18 bp, Homo sapiens
ctttatcactttttgaac

SEQ ID NO: 4964068 - DNA, 19 bp, Homo sapiens
ctttatgataatagattct

SEQ ID NO: 4964069 - DNA, 18 bp, Homo sapiens
ctttatgtggaaaacaga

SEQ ID NO: 4964070 - DNA, 20 bp, Homo sapiens
ctttattaccccctccttca

SEQ ID NO: 4964071 - DNA, 20 bp, Homo sapiens
ctttattccagaatgctgta

SEQ ID NO: 4964072 - DNA, 19 bp, Homo sapiens
ctttattgcttttttgtat

SEQ ID NO: 4964073 - DNA, 14 bp, Homo sapiens
ctttatttctgtca

SEQ ID NO: 4964074 - DNA, 16 bp, Homo sapiens
ctttatttgttttttt

SEQ ID NO: 4964075 - DNA, 14 bp, Homo sapiens
ctttcaaatttcac

SEQ ID NO: 4964076 - DNA, 14 bp, Homo sapiens
ctttcaacttgcat

SEQ ID NO: 4964077 - DNA, 16 bp, Homo sapiens
ctttcacaaccttctg

SEQ ID NO: 4964078 - DNA, 14 bp, Homo sapiens
ctttcacagctcct

SEQ ID NO: 4964079 - DNA, 14 bp, Homo sapiens
ctttcagagacagc

SEQ ID NO: 4964080 - DNA, 16 bp, Homo sapiens
ctttcagggccatggt

SEQ ID NO: 4964081 - DNA, 14 bp, Homo sapiens
ctttcagttagcct

SEQ ID NO: 4964082 - DNA, 14 bp, Homo sapiens
ctttccacttcttc

SEQ ID NO: 4964083 - DNA, 19 bp, Homo sapiens
ctttcccaccgccctccct

SEQ ID NO: 4964084 - DNA, 12 bp, Homo sapiens
ctttcccttcct

SEQ ID NO: 4964085 - DNA, 14 bp, Homo sapiens
ctttcccttcctct

SEQ ID NO: 4964086 - DNA, 16 bp, Homo sapiens
ctttcccttcctcttc

SEQ ID NO: 4964087 - DNA, 17 bp, Homo sapiens
ctttcccttcctcttcg

SEQ ID NO: 4964088 - DNA, 19 bp, Homo sapiens
ctttcccttgcttttccct

SEQ ID NO: 4964089 - DNA, 22 bp, Homo sapiens
ctttcctgatggtacaggaaag

SEQ ID NO: 4964090 - DNA, 20 bp, Homo sapiens
ctttcctggacactcagacc

SEQ ID NO: 4964091 - DNA, 23 bp, Homo sapiens
ctttcctggacactcagacctga

SEQ ID NO: 4964092 - DNA, 13 bp, Homo sapiens
ctttccttcctaa

SEQ ID NO: 4964093 - DNA, 18 bp, Homo sapiens
ctttccttgtggcagagg

SEQ ID NO: 4964094 - DNA, 20 bp, Homo sapiens
ctttcctttccccagcccag

SEQ ID NO: 4964095 - DNA, 15 bp, Homo sapiens
ctttcgtcacccttg

SEQ ID NO: 4964096 - DNA, 17 bp, Homo sapiens
ctttctaatgtgtgaat

SEQ ID NO: 4964097 - DNA, 15 bp, Homo sapiens
ctttctaatgtttct

SEQ ID NO: 4964098 - DNA, 23 bp, Homo sapiens
ctttctagaagtttcccttcctc

SEQ ID NO: 4964099 - DNA, 16 bp, Homo sapiens
ctttctagtggtcttt

SEQ ID NO: 4964100 - DNA, 13 bp, Homo sapiens
ctttctccaggac

SEQ ID NO: 4964101 - DNA, 14 bp, Homo sapiens
ctttctccaggacc

SEQ ID NO: 4964102 - DNA, 20 bp, Homo sapiens
ctttctctcagccttacatt

SEQ ID NO: 4964103 - DNA, 17 bp, Homo sapiens
ctttctctttctctctt

SEQ ID NO: 4964104 - DNA, 20 bp, Homo sapiens
ctttctgcagtttttcagga

SEQ ID NO: 4964105 - DNA, 16 bp, Homo sapiens
ctttctgcttgtgtta

SEQ ID NO: 4964106 - DNA, 16 bp, Homo sapiens
ctttctgtaaccataa

SEQ ID NO: 4964107 - DNA, 18 bp, Homo sapiens
ctttctgtatatactttt

SEQ ID NO: 4964108 - DNA, 13 bp, Homo sapiens
ctttctgtgccct

SEQ ID NO: 4964109 - DNA, 15 bp, Homo sapiens
ctttctgtgtgcacc

SEQ ID NO: 4964110 - DNA, 15 bp, Homo sapiens
ctttctgttggtgta

SEQ ID NO: 4964111 - DNA, 21 bp, Homo sapiens
ctttcttataatactctgttg

SEQ ID NO: 4964112 - DNA, 11 bp, Homo sapiens
ctttcttcctc

SEQ ID NO: 4964113 - DNA, 16 bp, Homo sapiens
ctttcttcctctgctg

SEQ ID NO: 4964114 - DNA, 19 bp, Homo sapiens
ctttcttgctcccttcagc

SEQ ID NO: 4964115 - DNA, 15 bp, Homo sapiens
ctttctttaaatgtt

SEQ ID NO: 4964116 - DNA, 19 bp, Homo sapiens
ctttctttttttccccccc

SEQ ID NO: 4964117 - DNA, 19 bp, Homo sapiens
ctttgaaatacctcatgtt

SEQ ID NO: 4964118 - DNA, 20 bp, Homo sapiens
ctttgaaatacctcatgttt

SEQ ID NO: 4964119 - DNA, 21 bp, Homo sapiens
ctttgaaatacctcatgttta

SEQ ID NO: 4964120 - DNA, 22 bp, Homo sapiens
ctttgaactaatgataaagtaa

SEQ ID NO: 4964121 - DNA, 13 bp, Homo sapiens
ctttgaagcctca

SEQ ID NO: 4964122 - DNA, 16 bp, Homo sapiens
ctttgaagcctcagct

SEQ ID NO: 4964123 - DNA, 23 bp, Homo sapiens
ctttgaagctgaaaatataaaac

SEQ ID NO: 4964124 - DNA, 16 bp, Homo sapiens
ctttgaaggggcctca

SEQ ID NO: 4964125 - DNA, 16 bp, Homo sapiens
ctttgaatgctttttg

SEQ ID NO: 4964126 - DNA, 23 bp, Homo sapiens
ctttgaatgctttttgaatgtta

SEQ ID NO: 4964127 - DNA, 17 bp, Homo sapiens
ctttgacatttaattta

SEQ ID NO: 4964128 - DNA, 18 bp, Homo sapiens
ctttgacatttaatttag

SEQ ID NO: 4964129 - DNA, 21 bp, Homo sapiens
ctttgacgagtcaccttccag

SEQ ID NO: 4964130 - DNA, 17 bp, Homo sapiens
ctttgagacagtttctt

SEQ ID NO: 4964131 - DNA, 17 bp, Homo sapiens
ctttgagactgggtctc

SEQ ID NO: 4964132 - DNA, 14 bp, Homo sapiens
ctttgataatgtta

SEQ ID NO: 4964133 - DNA, 15 bp, Homo sapiens
ctttgataatgttaa

SEQ ID NO: 4964134 - DNA, 22 bp, Homo sapiens
ctttgatattttcaacgcagcc

SEQ ID NO: 4964135 - DNA, 13 bp, Homo sapiens
ctttgattctcct

SEQ ID NO: 4964136 - DNA, 20 bp, Homo sapiens
ctttgcacaggatgctggcc

SEQ ID NO: 4964137 - DNA, 14 bp, Homo sapiens
ctttgcacattttg

SEQ ID NO: 4964138 - DNA, 17 bp, Homo sapiens
cttttttgtttgtttct

SEQ ID NO: 4964139 - DNA, 19 bp, Homo sapiens
ctttttttccatctttaca

SEQ ID NO: 4964140 - DNA, 17 bp, Homo sapiens
gaaaaaaaaaagaagaa

SEQ ID NO: 4964141 - DNA, 18 bp, Homo sapiens
gaaaaaaaaaagaagaag

SEQ ID NO: 4964142 - DNA, 17 bp, Homo sapiens
gaaaaaaacgaaaacag

SEQ ID NO: 4964143 - DNA, 22 bp, Homo sapiens
gaaaaaaatcttctccagattt

SEQ ID NO: 4964144 - DNA, 11 bp, Homo sapiens
gaaaaaagctc

SEQ ID NO: 4964145 - DNA, 17 bp, Homo sapiens
gaaaaaagttccttcct

SEQ ID NO: 4964146 - DNA, 20 bp, Homo sapiens
gaaaaacacatggggaaaaa

SEQ ID NO: 4964147 - DNA, 11 bp, Homo sapiens
gaaaaacaggt

SEQ ID NO: 4964148 - DNA, 20 bp, Homo sapiens
gaaaaaccactcccagtccc

SEQ ID NO: 4964149 - DNA, 15 bp, Homo sapiens
gaaaaaccatttgaa

SEQ ID NO: 4964150 - DNA, 20 bp, Homo sapiens
gaaaaagctccatgtgcctc

SEQ ID NO: 4964151 - DNA, 21 bp, Homo sapiens
gaaaaagctcctgtcctccca

SEQ ID NO: 4964152 - DNA, 21 bp, Homo sapiens
gaaaaatcttgtgctagaata

SEQ ID NO: 4964153 - DNA, 12 bp, Homo sapiens
gaaaaatgtttg

SEQ ID NO: 4964154 - DNA, 14 bp, Homo sapiens
gaaaaatgtttgtc

SEQ ID NO: 4964155 - DNA, 19 bp, Homo sapiens
gaaaacaaaattttatttt

SEQ ID NO: 4964156 - DNA, 19 bp, Homo sapiens
gaaaacaatgcaaaacctt

SEQ ID NO: 4964157 - DNA, 21 bp, Homo sapiens
gaaaaccaaaatgacatcttt

SEQ ID NO: 4964158 - DNA, 18 bp, Homo sapiens
gaaaaccaagccgtggct

SEQ ID NO: 4964159 - DNA, 19 bp, Homo sapiens
gaaaaccaagccgtggctt

SEQ ID NO: 4964160 - DNA, 21 bp, Homo sapiens
gaaaaccaagccgtggcttcc

SEQ ID NO: 4964161 - DNA, 19 bp, Homo sapiens
gaaaaccatctggcctggc

SEQ ID NO: 4964162 - DNA, 20 bp, Homo sapiens
gaaaaccatctggcctggcc

SEQ ID NO: 4964163 - DNA, 21 bp, Homo sapiens
gaaaaccatctggcctggcct

SEQ ID NO: 4964164 - DNA, 13 bp, Homo sapiens
gaaaacggagctg

SEQ ID NO: 4964165 - DNA, 14 bp, Homo sapiens
gaaaacggagctga

SEQ ID NO: 4964166 - DNA, 17 bp, Homo sapiens
gaaaactcattactttt

SEQ ID NO: 4964167 - DNA, 16 bp, Homo sapiens
gaaaactgaaaatcta

SEQ ID NO: 4964168 - DNA, 17 bp, Homo sapiens
gaaaactggaataagaa

SEQ ID NO: 4964169 - DNA, 11 bp, Homo sapiens
gaaaactgtta

SEQ ID NO: 4964170 - DNA, 22 bp, Homo sapiens
gaaaacttgtgtgaaattttct

SEQ ID NO: 4964171 - DNA, 22 bp, Homo sapiens
gaaaagaaaaaaaaaagaagaa

SEQ ID NO: 4964172 - DNA, 23 bp, Homo sapiens
gaaaagaaaaaaaaaagaagaag

SEQ ID NO: 4964173 - DNA, 19 bp, Homo sapiens
gaaaagaacgtattttaaa

SEQ ID NO: 4964174 - DNA, 19 bp, Homo sapiens
gaaaagaactgtttactgc

SEQ ID NO: 4964175 - DNA, 16 bp, Homo sapiens
gaaaagacaagaaaat

SEQ ID NO: 4964176 - DNA, 14 bp, Homo sapiens
gaaaagctattagc

SEQ ID NO: 4964177 - DNA, 17 bp, Homo sapiens
gaaaagctattagccag

SEQ ID NO: 4964178 - DNA, 18 bp, Homo sapiens
gaaaagcttcttaattaa

SEQ ID NO: 4964179 - DNA, 22 bp, Homo sapiens
gaaaagcttcttaattaatttg

SEQ ID NO: 4964180 - DNA, 14 bp, Homo sapiens
gaaaaggaaaagaa

SEQ ID NO: 4964181 - DNA, 23 bp, Homo sapiens
gaaaaggtagcttacctgacaca

SEQ ID NO: 4964182 - DNA, 23 bp, Homo sapiens
gaaaaggttcttcatccctttcc

SEQ ID NO: 4964183 - DNA, 20 bp, Homo sapiens
gaaaataaagacaaccatat

SEQ ID NO: 4964184 - DNA, 22 bp, Homo sapiens
gaaaataaagacaaccatattt

SEQ ID NO: 4964185 - DNA, 17 bp, Homo sapiens
gaaaatattatgtgttt

SEQ ID NO: 4964186 - DNA, 18 bp, Homo sapiens
gaaaatattttttatata

SEQ ID NO: 4964187 - DNA, 20 bp, Homo sapiens
gaaaatgaatatctattaat

SEQ ID NO: 4964188 - DNA, 23 bp, Homo sapiens
gaaaatggtttattttgtattgt

SEQ ID NO: 4964189 - DNA, 19 bp, Homo sapiens
gaaaatgtactgagatttt

SEQ ID NO: 4964190 - DNA, 14 bp, Homo sapiens
gaaaatgttcatca

SEQ ID NO: 4964191 - DNA, 20 bp, Homo sapiens
gaaaatgttgagaatcccaa

SEQ ID NO: 4964192 - DNA, 21 bp, Homo sapiens
gaaaatgttgagaatcccaaa

SEQ ID NO: 4964193 - DNA, 22 bp, Homo sapiens
gaaaattaggatttcatgattt

SEQ ID NO: 4964194 - DNA, 22 bp, Homo sapiens
gaaaattcaaaaagtgtttatt

SEQ ID NO: 4964195 - DNA, 16 bp, Homo sapiens
gaaaattcatttcaca

SEQ ID NO: 4964196 - DNA, 23 bp, Homo sapiens
gaaacaaaaacactaaaaataaa

SEQ ID NO: 4964197 - DNA, 17 bp, Homo sapiens
gaaacaaataatcacat

SEQ ID NO: 4964198 - DNA, 17 bp, Homo sapiens
gaaacaagtgaaagcat

SEQ ID NO: 4964199 - DNA, 13 bp, Homo sapiens
gaaacacagaaac

SEQ ID NO: 4964200 - DNA, 18 bp, Homo sapiens
gaaacacgaaacttgtta

SEQ ID NO: 4964201 - DNA, 11 bp, Homo sapiens
gaaacactgcc

SEQ ID NO: 4964202 - DNA, 13 bp, Homo sapiens
gaaacactgcctt

SEQ ID NO: 4964203 - DNA, 14 bp, Homo sapiens
gaaacactgccttt

SEQ ID NO: 4964204 - DNA, 16 bp, Homo sapiens
gaaacactgccttttt

SEQ ID NO: 4964205 - DNA, 14 bp, Homo sapiens
gaaacagataccat

SEQ ID NO: 4964206 - DNA, 16 bp, Homo sapiens
gaaacagatttcatac

SEQ ID NO: 4964207 - DNA, 18 bp, Homo sapiens
gaaacagctaatgggaca

SEQ ID NO: 4964208 - DNA, 18 bp, Homo sapiens
gaaacagctttcaagtgc

SEQ ID NO: 4964209 - DNA, 21 bp, Homo sapiens
gaaacagctttcaagtgcctt

SEQ ID NO: 4964210 - DNA, 16 bp, Homo sapiens
gaaacatgacactgac

SEQ ID NO: 4964211 - DNA, 14 bp, Homo sapiens
gaaacatttatatt

SEQ ID NO: 4964212 - DNA, 19 bp, Homo sapiens
gaaacatttatatttttat

SEQ ID NO: 4964213 - DNA, 18 bp, Homo sapiens
gaaacccaagctcctcct

SEQ ID NO: 4964214 - DNA, 13 bp, Homo sapiens
gaaacctgaaaaa

SEQ ID NO: 4964215 - DNA, 19 bp, Homo sapiens
gaaacctgctctgtaggag

SEQ ID NO: 4964216 - DNA, 16 bp, Homo sapiens
gaaacctgggattcag

SEQ ID NO: 4964217 - DNA, 13 bp, Homo sapiens
gaaaccttaatat

SEQ ID NO: 4964218 - DNA, 17 bp, Homo sapiens
gaaaccttttttaagat

SEQ ID NO: 4964219 - DNA, 22 bp, Homo sapiens
gaaaccttttttaagatttttc

SEQ ID NO: 4964220 - DNA, 15 bp, Homo sapiens
gaaacttgttattgt

SEQ ID NO: 4964221 - DNA, 17 bp, Homo sapiens
gaaactttatacattag

SEQ ID NO: 4964222 - DNA, 15 bp, Homo sapiens
gaaacttttgtaaag

SEQ ID NO: 4964223 - DNA, 11 bp, Homo sapiens
gaaagaaggaa

SEQ ID NO: 4964224 - DNA, 18 bp, Homo sapiens
gaaagaatatatttattt

SEQ ID NO: 4964225 - DNA, 18 bp, Homo sapiens
gaaagacaccatttatct

SEQ ID NO: 4964226 - DNA, 15 bp, Homo sapiens
gaaagacactgcctg

SEQ ID NO: 4964227 - DNA, 18 bp, Homo sapiens
gaaagacactgcctgggc

SEQ ID NO: 4964228 - DNA, 20 bp, Homo sapiens
gaaagacactgcctgggctg

SEQ ID NO: 4964229 - DNA, 11 bp, Homo sapiens
gaaagagagag

SEQ ID NO: 4964230 - DNA, 17 bp, Homo sapiens
gaaagagagagaaacaa

SEQ ID NO: 4964231 - DNA, 20 bp, Homo sapiens
gaaagcagatacctcaccct

SEQ ID NO: 4964232 - DNA, 19 bp, Homo sapiens
gaaagcaggggctacaaga

SEQ ID NO: 4964233 - DNA, 14 bp, Homo sapiens
gaaagccccagcac

SEQ ID NO: 4964234 - DNA, 18 bp, Homo sapiens
gaaagcctcactgatata

SEQ ID NO: 4964235 - DNA, 16 bp, Homo sapiens
gaaagccttagggaag

SEQ ID NO: 4964236 - DNA, 12 bp, Homo sapiens
gaaagctctaga

SEQ ID NO: 4964237 - DNA, 18 bp, Homo sapiens
gaaaggaaaacctgaaga

SEQ ID NO: 4964238 - DNA, 20 bp, Homo sapiens
gaaaggaaaacctgaagact

SEQ ID NO: 4964239 - DNA, 21 bp, Homo sapiens
gaaaggaggcatgcctctgat

SEQ ID NO: 4964240 - DNA, 15 bp, Homo sapiens
gaaaggcctgcacac

SEQ ID NO: 4964241 - DNA, 19 bp, Homo sapiens
gaaagggacttggaagctc

SEQ ID NO: 4964242 - DNA, 14 bp, Homo sapiens
gaaaggggttgggg

SEQ ID NO: 4964243 - DNA, 14 bp, Homo sapiens
gaaaggttctgccc

SEQ ID NO: 4964244 - DNA, 14 bp, Homo sapiens
gaaaggtttacatt

SEQ ID NO: 4964245 - DNA, 17 bp, Homo sapiens
gaaagtgaataaacttc

SEQ ID NO: 4964246 - DNA, 21 bp, Homo sapiens
gaaagtgaataaacttcagca

SEQ ID NO: 4964247 - DNA, 21 bp, Homo sapiens
gaaagtgggaggtcaggaaac

SEQ ID NO: 4964248 - DNA, 12 bp, Homo sapiens
gaatattgtgtt

SEQ ID NO: 4964249 - DNA, 15 bp, Homo sapiens
gaatcaaaaattgaa

SEQ ID NO: 4964250 - DNA, 16 bp, Homo sapiens
gaatcaagagctgccc

SEQ ID NO: 4964251 - DNA, 16 bp, Homo sapiens
gaatcagagtagaaat

SEQ ID NO: 4964252 - DNA, 13 bp, Homo sapiens
gaatcagcacaga

SEQ ID NO: 4964253 - DNA, 17 bp, Homo sapiens
gaatcatgtcaggcctg

SEQ ID NO: 4964254 - DNA, 14 bp, Homo sapiens
gaatccaagcctcc

SEQ ID NO: 4964255 - DNA, 17 bp, Homo sapiens
gaatccaagcctccaca

SEQ ID NO: 4964256 - DNA, 15 bp, Homo sapiens
gaatccaagctccct

SEQ ID NO: 4964257 - DNA, 18 bp, Homo sapiens
gaatccaagctccctgcc

SEQ ID NO: 4964258 - DNA, 17 bp, Homo sapiens
gaatccacatttctaaa

SEQ ID NO: 4964259 - DNA, 20 bp, Homo sapiens
gaatccagacccggctgcgt

SEQ ID NO: 4964260 - DNA, 14 bp, Homo sapiens
gaatcccccttgcc

SEQ ID NO: 4964261 - DNA, 18 bp, Homo sapiens
gaatcccccttgccaccc

SEQ ID NO: 4964262 - DNA, 14 bp, Homo sapiens
gaatcctggcagcc

SEQ ID NO: 4964263 - DNA, 17 bp, Homo sapiens
gaatcctggcagcccag

SEQ ID NO: 4964264 - DNA, 22 bp, Homo sapiens
gaatctacccccagatccaagc

SEQ ID NO: 4964265 - DNA, 17 bp, Homo sapiens
gaatctattttctatgt

SEQ ID NO: 4964266 - DNA, 18 bp, Homo sapiens
gaatctattttctatgta

SEQ ID NO: 4964267 - DNA, 23 bp, Homo sapiens
gaatctattttctatgtactagt

SEQ ID NO: 4964268 - DNA, 17 bp, Homo sapiens
gaatctcccactccagc

SEQ ID NO: 4964269 - DNA, 22 bp, Homo sapiens
gaatctgcaattcaaaagttcc

SEQ ID NO: 4964270 - DNA, 15 bp, Homo sapiens
gaatgaaaactcatt

SEQ ID NO: 4964271 - DNA, 13 bp, Homo sapiens
gaatgaaaagaca

SEQ ID NO: 4964272 - DNA, 14 bp, Homo sapiens
gaatgaaagggccc

SEQ ID NO: 4964273 - DNA, 18 bp, Homo sapiens
gaatgaaccacatcttgc

SEQ ID NO: 4964274 - DNA, 12 bp, Homo sapiens
gaatgagcccag

SEQ ID NO: 4964275 - DNA, 19 bp, Homo sapiens
gaatgagcccagagaacag

SEQ ID NO: 4964276 - DNA, 11 bp, Homo sapiens
gaatgagcctc

SEQ ID NO: 4964277 - DNA, 14 bp, Homo sapiens
gaatgaggtcccag

SEQ ID NO: 4964278 - DNA, 17 bp, Homo sapiens
gaatgaggtcccaggca

SEQ ID NO: 4964279 - DNA, 18 bp, Homo sapiens
gaatgaggtcccaggcag

SEQ ID NO: 4964280 - DNA, 19 bp, Homo sapiens
gaatgaggtcccaggcaga

SEQ ID NO: 4964281 - DNA, 15 bp, Homo sapiens
gaatgaggtctgggc

SEQ ID NO: 4964282 - DNA, 16 bp, Homo sapiens
gaatgatctcttcttt

SEQ ID NO: 4964283 - DNA, 15 bp, Homo sapiens
gaatgattcatgtta

SEQ ID NO: 4964284 - DNA, 23 bp, Homo sapiens
gaatgattctaatttttaagcaa

SEQ ID NO: 4964285 - DNA, 14 bp, Homo sapiens
gaatgatttcatgc

SEQ ID NO: 4964286 - DNA, 14 bp, Homo sapiens
gaatgatttttaga

SEQ ID NO: 4964287 - DNA, 22 bp, Homo sapiens
gaatgcacagatatactttgtg

SEQ ID NO: 4964288 - DNA, 16 bp, Homo sapiens
gaatgcctcctgtggg

SEQ ID NO: 4964289 - DNA, 18 bp, Homo sapiens
gaatgcctcctgtgggga

SEQ ID NO: 4964290 - DNA, 10 bp, Homo sapiens
gaatgctgcc

SEQ ID NO: 4964291 - DNA, 11 bp, Homo sapiens
gaatgctgcca

SEQ ID NO: 4964292 - DNA, 20 bp, Homo sapiens
gaatgctgtacatctatttt

SEQ ID NO: 4964293 - DNA, 12 bp, Homo sapiens
gaatgcttctca

SEQ ID NO: 4964294 - DNA, 19 bp, Homo sapiens
gaatggattggattattta

SEQ ID NO: 4964295 - DNA, 21 bp, Homo sapiens
gaatgtagcagccccgggagg

SEQ ID NO: 4964296 - DNA, 16 bp, Homo sapiens
gaatgtatctgtgaag

SEQ ID NO: 4964297 - DNA, 14 bp, Homo sapiens
gaatgtatgtaatg

SEQ ID NO: 4964298 - DNA, 17 bp, Homo sapiens
gaatgtatgtaatgtgt

SEQ ID NO: 4964299 - DNA, 23 bp, Homo sapiens
gaatgtatttatttgggagaccg

SEQ ID NO: 4964300 - DNA, 14 bp, Homo sapiens
gaatgtggtctcag

SEQ ID NO: 4964301 - DNA, 17 bp, Homo sapiens
gaatgtggtctcaggat

SEQ ID NO: 4964302 - DNA, 18 bp, Homo sapiens
gaatgtgtacaaagtgta

SEQ ID NO: 4964303 - DNA, 12 bp, Homo sapiens
gaatgtgtcagg

SEQ ID NO: 4964304 - DNA, 19 bp, Homo sapiens
gaatgttaagaattgacca

SEQ ID NO: 4964305 - DNA, 15 bp, Homo sapiens
gaatgttaagcagat

SEQ ID NO: 4964306 - DNA, 20 bp, Homo sapiens
gaatgttggtttactttcaa

SEQ ID NO: 4964307 - DNA, 14 bp, Homo sapiens
gaatgtttattcct

SEQ ID NO: 4964308 - DNA, 15 bp, Homo sapiens
gaatgtttcttaact

SEQ ID NO: 4964309 - DNA, 23 bp, Homo sapiens
gaatgtttcttaactataaatat

SEQ ID NO: 4964310 - DNA, 22 bp, Homo sapiens
gaattaaaacttcttaaatatc

SEQ ID NO: 4964311 - DNA, 12 bp, Homo sapiens
gaattaaataaa

SEQ ID NO: 4964312 - DNA, 13 bp, Homo sapiens
gaattaagaatat

SEQ ID NO: 4964313 - DNA, 17 bp, Homo sapiens
gaattaagatacaaatt

SEQ ID NO: 4964314 - DNA, 21 bp, Homo sapiens
gaattaatcatctataaagaa

SEQ ID NO: 4964315 - DNA, 15 bp, Homo sapiens
gaattagattatatt

SEQ ID NO: 4964316 - DNA, 16 bp, Homo sapiens
gaattagtaaagttag

SEQ ID NO: 4964317 - DNA, 13 bp, Homo sapiens
gaattgatttgca

SEQ ID NO: 4964318 - DNA, 17 bp, Homo sapiens
gaattgatttgcattga

SEQ ID NO: 4964319 - DNA, 13 bp, Homo sapiens
gaatttatacctc

SEQ ID NO: 4964320 - DNA, 17 bp, Homo sapiens
gaatttctaaaaaacag

SEQ ID NO: 4964321 - DNA, 19 bp, Homo sapiens
gaatttcttcactgttgaa

SEQ ID NO: 4964322 - DNA, 13 bp, Homo sapiens
gaatttgttatca

SEQ ID NO: 4964323 - DNA, 15 bp, Homo sapiens
gaattttacatggta

SEQ ID NO: 4964324 - DNA, 19 bp, Homo sapiens
gaattttaggaacttcaga

SEQ ID NO: 4964325 - DNA, 22 bp, Homo sapiens
gaatttttttttcctagccctc

SEQ ID NO: 4964326 - DNA, 16 bp, Homo sapiens
gacaaaaagtttccat

SEQ ID NO: 4964327 - DNA, 19 bp, Homo sapiens
gacaaaacttcttgtcaga

SEQ ID NO: 4964328 - DNA, 22 bp, Homo sapiens
gacaaaacttcttgtcagacat

SEQ ID NO: 4964329 - DNA, 16 bp, Homo sapiens
gacaaaatatttccca

SEQ ID NO: 4964330 - DNA, 13 bp, Homo sapiens
gacaaaatgtttt

SEQ ID NO: 4964331 - DNA, 23 bp, Homo sapiens
gacaaatcaacagaagcatttgt

SEQ ID NO: 4964332 - DNA, 12 bp, Homo sapiens
gacaaccatgac

SEQ ID NO: 4964333 - DNA, 12 bp, Homo sapiens
gacaactgtgac

SEQ ID NO: 4964334 - DNA, 23 bp, Homo sapiens
gacaagagcctgatctcttcctg

SEQ ID NO: 4964335 - DNA, 18 bp, Homo sapiens
gacaagatattgtacata

SEQ ID NO: 4964336 - DNA, 19 bp, Homo sapiens
gacaagatattgtacataa

SEQ ID NO: 4964337 - DNA, 19 bp, Homo sapiens
gacaaggattgctactgtc

SEQ ID NO: 4964338 - DNA, 13 bp, Homo sapiens
gacaagggctgac

SEQ ID NO: 4964339 - DNA, 20 bp, Homo sapiens
gacaagtgactgtatctgtg

SEQ ID NO: 4964340 - DNA, 19 bp, Homo sapiens
gacaatcatgaaatatgca

SEQ ID NO: 4964341 - DNA, 21 bp, Homo sapiens
gacaatcatgaaatatgcatc

SEQ ID NO: 4964342 - DNA, 14 bp, Homo sapiens
gacaatcattgttt

SEQ ID NO: 4964343 - DNA, 21 bp, Homo sapiens
gacaattgttttaatctgaaa

SEQ ID NO: 4964344 - DNA, 22 bp, Homo sapiens
gacaatttgatacataataaaa

SEQ ID NO: 4964345 - DNA, 17 bp, Homo sapiens
gacacaaaactccgccc

SEQ ID NO: 4964346 - DNA, 13 bp, Homo sapiens
gacacaactattt

SEQ ID NO: 4964347 - DNA, 22 bp, Homo sapiens
gacacaagtggaccttaggcct

SEQ ID NO: 4964348 - DNA, 13 bp, Homo sapiens
gacacacacacgc

SEQ ID NO: 4964349 - DNA, 18 bp, Homo sapiens
gacacacacacgcacgca

SEQ ID NO: 4964350 - DNA, 23 bp, Homo sapiens
gacacacacacgcacgcacacac

SEQ ID NO: 4964351 - DNA, 17 bp, Homo sapiens
gacacacagctctgtcc

SEQ ID NO: 4964352 - DNA, 11 bp, Homo sapiens
gacacagaaaa

SEQ ID NO: 4964353 - DNA, 18 bp, Homo sapiens
gacacagcagcttcacca

SEQ ID NO: 4964354 - DNA, 20 bp, Homo sapiens
gacacagcagcttcaccaga

SEQ ID NO: 4964355 - DNA, 21 bp, Homo sapiens
gacacagcgtccctagcagtg

SEQ ID NO: 4964356 - DNA, 12 bp, Homo sapiens
gacacagctctt

SEQ ID NO: 4964357 - DNA, 16 bp, Homo sapiens
gacacagctcttctcc

SEQ ID NO: 4964358 - DNA, 17 bp, Homo sapiens
gacacagctcttctcca

SEQ ID NO: 4964359 - DNA, 22 bp, Homo sapiens
gaccaactgtgttgtattaaca

SEQ ID NO: 4964360 - DNA, 15 bp, Homo sapiens
gaccaaggaacaaaa

SEQ ID NO: 4964361 - DNA, 16 bp, Homo sapiens
gaccaattattgatat

SEQ ID NO: 4964362 - DNA, 18 bp, Homo sapiens
gaccaattgtgctgccat

SEQ ID NO: 4964363 - DNA, 23 bp, Homo sapiens
gaccacatctttatctgttcttg

SEQ ID NO: 4964364 - DNA, 22 bp, Homo sapiens
gaccaccaccccaacaaaccat

SEQ ID NO: 4964365 - DNA, 14 bp, Homo sapiens
gaccacctgcccaa

SEQ ID NO: 4964366 - DNA, 12 bp, Homo sapiens
gaccactcagcc

SEQ ID NO: 4964367 - DNA, 13 bp, Homo sapiens
gaccactcagccc

SEQ ID NO: 4964368 - DNA, 15 bp, Homo sapiens
gaccactcagcccct

SEQ ID NO: 4964369 - DNA, 12 bp, Homo sapiens
gaccactgcatg

SEQ ID NO: 4964370 - DNA, 23 bp, Homo sapiens
gaccacttccaggggaacctgcc

SEQ ID NO: 4964371 - DNA, 15 bp, Homo sapiens
gaccagaggagcctt

SEQ ID NO: 4964372 - DNA, 20 bp, Homo sapiens
gaccagcctccatgctgcct

SEQ ID NO: 4964373 - DNA, 22 bp, Homo sapiens
gaccagcctccatgctgcctcc

SEQ ID NO: 4964374 - DNA, 23 bp, Homo sapiens
gaccatccactctaccctcccac

SEQ ID NO: 4964375 - DNA, 12 bp, Homo sapiens
gaccatgtgtca

SEQ ID NO: 4964376 - DNA, 19 bp, Homo sapiens
gacccaatgtaggagctgc

SEQ ID NO: 4964377 - DNA, 13 bp, Homo sapiens
gacccacatgtaa

SEQ ID NO: 4964378 - DNA, 16 bp, Homo sapiens
gacccaccccacctgc

SEQ ID NO: 4964379 - DNA, 11 bp, Homo sapiens
gacccactgct

SEQ ID NO: 4964380 - DNA, 20 bp, Homo sapiens
gacccactggttccttcttc

SEQ ID NO: 4964381 - DNA, 22 bp, Homo sapiens
gacccagtgagattacagagga

SEQ ID NO: 4964382 - DNA, 22 bp, Homo sapiens
gacccatgtaaataccagactg

SEQ ID NO: 4964383 - DNA, 12 bp, Homo sapiens
gacccccaacca

SEQ ID NO: 4964384 - DNA, 22 bp, Homo sapiens
gacccctagttccctctgctca

SEQ ID NO: 4964385 - DNA, 15 bp, Homo sapiens
gacccctcctcactg

SEQ ID NO: 4964386 - DNA, 13 bp, Homo sapiens
gacccctggcttt

SEQ ID NO: 4964387 - DNA, 21 bp, Homo sapiens
gacccctggcttttcactgct

SEQ ID NO: 4964388 - DNA, 22 bp, Homo sapiens
gacccctggcttttcactgctg

SEQ ID NO: 4964389 - DNA, 20 bp, Homo sapiens
gacccggaggggcctggcag

SEQ ID NO: 4964390 - DNA, 16 bp, Homo sapiens
gaccctctgccaccag

SEQ ID NO: 4964391 - DNA, 22 bp, Homo sapiens
gaccctctgggaacctcccaga

SEQ ID NO: 4964392 - DNA, 19 bp, Homo sapiens
gaccctgcaaacagaacag

SEQ ID NO: 4964393 - DNA, 17 bp, Homo sapiens
gaccctggtgcctggct

SEQ ID NO: 4964394 - DNA, 17 bp, Homo sapiens
gacccttccagacatac

SEQ ID NO: 4964395 - DNA, 14 bp, Homo sapiens
gaccgccccctcct

SEQ ID NO: 4964396 - DNA, 22 bp, Homo sapiens
gaccgcttgtggggacccaggc

SEQ ID NO: 4964397 - DNA, 16 bp, Homo sapiens
gacctcacagtgaccc

SEQ ID NO: 4964398 - DNA, 20 bp, Homo sapiens
gacctcacagtgacccttcc

SEQ ID NO: 4964399 - DNA, 19 bp, Homo sapiens
gacctcaggcactagcctt

SEQ ID NO: 4964400 - DNA, 19 bp, Homo sapiens
gacctcaggtgatccaccc

SEQ ID NO: 4964401 - DNA, 20 bp, Homo sapiens
gacctcaggtgatccaccca

SEQ ID NO: 4964402 - DNA, 21 bp, Homo sapiens
gacctcaggtgatccacccac

SEQ ID NO: 4964403 - DNA, 13 bp, Homo sapiens
gacctccccagcc

SEQ ID NO: 4964404 - DNA, 12 bp, Homo sapiens
gacctcccttcc

SEQ ID NO: 4964405 - DNA, 14 bp, Homo sapiens
gacctcccttccga

SEQ ID NO: 4964406 - DNA, 20 bp, Homo sapiens
gacctcctcttcccccttcc

SEQ ID NO: 4964407 - DNA, 18 bp, Homo sapiens
gacctctactttccaggc

SEQ ID NO: 4964408 - DNA, 16 bp, Homo sapiens
gacctcttgctgtctc

SEQ ID NO: 4964409 - DNA, 20 bp, Homo sapiens
gacctcttgctgtctctgct

SEQ ID NO: 4964410 - DNA, 17 bp, Homo sapiens
gacctgaaattccaaag

SEQ ID NO: 4964411 - DNA, 20 bp, Homo sapiens
gacctgcactggggagcccg

SEQ ID NO: 4964412 - DNA, 20 bp, Homo sapiens
gacctgcctcctgcctgccc

SEQ ID NO: 4964413 - DNA, 22 bp, Homo sapiens
gacctgcctcctgcctgcccct

SEQ ID NO: 4964414 - DNA, 18 bp, Homo sapiens
gacctgcctctcacacac

SEQ ID NO: 4964415 - DNA, 18 bp, Homo sapiens
gacctgctccgctgctcc

SEQ ID NO: 4964416 - DNA, 19 bp, Homo sapiens
gacctgctccgctgctcct

SEQ ID NO: 4964417 - DNA, 21 bp, Homo sapiens
gacctgctccgctgctccttg

SEQ ID NO: 4964418 - DNA, 14 bp, Homo sapiens
gacctggggcacag

SEQ ID NO: 4964419 - DNA, 15 bp, Homo sapiens
gacctggggcacagt

SEQ ID NO: 4964420 - DNA, 13 bp, Homo sapiens
gacctggttttta

SEQ ID NO: 4964421 - DNA, 16 bp, Homo sapiens
gacctgtatttaagca

SEQ ID NO: 4964422 - DNA, 22 bp, Homo sapiens
gacctgtatttaagcaaatact

SEQ ID NO: 4964423 - DNA, 17 bp, Homo sapiens
gacctgtttatgagatg

SEQ ID NO: 4964424 - DNA, 16 bp, Homo sapiens
gaccttaggccttcct

SEQ ID NO: 4964425 - DNA, 18 bp, Homo sapiens
gaccttcctctggggctc

SEQ ID NO: 4964426 - DNA, 14 bp, Homo sapiens
gaccttgaactggg

SEQ ID NO: 4964427 - DNA, 18 bp, Homo sapiens
gaccttggagagacacag

SEQ ID NO: 4964428 - DNA, 21 bp, Homo sapiens
gaccttgggccaaatccgctc

SEQ ID NO: 4964429 - DNA, 20 bp, Homo sapiens
gaccttttaaagtgtttcag

SEQ ID NO: 4964430 - DNA, 22 bp, Homo sapiens
gaccttttaaagtgtttcagct

SEQ ID NO: 4964431 - DNA, 21 bp, Homo sapiens
gacgaacatccaaccttccca

SEQ ID NO: 4964432 - DNA, 17 bp, Homo sapiens
gacgattccttctctga

SEQ ID NO: 4964433 - DNA, 11 bp, Homo sapiens
gacgcccaccc

SEQ ID NO: 4964434 - DNA, 15 bp, Homo sapiens
gacgccctctcccca

SEQ ID NO: 4964435 - DNA, 15 bp, Homo sapiens
gacgcgtctcctgtt

SEQ ID NO: 4964436 - DNA, 22 bp, Homo sapiens
gacgctgatacataactaaatt

SEQ ID NO: 4964437 - DNA, 13 bp, Homo sapiens
gacggagtcccac

SEQ ID NO: 4964438 - DNA, 11 bp, Homo sapiens
gacggccctgc

SEQ ID NO: 4964439 - DNA, 13 bp, Homo sapiens
gacggccctgcaa

SEQ ID NO: 4964440 - DNA, 23 bp, Homo sapiens
gacggcctgatgctccctcccct

SEQ ID NO: 4964441 - DNA, 16 bp, Homo sapiens
gacggggactggggat

SEQ ID NO: 4964442 - DNA, 14 bp, Homo sapiens
gacggtgacaaaga

SEQ ID NO: 4964443 - DNA, 18 bp, Homo sapiens
gacgtggaacctctgtct

SEQ ID NO: 4964444 - DNA, 20 bp, Homo sapiens
gacgtggaacctctgtctca

SEQ ID NO: 4964445 - DNA, 20 bp, Homo sapiens
gacgttcatttgtgtgctca

SEQ ID NO: 4964446 - DNA, 20 bp, Homo sapiens
gactaaatgcctagttttta

SEQ ID NO: 4964447 - DNA, 20 bp, Homo sapiens
gactaaatttggggacagat

SEQ ID NO: 4964448 - DNA, 22 bp, Homo sapiens
gactaattagggtacatttata

SEQ ID NO: 4964449 - DNA, 12 bp, Homo sapiens
gactacaggcac

SEQ ID NO: 4964450 - DNA, 13 bp, Homo sapiens
gactacaggtgtg

SEQ ID NO: 4964451 - DNA, 13 bp, Homo sapiens
gactacttagcat

SEQ ID NO: 4964452 - DNA, 23 bp, Homo sapiens
gactagaagggccagtcctgcct

SEQ ID NO: 4964453 - DNA, 21 bp, Homo sapiens
gactagcccctgtggagactg

SEQ ID NO: 4964454 - DNA, 23 bp, Homo sapiens
gactagcccctgtggagactggg

SEQ ID NO: 4964455 - DNA, 22 bp, Homo sapiens
gactatatacatgtgtgtatat

SEQ ID NO: 4964456 - DNA, 23 bp, Homo sapiens
gactatatacatgtgtgtatata

SEQ ID NO: 4964457 - DNA, 19 bp, Homo sapiens
gactatatagagatgtttt

SEQ ID NO: 4964458 - DNA, 19 bp, Homo sapiens
gactatgaacttctctcag

SEQ ID NO: 4964459 - DNA, 20 bp, Homo sapiens
gactatttaaacttataaat

SEQ ID NO: 4964460 - DNA, 19 bp, Homo sapiens
gactcaaatctccagtatt

SEQ ID NO: 4964461 - DNA, 15 bp, Homo sapiens
gactcaaatgttcta

SEQ ID NO: 4964462 - DNA, 23 bp, Homo sapiens
gactcaggatttaaaaactggaa

SEQ ID NO: 4964463 - DNA, 19 bp, Homo sapiens
gactcagggccatgcctgc

SEQ ID NO: 4964464 - DNA, 22 bp, Homo sapiens
gactcagggccatgcctgcccc

SEQ ID NO: 4964465 - DNA, 15 bp, Homo sapiens
gactcaggttgtctg

SEQ ID NO: 4964466 - DNA, 14 bp, Homo sapiens
gactcattcttctg

SEQ ID NO: 4964467 - DNA, 15 bp, Homo sapiens
gactcattcttctgt

SEQ ID NO: 4964468 - DNA, 19 bp, Homo sapiens
gagactcccatgaagcctt

SEQ ID NO: 4964469 - DNA, 20 bp, Homo sapiens
gagactctagggtccagtgg

SEQ ID NO: 4964470 - DNA, 16 bp, Homo sapiens
gagactggtcctgtgt

SEQ ID NO: 4964471 - DNA, 23 bp, Homo sapiens
gagactggtcctgtgtgcagtga

SEQ ID NO: 4964472 - DNA, 22 bp, Homo sapiens
gagactgtccctgaaacctagt

SEQ ID NO: 4964473 - DNA, 22 bp, Homo sapiens
gagacttttaatcagacaaagt

SEQ ID NO: 4964474 - DNA, 14 bp, Homo sapiens
gagacttttttcta

SEQ ID NO: 4964475 - DNA, 13 bp, Homo sapiens
gagagaaacaaac

SEQ ID NO: 4964476 - DNA, 14 bp, Homo sapiens
gagagaaattctgt

SEQ ID NO: 4964477 - DNA, 16 bp, Homo sapiens
gagagaaattctgtta

SEQ ID NO: 4964478 - DNA, 17 bp, Homo sapiens
gagagaattggctcaat

SEQ ID NO: 4964479 - DNA, 20 bp, Homo sapiens
gagagactcccatgaagcct

SEQ ID NO: 4964480 - DNA, 21 bp, Homo sapiens
gagagactcccatgaagcctt

SEQ ID NO: 4964481 - DNA, 11 bp, Homo sapiens
gagagagaaaa

SEQ ID NO: 4964482 - DNA, 14 bp, Homo sapiens
gagagagagaaatt

SEQ ID NO: 4964483 - DNA, 12 bp, Homo sapiens
gagagagagaga

SEQ ID NO: 4964484 - DNA, 14 bp, Homo sapiens
gagagagagagaaa

SEQ ID NO: 4964485 - DNA, 18 bp, Homo sapiens
gagagatatatctgaaaa

SEQ ID NO: 4964486 - DNA, 13 bp, Homo sapiens
gagagcaactctg

SEQ ID NO: 4964487 - DNA, 17 bp, Homo sapiens
gagagcccctggggcct

SEQ ID NO: 4964488 - DNA, 16 bp, Homo sapiens
gagagcccttcatttg

SEQ ID NO: 4964489 - DNA, 21 bp, Homo sapiens
gagagcggtctcaggctggtg

SEQ ID NO: 4964490 - DNA, 13 bp, Homo sapiens
gagagctgggtgt

SEQ ID NO: 4964491 - DNA, 17 bp, Homo sapiens
gagagctggtgcccgga

SEQ ID NO: 4964492 - DNA, 23 bp, Homo sapiens
gagaggaactccttggcctagcc

SEQ ID NO: 4964493 - DNA, 15 bp, Homo sapiens
gagaggagagaggca

SEQ ID NO: 4964494 - DNA, 17 bp, Homo sapiens
gagaggagccagacaga

SEQ ID NO: 4964495 - DNA, 13 bp, Homo sapiens
gagaggcagagag

SEQ ID NO: 4964496 - DNA, 16 bp, Homo sapiens
gagaggcagagagcgg

SEQ ID NO: 4964497 - DNA, 18 bp, Homo sapiens
gagaggccaaaggctggt

SEQ ID NO: 4964498 - DNA, 19 bp, Homo sapiens
gagaggggaacagactgga

SEQ ID NO: 4964499 - DNA, 17 bp, Homo sapiens
gagagtatttttataca

SEQ ID NO: 4964500 - DNA, 22 bp, Homo sapiens
gagagtatttttatacaaacct

SEQ ID NO: 4964501 - DNA, 13 bp, Homo sapiens
gagagtctagatt

SEQ ID NO: 4964502 - DNA, 15 bp, Homo sapiens
gagatactggtggaa

SEQ ID NO: 4964503 - DNA, 23 bp, Homo sapiens
gagatcaaccccttcgctcctgt

SEQ ID NO: 4964504 - DNA, 23 bp, Homo sapiens
gagatctaaggatgtcacagggc

SEQ ID NO: 4964505 - DNA, 21 bp, Homo sapiens
gagatgctggagaagagagga

SEQ ID NO: 4964506 - DNA, 16 bp, Homo sapiens
gagatgggaaggcaca

SEQ ID NO: 4964507 - DNA, 16 bp, Homo sapiens
gagatgtgtggactgt

SEQ ID NO: 4964508 - DNA, 20 bp, Homo sapiens
gagatgtgtggactgtggca

SEQ ID NO: 4964509 - DNA, 17 bp, Homo sapiens
gagattcagttttcatt

SEQ ID NO: 4964510 - DNA, 17 bp, Homo sapiens
gagattgagaaggagag

SEQ ID NO: 4964511 - DNA, 17 bp, Homo sapiens
gagattggacggcctga

SEQ ID NO: 4964512 - DNA, 12 bp, Homo sapiens
gagatttgtcta

SEQ ID NO: 4964513 - DNA, 13 bp, Homo sapiens
gagcaaagatcaa

SEQ ID NO: 4964514 - DNA, 14 bp, Homo sapiens
gagcaaagatcaaa

SEQ ID NO: 4964515 - DNA, 20 bp, Homo sapiens
gagcacactttagtggccga

SEQ ID NO: 4964516 - DNA, 18 bp, Homo sapiens
gagcacaggtcccacctc

SEQ ID NO: 4964517 - DNA, 23 bp, Homo sapiens
gagcacaggtcccacctccagcc

SEQ ID NO: 4964518 - DNA, 16 bp, Homo sapiens
gagcacccattccaaa

SEQ ID NO: 4964519 - DNA, 21 bp, Homo sapiens
gagcactaaggtgtgctctga

SEQ ID NO: 4964520 - DNA, 17 bp, Homo sapiens
gagcagaagtggagctg

SEQ ID NO: 4964521 - DNA, 14 bp, Homo sapiens
gagcagacaggagg

SEQ ID NO: 4964522 - DNA, 15 bp, Homo sapiens
gagcagacaggagga

SEQ ID NO: 4964523 - DNA, 21 bp, Homo sapiens
gagcagagagcttagcctgga

SEQ ID NO: 4964524 - DNA, 19 bp, Homo sapiens
gagcagatgcagagagcca

SEQ ID NO: 4964525 - DNA, 14 bp, Homo sapiens
gagcagcctgtggc

SEQ ID NO: 4964526 - DNA, 16 bp, Homo sapiens
gagcagcctgtggcat

SEQ ID NO: 4964527 - DNA, 18 bp, Homo sapiens
gagcagcctgtggcatct

SEQ ID NO: 4964528 - DNA, 17 bp, Homo sapiens
gagcagctttaaactca

SEQ ID NO: 4964529 - DNA, 18 bp, Homo sapiens
gagcaggagattgagaag

SEQ ID NO: 4964530 - DNA, 20 bp, Homo sapiens
gagcaggagattgagaagga

SEQ ID NO: 4964531 - DNA, 18 bp, Homo sapiens
gagcaggcggtggggaga

SEQ ID NO: 4964532 - DNA, 16 bp, Homo sapiens
gagcagggaaggcctg

SEQ ID NO: 4964533 - DNA, 18 bp, Homo sapiens
gagcagtccatgcatgac

SEQ ID NO: 4964534 - DNA, 16 bp, Homo sapiens
gagcagtcctgcctca

SEQ ID NO: 4964535 - DNA, 15 bp, Homo sapiens
gagcagtgagcagaa

SEQ ID NO: 4964536 - DNA, 16 bp, Homo sapiens
gagcatagtccaaaaa

SEQ ID NO: 4964537 - DNA, 22 bp, Homo sapiens
gagcatagtccaaaaagctcct

SEQ ID NO: 4964538 - DNA, 22 bp, Homo sapiens
gagcatctcttgaggccaggag

SEQ ID NO: 4964539 - DNA, 20 bp, Homo sapiens
gagcatgttttgtatacaaa

SEQ ID NO: 4964540 - DNA, 19 bp, Homo sapiens
gagccaatttaaagaaaac

SEQ ID NO: 4964541 - DNA, 16 bp, Homo sapiens
gagccacagcagcatt

SEQ ID NO: 4964542 - DNA, 17 bp, Homo sapiens
gagccacagcagcattt

SEQ ID NO: 4964543 - DNA, 18 bp, Homo sapiens
gagccactgcaccgggcc

SEQ ID NO: 4964544 - DNA, 14 bp, Homo sapiens
gagccagacagacc

SEQ ID NO: 4964545 - DNA, 18 bp, Homo sapiens
gagccagctccctctatt

SEQ ID NO: 4964546 - DNA, 14 bp, Homo sapiens
gagccagggtctca

SEQ ID NO: 4964547 - DNA, 23 bp, Homo sapiens
gagccatataagtttgaaggaaa

SEQ ID NO: 4964548 - DNA, 13 bp, Homo sapiens
gagcccaccttgg

SEQ ID NO: 4964549 - DNA, 15 bp, Homo sapiens
gagcccaccttggct

SEQ ID NO: 4964550 - DNA, 21 bp, Homo sapiens
gagcccacggctaagaggctg

SEQ ID NO: 4964551 - DNA, 14 bp, Homo sapiens
gagcccagagaaca

SEQ ID NO: 4964552 - DNA, 17 bp, Homo sapiens
gagcccagccctgttct

SEQ ID NO: 4964553 - DNA, 13 bp, Homo sapiens
gagcccaggcggg

SEQ ID NO: 4964554 - DNA, 15 bp, Homo sapiens
gagcccaggcgggag

SEQ ID NO: 4964555 - DNA, 13 bp, Homo sapiens
gagcccatactca

SEQ ID NO: 4964556 - DNA, 16 bp, Homo sapiens
gagcccatactcagcc

SEQ ID NO: 4964557 - DNA, 18 bp, Homo sapiens
gagcccatactcagcctg

SEQ ID NO: 4964558 - DNA, 16 bp, Homo sapiens
gagccccaggcctctg

SEQ ID NO: 4964559 - DNA, 24 bp, Homo sapiens
gagccccagggtcttccctacctc

SEQ ID NO: 4964560 - DNA, 14 bp, Homo sapiens
gagccccgccctct

SEQ ID NO: 4964561 - DNA, 19 bp, Homo sapiens
gagccccgccctcttcctg

SEQ ID NO: 4964562 - DNA, 20 bp, Homo sapiens
gagcccctggtcctgagggt

SEQ ID NO: 4964563 - DNA, 17 bp, Homo sapiens
gagccctactccctgca

SEQ ID NO: 4964564 - DNA, 19 bp, Homo sapiens
gagccgagatcacgccact

SEQ ID NO: 4964565 - DNA, 15 bp, Homo sapiens
gagcctaggaccact

SEQ ID NO: 4964566 - DNA, 21 bp, Homo sapiens
gagcctaggaccactcagccc

SEQ ID NO: 4964567 - DNA, 17 bp, Homo sapiens
gagcctcagcatcctgg

SEQ ID NO: 4964568 - DNA, 20 bp, Homo sapiens
gagcctcagcatcctggcac

SEQ ID NO: 4964569 - DNA, 15 bp, Homo sapiens
gagcctgagtcaggg

SEQ ID NO: 4964570 - DNA, 15 bp, Homo sapiens
gagcctgcagttatt

SEQ ID NO: 4964571 - DNA, 16 bp, Homo sapiens
gagcctgcctggagcg

SEQ ID NO: 4964572 - DNA, 23 bp, Homo sapiens
gagcctgctggtcacagcctcct

SEQ ID NO: 4964573 - DNA, 17 bp, Homo sapiens
gagcctggcacaggact

SEQ ID NO: 4964574 - DNA, 19 bp, Homo sapiens
gagcctggcacaggactga

SEQ ID NO: 4964575 - DNA, 23 bp, Homo sapiens
gagcctggctccgtccaggagcc

SEQ ID NO: 4964576 - DNA, 21 bp, Homo sapiens
gagcctggctcttgtgctgga

SEQ ID NO: 4964577 - DNA, 23 bp, Homo sapiens
gagcctggctcttgtgctggatg

SEQ ID NO: 4964578 - DNA, 14 bp, Homo sapiens
gagggctctgtgct

SEQ ID NO: 4964579 - DNA, 12 bp, Homo sapiens
gaggggaacaga

SEQ ID NO: 4964580 - DNA, 23 bp, Homo sapiens
gaggggaagaaacactttctctt

SEQ ID NO: 4964581 - DNA, 19 bp, Homo sapiens
gaggggaagctgcagcttg

SEQ ID NO: 4964582 - DNA, 13 bp, Homo sapiens
gaggggactctgg

SEQ ID NO: 4964583 - DNA, 19 bp, Homo sapiens
gaggggactctgggctatg

SEQ ID NO: 4964584 - DNA, 23 bp, Homo sapiens
gaggggactctgggctatggaca

SEQ ID NO: 4964585 - DNA, 20 bp, Homo sapiens
gaggggcctggcagccgtgc

SEQ ID NO: 4964586 - DNA, 11 bp, Homo sapiens
gaggggctctc

SEQ ID NO: 4964587 - DNA, 16 bp, Homo sapiens
gaggggctctcagctc

SEQ ID NO: 4964588 - DNA, 23 bp, Homo sapiens
gaggggctctcagctcagcgcca

SEQ ID NO: 4964589 - DNA, 21 bp, Homo sapiens
gagggggactgctgctgcctg

SEQ ID NO: 4964590 - DNA, 15 bp, Homo sapiens
gagggtacagctggg

SEQ ID NO: 4964591 - DNA, 17 bp, Homo sapiens
gagggtctatggggaga

SEQ ID NO: 4964592 - DNA, 14 bp, Homo sapiens
gagggtctgaggaa

SEQ ID NO: 4964593 - DNA, 13 bp, Homo sapiens
gaggtaacagaac

SEQ ID NO: 4964594 - DNA, 14 bp, Homo sapiens
gaggtaacagaaca

SEQ ID NO: 4964595 - DNA, 21 bp, Homo sapiens
gaggtaacagaacagcttcag

SEQ ID NO: 4964596 - DNA, 12 bp, Homo sapiens
gaggtaagtttt

SEQ ID NO: 4964597 - DNA, 17 bp, Homo sapiens
gaggtactagaatgctt

SEQ ID NO: 4964598 - DNA, 20 bp, Homo sapiens
gaggtagaccaggatttcta

SEQ ID NO: 4964599 - DNA, 13 bp, Homo sapiens
gaggtcagagcct

SEQ ID NO: 4964600 - DNA, 20 bp, Homo sapiens
gaggtcagagcctgcagtta

SEQ ID NO: 4964601 - DNA, 15 bp, Homo sapiens
gaggtcaggccctgg

SEQ ID NO: 4964602 - DNA, 22 bp, Homo sapiens
gaggtcagggagtgctggctca

SEQ ID NO: 4964603 - DNA, 13 bp, Homo sapiens
gaggtccagccca

SEQ ID NO: 4964604 - DNA, 20 bp, Homo sapiens
gaggtcctctggagccctaa

SEQ ID NO: 4964605 - DNA, 12 bp, Homo sapiens
gaggtctgttta

SEQ ID NO: 4964606 - DNA, 13 bp, Homo sapiens
gaggtctgtttaa

SEQ ID NO: 4964607 - DNA, 13 bp, Homo sapiens
gaggtgcctgtcc

SEQ ID NO: 4964608 - DNA, 21 bp, Homo sapiens
gaggtgcctgtcccaccccca

SEQ ID NO: 4964609 - DNA, 17 bp, Homo sapiens
gaggtggccagagctgg

SEQ ID NO: 4964610 - DNA, 22 bp, Homo sapiens
gaggtggccagagctgggaggc

SEQ ID NO: 4964611 - DNA, 13 bp, Homo sapiens
gaggtgggagcag

SEQ ID NO: 4964612 - DNA, 12 bp, Homo sapiens
gaggtggtttta

SEQ ID NO: 4964613 - DNA, 16 bp, Homo sapiens
gagtaaatacaggtag

SEQ ID NO: 4964614 - DNA, 23 bp, Homo sapiens
gagtacaaatgccttaaaatgga

SEQ ID NO: 4964615 - DNA, 22 bp, Homo sapiens
gagtagctgggactacaggcac

SEQ ID NO: 4964616 - DNA, 14 bp, Homo sapiens
gagtagtgtggaat

SEQ ID NO: 4964617 - DNA, 12 bp, Homo sapiens
gagtcacactca

SEQ ID NO: 4964618 - DNA, 14 bp, Homo sapiens
gagtcaccaagccc

SEQ ID NO: 4964619 - DNA, 16 bp, Homo sapiens
gagtcaccaagcccag

SEQ ID NO: 4964620 - DNA, 15 bp, Homo sapiens
gagtcaccttccagg

SEQ ID NO: 4964621 - DNA, 21 bp, Homo sapiens
gagtcaccttccaggacccct

SEQ ID NO: 4964622 - DNA, 15 bp, Homo sapiens
gagtcatttaaatgt

SEQ ID NO: 4964623 - DNA, 21 bp, Homo sapiens
gagtcccaccttggctgcagg

SEQ ID NO: 4964624 - DNA, 22 bp, Homo sapiens
gagtcccccctcccacctccag

SEQ ID NO: 4964625 - DNA, 11 bp, Homo sapiens
gagtcccctca

SEQ ID NO: 4964626 - DNA, 18 bp, Homo sapiens
gagtcccctcacctcctc

SEQ ID NO: 4964627 - DNA, 16 bp, Homo sapiens
gagtcctcactcccag

SEQ ID NO: 4964628 - DNA, 17 bp, Homo sapiens
gagtcctcactcccagt

SEQ ID NO: 4964629 - DNA, 14 bp, Homo sapiens
gagtccttaaaatg

SEQ ID NO: 4964630 - DNA, 22 bp, Homo sapiens
gagtctaaagatggagtttcta

SEQ ID NO: 4964631 - DNA, 16 bp, Homo sapiens
gagtctagatgtttat

SEQ ID NO: 4964632 - DNA, 11 bp, Homo sapiens
gagtctagatt

SEQ ID NO: 4964633 - DNA, 22 bp, Homo sapiens
gagtctagattcaaaggttcta

SEQ ID NO: 4964634 - DNA, 13 bp, Homo sapiens
gagtctagattct

SEQ ID NO: 4964635 - DNA, 20 bp, Homo sapiens
gagtctcactgttgcccagg

SEQ ID NO: 4964636 - DNA, 15 bp, Homo sapiens
gagtctcttctccac

SEQ ID NO: 4964637 - DNA, 18 bp, Homo sapiens
gagtctcttctccactgg

SEQ ID NO: 4964638 - DNA, 19 bp, Homo sapiens
gagtcttggtttctctcta

SEQ ID NO: 4964639 - DNA, 15 bp, Homo sapiens
gagtctttggttcta

SEQ ID NO: 4964640 - DNA, 17 bp, Homo sapiens
gagtgacagaggcagcc

SEQ ID NO: 4964641 - DNA, 20 bp, Homo sapiens
gagtgacagaggcagcccca

SEQ ID NO: 4964642 - DNA, 14 bp, Homo sapiens
gagtgactagacgt

SEQ ID NO: 4964643 - DNA, 24 bp, Homo sapiens
gagtgagcactaaggtgtgctctg

SEQ ID NO: 4964644 - DNA, 15 bp, Homo sapiens
gagtgattgcagctt

SEQ ID NO: 4964645 - DNA, 14 bp, Homo sapiens
gagtgcacagctgt

SEQ ID NO: 4964646 - DNA, 12 bp, Homo sapiens
gagtgcagtgag

SEQ ID NO: 4964647 - DNA, 13 bp, Homo sapiens
gagtgcagtgagc

SEQ ID NO: 4964648 - DNA, 23 bp, Homo sapiens
gagtgcccaccctgggagacaga

SEQ ID NO: 4964649 - DNA, 22 bp, Homo sapiens
gagtgctggctcacagtacagc

SEQ ID NO: 4964650 - DNA, 14 bp, Homo sapiens
gagtggcctggcca

SEQ ID NO: 4964651 - DNA, 18 bp, Homo sapiens
gagtggcctggccaggag

SEQ ID NO: 4964652 - DNA, 13 bp, Homo sapiens
gagtggctcctcc

SEQ ID NO: 4964653 - DNA, 13 bp, Homo sapiens
gagtgggcagagc

SEQ ID NO: 4964654 - DNA, 18 bp, Homo sapiens
gagtgtacttaactattc

SEQ ID NO: 4964655 - DNA, 17 bp, Homo sapiens
gagtgtctctgataaaa

SEQ ID NO: 4964656 - DNA, 12 bp, Homo sapiens
gagtgtgacagg

SEQ ID NO: 4964657 - DNA, 16 bp, Homo sapiens
gagtgtgacagggcca

SEQ ID NO: 4964658 - DNA, 17 bp, Homo sapiens
gagtgtgacagggccag

SEQ ID NO: 4964659 - DNA, 13 bp, Homo sapiens
gagtgtgcatgga

SEQ ID NO: 4964660 - DNA, 15 bp, Homo sapiens
gagtgtgtgtgtgca

SEQ ID NO: 4964661 - DNA, 23 bp, Homo sapiens
gagtgtttgggggacgtttctca

SEQ ID NO: 4964662 - DNA, 18 bp, Homo sapiens
gagttagtttctttggga

SEQ ID NO: 4964663 - DNA, 22 bp, Homo sapiens
gagttcaataaatgtctgttga

SEQ ID NO: 4964664 - DNA, 21 bp, Homo sapiens
gagttcagagtccttaaaatg

SEQ ID NO: 4964665 - DNA, 14 bp, Homo sapiens
gagttcatccaggc

SEQ ID NO: 4964666 - DNA, 19 bp, Homo sapiens
gagttgaggaactgtacag

SEQ ID NO: 4964667 - DNA, 12 bp, Homo sapiens
gagtttctaagg

SEQ ID NO: 4964668 - DNA, 13 bp, Homo sapiens
gagtttctaaggt

SEQ ID NO: 4964669 - DNA, 13 bp, Homo sapiens
gagtttggtctgg

SEQ ID NO: 4964670 - DNA, 16 bp, Homo sapiens
gagtttggtctggact

SEQ ID NO: 4964671 - DNA, 19 bp, Homo sapiens
gagtttggtctggactgac

SEQ ID NO: 4964672 - DNA, 22 bp, Homo sapiens
gagttttcctctatacatctct

SEQ ID NO: 4964673 - DNA, 23 bp, Homo sapiens
gagttttcctctatacatctctc

SEQ ID NO: 4964674 - DNA, 19 bp, Homo sapiens
gagtttttgtttggagagc

SEQ ID NO: 4964675 - DNA, 14 bp, Homo sapiens
gataaatatttgac

SEQ ID NO: 4964676 - DNA, 15 bp, Homo sapiens
gataaatgatagaca

SEQ ID NO: 4964677 - DNA, 15 bp, Homo sapiens
gataaccagctgtaa

SEQ ID NO: 4964678 - DNA, 19 bp, Homo sapiens
gataataatattgtttttc

SEQ ID NO: 4964679 - DNA, 13 bp, Homo sapiens
gataatcagcctc

SEQ ID NO: 4964680 - DNA, 16 bp, Homo sapiens
gataatcagcctctta

SEQ ID NO: 4964681 - DNA, 12 bp, Homo sapiens
gataatgttaaa

SEQ ID NO: 4964682 - DNA, 13 bp, Homo sapiens
gataatgttaaat

SEQ ID NO: 4964683 - DNA, 14 bp, Homo sapiens
gataatgttaaatt

SEQ ID NO: 4964684 - DNA, 19 bp, Homo sapiens
gataatgttaaatttgtaa

SEQ ID NO: 4964685 - DNA, 17 bp, Homo sapiens
gatacaaatgtctatca

SEQ ID NO: 4964686 - DNA, 20 bp, Homo sapiens
gatacaggaaaagctgctga

SEQ ID NO: 4964687 - DNA, 19 bp, Homo sapiens
gatacagtccctaaagaaa

SEQ ID NO: 4964688 - DNA, 20 bp, Homo sapiens
gatacataactaaatttgat

SEQ ID NO: 4964689 - DNA, 18 bp, Homo sapiens
gatgcctggtggcagctg

SEQ ID NO: 4964690 - DNA, 13 bp, Homo sapiens
gatgcggccaaga

SEQ ID NO: 4964691 - DNA, 20 bp, Homo sapiens
gatgcgttgttacaggaagt

SEQ ID NO: 4964692 - DNA, 19 bp, Homo sapiens
gatgctccaagattctaga

SEQ ID NO: 4964693 - DNA, 20 bp, Homo sapiens
gatgctccaagattctagat

SEQ ID NO: 4964694 - DNA, 17 bp, Homo sapiens
gatgctgactgtactcc

SEQ ID NO: 4964695 - DNA, 19 bp, Homo sapiens
gatgctggagaagagagga

SEQ ID NO: 4964696 - DNA, 17 bp, Homo sapiens
gatgctgggtggccctg

SEQ ID NO: 4964697 - DNA, 17 bp, Homo sapiens
gatggaagtaaagcctc

SEQ ID NO: 4964698 - DNA, 20 bp, Homo sapiens
gatggacagttcacaccctg

SEQ ID NO: 4964699 - DNA, 14 bp, Homo sapiens
gatggagcccaggc

SEQ ID NO: 4964700 - DNA, 17 bp, Homo sapiens
gatggagcccaggcggg

SEQ ID NO: 4964701 - DNA, 22 bp, Homo sapiens
gatggagcccaggcgggagcgg

SEQ ID NO: 4964702 - DNA, 15 bp, Homo sapiens
gatggagtttctaag

SEQ ID NO: 4964703 - DNA, 14 bp, Homo sapiens
gatggctcagaggg

SEQ ID NO: 4964704 - DNA, 19 bp, Homo sapiens
gatggctggaaggggtcca

SEQ ID NO: 4964705 - DNA, 19 bp, Homo sapiens
gatggctgtgcctctgcct

SEQ ID NO: 4964706 - DNA, 21 bp, Homo sapiens
gatgggagctcctctcctgga

SEQ ID NO: 4964707 - DNA, 14 bp, Homo sapiens
gatgggcctggcat

SEQ ID NO: 4964708 - DNA, 21 bp, Homo sapiens
gatggggataaaatgactact

SEQ ID NO: 4964709 - DNA, 16 bp, Homo sapiens
gatgtacaattaaaaa

SEQ ID NO: 4964710 - DNA, 13 bp, Homo sapiens
gatgtatctgagt

SEQ ID NO: 4964711 - DNA, 15 bp, Homo sapiens
gatgtcacagggcca

SEQ ID NO: 4964712 - DNA, 17 bp, Homo sapiens
gatgtcccaacttgtaa

SEQ ID NO: 4964713 - DNA, 20 bp, Homo sapiens
gatgtccctgggccagggtc

SEQ ID NO: 4964714 - DNA, 20 bp, Homo sapiens
gatgtcccttgatgcacaga

SEQ ID NO: 4964715 - DNA, 19 bp, Homo sapiens
gatgtgaaacactttgcct

SEQ ID NO: 4964716 - DNA, 18 bp, Homo sapiens
gatgtgattgtggaatgg

SEQ ID NO: 4964717 - DNA, 20 bp, Homo sapiens
gatgttctaaggctctgaga

SEQ ID NO: 4964718 - DNA, 19 bp, Homo sapiens
gatgttgccatgtgtttta

SEQ ID NO: 4964719 - DNA, 19 bp, Homo sapiens
gatgtttattcttctagag

SEQ ID NO: 4964720 - DNA, 21 bp, Homo sapiens
gatgtttattcttctagagtt

SEQ ID NO: 4964721 - DNA, 23 bp, Homo sapiens
gatgtttattcttctagagttca

SEQ ID NO: 4964722 - DNA, 12 bp, Homo sapiens
gatgtttccaga

SEQ ID NO: 4964723 - DNA, 13 bp, Homo sapiens
gatgtttccagac

SEQ ID NO: 4964724 - DNA, 19 bp, Homo sapiens
gatgtttccagacttcctt

SEQ ID NO: 4964725 - DNA, 22 bp, Homo sapiens
gatgtttgctcttgtttttatt

SEQ ID NO: 4964726 - DNA, 16 bp, Homo sapiens
gatgtttgtggcctca

SEQ ID NO: 4964727 - DNA, 18 bp, Homo sapiens
gatgtttgtggcctcaga

SEQ ID NO: 4964728 - DNA, 22 bp, Homo sapiens
gatgttttggtagattaaatat

SEQ ID NO: 4964729 - DNA, 18 bp, Homo sapiens
gatgtttttaaaagtttc

SEQ ID NO: 4964730 - DNA, 17 bp, Homo sapiens
gattaaataagattcta

SEQ ID NO: 4964731 - DNA, 14 bp, Homo sapiens
gattaacaaatatg

SEQ ID NO: 4964732 - DNA, 21 bp, Homo sapiens
gattaacaaatatgctaattt

SEQ ID NO: 4964733 - DNA, 23 bp, Homo sapiens
gattacaagcgtgagccactgca

SEQ ID NO: 4964734 - DNA, 13 bp, Homo sapiens
gattagctttgtg

SEQ ID NO: 4964735 - DNA, 15 bp, Homo sapiens
gattagctttgtgtt

SEQ ID NO: 4964736 - DNA, 18 bp, Homo sapiens
gattatgtcttttatatt

SEQ ID NO: 4964737 - DNA, 21 bp, Homo sapiens
gattatgtcttttatatttgt

SEQ ID NO: 4964738 - DNA, 13 bp, Homo sapiens
gattatttaataa

SEQ ID NO: 4964739 - DNA, 15 bp, Homo sapiens
gattatttaataaca

SEQ ID NO: 4964740 - DNA, 22 bp, Homo sapiens
gattatttaataacattacctt

SEQ ID NO: 4964741 - DNA, 14 bp, Homo sapiens
gattcacatctgca

SEQ ID NO: 4964742 - DNA, 17 bp, Homo sapiens
gattcaggtatgttgcc

SEQ ID NO: 4964743 - DNA, 22 bp, Homo sapiens
gattcagttttcatttggttca

SEQ ID NO: 4964744 - DNA, 12 bp, Homo sapiens
gattcatgattt

SEQ ID NO: 4964745 - DNA, 17 bp, Homo sapiens
gattcatgatttataaa

SEQ ID NO: 4964746 - DNA, 19 bp, Homo sapiens
gattccaaagagtagaatt

SEQ ID NO: 4964747 - DNA, 15 bp, Homo sapiens
gattcccaagctctg

SEQ ID NO: 4964748 - DNA, 18 bp, Homo sapiens
gattcccaagctctgctc

SEQ ID NO: 4964749 - DNA, 19 bp, Homo sapiens
gattcccaagctctgctcc

SEQ ID NO: 4964750 - DNA, 21 bp, Homo sapiens
gattcccaagctctgctcctc

SEQ ID NO: 4964751 - DNA, 22 bp, Homo sapiens
gattcccaagctctgctcctct

SEQ ID NO: 4964752 - DNA, 15 bp, Homo sapiens
gattccggatcctaa

SEQ ID NO: 4964753 - DNA, 22 bp, Homo sapiens
gattcctaagccacttgaaatg

SEQ ID NO: 4964754 - DNA, 14 bp, Homo sapiens
gattctaaagattc

SEQ ID NO: 4964755 - DNA, 17 bp, Homo sapiens
gattctaaagattctat

SEQ ID NO: 4964756 - DNA, 14 bp, Homo sapiens
gattctcctgcctc

SEQ ID NO: 4964757 - DNA, 17 bp, Homo sapiens
gattctcctgcctcagc

SEQ ID NO: 4964758 - DNA, 19 bp, Homo sapiens
gattctcctgcctcagcct

SEQ ID NO: 4964759 - DNA, 23 bp, Homo sapiens
gattctctggctgtaaggctcta

SEQ ID NO: 4964760 - DNA, 18 bp, Homo sapiens
gattctctgtgtctaaga

SEQ ID NO: 4964761 - DNA, 12 bp, Homo sapiens
gattcttctgct

SEQ ID NO: 4964762 - DNA, 13 bp, Homo sapiens
gattcttctgctt

SEQ ID NO: 4964763 - DNA, 20 bp, Homo sapiens
gattcttctgcttcagcctc

SEQ ID NO: 4964764 - DNA, 21 bp, Homo sapiens
gattcttctgcttcagcctcc

SEQ ID NO: 4964765 - DNA, 20 bp, Homo sapiens
gattcttctgtgtttataaa

SEQ ID NO: 4964766 - DNA, 15 bp, Homo sapiens
gattgaactccaaga

SEQ ID NO: 4964767 - DNA, 23 bp, Homo sapiens
gattgacctgctccgctgctcct

SEQ ID NO: 4964768 - DNA, 16 bp, Homo sapiens
gattgagaagaggaca

SEQ ID NO: 4964769 - DNA, 16 bp, Homo sapiens
gattgagaaggagaga

SEQ ID NO: 4964770 - DNA, 15 bp, Homo sapiens
gattgatttgaagaa

SEQ ID NO: 4964771 - DNA, 16 bp, Homo sapiens
gattgcaacaggctgg

SEQ ID NO: 4964772 - DNA, 21 bp, Homo sapiens
gattgcaacaggctgggcttc

SEQ ID NO: 4964773 - DNA, 18 bp, Homo sapiens
gattgcaatatctgaagc

SEQ ID NO: 4964774 - DNA, 11 bp, Homo sapiens
gattgcagctt

SEQ ID NO: 4964775 - DNA, 19 bp, Homo sapiens
gattgcaggtggaactcag

SEQ ID NO: 4964776 - DNA, 15 bp, Homo sapiens
gattgctatgaatga

SEQ ID NO: 4964777 - DNA, 20 bp, Homo sapiens
gattggattatttaataaca

SEQ ID NO: 4964778 - DNA, 13 bp, Homo sapiens
gattgttgtttgc

SEQ ID NO: 4964779 - DNA, 16 bp, Homo sapiens
gatttaaacacacaga

SEQ ID NO: 4964780 - DNA, 22 bp, Homo sapiens
gatttaataaaataattctaaa

SEQ ID NO: 4964781 - DNA, 23 bp, Homo sapiens
gatttaataaaataattctaaag

SEQ ID NO: 4964782 - DNA, 14 bp, Homo sapiens
gatttaatatggat

SEQ ID NO: 4964783 - DNA, 13 bp, Homo sapiens
gatttaatttcca

SEQ ID NO: 4964784 - DNA, 18 bp, Homo sapiens
gatttagtgtaataagac

SEQ ID NO: 4964785 - DNA, 20 bp, Homo sapiens
gatttatagtttgtacatgc

SEQ ID NO: 4964786 - DNA, 22 bp, Homo sapiens
gatttcaagaaaaaataaatgg

SEQ ID NO: 4964787 - DNA, 22 bp, Homo sapiens
gatttgaactcagatctgtctg

SEQ ID NO: 4964788 - DNA, 19 bp, Homo sapiens
gatttgaagaacatgtgag

SEQ ID NO: 4964789 - DNA, 13 bp, Homo sapiens
gatttgacattgc

SEQ ID NO: 4964790 - DNA, 19 bp, Homo sapiens
gatttgcatattcattcat

SEQ ID NO: 4964791 - DNA, 15 bp, Homo sapiens
gatttgcattgaaca

SEQ ID NO: 4964792 - DNA, 17 bp, Homo sapiens
gatttgcattgaacaca

SEQ ID NO: 4964793 - DNA, 23 bp, Homo sapiens
gatttgtaggaaggtctcattct

SEQ ID NO: 4964794 - DNA, 20 bp, Homo sapiens
gattttaatggattgttaat

SEQ ID NO: 4964795 - DNA, 15 bp, Homo sapiens
gattttattttacta

SEQ ID NO: 4964796 - DNA, 21 bp, Homo sapiens
gattttcaaccagataacata

SEQ ID NO: 4964797 - DNA, 15 bp, Homo sapiens
gattttctccagctc

SEQ ID NO: 4964798 - DNA, 15 bp, Homo sapiens
gcagcattgactggt

SEQ ID NO: 4964799 - DNA, 13 bp, Homo sapiens
gcagccaccagcg

SEQ ID NO: 4964800 - DNA, 13 bp, Homo sapiens
gcagccagtgaga

SEQ ID NO: 4964801 - DNA, 18 bp, Homo sapiens
gcagcccagagactttgt

SEQ ID NO: 4964802 - DNA, 22 bp, Homo sapiens
gcagcccagagactttgtagat

SEQ ID NO: 4964803 - DNA, 22 bp, Homo sapiens
gcagcccatgcccacctgccca

SEQ ID NO: 4964804 - DNA, 17 bp, Homo sapiens
gcagccccattctgcct

SEQ ID NO: 4964805 - DNA, 18 bp, Homo sapiens
gcagccccattctgcctg

SEQ ID NO: 4964806 - DNA, 19 bp, Homo sapiens
gcagccccattctgcctgc

SEQ ID NO: 4964807 - DNA, 22 bp, Homo sapiens
gcagccctagagcctgcctgga

SEQ ID NO: 4964808 - DNA, 14 bp, Homo sapiens
gcagccctgctttg

SEQ ID NO: 4964809 - DNA, 24 bp, Homo sapiens
gcagccctgctttgggctgccctg

SEQ ID NO: 4964810 - DNA, 19 bp, Homo sapiens
gcagccctggcagggggca

SEQ ID NO: 4964811 - DNA, 14 bp, Homo sapiens
gcagccgccttcct

SEQ ID NO: 4964812 - DNA, 17 bp, Homo sapiens
gcagccgtgccttcagc

SEQ ID NO: 4964813 - DNA, 19 bp, Homo sapiens
gcagcctcaacctcctggg

SEQ ID NO: 4964814 - DNA, 22 bp, Homo sapiens
gcagcctgcttcccacctccct

SEQ ID NO: 4964815 - DNA, 17 bp, Homo sapiens
gcagcctttgcctcccc

SEQ ID NO: 4964816 - DNA, 16 bp, Homo sapiens
gcagcgaccgccccct

SEQ ID NO: 4964817 - DNA, 22 bp, Homo sapiens
gcagcgaccgccccctcctcta

SEQ ID NO: 4964818 - DNA, 13 bp, Homo sapiens
gcagcgagggcgg

SEQ ID NO: 4964819 - DNA, 14 bp, Homo sapiens
gcagcgagggcgga

SEQ ID NO: 4964820 - DNA, 17 bp, Homo sapiens
gcagctcaactttctgt

SEQ ID NO: 4964821 - DNA, 23 bp, Homo sapiens
gcagctcaagcagcgaccgcccc

SEQ ID NO: 4964822 - DNA, 20 bp, Homo sapiens
gcagctgagaaaatgagtga

SEQ ID NO: 4964823 - DNA, 23 bp, Homo sapiens
gcagctgcggtccacccaggagc

SEQ ID NO: 4964824 - DNA, 22 bp, Homo sapiens
gcagctgctatttattttccta

SEQ ID NO: 4964825 - DNA, 20 bp, Homo sapiens
gcagctgcttttgtctatgg

SEQ ID NO: 4964826 - DNA, 12 bp, Homo sapiens
gcagctggacag

SEQ ID NO: 4964827 - DNA, 16 bp, Homo sapiens
gcagctggactctgca

SEQ ID NO: 4964828 - DNA, 21 bp, Homo sapiens
gcagcttgagggttgggctgg

SEQ ID NO: 4964829 - DNA, 21 bp, Homo sapiens
gcagcttgggagagcccctgg

SEQ ID NO: 4964830 - DNA, 19 bp, Homo sapiens
gcagctttaaactcaggga

SEQ ID NO: 4964831 - DNA, 14 bp, Homo sapiens
gcagctttatgttc

SEQ ID NO: 4964832 - DNA, 21 bp, Homo sapiens
gcaggaagcattcagagagca

SEQ ID NO: 4964833 - DNA, 12 bp, Homo sapiens
gcaggaaggaga

SEQ ID NO: 4964834 - DNA, 16 bp, Homo sapiens
gcaggaaggagagcct

SEQ ID NO: 4964835 - DNA, 19 bp, Homo sapiens
gcaggagattgagaaggag

SEQ ID NO: 4964836 - DNA, 23 bp, Homo sapiens
gcaggaggattgcttgagcccag

SEQ ID NO: 4964837 - DNA, 18 bp, Homo sapiens
gcaggagtggtgcagaca

SEQ ID NO: 4964838 - DNA, 18 bp, Homo sapiens
gcaggattcagccggagg

SEQ ID NO: 4964839 - DNA, 16 bp, Homo sapiens
gcaggcatgtcctgga

SEQ ID NO: 4964840 - DNA, 18 bp, Homo sapiens
gcaggcattgaggaagag

SEQ ID NO: 4964841 - DNA, 20 bp, Homo sapiens
gcaggccaaggccttctcct

SEQ ID NO: 4964842 - DNA, 21 bp, Homo sapiens
gcaggccaaggccttctcctc

SEQ ID NO: 4964843 - DNA, 23 bp, Homo sapiens
gcaggccaaggccttctcctccc

SEQ ID NO: 4964844 - DNA, 20 bp, Homo sapiens
gcaggccaagtcaggccctt

SEQ ID NO: 4964845 - DNA, 15 bp, Homo sapiens
gcaggctgggccatg

SEQ ID NO: 4964846 - DNA, 13 bp, Homo sapiens
gcagggaaacagc

SEQ ID NO: 4964847 - DNA, 22 bp, Homo sapiens
gcagggaaacagctaatgggac

SEQ ID NO: 4964848 - DNA, 18 bp, Homo sapiens
gcagggagggcagttttc

SEQ ID NO: 4964849 - DNA, 16 bp, Homo sapiens
gcagggaggtcaggcc

SEQ ID NO: 4964850 - DNA, 20 bp, Homo sapiens
gcagggaggtcaggccctgg

SEQ ID NO: 4964851 - DNA, 22 bp, Homo sapiens
gcagggcaaatgacatgcactg

SEQ ID NO: 4964852 - DNA, 15 bp, Homo sapiens
gcagggccaggactg

SEQ ID NO: 4964853 - DNA, 22 bp, Homo sapiens
gcagggctcagcggggacagct

SEQ ID NO: 4964854 - DNA, 16 bp, Homo sapiens
gcaggggctctggaga

SEQ ID NO: 4964855 - DNA, 18 bp, Homo sapiens
gcaggggctctggagaga

SEQ ID NO: 4964856 - DNA, 22 bp, Homo sapiens
gcaggggctctggagagaaaca

SEQ ID NO: 4964857 - DNA, 16 bp, Homo sapiens
gcagggtctcactctg

SEQ ID NO: 4964858 - DNA, 17 bp, Homo sapiens
gcagggtctcactctgt

SEQ ID NO: 4964859 - DNA, 19 bp, Homo sapiens
gcaggtagccagggggact

SEQ ID NO: 4964860 - DNA, 21 bp, Homo sapiens
gcaggtagccagggggactag

SEQ ID NO: 4964861 - DNA, 21 bp, Homo sapiens
gcaggtcaacagctatgctgg

SEQ ID NO: 4964862 - DNA, 22 bp, Homo sapiens
gcaggtccagggtttgagttca

SEQ ID NO: 4964863 - DNA, 20 bp, Homo sapiens
gcaggtcttgaactcctggc

SEQ ID NO: 4964864 - DNA, 16 bp, Homo sapiens
gcaggtgctattgtta

SEQ ID NO: 4964865 - DNA, 14 bp, Homo sapiens
gcaggttggacccc

SEQ ID NO: 4964866 - DNA, 15 bp, Homo sapiens
gcagtaaatttgcta

SEQ ID NO: 4964867 - DNA, 19 bp, Homo sapiens
gcagtagaaataatatgca

SEQ ID NO: 4964868 - DNA, 21 bp, Homo sapiens
gcagtagaggctatggacagg

SEQ ID NO: 4964869 - DNA, 13 bp, Homo sapiens
gcagtaggggagg

SEQ ID NO: 4964870 - DNA, 14 bp, Homo sapiens
gcagtcatcagaag

SEQ ID NO: 4964871 - DNA, 21 bp, Homo sapiens
gcagtccgtgtggatccaatg

SEQ ID NO: 4964872 - DNA, 17 bp, Homo sapiens
gcagtcctgcctcagcc

SEQ ID NO: 4964873 - DNA, 20 bp, Homo sapiens
gcagtctcctctttaaaaca

SEQ ID NO: 4964874 - DNA, 20 bp, Homo sapiens
gcagtgagaaaaagctcctg

SEQ ID NO: 4964875 - DNA, 21 bp, Homo sapiens
gcagtgagaaaaagctcctgt

SEQ ID NO: 4964876 - DNA, 22 bp, Homo sapiens
gcagtgaggggtatatctgggc

SEQ ID NO: 4964877 - DNA, 17 bp, Homo sapiens
gcagtgagtgagcctgg

SEQ ID NO: 4964878 - DNA, 16 bp, Homo sapiens
gcagtgatatggcaga

SEQ ID NO: 4964879 - DNA, 22 bp, Homo sapiens
gcagtgctagtgagctgggcat

SEQ ID NO: 4964880 - DNA, 12 bp, Homo sapiens
gcagtgggagct

SEQ ID NO: 4964881 - DNA, 13 bp, Homo sapiens
gcagtgggagctg

SEQ ID NO: 4964882 - DNA, 14 bp, Homo sapiens
gcagtgggagctgc

SEQ ID NO: 4964883 - DNA, 16 bp, Homo sapiens
gcagtgggctcctggc

SEQ ID NO: 4964884 - DNA, 20 bp, Homo sapiens
gcagtggtgcgatctgggtt

SEQ ID NO: 4964885 - DNA, 21 bp, Homo sapiens
gcagtggtgcgatctgggttc

SEQ ID NO: 4964886 - DNA, 23 bp, Homo sapiens
gcagtgtctgtaaaagagcctag

SEQ ID NO: 4964887 - DNA, 20 bp, Homo sapiens
gcagtgttccccatctgggt

SEQ ID NO: 4964888 - DNA, 17 bp, Homo sapiens
gcagttcagcaccaccc

SEQ ID NO: 4964889 - DNA, 19 bp, Homo sapiens
gcagttcagcaccacccta

SEQ ID NO: 4964890 - DNA, 11 bp, Homo sapiens
gcagttctgtt

SEQ ID NO: 4964891 - DNA, 22 bp, Homo sapiens
gcagttgaatgacaacagaagc

SEQ ID NO: 4964892 - DNA, 23 bp, Homo sapiens
gcagtttttcaggagcgcaagat

SEQ ID NO: 4964893 - DNA, 12 bp, Homo sapiens
gcataaaacagc

SEQ ID NO: 4964894 - DNA, 13 bp, Homo sapiens
gcataaaacagct

SEQ ID NO: 4964895 - DNA, 19 bp, Homo sapiens
gcatacatgcaaaaagaaa

SEQ ID NO: 4964896 - DNA, 16 bp, Homo sapiens
gcatagaactgggtaa

SEQ ID NO: 4964897 - DNA, 17 bp, Homo sapiens
gcatagaactgggtaaa

SEQ ID NO: 4964898 - DNA, 22 bp, Homo sapiens
gcatagaggtaccagcaatatg

SEQ ID NO: 4964899 - DNA, 14 bp, Homo sapiens
gcatagcaaacaga

SEQ ID NO: 4964900 - DNA, 12 bp, Homo sapiens
gcatagtgctgg

SEQ ID NO: 4964901 - DNA, 17 bp, Homo sapiens
gcatataggtgatgttt

SEQ ID NO: 4964902 - DNA, 17 bp, Homo sapiens
gcatatgggttagatgt

SEQ ID NO: 4964903 - DNA, 12 bp, Homo sapiens
gcatatgttgaa

SEQ ID NO: 4964904 - DNA, 19 bp, Homo sapiens
gcatatgttgaatactttt

SEQ ID NO: 4964905 - DNA, 23 bp, Homo sapiens
gcatcaagaggtgggagggccct

SEQ ID NO: 4964906 - DNA, 14 bp, Homo sapiens
gcatcacctgcctg

SEQ ID NO: 4964907 - DNA, 14 bp, Homo sapiens
gccacacagaccac

SEQ ID NO: 4964908 - DNA, 22 bp, Homo sapiens
gccacacttcaggctcttctcc

SEQ ID NO: 4964909 - DNA, 20 bp, Homo sapiens
gccacagagaaagtacttct

SEQ ID NO: 4964910 - DNA, 14 bp, Homo sapiens
gccacagcagcatt

SEQ ID NO: 4964911 - DNA, 22 bp, Homo sapiens
gccacatttggaatactttttg

SEQ ID NO: 4964912 - DNA, 14 bp, Homo sapiens
gccaccaaagctgc

SEQ ID NO: 4964913 - DNA, 15 bp, Homo sapiens
gccaccaaagctgcc

SEQ ID NO: 4964914 - DNA, 16 bp, Homo sapiens
gccaccacctctgtgg

SEQ ID NO: 4964915 - DNA, 18 bp, Homo sapiens
gccaccacctctgtggca

SEQ ID NO: 4964916 - DNA, 16 bp, Homo sapiens
gccaccacgtccagct

SEQ ID NO: 4964917 - DNA, 19 bp, Homo sapiens
gccaccagagaccgtcctc

SEQ ID NO: 4964918 - DNA, 18 bp, Homo sapiens
gccaccatcctattgcaa

SEQ ID NO: 4964919 - DNA, 22 bp, Homo sapiens
gccaccctagccaatgtctcct

SEQ ID NO: 4964920 - DNA, 11 bp, Homo sapiens
gccacctctgc

SEQ ID NO: 4964921 - DNA, 22 bp, Homo sapiens
gccacctctgcggaccccagct

SEQ ID NO: 4964922 - DNA, 23 bp, Homo sapiens
gccacctctgcggaccccagctg

SEQ ID NO: 4964923 - DNA, 11 bp, Homo sapiens
gccacctgcct

SEQ ID NO: 4964924 - DNA, 12 bp, Homo sapiens
gccacctgcctg

SEQ ID NO: 4964925 - DNA, 13 bp, Homo sapiens
gccacctgcctgc

SEQ ID NO: 4964926 - DNA, 21 bp, Homo sapiens
gccacctgcctgcgtcttccg

SEQ ID NO: 4964927 - DNA, 14 bp, Homo sapiens
gccacggccaggcc

SEQ ID NO: 4964928 - DNA, 16 bp, Homo sapiens
gccacggccaggccag

SEQ ID NO: 4964929 - DNA, 17 bp, Homo sapiens
gccacggccaggccaga

SEQ ID NO: 4964930 - DNA, 19 bp, Homo sapiens
gccacggccaggccagagg

SEQ ID NO: 4964931 - DNA, 15 bp, Homo sapiens
gccacgttccacagt

SEQ ID NO: 4964932 - DNA, 21 bp, Homo sapiens
gccactcaggaggctgaggca

SEQ ID NO: 4964933 - DNA, 16 bp, Homo sapiens
gccactccagacccct

SEQ ID NO: 4964934 - DNA, 19 bp, Homo sapiens
gccactccagacccctggc

SEQ ID NO: 4964935 - DNA, 22 bp, Homo sapiens
gccactccagacccctggcttt

SEQ ID NO: 4964936 - DNA, 19 bp, Homo sapiens
gccactctcttccctttcc

SEQ ID NO: 4964937 - DNA, 17 bp, Homo sapiens
gccactgcaccgggcca

SEQ ID NO: 4964938 - DNA, 18 bp, Homo sapiens
gccactgcaccgggccac

SEQ ID NO: 4964939 - DNA, 13 bp, Homo sapiens
gccactgcctctt

SEQ ID NO: 4964940 - DNA, 12 bp, Homo sapiens
gccactgctccc

SEQ ID NO: 4964941 - DNA, 22 bp, Homo sapiens
gccactgctccctaagccagcc

SEQ ID NO: 4964942 - DNA, 16 bp, Homo sapiens
gccactgtggtggcag

SEQ ID NO: 4964943 - DNA, 21 bp, Homo sapiens
gccacttgaacaaaatctgtt

SEQ ID NO: 4964944 - DNA, 15 bp, Homo sapiens
gccactttaagagag

SEQ ID NO: 4964945 - DNA, 18 bp, Homo sapiens
gccactttacccacctag

SEQ ID NO: 4964946 - DNA, 22 bp, Homo sapiens
gccactttacccacctagaaca

SEQ ID NO: 4964947 - DNA, 14 bp, Homo sapiens
gccactttgcacga

SEQ ID NO: 4964948 - DNA, 17 bp, Homo sapiens
gccagaagatcccctca

SEQ ID NO: 4964949 - DNA, 14 bp, Homo sapiens
gccagagccgggca

SEQ ID NO: 4964950 - DNA, 20 bp, Homo sapiens
gccagaggaactgtccagag

SEQ ID NO: 4964951 - DNA, 23 bp, Homo sapiens
gccagaggaactgtccagagagc

SEQ ID NO: 4964952 - DNA, 20 bp, Homo sapiens
gccagaggaatcctggcagc

SEQ ID NO: 4964953 - DNA, 23 bp, Homo sapiens
gccagaggaatcctggcagccca

SEQ ID NO: 4964954 - DNA, 20 bp, Homo sapiens
gccagagggagtgacagagg

SEQ ID NO: 4964955 - DNA, 21 bp, Homo sapiens
gccagagggagtgacagaggc

SEQ ID NO: 4964956 - DNA, 14 bp, Homo sapiens
gccagaggggaagg

SEQ ID NO: 4964957 - DNA, 17 bp, Homo sapiens
gccagagtggcctggcc

SEQ ID NO: 4964958 - DNA, 15 bp, Homo sapiens
gccagatgcaccagc

SEQ ID NO: 4964959 - DNA, 17 bp, Homo sapiens
gccagatgcaccagccc

SEQ ID NO: 4964960 - DNA, 23 bp, Homo sapiens
gccagcaaagaggactcgcttgt

SEQ ID NO: 4964961 - DNA, 13 bp, Homo sapiens
gccagcaatgaca

SEQ ID NO: 4964962 - DNA, 16 bp, Homo sapiens
gccagcagcagcaggt

SEQ ID NO: 4964963 - DNA, 19 bp, Homo sapiens
gccagcagcagcaggtgat

SEQ ID NO: 4964964 - DNA, 18 bp, Homo sapiens
gccagccccacacagcta

SEQ ID NO: 4964965 - DNA, 22 bp, Homo sapiens
gccagccccacacagctacagc

SEQ ID NO: 4964966 - DNA, 14 bp, Homo sapiens
gccagccccaccca

SEQ ID NO: 4964967 - DNA, 17 bp, Homo sapiens
gccagccccggccctgg

SEQ ID NO: 4964968 - DNA, 18 bp, Homo sapiens
gccagccccggccctggg

SEQ ID NO: 4964969 - DNA, 22 bp, Homo sapiens
gccagcccggccgctccaccag

SEQ ID NO: 4964970 - DNA, 17 bp, Homo sapiens
gccagcctgaccttcct

SEQ ID NO: 4964971 - DNA, 14 bp, Homo sapiens
gccagcctggggcc

SEQ ID NO: 4964972 - DNA, 15 bp, Homo sapiens
gccagcctggggcct

SEQ ID NO: 4964973 - DNA, 20 bp, Homo sapiens
gccagcctggggcctggcag

SEQ ID NO: 4964974 - DNA, 20 bp, Homo sapiens
gccagcctgtcccatggaca

SEQ ID NO: 4964975 - DNA, 21 bp, Homo sapiens
gccagccttcttccatcccag

SEQ ID NO: 4964976 - DNA, 16 bp, Homo sapiens
gccagctcagtcccat

SEQ ID NO: 4964977 - DNA, 18 bp, Homo sapiens
gccagcttggggccacca

SEQ ID NO: 4964978 - DNA, 15 bp, Homo sapiens
gccaggaacctgtcc

SEQ ID NO: 4964979 - DNA, 19 bp, Homo sapiens
gccaggacagtcagctctc

SEQ ID NO: 4964980 - DNA, 15 bp, Homo sapiens
gccaggactgagccc

SEQ ID NO: 4964981 - DNA, 17 bp, Homo sapiens
gccaggactgagccccg

SEQ ID NO: 4964982 - DNA, 19 bp, Homo sapiens
gccaggagtttgagaccag

SEQ ID NO: 4964983 - DNA, 21 bp, Homo sapiens
gccaggcagatctgtgcccca

SEQ ID NO: 4964984 - DNA, 23 bp, Homo sapiens
gccaggcagatctgtgccccatg

SEQ ID NO: 4964985 - DNA, 19 bp, Homo sapiens
gccaggcaggtagccaggg

SEQ ID NO: 4964986 - DNA, 17 bp, Homo sapiens
gccaggcaggtccacag

SEQ ID NO: 4964987 - DNA, 15 bp, Homo sapiens
gccaggccagaggga

SEQ ID NO: 4964988 - DNA, 15 bp, Homo sapiens
gccaggctggtctca

SEQ ID NO: 4964989 - DNA, 17 bp, Homo sapiens
gccagggctgccctgag

SEQ ID NO: 4964990 - DNA, 19 bp, Homo sapiens
gccagggctgccctgagaa

SEQ ID NO: 4964991 - DNA, 20 bp, Homo sapiens
gccagggggactagcccctg

SEQ ID NO: 4964992 - DNA, 20 bp, Homo sapiens
gccagggtctgtgtgaatgt

SEQ ID NO: 4964993 - DNA, 16 bp, Homo sapiens
gccaggtatggctctg

SEQ ID NO: 4964994 - DNA, 17 bp, Homo sapiens
gccaggtttttggtctg

SEQ ID NO: 4964995 - DNA, 21 bp, Homo sapiens
gccagtatctatatatgtgta

SEQ ID NO: 4964996 - DNA, 14 bp, Homo sapiens
gccagtcctgcctg

SEQ ID NO: 4964997 - DNA, 20 bp, Homo sapiens
gccagtcctgcctggccagg

SEQ ID NO: 4964998 - DNA, 14 bp, Homo sapiens
gccagtggggcctg

SEQ ID NO: 4964999 - DNA, 16 bp, Homo sapiens
gccagtggggcctgtg

SEQ ID NO: 4965000 - DNA, 17 bp, Homo sapiens
gccagtggggcctgtgg

SEQ ID NO: 4965001 - DNA, 18 bp, Homo sapiens
gccagtggggcctgtgga

SEQ ID NO: 4965002 - DNA, 19 bp, Homo sapiens
gccagtgtaatcccccagg

SEQ ID NO: 4965003 - DNA, 13 bp, Homo sapiens
gccagtgtgacaa

SEQ ID NO: 4965004 - DNA, 17 bp, Homo sapiens
gccagttagactagtcc

SEQ ID NO: 4965005 - DNA, 22 bp, Homo sapiens
gccataaaacaggtaatataaa

SEQ ID NO: 4965006 - DNA, 20 bp, Homo sapiens
gccatacttatctctctgtg

SEQ ID NO: 4965007 - DNA, 21 bp, Homo sapiens
gccatacttatctctctgtgc

SEQ ID NO: 4965008 - DNA, 22 bp, Homo sapiens
gccatacttatctctctgtgct

SEQ ID NO: 4965009 - DNA, 16 bp, Homo sapiens
gccatagtcacatggc

SEQ ID NO: 4965010 - DNA, 16 bp, Homo sapiens
gccatataagtttgaa

SEQ ID NO: 4965011 - DNA, 21 bp, Homo sapiens
gccatccctcgtggtccccaa

SEQ ID NO: 4965012 - DNA, 18 bp, Homo sapiens
gccatgccaggaacctgt

SEQ ID NO: 4965013 - DNA, 16 bp, Homo sapiens
gccatgggcctcctgt

SEQ ID NO: 4965014 - DNA, 16 bp, Homo sapiens
gccatgtacctcccct

SEQ ID NO: 4965015 - DNA, 17 bp, Homo sapiens
gccatgtataaatgtga

SEQ ID NO: 4965016 - DNA, 22 bp, Homo sapiens
gcccctgctggttcagggttgg

SEQ ID NO: 4965017 - DNA, 12 bp, Homo sapiens
gcccctggggcc

SEQ ID NO: 4965018 - DNA, 17 bp, Homo sapiens
gcccctggggcctagac

SEQ ID NO: 4965019 - DNA, 21 bp, Homo sapiens
gcccctgggtcagtctggtgg

SEQ ID NO: 4965020 - DNA, 19 bp, Homo sapiens
gccccttcccactcacccc

SEQ ID NO: 4965021 - DNA, 19 bp, Homo sapiens
gccccttctctccctgcca

SEQ ID NO: 4965022 - DNA, 23 bp, Homo sapiens
gccccttctctccctgccagagg

SEQ ID NO: 4965023 - DNA, 14 bp, Homo sapiens
gcccgacagcctgg

SEQ ID NO: 4965024 - DNA, 19 bp, Homo sapiens
gcccgacagcctggcacag

SEQ ID NO: 4965025 - DNA, 17 bp, Homo sapiens
gcccgcacagcagcctg

SEQ ID NO: 4965026 - DNA, 15 bp, Homo sapiens
gcccgcccctgcagc

SEQ ID NO: 4965027 - DNA, 14 bp, Homo sapiens
gcccggaccttggc

SEQ ID NO: 4965028 - DNA, 21 bp, Homo sapiens
gcccggagattggacggcctg

SEQ ID NO: 4965029 - DNA, 22 bp, Homo sapiens
gcccggagattggacggcctga

SEQ ID NO: 4965030 - DNA, 13 bp, Homo sapiens
gcccggctccagg

SEQ ID NO: 4965031 - DNA, 14 bp, Homo sapiens
gcccggctccaggc

SEQ ID NO: 4965032 - DNA, 20 bp, Homo sapiens
gcccgggaaggtcaccagca

SEQ ID NO: 4965033 - DNA, 23 bp, Homo sapiens
gcccgggaaggtcaccagcacca

SEQ ID NO: 4965034 - DNA, 17 bp, Homo sapiens
aaaggcccagcccctag

SEQ ID NO: 4965035 - DNA, 14 bp, Homo sapiens
aaaggcctctgtcc

SEQ ID NO: 4965036 - DNA, 16 bp, Homo sapiens
aaaggggacaggcctc

SEQ ID NO: 4965037 - DNA, 19 bp, Homo sapiens
aaaggtggattttgtttaa

SEQ ID NO: 4965038 - DNA, 14 bp, Homo sapiens
aaaggtgtatttaa

SEQ ID NO: 4965039 - DNA, 14 bp, Homo sapiens
aaagtaactcattt

SEQ ID NO: 4965040 - DNA, 17 bp, Homo sapiens
aaagtaatgatctcaaa

SEQ ID NO: 4965041 - DNA, 17 bp, Homo sapiens
aaagtatagagagaagt

SEQ ID NO: 4965042 - DNA, 12 bp, Homo sapiens
aaagtattttga

SEQ ID NO: 4965043 - DNA, 13 bp, Homo sapiens
aaagtattttgaa

SEQ ID NO: 4965044 - DNA, 16 bp, Homo sapiens
aaagtattttgaagtt

SEQ ID NO: 4965045 - DNA, 21 bp, Homo sapiens
aaagtattttgaagtttacat

SEQ ID NO: 4965046 - DNA, 18 bp, Homo sapiens
aaagtcgttttccaaact

SEQ ID NO: 4965047 - DNA, 15 bp, Homo sapiens
aaagtctctaattct

SEQ ID NO: 4965048 - DNA, 21 bp, Homo sapiens
aaagtgaataaacttcagcac

SEQ ID NO: 4965049 - DNA, 15 bp, Homo sapiens
aaagtgaatgaaaga

SEQ ID NO: 4965050 - DNA, 21 bp, Homo sapiens
aaagtgatgggctttctcttt

SEQ ID NO: 4965051 - DNA, 17 bp, Homo sapiens
aaagtgctaaggttcta

SEQ ID NO: 4965052 - DNA, 20 bp, Homo sapiens
aaagtgctaaggttctaagg

SEQ ID NO: 4965053 - DNA, 13 bp, Homo sapiens
aaagtgctgagat

SEQ ID NO: 4965054 - DNA, 15 bp, Homo sapiens
aaagtgtaataatat

SEQ ID NO: 4965055 - DNA, 18 bp, Homo sapiens
aaagtgtttatttttcat

SEQ ID NO: 4965056 - DNA, 16 bp, Homo sapiens
aaagttaatcttcatg

SEQ ID NO: 4965057 - DNA, 15 bp, Homo sapiens
aaagttagaatctat

SEQ ID NO: 4965058 - DNA, 18 bp, Homo sapiens
aaagttagaatctatttt

SEQ ID NO: 4965059 - DNA, 20 bp, Homo sapiens
aaagttagaatctattttct

SEQ ID NO: 4965060 - DNA, 12 bp, Homo sapiens
aaagttctaaga

SEQ ID NO: 4965061 - DNA, 15 bp, Homo sapiens
aaagttctaagattc

SEQ ID NO: 4965062 - DNA, 17 bp, Homo sapiens
aaagttctaagattctg

SEQ ID NO: 4965063 - DNA, 18 bp, Homo sapiens
aaagttgtgattccagat

SEQ ID NO: 4965064 - DNA, 21 bp, Homo sapiens
aaagtttctcttttcaaaaca

SEQ ID NO: 4965065 - DNA, 14 bp, Homo sapiens
aaagttttgaaaag

SEQ ID NO: 4965066 - DNA, 21 bp, Homo sapiens
aaagttttgagtagatattac

SEQ ID NO: 4965067 - DNA, 22 bp, Homo sapiens
aaagttttgagtagatattact

SEQ ID NO: 4965068 - DNA, 24 bp, Homo sapiens
aaagttttgagtagatattacttt

SEQ ID NO: 4965069 - DNA, 17 bp, Homo sapiens
aaataaaacctttcaaa

SEQ ID NO: 4965070 - DNA, 14 bp, Homo sapiens
aaataaactctaaa

SEQ ID NO: 4965071 - DNA, 13 bp, Homo sapiens
aaataaacttttt

SEQ ID NO: 4965072 - DNA, 18 bp, Homo sapiens
aaataaactttttttcaa

SEQ ID NO: 4965073 - DNA, 20 bp, Homo sapiens
aaataaactttttttcaatg

SEQ ID NO: 4965074 - DNA, 22 bp, Homo sapiens
aaataaactttttttcaatgtg

SEQ ID NO: 4965075 - DNA, 17 bp, Homo sapiens
aaataaattagttgtta

SEQ ID NO: 4965076 - DNA, 15 bp, Homo sapiens
aaataacaatgttaa

SEQ ID NO: 4965077 - DNA, 18 bp, Homo sapiens
aaataacttcaagcaaac

SEQ ID NO: 4965078 - DNA, 14 bp, Homo sapiens
aaataacttcagtc

SEQ ID NO: 4965079 - DNA, 15 bp, Homo sapiens
aaataagtatttata

SEQ ID NO: 4965080 - DNA, 17 bp, Homo sapiens
aaataatgcttcagata

SEQ ID NO: 4965081 - DNA, 21 bp, Homo sapiens
aaataatgcttcagatattat

SEQ ID NO: 4965082 - DNA, 13 bp, Homo sapiens
aaataatttaact

SEQ ID NO: 4965083 - DNA, 21 bp, Homo sapiens
aaatacccgttaccatattta

SEQ ID NO: 4965084 - DNA, 17 bp, Homo sapiens
aaatacctcatgtttat

SEQ ID NO: 4965085 - DNA, 14 bp, Homo sapiens
aaatactgtgtgga

SEQ ID NO: 4965086 - DNA, 18 bp, Homo sapiens
aaatagagtgtagtttac

SEQ ID NO: 4965087 - DNA, 18 bp, Homo sapiens
aaatagcgctgtttttgt

SEQ ID NO: 4965088 - DNA, 18 bp, Homo sapiens
aaatagctaataatgtta

SEQ ID NO: 4965089 - DNA, 13 bp, Homo sapiens
aaataggaaacaa

SEQ ID NO: 4965090 - DNA, 14 bp, Homo sapiens
aaataggagaggat

SEQ ID NO: 4965091 - DNA, 15 bp, Homo sapiens
aaatagtatttgcat

SEQ ID NO: 4965092 - DNA, 17 bp, Homo sapiens
aaatagttaagacatga

SEQ ID NO: 4965093 - DNA, 16 bp, Homo sapiens
aaatagttgtccatat

SEQ ID NO: 4965094 - DNA, 12 bp, Homo sapiens
aaatagtttgtt

SEQ ID NO: 4965095 - DNA, 16 bp, Homo sapiens
aaatataaaacaaata

SEQ ID NO: 4965096 - DNA, 23 bp, Homo sapiens
aaatataaacaaagattcatgat

SEQ ID NO: 4965097 - DNA, 19 bp, Homo sapiens
aaatataattctgtaaatg

SEQ ID NO: 4965098 - DNA, 16 bp, Homo sapiens
aaatatagattagaaa

SEQ ID NO: 4965099 - DNA, 17 bp, Homo sapiens
aaatatagattagaaaa

SEQ ID NO: 4965100 - DNA, 14 bp, Homo sapiens
aaatatagttccta

SEQ ID NO: 4965101 - DNA, 23 bp, Homo sapiens
aaatatatacccccccatgcagt

SEQ ID NO: 4965102 - DNA, 18 bp, Homo sapiens
aaatatatacgaacaaaa

SEQ ID NO: 4965103 - DNA, 19 bp, Homo sapiens
aaatatatatacatatgta

SEQ ID NO: 4965104 - DNA, 15 bp, Homo sapiens
aaatatatttaatga

SEQ ID NO: 4965105 - DNA, 14 bp, Homo sapiens
aaatatcccttccg

SEQ ID NO: 4965106 - DNA, 23 bp, Homo sapiens
aaatatcttttatgtttgaatat

SEQ ID NO: 4965107 - DNA, 21 bp, Homo sapiens
aaatatgaaccctttgtttct

SEQ ID NO: 4965108 - DNA, 23 bp, Homo sapiens
aaatatgagtggttattgaaaat

SEQ ID NO: 4965109 - DNA, 14 bp, Homo sapiens
aaatatgcagtgat

SEQ ID NO: 4965110 - DNA, 15 bp, Homo sapiens
aaatatgctaatttg

SEQ ID NO: 4965111 - DNA, 20 bp, Homo sapiens
aaatatggaacttctaatat

SEQ ID NO: 4965112 - DNA, 18 bp, Homo sapiens
aaatatgtctcgctagtg

SEQ ID NO: 4965113 - DNA, 19 bp, Homo sapiens
aaatattagttaatggatt

SEQ ID NO: 4965114 - DNA, 16 bp, Homo sapiens
aaatattcatgcttct

SEQ ID NO: 4965115 - DNA, 13 bp, Homo sapiens
aaatattctatat

SEQ ID NO: 4965116 - DNA, 17 bp, Homo sapiens
aaatattgaggctttgt

SEQ ID NO: 4965117 - DNA, 20 bp, Homo sapiens
aaatattgaggctttgtgtt

SEQ ID NO: 4965118 - DNA, 20 bp, Homo sapiens
aaatattgtgttgtgaatgt

SEQ ID NO: 4965119 - DNA, 12 bp, Homo sapiens
aaatatttatct

SEQ ID NO: 4965120 - DNA, 16 bp, Homo sapiens
aaatatttattaaata

SEQ ID NO: 4965121 - DNA, 18 bp, Homo sapiens
aaatatttattaaataaa

SEQ ID NO: 4965122 - DNA, 13 bp, Homo sapiens
aaatatttatttt

SEQ ID NO: 4965123 - DNA, 22 bp, Homo sapiens
aaatatttgtacatagttattt

SEQ ID NO: 4965124 - DNA, 20 bp, Homo sapiens
aaatattttgataataaatt

SEQ ID NO: 4965125 - DNA, 15 bp, Homo sapiens
aaatattttttacag

SEQ ID NO: 4965126 - DNA, 16 bp, Homo sapiens
aaatcaaaacaagtga

SEQ ID NO: 4965127 - DNA, 12 bp, Homo sapiens
aaatcaagtatt

SEQ ID NO: 4965128 - DNA, 23 bp, Homo sapiens
aaatcaagtatttgggaagtgaa

SEQ ID NO: 4965129 - DNA, 16 bp, Homo sapiens
aaatcaagtattttgt

SEQ ID NO: 4965130 - DNA, 17 bp, Homo sapiens
aaatcaatttttaggaa

SEQ ID NO: 4965131 - DNA, 22 bp, Homo sapiens
aaatcacaaaaatttgaacact

SEQ ID NO: 4965132 - DNA, 22 bp, Homo sapiens
aaatcagagacaaaatatttcc

SEQ ID NO: 4965133 - DNA, 15 bp, Homo sapiens
aaatcaggtattaat

SEQ ID NO: 4965134 - DNA, 13 bp, Homo sapiens
aaatcatattgat

SEQ ID NO: 4965135 - DNA, 14 bp, Homo sapiens
aaatcatctatttt

SEQ ID NO: 4965136 - DNA, 17 bp, Homo sapiens
aaatccacccatatgtt

SEQ ID NO: 4965137 - DNA, 19 bp, Homo sapiens
aaatccacccatatgttaa

SEQ ID NO: 4965138 - DNA, 20 bp, Homo sapiens
aaatccacccatatgttaaa

SEQ ID NO: 4965139 - DNA, 23 bp, Homo sapiens
aaatccatatcttaaagaaacag

SEQ ID NO: 4965140 - DNA, 14 bp, Homo sapiens
aaatccctggatca

SEQ ID NO: 4965141 - DNA, 22 bp, Homo sapiens
aaatcctaagacacaaatgcat

SEQ ID NO: 4965142 - DNA, 16 bp, Homo sapiens
aaatctaaatctattt

SEQ ID NO: 4965143 - DNA, 18 bp, Homo sapiens
aaatctaatattaaaaat

SEQ ID NO: 4965144 - DNA, 14 bp, Homo sapiens
aaatttactttaca

SEQ ID NO: 4965145 - DNA, 17 bp, Homo sapiens
aaatttatcaaagcata

SEQ ID NO: 4965146 - DNA, 19 bp, Homo sapiens
aaatttcaaaagacatgtt

SEQ ID NO: 4965147 - DNA, 16 bp, Homo sapiens
aaatttctaagagagc

SEQ ID NO: 4965148 - DNA, 23 bp, Homo sapiens
aaatttctcatcacagggattta

SEQ ID NO: 4965149 - DNA, 22 bp, Homo sapiens
aaatttgatttacatatattat

SEQ ID NO: 4965150 - DNA, 14 bp, Homo sapiens
aaatttgatttcta

SEQ ID NO: 4965151 - DNA, 14 bp, Homo sapiens
aaatttgctagcag

SEQ ID NO: 4965152 - DNA, 17 bp, Homo sapiens
aaatttgtaagtttcag

SEQ ID NO: 4965153 - DNA, 15 bp, Homo sapiens
aaattttagtccaaa

SEQ ID NO: 4965154 - DNA, 22 bp, Homo sapiens
aaattttataagcaaatttcaa

SEQ ID NO: 4965155 - DNA, 18 bp, Homo sapiens
aaattttctagactttct

SEQ ID NO: 4965156 - DNA, 15 bp, Homo sapiens
aaattttgcaaatat

SEQ ID NO: 4965157 - DNA, 16 bp, Homo sapiens
aaattttgcaaatata

SEQ ID NO: 4965158 - DNA, 22 bp, Homo sapiens
aaattttgcttttaattaaata

SEQ ID NO: 4965159 - DNA, 21 bp, Homo sapiens
aaatttttctcagtttgtata

SEQ ID NO: 4965160 - DNA, 20 bp, Homo sapiens
aaatttttgtagtagcgttt

SEQ ID NO: 4965161 - DNA, 20 bp, Homo sapiens
aacaaaatctcctcttttag

SEQ ID NO: 4965162 - DNA, 13 bp, Homo sapiens
aacaaaatctgtt

SEQ ID NO: 4965163 - DNA, 21 bp, Homo sapiens
aacaaaattttattttgtgct

SEQ ID NO: 4965164 - DNA, 12 bp, Homo sapiens
aacaaagaaata

SEQ ID NO: 4965165 - DNA, 15 bp, Homo sapiens
aacaaagctgttaaa

SEQ ID NO: 4965166 - DNA, 13 bp, Homo sapiens
aacaaatatgcaa

SEQ ID NO: 4965167 - DNA, 16 bp, Homo sapiens
aacaaatatgctaatt

SEQ ID NO: 4965168 - DNA, 19 bp, Homo sapiens
aacaagaccccgtctcaaa

SEQ ID NO: 4965169 - DNA, 12 bp, Homo sapiens
aacaagatttcc

SEQ ID NO: 4965170 - DNA, 23 bp, Homo sapiens
aacaagctaattgggagtccagg

SEQ ID NO: 4965171 - DNA, 17 bp, Homo sapiens
aacaagttttaatgtat

SEQ ID NO: 4965172 - DNA, 15 bp, Homo sapiens
aacaataaatgtgca

SEQ ID NO: 4965173 - DNA, 18 bp, Homo sapiens
aacaataggctgttccca

SEQ ID NO: 4965174 - DNA, 13 bp, Homo sapiens
aacaatatcatat

SEQ ID NO: 4965175 - DNA, 17 bp, Homo sapiens
aacaatctggaagaaaa

SEQ ID NO: 4965176 - DNA, 19 bp, Homo sapiens
aacaatgcagcaaggccct

SEQ ID NO: 4965177 - DNA, 12 bp, Homo sapiens
aacaatgttaag

SEQ ID NO: 4965178 - DNA, 13 bp, Homo sapiens
aacaatgttaagg

SEQ ID NO: 4965179 - DNA, 13 bp, Homo sapiens
aacacaaactgta

SEQ ID NO: 4965180 - DNA, 19 bp, Homo sapiens
aacacaaactgtaaataaa

SEQ ID NO: 4965181 - DNA, 19 bp, Homo sapiens
aacacacgcgcgcacacac

SEQ ID NO: 4965182 - DNA, 20 bp, Homo sapiens
aacacacgcgcgcacacaca

SEQ ID NO: 4965183 - DNA, 22 bp, Homo sapiens
aacacagagaagcggatttcca

SEQ ID NO: 4965184 - DNA, 23 bp, Homo sapiens
aacacagagaagcggatttccag

SEQ ID NO: 4965185 - DNA, 18 bp, Homo sapiens
aacacagctgttcttctg

SEQ ID NO: 4965186 - DNA, 14 bp, Homo sapiens
aacacaggcagctt

SEQ ID NO: 4965187 - DNA, 18 bp, Homo sapiens
aacacaggcagctttcta

SEQ ID NO: 4965188 - DNA, 16 bp, Homo sapiens
aacacagtcaaaataa

SEQ ID NO: 4965189 - DNA, 14 bp, Homo sapiens
aacaccacagaaat

SEQ ID NO: 4965190 - DNA, 16 bp, Homo sapiens
aacaccacagacacac

SEQ ID NO: 4965191 - DNA, 14 bp, Homo sapiens
aacacccttccttc

SEQ ID NO: 4965192 - DNA, 20 bp, Homo sapiens
aacaccgcttctgccttttc

SEQ ID NO: 4965193 - DNA, 19 bp, Homo sapiens
aacacctagctttattctt

SEQ ID NO: 4965194 - DNA, 20 bp, Homo sapiens
aacacgaaacttgttattgt

SEQ ID NO: 4965195 - DNA, 15 bp, Homo sapiens
aacactaaaaataaa

SEQ ID NO: 4965196 - DNA, 18 bp, Homo sapiens
aacactaactcaccagcc

SEQ ID NO: 4965197 - DNA, 16 bp, Homo sapiens
aacactatgtttattt

SEQ ID NO: 4965198 - DNA, 12 bp, Homo sapiens
aacactcttttg

SEQ ID NO: 4965199 - DNA, 14 bp, Homo sapiens
aacactgccttttt

SEQ ID NO: 4965200 - DNA, 17 bp, Homo sapiens
aacactggtgtgacctg

SEQ ID NO: 4965201 - DNA, 20 bp, Homo sapiens
aacactgtggaactaataaa

SEQ ID NO: 4965202 - DNA, 14 bp, Homo sapiens
aacagaaaacattc

SEQ ID NO: 4965203 - DNA, 13 bp, Homo sapiens
aacagaaacaaaa

SEQ ID NO: 4965204 - DNA, 13 bp, Homo sapiens
aacagaacagggt

SEQ ID NO: 4965205 - DNA, 20 bp, Homo sapiens
aacagaacatcattagaaca

SEQ ID NO: 4965206 - DNA, 13 bp, Homo sapiens
aacagaactaaat

SEQ ID NO: 4965207 - DNA, 16 bp, Homo sapiens
aacagaagcatttgta

SEQ ID NO: 4965208 - DNA, 13 bp, Homo sapiens
aacagaaggatga

SEQ ID NO: 4965209 - DNA, 17 bp, Homo sapiens
aacagacaagtgactgt

SEQ ID NO: 4965210 - DNA, 21 bp, Homo sapiens
aacagaggccatggcagaata

SEQ ID NO: 4965211 - DNA, 16 bp, Homo sapiens
aacagatgaataaact

SEQ ID NO: 4965212 - DNA, 16 bp, Homo sapiens
aacagctgcattagaa

SEQ ID NO: 4965213 - DNA, 14 bp, Homo sapiens
aacagcttcaggtt

SEQ ID NO: 4965214 - DNA, 16 bp, Homo sapiens
aacagcttcaggttat

SEQ ID NO: 4965215 - DNA, 14 bp, Homo sapiens
aacaggataaccct

SEQ ID NO: 4965216 - DNA, 22 bp, Homo sapiens
aacaggctgggcttcagtggca

SEQ ID NO: 4965217 - DNA, 18 bp, Homo sapiens
aacaggtaatataaaaag

SEQ ID NO: 4965218 - DNA, 11 bp, Homo sapiens
aacagtattta

SEQ ID NO: 4965219 - DNA, 12 bp, Homo sapiens
aacagtatttat

SEQ ID NO: 4965220 - DNA, 18 bp, Homo sapiens
aacagtatttattttgta

SEQ ID NO: 4965221 - DNA, 19 bp, Homo sapiens
aacagtatttattttgtaa

SEQ ID NO: 4965222 - DNA, 23 bp, Homo sapiens
aacagtccccgtggccatccctg

SEQ ID NO: 4965223 - DNA, 21 bp, Homo sapiens
aacagtgagcctgaattttgt

SEQ ID NO: 4965224 - DNA, 16 bp, Homo sapiens
aacagttagctggagc

SEQ ID NO: 4965225 - DNA, 16 bp, Homo sapiens
aacataaaaaaacttc

SEQ ID NO: 4965226 - DNA, 12 bp, Homo sapiens
aacatatgattt

SEQ ID NO: 4965227 - DNA, 19 bp, Homo sapiens
aacatattctgtatgaact

SEQ ID NO: 4965228 - DNA, 16 bp, Homo sapiens
aacatccaaccttccc

SEQ ID NO: 4965229 - DNA, 19 bp, Homo sapiens
aacatcctttgcagggcag

SEQ ID NO: 4965230 - DNA, 21 bp, Homo sapiens
aacatcctttgcagggcagcc

SEQ ID NO: 4965231 - DNA, 20 bp, Homo sapiens
aacatctttgacactctgca

SEQ ID NO: 4965232 - DNA, 12 bp, Homo sapiens
aacatgtattta

SEQ ID NO: 4965233 - DNA, 15 bp, Homo sapiens
aacatgtatttatgt

SEQ ID NO: 4965234 - DNA, 13 bp, Homo sapiens
aacatgtgtttta

SEQ ID NO: 4965235 - DNA, 15 bp, Homo sapiens
aacattaaaaatgga

SEQ ID NO: 4965236 - DNA, 16 bp, Homo sapiens
aacattaaaaatggaa

SEQ ID NO: 4965237 - DNA, 21 bp, Homo sapiens
aacattaaaaatggaactgtg

SEQ ID NO: 4965238 - DNA, 12 bp, Homo sapiens
aacattaaatgt

SEQ ID NO: 4965239 - DNA, 16 bp, Homo sapiens
aacattaccttactgt

SEQ ID NO: 4965240 - DNA, 23 bp, Homo sapiens
aacattatttattcagcttcatt

SEQ ID NO: 4965241 - DNA, 17 bp, Homo sapiens
aacattccaagactcta

SEQ ID NO: 4965242 - DNA, 20 bp, Homo sapiens
aacattccaaggagttggaa

SEQ ID NO: 4965243 - DNA, 14 bp, Homo sapiens
aaaaagattagcaa

SEQ ID NO: 4965244 - DNA, 17 bp, Homo sapiens
aaaaagcataaaaacat

SEQ ID NO: 4965245 - DNA, 12 bp, Homo sapiens
aaaaagctttat

SEQ ID NO: 4965246 - DNA, 19 bp, Homo sapiens
aaaaagctttatgattttc

SEQ ID NO: 4965247 - DNA, 20 bp, Homo sapiens
aaaaagtgacacagcagctt

SEQ ID NO: 4965248 - DNA, 17 bp, Homo sapiens
aaaaagtttacaagtgt

SEQ ID NO: 4965249 - DNA, 19 bp, Homo sapiens
aaaaatatatttaatgata

SEQ ID NO: 4965250 - DNA, 18 bp, Homo sapiens
aaaaatcacaatttttaa

SEQ ID NO: 4965251 - DNA, 16 bp, Homo sapiens
aaaaatcttctccaga

SEQ ID NO: 4965252 - DNA, 20 bp, Homo sapiens
aaaaatgaatgtctaaaatt

SEQ ID NO: 4965253 - DNA, 18 bp, Homo sapiens
aaaaatgcctttgagaca

SEQ ID NO: 4965254 - DNA, 20 bp, Homo sapiens
aaaaatgcctttgagacagt

SEQ ID NO: 4965255 - DNA, 21 bp, Homo sapiens
aaaaatgcctttgagacagtt

SEQ ID NO: 4965256 - DNA, 15 bp, Homo sapiens
aaaaatggaactgtg

SEQ ID NO: 4965257 - DNA, 13 bp, Homo sapiens
aaaaatggtaatt

SEQ ID NO: 4965258 - DNA, 12 bp, Homo sapiens
aaaaatgttgaa

SEQ ID NO: 4965259 - DNA, 12 bp, Homo sapiens
aaaaatgtttgt

SEQ ID NO: 4965260 - DNA, 14 bp, Homo sapiens
aaaaattactaatt

SEQ ID NO: 4965261 - DNA, 11 bp, Homo sapiens
aaaaattatta

SEQ ID NO: 4965262 - DNA, 13 bp, Homo sapiens
aaaaattgaagag

SEQ ID NO: 4965263 - DNA, 14 bp, Homo sapiens
aaaacaaaacaaaa

SEQ ID NO: 4965264 - DNA, 16 bp, Homo sapiens
aaaacaaaacaaaact

SEQ ID NO: 4965265 - DNA, 15 bp, Homo sapiens
aaaacaaaattttat

SEQ ID NO: 4965266 - DNA, 12 bp, Homo sapiens
aaaacaagtgaa

SEQ ID NO: 4965267 - DNA, 15 bp, Homo sapiens
aaaacaagtgaaata

SEQ ID NO: 4965268 - DNA, 16 bp, Homo sapiens
aaaacaatcacactca

SEQ ID NO: 4965269 - DNA, 18 bp, Homo sapiens
aaaacactgccatcttag

SEQ ID NO: 4965270 - DNA, 22 bp, Homo sapiens
aaaacagaacatcattagaaca

SEQ ID NO: 4965271 - DNA, 19 bp, Homo sapiens
aaaacagctgcattagaaa

SEQ ID NO: 4965272 - DNA, 16 bp, Homo sapiens
aaaacagtatttattt

SEQ ID NO: 4965273 - DNA, 17 bp, Homo sapiens
aaaacagtatttatttt

SEQ ID NO: 4965274 - DNA, 20 bp, Homo sapiens
aaaacagtatttattttgta

SEQ ID NO: 4965275 - DNA, 14 bp, Homo sapiens
aaaacattggatta

SEQ ID NO: 4965276 - DNA, 21 bp, Homo sapiens
aaaacattggattatcctgag

SEQ ID NO: 4965277 - DNA, 17 bp, Homo sapiens
aaaaccactagaactct

SEQ ID NO: 4965278 - DNA, 23 bp, Homo sapiens
aaaaccttagctccctcccgcac

SEQ ID NO: 4965279 - DNA, 13 bp, Homo sapiens
aaaacgaaaacag

SEQ ID NO: 4965280 - DNA, 21 bp, Homo sapiens
aaaactatacttgaacaaaag

SEQ ID NO: 4965281 - DNA, 19 bp, Homo sapiens
aaaactcagcctgggacag

SEQ ID NO: 4965282 - DNA, 17 bp, Homo sapiens
aaaactccaccttccca

SEQ ID NO: 4965283 - DNA, 18 bp, Homo sapiens
aaaactgaaaatctaata

SEQ ID NO: 4965284 - DNA, 12 bp, Homo sapiens
aaaactgctttt

SEQ ID NO: 4965285 - DNA, 21 bp, Homo sapiens
aaaactggaataagaagcaaa

SEQ ID NO: 4965286 - DNA, 20 bp, Homo sapiens
aaaactgtacatttaaaatt

SEQ ID NO: 4965287 - DNA, 16 bp, Homo sapiens
aaaactgttacctaaa

SEQ ID NO: 4965288 - DNA, 19 bp, Homo sapiens
aaaacttaacatatttact

SEQ ID NO: 4965289 - DNA, 21 bp, Homo sapiens
aaaacttaacttccaatgaaa

SEQ ID NO: 4965290 - DNA, 18 bp, Homo sapiens
aaaacttcattctcgtga

SEQ ID NO: 4965291 - DNA, 23 bp, Homo sapiens
aaaacttcttgtcagacataaag

SEQ ID NO: 4965292 - DNA, 11 bp, Homo sapiens
aaaagaaaaaa

SEQ ID NO: 4965293 - DNA, 12 bp, Homo sapiens
aaaagaaaaaaa

SEQ ID NO: 4965294 - DNA, 14 bp, Homo sapiens
aaaagaaaaaccac

SEQ ID NO: 4965295 - DNA, 12 bp, Homo sapiens
aaaagaaaataa

SEQ ID NO: 4965296 - DNA, 14 bp, Homo sapiens
aaaagaaatgacta

SEQ ID NO: 4965297 - DNA, 15 bp, Homo sapiens
aaaagaaatgactaa

SEQ ID NO: 4965298 - DNA, 21 bp, Homo sapiens
aaaagaatattcagagaatat

SEQ ID NO: 4965299 - DNA, 15 bp, Homo sapiens
aaaagagaagaagaa

SEQ ID NO: 4965300 - DNA, 15 bp, Homo sapiens
aaaagagtcttccaa

SEQ ID NO: 4965301 - DNA, 23 bp, Homo sapiens
aaaagatctgttttgaaggcaaa

SEQ ID NO: 4965302 - DNA, 13 bp, Homo sapiens
aaaagccttgtgt

SEQ ID NO: 4965303 - DNA, 22 bp, Homo sapiens
aaaagcggaaagttagtgcttg

SEQ ID NO: 4965304 - DNA, 15 bp, Homo sapiens
aaaagctattagcca

SEQ ID NO: 4965305 - DNA, 17 bp, Homo sapiens
aaaagctattagccagg

SEQ ID NO: 4965306 - DNA, 21 bp, Homo sapiens
aaaagctattagccaggatca

SEQ ID NO: 4965307 - DNA, 17 bp, Homo sapiens
aaaagctcatttcatgc

SEQ ID NO: 4965308 - DNA, 22 bp, Homo sapiens
aaaagctccatgtgcctctttg

SEQ ID NO: 4965309 - DNA, 14 bp, Homo sapiens
aaaagcttcaaatt

SEQ ID NO: 4965310 - DNA, 21 bp, Homo sapiens
aaaagcttcttaattaatttg

SEQ ID NO: 4965311 - DNA, 14 bp, Homo sapiens
aaaaggaaaaagct

SEQ ID NO: 4965312 - DNA, 15 bp, Homo sapiens
aaaaggaaaaagctc

SEQ ID NO: 4965313 - DNA, 15 bp, Homo sapiens
aaaaggatagtattt

SEQ ID NO: 4965314 - DNA, 22 bp, Homo sapiens
aaaaggatagtatttttatcca

SEQ ID NO: 4965315 - DNA, 18 bp, Homo sapiens
aaaaggccagtggaaatt

SEQ ID NO: 4965316 - DNA, 20 bp, Homo sapiens
aaaaggctaggtacacagct

SEQ ID NO: 4965317 - DNA, 21 bp, Homo sapiens
aaaagggtcaatgctattttt

SEQ ID NO: 4965318 - DNA, 15 bp, Homo sapiens
aaaaggtattaaatt

SEQ ID NO: 4965319 - DNA, 20 bp, Homo sapiens
aaaaggttcttcatcccttt

SEQ ID NO: 4965320 - DNA, 13 bp, Homo sapiens
aaaagtattttga

SEQ ID NO: 4965321 - DNA, 14 bp, Homo sapiens
aaaagtattttgaa

SEQ ID NO: 4965322 - DNA, 16 bp, Homo sapiens
aaaagtattttgaagt

SEQ ID NO: 4965323 - DNA, 16 bp, Homo sapiens
aaaagtcgttttccaa

SEQ ID NO: 4965324 - DNA, 19 bp, Homo sapiens
aaaagtcgttttccaaact

SEQ ID NO: 4965325 - DNA, 23 bp, Homo sapiens
aaaagtcgttttccaaactgact

SEQ ID NO: 4965326 - DNA, 17 bp, Homo sapiens
aaaagtgaatgaaagat

SEQ ID NO: 4965327 - DNA, 14 bp, Homo sapiens
aaaagtgacacagc

SEQ ID NO: 4965328 - DNA, 15 bp, Homo sapiens
aaaagttacagaaat

SEQ ID NO: 4965329 - DNA, 15 bp, Homo sapiens
aaaagttccaagagt

SEQ ID NO: 4965330 - DNA, 23 bp, Homo sapiens
aaaagttccaagagtctaaagat

SEQ ID NO: 4965331 - DNA, 22 bp, Homo sapiens
aaaagtttacaagtgtatatca

SEQ ID NO: 4965332 - DNA, 12 bp, Homo sapiens
aaaagtttccat

SEQ ID NO: 4965333 - DNA, 17 bp, Homo sapiens
aaaataaaaagtgacac

SEQ ID NO: 4965334 - DNA, 21 bp, Homo sapiens
aaaataaaaagtgacacagca

SEQ ID NO: 4965335 - DNA, 15 bp, Homo sapiens
aaaataaatggaaat

SEQ ID NO: 4965336 - DNA, 12 bp, Homo sapiens
aaaataataatt

SEQ ID NO: 4965337 - DNA, 13 bp, Homo sapiens
aaaataattctaa

SEQ ID NO: 4965338 - DNA, 13 bp, Homo sapiens
aaaatagacactc

SEQ ID NO: 4965339 - DNA, 17 bp, Homo sapiens
aaaatagatgtctttta

SEQ ID NO: 4965340 - DNA, 13 bp, Homo sapiens
aaaatagcttgta

SEQ ID NO: 4965341 - DNA, 16 bp, Homo sapiens
aaaatagttgtccata

SEQ ID NO: 4965342 - DNA, 12 bp, Homo sapiens
aaaatagtttgt

SEQ ID NO: 4965343 - DNA, 13 bp, Homo sapiens
aaaatagtttgtt

SEQ ID NO: 4965344 - DNA, 22 bp, Homo sapiens
aaaatataaaatagttgtccat

SEQ ID NO: 4965345 - DNA, 15 bp, Homo sapiens
aaaatatatttaatg

SEQ ID NO: 4965346 - DNA, 23 bp, Homo sapiens
aaaatatgtctcgctagtgatgt

SEQ ID NO: 4965347 - DNA, 21 bp, Homo sapiens
aaaatattatgtgtttccata

SEQ ID NO: 4965348 - DNA, 21 bp, Homo sapiens
aaaatatttgactattctgta

SEQ ID NO: 4965349 - DNA, 13 bp, Homo sapiens
aaaatcacaaaaa

SEQ ID NO: 4965350 - DNA, 14 bp, Homo sapiens
aaaatcacaatttt

SEQ ID NO: 4965351 - DNA, 19 bp, Homo sapiens
aaaatcaggtattaatctt

SEQ ID NO: 4965352 - DNA, 16 bp, Homo sapiens
aaaatcctaagacaca

SEQ ID NO: 4965353 - DNA, 22 bp, Homo sapiens
aaaatcctaagacacaaatgca

SEQ ID NO: 4965354 - DNA, 21 bp, Homo sapiens
aaacgacactctctggaagcc

SEQ ID NO: 4965355 - DNA, 14 bp, Homo sapiens
aaacggttcagttt

SEQ ID NO: 4965356 - DNA, 19 bp, Homo sapiens
aaacggttcagtttcttct

SEQ ID NO: 4965357 - DNA, 15 bp, Homo sapiens
aaactaaaagacatt

SEQ ID NO: 4965358 - DNA, 13 bp, Homo sapiens
aaactactctttg

SEQ ID NO: 4965359 - DNA, 14 bp, Homo sapiens
aaactactctttga

SEQ ID NO: 4965360 - DNA, 18 bp, Homo sapiens
aaactatacttgaacaaa

SEQ ID NO: 4965361 - DNA, 20 bp, Homo sapiens
aaactatacttgaacaaaag

SEQ ID NO: 4965362 - DNA, 16 bp, Homo sapiens
aaactatcttggtgaa

SEQ ID NO: 4965363 - DNA, 18 bp, Homo sapiens
aaactcaaaacttaacat

SEQ ID NO: 4965364 - DNA, 13 bp, Homo sapiens
aaactcaaaatat

SEQ ID NO: 4965365 - DNA, 17 bp, Homo sapiens
aaactcagggacagagc

SEQ ID NO: 4965366 - DNA, 15 bp, Homo sapiens
aaactccaccttccc

SEQ ID NO: 4965367 - DNA, 17 bp, Homo sapiens
aaactccggattgcgtt

SEQ ID NO: 4965368 - DNA, 20 bp, Homo sapiens
aaactctaaacattaatcaa

SEQ ID NO: 4965369 - DNA, 15 bp, Homo sapiens
aaactcttatctcag

SEQ ID NO: 4965370 - DNA, 16 bp, Homo sapiens
aaactcttatctcagt

SEQ ID NO: 4965371 - DNA, 17 bp, Homo sapiens
aaactcttgacctcagg

SEQ ID NO: 4965372 - DNA, 13 bp, Homo sapiens
aaactgactatca

SEQ ID NO: 4965373 - DNA, 15 bp, Homo sapiens
aaactgtacatttaa

SEQ ID NO: 4965374 - DNA, 15 bp, Homo sapiens
aaacttactattttg

SEQ ID NO: 4965375 - DNA, 15 bp, Homo sapiens
aaacttataaatcat

SEQ ID NO: 4965376 - DNA, 21 bp, Homo sapiens
aaacttataaatcatattgat

SEQ ID NO: 4965377 - DNA, 13 bp, Homo sapiens
aaacttcagcacc

SEQ ID NO: 4965378 - DNA, 17 bp, Homo sapiens
aaacttccccatcttct

SEQ ID NO: 4965379 - DNA, 13 bp, Homo sapiens
aaacttcttaaat

SEQ ID NO: 4965380 - DNA, 16 bp, Homo sapiens
aaacttcttaaatatc

SEQ ID NO: 4965381 - DNA, 21 bp, Homo sapiens
aaacttcttaaatatctttta

SEQ ID NO: 4965382 - DNA, 13 bp, Homo sapiens
aaacttgaaaata

SEQ ID NO: 4965383 - DNA, 13 bp, Homo sapiens
aaacttgtgaatg

SEQ ID NO: 4965384 - DNA, 14 bp, Homo sapiens
aaacttgttattgt

SEQ ID NO: 4965385 - DNA, 16 bp, Homo sapiens
aaacttgttattgtga

SEQ ID NO: 4965386 - DNA, 18 bp, Homo sapiens
aaacttgttattgtgaat

SEQ ID NO: 4965387 - DNA, 22 bp, Homo sapiens
aaacttgttattgtgaatgatt

SEQ ID NO: 4965388 - DNA, 19 bp, Homo sapiens
aaacttgtttgctgtgaac

SEQ ID NO: 4965389 - DNA, 18 bp, Homo sapiens
aaactttagggtaaaaat

SEQ ID NO: 4965390 - DNA, 13 bp, Homo sapiens
aaacttttctgct

SEQ ID NO: 4965391 - DNA, 16 bp, Homo sapiens
aaacttttctgctgat

SEQ ID NO: 4965392 - DNA, 9 bp, Homo sapiens
aaagaaaaa

SEQ ID NO: 4965393 - DNA, 20 bp, Homo sapiens
aaagaaaaaaaaaagaagaa

SEQ ID NO: 4965394 - DNA, 22 bp, Homo sapiens
aaagaaaaaaaaaagaagaaga

SEQ ID NO: 4965395 - DNA, 14 bp, Homo sapiens
aaagaaagaaggaa

SEQ ID NO: 4965396 - DNA, 13 bp, Homo sapiens
aaagaaatgaaca

SEQ ID NO: 4965397 - DNA, 14 bp, Homo sapiens
aaagaaatgaacat

SEQ ID NO: 4965398 - DNA, 14 bp, Homo sapiens
aaagaaatttacta

SEQ ID NO: 4965399 - DNA, 21 bp, Homo sapiens
aaagaaatttactatatatat

SEQ ID NO: 4965400 - DNA, 15 bp, Homo sapiens
aaagaagatgttgaa

SEQ ID NO: 4965401 - DNA, 12 bp, Homo sapiens
aaagaaggaagt

SEQ ID NO: 4965402 - DNA, 19 bp, Homo sapiens
aaagaattcttatacacat

SEQ ID NO: 4965403 - DNA, 13 bp, Homo sapiens
aaagacacctact

SEQ ID NO: 4965404 - DNA, 13 bp, Homo sapiens
aaagacactgcct

SEQ ID NO: 4965405 - DNA, 19 bp, Homo sapiens
aaagacactgcctgggctg

SEQ ID NO: 4965406 - DNA, 15 bp, Homo sapiens
aaagacaggctctgt

SEQ ID NO: 4965407 - DNA, 11 bp, Homo sapiens
aaagaccaaac

SEQ ID NO: 4965408 - DNA, 13 bp, Homo sapiens
aaagaccaaactt

SEQ ID NO: 4965409 - DNA, 12 bp, Homo sapiens
aaagagaagaag

SEQ ID NO: 4965410 - DNA, 13 bp, Homo sapiens
aaagagaagaaga

SEQ ID NO: 4965411 - DNA, 14 bp, Homo sapiens
aaagagaagaagaa

SEQ ID NO: 4965412 - DNA, 11 bp, Homo sapiens
aaagagagaga

SEQ ID NO: 4965413 - DNA, 18 bp, Homo sapiens
aaagagcacaaacatttt

SEQ ID NO: 4965414 - DNA, 19 bp, Homo sapiens
aaagagcacaaacattttt

SEQ ID NO: 4965415 - DNA, 20 bp, Homo sapiens
aaagaggactcgcttgtaaa

SEQ ID NO: 4965416 - DNA, 15 bp, Homo sapiens
aaagatattgttcaa

SEQ ID NO: 4965417 - DNA, 22 bp, Homo sapiens
aaagatattgttcaaacaatat

SEQ ID NO: 4965418 - DNA, 20 bp, Homo sapiens
aaagatcaaaataaaaagtg

SEQ ID NO: 4965419 - DNA, 21 bp, Homo sapiens
aaagatgcagccgccttcctt

SEQ ID NO: 4965420 - DNA, 16 bp, Homo sapiens
aaagatggagtttcta

SEQ ID NO: 4965421 - DNA, 19 bp, Homo sapiens
aaagatggagtttctaagg

SEQ ID NO: 4965422 - DNA, 23 bp, Homo sapiens
aaagatggctgtgcctctgcctg

SEQ ID NO: 4965423 - DNA, 13 bp, Homo sapiens
aaagattagcaag

SEQ ID NO: 4965424 - DNA, 18 bp, Homo sapiens
aaagattctatagttcta

SEQ ID NO: 4965425 - DNA, 19 bp, Homo sapiens
aaagattctatagttctag

SEQ ID NO: 4965426 - DNA, 17 bp, Homo sapiens
aaagattgctgaaaaag

SEQ ID NO: 4965427 - DNA, 14 bp, Homo sapiens
aaagattttcagaa

SEQ ID NO: 4965428 - DNA, 19 bp, Homo sapiens
aaagattttttttaatcta

SEQ ID NO: 4965429 - DNA, 15 bp, Homo sapiens
aaagcacaggagaca

SEQ ID NO: 4965430 - DNA, 16 bp, Homo sapiens
aaagcacagtttgaac

SEQ ID NO: 4965431 - DNA, 22 bp, Homo sapiens
aaagcaggggctacaagaggga

SEQ ID NO: 4965432 - DNA, 13 bp, Homo sapiens
aaagcatgaatgg

SEQ ID NO: 4965433 - DNA, 22 bp, Homo sapiens
aaagcattaattttttttcatt

SEQ ID NO: 4965434 - DNA, 21 bp, Homo sapiens
aaagcattgcttttattttga

SEQ ID NO: 4965435 - DNA, 17 bp, Homo sapiens
aaagccacattatttct

SEQ ID NO: 4965436 - DNA, 20 bp, Homo sapiens
aaagccacctctgtcatttg

SEQ ID NO: 4965437 - DNA, 22 bp, Homo sapiens
aaagcccttccatgtcgcctct

SEQ ID NO: 4965438 - DNA, 14 bp, Homo sapiens
aaagccttgtgtat

SEQ ID NO: 4965439 - DNA, 18 bp, Homo sapiens
aaagccttgtgtatattt

SEQ ID NO: 4965440 - DNA, 17 bp, Homo sapiens
aaagcgatatacagatg

SEQ ID NO: 4965441 - DNA, 19 bp, Homo sapiens
aaagctattagccaggatc

SEQ ID NO: 4965442 - DNA, 13 bp, Homo sapiens
aaagctcatattt

SEQ ID NO: 4965443 - DNA, 21 bp, Homo sapiens
aaagctcatattttgtatata

SEQ ID NO: 4965444 - DNA, 20 bp, Homo sapiens
aaagctcatttcatgctctg

SEQ ID NO: 4965445 - DNA, 16 bp, Homo sapiens
aaagctcctgtcctcc

SEQ ID NO: 4965446 - DNA, 20 bp, Homo sapiens
aaagctgagaactcctgact

SEQ ID NO: 4965447 - DNA, 22 bp, Homo sapiens
aaagctgcccactgtttctctt

SEQ ID NO: 4965448 - DNA, 13 bp, Homo sapiens
aagcaaatactta

SEQ ID NO: 4965449 - DNA, 14 bp, Homo sapiens
aagcaactgttatg

SEQ ID NO: 4965450 - DNA, 12 bp, Homo sapiens
aagcaagctctc

SEQ ID NO: 4965451 - DNA, 15 bp, Homo sapiens
aagcaatttcttgct

SEQ ID NO: 4965452 - DNA, 15 bp, Homo sapiens
aagcacaaactttag

SEQ ID NO: 4965453 - DNA, 18 bp, Homo sapiens
aagcacagtttgaacaaa

SEQ ID NO: 4965454 - DNA, 15 bp, Homo sapiens
aagcacctcctgcct

SEQ ID NO: 4965455 - DNA, 19 bp, Homo sapiens
aagcaccttagctggcatt

SEQ ID NO: 4965456 - DNA, 12 bp, Homo sapiens
aagcactcgtgt

SEQ ID NO: 4965457 - DNA, 13 bp, Homo sapiens
aagcactgaaaaa

SEQ ID NO: 4965458 - DNA, 19 bp, Homo sapiens
aagcagagtgcacagctgt

SEQ ID NO: 4965459 - DNA, 21 bp, Homo sapiens
aagcagagtgcacagctgtcc

SEQ ID NO: 4965460 - DNA, 18 bp, Homo sapiens
aagcaggagacgacaggc

SEQ ID NO: 4965461 - DNA, 16 bp, Homo sapiens
aagcagggaatttcta

SEQ ID NO: 4965462 - DNA, 22 bp, Homo sapiens
aagcagggaatttctatctaaa

SEQ ID NO: 4965463 - DNA, 20 bp, Homo sapiens
aagcaggggctacaagaggg

SEQ ID NO: 4965464 - DNA, 22 bp, Homo sapiens
aagcaggggctacaagagggaa

SEQ ID NO: 4965465 - DNA, 21 bp, Homo sapiens
aagcagtagaaataatatgca

SEQ ID NO: 4965466 - DNA, 22 bp, Homo sapiens
aagcagtagaaataatatgcat

SEQ ID NO: 4965467 - DNA, 22 bp, Homo sapiens
aagcatacatgcaaaaagaaat

SEQ ID NO: 4965468 - DNA, 18 bp, Homo sapiens
aagcatctaagttataag

SEQ ID NO: 4965469 - DNA, 22 bp, Homo sapiens
aagcatgcttgtgaaaatgtgt

SEQ ID NO: 4965470 - DNA, 15 bp, Homo sapiens
aagcatgtttcatgt

SEQ ID NO: 4965471 - DNA, 20 bp, Homo sapiens
aagcatgtttcatgttttgt

SEQ ID NO: 4965472 - DNA, 13 bp, Homo sapiens
aagcattccttct

SEQ ID NO: 4965473 - DNA, 14 bp, Homo sapiens
aagcattccttctt

SEQ ID NO: 4965474 - DNA, 20 bp, Homo sapiens
aagcattccttctttgataa

SEQ ID NO: 4965475 - DNA, 22 bp, Homo sapiens
aagcattccttctttgataatg

SEQ ID NO: 4965476 - DNA, 23 bp, Homo sapiens
aagcattccttctttgataatgt

SEQ ID NO: 4965477 - DNA, 14 bp, Homo sapiens
aagcattctcccca

SEQ ID NO: 4965478 - DNA, 13 bp, Homo sapiens
aagcattgaaatt

SEQ ID NO: 4965479 - DNA, 13 bp, Homo sapiens
aagcattgcctgg

SEQ ID NO: 4965480 - DNA, 17 bp, Homo sapiens
aagcatttgtattttgt

SEQ ID NO: 4965481 - DNA, 19 bp, Homo sapiens
aagccaaagaaatgaacat

SEQ ID NO: 4965482 - DNA, 20 bp, Homo sapiens
aagccaaagaaatgaacatt

SEQ ID NO: 4965483 - DNA, 13 bp, Homo sapiens
aagccaaatttat

SEQ ID NO: 4965484 - DNA, 15 bp, Homo sapiens
aagccacaagaaatt

SEQ ID NO: 4965485 - DNA, 17 bp, Homo sapiens
aagccactagactcttc

SEQ ID NO: 4965486 - DNA, 18 bp, Homo sapiens
aagccatgtataaatgtg

SEQ ID NO: 4965487 - DNA, 20 bp, Homo sapiens
aagccattctaaggaaatta

SEQ ID NO: 4965488 - DNA, 16 bp, Homo sapiens
aagccctacagagctg

SEQ ID NO: 4965489 - DNA, 17 bp, Homo sapiens
aagccctacagagctgt

SEQ ID NO: 4965490 - DNA, 23 bp, Homo sapiens
aagcccttccatgtcgcctctgc

SEQ ID NO: 4965491 - DNA, 14 bp, Homo sapiens
aagccgtggcttcc

SEQ ID NO: 4965492 - DNA, 16 bp, Homo sapiens
aagcctaaatgcctta

SEQ ID NO: 4965493 - DNA, 14 bp, Homo sapiens
aagcctcatattta

SEQ ID NO: 4965494 - DNA, 22 bp, Homo sapiens
aagcctgcgttggtccagagcg

SEQ ID NO: 4965495 - DNA, 15 bp, Homo sapiens
aagcctgtggatgat

SEQ ID NO: 4965496 - DNA, 16 bp, Homo sapiens
aagccttcagctccag

SEQ ID NO: 4965497 - DNA, 19 bp, Homo sapiens
aagcctttagtatcagtgt

SEQ ID NO: 4965498 - DNA, 20 bp, Homo sapiens
aagcctttagtatcagtgtt

SEQ ID NO: 4965499 - DNA, 21 bp, Homo sapiens
aagcctttagtatcagtgttt

SEQ ID NO: 4965500 - DNA, 23 bp, Homo sapiens
aagcgaggcatgcctgagagaca

SEQ ID NO: 4965501 - DNA, 21 bp, Homo sapiens
aagcgatatacagatgaaaat

SEQ ID NO: 4965502 - DNA, 15 bp, Homo sapiens
aagcgtgagccactg

SEQ ID NO: 4965503 - DNA, 16 bp, Homo sapiens
aagcgtgagccactgc

SEQ ID NO: 4965504 - DNA, 14 bp, Homo sapiens
aagctaatttgcat

SEQ ID NO: 4965505 - DNA, 23 bp, Homo sapiens
aagctactgtgtgtgtgaatgaa

SEQ ID NO: 4965506 - DNA, 12 bp, Homo sapiens
aagctaggcctg

SEQ ID NO: 4965507 - DNA, 19 bp, Homo sapiens
aagctattagccaggatca

SEQ ID NO: 4965508 - DNA, 14 bp, Homo sapiens
aagctattcctttc

SEQ ID NO: 4965509 - DNA, 21 bp, Homo sapiens
aagctattcctttcccttcct

SEQ ID NO: 4965510 - DNA, 23 bp, Homo sapiens
aagctattcctttcccttcctct

SEQ ID NO: 4965511 - DNA, 16 bp, Homo sapiens
aagctccactgtcacc

SEQ ID NO: 4965512 - DNA, 19 bp, Homo sapiens
aagctccactgtcaccctc

SEQ ID NO: 4965513 - DNA, 11 bp, Homo sapiens
aagctccctgc

SEQ ID NO: 4965514 - DNA, 16 bp, Homo sapiens
aagctccctgccccaa

SEQ ID NO: 4965515 - DNA, 17 bp, Homo sapiens
aagctccctgccccaaa

SEQ ID NO: 4965516 - DNA, 17 bp, Homo sapiens
aagctcctcctcggaac

SEQ ID NO: 4965517 - DNA, 20 bp, Homo sapiens
aagctcctgtcctcccatcc

SEQ ID NO: 4965518 - DNA, 12 bp, Homo sapiens
aagctctgaagt

SEQ ID NO: 4965519 - DNA, 13 bp, Homo sapiens
aagctctgctcct

SEQ ID NO: 4965520 - DNA, 19 bp, Homo sapiens
aagctgagaactcctgact

SEQ ID NO: 4965521 - DNA, 11 bp, Homo sapiens
aagctgcagct

SEQ ID NO: 4965522 - DNA, 14 bp, Homo sapiens
aagctgcagcttcc

SEQ ID NO: 4965523 - DNA, 18 bp, Homo sapiens
aagctgcagcttcctgtc

SEQ ID NO: 4965524 - DNA, 19 bp, Homo sapiens
aagctgcctgtagttagga

SEQ ID NO: 4965525 - DNA, 22 bp, Homo sapiens
aagctgcctgtagttaggaaat

SEQ ID NO: 4965526 - DNA, 22 bp, Homo sapiens
aagctggccgagggtcctggct

SEQ ID NO: 4965527 - DNA, 19 bp, Homo sapiens
aagctgtgacttctccagg

SEQ ID NO: 4965528 - DNA, 16 bp, Homo sapiens
aagctgttaaactgtt

SEQ ID NO: 4965529 - DNA, 18 bp, Homo sapiens
aagctgttaaactgttag

SEQ ID NO: 4965530 - DNA, 18 bp, Homo sapiens
aagctgttgtacatttat

SEQ ID NO: 4965531 - DNA, 10 bp, Homo sapiens
aagcttagaa

SEQ ID NO: 4965532 - DNA, 18 bp, Homo sapiens
aagcttcaaactgcatga

SEQ ID NO: 4965533 - DNA, 14 bp, Homo sapiens
aagcttctaataaa

SEQ ID NO: 4965534 - DNA, 19 bp, Homo sapiens
aagcttcttaattaatttg

SEQ ID NO: 4965535 - DNA, 21 bp, Homo sapiens
aagctttattaccagtggcgt

SEQ ID NO: 4965536 - DNA, 18 bp, Homo sapiens
aaggaaaacctgaagact

SEQ ID NO: 4965537 - DNA, 13 bp, Homo sapiens
aaggaaaagaaaa

SEQ ID NO: 4965538 - DNA, 15 bp, Homo sapiens
aaggaaaagaaaaaa

SEQ ID NO: 4965539 - DNA, 22 bp, Homo sapiens
aaggaaatctcaccccatccca

SEQ ID NO: 4965540 - DNA, 13 bp, Homo sapiens
aaggaaccttcct

SEQ ID NO: 4965541 - DNA, 21 bp, Homo sapiens
aaggaaccttccttcctgctt

SEQ ID NO: 4965542 - DNA, 19 bp, Homo sapiens
aaggaagccaaatttatca

SEQ ID NO: 4965543 - DNA, 18 bp, Homo sapiens
aaggaagctccactgtca

SEQ ID NO: 4965544 - DNA, 11 bp, Homo sapiens
aaggaaggaaa

SEQ ID NO: 4965545 - DNA, 15 bp, Homo sapiens
aaggaaggttcatgt

SEQ ID NO: 4965546 - DNA, 14 bp, Homo sapiens
aaggacatcagcaa

SEQ ID NO: 4965547 - DNA, 18 bp, Homo sapiens
aaggacctgaaattccaa

SEQ ID NO: 4965548 - DNA, 13 bp, Homo sapiens
aaggactgaggga

SEQ ID NO: 4965549 - DNA, 14 bp, Homo sapiens
aaggactgtgcttt

SEQ ID NO: 4965550 - DNA, 14 bp, Homo sapiens
aaggagaacaaata

SEQ ID NO: 4965551 - DNA, 15 bp, Homo sapiens
aaggagaacaaatat

SEQ ID NO: 4965552 - DNA, 12 bp, Homo sapiens
aaggagagaaag

SEQ ID NO: 4965553 - DNA, 14 bp, Homo sapiens
aaggagagaaagtg

SEQ ID NO: 4965554 - DNA, 20 bp, Homo sapiens
aaggagagactcccatgaag

SEQ ID NO: 4965555 - DNA, 21 bp, Homo sapiens
aaggagcacaggtcccacctc

SEQ ID NO: 4965556 - DNA, 16 bp, Homo sapiens
aaggaggcatgcctct

SEQ ID NO: 4965557 - DNA, 20 bp, Homo sapiens
aaggaggggatagagagaga

SEQ ID NO: 4965558 - DNA, 18 bp, Homo sapiens
aaggagggtacagctggg

SEQ ID NO: 4965559 - DNA, 20 bp, Homo sapiens
aaggagtcagacattttaag

SEQ ID NO: 4965560 - DNA, 15 bp, Homo sapiens
aaggatgtcacaggg

SEQ ID NO: 4965561 - DNA, 17 bp, Homo sapiens
aaggatgtcacagggcc

SEQ ID NO: 4965562 - DNA, 22 bp, Homo sapiens
aaggatgtgattgtggaatgga

SEQ ID NO: 4965563 - DNA, 13 bp, Homo sapiens
aaggattgaaaat

SEQ ID NO: 4965564 - DNA, 14 bp, Homo sapiens
aaggattgaaaatt

SEQ ID NO: 4965565 - DNA, 12 bp, Homo sapiens
aaggattgtaaa

SEQ ID NO: 4965566 - DNA, 19 bp, Homo sapiens
aaggcaaaattgcaaatct

SEQ ID NO: 4965567 - DNA, 18 bp, Homo sapiens
aaggcaaatgtgtacatg

SEQ ID NO: 4965568 - DNA, 14 bp, Homo sapiens
aaggcactctagat

SEQ ID NO: 4965569 - DNA, 15 bp, Homo sapiens
aaggcactctagatt

SEQ ID NO: 4965570 - DNA, 11 bp, Homo sapiens
aaggcagccac

SEQ ID NO: 4965571 - DNA, 14 bp, Homo sapiens
aaggcagccaccag

SEQ ID NO: 4965572 - DNA, 20 bp, Homo sapiens
aaggcatcagtccctatgta

SEQ ID NO: 4965573 - DNA, 16 bp, Homo sapiens
aaggcatgttcctctg

SEQ ID NO: 4965574 - DNA, 19 bp, Homo sapiens
aaggccagagtggcctggc

SEQ ID NO: 4965575 - DNA, 22 bp, Homo sapiens
aaggccagagtggcctggccag

SEQ ID NO: 4965576 - DNA, 16 bp, Homo sapiens
aaggcctaggattcta

SEQ ID NO: 4965577 - DNA, 15 bp, Homo sapiens
aaggctatgtgatta

SEQ ID NO: 4965578 - DNA, 20 bp, Homo sapiens
aaggctctatgagtctagat

SEQ ID NO: 4965579 - DNA, 21 bp, Homo sapiens
aaggctctgagagtctagatt

SEQ ID NO: 4965580 - DNA, 13 bp, Homo sapiens
aaggcttgaagct

SEQ ID NO: 4965581 - DNA, 16 bp, Homo sapiens
aaggcttgaagctgtg

SEQ ID NO: 4965582 - DNA, 13 bp, Homo sapiens
aagggaaatatca

SEQ ID NO: 4965583 - DNA, 14 bp, Homo sapiens
aagggaagacattt

SEQ ID NO: 4965584 - DNA, 16 bp, Homo sapiens
aagggaagacatttct

SEQ ID NO: 4965585 - DNA, 20 bp, Homo sapiens
aagggacttggaagctccgc

SEQ ID NO: 4965586 - DNA, 14 bp, Homo sapiens
aagggcaaatctgc

SEQ ID NO: 4965587 - DNA, 22 bp, Homo sapiens
aagggcaggaaggagagcctgc

SEQ ID NO: 4965588 - DNA, 17 bp, Homo sapiens
aagggctgacctgcctc

SEQ ID NO: 4965589 - DNA, 18 bp, Homo sapiens
aaggggatcataaagtta

SEQ ID NO: 4965590 - DNA, 20 bp, Homo sapiens
aaggggcggtgcccacaccg

SEQ ID NO: 4965591 - DNA, 15 bp, Homo sapiens
aagggggaggggaag

SEQ ID NO: 4965592 - DNA, 19 bp, Homo sapiens
aagggggggctacattata

SEQ ID NO: 4965593 - DNA, 20 bp, Homo sapiens
aagggggggctacattataa

SEQ ID NO: 4965594 - DNA, 15 bp, Homo sapiens
aaggggttggggtga

SEQ ID NO: 4965595 - DNA, 17 bp, Homo sapiens
aagggtatcaggtgctg

SEQ ID NO: 4965596 - DNA, 22 bp, Homo sapiens
aagggtcgaaagctctagaatc

SEQ ID NO: 4965597 - DNA, 16 bp, Homo sapiens
aagggtgggtgctcag

SEQ ID NO: 4965598 - DNA, 17 bp, Homo sapiens
aagggtttgtggctggg

SEQ ID NO: 4965599 - DNA, 17 bp, Homo sapiens
aaggtcatttcttcagt

SEQ ID NO: 4965600 - DNA, 14 bp, Homo sapiens
aaggtctgagccac

SEQ ID NO: 4965601 - DNA, 19 bp, Homo sapiens
aaggtctttggttcagcta

SEQ ID NO: 4965602 - DNA, 13 bp, Homo sapiens
aaggtgccacttt

SEQ ID NO: 4965603 - DNA, 19 bp, Homo sapiens
aaggtggaccttttaaagt

SEQ ID NO: 4965604 - DNA, 14 bp, Homo sapiens
aaggtggattttgt

SEQ ID NO: 4965605 - DNA, 12 bp, Homo sapiens
aaggtgtattta

SEQ ID NO: 4965606 - DNA, 19 bp, Homo sapiens
aaggttccaactgtatata

SEQ ID NO: 4965607 - DNA, 21 bp, Homo sapiens
aaggttccaactgtatatatt

SEQ ID NO: 4965608 - DNA, 11 bp, Homo sapiens
aaggttctaag

SEQ ID NO: 4965609 - DNA, 12 bp, Homo sapiens
aaggttctaggt

SEQ ID NO: 4965610 - DNA, 17 bp, Homo sapiens
aaggttcttcatccctt

SEQ ID NO: 4965611 - DNA, 20 bp, Homo sapiens
aaggtttaaagagtctagat

SEQ ID NO: 4965612 - DNA, 21 bp, Homo sapiens
aaggtttaaagagtctagatt

SEQ ID NO: 4965613 - DNA, 22 bp, Homo sapiens
aaggtttcgtttctgtatacaa

SEQ ID NO: 4965614 - DNA, 15 bp, Homo sapiens
aaggttttaggttct

SEQ ID NO: 4965615 - DNA, 22 bp, Homo sapiens
aaggttttggatcttgaatgtg

SEQ ID NO: 4965616 - DNA, 21 bp, Homo sapiens
aagtaaagccattaaatgaat

SEQ ID NO: 4965617 - DNA, 12 bp, Homo sapiens
aagtaaatgcta

SEQ ID NO: 4965618 - DNA, 16 bp, Homo sapiens
aagtaatataatggaa

SEQ ID NO: 4965619 - DNA, 18 bp, Homo sapiens
aagtacaatgtgtttttc

SEQ ID NO: 4965620 - DNA, 17 bp, Homo sapiens
aagtacacaataagcaa

SEQ ID NO: 4965621 - DNA, 18 bp, Homo sapiens
aagtacacaataagcaaa

SEQ ID NO: 4965622 - DNA, 11 bp, Homo sapiens
aagtactgtaa

SEQ ID NO: 4965623 - DNA, 19 bp, Homo sapiens
aagtactgtttaccatttt

SEQ ID NO: 4965624 - DNA, 20 bp, Homo sapiens
aagtactgtttaccattttt

SEQ ID NO: 4965625 - DNA, 20 bp, Homo sapiens
aagtacttctccaccctgct

SEQ ID NO: 4965626 - DNA, 14 bp, Homo sapiens
aagtacttgagtgt

SEQ ID NO: 4965627 - DNA, 17 bp, Homo sapiens
aagtagtccttggcata

SEQ ID NO: 4965628 - DNA, 15 bp, Homo sapiens
aagtagtctgctcac

SEQ ID NO: 4965629 - DNA, 20 bp, Homo sapiens
aagtagtttgtataacttct

SEQ ID NO: 4965630 - DNA, 12 bp, Homo sapiens
aagtatagagag

SEQ ID NO: 4965631 - DNA, 14 bp, Homo sapiens
aagtatagagagaa

SEQ ID NO: 4965632 - DNA, 21 bp, Homo sapiens
aagtatgtaaacaggagacag

SEQ ID NO: 4965633 - DNA, 18 bp, Homo sapiens
aagtatgtgtaaaatgtg

SEQ ID NO: 4965634 - DNA, 17 bp, Homo sapiens
aagtattaaaacattgg

SEQ ID NO: 4965635 - DNA, 11 bp, Homo sapiens
aagtatttagg

SEQ ID NO: 4965636 - DNA, 11 bp, Homo sapiens
aagtattttga

SEQ ID NO: 4965637 - DNA, 22 bp, Homo sapiens
aagtattttgaagtttacattt

SEQ ID NO: 4965638 - DNA, 18 bp, Homo sapiens
aagtattttgtgtttgga

SEQ ID NO: 4965639 - DNA, 19 bp, Homo sapiens
aagtatttttataaatata

SEQ ID NO: 4965640 - DNA, 16 bp, Homo sapiens
aagtcaatcatttctc

SEQ ID NO: 4965641 - DNA, 18 bp, Homo sapiens
aagtcaatcatttctcac

SEQ ID NO: 4965642 - DNA, 24 bp, Homo sapiens
aagtcacacagtattacttctgct

SEQ ID NO: 4965643 - DNA, 19 bp, Homo sapiens
aagtcacatcacaggacac

SEQ ID NO: 4965644 - DNA, 19 bp, Homo sapiens
aagtcaccactccattccc

SEQ ID NO: 4965645 - DNA, 16 bp, Homo sapiens
aagtcagtgttgagat

SEQ ID NO: 4965646 - DNA, 23 bp, Homo sapiens
aagtcatgaagcccaagtgaaat

SEQ ID NO: 4965647 - DNA, 15 bp, Homo sapiens
aagtccaataagaca

SEQ ID NO: 4965648 - DNA, 18 bp, Homo sapiens
aagtccgcagaagccctg

SEQ ID NO: 4965649 - DNA, 13 bp, Homo sapiens
aagtcctttatgt

SEQ ID NO: 4965650 - DNA, 16 bp, Homo sapiens
aagtctctgctggccc

SEQ ID NO: 4965651 - DNA, 21 bp, Homo sapiens
aagtctctgctggcccagcca

SEQ ID NO: 4965652 - DNA, 11 bp, Homo sapiens
aagtctctgtg

SEQ ID NO: 4965653 - DNA, 9 bp, Homo sapiens
aagtcttgt

SEQ ID NO: 4965654 - DNA, 11 bp, Homo sapiens
aagtcttgtat

SEQ ID NO: 4965655 - DNA, 18 bp, Homo sapiens
aagtcttttgttcgcatg

SEQ ID NO: 4965656 - DNA, 14 bp, Homo sapiens
aagtgaataaactt

SEQ ID NO: 4965657 - DNA, 17 bp, Homo sapiens
aagtgaataaacttcag

SEQ ID NO: 4965658 - DNA, 20 bp, Homo sapiens
aagtgaataaacttcagcac

SEQ ID NO: 4965659 - DNA, 18 bp, Homo sapiens
aagtgcacacagaaatat

SEQ ID NO: 4965660 - DNA, 20 bp, Homo sapiens
aagtgcacacagaaatatat

SEQ ID NO: 4965661 - DNA, 23 bp, Homo sapiens
aagtgcacacagaaatatatata

SEQ ID NO: 4965662 - DNA, 15 bp, Homo sapiens
aagtgcactttctaa

SEQ ID NO: 4965663 - DNA, 22 bp, Homo sapiens
aagtgcatttctgaatagaaat

SEQ ID NO: 4965664 - DNA, 17 bp, Homo sapiens
aagtgccaaatgctctc

SEQ ID NO: 4965665 - DNA, 20 bp, Homo sapiens
aagtgccactcattcctgta

SEQ ID NO: 4965666 - DNA, 18 bp, Homo sapiens
aagtgcgtgtgtagagtt

SEQ ID NO: 4965667 - DNA, 21 bp, Homo sapiens
aagtgctaaggttctaaggcc

SEQ ID NO: 4965668 - DNA, 17 bp, Homo sapiens
aagtgctcatctgttgt

SEQ ID NO: 4965669 - DNA, 13 bp, Homo sapiens
aagtgctgagatt

SEQ ID NO: 4965670 - DNA, 14 bp, Homo sapiens
aagtgctgagatta

SEQ ID NO: 4965671 - DNA, 23 bp, Homo sapiens
aagtgctggcaaccactaagaat

SEQ ID NO: 4965672 - DNA, 21 bp, Homo sapiens
aagaagctttaatatttaaat

SEQ ID NO: 4965673 - DNA, 18 bp, Homo sapiens
aagaaggtggacctttta

SEQ ID NO: 4965674 - DNA, 20 bp, Homo sapiens
aagaaggtggaccttttaaa

SEQ ID NO: 4965675 - DNA, 23 bp, Homo sapiens
aagaatacagttaggcaccagaa

SEQ ID NO: 4965676 - DNA, 16 bp, Homo sapiens
aagaatcagagtagaa

SEQ ID NO: 4965677 - DNA, 18 bp, Homo sapiens
aagaatccacatttctaa

SEQ ID NO: 4965678 - DNA, 19 bp, Homo sapiens
aagaatccacatttctaaa

SEQ ID NO: 4965679 - DNA, 15 bp, Homo sapiens
aagaatggagaggaa

SEQ ID NO: 4965680 - DNA, 14 bp, Homo sapiens
aagaatgttggttt

SEQ ID NO: 4965681 - DNA, 17 bp, Homo sapiens
aagaatgttggtttact

SEQ ID NO: 4965682 - DNA, 21 bp, Homo sapiens
aagaattgaccatctgctttt

SEQ ID NO: 4965683 - DNA, 22 bp, Homo sapiens
aagaatttcttggtaagaagcc

SEQ ID NO: 4965684 - DNA, 14 bp, Homo sapiens
aagacaagaaaatc

SEQ ID NO: 4965685 - DNA, 17 bp, Homo sapiens
aagacaatttgatacat

SEQ ID NO: 4965686 - DNA, 13 bp, Homo sapiens
aagacaccagagc

SEQ ID NO: 4965687 - DNA, 11 bp, Homo sapiens
aagacactgcc

SEQ ID NO: 4965688 - DNA, 16 bp, Homo sapiens
aagacactgcctgggc

SEQ ID NO: 4965689 - DNA, 16 bp, Homo sapiens
aagacagatgccccag

SEQ ID NO: 4965690 - DNA, 14 bp, Homo sapiens
aagacataacgttt

SEQ ID NO: 4965691 - DNA, 18 bp, Homo sapiens
aagacataacgtttttcc

SEQ ID NO: 4965692 - DNA, 19 bp, Homo sapiens
aagacataacgtttttcct

SEQ ID NO: 4965693 - DNA, 20 bp, Homo sapiens
aagacataacgtttttcctt

SEQ ID NO: 4965694 - DNA, 21 bp, Homo sapiens
aagacataacgtttttccttt

SEQ ID NO: 4965695 - DNA, 22 bp, Homo sapiens
aagacataacgtttttccttta

SEQ ID NO: 4965696 - DNA, 14 bp, Homo sapiens
aagacatgatttcc

SEQ ID NO: 4965697 - DNA, 15 bp, Homo sapiens
aagacatgatttcct

SEQ ID NO: 4965698 - DNA, 20 bp, Homo sapiens
aagacatgatttccttgaat

SEQ ID NO: 4965699 - DNA, 21 bp, Homo sapiens
aagacattcttccaaaaagat

SEQ ID NO: 4965700 - DNA, 15 bp, Homo sapiens
aagacatttcttttc

SEQ ID NO: 4965701 - DNA, 13 bp, Homo sapiens
aagaccctccccg

SEQ ID NO: 4965702 - DNA, 21 bp, Homo sapiens
aagacctactgttctaaagct

SEQ ID NO: 4965703 - DNA, 23 bp, Homo sapiens
aagacctaggctcatggacgaga

SEQ ID NO: 4965704 - DNA, 13 bp, Homo sapiens
aagacctctgtga

SEQ ID NO: 4965705 - DNA, 19 bp, Homo sapiens
aagacggttaaatactgtg

SEQ ID NO: 4965706 - DNA, 14 bp, Homo sapiens
aagactcaaatgtt

SEQ ID NO: 4965707 - DNA, 19 bp, Homo sapiens
aagactcaaatgttctaag

SEQ ID NO: 4965708 - DNA, 17 bp, Homo sapiens
aagactcattcttctgt

SEQ ID NO: 4965709 - DNA, 15 bp, Homo sapiens
aagacttactctaag

SEQ ID NO: 4965710 - DNA, 16 bp, Homo sapiens
aagacttactctaaga

SEQ ID NO: 4965711 - DNA, 17 bp, Homo sapiens
aagacttactctaagat

SEQ ID NO: 4965712 - DNA, 21 bp, Homo sapiens
aagacttcattgtccctcttc

SEQ ID NO: 4965713 - DNA, 16 bp, Homo sapiens
aagacttggcaacaga

SEQ ID NO: 4965714 - DNA, 12 bp, Homo sapiens
aagagaaacttt

SEQ ID NO: 4965715 - DNA, 17 bp, Homo sapiens
aagagaaaggcctgcac

SEQ ID NO: 4965716 - DNA, 14 bp, Homo sapiens
aagagaagaagaaa

SEQ ID NO: 4965717 - DNA, 15 bp, Homo sapiens
aagagaagctgctga

SEQ ID NO: 4965718 - DNA, 14 bp, Homo sapiens
aagagacagaatgt

SEQ ID NO: 4965719 - DNA, 14 bp, Homo sapiens
aagagagaaaataa

SEQ ID NO: 4965720 - DNA, 11 bp, Homo sapiens
aagagagaaat

SEQ ID NO: 4965721 - DNA, 19 bp, Homo sapiens
aagagaggagaggagagag

SEQ ID NO: 4965722 - DNA, 21 bp, Homo sapiens
aagagagggccatgcaattca

SEQ ID NO: 4965723 - DNA, 22 bp, Homo sapiens
aagagagtatttttatacaaac

SEQ ID NO: 4965724 - DNA, 21 bp, Homo sapiens
aagagatatgtagaaggcaca

SEQ ID NO: 4965725 - DNA, 13 bp, Homo sapiens
aagagcaaaaata

SEQ ID NO: 4965726 - DNA, 14 bp, Homo sapiens
aagagcaaaaatat

SEQ ID NO: 4965727 - DNA, 13 bp, Homo sapiens
aagagcagcctgt

SEQ ID NO: 4965728 - DNA, 14 bp, Homo sapiens
aagagcagcctgtg

SEQ ID NO: 4965729 - DNA, 18 bp, Homo sapiens
aagagcatgaaattttta

SEQ ID NO: 4965730 - DNA, 16 bp, Homo sapiens
aagagcttgctttgat

SEQ ID NO: 4965731 - DNA, 22 bp, Homo sapiens
aagaggaacagcactggggagt

SEQ ID NO: 4965732 - DNA, 20 bp, Homo sapiens
aagaggactcgcttgtaaat

SEQ ID NO: 4965733 - DNA, 18 bp, Homo sapiens
aagaggagcacttccaaa

SEQ ID NO: 4965734 - DNA, 21 bp, Homo sapiens
aagaggagcacttccaaaatt

SEQ ID NO: 4965735 - DNA, 14 bp, Homo sapiens
aagaggcagggtct

SEQ ID NO: 4965736 - DNA, 17 bp, Homo sapiens
aagaggctgcccctctc

SEQ ID NO: 4965737 - DNA, 22 bp, Homo sapiens
aagagggaatccccgaaggtgc

SEQ ID NO: 4965738 - DNA, 16 bp, Homo sapiens
aagaggtacagggttt

SEQ ID NO: 4965739 - DNA, 20 bp, Homo sapiens
aagaggtacagggtttttac

SEQ ID NO: 4965740 - DNA, 21 bp, Homo sapiens
aagaggtatttatctttactt

SEQ ID NO: 4965741 - DNA, 14 bp, Homo sapiens
aagagtctaaagat

SEQ ID NO: 4965742 - DNA, 15 bp, Homo sapiens
aagagtgtagaagca

SEQ ID NO: 4965743 - DNA, 18 bp, Homo sapiens
aagagtgtagaagcattc

SEQ ID NO: 4965744 - DNA, 13 bp, Homo sapiens
aagagtgtgtgtg

SEQ ID NO: 4965745 - DNA, 17 bp, Homo sapiens
aagataattgctattta

SEQ ID NO: 4965746 - DNA, 21 bp, Homo sapiens
aagataattgctatttatttt

SEQ ID NO: 4965747 - DNA, 18 bp, Homo sapiens
aagatacaaattaatttt

SEQ ID NO: 4965748 - DNA, 20 bp, Homo sapiens
aagatacaaattaattttac

SEQ ID NO: 4965749 - DNA, 14 bp, Homo sapiens
aagatatacatgaa

SEQ ID NO: 4965750 - DNA, 17 bp, Homo sapiens
aagatatggagaattgc

SEQ ID NO: 4965751 - DNA, 13 bp, Homo sapiens
aagatattgtaca

SEQ ID NO: 4965752 - DNA, 15 bp, Homo sapiens
aagatattgtacata

SEQ ID NO: 4965753 - DNA, 16 bp, Homo sapiens
aagatattgtacataa

SEQ ID NO: 4965754 - DNA, 17 bp, Homo sapiens
aagatattgtacataaa

SEQ ID NO: 4965755 - DNA, 22 bp, Homo sapiens
aagatcaaaagcttattcatct

SEQ ID NO: 4965756 - DNA, 21 bp, Homo sapiens
aagatcaaaataaaaagtgac

SEQ ID NO: 4965757 - DNA, 14 bp, Homo sapiens
aagatccaagaagg

SEQ ID NO: 4965758 - DNA, 21 bp, Homo sapiens
aagatcctgtctttaaggaaa

SEQ ID NO: 4965759 - DNA, 16 bp, Homo sapiens
aagatcttagattctc

SEQ ID NO: 4965760 - DNA, 14 bp, Homo sapiens
aagatgaactctga

SEQ ID NO: 4965761 - DNA, 19 bp, Homo sapiens
aagatgaatacattttgtt

SEQ ID NO: 4965762 - DNA, 21 bp, Homo sapiens
aagatgagattggcatggctt

SEQ ID NO: 4965763 - DNA, 22 bp, Homo sapiens
aagatgagattggcatggcttt

SEQ ID NO: 4965764 - DNA, 15 bp, Homo sapiens
aagatgcaaggacca

SEQ ID NO: 4965765 - DNA, 16 bp, Homo sapiens
aagatgccatctgtgt

SEQ ID NO: 4965766 - DNA, 20 bp, Homo sapiens
aagatgtgatattctaagac

SEQ ID NO: 4965767 - DNA, 16 bp, Homo sapiens
aagatgttgattttta

SEQ ID NO: 4965768 - DNA, 21 bp, Homo sapiens
aagatgttgatttttactgtg

SEQ ID NO: 4965769 - DNA, 22 bp, Homo sapiens
aagatgttgatttttactgtgt

SEQ ID NO: 4965770 - DNA, 13 bp, Homo sapiens
aagattagaagct

SEQ ID NO: 4965771 - DNA, 21 bp, Homo sapiens
aagattagcaaggtcatttct

SEQ ID NO: 4965772 - DNA, 21 bp, Homo sapiens
aagattatagattctaaagat

SEQ ID NO: 4965773 - DNA, 12 bp, Homo sapiens
aagattctaaag

SEQ ID NO: 4965774 - DNA, 13 bp, Homo sapiens
aagattctaaagg

SEQ ID NO: 4965775 - DNA, 11 bp, Homo sapiens
aagattctaga

SEQ ID NO: 4965776 - DNA, 13 bp, Homo sapiens
aagattctagatc

SEQ ID NO: 4965777 - DNA, 12 bp, Homo sapiens
aagatttaagca

SEQ ID NO: 4965778 - DNA, 13 bp, Homo sapiens
aagcaaaaaatga

SEQ ID NO: 4965779 - DNA, 13 bp, Homo sapiens
aagcaaaagaaaa

SEQ ID NO: 4965780 - DNA, 14 bp, Homo sapiens
aagcaaaagaaaaa

SEQ ID NO: 4965781 - DNA, 18 bp, Homo sapiens
aagcaaaataaaaactat

SEQ ID NO: 4965782 - DNA, 14 bp, Homo sapiens
aagcaaaatattat

SEQ ID NO: 4965783 - DNA, 12 bp, Homo sapiens
aagcaaatactt

SEQ ID NO: 4965784 - DNA, 15 bp, Homo sapiens
aacattttgttctta

SEQ ID NO: 4965785 - DNA, 20 bp, Homo sapiens
aacattttgttcttacacat

SEQ ID NO: 4965786 - DNA, 23 bp, Homo sapiens
aacattttgttcttacacataca

SEQ ID NO: 4965787 - DNA, 20 bp, Homo sapiens
aaccaaaatgacatcttttt

SEQ ID NO: 4965788 - DNA, 16 bp, Homo sapiens
aaccaaaggacattat

SEQ ID NO: 4965789 - DNA, 18 bp, Homo sapiens
aaccaaaggacattatgt

SEQ ID NO: 4965790 - DNA, 21 bp, Homo sapiens
aaccaagatctataaagcgat

SEQ ID NO: 4965791 - DNA, 19 bp, Homo sapiens
aaccaagcaggagacgaca

SEQ ID NO: 4965792 - DNA, 20 bp, Homo sapiens
aaccaagtcatgtgcatttc

SEQ ID NO: 4965793 - DNA, 14 bp, Homo sapiens
aaccacaactgaca

SEQ ID NO: 4965794 - DNA, 16 bp, Homo sapiens
aaccacaactgacaca

SEQ ID NO: 4965795 - DNA, 15 bp, Homo sapiens
aaccacacaaagaca

SEQ ID NO: 4965796 - DNA, 15 bp, Homo sapiens
aaccacacacctcac

SEQ ID NO: 4965797 - DNA, 13 bp, Homo sapiens
aaccacatcttgc

SEQ ID NO: 4965798 - DNA, 18 bp, Homo sapiens
aaccactcccagtcccca

SEQ ID NO: 4965799 - DNA, 13 bp, Homo sapiens
aaccacttcattc

SEQ ID NO: 4965800 - DNA, 22 bp, Homo sapiens
aaccagctgtaacacagctgag

SEQ ID NO: 4965801 - DNA, 18 bp, Homo sapiens
aaccagggaagctgtccc

SEQ ID NO: 4965802 - DNA, 16 bp, Homo sapiens
aaccagtgccaaggac

SEQ ID NO: 4965803 - DNA, 22 bp, Homo sapiens
aaccagtttagatttcaagaaa

SEQ ID NO: 4965804 - DNA, 21 bp, Homo sapiens
aaccatccacttacatatatt

SEQ ID NO: 4965805 - DNA, 20 bp, Homo sapiens
aaccatccagtgacaaacca

SEQ ID NO: 4965806 - DNA, 16 bp, Homo sapiens
aaccatctggcctggc

SEQ ID NO: 4965807 - DNA, 17 bp, Homo sapiens
aaccatctggcctggcc

SEQ ID NO: 4965808 - DNA, 13 bp, Homo sapiens
aaccatggacttt

SEQ ID NO: 4965809 - DNA, 16 bp, Homo sapiens
aaccatggactttata

SEQ ID NO: 4965810 - DNA, 14 bp, Homo sapiens
aacccaagctcctc

SEQ ID NO: 4965811 - DNA, 15 bp, Homo sapiens
aacccaagcttagaa

SEQ ID NO: 4965812 - DNA, 16 bp, Homo sapiens
aacccaagcttagaac

SEQ ID NO: 4965813 - DNA, 16 bp, Homo sapiens
aacccaaggagcacag

SEQ ID NO: 4965814 - DNA, 22 bp, Homo sapiens
aacccaaggagcacaggtccca

SEQ ID NO: 4965815 - DNA, 20 bp, Homo sapiens
aacccagggctctgccccag

SEQ ID NO: 4965816 - DNA, 19 bp, Homo sapiens
aaccccaacgcacaggaaa

SEQ ID NO: 4965817 - DNA, 18 bp, Homo sapiens
aaccccatgtcctcagca

SEQ ID NO: 4965818 - DNA, 12 bp, Homo sapiens
aacccccacccc

SEQ ID NO: 4965819 - DNA, 17 bp, Homo sapiens
aacccccaccccacact

SEQ ID NO: 4965820 - DNA, 22 bp, Homo sapiens
aaccccgtcgaggggctctcag

SEQ ID NO: 4965821 - DNA, 21 bp, Homo sapiens
aacccctacatgaaacagaaa

SEQ ID NO: 4965822 - DNA, 17 bp, Homo sapiens
aaccctacacccagacc

SEQ ID NO: 4965823 - DNA, 22 bp, Homo sapiens
aaccctatctcctgacagaagg

SEQ ID NO: 4965824 - DNA, 23 bp, Homo sapiens
aaccctatctcctgacagaaggt

SEQ ID NO: 4965825 - DNA, 22 bp, Homo sapiens
aaccctcaggggaaaactgtta

SEQ ID NO: 4965826 - DNA, 21 bp, Homo sapiens
aacccttaccccttagcctcc

SEQ ID NO: 4965827 - DNA, 20 bp, Homo sapiens
aacccttcctgagctttatg

SEQ ID NO: 4965828 - DNA, 17 bp, Homo sapiens
aaccgacaggccctggc

SEQ ID NO: 4965829 - DNA, 22 bp, Homo sapiens
aaccgagcaaagatcaaaataa

SEQ ID NO: 4965830 - DNA, 12 bp, Homo sapiens
aaccgcacagct

SEQ ID NO: 4965831 - DNA, 16 bp, Homo sapiens
aaccgcctcaaaatgt

SEQ ID NO: 4965832 - DNA, 17 bp, Homo sapiens
aaccgttttgaagctac

SEQ ID NO: 4965833 - DNA, 17 bp, Homo sapiens
aacctagtactgccccc

SEQ ID NO: 4965834 - DNA, 17 bp, Homo sapiens
aacctcaaaatgtctaa

SEQ ID NO: 4965835 - DNA, 21 bp, Homo sapiens
aacctcattgacaagaactga

SEQ ID NO: 4965836 - DNA, 22 bp, Homo sapiens
aacctccattctattttagaat

SEQ ID NO: 4965837 - DNA, 15 bp, Homo sapiens
aacctcccaacccag

SEQ ID NO: 4965838 - DNA, 11 bp, Homo sapiens
aacctcccaga

SEQ ID NO: 4965839 - DNA, 12 bp, Homo sapiens
aacctcccagag

SEQ ID NO: 4965840 - DNA, 13 bp, Homo sapiens
aacctccctcttg

SEQ ID NO: 4965841 - DNA, 20 bp, Homo sapiens
aacctccgccaatgcacggc

SEQ ID NO: 4965842 - DNA, 15 bp, Homo sapiens
aacctcctgtggaac

SEQ ID NO: 4965843 - DNA, 18 bp, Homo sapiens
aacctgattgtaaacttc

SEQ ID NO: 4965844 - DNA, 15 bp, Homo sapiens
aacctgcatctttag

SEQ ID NO: 4965845 - DNA, 23 bp, Homo sapiens
aacctggtcacaggactctgcct

SEQ ID NO: 4965846 - DNA, 18 bp, Homo sapiens
aacctgtctccactgtgc

SEQ ID NO: 4965847 - DNA, 24 bp, Homo sapiens
aacctgtctccactgtgcctttgc

SEQ ID NO: 4965848 - DNA, 18 bp, Homo sapiens
aaccttatcctgcattgt

SEQ ID NO: 4965849 - DNA, 14 bp, Homo sapiens
aaccttgaatgctg

SEQ ID NO: 4965850 - DNA, 19 bp, Homo sapiens
aaccttgaatgctgccagt

SEQ ID NO: 4965851 - DNA, 20 bp, Homo sapiens
aaccttgaatgctgccagtg

SEQ ID NO: 4965852 - DNA, 13 bp, Homo sapiens
aaccttgctgtcc

SEQ ID NO: 4965853 - DNA, 19 bp, Homo sapiens
aaccttgtctctatgccag

SEQ ID NO: 4965854 - DNA, 23 bp, Homo sapiens
aaccttgtctctatgccagctca

SEQ ID NO: 4965855 - DNA, 20 bp, Homo sapiens
aacctttcacctttgtgtat

SEQ ID NO: 4965856 - DNA, 18 bp, Homo sapiens
aaccttttttaagatttt

SEQ ID NO: 4965857 - DNA, 22 bp, Homo sapiens
aaccttttttaagatttttctc

SEQ ID NO: 4965858 - DNA, 23 bp, Homo sapiens
aaccttttttaagatttttctca

SEQ ID NO: 4965859 - DNA, 12 bp, Homo sapiens
aacgcacaggaa

SEQ ID NO: 4965860 - DNA, 18 bp, Homo sapiens
aacgcagatgatccatga

SEQ ID NO: 4965861 - DNA, 16 bp, Homo sapiens
aacgcagccctgcttt

SEQ ID NO: 4965862 - DNA, 16 bp, Homo sapiens
aacgctgtcaaaagtt

SEQ ID NO: 4965863 - DNA, 20 bp, Homo sapiens
aacggagccccaggcctctg

SEQ ID NO: 4965864 - DNA, 16 bp, Homo sapiens
aacgtgatacatttgg

SEQ ID NO: 4965865 - DNA, 17 bp, Homo sapiens
aacgttactcagggctc

SEQ ID NO: 4965866 - DNA, 14 bp, Homo sapiens
aactaaatgttcta

SEQ ID NO: 4965867 - DNA, 18 bp, Homo sapiens
aactaaatgttctatggt

SEQ ID NO: 4965868 - DNA, 19 bp, Homo sapiens
aactaaatttgatacttat

SEQ ID NO: 4965869 - DNA, 20 bp, Homo sapiens
aactaaatttgatacttata

SEQ ID NO: 4965870 - DNA, 23 bp, Homo sapiens
aactaagcagtccctgagaccat

SEQ ID NO: 4965871 - DNA, 22 bp, Homo sapiens
aactacatgagaacaaacagat

SEQ ID NO: 4965872 - DNA, 17 bp, Homo sapiens
aactacccttaattact

SEQ ID NO: 4965873 - DNA, 18 bp, Homo sapiens
aactacccttaattactt

SEQ ID NO: 4965874 - DNA, 16 bp, Homo sapiens
aactactctttgattt

SEQ ID NO: 4965875 - DNA, 17 bp, Homo sapiens
aactagacaccaaagtt

SEQ ID NO: 4965876 - DNA, 20 bp, Homo sapiens
aactagacaccaaagttcta

SEQ ID NO: 4965877 - DNA, 16 bp, Homo sapiens
aactataaatatgtac

SEQ ID NO: 4965878 - DNA, 18 bp, Homo sapiens
aactatacttgaacaaaa

SEQ ID NO: 4965879 - DNA, 20 bp, Homo sapiens
aactatattcatttccactc

SEQ ID NO: 4965880 - DNA, 15 bp, Homo sapiens
aactattgcatttat

SEQ ID NO: 4965881 - DNA, 16 bp, Homo sapiens
aactattgcatttata

SEQ ID NO: 4965882 - DNA, 15 bp, Homo sapiens
aactcaaaatatttg

SEQ ID NO: 4965883 - DNA, 20 bp, Homo sapiens
aactcaccagccccactgcc

SEQ ID NO: 4965884 - DNA, 22 bp, Homo sapiens
aactcactcagtttatgctgtg

SEQ ID NO: 4965885 - DNA, 16 bp, Homo sapiens
aactcagggacagagc

SEQ ID NO: 4965886 - DNA, 15 bp, Homo sapiens
aactccaccttccca

SEQ ID NO: 4965887 - DNA, 16 bp, Homo sapiens
aactcctgacagtctt

SEQ ID NO: 4965888 - DNA, 23 bp, Homo sapiens
aactcctgacgtctgaagcttga

SEQ ID NO: 4965889 - DNA, 19 bp, Homo sapiens
aactctatctgggcctggg

SEQ ID NO: 4965890 - DNA, 14 bp, Homo sapiens
aactctgaactttg

SEQ ID NO: 4965891 - DNA, 21 bp, Homo sapiens
aactctgacaagggctgacct

SEQ ID NO: 4965892 - DNA, 16 bp, Homo sapiens
aactgaatttgtactt

SEQ ID NO: 4965893 - DNA, 15 bp, Homo sapiens
aactgactatcataa

SEQ ID NO: 4965894 - DNA, 22 bp, Homo sapiens
aactgactatcataaaatcaaa

SEQ ID NO: 4965895 - DNA, 17 bp, Homo sapiens
aactgcaataacttctg

SEQ ID NO: 4965896 - DNA, 21 bp, Homo sapiens
aactgcaataacttctgacct

SEQ ID NO: 4965897 - DNA, 22 bp, Homo sapiens
aactgcattgactttcagtaaa

SEQ ID NO: 4965898 - DNA, 18 bp, Homo sapiens
aactgccattattttctg

SEQ ID NO: 4965899 - DNA, 22 bp, Homo sapiens
aactgccattattttctgtcag

SEQ ID NO: 4965900 - DNA, 20 bp, Homo sapiens
aactgcctcgaaacacagaa

SEQ ID NO: 4965901 - DNA, 20 bp, Homo sapiens
aactgctggacgtctttctt

SEQ ID NO: 4965902 - DNA, 20 bp, Homo sapiens
aactgcttttttttttccag

SEQ ID NO: 4965903 - DNA, 16 bp, Homo sapiens
aactggagtctggagt

SEQ ID NO: 4965904 - DNA, 16 bp, Homo sapiens
aactgggtacttgtgg

SEQ ID NO: 4965905 - DNA, 21 bp, Homo sapiens
aactgggtacttgtggacaca

SEQ ID NO: 4965906 - DNA, 13 bp, Homo sapiens
aactgtaaataaa

SEQ ID NO: 4965907 - DNA, 23 bp, Homo sapiens
aactgtacatttcacaggctaat

SEQ ID NO: 4965908 - DNA, 14 bp, Homo sapiens
aactgtatatattc

SEQ ID NO: 4965909 - DNA, 14 bp, Homo sapiens
aactgtatgtcaga

SEQ ID NO: 4965910 - DNA, 16 bp, Homo sapiens
aactgtccagagagca

SEQ ID NO: 4965911 - DNA, 17 bp, Homo sapiens
aactgtgaagtttacat

SEQ ID NO: 4965912 - DNA, 22 bp, Homo sapiens
aactgtggatacccttaccctt

SEQ ID NO: 4965913 - DNA, 12 bp, Homo sapiens
aactgtgttgta

SEQ ID NO: 4965914 - DNA, 15 bp, Homo sapiens
aactgttacctaaag

SEQ ID NO: 4965915 - DNA, 20 bp, Homo sapiens
aactgttacctaaagtattt

SEQ ID NO: 4965916 - DNA, 16 bp, Homo sapiens
aactgttatgaaataa

SEQ ID NO: 4965917 - DNA, 21 bp, Homo sapiens
aactgttttgggtagctgcca

SEQ ID NO: 4965918 - DNA, 21 bp, Homo sapiens
aacttaaaaatgtaaatattc

SEQ ID NO: 4965919 - DNA, 11 bp, Homo sapiens
aacttaaaata

SEQ ID NO: 4965920 - DNA, 23 bp, Homo sapiens
aacttactattcattaaatgttt

SEQ ID NO: 4965921 - DNA, 20 bp, Homo sapiens
aacttagtgacaaaatagac

SEQ ID NO: 4965922 - DNA, 20 bp, Homo sapiens
aacttatatactatttccct

SEQ ID NO: 4965923 - DNA, 12 bp, Homo sapiens
aacttatattga

SEQ ID NO: 4965924 - DNA, 13 bp, Homo sapiens
aacttatattgaa

SEQ ID NO: 4965925 - DNA, 19 bp, Homo sapiens
aacttatattgaagacaat

SEQ ID NO: 4965926 - DNA, 18 bp, Homo sapiens
aacttatgtagatatttg

SEQ ID NO: 4965927 - DNA, 19 bp, Homo sapiens
aacttatgtagatatttgg

SEQ ID NO: 4965928 - DNA, 22 bp, Homo sapiens
aacttatgtagatatttggctt

SEQ ID NO: 4965929 - DNA, 12 bp, Homo sapiens
aacttatgtttt

SEQ ID NO: 4965930 - DNA, 13 bp, Homo sapiens
aacttattctgta

SEQ ID NO: 4965931 - DNA, 14 bp, Homo sapiens
aacttattctgtag

SEQ ID NO: 4965932 - DNA, 23 bp, Homo sapiens
aacttattctgtagattctgtgg

SEQ ID NO: 4965933 - DNA, 17 bp, Homo sapiens
aacttattttatttcca

SEQ ID NO: 4965934 - DNA, 17 bp, Homo sapiens
aacttcacattaaaaaa

SEQ ID NO: 4965935 - DNA, 13 bp, Homo sapiens
aacttcactctgg

SEQ ID NO: 4965936 - DNA, 14 bp, Homo sapiens
aacttctctcagac

SEQ ID NO: 4965937 - DNA, 15 bp, Homo sapiens
aacttcttatggaat

SEQ ID NO: 4965938 - DNA, 21 bp, Homo sapiens
aacttcttctccatccctcta

SEQ ID NO: 4965939 - DNA, 14 bp, Homo sapiens
aacttcttgtcaga

SEQ ID NO: 4965940 - DNA, 17 bp, Homo sapiens
aacttcttgtcagacat

SEQ ID NO: 4965941 - DNA, 20 bp, Homo sapiens
aacttgagatgtatgaaggc

SEQ ID NO: 4965942 - DNA, 22 bp, Homo sapiens
aacttgagcgtgaatctgtatc

SEQ ID NO: 4965943 - DNA, 20 bp, Homo sapiens
aacttgagggcccagagcag

SEQ ID NO: 4965944 - DNA, 17 bp, Homo sapiens
aacttggtatttttcag

SEQ ID NO: 4965945 - DNA, 14 bp, Homo sapiens
aacttgtagctgta

SEQ ID NO: 4965946 - DNA, 14 bp, Homo sapiens
aacttgtcttttca

SEQ ID NO: 4965947 - DNA, 13 bp, Homo sapiens
aacttgtgaatgc

SEQ ID NO: 4965948 - DNA, 17 bp, Homo sapiens
aacttgtgaatgcttct

SEQ ID NO: 4965949 - DNA, 20 bp, Homo sapiens
aacttgttattgtgaatgat

SEQ ID NO: 4965950 - DNA, 16 bp, Homo sapiens
aacttgtttgctgtga

SEQ ID NO: 4965951 - DNA, 12 bp, Homo sapiens
aactttaatcaa

SEQ ID NO: 4965952 - DNA, 21 bp, Homo sapiens
aactttaattctctttcaaag

SEQ ID NO: 4965953 - DNA, 18 bp, Homo sapiens
aactttatacattagtaa

SEQ ID NO: 4965954 - DNA, 17 bp, Homo sapiens
aactttatgtgtaaata

SEQ ID NO: 4965955 - DNA, 22 bp, Homo sapiens
aactttggagagtgagctacag

SEQ ID NO: 4965956 - DNA, 20 bp, Homo sapiens
aacttttcaaggcttatatt

SEQ ID NO: 4965957 - DNA, 21 bp, Homo sapiens
aacttttttaaataaactttt

SEQ ID NO: 4965958 - DNA, 14 bp, Homo sapiens
aactttttttcaat

SEQ ID NO: 4965959 - DNA, 15 bp, Homo sapiens
aactttttttcaatg

SEQ ID NO: 4965960 - DNA, 16 bp, Homo sapiens
aactttttttcaatgt

SEQ ID NO: 4965961 - DNA, 17 bp, Homo sapiens
aactttttttcaatgtg

SEQ ID NO: 4965962 - DNA, 15 bp, Homo sapiens
aagaaaaaaatcttc

SEQ ID NO: 4965963 - DNA, 22 bp, Homo sapiens
aagaaaagtattttgaagttta

SEQ ID NO: 4965964 - DNA, 23 bp, Homo sapiens
aagaaaagtattttgaagtttac

SEQ ID NO: 4965965 - DNA, 16 bp, Homo sapiens
aagaaactgaggaatt

SEQ ID NO: 4965966 - DNA, 12 bp, Homo sapiens
aagaaacttttg

SEQ ID NO: 4965967 - DNA, 16 bp, Homo sapiens
aagaaacttttgtaaa

SEQ ID NO: 4965968 - DNA, 18 bp, Homo sapiens
aagaaacttttgtaaaga

SEQ ID NO: 4965969 - DNA, 17 bp, Homo sapiens
aagaaagtgggaggtca

SEQ ID NO: 4965970 - DNA, 23 bp, Homo sapiens
aagaaagtgggaggtcaggaaac

SEQ ID NO: 4965971 - DNA, 11 bp, Homo sapiens
aagaaatatgt

SEQ ID NO: 4965972 - DNA, 13 bp, Homo sapiens
aagaaatatgtga

SEQ ID NO: 4965973 - DNA, 15 bp, Homo sapiens
aagaaatatgtgaga

SEQ ID NO: 4965974 - DNA, 14 bp, Homo sapiens
aagaaatgaacatt

SEQ ID NO: 4965975 - DNA, 13 bp, Homo sapiens
aagaaatgtctta

SEQ ID NO: 4965976 - DNA, 14 bp, Homo sapiens
aagaacaagaattt

SEQ ID NO: 4965977 - DNA, 13 bp, Homo sapiens
aagaacctggaaa

SEQ ID NO: 4965978 - DNA, 21 bp, Homo sapiens
aagaactgtttactgcttgat

SEQ ID NO: 4965979 - DNA, 20 bp, Homo sapiens
aagaacttactgattatttt

SEQ ID NO: 4965980 - DNA, 12 bp, Homo sapiens
aagaagaaaaaa

SEQ ID NO: 4965981 - DNA, 14 bp, Homo sapiens
aagaagaaaaaaac

SEQ ID NO: 4965982 - DNA, 14 bp, Homo sapiens
aagaagaaaaaggt

SEQ ID NO: 4965983 - DNA, 13 bp, Homo sapiens
aagaagaaaagag

SEQ ID NO: 4965984 - DNA, 15 bp, Homo sapiens
aagaagaaaagagaa

SEQ ID NO: 4965985 - DNA, 15 bp, Homo sapiens
aagaagaacttgcat

SEQ ID NO: 4965986 - DNA, 14 bp, Homo sapiens
aagaagagaagctg

SEQ ID NO: 4965987 - DNA, 16 bp, Homo sapiens
aagaagagaagctgct

SEQ ID NO: 4965988 - DNA, 17 bp, Homo sapiens
aagaagagaagctgctg

SEQ ID NO: 4965989 - DNA, 18 bp, Homo sapiens
aagaagagaagctgctga

SEQ ID NO: 4965990 - DNA, 12 bp, Homo sapiens
aagaagcagaga

SEQ ID NO: 4965991 - DNA, 17 bp, Homo sapiens
aagaagccgggaacaga

SEQ ID NO: 4965992 - DNA, 16 bp, Homo sapiens
aagaagctgttgtaca

SEQ ID NO: 4965993 - DNA, 17 bp, Homo sapiens
aagaagctgttgtacat

SEQ ID NO: 4965994 - DNA, 23 bp, Homo sapiens
aagaagctgttgtacatttatga

SEQ ID NO: 4965995 - DNA, 22 bp, Homo sapiens
aagaagcttctaataaattata

SEQ ID NO: 4965996 - DNA, 15 bp, Homo sapiens
ttctaaggcctagga

SEQ ID NO: 4965997 - DNA, 17 bp, Homo sapiens
ttctaaggcctaggatt

SEQ ID NO: 4965998 - DNA, 18 bp, Homo sapiens
ttctaaggctctgagagt

SEQ ID NO: 4965999 - DNA, 12 bp, Homo sapiens
ttctaagtttct

SEQ ID NO: 4966000 - DNA, 13 bp, Homo sapiens
ttctaataaatta

SEQ ID NO: 4966001 - DNA, 18 bp, Homo sapiens
ttctaataaattatacaa

SEQ ID NO: 4966002 - DNA, 18 bp, Homo sapiens
ttctaataatttctaatg

SEQ ID NO: 4966003 - DNA, 22 bp, Homo sapiens
ttctaatatatttttatattta

SEQ ID NO: 4966004 - DNA, 16 bp, Homo sapiens
ttctaatggaatggtt

SEQ ID NO: 4966005 - DNA, 14 bp, Homo sapiens
ttctaatgtcttca

SEQ ID NO: 4966006 - DNA, 16 bp, Homo sapiens
ttctaatgtcttcatt

SEQ ID NO: 4966007 - DNA, 21 bp, Homo sapiens
ttctaatttcaaaaatataac

SEQ ID NO: 4966008 - DNA, 14 bp, Homo sapiens
ttctaccatttcag

SEQ ID NO: 4966009 - DNA, 18 bp, Homo sapiens
ttctacccaacggccctg

SEQ ID NO: 4966010 - DNA, 20 bp, Homo sapiens
ttctacccagcgagccctgg

SEQ ID NO: 4966011 - DNA, 20 bp, Homo sapiens
ttctacggatcatcaacaag

SEQ ID NO: 4966012 - DNA, 23 bp, Homo sapiens
ttctagacatggaggttctaagg

SEQ ID NO: 4966013 - DNA, 15 bp, Homo sapiens
ttctagactttctgt

SEQ ID NO: 4966014 - DNA, 16 bp, Homo sapiens
ttctagatcagatgct

SEQ ID NO: 4966015 - DNA, 22 bp, Homo sapiens
ttctagatcagatgctccaaga

SEQ ID NO: 4966016 - DNA, 23 bp, Homo sapiens
ttctagatcagatgctccaagat

SEQ ID NO: 4966017 - DNA, 24 bp, Homo sapiens
ttctagatcagatgctccaagatt

SEQ ID NO: 4966018 - DNA, 12 bp, Homo sapiens
ttctagatgatt

SEQ ID NO: 4966019 - DNA, 24 bp, Homo sapiens
ttctagcctgcactttgatgtcat

SEQ ID NO: 4966020 - DNA, 17 bp, Homo sapiens
ttctagctaatgtaata

SEQ ID NO: 4966021 - DNA, 16 bp, Homo sapiens
ttctaggcatctctgt

SEQ ID NO: 4966022 - DNA, 15 bp, Homo sapiens
ttctagtggtctttg

SEQ ID NO: 4966023 - DNA, 21 bp, Homo sapiens
ttctagtggtctttgtaagag

SEQ ID NO: 4966024 - DNA, 21 bp, Homo sapiens
ttctattaaagtgctaaggtt

SEQ ID NO: 4966025 - DNA, 17 bp, Homo sapiens
ttctattgccttctttg

SEQ ID NO: 4966026 - DNA, 18 bp, Homo sapiens
ttctattgccttctttga

SEQ ID NO: 4966027 - DNA, 20 bp, Homo sapiens
ttctattgccttctttgaag

SEQ ID NO: 4966028 - DNA, 13 bp, Homo sapiens
ttcagcaaaccat

SEQ ID NO: 4966029 - DNA, 13 bp, Homo sapiens
ttcagcacttgtc

SEQ ID NO: 4966030 - DNA, 15 bp, Homo sapiens
ttcagcacttgtctc

SEQ ID NO: 4966031 - DNA, 17 bp, Homo sapiens
ttcagctctctgtataa

SEQ ID NO: 4966032 - DNA, 18 bp, Homo sapiens
ttcagctctctgtataaa

SEQ ID NO: 4966033 - DNA, 18 bp, Homo sapiens
ttcagctgtcctccctcc

SEQ ID NO: 4966034 - DNA, 16 bp, Homo sapiens
ttcaggctcttctcct

SEQ ID NO: 4966035 - DNA, 22 bp, Homo sapiens
ttcaggcttcctgcaattttct

SEQ ID NO: 4966036 - DNA, 19 bp, Homo sapiens
ttcaggggactcagccctg

SEQ ID NO: 4966037 - DNA, 20 bp, Homo sapiens
ttcaggggactcagccctga

SEQ ID NO: 4966038 - DNA, 14 bp, Homo sapiens
ttcagggttggccc

SEQ ID NO: 4966039 - DNA, 17 bp, Homo sapiens
ttcagggttggcccctg

SEQ ID NO: 4966040 - DNA, 22 bp, Homo sapiens
ttcagggttggcccctgcccgg

SEQ ID NO: 4966041 - DNA, 16 bp, Homo sapiens
ttcaggtaacaggcag

SEQ ID NO: 4966042 - DNA, 15 bp, Homo sapiens
ttcaggtgaaaatgt

SEQ ID NO: 4966043 - DNA, 17 bp, Homo sapiens
ttcaggtgacatgtgaa

SEQ ID NO: 4966044 - DNA, 22 bp, Homo sapiens
ttcaggtgacatgtgaaacctt

SEQ ID NO: 4966045 - DNA, 20 bp, Homo sapiens
ttcagtattatgtagttgtt

SEQ ID NO: 4966046 - DNA, 17 bp, Homo sapiens
ttcagtattttggagaa

SEQ ID NO: 4966047 - DNA, 17 bp, Homo sapiens
ttcagtccaataggtgt

SEQ ID NO: 4966048 - DNA, 16 bp, Homo sapiens
ttcagtcctgtagttt

SEQ ID NO: 4966049 - DNA, 12 bp, Homo sapiens
ttcagtggagaa

SEQ ID NO: 4966050 - DNA, 15 bp, Homo sapiens
ttcagtggcagctgc

SEQ ID NO: 4966051 - DNA, 14 bp, Homo sapiens
ttcagtgtagttaa

SEQ ID NO: 4966052 - DNA, 16 bp, Homo sapiens
ttcagtgtagttaatt

SEQ ID NO: 4966053 - DNA, 18 bp, Homo sapiens
ttcagtgtagttaattta

SEQ ID NO: 4966054 - DNA, 18 bp, Homo sapiens
ttcatacactaaccaaat

SEQ ID NO: 4966055 - DNA, 20 bp, Homo sapiens
ttcatacactaaccaaatct

SEQ ID NO: 4966056 - DNA, 16 bp, Homo sapiens
ttcatacctaagtact

SEQ ID NO: 4966057 - DNA, 17 bp, Homo sapiens
ttcatagtaacttctta

SEQ ID NO: 4966058 - DNA, 12 bp, Homo sapiens
ttcatattgtgc

SEQ ID NO: 4966059 - DNA, 13 bp, Homo sapiens
ttcatcagcattt

SEQ ID NO: 4966060 - DNA, 15 bp, Homo sapiens
ttcatcattgtttct

SEQ ID NO: 4966061 - DNA, 22 bp, Homo sapiens
ttcatcattgtttctgcatgaa

SEQ ID NO: 4966062 - DNA, 23 bp, Homo sapiens
ttcatcattgtttctgcatgaat

SEQ ID NO: 4966063 - DNA, 16 bp, Homo sapiens
ttcatcctattgttga

SEQ ID NO: 4966064 - DNA, 23 bp, Homo sapiens
ttcatcgaatctactaattccac

SEQ ID NO: 4966065 - DNA, 17 bp, Homo sapiens
ttcatgatgcagtctcc

SEQ ID NO: 4966066 - DNA, 19 bp, Homo sapiens
ttcatgccaccatggccag

SEQ ID NO: 4966067 - DNA, 22 bp, Homo sapiens
ttcatgccagctacttcctcct

SEQ ID NO: 4966068 - DNA, 18 bp, Homo sapiens
ttcctagccctctcacat

SEQ ID NO: 4966069 - DNA, 16 bp, Homo sapiens
ttcctagcctgtttct

SEQ ID NO: 4966070 - DNA, 20 bp, Homo sapiens
ttcctatttgccatgggctt

SEQ ID NO: 4966071 - DNA, 22 bp, Homo sapiens
ttcctatttgccatgggcttca

SEQ ID NO: 4966072 - DNA, 23 bp, Homo sapiens
ttcctatttgccatgggcttcac

SEQ ID NO: 4966073 - DNA, 19 bp, Homo sapiens
ttcctatttgttttcatgg

SEQ ID NO: 4966074 - DNA, 21 bp, Homo sapiens
ttcctatttgttttcatggtg

SEQ ID NO: 4966075 - DNA, 13 bp, Homo sapiens
ttcctccatccta

SEQ ID NO: 4966076 - DNA, 22 bp, Homo sapiens
ttcctctatacatctctcccca

SEQ ID NO: 4966077 - DNA, 12 bp, Homo sapiens
ttcctctccact

SEQ ID NO: 4966078 - DNA, 14 bp, Homo sapiens
ttcctctccactgc

SEQ ID NO: 4966079 - DNA, 22 bp, Homo sapiens
ttcctctccttcgtatcccgag

SEQ ID NO: 4966080 - DNA, 11 bp, Homo sapiens
ttcctctctgg

SEQ ID NO: 4966081 - DNA, 21 bp, Homo sapiens
ttcctctgtattgtgctgatt

SEQ ID NO: 4966082 - DNA, 23 bp, Homo sapiens
ttcctgacgaaactggccccgga

SEQ ID NO: 4966083 - DNA, 17 bp, Homo sapiens
ttcctgagacaaatttt

SEQ ID NO: 4966084 - DNA, 21 bp, Homo sapiens
ttcctgagatttcctcctggc

SEQ ID NO: 4966085 - DNA, 14 bp, Homo sapiens
ttcctgagctttat

SEQ ID NO: 4966086 - DNA, 17 bp, Homo sapiens
ttcctgcaattttctaa

SEQ ID NO: 4966087 - DNA, 18 bp, Homo sapiens
ttcctgcatttgtgaaat

SEQ ID NO: 4966088 - DNA, 14 bp, Homo sapiens
ttcctgcccctctt

SEQ ID NO: 4966089 - DNA, 15 bp, Homo sapiens
ttcctgcccctcttt

SEQ ID NO: 4966090 - DNA, 17 bp, Homo sapiens
ttcctgcccctctttct

SEQ ID NO: 4966091 - DNA, 21 bp, Homo sapiens
ttcctgcccctctttctcttt

SEQ ID NO: 4966092 - DNA, 20 bp, Homo sapiens
ttcctgtctagtctctcctg

SEQ ID NO: 4966093 - DNA, 14 bp, Homo sapiens
ttcctgttaatgta

SEQ ID NO: 4966094 - DNA, 19 bp, Homo sapiens
ttccttaagtatatcatgt

SEQ ID NO: 4966095 - DNA, 15 bp, Homo sapiens
ttccttacccaaact

SEQ ID NO: 4966096 - DNA, 22 bp, Homo sapiens
ttccttcccgccagagggcttg

SEQ ID NO: 4966097 - DNA, 17 bp, Homo sapiens
ttccttctctgaacaca

SEQ ID NO: 4966098 - DNA, 19 bp, Homo sapiens
ttccttctttgataatgtt

SEQ ID NO: 4966099 - DNA, 22 bp, Homo sapiens
ttccttctttgataatgttaaa

SEQ ID NO: 4966100 - DNA, 22 bp, Homo sapiens
ttccttgagacacggagcccag

SEQ ID NO: 4966101 - DNA, 16 bp, Homo sapiens
ttccttgatcattttg

SEQ ID NO: 4966102 - DNA, 16 bp, Homo sapiens
ttcctttaaaaaaatt

SEQ ID NO: 4966103 - DNA, 15 bp, Homo sapiens
ttcctttactttccc

SEQ ID NO: 4966104 - DNA, 16 bp, Homo sapiens
ttcctttactttccct

SEQ ID NO: 4966105 - DNA, 17 bp, Homo sapiens
ttcctttactttccctt

SEQ ID NO: 4966106 - DNA, 17 bp, Homo sapiens
ttcctttcccttcctct

SEQ ID NO: 4966107 - DNA, 18 bp, Homo sapiens
ttcctttcccttcctctt

SEQ ID NO: 4966108 - DNA, 12 bp, Homo sapiens
ttcctttctcag

SEQ ID NO: 4966109 - DNA, 13 bp, Homo sapiens
ttcctttctcttt

SEQ ID NO: 4966110 - DNA, 17 bp, Homo sapiens
ttcctttgggcctctgc

SEQ ID NO: 4966111 - DNA, 21 bp, Homo sapiens
ttccttttaaaacacttccat

SEQ ID NO: 4966112 - DNA, 22 bp, Homo sapiens
ttccttttaaaacacttccata

SEQ ID NO: 4966113 - DNA, 13 bp, Homo sapiens
ttccttttcttta

SEQ ID NO: 4966114 - DNA, 22 bp, Homo sapiens
ttcctttttctgattagctttg

SEQ ID NO: 4966115 - DNA, 16 bp, Homo sapiens
ttccttttttcaaaat

SEQ ID NO: 4966116 - DNA, 22 bp, Homo sapiens
ttcgaaacctgggattcaggaa

SEQ ID NO: 4966117 - DNA, 22 bp, Homo sapiens
ttcgaagccttgcctaaattta

SEQ ID NO: 4966118 - DNA, 15 bp, Homo sapiens
ttcgacatatttcct

SEQ ID NO: 4966119 - DNA, 23 bp, Homo sapiens
ttcgatacccaggaccaagccac

SEQ ID NO: 4966120 - DNA, 17 bp, Homo sapiens
ttcgcatggtcacacac

SEQ ID NO: 4966121 - DNA, 20 bp, Homo sapiens
ttcgcatggtcacacactga

SEQ ID NO: 4966122 - DNA, 21 bp, Homo sapiens
ttcgcatggtcacacactgat

SEQ ID NO: 4966123 - DNA, 15 bp, Homo sapiens
ttcgctcctgtgtct

SEQ ID NO: 4966124 - DNA, 15 bp, Homo sapiens
ttcgtatgaaaatga

SEQ ID NO: 4966125 - DNA, 14 bp, Homo sapiens
ttcgtttctgtata

SEQ ID NO: 4966126 - DNA, 14 bp, Homo sapiens
ttctaaaaagatta

SEQ ID NO: 4966127 - DNA, 22 bp, Homo sapiens
ttctaaaatcttatagttctag

SEQ ID NO: 4966128 - DNA, 19 bp, Homo sapiens
ttctaaacccaatccaaat

SEQ ID NO: 4966129 - DNA, 23 bp, Homo sapiens
ttctaaagataatattactgttt

SEQ ID NO: 4966130 - DNA, 22 bp, Homo sapiens
ttctaaagattctatagttcta

SEQ ID NO: 4966131 - DNA, 15 bp, Homo sapiens
ttctaaagctctgac

SEQ ID NO: 4966132 - DNA, 16 bp, Homo sapiens
ttctaaagctctgaca

SEQ ID NO: 4966133 - DNA, 21 bp, Homo sapiens
ttctaaccttgaatgctgcca

SEQ ID NO: 4966134 - DNA, 23 bp, Homo sapiens
ttctaaccttgaatgctgccagt

SEQ ID NO: 4966135 - DNA, 24 bp, Homo sapiens
ttctaaccttgaatgctgccagtg

SEQ ID NO: 4966136 - DNA, 21 bp, Homo sapiens
ttctaagatgtgatattctaa

SEQ ID NO: 4966137 - DNA, 12 bp, Homo sapiens
ttctaagattct

SEQ ID NO: 4966138 - DNA, 13 bp, Homo sapiens
ttctaagattcta

SEQ ID NO: 4966139 - DNA, 17 bp, Homo sapiens
ttctaagattctaaagg

SEQ ID NO: 4966140 - DNA, 23 bp, Homo sapiens
ttactgggccttagtgggccagg

SEQ ID NO: 4966141 - DNA, 23 bp, Homo sapiens
ttactgtctggttttaacaattt

SEQ ID NO: 4966142 - DNA, 14 bp, Homo sapiens
ttactgtgaaactg

SEQ ID NO: 4966143 - DNA, 14 bp, Homo sapiens
ttactgtggaggaa

SEQ ID NO: 4966144 - DNA, 16 bp, Homo sapiens
ttactgtggaggaagg

SEQ ID NO: 4966145 - DNA, 17 bp, Homo sapiens
ttactgtggaggaagga

SEQ ID NO: 4966146 - DNA, 18 bp, Homo sapiens
ttactgtggaggaaggat

SEQ ID NO: 4966147 - DNA, 20 bp, Homo sapiens
ttactgtggaggaaggattg

SEQ ID NO: 4966148 - DNA, 20 bp, Homo sapiens
ttactgtgttttataaaata

SEQ ID NO: 4966149 - DNA, 11 bp, Homo sapiens
ttactgttctt

SEQ ID NO: 4966150 - DNA, 15 bp, Homo sapiens
ttactgttcttgctg

SEQ ID NO: 4966151 - DNA, 19 bp, Homo sapiens
ttactgttcttgctgctag

SEQ ID NO: 4966152 - DNA, 21 bp, Homo sapiens
ttactgttcttgctgctagaa

SEQ ID NO: 4966153 - DNA, 18 bp, Homo sapiens
ttactgtttatttctgtt

SEQ ID NO: 4966154 - DNA, 15 bp, Homo sapiens
ttactttatgtttgt

SEQ ID NO: 4966155 - DNA, 21 bp, Homo sapiens
ttactttcctttccccagccc

SEQ ID NO: 4966156 - DNA, 23 bp, Homo sapiens
ttacttttatttgcaacatttac

SEQ ID NO: 4966157 - DNA, 15 bp, Homo sapiens
ttagaaaaaaattac

SEQ ID NO: 4966158 - DNA, 21 bp, Homo sapiens
ttagaaagtagccacgtatgg

SEQ ID NO: 4966159 - DNA, 16 bp, Homo sapiens
ttagaaatgcagaatc

SEQ ID NO: 4966160 - DNA, 17 bp, Homo sapiens
ttagaaatgtaaactgc

SEQ ID NO: 4966161 - DNA, 20 bp, Homo sapiens
ttagaaatgtaaactgccat

SEQ ID NO: 4966162 - DNA, 14 bp, Homo sapiens
ttagaaattagaaa

SEQ ID NO: 4966163 - DNA, 19 bp, Homo sapiens
ttagaagtgcatttctgaa

SEQ ID NO: 4966164 - DNA, 13 bp, Homo sapiens
ttagaataaattc

SEQ ID NO: 4966165 - DNA, 15 bp, Homo sapiens
ttagaattatttaaa

SEQ ID NO: 4966166 - DNA, 13 bp, Homo sapiens
ttagaccaaggaa

SEQ ID NO: 4966167 - DNA, 15 bp, Homo sapiens
ttagaccgctctctt

SEQ ID NO: 4966168 - DNA, 18 bp, Homo sapiens
ttagaccgctctcttttc

SEQ ID NO: 4966169 - DNA, 13 bp, Homo sapiens
ttagactcctcct

SEQ ID NO: 4966170 - DNA, 19 bp, Homo sapiens
ttagagagggaccatgtgt

SEQ ID NO: 4966171 - DNA, 17 bp, Homo sapiens
ttagagtttctgtttga

SEQ ID NO: 4966172 - DNA, 18 bp, Homo sapiens
ttagagtttctgtttgat

SEQ ID NO: 4966173 - DNA, 14 bp, Homo sapiens
ttagatataacact

SEQ ID NO: 4966174 - DNA, 17 bp, Homo sapiens
ttagatataacactatg

SEQ ID NO: 4966175 - DNA, 22 bp, Homo sapiens
ttagatgttccagtaatctaat

SEQ ID NO: 4966176 - DNA, 22 bp, Homo sapiens
ttagatgttgccatgtgtttta

SEQ ID NO: 4966177 - DNA, 18 bp, Homo sapiens
ttagattttctggttcta

SEQ ID NO: 4966178 - DNA, 19 bp, Homo sapiens
ttagcacagattttaattg

SEQ ID NO: 4966179 - DNA, 18 bp, Homo sapiens
ttagcatagcttattatt

SEQ ID NO: 4966180 - DNA, 15 bp, Homo sapiens
ttagccaggatcatg

SEQ ID NO: 4966181 - DNA, 14 bp, Homo sapiens
ttagccccataatt

SEQ ID NO: 4966182 - DNA, 23 bp, Homo sapiens
ttagctgatgaacttattctgta

SEQ ID NO: 4966183 - DNA, 12 bp, Homo sapiens
ttagcttcctta

SEQ ID NO: 4966184 - DNA, 13 bp, Homo sapiens
ttagcttccttaa

SEQ ID NO: 4966185 - DNA, 17 bp, Homo sapiens
ttagcttgcaccttgtc

SEQ ID NO: 4966186 - DNA, 18 bp, Homo sapiens
ttagctttttaaaacatt

SEQ ID NO: 4966187 - DNA, 17 bp, Homo sapiens
ttagctttttaattgtt

SEQ ID NO: 4966188 - DNA, 22 bp, Homo sapiens
ttaggaagttgacttatagtac

SEQ ID NO: 4966189 - DNA, 23 bp, Homo sapiens
ttaggaagttgacttatagtaca

SEQ ID NO: 4966190 - DNA, 23 bp, Homo sapiens
ttaggaattaagttatctttaaa

SEQ ID NO: 4966191 - DNA, 17 bp, Homo sapiens
ttaggaggctcaacaat

SEQ ID NO: 4966192 - DNA, 18 bp, Homo sapiens
ttaggaggctcaacaata

SEQ ID NO: 4966193 - DNA, 20 bp, Homo sapiens
ttaggcaaggctatgtgatt

SEQ ID NO: 4966194 - DNA, 16 bp, Homo sapiens
ttaggccacatgggag

SEQ ID NO: 4966195 - DNA, 22 bp, Homo sapiens
ttaggtgcaatttcaaggttct

SEQ ID NO: 4966196 - DNA, 13 bp, Homo sapiens
ttaggttctaaag

SEQ ID NO: 4966197 - DNA, 20 bp, Homo sapiens
ttaggttctaaagttctaag

SEQ ID NO: 4966198 - DNA, 22 bp, Homo sapiens
ttaggttctaaagttctaagat

SEQ ID NO: 4966199 - DNA, 16 bp, Homo sapiens
ttaggtttttccttat

SEQ ID NO: 4966200 - DNA, 13 bp, Homo sapiens
ttagtaaatgtct

SEQ ID NO: 4966201 - DNA, 16 bp, Homo sapiens
ttagtaaatgtctttg

SEQ ID NO: 4966202 - DNA, 15 bp, Homo sapiens
ttagtatcagtgttt

SEQ ID NO: 4966203 - DNA, 19 bp, Homo sapiens
ttagtatgacgctgataca

SEQ ID NO: 4966204 - DNA, 22 bp, Homo sapiens
ttagtatgacgctgatacataa

SEQ ID NO: 4966205 - DNA, 17 bp, Homo sapiens
ttagtattcattctgca

SEQ ID NO: 4966206 - DNA, 14 bp, Homo sapiens
ttagtgagttattc

SEQ ID NO: 4966207 - DNA, 17 bp, Homo sapiens
ttagtgttttaagaaat

SEQ ID NO: 4966208 - DNA, 14 bp, Homo sapiens
ttagtttctttggg

SEQ ID NO: 4966209 - DNA, 18 bp, Homo sapiens
ttagtttggattcttatg

SEQ ID NO: 4966210 - DNA, 17 bp, Homo sapiens
ttataaaaataaataga

SEQ ID NO: 4966211 - DNA, 10 bp, Homo sapiens
ttataaaatt

SEQ ID NO: 4966212 - DNA, 17 bp, Homo sapiens
ttataaaattagaaagc

SEQ ID NO: 4966213 - DNA, 19 bp, Homo sapiens
ttataaatatatataaaga

SEQ ID NO: 4966214 - DNA, 21 bp, Homo sapiens
ttataaatcatattgatgaaa

SEQ ID NO: 4966215 - DNA, 15 bp, Homo sapiens
ttataaatgagcaaa

SEQ ID NO: 4966216 - DNA, 13 bp, Homo sapiens
ttataagactctc

SEQ ID NO: 4966217 - DNA, 18 bp, Homo sapiens
ttataagtagcaggccaa

SEQ ID NO: 4966218 - DNA, 16 bp, Homo sapiens
ttataagtcacaaaga

SEQ ID NO: 4966219 - DNA, 17 bp, Homo sapiens
ttataagtgaagtgata

SEQ ID NO: 4966220 - DNA, 20 bp, Homo sapiens
ttatacaaacctaccaaaat

SEQ ID NO: 4966221 - DNA, 18 bp, Homo sapiens
ttatacaaattaaaaaga

SEQ ID NO: 4966222 - DNA, 15 bp, Homo sapiens
ttatacaatatcatc

SEQ ID NO: 4966223 - DNA, 20 bp, Homo sapiens
ttatacagatagagttccat

SEQ ID NO: 4966224 - DNA, 14 bp, Homo sapiens
ttatacattagtaa

SEQ ID NO: 4966225 - DNA, 21 bp, Homo sapiens
ttatacattagtaaatgtctt

SEQ ID NO: 4966226 - DNA, 15 bp, Homo sapiens
ttatacctacctgtg

SEQ ID NO: 4966227 - DNA, 16 bp, Homo sapiens
ttatacctgctatcag

SEQ ID NO: 4966228 - DNA, 11 bp, Homo sapiens
ttatactaact

SEQ ID NO: 4966229 - DNA, 13 bp, Homo sapiens
ttatactgattat

SEQ ID NO: 4966230 - DNA, 21 bp, Homo sapiens
ttatagagaatgatgataaca

SEQ ID NO: 4966231 - DNA, 14 bp, Homo sapiens
ttatagattctaaa

SEQ ID NO: 4966232 - DNA, 15 bp, Homo sapiens
ttatagattctaaag

SEQ ID NO: 4966233 - DNA, 13 bp, Homo sapiens
ttatagtggaaaa

SEQ ID NO: 4966234 - DNA, 17 bp, Homo sapiens
ttatagtggaaaaacac

SEQ ID NO: 4966235 - DNA, 12 bp, Homo sapiens
ttatagtttctg

SEQ ID NO: 4966236 - DNA, 12 bp, Homo sapiens
ttatagtttgta

SEQ ID NO: 4966237 - DNA, 14 bp, Homo sapiens
ttatatacagagga

SEQ ID NO: 4966238 - DNA, 21 bp, Homo sapiens
ttatatacagaggaaatctgt

SEQ ID NO: 4966239 - DNA, 18 bp, Homo sapiens
ttatatatgaaaactata

SEQ ID NO: 4966240 - DNA, 17 bp, Homo sapiens
ttatatctgtacaatga

SEQ ID NO: 4966241 - DNA, 16 bp, Homo sapiens
ttatatgtaccgtagg

SEQ ID NO: 4966242 - DNA, 13 bp, Homo sapiens
ttatatgtgttga

SEQ ID NO: 4966243 - DNA, 16 bp, Homo sapiens
ttatattcaaccatgg

SEQ ID NO: 4966244 - DNA, 23 bp, Homo sapiens
ttatattcaaccatggactttat

SEQ ID NO: 4966245 - DNA, 22 bp, Homo sapiens
ttatattgaagacaatttgata

SEQ ID NO: 4966246 - DNA, 17 bp, Homo sapiens
ttatatttagttatagt

SEQ ID NO: 4966247 - DNA, 22 bp, Homo sapiens
ttatatttagttatagtttcag

SEQ ID NO: 4966248 - DNA, 20 bp, Homo sapiens
ttatatttccctaaaataca

SEQ ID NO: 4966249 - DNA, 20 bp, Homo sapiens
ttatcactttttgaactaag

SEQ ID NO: 4966250 - DNA, 21 bp, Homo sapiens
tgtttatgcaaggaaggaaag

SEQ ID NO: 4966251 - DNA, 24 bp, Homo sapiens
tgtttatggcctcagctgcctcac

SEQ ID NO: 4966252 - DNA, 14 bp, Homo sapiens
tgtttatgttttta

SEQ ID NO: 4966253 - DNA, 16 bp, Homo sapiens
tgtttattcttctaga

SEQ ID NO: 4966254 - DNA, 17 bp, Homo sapiens
tgtttattcttctagag

SEQ ID NO: 4966255 - DNA, 24 bp, Homo sapiens
tgtttatttatagagtgtacttaa

SEQ ID NO: 4966256 - DNA, 17 bp, Homo sapiens
tgtttatttctgtttct

SEQ ID NO: 4966257 - DNA, 19 bp, Homo sapiens
tgtttatttttcatattgt

SEQ ID NO: 4966258 - DNA, 15 bp, Homo sapiens
tgtttcagatttttt

SEQ ID NO: 4966259 - DNA, 22 bp, Homo sapiens
tgtttcaggttcagtattatgt

SEQ ID NO: 4966260 - DNA, 14 bp, Homo sapiens
tgtttcatgttttg

SEQ ID NO: 4966261 - DNA, 19 bp, Homo sapiens
tgtttcatgttttgtgact

SEQ ID NO: 4966262 - DNA, 21 bp, Homo sapiens
tgtttcatgttttgtgactat

SEQ ID NO: 4966263 - DNA, 22 bp, Homo sapiens
tgtttcatgttttgtgactata

SEQ ID NO: 4966264 - DNA, 23 bp, Homo sapiens
tgtttccagacttccttgagaca

SEQ ID NO: 4966265 - DNA, 21 bp, Homo sapiens
tgtttccagcagaagacaaaa

SEQ ID NO: 4966266 - DNA, 19 bp, Homo sapiens
tgtttctattgacttcaat

SEQ ID NO: 4966267 - DNA, 17 bp, Homo sapiens
tgtttctgagaaaagaa

SEQ ID NO: 4966268 - DNA, 14 bp, Homo sapiens
tgtttctgttatta

SEQ ID NO: 4966269 - DNA, 18 bp, Homo sapiens
tgtttcttcctgttaatg

SEQ ID NO: 4966270 - DNA, 15 bp, Homo sapiens
tgtttcttgcttgta

SEQ ID NO: 4966271 - DNA, 19 bp, Homo sapiens
tgtttcttgcttgtacctc

SEQ ID NO: 4966272 - DNA, 14 bp, Homo sapiens
tgtttcttgtttat

SEQ ID NO: 4966273 - DNA, 17 bp, Homo sapiens
tgtttcttgtttattga

SEQ ID NO: 4966274 - DNA, 12 bp, Homo sapiens
tgtttctttgtg

SEQ ID NO: 4966275 - DNA, 21 bp, Homo sapiens
tgtttgaaatgaggtctgttt

SEQ ID NO: 4966276 - DNA, 19 bp, Homo sapiens
tgtttgaatatggacaaga

SEQ ID NO: 4966277 - DNA, 18 bp, Homo sapiens
tgtttgaggagcatgttt

SEQ ID NO: 4966278 - DNA, 22 bp, Homo sapiens
tgtttgcataaacattctttta

SEQ ID NO: 4966279 - DNA, 22 bp, Homo sapiens
tgtttgccatactttgtctgaa

SEQ ID NO: 4966280 - DNA, 18 bp, Homo sapiens
tgtttgcttcataaatga

SEQ ID NO: 4966281 - DNA, 15 bp, Homo sapiens
tgtttggtttacatt

SEQ ID NO: 4966282 - DNA, 18 bp, Homo sapiens
tgtttgtctctccttttc

SEQ ID NO: 4966283 - DNA, 19 bp, Homo sapiens
tgtttgtctctccttttct

SEQ ID NO: 4966284 - DNA, 19 bp, Homo sapiens
tgtttgtcttttaatgctt

SEQ ID NO: 4966285 - DNA, 14 bp, Homo sapiens
tgtttgtggcctca

SEQ ID NO: 4966286 - DNA, 22 bp, Homo sapiens
tgttttaaatacgcactacatg

SEQ ID NO: 4966287 - DNA, 12 bp, Homo sapiens
tgttttaaattc

SEQ ID NO: 4966288 - DNA, 14 bp, Homo sapiens
tgttttaaattctg

SEQ ID NO: 4966289 - DNA, 17 bp, Homo sapiens
tgttttaagaggcaggg

SEQ ID NO: 4966290 - DNA, 18 bp, Homo sapiens
tgttttaagtactacaca

SEQ ID NO: 4966291 - DNA, 18 bp, Homo sapiens
tgttttaatctgaaattc

SEQ ID NO: 4966292 - DNA, 23 bp, Homo sapiens
tgttttaatttaaacacctcctc

SEQ ID NO: 4966293 - DNA, 14 bp, Homo sapiens
tgttttattcctgt

SEQ ID NO: 4966294 - DNA, 22 bp, Homo sapiens
tgttttctttctttaaatgttt

SEQ ID NO: 4966295 - DNA, 17 bp, Homo sapiens
tgttttgaaatcaatgc

SEQ ID NO: 4966296 - DNA, 22 bp, Homo sapiens
tgttttgaaatcaatgcaagag

SEQ ID NO: 4966297 - DNA, 15 bp, Homo sapiens
tgttttgaatattac

SEQ ID NO: 4966298 - DNA, 21 bp, Homo sapiens
tgttttgaatattactcctat

SEQ ID NO: 4966299 - DNA, 23 bp, Homo sapiens
ttaaggatggggttatgaaccct

SEQ ID NO: 4966300 - DNA, 16 bp, Homo sapiens
ttaagggcatgccttg

SEQ ID NO: 4966301 - DNA, 17 bp, Homo sapiens
ttaagtatatcatgtaa

SEQ ID NO: 4966302 - DNA, 19 bp, Homo sapiens
ttaagtatcttttttcaaa

SEQ ID NO: 4966303 - DNA, 14 bp, Homo sapiens
ttaagtatgtgtaa

SEQ ID NO: 4966304 - DNA, 18 bp, Homo sapiens
ttaagtgcgtgtgtagag

SEQ ID NO: 4966305 - DNA, 19 bp, Homo sapiens
ttaagttctcaatgtgaaa

SEQ ID NO: 4966306 - DNA, 14 bp, Homo sapiens
ttaataaactactc

SEQ ID NO: 4966307 - DNA, 21 bp, Homo sapiens
ttaataaagaattaacagaga

SEQ ID NO: 4966308 - DNA, 22 bp, Homo sapiens
ttaataaagacgatttgtcagt

SEQ ID NO: 4966309 - DNA, 16 bp, Homo sapiens
ttaataacattacctt

SEQ ID NO: 4966310 - DNA, 17 bp, Homo sapiens
ttaataacattacctta

SEQ ID NO: 4966311 - DNA, 17 bp, Homo sapiens
ttaatactaccttgaaa

SEQ ID NO: 4966312 - DNA, 20 bp, Homo sapiens
ttaatagcttttattgtata

SEQ ID NO: 4966313 - DNA, 19 bp, Homo sapiens
ttaatagtcattccaaata

SEQ ID NO: 4966314 - DNA, 16 bp, Homo sapiens
ttaatagtttgtctat

SEQ ID NO: 4966315 - DNA, 20 bp, Homo sapiens
ttaatatatcccagaaatta

SEQ ID NO: 4966316 - DNA, 18 bp, Homo sapiens
ttaatatatttgaaaaaa

SEQ ID NO: 4966317 - DNA, 15 bp, Homo sapiens
ttaatattctattaa

SEQ ID NO: 4966318 - DNA, 15 bp, Homo sapiens
ttaatatttaaacag

SEQ ID NO: 4966319 - DNA, 20 bp, Homo sapiens
ttaatcacaaatttcactta

SEQ ID NO: 4966320 - DNA, 21 bp, Homo sapiens
ttaatcacaaatttcacttat

SEQ ID NO: 4966321 - DNA, 16 bp, Homo sapiens
ttaatcagacaaagta

SEQ ID NO: 4966322 - DNA, 20 bp, Homo sapiens
ttaatcaggtcctcagagaa

SEQ ID NO: 4966323 - DNA, 18 bp, Homo sapiens
ttaatcatctataaagaa

SEQ ID NO: 4966324 - DNA, 22 bp, Homo sapiens
ttaatcctttgttttctgacta

SEQ ID NO: 4966325 - DNA, 20 bp, Homo sapiens
ttaatctctgttatgtactg

SEQ ID NO: 4966326 - DNA, 17 bp, Homo sapiens
ttaatctgaaattctaa

SEQ ID NO: 4966327 - DNA, 21 bp, Homo sapiens
ttaatgataagtaaatgctag

SEQ ID NO: 4966328 - DNA, 22 bp, Homo sapiens
ttaatgcagttgcttactaaag

SEQ ID NO: 4966329 - DNA, 18 bp, Homo sapiens
ttaatgcattaaacctgt

SEQ ID NO: 4966330 - DNA, 16 bp, Homo sapiens
ttaatgctgccttttc

SEQ ID NO: 4966331 - DNA, 13 bp, Homo sapiens
ttaatgcttcatt

SEQ ID NO: 4966332 - DNA, 21 bp, Homo sapiens
ttaatggacttatttcttcaa

SEQ ID NO: 4966333 - DNA, 15 bp, Homo sapiens
ttaatggtctaaaaa

SEQ ID NO: 4966334 - DNA, 21 bp, Homo sapiens
ttaatgtatttgttcatgttt

SEQ ID NO: 4966335 - DNA, 18 bp, Homo sapiens
ttaatgtcacaggcaggt

SEQ ID NO: 4966336 - DNA, 19 bp, Homo sapiens
ttaatgtgaacttgtagct

SEQ ID NO: 4966337 - DNA, 11 bp, Homo sapiens
ttaatgtgagt

SEQ ID NO: 4966338 - DNA, 20 bp, Homo sapiens
ttaatgtgatgatgtaattg

SEQ ID NO: 4966339 - DNA, 13 bp, Homo sapiens
ttaattacaccat

SEQ ID NO: 4966340 - DNA, 21 bp, Homo sapiens
ttaattactcagcagaatggt

SEQ ID NO: 4966341 - DNA, 17 bp, Homo sapiens
ttaattattaactacat

SEQ ID NO: 4966342 - DNA, 14 bp, Homo sapiens
ttaattattatttg

SEQ ID NO: 4966343 - DNA, 17 bp, Homo sapiens
ttaattctctttcaaag

SEQ ID NO: 4966344 - DNA, 14 bp, Homo sapiens
ttaattgtcatggt

SEQ ID NO: 4966345 - DNA, 20 bp, Homo sapiens
ttaattgttgtttctttcta

SEQ ID NO: 4966346 - DNA, 21 bp, Homo sapiens
ttaatttaaagcttactctgt

SEQ ID NO: 4966347 - DNA, 14 bp, Homo sapiens
ttaatttatatgta

SEQ ID NO: 4966348 - DNA, 14 bp, Homo sapiens
ttaatttcagtcct

SEQ ID NO: 4966349 - DNA, 11 bp, Homo sapiens
ttaatttccag

SEQ ID NO: 4966350 - DNA, 20 bp, Homo sapiens
ttacaaaactacatgagaac

SEQ ID NO: 4966351 - DNA, 13 bp, Homo sapiens
ttacaagaagttt

SEQ ID NO: 4966352 - DNA, 21 bp, Homo sapiens
ttacaagcgtgagccactgca

SEQ ID NO: 4966353 - DNA, 20 bp, Homo sapiens
ttacacaaaggggatcataa

SEQ ID NO: 4966354 - DNA, 16 bp, Homo sapiens
ttacacacacagatgt

SEQ ID NO: 4966355 - DNA, 17 bp, Homo sapiens
ttacactgcctgtatac

SEQ ID NO: 4966356 - DNA, 21 bp, Homo sapiens
ttacactgcctgtatacttta

SEQ ID NO: 4966357 - DNA, 22 bp, Homo sapiens
ttacactgcctgtatactttag

SEQ ID NO: 4966358 - DNA, 17 bp, Homo sapiens
ttacactgtatttgtat

SEQ ID NO: 4966359 - DNA, 15 bp, Homo sapiens
ttacagaaaaatctt

SEQ ID NO: 4966360 - DNA, 15 bp, Homo sapiens
ttacagaaatactat

SEQ ID NO: 4966361 - DNA, 13 bp, Homo sapiens
tgtctcatcccca

SEQ ID NO: 4966362 - DNA, 19 bp, Homo sapiens
tgtctcatcctcctggaac

SEQ ID NO: 4966363 - DNA, 12 bp, Homo sapiens
tgtctctccttt

SEQ ID NO: 4966364 - DNA, 15 bp, Homo sapiens
tgtctctccttttct

SEQ ID NO: 4966365 - DNA, 22 bp, Homo sapiens
tgtctctccttttcttttgtta

SEQ ID NO: 4966366 - DNA, 22 bp, Homo sapiens
tgtctctgctcgccctcctttc

SEQ ID NO: 4966367 - DNA, 13 bp, Homo sapiens
tgtctcttgaaaa

SEQ ID NO: 4966368 - DNA, 17 bp, Homo sapiens
tgtctctttaagggcat

SEQ ID NO: 4966369 - DNA, 16 bp, Homo sapiens
tgtctgaagtcactgc

SEQ ID NO: 4966370 - DNA, 15 bp, Homo sapiens
tgtctgattggcttg

SEQ ID NO: 4966371 - DNA, 17 bp, Homo sapiens
tgtctgcgtgggtcaga

SEQ ID NO: 4966372 - DNA, 21 bp, Homo sapiens
tgtctgcgtggttcctttctc

SEQ ID NO: 4966373 - DNA, 22 bp, Homo sapiens
tgtctggttttaacaatttcct

SEQ ID NO: 4966374 - DNA, 21 bp, Homo sapiens
tgtctgtacacgtgtcctgta

SEQ ID NO: 4966375 - DNA, 20 bp, Homo sapiens
tgtctgtatttcatgtggct

SEQ ID NO: 4966376 - DNA, 21 bp, Homo sapiens
tgtctgtttaagaaaagtatt

SEQ ID NO: 4966377 - DNA, 22 bp, Homo sapiens
tgtctgtttgtttcaagaacct

SEQ ID NO: 4966378 - DNA, 23 bp, Homo sapiens
tgtctgtttgtttcaagaacctg

SEQ ID NO: 4966379 - DNA, 16 bp, Homo sapiens
tgtcttcaaactgtga

SEQ ID NO: 4966380 - DNA, 19 bp, Homo sapiens
tgtcttcatttcattgtat

SEQ ID NO: 4966381 - DNA, 16 bp, Homo sapiens
tgtcttctctgtctca

SEQ ID NO: 4966382 - DNA, 15 bp, Homo sapiens
tgtcttggacactgt

SEQ ID NO: 4966383 - DNA, 16 bp, Homo sapiens
tgtcttgtacatgtgt

SEQ ID NO: 4966384 - DNA, 15 bp, Homo sapiens
tgtctttaaaagaga

SEQ ID NO: 4966385 - DNA, 11 bp, Homo sapiens
tgtctttcaaa

SEQ ID NO: 4966386 - DNA, 20 bp, Homo sapiens
tgtctttcaaactccaaggt

SEQ ID NO: 4966387 - DNA, 12 bp, Homo sapiens
tgtctttctgag

SEQ ID NO: 4966388 - DNA, 13 bp, Homo sapiens
tgtctttggaaaa

SEQ ID NO: 4966389 - DNA, 11 bp, Homo sapiens
tgtctttgtaa

SEQ ID NO: 4966390 - DNA, 18 bp, Homo sapiens
tgtcttttatatttgtat

SEQ ID NO: 4966391 - DNA, 13 bp, Homo sapiens
tgtcttttgaata

SEQ ID NO: 4966392 - DNA, 16 bp, Homo sapiens
tgtcttttttcactac

SEQ ID NO: 4966393 - DNA, 17 bp, Homo sapiens
tgtgaaacacagctgtt

SEQ ID NO: 4966394 - DNA, 19 bp, Homo sapiens
tgtgaaacactttgcctcc

SEQ ID NO: 4966395 - DNA, 22 bp, Homo sapiens
tgtgaaaccttttttaagattt

SEQ ID NO: 4966396 - DNA, 19 bp, Homo sapiens
tgtgaaactggcactgaat

SEQ ID NO: 4966397 - DNA, 20 bp, Homo sapiens
tgtgaaaggaagctccactg

SEQ ID NO: 4966398 - DNA, 20 bp, Homo sapiens
tgtgaacaaaagatgctctt

SEQ ID NO: 4966399 - DNA, 16 bp, Homo sapiens
tgtgaaccaagatcta

SEQ ID NO: 4966400 - DNA, 15 bp, Homo sapiens
tgtgaaccaccacac

SEQ ID NO: 4966401 - DNA, 20 bp, Homo sapiens
tgtgaaccaccacacccagc

SEQ ID NO: 4966402 - DNA, 21 bp, Homo sapiens
tgtgaaccaccacacccagcc

SEQ ID NO: 4966403 - DNA, 22 bp, Homo sapiens
tgtgaaccaccacacccagccc

SEQ ID NO: 4966404 - DNA, 12 bp, Homo sapiens
tgtgaacttgta

SEQ ID NO: 4966405 - DNA, 15 bp, Homo sapiens
tgtgaacttgtagct

SEQ ID NO: 4966406 - DNA, 20 bp, Homo sapiens
tgtgaagtttacattgtaaa

SEQ ID NO: 4966407 - DNA, 23 bp, Homo sapiens
tgtgaatgaacactcttttgctt

SEQ ID NO: 4966408 - DNA, 13 bp, Homo sapiens
tgtgaatggattg

SEQ ID NO: 4966409 - DNA, 15 bp, Homo sapiens
tgtgaatgtgggcac

SEQ ID NO: 4966410 - DNA, 21 bp, Homo sapiens
tgtgacaactgtctaacttta

SEQ ID NO: 4966411 - DNA, 22 bp, Homo sapiens
tgtgacacatatgcaccttgtg

SEQ ID NO: 4966412 - DNA, 15 bp, Homo sapiens
tgtgacattttacat

SEQ ID NO: 4966413 - DNA, 19 bp, Homo sapiens
tgtgaccaactgtgttgta

SEQ ID NO: 4966414 - DNA, 21 bp, Homo sapiens
tgtgaccaactgtgttgtatt

SEQ ID NO: 4966415 - DNA, 13 bp, Homo sapiens
tgtgacctcaggc

SEQ ID NO: 4966416 - DNA, 14 bp, Homo sapiens
tgtgacctcaggca

SEQ ID NO: 4966417 - DNA, 20 bp, Homo sapiens
tgtgacctcaggcactagcc

SEQ ID NO: 4966418 - DNA, 16 bp, Homo sapiens
tgtgactctaaattct

SEQ ID NO: 4966419 - DNA, 15 bp, Homo sapiens
tgtgagacccccaca

SEQ ID NO: 4966420 - DNA, 19 bp, Homo sapiens
tgttctgtttgttattgtt

SEQ ID NO: 4966421 - DNA, 14 bp, Homo sapiens
tgttcttacacata

SEQ ID NO: 4966422 - DNA, 22 bp, Homo sapiens
tgttcttacacatacagtttta

SEQ ID NO: 4966423 - DNA, 17 bp, Homo sapiens
tgttcttacctgtatgt

SEQ ID NO: 4966424 - DNA, 16 bp, Homo sapiens
tgttcttgctgctaga

SEQ ID NO: 4966425 - DNA, 17 bp, Homo sapiens
tgttcttgctgctagaa

SEQ ID NO: 4966426 - DNA, 18 bp, Homo sapiens
tgttcttgctgctagaac

SEQ ID NO: 4966427 - DNA, 20 bp, Homo sapiens
tgttcttgctgctagaactt

SEQ ID NO: 4966428 - DNA, 22 bp, Homo sapiens
tgttcttgctgctagaactttt

SEQ ID NO: 4966429 - DNA, 18 bp, Homo sapiens
tgttgaaaaccaaaatga

SEQ ID NO: 4966430 - DNA, 22 bp, Homo sapiens
tgttgaaaattattttaaacaa

SEQ ID NO: 4966431 - DNA, 18 bp, Homo sapiens
tgttgaaattttgcaaat

SEQ ID NO: 4966432 - DNA, 23 bp, Homo sapiens
tgttgaaattttgcaaatataaa

SEQ ID NO: 4966433 - DNA, 17 bp, Homo sapiens
tgttgaagggaggtggc

SEQ ID NO: 4966434 - DNA, 16 bp, Homo sapiens
tgttgacagttctgaa

SEQ ID NO: 4966435 - DNA, 18 bp, Homo sapiens
tgttgagccttttccctc

SEQ ID NO: 4966436 - DNA, 13 bp, Homo sapiens
tgttgatgtatct

SEQ ID NO: 4966437 - DNA, 13 bp, Homo sapiens
tgttgattaaaac

SEQ ID NO: 4966438 - DNA, 20 bp, Homo sapiens
tgttgcattattcatttagt

SEQ ID NO: 4966439 - DNA, 14 bp, Homo sapiens
tgttgccatgtgtt

SEQ ID NO: 4966440 - DNA, 15 bp, Homo sapiens
tgttgccatgtgttt

SEQ ID NO: 4966441 - DNA, 12 bp, Homo sapiens
tgttgcccaggc

SEQ ID NO: 4966442 - DNA, 16 bp, Homo sapiens
tgttgcccaggcaggt

SEQ ID NO: 4966443 - DNA, 15 bp, Homo sapiens
tgttgcccaggctgg

SEQ ID NO: 4966444 - DNA, 23 bp, Homo sapiens
tgttgcccaggctggcgtgcagt

SEQ ID NO: 4966445 - DNA, 12 bp, Homo sapiens
tgttgcctaagt

SEQ ID NO: 4966446 - DNA, 21 bp, Homo sapiens
tgttggacacctttaggttct

SEQ ID NO: 4966447 - DNA, 17 bp, Homo sapiens
tgttggattccatgcta

SEQ ID NO: 4966448 - DNA, 18 bp, Homo sapiens
tgttgggatactgcaggg

SEQ ID NO: 4966449 - DNA, 19 bp, Homo sapiens
tgttggttgttttttcctt

SEQ ID NO: 4966450 - DNA, 17 bp, Homo sapiens
tgttggtttactttcaa

SEQ ID NO: 4966451 - DNA, 17 bp, Homo sapiens
tgttgtaaaaagaaaaa

SEQ ID NO: 4966452 - DNA, 19 bp, Homo sapiens
tgttgtaacttatgtagat

SEQ ID NO: 4966453 - DNA, 24 bp, Homo sapiens
tgttgtaacttatgtagatatttg

SEQ ID NO: 4966454 - DNA, 13 bp, Homo sapiens
tgttgtaatgctg

SEQ ID NO: 4966455 - DNA, 15 bp, Homo sapiens
tgttgtacatttatg

SEQ ID NO: 4966456 - DNA, 17 bp, Homo sapiens
tgttgtacatttatgat

SEQ ID NO: 4966457 - DNA, 20 bp, Homo sapiens
tgttgtacatttatgattta

SEQ ID NO: 4966458 - DNA, 22 bp, Homo sapiens
tgttgtacatttatgatttaat

SEQ ID NO: 4966459 - DNA, 16 bp, Homo sapiens
tgttgtattaacaaaa

SEQ ID NO: 4966460 - DNA, 13 bp, Homo sapiens
tgttgtcattgta

SEQ ID NO: 4966461 - DNA, 21 bp, Homo sapiens
tgttgtcattgtaaacaaact

SEQ ID NO: 4966462 - DNA, 12 bp, Homo sapiens
tgttgtcttgaa

SEQ ID NO: 4966463 - DNA, 12 bp, Homo sapiens
tgttgtgtgtgc

SEQ ID NO: 4966464 - DNA, 14 bp, Homo sapiens
tgttgtttctttct

SEQ ID NO: 4966465 - DNA, 12 bp, Homo sapiens
tgttgtttgcca

SEQ ID NO: 4966466 - DNA, 18 bp, Homo sapiens
tgtttaagaaaagtattt

SEQ ID NO: 4966467 - DNA, 14 bp, Homo sapiens
tgtttaagatgggc

SEQ ID NO: 4966468 - DNA, 14 bp, Homo sapiens
tgtttaatatttaa

SEQ ID NO: 4966469 - DNA, 17 bp, Homo sapiens
tgtttaatatttaaaca

SEQ ID NO: 4966470 - DNA, 15 bp, Homo sapiens
tgtttaatgtgaact

SEQ ID NO: 4966471 - DNA, 22 bp, Homo sapiens
tgtttaatgtgaacttgtagct

SEQ ID NO: 4966472 - DNA, 14 bp, Homo sapiens
tgtttaatttcttc

SEQ ID NO: 4966473 - DNA, 15 bp, Homo sapiens
tgtttacatgtgtag

SEQ ID NO: 4966474 - DNA, 14 bp, Homo sapiens
tgtttaccattttt

SEQ ID NO: 4966475 - DNA, 17 bp, Homo sapiens
tgtttactttaaacttg

SEQ ID NO: 4966476 - DNA, 16 bp, Homo sapiens
tgtttagatagggctg

SEQ ID NO: 4966477 - DNA, 15 bp, Homo sapiens
tgtttatcagataca

SEQ ID NO: 4966478 - DNA, 19 bp, Homo sapiens
tgtttatcagatacatcac

SEQ ID NO: 4966479 - DNA, 22 bp, Homo sapiens
tgtatccaacaagccagaatca

SEQ ID NO: 4966480 - DNA, 19 bp, Homo sapiens
tgtatctctgaagcatgtt

SEQ ID NO: 4966481 - DNA, 12 bp, Homo sapiens
tgtatctgagtt

SEQ ID NO: 4966482 - DNA, 15 bp, Homo sapiens
tgtatctgagttgcc

SEQ ID NO: 4966483 - DNA, 16 bp, Homo sapiens
tgtatctgagttgcca

SEQ ID NO: 4966484 - DNA, 15 bp, Homo sapiens
tgtatcttaaatttg

SEQ ID NO: 4966485 - DNA, 16 bp, Homo sapiens
tgtatcttccatattt

SEQ ID NO: 4966486 - DNA, 22 bp, Homo sapiens
tgtatgaaagatggctgtgcct

SEQ ID NO: 4966487 - DNA, 14 bp, Homo sapiens
tgtatgcactttgt

SEQ ID NO: 4966488 - DNA, 23 bp, Homo sapiens
tgtatggaaataaatgtatcata

SEQ ID NO: 4966489 - DNA, 21 bp, Homo sapiens
tgtatgtcagacatccatgtt

SEQ ID NO: 4966490 - DNA, 14 bp, Homo sapiens
tgtatgtcttggac

SEQ ID NO: 4966491 - DNA, 18 bp, Homo sapiens
tgtatgtgagagattctg

SEQ ID NO: 4966492 - DNA, 21 bp, Homo sapiens
tgtatgttattatattccgta

SEQ ID NO: 4966493 - DNA, 12 bp, Homo sapiens
tgtattaacaaa

SEQ ID NO: 4966494 - DNA, 13 bp, Homo sapiens
tgtattaacaaaa

SEQ ID NO: 4966495 - DNA, 15 bp, Homo sapiens
tgtattgtaaacatg

SEQ ID NO: 4966496 - DNA, 14 bp, Homo sapiens
tgtattgtggtatt

SEQ ID NO: 4966497 - DNA, 12 bp, Homo sapiens
tgtatttaagca

SEQ ID NO: 4966498 - DNA, 23 bp, Homo sapiens
tgtatttacgctttgattcatag

SEQ ID NO: 4966499 - DNA, 14 bp, Homo sapiens
tgtatttgttcatg

SEQ ID NO: 4966500 - DNA, 17 bp, Homo sapiens
tgtatttgttcatgttt

SEQ ID NO: 4966501 - DNA, 18 bp, Homo sapiens
tgtatttgttcatgtttg

SEQ ID NO: 4966502 - DNA, 16 bp, Homo sapiens
tgtattttgtgtgacc

SEQ ID NO: 4966503 - DNA, 14 bp, Homo sapiens
tgtcaaaacactgt

SEQ ID NO: 4966504 - DNA, 16 bp, Homo sapiens
tgtcaaaacactgtgg

SEQ ID NO: 4966505 - DNA, 18 bp, Homo sapiens
tgtcaaaacactgtggaa

SEQ ID NO: 4966506 - DNA, 16 bp, Homo sapiens
tgtcaaaagttggact

SEQ ID NO: 4966507 - DNA, 20 bp, Homo sapiens
tgtcaaaagttggactaaat

SEQ ID NO: 4966508 - DNA, 14 bp, Homo sapiens
tgtcaagaaagagc

SEQ ID NO: 4966509 - DNA, 19 bp, Homo sapiens
tgtcaagaagatgatcaga

SEQ ID NO: 4966510 - DNA, 19 bp, Homo sapiens
tgtcaagagggtctgagga

SEQ ID NO: 4966511 - DNA, 19 bp, Homo sapiens
tgtcaagtctctgctggcc

SEQ ID NO: 4966512 - DNA, 12 bp, Homo sapiens
tgtcacaaagaa

SEQ ID NO: 4966513 - DNA, 17 bp, Homo sapiens
tgtcacacactttggct

SEQ ID NO: 4966514 - DNA, 12 bp, Homo sapiens
tgtcacaggcag

SEQ ID NO: 4966515 - DNA, 17 bp, Homo sapiens
tgtcacaggcaggtcca

SEQ ID NO: 4966516 - DNA, 14 bp, Homo sapiens
tgtcacagggccaa

SEQ ID NO: 4966517 - DNA, 21 bp, Homo sapiens
tgtcacatggtgcccctagct

SEQ ID NO: 4966518 - DNA, 18 bp, Homo sapiens
tgtcaccctccacctctt

SEQ ID NO: 4966519 - DNA, 15 bp, Homo sapiens
tgtcactagaatgga

SEQ ID NO: 4966520 - DNA, 22 bp, Homo sapiens
tgtcactcattgctgagcctct

SEQ ID NO: 4966521 - DNA, 19 bp, Homo sapiens
tgtcactgacacaaaggaa

SEQ ID NO: 4966522 - DNA, 22 bp, Homo sapiens
tgtcagaatgctattgaaaatg

SEQ ID NO: 4966523 - DNA, 14 bp, Homo sapiens
tgtcagacataaag

SEQ ID NO: 4966524 - DNA, 20 bp, Homo sapiens
tgtcagacataaagccatgt

SEQ ID NO: 4966525 - DNA, 16 bp, Homo sapiens
tgtcagatgagaacaa

SEQ ID NO: 4966526 - DNA, 19 bp, Homo sapiens
tgtcagatgagaacaaagc

SEQ ID NO: 4966527 - DNA, 20 bp, Homo sapiens
tgtcagatgagaacaaagct

SEQ ID NO: 4966528 - DNA, 16 bp, Homo sapiens
tgtcaggaacagaagg

SEQ ID NO: 4966529 - DNA, 20 bp, Homo sapiens
tgtcaggaacagaaggatga

SEQ ID NO: 4966530 - DNA, 14 bp, Homo sapiens
tgtcaggcctgtgt

SEQ ID NO: 4966531 - DNA, 14 bp, Homo sapiens
tgtcagtatccagg

SEQ ID NO: 4966532 - DNA, 18 bp, Homo sapiens
tgtcagtatttcagtgta

SEQ ID NO: 4966533 - DNA, 21 bp, Homo sapiens
tgtcataaacagatgaataaa

SEQ ID NO: 4966534 - DNA, 13 bp, Homo sapiens
tgtcatatcagca

SEQ ID NO: 4966535 - DNA, 23 bp, Homo sapiens
tgtcatatcagcacatattttct

SEQ ID NO: 4966536 - DNA, 19 bp, Homo sapiens
tgtcatcagagctcctctg

SEQ ID NO: 4966537 - DNA, 20 bp, Homo sapiens
tgtcatccttggtctttgta

SEQ ID NO: 4966538 - DNA, 16 bp, Homo sapiens
tgtcatgaattcttat

SEQ ID NO: 4966539 - DNA, 16 bp, Homo sapiens
tgtcatgtgttccctt

SEQ ID NO: 4966540 - DNA, 23 bp, Homo sapiens
tgtcattaaatggggctcacaaa

SEQ ID NO: 4966541 - DNA, 19 bp, Homo sapiens
tggggagcccgtctcagtg

SEQ ID NO: 4966542 - DNA, 15 bp, Homo sapiens
tggggaggacaaaac

SEQ ID NO: 4966543 - DNA, 18 bp, Homo sapiens
tggggaggacaaaacttc

SEQ ID NO: 4966544 - DNA, 14 bp, Homo sapiens
tggggatgtgggag

SEQ ID NO: 4966545 - DNA, 18 bp, Homo sapiens
tggggcacagtccaggaa

SEQ ID NO: 4966546 - DNA, 14 bp, Homo sapiens
tggggcagagcctc

SEQ ID NO: 4966547 - DNA, 17 bp, Homo sapiens
tggggcaggctgggcca

SEQ ID NO: 4966548 - DNA, 12 bp, Homo sapiens
tggggcctgaga

SEQ ID NO: 4966549 - DNA, 16 bp, Homo sapiens
tggggcctgagagaat

SEQ ID NO: 4966550 - DNA, 12 bp, Homo sapiens
tggggcctggca

SEQ ID NO: 4966551 - DNA, 13 bp, Homo sapiens
tggggcctgtgga

SEQ ID NO: 4966552 - DNA, 14 bp, Homo sapiens
tggggcctgtggaa

SEQ ID NO: 4966553 - DNA, 16 bp, Homo sapiens
tggggcttggcgtgga

SEQ ID NO: 4966554 - DNA, 18 bp, Homo sapiens
tggggcttggcgtggagc

SEQ ID NO: 4966555 - DNA, 23 bp, Homo sapiens
tgggggaatgagcccagagaaca

SEQ ID NO: 4966556 - DNA, 17 bp, Homo sapiens
tgggggacgtttctcat

SEQ ID NO: 4966557 - DNA, 19 bp, Homo sapiens
tgggggtcaggcagccagt

SEQ ID NO: 4966558 - DNA, 15 bp, Homo sapiens
tgggggttctttctt

SEQ ID NO: 4966559 - DNA, 20 bp, Homo sapiens
tgggggttctttcttcctct

SEQ ID NO: 4966560 - DNA, 14 bp, Homo sapiens
tggggtacccactg

SEQ ID NO: 4966561 - DNA, 16 bp, Homo sapiens
tggggtacccactgct

SEQ ID NO: 4966562 - DNA, 21 bp, Homo sapiens
tggggtctcacagtgttgccc

SEQ ID NO: 4966563 - DNA, 20 bp, Homo sapiens
tggggtgggaggtcttgcta

SEQ ID NO: 4966564 - DNA, 16 bp, Homo sapiens
tggggtgtttgggagg

SEQ ID NO: 4966565 - DNA, 18 bp, Homo sapiens
tggggttatctctgtgtt

SEQ ID NO: 4966566 - DNA, 15 bp, Homo sapiens
tgggtaaatgcaaag

SEQ ID NO: 4966567 - DNA, 21 bp, Homo sapiens
tgggtagtgagcagtgagcag

SEQ ID NO: 4966568 - DNA, 18 bp, Homo sapiens
tgggtcacccctccagga

SEQ ID NO: 4966569 - DNA, 16 bp, Homo sapiens
tgggtccgataatatc

SEQ ID NO: 4966570 - DNA, 14 bp, Homo sapiens
tgggtcctgaagaa

SEQ ID NO: 4966571 - DNA, 18 bp, Homo sapiens
tgggtgacaagagcctga

SEQ ID NO: 4966572 - DNA, 13 bp, Homo sapiens
tgggtgctcagaa

SEQ ID NO: 4966573 - DNA, 15 bp, Homo sapiens
tgggtggcctcggga

SEQ ID NO: 4966574 - DNA, 16 bp, Homo sapiens
tgggtggggtattttt

SEQ ID NO: 4966575 - DNA, 22 bp, Homo sapiens
tgggtggtaccctctggagggg

SEQ ID NO: 4966576 - DNA, 14 bp, Homo sapiens
tgggtgtcatttca

SEQ ID NO: 4966577 - DNA, 13 bp, Homo sapiens
tggtaaactattt

SEQ ID NO: 4966578 - DNA, 17 bp, Homo sapiens
tggtaacagttcatgtt

SEQ ID NO: 4966579 - DNA, 22 bp, Homo sapiens
tggtaagaagccgggaacagac

SEQ ID NO: 4966580 - DNA, 20 bp, Homo sapiens
tgtaacttatgtagatattt

SEQ ID NO: 4966581 - DNA, 20 bp, Homo sapiens
tgtaacttttgtaagacaaa

SEQ ID NO: 4966582 - DNA, 21 bp, Homo sapiens
tgtaagacaaaggttttcctc

SEQ ID NO: 4966583 - DNA, 15 bp, Homo sapiens
tgtaagccaaagaaa

SEQ ID NO: 4966584 - DNA, 14 bp, Homo sapiens
tgtaagcctgcaag

SEQ ID NO: 4966585 - DNA, 17 bp, Homo sapiens
tgtaagtcagtgttgag

SEQ ID NO: 4966586 - DNA, 16 bp, Homo sapiens
tgtaagtgctacataa

SEQ ID NO: 4966587 - DNA, 16 bp, Homo sapiens
tgtaagtttcaggtga

SEQ ID NO: 4966588 - DNA, 18 bp, Homo sapiens
tgtaagtttcaggtgaca

SEQ ID NO: 4966589 - DNA, 20 bp, Homo sapiens
tgtaagtttcaggtgacatg

SEQ ID NO: 4966590 - DNA, 13 bp, Homo sapiens
tgtaataatacct

SEQ ID NO: 4966591 - DNA, 18 bp, Homo sapiens
tgtaatagaaaactgaaa

SEQ ID NO: 4966592 - DNA, 19 bp, Homo sapiens
tgtaatataccagcttgta

SEQ ID NO: 4966593 - DNA, 17 bp, Homo sapiens
tgtaatattttgtatta

SEQ ID NO: 4966594 - DNA, 22 bp, Homo sapiens
tgtaatatttttatatacagag

SEQ ID NO: 4966595 - DNA, 13 bp, Homo sapiens
tgtaatcccccag

SEQ ID NO: 4966596 - DNA, 20 bp, Homo sapiens
tgtaatctctctgcagctgc

SEQ ID NO: 4966597 - DNA, 20 bp, Homo sapiens
tgtaatgctgcacttcctgt

SEQ ID NO: 4966598 - DNA, 23 bp, Homo sapiens
tgtaatttagggtactaaattta

SEQ ID NO: 4966599 - DNA, 15 bp, Homo sapiens
tgtaatttataaaat

SEQ ID NO: 4966600 - DNA, 22 bp, Homo sapiens
tgtaatttttcagctctctgta

SEQ ID NO: 4966601 - DNA, 16 bp, Homo sapiens
tgtacacgtgtcctgt

SEQ ID NO: 4966602 - DNA, 19 bp, Homo sapiens
tgtacagaattttggaaga

SEQ ID NO: 4966603 - DNA, 19 bp, Homo sapiens
tgtacagagtgcttttctg

SEQ ID NO: 4966604 - DNA, 17 bp, Homo sapiens
tgtacagcgttttaaaa

SEQ ID NO: 4966605 - DNA, 19 bp, Homo sapiens
tgtacataaacaatgatgc

SEQ ID NO: 4966606 - DNA, 15 bp, Homo sapiens
tgtacatagtgtaat

SEQ ID NO: 4966607 - DNA, 14 bp, Homo sapiens
tgtacatctatttt

SEQ ID NO: 4966608 - DNA, 16 bp, Homo sapiens
tgtacatgagaaggaa

SEQ ID NO: 4966609 - DNA, 14 bp, Homo sapiens
tgtacatgcattca

SEQ ID NO: 4966610 - DNA, 17 bp, Homo sapiens
tgtacatggcagagttt

SEQ ID NO: 4966611 - DNA, 11 bp, Homo sapiens
tgtacatgtgt

SEQ ID NO: 4966612 - DNA, 21 bp, Homo sapiens
tgtacatgtgtagcctgtgca

SEQ ID NO: 4966613 - DNA, 20 bp, Homo sapiens
tgtacatttcacaggctaat

SEQ ID NO: 4966614 - DNA, 23 bp, Homo sapiens
tgtacattttgttgtaaaaagaa

SEQ ID NO: 4966615 - DNA, 21 bp, Homo sapiens
tgtaccatgaaacaaagctgc

SEQ ID NO: 4966616 - DNA, 18 bp, Homo sapiens
tgtacctcccctgccttg

SEQ ID NO: 4966617 - DNA, 16 bp, Homo sapiens
tgtacctgtgtacata

SEQ ID NO: 4966618 - DNA, 18 bp, Homo sapiens
tgtaccttctttcactct

SEQ ID NO: 4966619 - DNA, 21 bp, Homo sapiens
tgtaccttttgaggagcccca

SEQ ID NO: 4966620 - DNA, 22 bp, Homo sapiens
tgtaccttttgaggagccccag

SEQ ID NO: 4966621 - DNA, 16 bp, Homo sapiens
tgtacgtctgacaggc

SEQ ID NO: 4966622 - DNA, 14 bp, Homo sapiens
tgtactacctgtgt

SEQ ID NO: 4966623 - DNA, 21 bp, Homo sapiens
tgtactagtactgtgtactgt

SEQ ID NO: 4966624 - DNA, 12 bp, Homo sapiens
tgtactcctccc

SEQ ID NO: 4966625 - DNA, 13 bp, Homo sapiens
tgtactcctccca

SEQ ID NO: 4966626 - DNA, 19 bp, Homo sapiens
tgtactctggggtgctgcc

SEQ ID NO: 4966627 - DNA, 18 bp, Homo sapiens
tgtactgcatgttaccat

SEQ ID NO: 4966628 - DNA, 16 bp, Homo sapiens
tgtactgctcaggctg

SEQ ID NO: 4966629 - DNA, 17 bp, Homo sapiens
tgtactgctcaggctgc

SEQ ID NO: 4966630 - DNA, 20 bp, Homo sapiens
tgtactgctcaggctgcagc

SEQ ID NO: 4966631 - DNA, 16 bp, Homo sapiens
tgtactgtactaattc

SEQ ID NO: 4966632 - DNA, 16 bp, Homo sapiens
tgtactgttctgtgtc

SEQ ID NO: 4966633 - DNA, 11 bp, Homo sapiens
tgtacttcctg

SEQ ID NO: 4966634 - DNA, 12 bp, Homo sapiens
tgtacttcctga

SEQ ID NO: 4966635 - DNA, 22 bp, Homo sapiens
tgtacttggagtattggggtct

SEQ ID NO: 4966636 - DNA, 16 bp, Homo sapiens
tgtagaatgatttcat

SEQ ID NO: 4966637 - DNA, 18 bp, Homo sapiens
tgtagactatatacatgt

SEQ ID NO: 4966638 - DNA, 15 bp, Homo sapiens
tgtagagccagggtc

SEQ ID NO: 4966639 - DNA, 18 bp, Homo sapiens
tgtagagccagggtctca

SEQ ID NO: 4966640 - DNA, 12 bp, Homo sapiens
tgtagagttaag

SEQ ID NO: 4966641 - DNA, 14 bp, Homo sapiens
tgtagagttaagaa

SEQ ID NO: 4966642 - DNA, 17 bp, Homo sapiens
tgtagatatttggctta

SEQ ID NO: 4966643 - DNA, 13 bp, Homo sapiens
tgtagatcccaag

SEQ ID NO: 4966644 - DNA, 15 bp, Homo sapiens
tgtagatgatgtatt

SEQ ID NO: 4966645 - DNA, 11 bp, Homo sapiens
tgtagcagtga

SEQ ID NO: 4966646 - DNA, 13 bp, Homo sapiens
tggtacatgtctt

SEQ ID NO: 4966647 - DNA, 17 bp, Homo sapiens
tggtacatgtcttccat

SEQ ID NO: 4966648 - DNA, 21 bp, Homo sapiens
tggtaccaatcatgaatcttt

SEQ ID NO: 4966649 - DNA, 14 bp, Homo sapiens
tggtaccagccctg

SEQ ID NO: 4966650 - DNA, 20 bp, Homo sapiens
tggtaccagccctggggctg

SEQ ID NO: 4966651 - DNA, 16 bp, Homo sapiens
tggtaccctcctggct

SEQ ID NO: 4966652 - DNA, 21 bp, Homo sapiens
tggtaccctcctggctcttga

SEQ ID NO: 4966653 - DNA, 22 bp, Homo sapiens
tggtactccctctcaggatcca

SEQ ID NO: 4966654 - DNA, 18 bp, Homo sapiens
tggtacttttgagtgtgt

SEQ ID NO: 4966655 - DNA, 20 bp, Homo sapiens
tggtacttttgagtgtgtgt

SEQ ID NO: 4966656 - DNA, 15 bp, Homo sapiens
tggtagattaaatat

SEQ ID NO: 4966657 - DNA, 19 bp, Homo sapiens
tggtagattaaatatagat

SEQ ID NO: 4966658 - DNA, 20 bp, Homo sapiens
tggtagattaaatatagatt

SEQ ID NO: 4966659 - DNA, 20 bp, Homo sapiens
tggtagcttttcccttcttt

SEQ ID NO: 4966660 - DNA, 19 bp, Homo sapiens
tggtatggaactctctcca

SEQ ID NO: 4966661 - DNA, 19 bp, Homo sapiens
tggtatgtgacaccaaagc

SEQ ID NO: 4966662 - DNA, 20 bp, Homo sapiens
tggtattacactgtatttgt

SEQ ID NO: 4966663 - DNA, 22 bp, Homo sapiens
tggtcaatccgaagtatgaggg

SEQ ID NO: 4966664 - DNA, 13 bp, Homo sapiens
tggtcacagcctc

SEQ ID NO: 4966665 - DNA, 16 bp, Homo sapiens
tggtcacagcctcctc

SEQ ID NO: 4966666 - DNA, 20 bp, Homo sapiens
tggtcacaggactctgcctc

SEQ ID NO: 4966667 - DNA, 22 bp, Homo sapiens
tggtcacaggactctgcctcct

SEQ ID NO: 4966668 - DNA, 13 bp, Homo sapiens
tggtcacagggca

SEQ ID NO: 4966669 - DNA, 15 bp, Homo sapiens
tggtccaagattccg

SEQ ID NO: 4966670 - DNA, 13 bp, Homo sapiens
tggtccctgcctt

SEQ ID NO: 4966671 - DNA, 16 bp, Homo sapiens
tggtccggacactcct

SEQ ID NO: 4966672 - DNA, 21 bp, Homo sapiens
tggtcctaaaagcaaaataaa

SEQ ID NO: 4966673 - DNA, 18 bp, Homo sapiens
tggtctaaaaataaacca

SEQ ID NO: 4966674 - DNA, 17 bp, Homo sapiens
tggtctaacactggcat

SEQ ID NO: 4966675 - DNA, 23 bp, Homo sapiens
tggtctaacactggcatgttcaa

SEQ ID NO: 4966676 - DNA, 16 bp, Homo sapiens
tggtctcaaactcttg

SEQ ID NO: 4966677 - DNA, 23 bp, Homo sapiens
tggtctcaaactcttgacctcag

SEQ ID NO: 4966678 - DNA, 18 bp, Homo sapiens
tggtctgacccactgctt

SEQ ID NO: 4966679 - DNA, 14 bp, Homo sapiens
tggtctttcctctg

SEQ ID NO: 4966680 - DNA, 13 bp, Homo sapiens
tggtctttgtaag

SEQ ID NO: 4966681 - DNA, 18 bp, Homo sapiens
tggtgaaatttattagtt

SEQ ID NO: 4966682 - DNA, 19 bp, Homo sapiens
tggtgaatggccttccttc

SEQ ID NO: 4966683 - DNA, 15 bp, Homo sapiens
tggtgacctctgcct

SEQ ID NO: 4966684 - DNA, 16 bp, Homo sapiens
tggtgacctctgcctg

SEQ ID NO: 4966685 - DNA, 12 bp, Homo sapiens
tggtgacttcct

SEQ ID NO: 4966686 - DNA, 23 bp, Homo sapiens
tggtgacttcctcgcctctccca

SEQ ID NO: 4966687 - DNA, 13 bp, Homo sapiens
tggtgaggagcac

SEQ ID NO: 4966688 - DNA, 21 bp, Homo sapiens
tggtgatctcccaagctatct

SEQ ID NO: 4966689 - DNA, 13 bp, Homo sapiens
tggtgcagacaga

SEQ ID NO: 4966690 - DNA, 22 bp, Homo sapiens
tggtgcagacagaagtctcctc

SEQ ID NO: 4966691 - DNA, 15 bp, Homo sapiens
tggtgcatagaactg

SEQ ID NO: 4966692 - DNA, 18 bp, Homo sapiens
tggtgcatagaactgggt

SEQ ID NO: 4966693 - DNA, 12 bp, Homo sapiens
tggtgcctggcc

SEQ ID NO: 4966694 - DNA, 14 bp, Homo sapiens
tggtgcctggcctg

SEQ ID NO: 4966695 - DNA, 16 bp, Homo sapiens
tggtgcgatctgggtt

SEQ ID NO: 4966696 - DNA, 17 bp, Homo sapiens
tggtgcgatctgggttc

SEQ ID NO: 4966697 - DNA, 21 bp, Homo sapiens
tggtgctcaccatgcttccag

SEQ ID NO: 4966698 - DNA, 18 bp, Homo sapiens
tggtgctgccacacttca

SEQ ID NO: 4966699 - DNA, 19 bp, Homo sapiens
tggtgcttccaaatattgt

SEQ ID NO: 4966700 - DNA, 14 bp, Homo sapiens
tggtggcagctgcg

SEQ ID NO: 4966701 - DNA, 18 bp, Homo sapiens
tggtggcagtgggagctg

SEQ ID NO: 4966702 - DNA, 20 bp, Homo sapiens
tggtggcagtgggagctgcc

SEQ ID NO: 4966703 - DNA, 21 bp, Homo sapiens
tggtggcccgacagcctggca

SEQ ID NO: 4966704 - DNA, 13 bp, Homo sapiens
tggtggctttcct

SEQ ID NO: 4966705 - DNA, 22 bp, Homo sapiens
tggtgggaggggcgcccacctc

SEQ ID NO: 4966706 - DNA, 21 bp, Homo sapiens
tggtgggttcaggggactcag

SEQ ID NO: 4966707 - DNA, 13 bp, Homo sapiens
tggtgtaataaga

SEQ ID NO: 4966708 - DNA, 14 bp, Homo sapiens
tggtgtaataagac

SEQ ID NO: 4966709 - DNA, 15 bp, Homo sapiens
tggtgtaataagaca

SEQ ID NO: 4966710 - DNA, 23 bp, Homo sapiens
tggtgtatcccccccctgtatag

SEQ ID NO: 4966711 - DNA, 16 bp, Homo sapiens
tggtgtcacctgaaga

SEQ ID NO: 4966712 - DNA, 17 bp, Homo sapiens
tggttaagagtccaaga

SEQ ID NO: 4966713 - DNA, 13 bp, Homo sapiens
tggttatgaaaga

SEQ ID NO: 4966714 - DNA, 20 bp, Homo sapiens
tggttatgaaagaatatatt

SEQ ID NO: 4966715 - DNA, 22 bp, Homo sapiens
tggttcagggttggcccctgcc

SEQ ID NO: 4966716 - DNA, 11 bp, Homo sapiens
tggttcccctg

SEQ ID NO: 4966717 - DNA, 19 bp, Homo sapiens
tggttcccctgttcactct

SEQ ID NO: 4966718 - DNA, 23 bp, Homo sapiens
tggttcccctgttcactctactt

SEQ ID NO: 4966719 - DNA, 20 bp, Homo sapiens
tggttcccgtttctccacct

SEQ ID NO: 4966720 - DNA, 15 bp, Homo sapiens
tggttctgcttcaat

SEQ ID NO: 4966721 - DNA, 18 bp, Homo sapiens
tggttgatgatctttgca

SEQ ID NO: 4966722 - DNA, 18 bp, Homo sapiens
tggttgccttaaagaaag

SEQ ID NO: 4966723 - DNA, 22 bp, Homo sapiens
tggtttacaggccctgctcctg

SEQ ID NO: 4966724 - DNA, 14 bp, Homo sapiens
tggtttactttcaa

SEQ ID NO: 4966725 - DNA, 20 bp, Homo sapiens
tggtttatattttttcagtt

SEQ ID NO: 4966726 - DNA, 16 bp, Homo sapiens
tggtttattttgtatt

SEQ ID NO: 4966727 - DNA, 16 bp, Homo sapiens
tggtttctcattcttg

SEQ ID NO: 4966728 - DNA, 13 bp, Homo sapiens
tggtttgagattg

SEQ ID NO: 4966729 - DNA, 20 bp, Homo sapiens
tggtttgggaatatccatgt

SEQ ID NO: 4966730 - DNA, 18 bp, Homo sapiens
tggttttaacaatttcct

SEQ ID NO: 4966731 - DNA, 14 bp, Homo sapiens
tggttttagatttt

SEQ ID NO: 4966732 - DNA, 19 bp, Homo sapiens
tgtaaaaaaaaatgccttt

SEQ ID NO: 4966733 - DNA, 17 bp, Homo sapiens
tgtaaaaaagaaaaaca

SEQ ID NO: 4966734 - DNA, 14 bp, Homo sapiens
tgtaaaaacactga

SEQ ID NO: 4966735 - DNA, 18 bp, Homo sapiens
tgtaaaacctgtcaatga

SEQ ID NO: 4966736 - DNA, 12 bp, Homo sapiens
tgtaaaacgctg

SEQ ID NO: 4966737 - DNA, 18 bp, Homo sapiens
tgtaaaataagaatgatt

SEQ ID NO: 4966738 - DNA, 17 bp, Homo sapiens
tgtaaaatagcttgtat

SEQ ID NO: 4966739 - DNA, 20 bp, Homo sapiens
tgtaaaatagcttgtatagt

SEQ ID NO: 4966740 - DNA, 14 bp, Homo sapiens
tgtaaacaaactct

SEQ ID NO: 4966741 - DNA, 22 bp, Homo sapiens
tgtaaacatgtgttttaattcc

SEQ ID NO: 4966742 - DNA, 22 bp, Homo sapiens
tgtaaactcaaaacttaacata

SEQ ID NO: 4966743 - DNA, 14 bp, Homo sapiens
tgtaaataaaaaga

SEQ ID NO: 4966744 - DNA, 15 bp, Homo sapiens
tgtaaataccaggat

SEQ ID NO: 4966745 - DNA, 20 bp, Homo sapiens
tgtaaataccattgacacat

SEQ ID NO: 4966746 - DNA, 16 bp, Homo sapiens
tgtaaatagctcaggt

SEQ ID NO: 4966747 - DNA, 17 bp, Homo sapiens
tgtaaatgttatttctg

SEQ ID NO: 4966748 - DNA, 22 bp, Homo sapiens
tgtaaatgttatttctgcaaac

SEQ ID NO: 4966749 - DNA, 23 bp, Homo sapiens
tgtaaattaggaggctcaacaat

SEQ ID NO: 4966750 - DNA, 17 bp, Homo sapiens
tgtaacatactggcctg

SEQ ID NO: 4966751 - DNA, 18 bp, Homo sapiens
tgtaacggttaactgtaa

SEQ ID NO: 4966752 - DNA, 22 bp, Homo sapiens
tgtaacgttttctttcacacac

SEQ ID NO: 4966753 - DNA, 21 bp, Homo sapiens
tgtaactaggctcagagatgt

SEQ ID NO: 4966754 - DNA, 23 bp, Homo sapiens
tgtaactatagactggaaaaaat

SEQ ID NO: 4966755 - DNA, 16 bp, Homo sapiens
tgtaacttatattgaa

SEQ ID NO: 4966756 - DNA, 13 bp, Homo sapiens
tgtaacttatgta

SEQ ID NO: 4966757 - DNA, 20 bp, Homo sapiens
tgcattctattgccttcttt

SEQ ID NO: 4966758 - DNA, 22 bp, Homo sapiens
tgcattctattgccttctttga

SEQ ID NO: 4966759 - DNA, 13 bp, Homo sapiens
tgcattgaacaca

SEQ ID NO: 4966760 - DNA, 15 bp, Homo sapiens
tgcattgaacacaaa

SEQ ID NO: 4966761 - DNA, 22 bp, Homo sapiens
tgcattgaccgcgactaatttc

SEQ ID NO: 4966762 - DNA, 14 bp, Homo sapiens
tgcattgactttca

SEQ ID NO: 4966763 - DNA, 21 bp, Homo sapiens
tgcattgactttcagtaaaca

SEQ ID NO: 4966764 - DNA, 15 bp, Homo sapiens
tgcattgctagataa

SEQ ID NO: 4966765 - DNA, 14 bp, Homo sapiens
tgcatttatatgta

SEQ ID NO: 4966766 - DNA, 13 bp, Homo sapiens
tgcatttcctgac

SEQ ID NO: 4966767 - DNA, 18 bp, Homo sapiens
tgcatttctgaatagaaa

SEQ ID NO: 4966768 - DNA, 17 bp, Homo sapiens
tgcattttcaccccacc

SEQ ID NO: 4966769 - DNA, 20 bp, Homo sapiens
tgccaaagctagggtggccc

SEQ ID NO: 4966770 - DNA, 22 bp, Homo sapiens
tgccaaagctagggtggccctt

SEQ ID NO: 4966771 - DNA, 18 bp, Homo sapiens
tgccaaagggaaatatca

SEQ ID NO: 4966772 - DNA, 16 bp, Homo sapiens
tgccaaggccagagtg

SEQ ID NO: 4966773 - DNA, 21 bp, Homo sapiens
tgccaaggccagagtggcctg

SEQ ID NO: 4966774 - DNA, 16 bp, Homo sapiens
tgccaatatgtattgt

SEQ ID NO: 4966775 - DNA, 19 bp, Homo sapiens
tgccaatatgtattgtaaa

SEQ ID NO: 4966776 - DNA, 15 bp, Homo sapiens
tgccaattagcaatt

SEQ ID NO: 4966777 - DNA, 21 bp, Homo sapiens
tgccaattattgttacacatt

SEQ ID NO: 4966778 - DNA, 22 bp, Homo sapiens
tgccacaccctcccccgccact

SEQ ID NO: 4966779 - DNA, 18 bp, Homo sapiens
tgccacactctccatcac

SEQ ID NO: 4966780 - DNA, 12 bp, Homo sapiens
tgccacacttca

SEQ ID NO: 4966781 - DNA, 14 bp, Homo sapiens
tgccacacttcagg

SEQ ID NO: 4966782 - DNA, 15 bp, Homo sapiens
tgccacacttcaggc

SEQ ID NO: 4966783 - DNA, 22 bp, Homo sapiens
tgccacagctggagctctcaaa

SEQ ID NO: 4966784 - DNA, 16 bp, Homo sapiens
tgccaccacctctgtg

SEQ ID NO: 4966785 - DNA, 18 bp, Homo sapiens
tgccaccacctctgtggc

SEQ ID NO: 4966786 - DNA, 13 bp, Homo sapiens
tgccaccagagac

SEQ ID NO: 4966787 - DNA, 18 bp, Homo sapiens
tgccaccagagaccgtcc

SEQ ID NO: 4966788 - DNA, 14 bp, Homo sapiens
tgccaccaggagaa

SEQ ID NO: 4966789 - DNA, 21 bp, Homo sapiens
tgccacccaggtgatgttagt

SEQ ID NO: 4966790 - DNA, 14 bp, Homo sapiens
tgccaccctagcca

SEQ ID NO: 4966791 - DNA, 20 bp, Homo sapiens
tgccaccctggggagaaagt

SEQ ID NO: 4966792 - DNA, 15 bp, Homo sapiens
tgccacgttccacag

SEQ ID NO: 4966793 - DNA, 16 bp, Homo sapiens
tgccacgttccacagt

SEQ ID NO: 4966794 - DNA, 18 bp, Homo sapiens
tgccactaattttagtat

SEQ ID NO: 4966795 - DNA, 13 bp, Homo sapiens
tgccactgcctct

SEQ ID NO: 4966796 - DNA, 17 bp, Homo sapiens
tgccactgcctcttcct

SEQ ID NO: 4966797 - DNA, 18 bp, Homo sapiens
tgccactgcctcttcctc

SEQ ID NO: 4966798 - DNA, 19 bp, Homo sapiens
tgccactgcctcttcctcc

SEQ ID NO: 4966799 - DNA, 20 bp, Homo sapiens
tgccactgcctcttcctccc

SEQ ID NO: 4966800 - DNA, 19 bp, Homo sapiens
tgccactggggaaaactcc

SEQ ID NO: 4966801 - DNA, 19 bp, Homo sapiens
tgccacttgaacaaaatct

SEQ ID NO: 4966802 - DNA, 13 bp, Homo sapiens
tgccactttgcac

SEQ ID NO: 4966803 - DNA, 21 bp, Homo sapiens
tgccactttgcacattttgat

SEQ ID NO: 4966804 - DNA, 17 bp, Homo sapiens
tgccagaattttaggaa

SEQ ID NO: 4966805 - DNA, 21 bp, Homo sapiens
tgccagaggaatcctggcagc

SEQ ID NO: 4966806 - DNA, 22 bp, Homo sapiens
tgccagaggaatcctggcagcc

SEQ ID NO: 4966807 - DNA, 15 bp, Homo sapiens
tgccagcagcagcag

SEQ ID NO: 4966808 - DNA, 17 bp, Homo sapiens
tgccagcagcagcaggt

SEQ ID NO: 4966809 - DNA, 18 bp, Homo sapiens
tgccagcagcagcaggtg

SEQ ID NO: 4966810 - DNA, 18 bp, Homo sapiens
tgccagccccacacagct

SEQ ID NO: 4966811 - DNA, 13 bp, Homo sapiens
tgccaggacacgc

SEQ ID NO: 4966812 - DNA, 12 bp, Homo sapiens
tgccagggagct

SEQ ID NO: 4966813 - DNA, 17 bp, Homo sapiens
tgccaggtttttggtct

SEQ ID NO: 4966814 - DNA, 19 bp, Homo sapiens
tgccaggtttttggtctga

SEQ ID NO: 4966815 - DNA, 22 bp, Homo sapiens
tgccaggtttttggtctgaccc

SEQ ID NO: 4966816 - DNA, 24 bp, Homo sapiens
tgccaggtttttggtctgacccac

SEQ ID NO: 4966817 - DNA, 17 bp, Homo sapiens
tgccagtccccctgccc

SEQ ID NO: 4966818 - DNA, 19 bp, Homo sapiens
tgccagtccccctgcccca

SEQ ID NO: 4966819 - DNA, 22 bp, Homo sapiens
tgccatacatcagttattcatt

SEQ ID NO: 4966820 - DNA, 18 bp, Homo sapiens
tgccatagagtttaacac

SEQ ID NO: 4966821 - DNA, 20 bp, Homo sapiens
tgccatagagtttaacacaa

SEQ ID NO: 4966822 - DNA, 16 bp, Homo sapiens
tgccatagtcacatgg

SEQ ID NO: 4966823 - DNA, 16 bp, Homo sapiens
tgccatattctgttgg

SEQ ID NO: 4966824 - DNA, 17 bp, Homo sapiens
tgccatattctgttggc

SEQ ID NO: 4966825 - DNA, 21 bp, Homo sapiens
tgccatcctaaaagccacccc

SEQ ID NO: 4966826 - DNA, 19 bp, Homo sapiens
tgccatgggcttcactgta

SEQ ID NO: 4966827 - DNA, 12 bp, Homo sapiens
tgccatgtacct

SEQ ID NO: 4966828 - DNA, 19 bp, Homo sapiens
tgccatgtacctcccctgc

SEQ ID NO: 4966829 - DNA, 22 bp, Homo sapiens
tgccatgtacctcccctgcctt

SEQ ID NO: 4966830 - DNA, 23 bp, Homo sapiens
tgccatgtacctcccctgccttg

SEQ ID NO: 4966831 - DNA, 15 bp, Homo sapiens
tgccatgtgccaggt

SEQ ID NO: 4966832 - DNA, 15 bp, Homo sapiens
tgccatgttggccag

SEQ ID NO: 4966833 - DNA, 17 bp, Homo sapiens
tgccatgttggccaggc

SEQ ID NO: 4966834 - DNA, 18 bp, Homo sapiens
tgccatgttggccaggct

SEQ ID NO: 4966835 - DNA, 19 bp, Homo sapiens
tgccatgttggccaggctg

SEQ ID NO: 4966836 - DNA, 20 bp, Homo sapiens
tgccatgttggccaggctgg

SEQ ID NO: 4966837 - DNA, 21 bp, Homo sapiens
tgccatgttggccaggctggt

SEQ ID NO: 4966838 - DNA, 16 bp, Homo sapiens
tgccattcatagagag

SEQ ID NO: 4966839 - DNA, 17 bp, Homo sapiens
tgccatttaaaaagttg

SEQ ID NO: 4966840 - DNA, 14 bp, Homo sapiens
tgccatttatttat

SEQ ID NO: 4966841 - DNA, 23 bp, Homo sapiens
tgcccaaagagcacaaacatttt

SEQ ID NO: 4966842 - DNA, 20 bp, Homo sapiens
tgcccaatgagactctaggg

SEQ ID NO: 4966843 - DNA, 21 bp, Homo sapiens
tgcccaatgagactctagggt

SEQ ID NO: 4966844 - DNA, 21 bp, Homo sapiens
tgcccaattggaggaaagcaa

SEQ ID NO: 4966845 - DNA, 18 bp, Homo sapiens
tgcccacgctggagtgca

SEQ ID NO: 4966846 - DNA, 19 bp, Homo sapiens
tggaagatagttttctcct

SEQ ID NO: 4966847 - DNA, 14 bp, Homo sapiens
tggaagattcagct

SEQ ID NO: 4966848 - DNA, 18 bp, Homo sapiens
tggaagcaacaggaatca

SEQ ID NO: 4966849 - DNA, 18 bp, Homo sapiens
tggaagctgccctgccca

SEQ ID NO: 4966850 - DNA, 14 bp, Homo sapiens
tggaaggcagacag

SEQ ID NO: 4966851 - DNA, 18 bp, Homo sapiens
tggaagttcatacctaag

SEQ ID NO: 4966852 - DNA, 23 bp, Homo sapiens
tggaagttcatacctaagtactg

SEQ ID NO: 4966853 - DNA, 15 bp, Homo sapiens
tggaataaaaggctt

SEQ ID NO: 4966854 - DNA, 14 bp, Homo sapiens
tggaataatgtaaa

SEQ ID NO: 4966855 - DNA, 17 bp, Homo sapiens
tggaatgaattaaataa

SEQ ID NO: 4966856 - DNA, 23 bp, Homo sapiens
tggaatgtggcccctgaacaaga

SEQ ID NO: 4966857 - DNA, 17 bp, Homo sapiens
tggaattaaaaggatag

SEQ ID NO: 4966858 - DNA, 16 bp, Homo sapiens
tggaattgatttgcat

SEQ ID NO: 4966859 - DNA, 18 bp, Homo sapiens
tggaattgatttgcattg

SEQ ID NO: 4966860 - DNA, 17 bp, Homo sapiens
tggaatttcttgtttct

SEQ ID NO: 4966861 - DNA, 22 bp, Homo sapiens
tggacaaactggagtctggagt

SEQ ID NO: 4966862 - DNA, 23 bp, Homo sapiens
tggacacagctcttctccaggct

SEQ ID NO: 4966863 - DNA, 16 bp, Homo sapiens
tggacactcagacctg

SEQ ID NO: 4966864 - DNA, 14 bp, Homo sapiens
tggacagaggggac

SEQ ID NO: 4966865 - DNA, 22 bp, Homo sapiens
tggacaggcatgttctctgagg

SEQ ID NO: 4966866 - DNA, 23 bp, Homo sapiens
tggacaggcatgttctctgagga

SEQ ID NO: 4966867 - DNA, 20 bp, Homo sapiens
tggacagtcactgccacttt

SEQ ID NO: 4966868 - DNA, 19 bp, Homo sapiens
tggacagttcacaccctgc

SEQ ID NO: 4966869 - DNA, 22 bp, Homo sapiens
tggacagttcacaccctgcaag

SEQ ID NO: 4966870 - DNA, 19 bp, Homo sapiens
tggacatagatattttcac

SEQ ID NO: 4966871 - DNA, 22 bp, Homo sapiens
tggacatttgccttgctggacg

SEQ ID NO: 4966872 - DNA, 20 bp, Homo sapiens
tggaccactgcatgagcttt

SEQ ID NO: 4966873 - DNA, 15 bp, Homo sapiens
tggaccactgtttct

SEQ ID NO: 4966874 - DNA, 18 bp, Homo sapiens
tggaccactgtttcttgc

SEQ ID NO: 4966875 - DNA, 23 bp, Homo sapiens
tggaccactgtttcttgcttgta

SEQ ID NO: 4966876 - DNA, 15 bp, Homo sapiens
tggaccttaggcctt

SEQ ID NO: 4966877 - DNA, 16 bp, Homo sapiens
tggaccttaggccttc

SEQ ID NO: 4966878 - DNA, 17 bp, Homo sapiens
tggaccttaggccttcc

SEQ ID NO: 4966879 - DNA, 19 bp, Homo sapiens
tggaccttaggccttcctc

SEQ ID NO: 4966880 - DNA, 14 bp, Homo sapiens
tggacgtctttctt

SEQ ID NO: 4966881 - DNA, 16 bp, Homo sapiens
tggactaaatgcctag

SEQ ID NO: 4966882 - DNA, 22 bp, Homo sapiens
tggactaaccccaacgcacagg

SEQ ID NO: 4966883 - DNA, 19 bp, Homo sapiens
tggactcaatccctagggc

SEQ ID NO: 4966884 - DNA, 13 bp, Homo sapiens
tggactcctctgt

SEQ ID NO: 4966885 - DNA, 14 bp, Homo sapiens
tggactcctctgtc

SEQ ID NO: 4966886 - DNA, 21 bp, Homo sapiens
tggactctaaagaccaaactt

SEQ ID NO: 4966887 - DNA, 18 bp, Homo sapiens
tggactctgcacatgtct

SEQ ID NO: 4966888 - DNA, 19 bp, Homo sapiens
tggactctgcacatgtctt

SEQ ID NO: 4966889 - DNA, 14 bp, Homo sapiens
tggactctgcatcc

SEQ ID NO: 4966890 - DNA, 20 bp, Homo sapiens
tggactctgcatcccagcac

SEQ ID NO: 4966891 - DNA, 21 bp, Homo sapiens
tggactcttcaaaaactgttt

SEQ ID NO: 4966892 - DNA, 22 bp, Homo sapiens
tggactgacagcatgtgccctc

SEQ ID NO: 4966893 - DNA, 17 bp, Homo sapiens
tggactggcccctgggt

SEQ ID NO: 4966894 - DNA, 19 bp, Homo sapiens
tggactggctagagtcctc

SEQ ID NO: 4966895 - DNA, 22 bp, Homo sapiens
tggactggctagagtcctcact

SEQ ID NO: 4966896 - DNA, 20 bp, Homo sapiens
tggactgtggcacttgcctg

SEQ ID NO: 4966897 - DNA, 17 bp, Homo sapiens
tggactgttttctctcg

SEQ ID NO: 4966898 - DNA, 22 bp, Homo sapiens
tggactgttttctctcggctcc

SEQ ID NO: 4966899 - DNA, 16 bp, Homo sapiens
tggactttcaaaatta

SEQ ID NO: 4966900 - DNA, 14 bp, Homo sapiens
tggagaactagaga

SEQ ID NO: 4966901 - DNA, 18 bp, Homo sapiens
tggagaattgctgaaggg

SEQ ID NO: 4966902 - DNA, 22 bp, Homo sapiens
tggagaattgctgaagggcatt

SEQ ID NO: 4966903 - DNA, 22 bp, Homo sapiens
tggagacagccccagagcaggg

SEQ ID NO: 4966904 - DNA, 12 bp, Homo sapiens
tggagacgtgga

SEQ ID NO: 4966905 - DNA, 22 bp, Homo sapiens
tggagacgtggaacctctgtct

SEQ ID NO: 4966906 - DNA, 21 bp, Homo sapiens
tggagagaaacaataaagaga

SEQ ID NO: 4966907 - DNA, 21 bp, Homo sapiens
tggagagaaggcctccctagc

SEQ ID NO: 4966908 - DNA, 21 bp, Homo sapiens
tggagagcccggcgcccctgc

SEQ ID NO: 4966909 - DNA, 16 bp, Homo sapiens
tggagagctggtgccc

SEQ ID NO: 4966910 - DNA, 16 bp, Homo sapiens
tggagagtcagatctt

SEQ ID NO: 4966911 - DNA, 15 bp, Homo sapiens
tggagcaaagctgat

SEQ ID NO: 4966912 - DNA, 17 bp, Homo sapiens
tggagcagaccaccccg

SEQ ID NO: 4966913 - DNA, 22 bp, Homo sapiens
tggagcagtacatgggaaagga

SEQ ID NO: 4966914 - DNA, 14 bp, Homo sapiens
tggagcctggcaca

SEQ ID NO: 4966915 - DNA, 18 bp, Homo sapiens
tggagcctggcacaggac

SEQ ID NO: 4966916 - DNA, 21 bp, Homo sapiens
tggaggaaaaccaagccgtgg

SEQ ID NO: 4966917 - DNA, 14 bp, Homo sapiens
tggaggaaagcaac

SEQ ID NO: 4966918 - DNA, 17 bp, Homo sapiens
tggaggatcagtttttt

SEQ ID NO: 4966919 - DNA, 16 bp, Homo sapiens
tggaggccctcctgtg

SEQ ID NO: 4966920 - DNA, 17 bp, Homo sapiens
tggaggtgggagcagga

SEQ ID NO: 4966921 - DNA, 18 bp, Homo sapiens
tggaggtgggagcaggag

SEQ ID NO: 4966922 - DNA, 14 bp, Homo sapiens
tggagtcccctcac

SEQ ID NO: 4966923 - DNA, 19 bp, Homo sapiens
tggagtcccctcacctcct

SEQ ID NO: 4966924 - DNA, 20 bp, Homo sapiens
tggagtcccctcacctcctc

SEQ ID NO: 4966925 - DNA, 16 bp, Homo sapiens
tggagtctggagtggg

SEQ ID NO: 4966926 - DNA, 17 bp, Homo sapiens
tggagtctggagtgggc

SEQ ID NO: 4966927 - DNA, 19 bp, Homo sapiens
tggagtctggagtgggcag

SEQ ID NO: 4966928 - DNA, 16 bp, Homo sapiens
tggagtggagtgagag

SEQ ID NO: 4966929 - DNA, 13 bp, Homo sapiens
tggagtttctaag

SEQ ID NO: 4966930 - DNA, 17 bp, Homo sapiens
tggataaaataatgctg

SEQ ID NO: 4966931 - DNA, 16 bp, Homo sapiens
tggatattattagaaa

SEQ ID NO: 4966932 - DNA, 19 bp, Homo sapiens
tggatcacgacgctgcaga

SEQ ID NO: 4966933 - DNA, 23 bp, Homo sapiens
tggatccaatgttagagactttt

SEQ ID NO: 4966934 - DNA, 14 bp, Homo sapiens
tggatcttgaatgt

SEQ ID NO: 4966935 - DNA, 13 bp, Homo sapiens
tggatgcaaagta

SEQ ID NO: 4966936 - DNA, 20 bp, Homo sapiens
tggatgccacagcccagctt

SEQ ID NO: 4966937 - DNA, 15 bp, Homo sapiens
tggatgcctggtggc

SEQ ID NO: 4966938 - DNA, 21 bp, Homo sapiens
tggatgcctggtggcagctgc

SEQ ID NO: 4966939 - DNA, 15 bp, Homo sapiens
tggatgttgtgtgta

SEQ ID NO: 4966940 - DNA, 15 bp, Homo sapiens
tggattatttaataa

SEQ ID NO: 4966941 - DNA, 16 bp, Homo sapiens
tggattatttaataac

SEQ ID NO: 4966942 - DNA, 20 bp, Homo sapiens
tggattatttaataacatta

SEQ ID NO: 4966943 - DNA, 13 bp, Homo sapiens
tggattcatcagc

SEQ ID NO: 4966944 - DNA, 23 bp, Homo sapiens
tggattcattctcataattccta

SEQ ID NO: 4966945 - DNA, 16 bp, Homo sapiens
tggattcattgtctct

SEQ ID NO: 4966946 - DNA, 13 bp, Homo sapiens
tggattccatgct

SEQ ID NO: 4966947 - DNA, 20 bp, Homo sapiens
tggattctgaggccctgccc

SEQ ID NO: 4966948 - DNA, 19 bp, Homo sapiens
tggattgcaatatctgaag

SEQ ID NO: 4966949 - DNA, 16 bp, Homo sapiens
tggattggattattta

SEQ ID NO: 4966950 - DNA, 20 bp, Homo sapiens
tggattggattatttaataa

SEQ ID NO: 4966951 - DNA, 12 bp, Homo sapiens
tggcaaatataa

SEQ ID NO: 4966952 - DNA, 13 bp, Homo sapiens
tggcaacagaagc

SEQ ID NO: 4966953 - DNA, 15 bp, Homo sapiens
tggcaacagaagcag

SEQ ID NO: 4966954 - DNA, 15 bp, Homo sapiens
tggcaagaaagctgg

SEQ ID NO: 4966955 - DNA, 18 bp, Homo sapiens
tggctctgtggcttgcta

SEQ ID NO: 4966956 - DNA, 15 bp, Homo sapiens
tggctcttctgccca

SEQ ID NO: 4966957 - DNA, 21 bp, Homo sapiens
tggctcttgatacccccctct

SEQ ID NO: 4966958 - DNA, 23 bp, Homo sapiens
tggctgactaaatttggggacag

SEQ ID NO: 4966959 - DNA, 17 bp, Homo sapiens
tggctgaggaggcctcc

SEQ ID NO: 4966960 - DNA, 14 bp, Homo sapiens
tggctgagggcagc

SEQ ID NO: 4966961 - DNA, 12 bp, Homo sapiens
tggctgcaaagg

SEQ ID NO: 4966962 - DNA, 14 bp, Homo sapiens
tggctgcagggagt

SEQ ID NO: 4966963 - DNA, 17 bp, Homo sapiens
tggctgccccaacctgc

SEQ ID NO: 4966964 - DNA, 19 bp, Homo sapiens
tggctggatgaaattttct

SEQ ID NO: 4966965 - DNA, 22 bp, Homo sapiens
tggctggatgaaattttctaga

SEQ ID NO: 4966966 - DNA, 17 bp, Homo sapiens
tggctgggggcaggagg

SEQ ID NO: 4966967 - DNA, 14 bp, Homo sapiens
tggctgggggcctc

SEQ ID NO: 4966968 - DNA, 20 bp, Homo sapiens
tggctgtaaggctctagatc

SEQ ID NO: 4966969 - DNA, 15 bp, Homo sapiens
tggctgtgcctctgc

SEQ ID NO: 4966970 - DNA, 18 bp, Homo sapiens
tggctgttggcagtgagt

SEQ ID NO: 4966971 - DNA, 23 bp, Homo sapiens
tggctgttggctgggggcctcag

SEQ ID NO: 4966972 - DNA, 13 bp, Homo sapiens
tggcttaaatata

SEQ ID NO: 4966973 - DNA, 22 bp, Homo sapiens
tggcttaaatatagttcctaag

SEQ ID NO: 4966974 - DNA, 22 bp, Homo sapiens
tggcttacctgacctcttgctg

SEQ ID NO: 4966975 - DNA, 16 bp, Homo sapiens
tggcttataggtgttg

SEQ ID NO: 4966976 - DNA, 14 bp, Homo sapiens
tggcttattttaat

SEQ ID NO: 4966977 - DNA, 16 bp, Homo sapiens
tggcttccatgatggt

SEQ ID NO: 4966978 - DNA, 15 bp, Homo sapiens
tggcttcccgctcag

SEQ ID NO: 4966979 - DNA, 13 bp, Homo sapiens
tggcttctgtgat

SEQ ID NO: 4966980 - DNA, 14 bp, Homo sapiens
tggcttctgtgatg

SEQ ID NO: 4966981 - DNA, 17 bp, Homo sapiens
tggcttgtagaattgtt

SEQ ID NO: 4966982 - DNA, 18 bp, Homo sapiens
tggcttgtagaattgtta

SEQ ID NO: 4966983 - DNA, 19 bp, Homo sapiens
tggcttgtagaattgttat

SEQ ID NO: 4966984 - DNA, 17 bp, Homo sapiens
tggctttatttgttttt

SEQ ID NO: 4966985 - DNA, 20 bp, Homo sapiens
tggctttccttgtggcagag

SEQ ID NO: 4966986 - DNA, 19 bp, Homo sapiens
tggcttttcactgctggct

SEQ ID NO: 4966987 - DNA, 21 bp, Homo sapiens
tggcttttcactgctggctgc

SEQ ID NO: 4966988 - DNA, 20 bp, Homo sapiens
tgggaaatgagaaggcagcc

SEQ ID NO: 4966989 - DNA, 12 bp, Homo sapiens
tgcaatttcaag

SEQ ID NO: 4966990 - DNA, 17 bp, Homo sapiens
tgcaatttcaaggttct

SEQ ID NO: 4966991 - DNA, 20 bp, Homo sapiens
tgcaatttcatatgctgtat

SEQ ID NO: 4966992 - DNA, 23 bp, Homo sapiens
tgcaatttgattgactgcccatt

SEQ ID NO: 4966993 - DNA, 15 bp, Homo sapiens
tgcacaaggattgaa

SEQ ID NO: 4966994 - DNA, 18 bp, Homo sapiens
tgcacaaggattgaaaat

SEQ ID NO: 4966995 - DNA, 20 bp, Homo sapiens
tgcacacaagcccacagcac

SEQ ID NO: 4966996 - DNA, 22 bp, Homo sapiens
tgcacacacacacacatgcaca

SEQ ID NO: 4966997 - DNA, 21 bp, Homo sapiens
tgcacacaccagagcccacct

SEQ ID NO: 4966998 - DNA, 18 bp, Homo sapiens
tgcacagagaagctgggg

SEQ ID NO: 4966999 - DNA, 16 bp, Homo sapiens
tgcacagatatacttt

SEQ ID NO: 4967000 - DNA, 16 bp, Homo sapiens
tgcacagcggcccctg

SEQ ID NO: 4967001 - DNA, 18 bp, Homo sapiens
tgcacagcggcccctgca

SEQ ID NO: 4967002 - DNA, 13 bp, Homo sapiens
tgcacagctgtcc

SEQ ID NO: 4967003 - DNA, 16 bp, Homo sapiens
tgcacagtgcatctca

SEQ ID NO: 4967004 - DNA, 18 bp, Homo sapiens
tgcacagtgcatctcagc

SEQ ID NO: 4967005 - DNA, 20 bp, Homo sapiens
tgcacagtgcatctcagccc

SEQ ID NO: 4967006 - DNA, 18 bp, Homo sapiens
tgcacatatggactctgc

SEQ ID NO: 4967007 - DNA, 19 bp, Homo sapiens
tgcacatatggactctgca

SEQ ID NO: 4967008 - DNA, 16 bp, Homo sapiens
tgcacatccattccca

SEQ ID NO: 4967009 - DNA, 24 bp, Homo sapiens
tgcacatcttggctatgtaattct

SEQ ID NO: 4967010 - DNA, 12 bp, Homo sapiens
tgcaccagagca

SEQ ID NO: 4967011 - DNA, 16 bp, Homo sapiens
tgcacccatggtacca

SEQ ID NO: 4967012 - DNA, 15 bp, Homo sapiens
tgcaccgggccacag

SEQ ID NO: 4967013 - DNA, 18 bp, Homo sapiens
tgcaccttaccaactttc

SEQ ID NO: 4967014 - DNA, 15 bp, Homo sapiens
tgcaccttgtgtctg

SEQ ID NO: 4967015 - DNA, 19 bp, Homo sapiens
tgcacgacgccctctcccc

SEQ ID NO: 4967016 - DNA, 13 bp, Homo sapiens
tgcacgcagatta

SEQ ID NO: 4967017 - DNA, 16 bp, Homo sapiens
tgcacgtacacacaca

SEQ ID NO: 4967018 - DNA, 12 bp, Homo sapiens
tgcacgtggaga

SEQ ID NO: 4967019 - DNA, 17 bp, Homo sapiens
tgcacgtggagagctgg

SEQ ID NO: 4967020 - DNA, 18 bp, Homo sapiens
tgcacgtggagagctggt

SEQ ID NO: 4967021 - DNA, 21 bp, Homo sapiens
tgcacgtggagagctggtgcc

SEQ ID NO: 4967022 - DNA, 14 bp, Homo sapiens
tgcacgtgtgtgca

SEQ ID NO: 4967023 - DNA, 18 bp, Homo sapiens
tgcactaaagccagcctg

SEQ ID NO: 4967024 - DNA, 18 bp, Homo sapiens
tgcactaaatcagagaca

SEQ ID NO: 4967025 - DNA, 14 bp, Homo sapiens
tgcactcaacctta

SEQ ID NO: 4967026 - DNA, 20 bp, Homo sapiens
tgcactccagcctgggcaac

SEQ ID NO: 4967027 - DNA, 12 bp, Homo sapiens
tgcactcctcag

SEQ ID NO: 4967028 - DNA, 16 bp, Homo sapiens
tgcactcctcagggca

SEQ ID NO: 4967029 - DNA, 21 bp, Homo sapiens
tgcactgacattgttggccaa

SEQ ID NO: 4967030 - DNA, 16 bp, Homo sapiens
tgcactgacccttcca

SEQ ID NO: 4967031 - DNA, 16 bp, Homo sapiens
tgcacttgcagactct

SEQ ID NO: 4967032 - DNA, 17 bp, Homo sapiens
tgcactttgatgtcatg

SEQ ID NO: 4967033 - DNA, 20 bp, Homo sapiens
tgcagaactgccattatttt

SEQ ID NO: 4967034 - DNA, 21 bp, Homo sapiens
tgcagacacgccttcccctca

SEQ ID NO: 4967035 - DNA, 16 bp, Homo sapiens
tgcagactctacagag

SEQ ID NO: 4967036 - DNA, 20 bp, Homo sapiens
tgcagactctacagaggcca

SEQ ID NO: 4967037 - DNA, 15 bp, Homo sapiens
tgcagagagccattt

SEQ ID NO: 4967038 - DNA, 18 bp, Homo sapiens
tgcagagagccattttgt

SEQ ID NO: 4967039 - DNA, 22 bp, Homo sapiens
tgcagagagccattttgtgaat

SEQ ID NO: 4967040 - DNA, 21 bp, Homo sapiens
tgcagagcaggaaacatgact

SEQ ID NO: 4967041 - DNA, 17 bp, Homo sapiens
tgcagatgccaccctag

SEQ ID NO: 4967042 - DNA, 19 bp, Homo sapiens
tgcagcaaggccctgctgc

SEQ ID NO: 4967043 - DNA, 20 bp, Homo sapiens
tgcagcacggacaataaacc

SEQ ID NO: 4967044 - DNA, 22 bp, Homo sapiens
tgcagcacggacaataaacctc

SEQ ID NO: 4967045 - DNA, 18 bp, Homo sapiens
tgcagcatttgataatga

SEQ ID NO: 4967046 - DNA, 12 bp, Homo sapiens
tgcagcccatgc

SEQ ID NO: 4967047 - DNA, 18 bp, Homo sapiens
tgcagcccatgcccacct

SEQ ID NO: 4967048 - DNA, 19 bp, Homo sapiens
tgcagcccatgcccacctg

SEQ ID NO: 4967049 - DNA, 15 bp, Homo sapiens
tgcagccgccttcct

SEQ ID NO: 4967050 - DNA, 16 bp, Homo sapiens
tgcagccgccttcctt

SEQ ID NO: 4967051 - DNA, 17 bp, Homo sapiens
tgcagccgccttccttg

SEQ ID NO: 4967052 - DNA, 22 bp, Homo sapiens
tgcagcctcaacctcctgggct

SEQ ID NO: 4967053 - DNA, 22 bp, Homo sapiens
tgcagcgcagctggactctgca

SEQ ID NO: 4967054 - DNA, 17 bp, Homo sapiens
tgcagctcaactttctg

SEQ ID NO: 4967055 - DNA, 14 bp, Homo sapiens
tgcagctggacaga

SEQ ID NO: 4967056 - DNA, 23 bp, Homo sapiens
tgcagcttgtgtgcaaaagcagt

SEQ ID NO: 4967057 - DNA, 19 bp, Homo sapiens
tgcaggaatcaaaaattga

SEQ ID NO: 4967058 - DNA, 13 bp, Homo sapiens
tgcaggacttgag

SEQ ID NO: 4967059 - DNA, 11 bp, Homo sapiens
tgcaggccctt

SEQ ID NO: 4967060 - DNA, 19 bp, Homo sapiens
tgcaggctgagccactctc

SEQ ID NO: 4967061 - DNA, 12 bp, Homo sapiens
tgcagggcagcc

SEQ ID NO: 4967062 - DNA, 13 bp, Homo sapiens
tgcagggcagccc

SEQ ID NO: 4967063 - DNA, 15 bp, Homo sapiens
tgcagggccaggact

SEQ ID NO: 4967064 - DNA, 19 bp, Homo sapiens
tgcagggggtgtgtctgct

SEQ ID NO: 4967065 - DNA, 22 bp, Homo sapiens
tgcagggggtgtgtctgctcag

SEQ ID NO: 4967066 - DNA, 22 bp, Homo sapiens
tgcaggggtgacggccctcatc

SEQ ID NO: 4967067 - DNA, 21 bp, Homo sapiens
tgcaggtgctattgttactct

SEQ ID NO: 4967068 - DNA, 14 bp, Homo sapiens
tgcagtaaatcttt

SEQ ID NO: 4967069 - DNA, 18 bp, Homo sapiens
tgcagtactttacctcct

SEQ ID NO: 4967070 - DNA, 21 bp, Homo sapiens
tgcagtcagtcatgatggcac

SEQ ID NO: 4967071 - DNA, 23 bp, Homo sapiens
tgcagtctcctctttaaaacaaa

SEQ ID NO: 4967072 - DNA, 22 bp, Homo sapiens
tgcagtggtatgatcacggctc

SEQ ID NO: 4967073 - DNA, 21 bp, Homo sapiens
tgcagtggtgcgatctgggtt

SEQ ID NO: 4967074 - DNA, 15 bp, Homo sapiens
tgcatacagaaatat

SEQ ID NO: 4967075 - DNA, 14 bp, Homo sapiens
tgcatactggactc

SEQ ID NO: 4967076 - DNA, 16 bp, Homo sapiens
tgcatagaactgggta

SEQ ID NO: 4967077 - DNA, 17 bp, Homo sapiens
tgcatagaactgggtaa

SEQ ID NO: 4967078 - DNA, 21 bp, Homo sapiens
tgcatatgtcactagaatgga

SEQ ID NO: 4967079 - DNA, 16 bp, Homo sapiens
tgcatcacctctgtaa

SEQ ID NO: 4967080 - DNA, 17 bp, Homo sapiens
tgcatccaactccagga

SEQ ID NO: 4967081 - DNA, 20 bp, Homo sapiens
tgcatcccagcacctgcctc

SEQ ID NO: 4967082 - DNA, 22 bp, Homo sapiens
tcttattgcccacgctggagtg

SEQ ID NO: 4967083 - DNA, 17 bp, Homo sapiens
tcttattgcgctgctac

SEQ ID NO: 4967084 - DNA, 14 bp, Homo sapiens
tcttcaaaatgtat

SEQ ID NO: 4967085 - DNA, 17 bp, Homo sapiens
tcttcaaatccttccaa

SEQ ID NO: 4967086 - DNA, 18 bp, Homo sapiens
tcttcaacatcctgccag

SEQ ID NO: 4967087 - DNA, 19 bp, Homo sapiens
tcttcaactgaccagcctc

SEQ ID NO: 4967088 - DNA, 18 bp, Homo sapiens
tcttcacagctctgtgtt

SEQ ID NO: 4967089 - DNA, 11 bp, Homo sapiens
tcttcaccccg

SEQ ID NO: 4967090 - DNA, 17 bp, Homo sapiens
tcttcaccccggcaggc

SEQ ID NO: 4967091 - DNA, 23 bp, Homo sapiens
tcttcacctaagtctctgtgaat

SEQ ID NO: 4967092 - DNA, 14 bp, Homo sapiens
tcttcactccccct

SEQ ID NO: 4967093 - DNA, 23 bp, Homo sapiens
tcttcagactctcagcccagaag

SEQ ID NO: 4967094 - DNA, 18 bp, Homo sapiens
tcttcagcgtaaaatggt

SEQ ID NO: 4967095 - DNA, 13 bp, Homo sapiens
tcttcaggcctcc

SEQ ID NO: 4967096 - DNA, 18 bp, Homo sapiens
tcttcaggcctccctctc

SEQ ID NO: 4967097 - DNA, 21 bp, Homo sapiens
tcttcagttggttgtgtcttt

SEQ ID NO: 4967098 - DNA, 13 bp, Homo sapiens
tcttcatactttt

SEQ ID NO: 4967099 - DNA, 17 bp, Homo sapiens
tcttcatttcattgtat

SEQ ID NO: 4967100 - DNA, 21 bp, Homo sapiens
tcttcatttcattgtatgatg

SEQ ID NO: 4967101 - DNA, 13 bp, Homo sapiens
tcttccactttgc

SEQ ID NO: 4967102 - DNA, 15 bp, Homo sapiens
tcttccatcccagga

SEQ ID NO: 4967103 - DNA, 16 bp, Homo sapiens
tcttccatcccaggac

SEQ ID NO: 4967104 - DNA, 16 bp, Homo sapiens
tcttccatgtatcttt

SEQ ID NO: 4967105 - DNA, 20 bp, Homo sapiens
tcttccccagaaaggagact

SEQ ID NO: 4967106 - DNA, 13 bp, Homo sapiens
tcttccctacctc

SEQ ID NO: 4967107 - DNA, 14 bp, Homo sapiens
tcttccctacctca

SEQ ID NO: 4967108 - DNA, 17 bp, Homo sapiens
tcttcctacctatccca

SEQ ID NO: 4967109 - DNA, 23 bp, Homo sapiens
tcttcctagttttctcctcccag

SEQ ID NO: 4967110 - DNA, 22 bp, Homo sapiens
tcttcctcacagtcccactgtg

SEQ ID NO: 4967111 - DNA, 19 bp, Homo sapiens
tcttcctccagctgcacca

SEQ ID NO: 4967112 - DNA, 11 bp, Homo sapiens
tcttcctgacg

SEQ ID NO: 4967113 - DNA, 13 bp, Homo sapiens
tcttcctgcccct

SEQ ID NO: 4967114 - DNA, 14 bp, Homo sapiens
tcttcctgcccctc

SEQ ID NO: 4967115 - DNA, 19 bp, Homo sapiens
tcttcctgcccctctttct

SEQ ID NO: 4967116 - DNA, 17 bp, Homo sapiens
tcttcctgttaatgtat

SEQ ID NO: 4967117 - DNA, 19 bp, Homo sapiens
tcttcctgttaatgtattt

SEQ ID NO: 4967118 - DNA, 17 bp, Homo sapiens
tcttcctttactttccc

SEQ ID NO: 4967119 - DNA, 18 bp, Homo sapiens
tcttcctttactttccct

SEQ ID NO: 4967120 - DNA, 19 bp, Homo sapiens
tcttcctttactttccctt

SEQ ID NO: 4967121 - DNA, 20 bp, Homo sapiens
tcttcctttactttcccttg

SEQ ID NO: 4967122 - DNA, 18 bp, Homo sapiens
tcttcctttctctttctc

SEQ ID NO: 4967123 - DNA, 15 bp, Homo sapiens
tcttcgcgcccgccc

SEQ ID NO: 4967124 - DNA, 20 bp, Homo sapiens
tcttctaatttcaaaaatat

SEQ ID NO: 4967125 - DNA, 14 bp, Homo sapiens
tcttctagagttca

SEQ ID NO: 4967126 - DNA, 11 bp, Homo sapiens
tcttctcaagt

SEQ ID NO: 4967127 - DNA, 15 bp, Homo sapiens
tcttctcaagttcta

SEQ ID NO: 4967128 - DNA, 16 bp, Homo sapiens
tcttctccactggatg

SEQ ID NO: 4967129 - DNA, 14 bp, Homo sapiens
tcttctccagattt

SEQ ID NO: 4967130 - DNA, 17 bp, Homo sapiens
tcttctccagatttttc

SEQ ID NO: 4967131 - DNA, 12 bp, Homo sapiens
tcttctccaggc

SEQ ID NO: 4967132 - DNA, 14 bp, Homo sapiens
tcttctccaggctg

SEQ ID NO: 4967133 - DNA, 13 bp, Homo sapiens
tcttctcctttca

SEQ ID NO: 4967134 - DNA, 20 bp, Homo sapiens
tcttctgcccaattggagga

SEQ ID NO: 4967135 - DNA, 12 bp, Homo sapiens
tcttctgctcca

SEQ ID NO: 4967136 - DNA, 13 bp, Homo sapiens
tcttctgctccac

SEQ ID NO: 4967137 - DNA, 14 bp, Homo sapiens
tcttctgctccacc

SEQ ID NO: 4967138 - DNA, 15 bp, Homo sapiens
tcttctgctccaccc

SEQ ID NO: 4967139 - DNA, 19 bp, Homo sapiens
tcttctgcttcagcctccc

SEQ ID NO: 4967140 - DNA, 22 bp, Homo sapiens
tcttctgcttcagcctcccgag

SEQ ID NO: 4967141 - DNA, 21 bp, Homo sapiens
tcttctggctcaaaaagagaa

SEQ ID NO: 4967142 - DNA, 22 bp, Homo sapiens
tcttctggggcaggctgggcca

SEQ ID NO: 4967143 - DNA, 22 bp, Homo sapiens
tcttctgtacgtctgacaggca

SEQ ID NO: 4967144 - DNA, 12 bp, Homo sapiens
tcttcttatgca

SEQ ID NO: 4967145 - DNA, 18 bp, Homo sapiens
tcttcttttggcttccat

SEQ ID NO: 4967146 - DNA, 16 bp, Homo sapiens
tcttctttttttgtga

SEQ ID NO: 4967147 - DNA, 16 bp, Homo sapiens
tcttgaactcctggcc

SEQ ID NO: 4967148 - DNA, 17 bp, Homo sapiens
tcttgaactcctggcct

SEQ ID NO: 4967149 - DNA, 15 bp, Homo sapiens
tcttgaagggcccag

SEQ ID NO: 4967150 - DNA, 11 bp, Homo sapiens
tcttgaatgtg

SEQ ID NO: 4967151 - DNA, 19 bp, Homo sapiens
tcttgaatgtggtctcagg

SEQ ID NO: 4967152 - DNA, 13 bp, Homo sapiens
tcttgacaaaacc

SEQ ID NO: 4967153 - DNA, 13 bp, Homo sapiens
tcttgagctggcc

SEQ ID NO: 4967154 - DNA, 21 bp, Homo sapiens
tcttgagctggcctctctagc

SEQ ID NO: 4967155 - DNA, 23 bp, Homo sapiens
tcttgagctggcctctctagcac

SEQ ID NO: 4967156 - DNA, 21 bp, Homo sapiens
tcttgagtataagaaatgcat

SEQ ID NO: 4967157 - DNA, 20 bp, Homo sapiens
tcttgatacccccctctgtc

SEQ ID NO: 4967158 - DNA, 17 bp, Homo sapiens
tcttgcaagcatgcttg

SEQ ID NO: 4967159 - DNA, 18 bp, Homo sapiens
tcttgcatccttcctata

SEQ ID NO: 4967160 - DNA, 23 bp, Homo sapiens
tcttgcatggcaaggactgcagg

SEQ ID NO: 4967161 - DNA, 17 bp, Homo sapiens
tcttgccactgcctctt

SEQ ID NO: 4967162 - DNA, 19 bp, Homo sapiens
tcttgcgaatccaagctcc

SEQ ID NO: 4967163 - DNA, 21 bp, Homo sapiens
tcttgcgaatccaagctccct

SEQ ID NO: 4967164 - DNA, 18 bp, Homo sapiens
tcttgctcccttcagccc

SEQ ID NO: 4967165 - DNA, 19 bp, Homo sapiens
tcttgctcccttcagcccc

SEQ ID NO: 4967166 - DNA, 18 bp, Homo sapiens
tcttgctctatctctcaa

SEQ ID NO: 4967167 - DNA, 11 bp, Homo sapiens
tcttgctctgc

SEQ ID NO: 4967168 - DNA, 12 bp, Homo sapiens
tcttgctctgct

SEQ ID NO: 4967169 - DNA, 15 bp, Homo sapiens
tcttgctgctagaac

SEQ ID NO: 4967170 - DNA, 16 bp, Homo sapiens
tcttgctgctagaact

SEQ ID NO: 4967171 - DNA, 17 bp, Homo sapiens
tcttgctgctagaactt

SEQ ID NO: 4967172 - DNA, 19 bp, Homo sapiens
tcttgctgctagaactttt

SEQ ID NO: 4967173 - DNA, 14 bp, Homo sapiens
tcttgctgtctctg

SEQ ID NO: 4967174 - DNA, 12 bp, Homo sapiens
tcttgcttgtac

SEQ ID NO: 4967175 - DNA, 15 bp, Homo sapiens
tcttgcttgtacctc

SEQ ID NO: 4967176 - DNA, 15 bp, Homo sapiens
tcttggagtttttca

SEQ ID NO: 4967177 - DNA, 20 bp, Homo sapiens
tcttggcaaaagccttgtgt

SEQ ID NO: 4967178 - DNA, 17 bp, Homo sapiens
tcttggcaatattcctt

SEQ ID NO: 4967179 - DNA, 14 bp, Homo sapiens
tcttgggaactgaa

SEQ ID NO: 4967180 - DNA, 21 bp, Homo sapiens
tcttgtaatttccagctttct

SEQ ID NO: 4967181 - DNA, 18 bp, Homo sapiens
tcttgtcagacataaagc

SEQ ID NO: 4967182 - DNA, 23 bp, Homo sapiens
tcttgtccatgtggttcttcaaa

SEQ ID NO: 4967183 - DNA, 20 bp, Homo sapiens
tcttgtcccacgtgtcttcc

SEQ ID NO: 4967184 - DNA, 19 bp, Homo sapiens
tcttgtcctcagtccattt

SEQ ID NO: 4967185 - DNA, 15 bp, Homo sapiens
tcttgtgaaggcagg

SEQ ID NO: 4967186 - DNA, 15 bp, Homo sapiens
tcttgtgttgtcctt

SEQ ID NO: 4967187 - DNA, 15 bp, Homo sapiens
tcttgttttgtttgt

SEQ ID NO: 4967188 - DNA, 16 bp, Homo sapiens
tcttgttttgtttgtc

SEQ ID NO: 4967189 - DNA, 23 bp, Homo sapiens
tcttgttttgtttgtctctcctt

SEQ ID NO: 4967190 - DNA, 20 bp, Homo sapiens
tcttgtttttattaatttat

SEQ ID NO: 4967191 - DNA, 19 bp, Homo sapiens
tgactgaagatgcagctca

SEQ ID NO: 4967192 - DNA, 18 bp, Homo sapiens
tgactgcccattcaccaa

SEQ ID NO: 4967193 - DNA, 22 bp, Homo sapiens
tgactgctccccagccctggct

SEQ ID NO: 4967194 - DNA, 20 bp, Homo sapiens
tgactggggtgggaggtctt

SEQ ID NO: 4967195 - DNA, 19 bp, Homo sapiens
tgactggtttacaggccct

SEQ ID NO: 4967196 - DNA, 17 bp, Homo sapiens
tgactgtactcctccca

SEQ ID NO: 4967197 - DNA, 17 bp, Homo sapiens
tgactgtcactgttcct

SEQ ID NO: 4967198 - DNA, 24 bp, Homo sapiens
tgactgtcctctcccctccagcct

SEQ ID NO: 4967199 - DNA, 13 bp, Homo sapiens
tgacttaatgtga

SEQ ID NO: 4967200 - DNA, 15 bp, Homo sapiens
tgacttatagtacat

SEQ ID NO: 4967201 - DNA, 21 bp, Homo sapiens
tgacttcatggaatggacatc

SEQ ID NO: 4967202 - DNA, 14 bp, Homo sapiens
tgacttctccaggt

SEQ ID NO: 4967203 - DNA, 21 bp, Homo sapiens
tgacttctgctggcatcaaga

SEQ ID NO: 4967204 - DNA, 12 bp, Homo sapiens
tgacttggggga

SEQ ID NO: 4967205 - DNA, 19 bp, Homo sapiens
tgacttgtggttgaattaa

SEQ ID NO: 4967206 - DNA, 17 bp, Homo sapiens
tgagaaaaagctcctgt

SEQ ID NO: 4967207 - DNA, 19 bp, Homo sapiens
tgagaaatttctgtgaaac

SEQ ID NO: 4967208 - DNA, 19 bp, Homo sapiens
tgagaacaaagctgttaaa

SEQ ID NO: 4967209 - DNA, 22 bp, Homo sapiens
tgagaagctgctccaggcctgc

SEQ ID NO: 4967210 - DNA, 21 bp, Homo sapiens
tgagaatctacccccagatcc

SEQ ID NO: 4967211 - DNA, 23 bp, Homo sapiens
tgagacaaattttaacttcttgt

SEQ ID NO: 4967212 - DNA, 13 bp, Homo sapiens
tgagacagaatct

SEQ ID NO: 4967213 - DNA, 14 bp, Homo sapiens
tgagacagaatctc

SEQ ID NO: 4967214 - DNA, 16 bp, Homo sapiens
tgagacagtttcttag

SEQ ID NO: 4967215 - DNA, 21 bp, Homo sapiens
tgagacagtttcttagctttt

SEQ ID NO: 4967216 - DNA, 13 bp, Homo sapiens
tgagaccacagag

SEQ ID NO: 4967217 - DNA, 13 bp, Homo sapiens
tgagacccccaca

SEQ ID NO: 4967218 - DNA, 15 bp, Homo sapiens
tgagacccccacacc

SEQ ID NO: 4967219 - DNA, 17 bp, Homo sapiens
tgagacccccacacctc

SEQ ID NO: 4967220 - DNA, 22 bp, Homo sapiens
tgagacccccacacctcagttc

SEQ ID NO: 4967221 - DNA, 13 bp, Homo sapiens
tgagaccctggtg

SEQ ID NO: 4967222 - DNA, 14 bp, Homo sapiens
tgagactatttaaa

SEQ ID NO: 4967223 - DNA, 17 bp, Homo sapiens
tgagagagatgggagct

SEQ ID NO: 4967224 - DNA, 21 bp, Homo sapiens
tgagagagatgggagctcctc

SEQ ID NO: 4967225 - DNA, 22 bp, Homo sapiens
tgagagagatgggagctcctct

SEQ ID NO: 4967226 - DNA, 14 bp, Homo sapiens
tgagagattctgtg

SEQ ID NO: 4967227 - DNA, 21 bp, Homo sapiens
tgagagattctgtgatctttt

SEQ ID NO: 4967228 - DNA, 15 bp, Homo sapiens
tgagagcccagaggt

SEQ ID NO: 4967229 - DNA, 23 bp, Homo sapiens
tgagaggacttttctttgtggct

SEQ ID NO: 4967230 - DNA, 12 bp, Homo sapiens
tgagaggggaag

SEQ ID NO: 4967231 - DNA, 19 bp, Homo sapiens
tgagagtatcaggtctccc

SEQ ID NO: 4967232 - DNA, 14 bp, Homo sapiens
tgagagtctagatt

SEQ ID NO: 4967233 - DNA, 17 bp, Homo sapiens
tgagagtctagattctc

SEQ ID NO: 4967234 - DNA, 21 bp, Homo sapiens
tgagagtctagcactcatttt

SEQ ID NO: 4967235 - DNA, 22 bp, Homo sapiens
tgagatgagggatgggcctggc

SEQ ID NO: 4967236 - DNA, 15 bp, Homo sapiens
tgagatgctggagaa

SEQ ID NO: 4967237 - DNA, 16 bp, Homo sapiens
tgagatgctggagaag

SEQ ID NO: 4967238 - DNA, 18 bp, Homo sapiens
tgagatgctggagaagag

SEQ ID NO: 4967239 - DNA, 20 bp, Homo sapiens
tgagatgctggagaagagag

SEQ ID NO: 4967240 - DNA, 21 bp, Homo sapiens
tgagatggggataaaatgact

SEQ ID NO: 4967241 - DNA, 19 bp, Homo sapiens
tgagattgccccaggtctg

SEQ ID NO: 4967242 - DNA, 17 bp, Homo sapiens
tgagatttcttaaataa

SEQ ID NO: 4967243 - DNA, 15 bp, Homo sapiens
tgagcaaatgtggct

SEQ ID NO: 4967244 - DNA, 21 bp, Homo sapiens
tgagcaaggagcacaagccac

SEQ ID NO: 4967245 - DNA, 13 bp, Homo sapiens
tgagcacacttta

SEQ ID NO: 4967246 - DNA, 21 bp, Homo sapiens
tgagcactaaggtgtgctctg

SEQ ID NO: 4967247 - DNA, 18 bp, Homo sapiens
tgagcagaaggaaacaaa

SEQ ID NO: 4967248 - DNA, 15 bp, Homo sapiens
tgagcagggctcagc

SEQ ID NO: 4967249 - DNA, 20 bp, Homo sapiens
tgagcagggctcagcgggga

SEQ ID NO: 4967250 - DNA, 23 bp, Homo sapiens
tgagcagggctcagcggggacag

SEQ ID NO: 4967251 - DNA, 15 bp, Homo sapiens
tgagcatcctgagcc

SEQ ID NO: 4967252 - DNA, 23 bp, Homo sapiens
tgagcatcctgagccccgccctc

SEQ ID NO: 4967253 - DNA, 18 bp, Homo sapiens
tgagccacagcagcattt

SEQ ID NO: 4967254 - DNA, 19 bp, Homo sapiens
tgagccacagcagcatttt

SEQ ID NO: 4967255 - DNA, 20 bp, Homo sapiens
tgagccacagcagcattttt

SEQ ID NO: 4967256 - DNA, 12 bp, Homo sapiens
tgagccactgca

SEQ ID NO: 4967257 - DNA, 18 bp, Homo sapiens
tgagcccagccctgttct

SEQ ID NO: 4967258 - DNA, 13 bp, Homo sapiens
tgagcccaggagt

SEQ ID NO: 4967259 - DNA, 21 bp, Homo sapiens
tgagcccatgttctgccccca

SEQ ID NO: 4967260 - DNA, 23 bp, Homo sapiens
tgagcccatgttctgcccccagc

SEQ ID NO: 4967261 - DNA, 18 bp, Homo sapiens
tgagccccagggtgccca

SEQ ID NO: 4967262 - DNA, 23 bp, Homo sapiens
tgagccccagggtgcccagaact

SEQ ID NO: 4967263 - DNA, 16 bp, Homo sapiens
tgagccccgcagacct

SEQ ID NO: 4967264 - DNA, 17 bp, Homo sapiens
tgagccccgcagacctc

SEQ ID NO: 4967265 - DNA, 20 bp, Homo sapiens
tgagccccgccctcttcctg

SEQ ID NO: 4967266 - DNA, 22 bp, Homo sapiens
tgagccccgccctcttcctgac

SEQ ID NO: 4967267 - DNA, 15 bp, Homo sapiens
tgagcccctggtcct

SEQ ID NO: 4967268 - DNA, 22 bp, Homo sapiens
tgagccgagatcacgccactgc

SEQ ID NO: 4967269 - DNA, 21 bp, Homo sapiens
tgagccgctgtgagcccctgg

SEQ ID NO: 4967270 - DNA, 19 bp, Homo sapiens
tgagccgtgaactgtgcat

SEQ ID NO: 4967271 - DNA, 15 bp, Homo sapiens
tgagcctcagcatcc

SEQ ID NO: 4967272 - DNA, 18 bp, Homo sapiens
tgagcctcagcatcctgg

SEQ ID NO: 4967273 - DNA, 22 bp, Homo sapiens
tgagcctcagcatcctggcacc

SEQ ID NO: 4967274 - DNA, 14 bp, Homo sapiens
tgagcctctgctcc

SEQ ID NO: 4967275 - DNA, 17 bp, Homo sapiens
tgagcctctgctcccca

SEQ ID NO: 4967276 - DNA, 18 bp, Homo sapiens
tgagcctctgctccccag

SEQ ID NO: 4967277 - DNA, 13 bp, Homo sapiens
tgagccttcagtc

SEQ ID NO: 4967278 - DNA, 14 bp, Homo sapiens
tgagccttcagtct

SEQ ID NO: 4967279 - DNA, 19 bp, Homo sapiens
tgagccttcgtgccccccc

SEQ ID NO: 4967280 - DNA, 16 bp, Homo sapiens
tgagccttttccctct

SEQ ID NO: 4967281 - DNA, 18 bp, Homo sapiens
tgagcgcctggatttctg

SEQ ID NO: 4967282 - DNA, 15 bp, Homo sapiens
tgagctattaaaact

SEQ ID NO: 4967283 - DNA, 15 bp, Homo sapiens
tgagctgatataaat

SEQ ID NO: 4967284 - DNA, 21 bp, Homo sapiens
tgagctgatataaattctgtg

SEQ ID NO: 4967285 - DNA, 16 bp, Homo sapiens
tgagctgatctgcgga

SEQ ID NO: 4967286 - DNA, 10 bp, Homo sapiens
tgagctggcc

SEQ ID NO: 4967287 - DNA, 15 bp, Homo sapiens
tgaggaactgtacag

SEQ ID NO: 4967288 - DNA, 14 bp, Homo sapiens
tgaggaagagtctt

SEQ ID NO: 4967289 - DNA, 19 bp, Homo sapiens
tgaggaataattatttatt

SEQ ID NO: 4967290 - DNA, 21 bp, Homo sapiens
tgaggaatccagacccggctg

SEQ ID NO: 4967291 - DNA, 23 bp, Homo sapiens
tgatgaagcaaggaagatataca

SEQ ID NO: 4967292 - DNA, 15 bp, Homo sapiens
tgatgatacaagatt

SEQ ID NO: 4967293 - DNA, 17 bp, Homo sapiens
tgatgatacaatgaaca

SEQ ID NO: 4967294 - DNA, 20 bp, Homo sapiens
tgatgatctttgcagacagg

SEQ ID NO: 4967295 - DNA, 21 bp, Homo sapiens
tgatgatctttgcagacaggc

SEQ ID NO: 4967296 - DNA, 22 bp, Homo sapiens
tgatgatctttgcagacaggca

SEQ ID NO: 4967297 - DNA, 13 bp, Homo sapiens
tgatgatgtaatt

SEQ ID NO: 4967298 - DNA, 16 bp, Homo sapiens
tgatgcacagagaagc

SEQ ID NO: 4967299 - DNA, 17 bp, Homo sapiens
tgatgcacagagaagct

SEQ ID NO: 4967300 - DNA, 18 bp, Homo sapiens
tgatgcacagagaagctg

SEQ ID NO: 4967301 - DNA, 13 bp, Homo sapiens
tgatgcagcattt

SEQ ID NO: 4967302 - DNA, 23 bp, Homo sapiens
tgatgcagcatttgataatgata

SEQ ID NO: 4967303 - DNA, 22 bp, Homo sapiens
tgatgccaatactagtcacccc

SEQ ID NO: 4967304 - DNA, 19 bp, Homo sapiens
tgatgccctgctccaggga

SEQ ID NO: 4967305 - DNA, 14 bp, Homo sapiens
tgatgctccctccc

SEQ ID NO: 4967306 - DNA, 22 bp, Homo sapiens
tgatggaagtaaagcctcaacc

SEQ ID NO: 4967307 - DNA, 23 bp, Homo sapiens
tgatggaccagtggtttccagtc

SEQ ID NO: 4967308 - DNA, 17 bp, Homo sapiens
tgatggcaattttgtaa

SEQ ID NO: 4967309 - DNA, 19 bp, Homo sapiens
tgatgggagagtagatggt

SEQ ID NO: 4967310 - DNA, 24 bp, Homo sapiens
tgatggggcaagggcacaagtcct

SEQ ID NO: 4967311 - DNA, 14 bp, Homo sapiens
tgatggttcccctg

SEQ ID NO: 4967312 - DNA, 23 bp, Homo sapiens
tgatgtaatctctctgcagctgc

SEQ ID NO: 4967313 - DNA, 11 bp, Homo sapiens
tgatgtaattg

SEQ ID NO: 4967314 - DNA, 18 bp, Homo sapiens
tgatgtatctgagttgcc

SEQ ID NO: 4967315 - DNA, 13 bp, Homo sapiens
tgatgtcatgtgt

SEQ ID NO: 4967316 - DNA, 19 bp, Homo sapiens
tgatgtcccaacttgtaaa

SEQ ID NO: 4967317 - DNA, 18 bp, Homo sapiens
tgatgtcttttcttggca

SEQ ID NO: 4967318 - DNA, 23 bp, Homo sapiens
tgatgtcttttcttggcaaaagc

SEQ ID NO: 4967319 - DNA, 23 bp, Homo sapiens
tgatgtgttgtgatagctaacat

SEQ ID NO: 4967320 - DNA, 14 bp, Homo sapiens
tgatgtgtttattt

SEQ ID NO: 4967321 - DNA, 12 bp, Homo sapiens
tgatgttctaag

SEQ ID NO: 4967322 - DNA, 15 bp, Homo sapiens
tgatgttctaaggct

SEQ ID NO: 4967323 - DNA, 18 bp, Homo sapiens
tgatgtttgtggcctcag

SEQ ID NO: 4967324 - DNA, 20 bp, Homo sapiens
tgatgtttgtggcctcagaa

SEQ ID NO: 4967325 - DNA, 15 bp, Homo sapiens
tgatgtttttatgat

SEQ ID NO: 4967326 - DNA, 14 bp, Homo sapiens
tgattaacaaatat

SEQ ID NO: 4967327 - DNA, 15 bp, Homo sapiens
tgattaacaaatatg

SEQ ID NO: 4967328 - DNA, 16 bp, Homo sapiens
tgattagctttgtgtt

SEQ ID NO: 4967329 - DNA, 20 bp, Homo sapiens
tgattattttcattacaatg

SEQ ID NO: 4967330 - DNA, 21 bp, Homo sapiens
tgattattttcattacaatgg

SEQ ID NO: 4967331 - DNA, 13 bp, Homo sapiens
tgattcactgcat

SEQ ID NO: 4967332 - DNA, 16 bp, Homo sapiens
tgattcatagtaactt

SEQ ID NO: 4967333 - DNA, 18 bp, Homo sapiens
tgattcatagtaacttct

SEQ ID NO: 4967334 - DNA, 16 bp, Homo sapiens
tgattcccaagctctg

SEQ ID NO: 4967335 - DNA, 21 bp, Homo sapiens
tgattctatttatatgtacat

SEQ ID NO: 4967336 - DNA, 13 bp, Homo sapiens
tgattctcctgcc

SEQ ID NO: 4967337 - DNA, 16 bp, Homo sapiens
tgattctgcagtaaat

SEQ ID NO: 4967338 - DNA, 22 bp, Homo sapiens
tgattctgcagtaaatctttta

SEQ ID NO: 4967339 - DNA, 12 bp, Homo sapiens
tgattgatttga

SEQ ID NO: 4967340 - DNA, 14 bp, Homo sapiens
tgattgatttgaag

SEQ ID NO: 4967341 - DNA, 12 bp, Homo sapiens
tgattgcagctt

SEQ ID NO: 4967342 - DNA, 17 bp, Homo sapiens
tgattggaccaggccat

SEQ ID NO: 4967343 - DNA, 21 bp, Homo sapiens
tgattggtgcaacccttaccc

SEQ ID NO: 4967344 - DNA, 12 bp, Homo sapiens
tgattgtaaaat

SEQ ID NO: 4967345 - DNA, 23 bp, Homo sapiens
tgattgtaaaatagcttgtatag

SEQ ID NO: 4967346 - DNA, 21 bp, Homo sapiens
tgattgtggaatggagattca

SEQ ID NO: 4967347 - DNA, 16 bp, Homo sapiens
tgatttaaacacacag

SEQ ID NO: 4967348 - DNA, 22 bp, Homo sapiens
tgatttaataaaataattctaa

SEQ ID NO: 4967349 - DNA, 16 bp, Homo sapiens
tgatttacagcaagta

SEQ ID NO: 4967350 - DNA, 22 bp, Homo sapiens
tgatttacatatattatttatt

SEQ ID NO: 4967351 - DNA, 16 bp, Homo sapiens
tgatttatagtttgta

SEQ ID NO: 4967352 - DNA, 22 bp, Homo sapiens
tgatttatgcatggaaacctga

SEQ ID NO: 4967353 - DNA, 13 bp, Homo sapiens
tgatttccttgaa

SEQ ID NO: 4967354 - DNA, 15 bp, Homo sapiens
tgatttccttgaatg

SEQ ID NO: 4967355 - DNA, 16 bp, Homo sapiens
tgatttccttgaatgt

SEQ ID NO: 4967356 - DNA, 17 bp, Homo sapiens
tgatttgaagaacatgt

SEQ ID NO: 4967357 - DNA, 19 bp, Homo sapiens
tgatttgaagaacatgtga

SEQ ID NO: 4967358 - DNA, 22 bp, Homo sapiens
tgatttgagttgattgagaaga

SEQ ID NO: 4967359 - DNA, 17 bp, Homo sapiens
tgatttgcaataaaaat

SEQ ID NO: 4967360 - DNA, 15 bp, Homo sapiens
tgatttgcatattca

SEQ ID NO: 4967361 - DNA, 13 bp, Homo sapiens
tgatttgcattga

SEQ ID NO: 4967362 - DNA, 15 bp, Homo sapiens
tgatttgcattgaac

SEQ ID NO: 4967363 - DNA, 18 bp, Homo sapiens
tgatttgggttggggaag

SEQ ID NO: 4967364 - DNA, 13 bp, Homo sapiens
tgatttggtgacc

SEQ ID NO: 4967365 - DNA, 19 bp, Homo sapiens
tgatttggtgaccaactgt

SEQ ID NO: 4967366 - DNA, 15 bp, Homo sapiens
tgatttgtactgaaa

SEQ ID NO: 4967367 - DNA, 17 bp, Homo sapiens
tgattttcaagcagcat

SEQ ID NO: 4967368 - DNA, 15 bp, Homo sapiens
tgattttcataactt

SEQ ID NO: 4967369 - DNA, 13 bp, Homo sapiens
tgatttttactgt

SEQ ID NO: 4967370 - DNA, 19 bp, Homo sapiens
tgatttttgttgattaaaa

SEQ ID NO: 4967371 - DNA, 17 bp, Homo sapiens
tgattttttaaaagaaa

SEQ ID NO: 4967372 - DNA, 16 bp, Homo sapiens
tgatttttttttttca

SEQ ID NO: 4967373 - DNA, 22 bp, Homo sapiens
tgcaaaaagaaatgactaatta

SEQ ID NO: 4967374 - DNA, 20 bp, Homo sapiens
tgcaaaagactaatttaaaa

SEQ ID NO: 4967375 - DNA, 13 bp, Homo sapiens
tgcaaaagcagtg

SEQ ID NO: 4967376 - DNA, 15 bp, Homo sapiens
tgcaaaagcttcaaa

SEQ ID NO: 4967377 - DNA, 12 bp, Homo sapiens
tgcaaagaaaat

SEQ ID NO: 4967378 - DNA, 22 bp, Homo sapiens
tgcaaaggtctttttaaaccag

SEQ ID NO: 4967379 - DNA, 14 bp, Homo sapiens
tgcaaagttctgtg

SEQ ID NO: 4967380 - DNA, 17 bp, Homo sapiens
tgcaaagttctgtgttt

SEQ ID NO: 4967381 - DNA, 20 bp, Homo sapiens
tgcaaagttctgtgtttaat

SEQ ID NO: 4967382 - DNA, 13 bp, Homo sapiens
tgcaaatataaac

SEQ ID NO: 4967383 - DNA, 15 bp, Homo sapiens
tgcaaatataaacat

SEQ ID NO: 4967384 - DNA, 17 bp, Homo sapiens
tgcaaatataaacatct

SEQ ID NO: 4967385 - DNA, 13 bp, Homo sapiens
tgcaacaggctgg

SEQ ID NO: 4967386 - DNA, 15 bp, Homo sapiens
tgcaacaggctgggc

SEQ ID NO: 4967387 - DNA, 17 bp, Homo sapiens
tgcaacaggctgggctt

SEQ ID NO: 4967388 - DNA, 19 bp, Homo sapiens
tgcaacaggctgggcttca

SEQ ID NO: 4967389 - DNA, 21 bp, Homo sapiens
tgcaacccaaggactgaggga

SEQ ID NO: 4967390 - DNA, 17 bp, Homo sapiens
tgcaacccttacccctt

SEQ ID NO: 4967391 - DNA, 13 bp, Homo sapiens
tgcaacctccgcc

SEQ ID NO: 4967392 - DNA, 19 bp, Homo sapiens
tgcaagagtgattgcagct

SEQ ID NO: 4967393 - DNA, 18 bp, Homo sapiens
tgcaagcctgtctgagac

SEQ ID NO: 4967394 - DNA, 20 bp, Homo sapiens
tgcaagctgtccagagaaaa

SEQ ID NO: 4967395 - DNA, 19 bp, Homo sapiens
tgcaaggaaggaaagaaag

SEQ ID NO: 4967396 - DNA, 14 bp, Homo sapiens
tgcaaggaccagga

SEQ ID NO: 4967397 - DNA, 11 bp, Homo sapiens
tgcaaggcact

SEQ ID NO: 4967398 - DNA, 13 bp, Homo sapiens
tgcaaggcccaca

SEQ ID NO: 4967399 - DNA, 14 bp, Homo sapiens
tgcaataacttctg

SEQ ID NO: 4967400 - DNA, 17 bp, Homo sapiens
tgcaataacttctgacc

SEQ ID NO: 4967401 - DNA, 15 bp, Homo sapiens
tctacagaggccatg

SEQ ID NO: 4967402 - DNA, 23 bp, Homo sapiens
tctacagctaatcagcattctca

SEQ ID NO: 4967403 - DNA, 17 bp, Homo sapiens
tctacatcttctgcctt

SEQ ID NO: 4967404 - DNA, 15 bp, Homo sapiens
tctaccatttcagag

SEQ ID NO: 4967405 - DNA, 14 bp, Homo sapiens
tctacccaaaccct

SEQ ID NO: 4967406 - DNA, 20 bp, Homo sapiens
tctacccagcgagccctggt

SEQ ID NO: 4967407 - DNA, 16 bp, Homo sapiens
tctacccgttccaaaa

SEQ ID NO: 4967408 - DNA, 18 bp, Homo sapiens
tctaccctcccaccccct

SEQ ID NO: 4967409 - DNA, 19 bp, Homo sapiens
tctacctcaggcagctcaa

SEQ ID NO: 4967410 - DNA, 20 bp, Homo sapiens
tctgacttaagcaaaagaaa

SEQ ID NO: 4967411 - DNA, 23 bp, Homo sapiens
tctgacttaagcaaaagaaaaag

SEQ ID NO: 4967412 - DNA, 14 bp, Homo sapiens
tctgagaaaacaag

SEQ ID NO: 4967413 - DNA, 22 bp, Homo sapiens
tctgagaaaagaacgtatttta

SEQ ID NO: 4967414 - DNA, 16 bp, Homo sapiens
tctgagaagaggagcc

SEQ ID NO: 4967415 - DNA, 14 bp, Homo sapiens
tctgagactcacag

SEQ ID NO: 4967416 - DNA, 16 bp, Homo sapiens
tctgagagtctagatt

SEQ ID NO: 4967417 - DNA, 21 bp, Homo sapiens
tctgagagtctagattctctg

SEQ ID NO: 4967418 - DNA, 19 bp, Homo sapiens
tctgagccacagcagcatt

SEQ ID NO: 4967419 - DNA, 20 bp, Homo sapiens
tctgagccagtgctttaatg

SEQ ID NO: 4967420 - DNA, 18 bp, Homo sapiens
tctgaggaatccagaccc

SEQ ID NO: 4967421 - DNA, 14 bp, Homo sapiens
tctgaggccctgcc

SEQ ID NO: 4967422 - DNA, 21 bp, Homo sapiens
tctgaggtgcctgtcccaccc

SEQ ID NO: 4967423 - DNA, 13 bp, Homo sapiens
tctgagtacagag

SEQ ID NO: 4967424 - DNA, 21 bp, Homo sapiens
tctgagttgccaagacaaatc

SEQ ID NO: 4967425 - DNA, 13 bp, Homo sapiens
tctgatatgggac

SEQ ID NO: 4967426 - DNA, 20 bp, Homo sapiens
tctgatgtctctaaagcact

SEQ ID NO: 4967427 - DNA, 18 bp, Homo sapiens
tctgattcccaagctctg

SEQ ID NO: 4967428 - DNA, 19 bp, Homo sapiens
tctgattcccaagctctgc

SEQ ID NO: 4967429 - DNA, 15 bp, Homo sapiens
tctgcaaaaggagag

SEQ ID NO: 4967430 - DNA, 16 bp, Homo sapiens
tctgcaaacaaacacc

SEQ ID NO: 4967431 - DNA, 16 bp, Homo sapiens
tctgcaattcaaaagt

SEQ ID NO: 4967432 - DNA, 19 bp, Homo sapiens
tctgcaattcaaaagttcc

SEQ ID NO: 4967433 - DNA, 21 bp, Homo sapiens
tctgcaattcaaaagttccaa

SEQ ID NO: 4967434 - DNA, 21 bp, Homo sapiens
tctgcaattcccctctgctgc

SEQ ID NO: 4967435 - DNA, 21 bp, Homo sapiens
tctgcacatgtcttgtacatg

SEQ ID NO: 4967436 - DNA, 13 bp, Homo sapiens
tctgcacccttct

SEQ ID NO: 4967437 - DNA, 15 bp, Homo sapiens
tctgcacccttcttt

SEQ ID NO: 4967438 - DNA, 16 bp, Homo sapiens
tctgcacccttctttt

SEQ ID NO: 4967439 - DNA, 19 bp, Homo sapiens
tctgcacccttcttttctc

SEQ ID NO: 4967440 - DNA, 20 bp, Homo sapiens
tctgcacccttcttttctca

SEQ ID NO: 4967441 - DNA, 22 bp, Homo sapiens
tctgcacctatgtagctctgca

SEQ ID NO: 4967442 - DNA, 13 bp, Homo sapiens
tctgcagctgccg

SEQ ID NO: 4967443 - DNA, 16 bp, Homo sapiens
tctgcagtaaatcttt

SEQ ID NO: 4967444 - DNA, 18 bp, Homo sapiens
tctgcatcccagcacctg

SEQ ID NO: 4967445 - DNA, 23 bp, Homo sapiens
tctgcatcccagcacctgcctcc

SEQ ID NO: 4967446 - DNA, 24 bp, Homo sapiens
tctgcatcccagcacctgcctcct

SEQ ID NO: 4967447 - DNA, 17 bp, Homo sapiens
tctgcattcaggatcaa

SEQ ID NO: 4967448 - DNA, 12 bp, Homo sapiens
tctgccagggag

SEQ ID NO: 4967449 - DNA, 19 bp, Homo sapiens
tctgccagggagcttgaaa

SEQ ID NO: 4967450 - DNA, 17 bp, Homo sapiens
tctgccagggcagtgct

SEQ ID NO: 4967451 - DNA, 23 bp, Homo sapiens
tctgccatattctgttggccagt

SEQ ID NO: 4967452 - DNA, 13 bp, Homo sapiens
tctgccatcaact

SEQ ID NO: 4967453 - DNA, 13 bp, Homo sapiens
tctgcccccagcc

SEQ ID NO: 4967454 - DNA, 16 bp, Homo sapiens
tctgccccctgctggc

SEQ ID NO: 4967455 - DNA, 13 bp, Homo sapiens
tctgcccctcccc

SEQ ID NO: 4967456 - DNA, 22 bp, Homo sapiens
tctgcccctcccccaaccccca

SEQ ID NO: 4967457 - DNA, 15 bp, Homo sapiens
tctgcctctctagga

SEQ ID NO: 4967458 - DNA, 21 bp, Homo sapiens
tctgcctctgacacacagctc

SEQ ID NO: 4967459 - DNA, 13 bp, Homo sapiens
tctgcctgcccag

SEQ ID NO: 4967460 - DNA, 18 bp, Homo sapiens
tctgcctgcccaggcccc

SEQ ID NO: 4967461 - DNA, 20 bp, Homo sapiens
tctgcctgcccaggcccctg

SEQ ID NO: 4967462 - DNA, 15 bp, Homo sapiens
tctgccttagtctca

SEQ ID NO: 4967463 - DNA, 16 bp, Homo sapiens
tctgcctttgacattt

SEQ ID NO: 4967464 - DNA, 14 bp, Homo sapiens
tctgcgcctcaggc

SEQ ID NO: 4967465 - DNA, 15 bp, Homo sapiens
tctgcggaccccagc

SEQ ID NO: 4967466 - DNA, 19 bp, Homo sapiens
tctgctcacatatctgtca

SEQ ID NO: 4967467 - DNA, 22 bp, Homo sapiens
tctgctcagacagaacccctac

SEQ ID NO: 4967468 - DNA, 16 bp, Homo sapiens
tctgctcagccaagct

SEQ ID NO: 4967469 - DNA, 12 bp, Homo sapiens
tctgctccacca

SEQ ID NO: 4967470 - DNA, 20 bp, Homo sapiens
tctgctccaccacatcctcc

SEQ ID NO: 4967471 - DNA, 14 bp, Homo sapiens
tctgctccaccctt

SEQ ID NO: 4967472 - DNA, 15 bp, Homo sapiens
tctgctccacccttg

SEQ ID NO: 4967473 - DNA, 20 bp, Homo sapiens
tctgctccacccttggcctg

SEQ ID NO: 4967474 - DNA, 21 bp, Homo sapiens
tctgctcctctccccagcaag

SEQ ID NO: 4967475 - DNA, 17 bp, Homo sapiens
tctgctcgccctccttt

SEQ ID NO: 4967476 - DNA, 18 bp, Homo sapiens
tctgctgacagacacagg

SEQ ID NO: 4967477 - DNA, 21 bp, Homo sapiens
tctgctgacagacacaggccc

SEQ ID NO: 4967478 - DNA, 22 bp, Homo sapiens
tctgctgcctgcccgcacagca

SEQ ID NO: 4967479 - DNA, 19 bp, Homo sapiens
tctgctggagtttcatgta

SEQ ID NO: 4967480 - DNA, 23 bp, Homo sapiens
tctgctggagtttcatgtacaag

SEQ ID NO: 4967481 - DNA, 12 bp, Homo sapiens
tctgctggccca

SEQ ID NO: 4967482 - DNA, 12 bp, Homo sapiens
tctgcttcaata

SEQ ID NO: 4967483 - DNA, 19 bp, Homo sapiens
tctgcttcaataaatcttt

SEQ ID NO: 4967484 - DNA, 14 bp, Homo sapiens
tctgcttcagtgga

SEQ ID NO: 4967485 - DNA, 14 bp, Homo sapiens
tctgcttctctcac

SEQ ID NO: 4967486 - DNA, 14 bp, Homo sapiens
tctgcttgtgttaa

SEQ ID NO: 4967487 - DNA, 21 bp, Homo sapiens
tctgctttaaagggcctgcct

SEQ ID NO: 4967488 - DNA, 15 bp, Homo sapiens
tctggaatgcagtgg

SEQ ID NO: 4967489 - DNA, 23 bp, Homo sapiens
tctggaatggtacatgtcttcca

SEQ ID NO: 4967490 - DNA, 14 bp, Homo sapiens
tctggacaggctct

SEQ ID NO: 4967491 - DNA, 22 bp, Homo sapiens
tctggactcctctgtccaggca

SEQ ID NO: 4967492 - DNA, 14 bp, Homo sapiens
tctggactctaaag

SEQ ID NO: 4967493 - DNA, 20 bp, Homo sapiens
tctggactctaaagaccaaa

SEQ ID NO: 4967494 - DNA, 15 bp, Homo sapiens
tctggactggctaga

SEQ ID NO: 4967495 - DNA, 15 bp, Homo sapiens
tctggagacagcccc

SEQ ID NO: 4967496 - DNA, 16 bp, Homo sapiens
tctggagacagcccca

SEQ ID NO: 4967497 - DNA, 18 bp, Homo sapiens
tctggagacagccccaga

SEQ ID NO: 4967498 - DNA, 20 bp, Homo sapiens
tctggagacagccccagagc

SEQ ID NO: 4967499 - DNA, 24 bp, Homo sapiens
tctggagacagccccagagcaggg

SEQ ID NO: 4967500 - DNA, 15 bp, Homo sapiens
tctggagagaaacaa

SEQ ID NO: 4967501 - DNA, 16 bp, Homo sapiens
tctggagccctaaccc

SEQ ID NO: 4967502 - DNA, 16 bp, Homo sapiens
tctggaggccttccag

SEQ ID NO: 4967503 - DNA, 17 bp, Homo sapiens
tctggaggccttccagc

SEQ ID NO: 4967504 - DNA, 20 bp, Homo sapiens
tctggaggccttccagctgc

SEQ ID NO: 4967505 - DNA, 21 bp, Homo sapiens
tctggaggccttccagctgct

SEQ ID NO: 4967506 - DNA, 14 bp, Homo sapiens
tctggagtgggcag

SEQ ID NO: 4967507 - DNA, 16 bp, Homo sapiens
tctggataggagcctg

SEQ ID NO: 4967508 - DNA, 21 bp, Homo sapiens
tctggataggagcctgctggt

SEQ ID NO: 4967509 - DNA, 17 bp, Homo sapiens
tctggcctaaaatcttg

SEQ ID NO: 4967510 - DNA, 22 bp, Homo sapiens
tctggcctaaaatcttggaagt

SEQ ID NO: 4967511 - DNA, 18 bp, Homo sapiens
tctggcctggcctggccc

SEQ ID NO: 4967512 - DNA, 19 bp, Homo sapiens
tctggcctggcctggccct

SEQ ID NO: 4967513 - DNA, 22 bp, Homo sapiens
tctggcctggcctggccctgcc

SEQ ID NO: 4967514 - DNA, 16 bp, Homo sapiens
tctggctagaggccag

SEQ ID NO: 4967515 - DNA, 21 bp, Homo sapiens
tctggctgccccaacctgctg

SEQ ID NO: 4967516 - DNA, 18 bp, Homo sapiens
tccagatgtttccagact

SEQ ID NO: 4967517 - DNA, 19 bp, Homo sapiens
tccagatgtttccagactt

SEQ ID NO: 4967518 - DNA, 19 bp, Homo sapiens
tccagatttttcggaggcc

SEQ ID NO: 4967519 - DNA, 17 bp, Homo sapiens
tccagcaacacagcctg

SEQ ID NO: 4967520 - DNA, 18 bp, Homo sapiens
tccagcccatctcggagc

SEQ ID NO: 4967521 - DNA, 19 bp, Homo sapiens
tccagcccatctcggagca

SEQ ID NO: 4967522 - DNA, 13 bp, Homo sapiens
tccagcccgggag

SEQ ID NO: 4967523 - DNA, 14 bp, Homo sapiens
tccagcccgggagc

SEQ ID NO: 4967524 - DNA, 15 bp, Homo sapiens
tccagcccgggagcc

SEQ ID NO: 4967525 - DNA, 19 bp, Homo sapiens
tccagccctattctgccac

SEQ ID NO: 4967526 - DNA, 20 bp, Homo sapiens
tccagccgccattgccacca

SEQ ID NO: 4967527 - DNA, 20 bp, Homo sapiens
tccagcctgggcaacagagc

SEQ ID NO: 4967528 - DNA, 17 bp, Homo sapiens
tccagctcaccagcccc

SEQ ID NO: 4967529 - DNA, 18 bp, Homo sapiens
tccagctcaccagcccca

SEQ ID NO: 4967530 - DNA, 23 bp, Homo sapiens
tccagctcaccagccccagtgcc

SEQ ID NO: 4967531 - DNA, 21 bp, Homo sapiens
tccagctcagaacccagggct

SEQ ID NO: 4967532 - DNA, 22 bp, Homo sapiens
tccagctctaataaaacagctg

SEQ ID NO: 4967533 - DNA, 17 bp, Homo sapiens
tccagctgctgtcttct

SEQ ID NO: 4967534 - DNA, 20 bp, Homo sapiens
tcgaatctactaattccaca

SEQ ID NO: 4967535 - DNA, 15 bp, Homo sapiens
tcgaattaagaatat

SEQ ID NO: 4967536 - DNA, 14 bp, Homo sapiens
tcgaccccaaagcc

SEQ ID NO: 4967537 - DNA, 14 bp, Homo sapiens
tcgacttttcttaa

SEQ ID NO: 4967538 - DNA, 21 bp, Homo sapiens
tcgagcagtcctgcctcagcc

SEQ ID NO: 4967539 - DNA, 13 bp, Homo sapiens
tcgaggacaggga

SEQ ID NO: 4967540 - DNA, 17 bp, Homo sapiens
tcgaggacagggaggtg

SEQ ID NO: 4967541 - DNA, 18 bp, Homo sapiens
tcgaggggctctcagctc

SEQ ID NO: 4967542 - DNA, 20 bp, Homo sapiens
tcgaggggctctcagctcag

SEQ ID NO: 4967543 - DNA, 18 bp, Homo sapiens
tcgatgcgttcactccaa

SEQ ID NO: 4967544 - DNA, 23 bp, Homo sapiens
tcgcccagtctggaatgcagtgg

SEQ ID NO: 4967545 - DNA, 22 bp, Homo sapiens
tcgcccgagctgtttatgtttt

SEQ ID NO: 4967546 - DNA, 17 bp, Homo sapiens
tcgccgttgaagaggaa

SEQ ID NO: 4967547 - DNA, 19 bp, Homo sapiens
tcgcctgtggagctcagcc

SEQ ID NO: 4967548 - DNA, 20 bp, Homo sapiens
tcgcgtgccctcgctgcttc

SEQ ID NO: 4967549 - DNA, 16 bp, Homo sapiens
tcgctgacttcatgga

SEQ ID NO: 4967550 - DNA, 12 bp, Homo sapiens
tcgcttgtaaat

SEQ ID NO: 4967551 - DNA, 20 bp, Homo sapiens
tcggaaccgctcacctagag

SEQ ID NO: 4967552 - DNA, 19 bp, Homo sapiens
tcggactaagcctacctgc

SEQ ID NO: 4967553 - DNA, 23 bp, Homo sapiens
tcggaggctgcccccggccccct

SEQ ID NO: 4967554 - DNA, 17 bp, Homo sapiens
tcgggcaccagccagcg

SEQ ID NO: 4967555 - DNA, 20 bp, Homo sapiens
tcgtggcagataatcagcct

SEQ ID NO: 4967556 - DNA, 23 bp, Homo sapiens
tcgtggcagataatcagcctctt

SEQ ID NO: 4967557 - DNA, 22 bp, Homo sapiens
tcgtggtccccaacagcgacat

SEQ ID NO: 4967558 - DNA, 15 bp, Homo sapiens
tcgttagaccgctct

SEQ ID NO: 4967559 - DNA, 12 bp, Homo sapiens
tcgtttctgtat

SEQ ID NO: 4967560 - DNA, 18 bp, Homo sapiens
tctaaaaaacagaggcca

SEQ ID NO: 4967561 - DNA, 22 bp, Homo sapiens
tctaaaaataaaccaaaggaca

SEQ ID NO: 4967562 - DNA, 15 bp, Homo sapiens
tctaaaatcttatag

SEQ ID NO: 4967563 - DNA, 22 bp, Homo sapiens
tctaaaatcttatagttctagg

SEQ ID NO: 4967564 - DNA, 23 bp, Homo sapiens
tctaaaatcttatagttctaggc

SEQ ID NO: 4967565 - DNA, 19 bp, Homo sapiens
tctaaaatgtgatgttcta

SEQ ID NO: 4967566 - DNA, 20 bp, Homo sapiens
tctaaaatgtgatgttctaa

SEQ ID NO: 4967567 - DNA, 22 bp, Homo sapiens
tctaaaatgtgatgttctaagg

SEQ ID NO: 4967568 - DNA, 14 bp, Homo sapiens
tctaaacattaatc

SEQ ID NO: 4967569 - DNA, 17 bp, Homo sapiens
tctaaacattaatcaat

SEQ ID NO: 4967570 - DNA, 22 bp, Homo sapiens
tctaaagaccaaacttcactct

SEQ ID NO: 4967571 - DNA, 15 bp, Homo sapiens
tctaaagagcactta

SEQ ID NO: 4967572 - DNA, 18 bp, Homo sapiens
tctaaagatggagtttct

SEQ ID NO: 4967573 - DNA, 21 bp, Homo sapiens
tctaaagatggagtttctaag

SEQ ID NO: 4967574 - DNA, 22 bp, Homo sapiens
tctaaagatggagtttctaagg

SEQ ID NO: 4967575 - DNA, 12 bp, Homo sapiens
tctaaagctctg

SEQ ID NO: 4967576 - DNA, 22 bp, Homo sapiens
tctaaaggtccacaggtctaga

SEQ ID NO: 4967577 - DNA, 12 bp, Homo sapiens
tctaaagttcta

SEQ ID NO: 4967578 - DNA, 14 bp, Homo sapiens
tctaaagttctaag

SEQ ID NO: 4967579 - DNA, 21 bp, Homo sapiens
tctaaagttctaagattctga

SEQ ID NO: 4967580 - DNA, 19 bp, Homo sapiens
tctaaatctatttattaat

SEQ ID NO: 4967581 - DNA, 17 bp, Homo sapiens
tctaaattctttatttc

SEQ ID NO: 4967582 - DNA, 20 bp, Homo sapiens
tctaaattctttatttctgt

SEQ ID NO: 4967583 - DNA, 13 bp, Homo sapiens
tctaaatttgaat

SEQ ID NO: 4967584 - DNA, 22 bp, Homo sapiens
tctaaatttgaatgttaagcag

SEQ ID NO: 4967585 - DNA, 19 bp, Homo sapiens
tctaacaaaaaaatatatt

SEQ ID NO: 4967586 - DNA, 21 bp, Homo sapiens
tctaaccttgaatgctgccag

SEQ ID NO: 4967587 - DNA, 17 bp, Homo sapiens
tctaacggtctgttctg

SEQ ID NO: 4967588 - DNA, 22 bp, Homo sapiens
tctaacggtctgttctgtttca

SEQ ID NO: 4967589 - DNA, 16 bp, Homo sapiens
tctaactcagaattat

SEQ ID NO: 4967590 - DNA, 13 bp, Homo sapiens
tctaactttagaa

SEQ ID NO: 4967591 - DNA, 19 bp, Homo sapiens
tctaagactcaaatgttct

SEQ ID NO: 4967592 - DNA, 21 bp, Homo sapiens
tctaagactcaaatgttctaa

SEQ ID NO: 4967593 - DNA, 23 bp, Homo sapiens
tctaagacttactctaagatctt

SEQ ID NO: 4967594 - DNA, 12 bp, Homo sapiens
tctaagatctta

SEQ ID NO: 4967595 - DNA, 15 bp, Homo sapiens
tctaagatcttagat

SEQ ID NO: 4967596 - DNA, 17 bp, Homo sapiens
tctaagatcttagattc

SEQ ID NO: 4967597 - DNA, 19 bp, Homo sapiens
tctaagatgtgatattcta

SEQ ID NO: 4967598 - DNA, 20 bp, Homo sapiens
tctaagatgtgatattctaa

SEQ ID NO: 4967599 - DNA, 12 bp, Homo sapiens
tctaagattcta

SEQ ID NO: 4967600 - DNA, 17 bp, Homo sapiens
tctaagattctaaaggt

SEQ ID NO: 4967601 - DNA, 14 bp, Homo sapiens
tctaagattctaat

SEQ ID NO: 4967602 - DNA, 17 bp, Homo sapiens
tctaagattctaatgat

SEQ ID NO: 4967603 - DNA, 19 bp, Homo sapiens
tctaagattctaatgatga

SEQ ID NO: 4967604 - DNA, 16 bp, Homo sapiens
tctaagattctagatc

SEQ ID NO: 4967605 - DNA, 13 bp, Homo sapiens
tctaagattctga

SEQ ID NO: 4967606 - DNA, 12 bp, Homo sapiens
tctaagctgcag

SEQ ID NO: 4967607 - DNA, 14 bp, Homo sapiens
tctaagctgcagct

SEQ ID NO: 4967608 - DNA, 17 bp, Homo sapiens
tctaagctgcagcttcc

SEQ ID NO: 4967609 - DNA, 19 bp, Homo sapiens
tctaagctgcagcttcctg

SEQ ID NO: 4967610 - DNA, 17 bp, Homo sapiens
tctaaggacctgaaatt

SEQ ID NO: 4967611 - DNA, 21 bp, Homo sapiens
tctaaggacctgaaattccaa

SEQ ID NO: 4967612 - DNA, 23 bp, Homo sapiens
tctaaggatgtcacagggccaac

SEQ ID NO: 4967613 - DNA, 17 bp, Homo sapiens
tctaaggctctgagagt

SEQ ID NO: 4967614 - DNA, 22 bp, Homo sapiens
tctaaggtccggtgttctaaga

SEQ ID NO: 4967615 - DNA, 15 bp, Homo sapiens
tctaaggtctatcaa

SEQ ID NO: 4967616 - DNA, 14 bp, Homo sapiens
tctaagtttctaag

SEQ ID NO: 4967617 - DNA, 15 bp, Homo sapiens
tctaagtttctaaga

SEQ ID NO: 4967618 - DNA, 16 bp, Homo sapiens
tctaagtttctaagat

SEQ ID NO: 4967619 - DNA, 18 bp, Homo sapiens
tctaagtttctaagattc

SEQ ID NO: 4967620 - DNA, 22 bp, Homo sapiens
tctaagtttctaagattctaaa

SEQ ID NO: 4967621 - DNA, 23 bp, Homo sapiens
tctaagtttctaagattctaaag

SEQ ID NO: 4967622 - DNA, 14 bp, Homo sapiens
tctaatacctctgt

SEQ ID NO: 4967623 - DNA, 14 bp, Homo sapiens
tctaatatcattca

SEQ ID NO: 4967624 - DNA, 19 bp, Homo sapiens
tctaatatccccaaattag

SEQ ID NO: 4967625 - DNA, 14 bp, Homo sapiens
tctaatatgtaaca

SEQ ID NO: 4967626 - DNA, 17 bp, Homo sapiens
tctaatcgaaagaaaat

SEQ ID NO: 4967627 - DNA, 21 bp, Homo sapiens
tctaattccatccataaatcc

SEQ ID NO: 4967628 - DNA, 19 bp, Homo sapiens
tctaattctattaaagtgc

SEQ ID NO: 4967629 - DNA, 22 bp, Homo sapiens
tctaatttcaaaaatataactt

SEQ ID NO: 4967630 - DNA, 19 bp, Homo sapiens
tctacaaataattttagtg

SEQ ID NO: 4967631 - DNA, 19 bp, Homo sapiens
tctacaaatataagatttt

SEQ ID NO: 4967632 - DNA, 18 bp, Homo sapiens
tctacacagtgggaactc

SEQ ID NO: 4967633 - DNA, 16 bp, Homo sapiens
tcatacctaagtactg

SEQ ID NO: 4967634 - DNA, 19 bp, Homo sapiens
tcatacctaagtactgtaa

SEQ ID NO: 4967635 - DNA, 20 bp, Homo sapiens
tcatacctaagtactgtaat

SEQ ID NO: 4967636 - DNA, 21 bp, Homo sapiens
tcatacctaagtactgtaata

SEQ ID NO: 4967637 - DNA, 22 bp, Homo sapiens
tcatagaaatgtaacttttgta

SEQ ID NO: 4967638 - DNA, 20 bp, Homo sapiens
tcatagagatttgtctaatt

SEQ ID NO: 4967639 - DNA, 16 bp, Homo sapiens
tcataggtatttcaaa

SEQ ID NO: 4967640 - DNA, 16 bp, Homo sapiens
tcataggttgccaata

SEQ ID NO: 4967641 - DNA, 14 bp, Homo sapiens
tcatagtaacttct

SEQ ID NO: 4967642 - DNA, 18 bp, Homo sapiens
tcatagtatggtggctgg

SEQ ID NO: 4967643 - DNA, 19 bp, Homo sapiens
tcatagtatggtggctggg

SEQ ID NO: 4967644 - DNA, 21 bp, Homo sapiens
tcatatcatcacattgagctg

SEQ ID NO: 4967645 - DNA, 16 bp, Homo sapiens
tcatattgatgaaaag

SEQ ID NO: 4967646 - DNA, 23 bp, Homo sapiens
tcatattttgtatatatctgctt

SEQ ID NO: 4967647 - DNA, 13 bp, Homo sapiens
tcatcaatcaaat

SEQ ID NO: 4967648 - DNA, 21 bp, Homo sapiens
tcatcaatcaaataagtattt

SEQ ID NO: 4967649 - DNA, 23 bp, Homo sapiens
tcatcaatcaaataagtatttat

SEQ ID NO: 4967650 - DNA, 12 bp, Homo sapiens
tcatcaattccc

SEQ ID NO: 4967651 - DNA, 15 bp, Homo sapiens
tcatcacttttcagt

SEQ ID NO: 4967652 - DNA, 13 bp, Homo sapiens
tcatcagaagtgg

SEQ ID NO: 4967653 - DNA, 21 bp, Homo sapiens
tcatcagagctcctctgtcct

SEQ ID NO: 4967654 - DNA, 13 bp, Homo sapiens
tcatcagggcctg

SEQ ID NO: 4967655 - DNA, 16 bp, Homo sapiens
tcatcagggcctgggg

SEQ ID NO: 4967656 - DNA, 14 bp, Homo sapiens
tcatcatcagggcc

SEQ ID NO: 4967657 - DNA, 15 bp, Homo sapiens
tcatcatcagggcct

SEQ ID NO: 4967658 - DNA, 12 bp, Homo sapiens
tcatccacccca

SEQ ID NO: 4967659 - DNA, 14 bp, Homo sapiens
tcatccaccccatc

SEQ ID NO: 4967660 - DNA, 14 bp, Homo sapiens
tcatccactgtgcc

SEQ ID NO: 4967661 - DNA, 21 bp, Homo sapiens
tcatccactgtgccatgtgcc

SEQ ID NO: 4967662 - DNA, 23 bp, Homo sapiens
tcatccactgtgccatgtgccag

SEQ ID NO: 4967663 - DNA, 20 bp, Homo sapiens
tcatccaggcccaactgtga

SEQ ID NO: 4967664 - DNA, 13 bp, Homo sapiens
tcatcccagcccc

SEQ ID NO: 4967665 - DNA, 21 bp, Homo sapiens
tcatcccatctaagctgcagc

SEQ ID NO: 4967666 - DNA, 17 bp, Homo sapiens
tcatcccatgagaccct

SEQ ID NO: 4967667 - DNA, 21 bp, Homo sapiens
tcatcccattaatcatttccc

SEQ ID NO: 4967668 - DNA, 14 bp, Homo sapiens
tcatccctttccag

SEQ ID NO: 4967669 - DNA, 14 bp, Homo sapiens
tcatcctcctggaa

SEQ ID NO: 4967670 - DNA, 17 bp, Homo sapiens
tcatcctgactctgccc

SEQ ID NO: 4967671 - DNA, 20 bp, Homo sapiens
tcatcctgactctgccccct

SEQ ID NO: 4967672 - DNA, 15 bp, Homo sapiens
tcatcctgccttcat

SEQ ID NO: 4967673 - DNA, 23 bp, Homo sapiens
tcatctataaagaagaacttgca

SEQ ID NO: 4967674 - DNA, 18 bp, Homo sapiens
tcatctattttgatgcag

SEQ ID NO: 4967675 - DNA, 20 bp, Homo sapiens
tcatctattttgatgcagca

SEQ ID NO: 4967676 - DNA, 21 bp, Homo sapiens
tcatctgattggacaggcatg

SEQ ID NO: 4967677 - DNA, 16 bp, Homo sapiens
tcatctgcacccttct

SEQ ID NO: 4967678 - DNA, 21 bp, Homo sapiens
tcatctgcacccttcttttct

SEQ ID NO: 4967679 - DNA, 23 bp, Homo sapiens
tcatctgcacccttcttttctca

SEQ ID NO: 4967680 - DNA, 12 bp, Homo sapiens
tcatcttactgt

SEQ ID NO: 4967681 - DNA, 18 bp, Homo sapiens
tcatcttgaagggcccag

SEQ ID NO: 4967682 - DNA, 15 bp, Homo sapiens
tcatcttgtgaaatg

SEQ ID NO: 4967683 - DNA, 14 bp, Homo sapiens
tcatgaaatatgca

SEQ ID NO: 4967684 - DNA, 15 bp, Homo sapiens
tcatgaaatatgcat

SEQ ID NO: 4967685 - DNA, 12 bp, Homo sapiens
tcatgaagccca

SEQ ID NO: 4967686 - DNA, 13 bp, Homo sapiens
tcatgaagcccaa

SEQ ID NO: 4967687 - DNA, 12 bp, Homo sapiens
tcatgaagcctg

SEQ ID NO: 4967688 - DNA, 15 bp, Homo sapiens
tcatgaagcctgtgg

SEQ ID NO: 4967689 - DNA, 16 bp, Homo sapiens
tcatgaattttacatg

SEQ ID NO: 4967690 - DNA, 19 bp, Homo sapiens
tcatgaattttacatggta

SEQ ID NO: 4967691 - DNA, 13 bp, Homo sapiens
tcatgatgcagtc

SEQ ID NO: 4967692 - DNA, 23 bp, Homo sapiens
tcatgatgcagtctcctctttaa

SEQ ID NO: 4967693 - DNA, 16 bp, Homo sapiens
tcatgatttataaatg

SEQ ID NO: 4967694 - DNA, 20 bp, Homo sapiens
tcatgcataaatatgcagtg

SEQ ID NO: 4967695 - DNA, 19 bp, Homo sapiens
tcatgccaccatggccagc

SEQ ID NO: 4967696 - DNA, 22 bp, Homo sapiens
tcatgccaccatggccagccaa

SEQ ID NO: 4967697 - DNA, 13 bp, Homo sapiens
tcatgctttaaag

SEQ ID NO: 4967698 - DNA, 18 bp, Homo sapiens
tcatggaatggacatcct

SEQ ID NO: 4967699 - DNA, 20 bp, Homo sapiens
tcatggaatggacatcctgt

SEQ ID NO: 4967700 - DNA, 18 bp, Homo sapiens
tcatggaccactgtttct

SEQ ID NO: 4967701 - DNA, 21 bp, Homo sapiens
tcatggaccactgtttcttgc

SEQ ID NO: 4967702 - DNA, 18 bp, Homo sapiens
tcatggcccctctgacct

SEQ ID NO: 4967703 - DNA, 14 bp, Homo sapiens
tcatggggtccaag

SEQ ID NO: 4967704 - DNA, 17 bp, Homo sapiens
tcatgggttatgtgtat

SEQ ID NO: 4967705 - DNA, 14 bp, Homo sapiens
tcatggtgaaaatg

SEQ ID NO: 4967706 - DNA, 17 bp, Homo sapiens
tcatggtgtaataagac

SEQ ID NO: 4967707 - DNA, 18 bp, Homo sapiens
tcatggtgtaataagaca

SEQ ID NO: 4967708 - DNA, 16 bp, Homo sapiens
tcatgtaaagaaatgt

SEQ ID NO: 4967709 - DNA, 22 bp, Homo sapiens
tcatgtaaagaaatgtcttaat

SEQ ID NO: 4967710 - DNA, 15 bp, Homo sapiens
tcatgtatcatctgg

SEQ ID NO: 4967711 - DNA, 18 bp, Homo sapiens
tcatgtatcatctggata

SEQ ID NO: 4967712 - DNA, 15 bp, Homo sapiens
tcatgtgttcccttt

SEQ ID NO: 4967713 - DNA, 17 bp, Homo sapiens
tcatgtgttccctttgt

SEQ ID NO: 4967714 - DNA, 22 bp, Homo sapiens
tcatgttatatttaatgcatta

SEQ ID NO: 4967715 - DNA, 14 bp, Homo sapiens
tcatgtttgcttca

SEQ ID NO: 4967716 - DNA, 19 bp, Homo sapiens
tcatgtttggtgcatagaa

SEQ ID NO: 4967717 - DNA, 14 bp, Homo sapiens
tcatgttttgtgac

SEQ ID NO: 4967718 - DNA, 14 bp, Homo sapiens
tcattaaatgtttg

SEQ ID NO: 4967719 - DNA, 13 bp, Homo sapiens
tacttgtggacac

SEQ ID NO: 4967720 - DNA, 15 bp, Homo sapiens
tacttgtggacacag

SEQ ID NO: 4967721 - DNA, 17 bp, Homo sapiens
tacttgtggttttcaaa

SEQ ID NO: 4967722 - DNA, 18 bp, Homo sapiens
tacttgtggttttcaaat

SEQ ID NO: 4967723 - DNA, 14 bp, Homo sapiens
tactttaaacttgt

SEQ ID NO: 4967724 - DNA, 17 bp, Homo sapiens
tactttaaacttgtctt

SEQ ID NO: 4967725 - DNA, 16 bp, Homo sapiens
tactttactcattttt

SEQ ID NO: 4967726 - DNA, 15 bp, Homo sapiens
tactttagtatgacg

SEQ ID NO: 4967727 - DNA, 20 bp, Homo sapiens
tactttcatcctgactctgc

SEQ ID NO: 4967728 - DNA, 12 bp, Homo sapiens
tactttcccttg

SEQ ID NO: 4967729 - DNA, 20 bp, Homo sapiens
tactttcctttccccagccc

SEQ ID NO: 4967730 - DNA, 22 bp, Homo sapiens
tactttgtggaccaattattga

SEQ ID NO: 4967731 - DNA, 21 bp, Homo sapiens
tacttttaaacagtgagcctg

SEQ ID NO: 4967732 - DNA, 19 bp, Homo sapiens
tacttttatttgcaacatt

SEQ ID NO: 4967733 - DNA, 23 bp, Homo sapiens
tacttttattttacacagaaaca

SEQ ID NO: 4967734 - DNA, 16 bp, Homo sapiens
tacttttgagtgtgtg

SEQ ID NO: 4967735 - DNA, 15 bp, Homo sapiens
tagaaaactgaaaat

SEQ ID NO: 4967736 - DNA, 16 bp, Homo sapiens
tagaaaactgaaaatc

SEQ ID NO: 4967737 - DNA, 16 bp, Homo sapiens
tagaaaagtagacaat

SEQ ID NO: 4967738 - DNA, 14 bp, Homo sapiens
tagaaacatgacac

SEQ ID NO: 4967739 - DNA, 18 bp, Homo sapiens
tagaaacccaagctcctc

SEQ ID NO: 4967740 - DNA, 21 bp, Homo sapiens
tagaaacccaagctcctcctc

SEQ ID NO: 4967741 - DNA, 22 bp, Homo sapiens
tagaaagcaggggctacaagag

SEQ ID NO: 4967742 - DNA, 23 bp, Homo sapiens
tagaaataaaagtgaatgaaaga

SEQ ID NO: 4967743 - DNA, 20 bp, Homo sapiens
tagaaataaaggatgtgatt

SEQ ID NO: 4967744 - DNA, 11 bp, Homo sapiens
tagaaataagt

SEQ ID NO: 4967745 - DNA, 12 bp, Homo sapiens
tagaaataagtg

SEQ ID NO: 4967746 - DNA, 15 bp, Homo sapiens
tagaaataatatgca

SEQ ID NO: 4967747 - DNA, 15 bp, Homo sapiens
tagaaatgtaaactg

SEQ ID NO: 4967748 - DNA, 19 bp, Homo sapiens
tagaaattacacccaaaga

SEQ ID NO: 4967749 - DNA, 23 bp, Homo sapiens
tagaaattagaaaaaaattacta

SEQ ID NO: 4967750 - DNA, 16 bp, Homo sapiens
tagaacaaaggacaga

SEQ ID NO: 4967751 - DNA, 16 bp, Homo sapiens
tagaacactaactcac

SEQ ID NO: 4967752 - DNA, 18 bp, Homo sapiens
tagaactgggtaaatgca

SEQ ID NO: 4967753 - DNA, 19 bp, Homo sapiens
tagaactgtatgtcagaca

SEQ ID NO: 4967754 - DNA, 16 bp, Homo sapiens
tagaacttgaccccct

SEQ ID NO: 4967755 - DNA, 19 bp, Homo sapiens
tagaactttaagcaacaag

SEQ ID NO: 4967756 - DNA, 18 bp, Homo sapiens
tagaacttttttaaataa

SEQ ID NO: 4967757 - DNA, 20 bp, Homo sapiens
tagaagcattccttctttga

SEQ ID NO: 4967758 - DNA, 21 bp, Homo sapiens
tagaagcattccttctttgat

SEQ ID NO: 4967759 - DNA, 22 bp, Homo sapiens
tagaagcattccttctttgata

SEQ ID NO: 4967760 - DNA, 16 bp, Homo sapiens
tagaagctgtagtagc

SEQ ID NO: 4967761 - DNA, 23 bp, Homo sapiens
tagaaggaaaaaagttccttcct

SEQ ID NO: 4967762 - DNA, 22 bp, Homo sapiens
tagaagggccagtcctgcctgg

SEQ ID NO: 4967763 - DNA, 18 bp, Homo sapiens
tagaagtgcatttctgaa

SEQ ID NO: 4967764 - DNA, 14 bp, Homo sapiens
tagaagtttgtcca

SEQ ID NO: 4967765 - DNA, 18 bp, Homo sapiens
tagaatactttttaaaag

SEQ ID NO: 4967766 - DNA, 16 bp, Homo sapiens
tagaatataggtctct

SEQ ID NO: 4967767 - DNA, 13 bp, Homo sapiens
tagaatctatttt

SEQ ID NO: 4967768 - DNA, 20 bp, Homo sapiens
tagaatctattttctatgta

SEQ ID NO: 4967769 - DNA, 14 bp, Homo sapiens
tatgtgtgtagaca

SEQ ID NO: 4967770 - DNA, 16 bp, Homo sapiens
tatgtgttgaaaacca

SEQ ID NO: 4967771 - DNA, 23 bp, Homo sapiens
tatgtgttgaaaaccaaaatgac

SEQ ID NO: 4967772 - DNA, 15 bp, Homo sapiens
tatgttaaaagattt

SEQ ID NO: 4967773 - DNA, 15 bp, Homo sapiens
tatgttactattttc

SEQ ID NO: 4967774 - DNA, 14 bp, Homo sapiens
tatgttatatcaac

SEQ ID NO: 4967775 - DNA, 17 bp, Homo sapiens
tatgttcatttgtttgt

SEQ ID NO: 4967776 - DNA, 20 bp, Homo sapiens
tatgttgcctttatggtttc

SEQ ID NO: 4967777 - DNA, 16 bp, Homo sapiens
tatgttgtccaattgt

SEQ ID NO: 4967778 - DNA, 21 bp, Homo sapiens
tatgttgtccaattgttgaca

SEQ ID NO: 4967779 - DNA, 18 bp, Homo sapiens
tattaaaacattggatta

SEQ ID NO: 4967780 - DNA, 22 bp, Homo sapiens
tattaaaatgattgtaaaatag

SEQ ID NO: 4967781 - DNA, 18 bp, Homo sapiens
tattaaagtgctaaggtt

SEQ ID NO: 4967782 - DNA, 15 bp, Homo sapiens
tattaaataaaatca

SEQ ID NO: 4967783 - DNA, 11 bp, Homo sapiens
tattaatcttg

SEQ ID NO: 4967784 - DNA, 16 bp, Homo sapiens
tattaatcttggatag

SEQ ID NO: 4967785 - DNA, 21 bp, Homo sapiens
tattaatcttggatagctaat

SEQ ID NO: 4967786 - DNA, 11 bp, Homo sapiens
tattacaaata

SEQ ID NO: 4967787 - DNA, 17 bp, Homo sapiens
tattacactgtatttgt

SEQ ID NO: 4967788 - DNA, 19 bp, Homo sapiens
tattaccagcaagaataaa

SEQ ID NO: 4967789 - DNA, 14 bp, Homo sapiens
tattactcagttta

SEQ ID NO: 4967790 - DNA, 18 bp, Homo sapiens
tattactgtctggtttta

SEQ ID NO: 4967791 - DNA, 14 bp, Homo sapiens
tattacttgttgca

SEQ ID NO: 4967792 - DNA, 14 bp, Homo sapiens
tattactttatcac

SEQ ID NO: 4967793 - DNA, 18 bp, Homo sapiens
tattactttatcactttt

SEQ ID NO: 4967794 - DNA, 23 bp, Homo sapiens
tattactttatcactttttgaac

SEQ ID NO: 4967795 - DNA, 19 bp, Homo sapiens
tattagccaggatcatggt

SEQ ID NO: 4967796 - DNA, 17 bp, Homo sapiens
tattaggtgcaatttca

SEQ ID NO: 4967797 - DNA, 21 bp, Homo sapiens
tattaggtgcaatttcaaggt

SEQ ID NO: 4967798 - DNA, 21 bp, Homo sapiens
tattagtactgctcttgtttc

SEQ ID NO: 4967799 - DNA, 13 bp, Homo sapiens
tattataaatata

SEQ ID NO: 4967800 - DNA, 13 bp, Homo sapiens
tattataagcatt

SEQ ID NO: 4967801 - DNA, 16 bp, Homo sapiens
tattatatatataata

SEQ ID NO: 4967802 - DNA, 15 bp, Homo sapiens
tattatgtagttgtt

SEQ ID NO: 4967803 - DNA, 13 bp, Homo sapiens
tattattagaaat

SEQ ID NO: 4967804 - DNA, 19 bp, Homo sapiens
tattattagaaattagaaa

SEQ ID NO: 4967805 - DNA, 15 bp, Homo sapiens
tattattattttggg

SEQ ID NO: 4967806 - DNA, 18 bp, Homo sapiens
tattattgctgttgcttg

SEQ ID NO: 4967807 - DNA, 19 bp, Homo sapiens
tattattgctgttgcttga

SEQ ID NO: 4967808 - DNA, 21 bp, Homo sapiens
tattattgtggtaggcctttt

SEQ ID NO: 4967809 - DNA, 22 bp, Homo sapiens
tattattgtggtaggcctttta

SEQ ID NO: 4967810 - DNA, 13 bp, Homo sapiens
tattattttgggg

SEQ ID NO: 4967811 - DNA, 16 bp, Homo sapiens
tattcaaccatggact

SEQ ID NO: 4967812 - DNA, 17 bp, Homo sapiens
tattcaaccatggactt

SEQ ID NO: 4967813 - DNA, 14 bp, Homo sapiens
tattcactgggcca

SEQ ID NO: 4967814 - DNA, 12 bp, Homo sapiens
tattcagaatat

SEQ ID NO: 4967815 - DNA, 20 bp, Homo sapiens
tattcattctgtgatcattt

SEQ ID NO: 4967816 - DNA, 21 bp, Homo sapiens
tattccaaaaaggttgctgtt

SEQ ID NO: 4967817 - DNA, 17 bp, Homo sapiens
tattccagaatgctgta

SEQ ID NO: 4967818 - DNA, 17 bp, Homo sapiens
tattcctgcatttgtga

SEQ ID NO: 4967819 - DNA, 19 bp, Homo sapiens
tattccttctggcctttcc

SEQ ID NO: 4967820 - DNA, 12 bp, Homo sapiens
tattcctttccc

SEQ ID NO: 4967821 - DNA, 13 bp, Homo sapiens
tattcctttccct

SEQ ID NO: 4967822 - DNA, 16 bp, Homo sapiens
tattcgaatgaaaaga

SEQ ID NO: 4967823 - DNA, 11 bp, Homo sapiens
tattctaagac

SEQ ID NO: 4967824 - DNA, 13 bp, Homo sapiens
tattctaagactt

SEQ ID NO: 4967825 - DNA, 23 bp, Homo sapiens
tattctaagacttactctaagat

SEQ ID NO: 4967826 - DNA, 14 bp, Homo sapiens
tattctatatgaat

SEQ ID NO: 4967827 - DNA, 19 bp, Homo sapiens
tattctatatgaatttaaa

SEQ ID NO: 4967828 - DNA, 16 bp, Homo sapiens
tattctgaagcaacat

SEQ ID NO: 4967829 - DNA, 12 bp, Homo sapiens
tattctggagtt

SEQ ID NO: 4967830 - DNA, 22 bp, Homo sapiens
tattctgtagattctgtggaac

SEQ ID NO: 4967831 - DNA, 15 bp, Homo sapiens
tattctgttggaagc

SEQ ID NO: 4967832 - DNA, 14 bp, Homo sapiens
tattcttctagagt

SEQ ID NO: 4967833 - DNA, 18 bp, Homo sapiens
tattcttctagagttcag

SEQ ID NO: 4967834 - DNA, 18 bp, Homo sapiens
tattcttttctgcaaaat

SEQ ID NO: 4967835 - DNA, 13 bp, Homo sapiens
tattgaagaaaca

SEQ ID NO: 4967836 - DNA, 22 bp, Homo sapiens
tattgaagacaatttgatacat

SEQ ID NO: 4967837 - DNA, 20 bp, Homo sapiens
tattgacacagaaaatgttg

SEQ ID NO: 4967838 - DNA, 14 bp, Homo sapiens
tattgacatttgta

SEQ ID NO: 4967839 - DNA, 15 bp, Homo sapiens
tattgagatttctta

SEQ ID NO: 4967840 - DNA, 23 bp, Homo sapiens
tattgaggctttgtgttgtaatt

SEQ ID NO: 4967841 - DNA, 22 bp, Homo sapiens
ggatctcagctttgagaagcct

SEQ ID NO: 4967842 - DNA, 15 bp, Homo sapiens
ggatcttgaatgtgg

SEQ ID NO: 4967843 - DNA, 20 bp, Homo sapiens
ggatcttgaatgtggtctca

SEQ ID NO: 4967844 - DNA, 21 bp, Homo sapiens
ggatcttgaatgtggtctcag

SEQ ID NO: 4967845 - DNA, 22 bp, Homo sapiens
ggatgaatgaggtcccaggcag

SEQ ID NO: 4967846 - DNA, 12 bp, Homo sapiens
ggatgagaaagg

SEQ ID NO: 4967847 - DNA, 22 bp, Homo sapiens
ggatgagaaaggttgaagcacc

SEQ ID NO: 4967848 - DNA, 15 bp, Homo sapiens
ggatgagagcccaga

SEQ ID NO: 4967849 - DNA, 17 bp, Homo sapiens
ggatgccagggccgacc

SEQ ID NO: 4967850 - DNA, 19 bp, Homo sapiens
ggatgcctggtggcagctg

SEQ ID NO: 4967851 - DNA, 15 bp, Homo sapiens
ggatgtcacagggcc

SEQ ID NO: 4967852 - DNA, 15 bp, Homo sapiens
ggatgttctgggaca

SEQ ID NO: 4967853 - DNA, 16 bp, Homo sapiens
ggatgttctgggacac

SEQ ID NO: 4967854 - DNA, 23 bp, Homo sapiens
ggattacaagcgtgagccactgc

SEQ ID NO: 4967855 - DNA, 13 bp, Homo sapiens
ggattcaggctgc

SEQ ID NO: 4967856 - DNA, 22 bp, Homo sapiens
ggattcattgtctctcacagat

SEQ ID NO: 4967857 - DNA, 13 bp, Homo sapiens
ggattccatgcta

SEQ ID NO: 4967858 - DNA, 20 bp, Homo sapiens
ggattctgaggccctgccca

SEQ ID NO: 4967859 - DNA, 16 bp, Homo sapiens
ggattgctatgaatga

SEQ ID NO: 4967860 - DNA, 17 bp, Homo sapiens
ggattgcttgagcccag

SEQ ID NO: 4967861 - DNA, 16 bp, Homo sapiens
ggattggattatttaa

SEQ ID NO: 4967862 - DNA, 18 bp, Homo sapiens
ggattggattatttaata

SEQ ID NO: 4967863 - DNA, 22 bp, Homo sapiens
ggattggattatttaataacat

SEQ ID NO: 4967864 - DNA, 17 bp, Homo sapiens
ggatttaaaaactggaa

SEQ ID NO: 4967865 - DNA, 15 bp, Homo sapiens
ggcaaaagccttgtg

SEQ ID NO: 4967866 - DNA, 20 bp, Homo sapiens
ggcaaaagccttgtgtatat

SEQ ID NO: 4967867 - DNA, 19 bp, Homo sapiens
ggcaaccactaagaattca

SEQ ID NO: 4967868 - DNA, 16 bp, Homo sapiens
ggcaacccccagcctg

SEQ ID NO: 4967869 - DNA, 19 bp, Homo sapiens
ggcaacccccagcctgcta

SEQ ID NO: 4967870 - DNA, 15 bp, Homo sapiens
ggcaaccttgtctct

SEQ ID NO: 4967871 - DNA, 19 bp, Homo sapiens
ggcaaccttgtctctatgc

SEQ ID NO: 4967872 - DNA, 18 bp, Homo sapiens
ggcaactaagcagtccct

SEQ ID NO: 4967873 - DNA, 21 bp, Homo sapiens
ggcaacttcagtcctgggaga

SEQ ID NO: 4967874 - DNA, 22 bp, Homo sapiens
ggcaagctgtgacttctccagg

SEQ ID NO: 4967875 - DNA, 15 bp, Homo sapiens
ggcaatgatggcaat

SEQ ID NO: 4967876 - DNA, 13 bp, Homo sapiens
ggcaattgtctat

SEQ ID NO: 4967877 - DNA, 22 bp, Homo sapiens
ggcacaactgcaataacttctg

SEQ ID NO: 4967878 - DNA, 21 bp, Homo sapiens
ggcacactctgccagcaaaga

SEQ ID NO: 4967879 - DNA, 18 bp, Homo sapiens
ggcacagcggggccccag

SEQ ID NO: 4967880 - DNA, 13 bp, Homo sapiens
ggcacaggactga

SEQ ID NO: 4967881 - DNA, 16 bp, Homo sapiens
ggcacagggcagtggg

SEQ ID NO: 4967882 - DNA, 15 bp, Homo sapiens
ggcacagtccaggaa

SEQ ID NO: 4967883 - DNA, 15 bp, Homo sapiens
ggcaccaaagatgca

SEQ ID NO: 4967884 - DNA, 20 bp, Homo sapiens
ggcaccaaagatgcagccgc

SEQ ID NO: 4967885 - DNA, 22 bp, Homo sapiens
ggcaccactgcactccagcctg

SEQ ID NO: 4967886 - DNA, 14 bp, Homo sapiens
ggcaccagccagcg

SEQ ID NO: 4967887 - DNA, 14 bp, Homo sapiens
ggcaccatctccct

SEQ ID NO: 4967888 - DNA, 15 bp, Homo sapiens
ggcacccggcccctg

SEQ ID NO: 4967889 - DNA, 15 bp, Homo sapiens
ggcactagcctttgg

SEQ ID NO: 4967890 - DNA, 15 bp, Homo sapiens
ggcactggtggcccg

SEQ ID NO: 4967891 - DNA, 17 bp, Homo sapiens
ggcactgtagttctaag

SEQ ID NO: 4967892 - DNA, 18 bp, Homo sapiens
ggcactgtagttctaaga

SEQ ID NO: 4967893 - DNA, 15 bp, Homo sapiens
ggcacttaagcacaa

SEQ ID NO: 4967894 - DNA, 14 bp, Homo sapiens
ggcagaaaggaaaa

SEQ ID NO: 4967895 - DNA, 22 bp, Homo sapiens
ggcagaaaggaaaacctgaaga

SEQ ID NO: 4967896 - DNA, 19 bp, Homo sapiens
ggcagaagacaccagagca

SEQ ID NO: 4967897 - DNA, 21 bp, Homo sapiens
ggcagaagacaccagagcaga

SEQ ID NO: 4967898 - DNA, 22 bp, Homo sapiens
ggcagaagacaccagagcagat

SEQ ID NO: 4967899 - DNA, 16 bp, Homo sapiens
ggcagacgccggggac

SEQ ID NO: 4967900 - DNA, 9 bp, Homo sapiens
ggcagagag

SEQ ID NO: 4967901 - DNA, 21 bp, Homo sapiens
ggcagagtttgtgtgttgtct

SEQ ID NO: 4967902 - DNA, 18 bp, Homo sapiens
ggcagataatcagcctct

SEQ ID NO: 4967903 - DNA, 23 bp, Homo sapiens
ggcagatacaggaaaagctgctg

SEQ ID NO: 4967904 - DNA, 16 bp, Homo sapiens
ggcagatctgtgcccc

SEQ ID NO: 4967905 - DNA, 13 bp, Homo sapiens
ggcagccaggctg

SEQ ID NO: 4967906 - DNA, 15 bp, Homo sapiens
ggcagccaggctgcc

SEQ ID NO: 4967907 - DNA, 22 bp, Homo sapiens
ggcagcccagagactttgtaga

SEQ ID NO: 4967908 - DNA, 22 bp, Homo sapiens
ggcagccgtgccttcagctcta

SEQ ID NO: 4967909 - DNA, 16 bp, Homo sapiens
ggcagcctccagcctg

SEQ ID NO: 4967910 - DNA, 12 bp, Homo sapiens
ggcaggccctgc

SEQ ID NO: 4967911 - DNA, 14 bp, Homo sapiens
ggcaggccctgcag

SEQ ID NO: 4967912 - DNA, 17 bp, Homo sapiens
ggcagggaggtcaggcc

SEQ ID NO: 4967913 - DNA, 16 bp, Homo sapiens
ggcaggggctggaggg

SEQ ID NO: 4967914 - DNA, 18 bp, Homo sapiens
ggcagggtctcactctgt

SEQ ID NO: 4967915 - DNA, 14 bp, Homo sapiens
ggcagggtgaccct

SEQ ID NO: 4967916 - DNA, 14 bp, Homo sapiens
ggcaggtagccagg

SEQ ID NO: 4967917 - DNA, 13 bp, Homo sapiens
ggcaggtccaggg

SEQ ID NO: 4967918 - DNA, 15 bp, Homo sapiens
ggcaggtcctggcca

SEQ ID NO: 4967919 - DNA, 18 bp, Homo sapiens
ggcagtgagtgagcctgg

SEQ ID NO: 4967920 - DNA, 19 bp, Homo sapiens
ggcagtgagtgagcctggc

SEQ ID NO: 4967921 - DNA, 13 bp, Homo sapiens
ggcagtgggagct

SEQ ID NO: 4967922 - DNA, 18 bp, Homo sapiens
ggcagtgggagctgcctg

SEQ ID NO: 4967923 - DNA, 16 bp, Homo sapiens
ggcataaaacagcttt

SEQ ID NO: 4967924 - DNA, 13 bp, Homo sapiens
ggcataaactgtt

SEQ ID NO: 4967925 - DNA, 21 bp, Homo sapiens
ggcatacgcctgtagtcctag

SEQ ID NO: 4967926 - DNA, 18 bp, Homo sapiens
ggcatcagtccctatgta

SEQ ID NO: 4967927 - DNA, 19 bp, Homo sapiens
ggcatctgatttgcatatt

SEQ ID NO: 4967928 - DNA, 16 bp, Homo sapiens
ggcatctgcccctccc

SEQ ID NO: 4967929 - DNA, 19 bp, Homo sapiens
ggcatctgcccctccccca

SEQ ID NO: 4967930 - DNA, 21 bp, Homo sapiens
ggcatctttgccttgggctgc

SEQ ID NO: 4967931 - DNA, 22 bp, Homo sapiens
ggcatctttgccttgggctgct

SEQ ID NO: 4967932 - DNA, 13 bp, Homo sapiens
ggcatgaccagat

SEQ ID NO: 4967933 - DNA, 15 bp, Homo sapiens
ggcatgccccggcca

SEQ ID NO: 4967934 - DNA, 20 bp, Homo sapiens
ggcatgccccggccacctct

SEQ ID NO: 4967935 - DNA, 13 bp, Homo sapiens
ggcatgccttgtg

SEQ ID NO: 4967936 - DNA, 23 bp, Homo sapiens
ggcatggctttatttgttttttt

SEQ ID NO: 4967937 - DNA, 20 bp, Homo sapiens
ggcattagaattatttaaac

SEQ ID NO: 4967938 - DNA, 20 bp, Homo sapiens
ggcattatgtccactgtgta

SEQ ID NO: 4967939 - DNA, 16 bp, Homo sapiens
ggcattcttgtacagt

SEQ ID NO: 4967940 - DNA, 20 bp, Homo sapiens
ggcattgacaaatctgtgta

SEQ ID NO: 4967941 - DNA, 17 bp, Homo sapiens
ggccaaaagcagtaaat

SEQ ID NO: 4967942 - DNA, 15 bp, Homo sapiens
ggccaaaaggaaaaa

SEQ ID NO: 4967943 - DNA, 21 bp, Homo sapiens
ggccaacttgagggcccagag

SEQ ID NO: 4967944 - DNA, 23 bp, Homo sapiens
ggccaacttgagggcccagagca

SEQ ID NO: 4967945 - DNA, 15 bp, Homo sapiens
ggccaagacttggca

SEQ ID NO: 4967946 - DNA, 18 bp, Homo sapiens
tacatttggataaacaac

SEQ ID NO: 4967947 - DNA, 18 bp, Homo sapiens
tacattttgttgtaaaaa

SEQ ID NO: 4967948 - DNA, 22 bp, Homo sapiens
tacattttgttgtaaaaagaaa

SEQ ID NO: 4967949 - DNA, 20 bp, Homo sapiens
tacattttttgggcagcaat

SEQ ID NO: 4967950 - DNA, 17 bp, Homo sapiens
taccaaagttttatcaa

SEQ ID NO: 4967951 - DNA, 19 bp, Homo sapiens
taccaactttctgtaaact

SEQ ID NO: 4967952 - DNA, 21 bp, Homo sapiens
taccaatgccaagataattca

SEQ ID NO: 4967953 - DNA, 16 bp, Homo sapiens
taccactcacatgaca

SEQ ID NO: 4967954 - DNA, 23 bp, Homo sapiens
taccagactgcaggttggacccc

SEQ ID NO: 4967955 - DNA, 19 bp, Homo sapiens
taccagccctggggctggg

SEQ ID NO: 4967956 - DNA, 17 bp, Homo sapiens
taccagcttttaaccat

SEQ ID NO: 4967957 - DNA, 15 bp, Homo sapiens
taccagttaattact

SEQ ID NO: 4967958 - DNA, 14 bp, Homo sapiens
taccagtttgctga

SEQ ID NO: 4967959 - DNA, 13 bp, Homo sapiens
taccatacattta

SEQ ID NO: 4967960 - DNA, 22 bp, Homo sapiens
taccatactcatttctaaaaga

SEQ ID NO: 4967961 - DNA, 20 bp, Homo sapiens
taccattaaaactgcttttt

SEQ ID NO: 4967962 - DNA, 21 bp, Homo sapiens
taccattcacaataaaagctt

SEQ ID NO: 4967963 - DNA, 22 bp, Homo sapiens
taccattcagatcactgaattt

SEQ ID NO: 4967964 - DNA, 12 bp, Homo sapiens
taccatttcaga

SEQ ID NO: 4967965 - DNA, 15 bp, Homo sapiens
taccatttcagagag

SEQ ID NO: 4967966 - DNA, 21 bp, Homo sapiens
taccatttgctactgtacata

SEQ ID NO: 4967967 - DNA, 15 bp, Homo sapiens
tacccaaaagagaaa

SEQ ID NO: 4967968 - DNA, 23 bp, Homo sapiens
tacccaacggccctgcagccagc

SEQ ID NO: 4967969 - DNA, 17 bp, Homo sapiens
tacccacacctctgcca

SEQ ID NO: 4967970 - DNA, 18 bp, Homo sapiens
tacccacacctctgccag

SEQ ID NO: 4967971 - DNA, 12 bp, Homo sapiens
tacccacctaga

SEQ ID NO: 4967972 - DNA, 15 bp, Homo sapiens
tacccacctagaaca

SEQ ID NO: 4967973 - DNA, 12 bp, Homo sapiens
tacccactgctc

SEQ ID NO: 4967974 - DNA, 20 bp, Homo sapiens
tacccatctagtacttgaaa

SEQ ID NO: 4967975 - DNA, 21 bp, Homo sapiens
tacccccaggtggaaggcaga

SEQ ID NO: 4967976 - DNA, 17 bp, Homo sapiens
taccccctccttcagac

SEQ ID NO: 4967977 - DNA, 18 bp, Homo sapiens
taccccctccttcagaca

SEQ ID NO: 4967978 - DNA, 13 bp, Homo sapiens
tacccgttccaaa

SEQ ID NO: 4967979 - DNA, 14 bp, Homo sapiens
taccctaatgtctt

SEQ ID NO: 4967980 - DNA, 13 bp, Homo sapiens
taccctcccaccc

SEQ ID NO: 4967981 - DNA, 14 bp, Homo sapiens
taccctcccacccc

SEQ ID NO: 4967982 - DNA, 15 bp, Homo sapiens
taccctcccaccccc

SEQ ID NO: 4967983 - DNA, 21 bp, Homo sapiens
taccctctcagctccaggtgg

SEQ ID NO: 4967984 - DNA, 17 bp, Homo sapiens
taccctgagttcatcca

SEQ ID NO: 4967985 - DNA, 18 bp, Homo sapiens
taccctggccgccccctg

SEQ ID NO: 4967986 - DNA, 21 bp, Homo sapiens
taccctgggaaggcctcttgg

SEQ ID NO: 4967987 - DNA, 17 bp, Homo sapiens
tacccttaattacttaa

SEQ ID NO: 4967988 - DNA, 17 bp, Homo sapiens
taccctttttctccagc

SEQ ID NO: 4967989 - DNA, 19 bp, Homo sapiens
taccctttttctccagctg

SEQ ID NO: 4967990 - DNA, 22 bp, Homo sapiens
tacctaaaaggaaatctcaccc

SEQ ID NO: 4967991 - DNA, 23 bp, Homo sapiens
tacctaaaaggaaatctcacccc

SEQ ID NO: 4967992 - DNA, 16 bp, Homo sapiens
tacctataatgtgtgt

SEQ ID NO: 4967993 - DNA, 17 bp, Homo sapiens
tacctataatgtgtgta

SEQ ID NO: 4967994 - DNA, 19 bp, Homo sapiens
tacctcaaccatcctggct

SEQ ID NO: 4967995 - DNA, 13 bp, Homo sapiens
tacctcaatgttt

SEQ ID NO: 4967996 - DNA, 14 bp, Homo sapiens
tacctcaatgtttg

SEQ ID NO: 4967997 - DNA, 15 bp, Homo sapiens
tacctcaggcaggaa

SEQ ID NO: 4967998 - DNA, 12 bp, Homo sapiens
tacctcatgttt

SEQ ID NO: 4967999 - DNA, 20 bp, Homo sapiens
tacctcatgtttatgaaaat

SEQ ID NO: 4968000 - DNA, 22 bp, Homo sapiens
tacctccaacagaactaaatgt

SEQ ID NO: 4968001 - DNA, 11 bp, Homo sapiens
tacctcctcct

SEQ ID NO: 4968002 - DNA, 17 bp, Homo sapiens
tacctctgaccaacagg

SEQ ID NO: 4968003 - DNA, 21 bp, Homo sapiens
tacctctggctgactaaattt

SEQ ID NO: 4968004 - DNA, 12 bp, Homo sapiens
tacctctgtgtg

SEQ ID NO: 4968005 - DNA, 18 bp, Homo sapiens
tacctgacctcttgctgt

SEQ ID NO: 4968006 - DNA, 22 bp, Homo sapiens
tacctgacctcttgctgtctct

SEQ ID NO: 4968007 - DNA, 23 bp, Homo sapiens
tacctgatggaagtaaagcctca

SEQ ID NO: 4968008 - DNA, 18 bp, Homo sapiens
tacctgtcacattgcatt

SEQ ID NO: 4968009 - DNA, 14 bp, Homo sapiens
tacctgtgtacata

SEQ ID NO: 4968010 - DNA, 12 bp, Homo sapiens
taccttactgtg

SEQ ID NO: 4968011 - DNA, 12 bp, Homo sapiens
taccttctttca

SEQ ID NO: 4968012 - DNA, 16 bp, Homo sapiens
taccttttatgtagca

SEQ ID NO: 4968013 - DNA, 14 bp, Homo sapiens
tacgatacgctact

SEQ ID NO: 4968014 - DNA, 20 bp, Homo sapiens
tacggtcaggtttaacattt

SEQ ID NO: 4968015 - DNA, 16 bp, Homo sapiens
tacgtctgacaggcaa

SEQ ID NO: 4968016 - DNA, 12 bp, Homo sapiens
tactaaaatata

SEQ ID NO: 4968017 - DNA, 13 bp, Homo sapiens
tactaaaatatat

SEQ ID NO: 4968018 - DNA, 12 bp, Homo sapiens
tactaaacatat

SEQ ID NO: 4968019 - DNA, 18 bp, Homo sapiens
tactaaacatatgatttc

SEQ ID NO: 4968020 - DNA, 13 bp, Homo sapiens
tactaaatttaaa

SEQ ID NO: 4968021 - DNA, 17 bp, Homo sapiens
tactaaatttaaattta

SEQ ID NO: 4968022 - DNA, 21 bp, Homo sapiens
tactaaatttaaatttaaaga

SEQ ID NO: 4968023 - DNA, 23 bp, Homo sapiens
tactaaatttaaatttaaagata

SEQ ID NO: 4968024 - DNA, 22 bp, Homo sapiens
tactaagttcacattagaatta

SEQ ID NO: 4968025 - DNA, 16 bp, Homo sapiens
tactaatgtaaaatga

SEQ ID NO: 4968026 - DNA, 13 bp, Homo sapiens
tactaattccaca

SEQ ID NO: 4968027 - DNA, 15 bp, Homo sapiens
tactaattttacaca

SEQ ID NO: 4968028 - DNA, 17 bp, Homo sapiens
tactaattttacacatt

SEQ ID NO: 4968029 - DNA, 18 bp, Homo sapiens
tactaattttacacatta

SEQ ID NO: 4968030 - DNA, 20 bp, Homo sapiens
tactacactccatgtcaggt

SEQ ID NO: 4968031 - DNA, 13 bp, Homo sapiens
tactacactgagg

SEQ ID NO: 4968032 - DNA, 16 bp, Homo sapiens
tactaccttgaaaata

SEQ ID NO: 4968033 - DNA, 20 bp, Homo sapiens
tactaccttgaaaataagaa

SEQ ID NO: 4968034 - DNA, 21 bp, Homo sapiens
tactactgaaacagatttcat

SEQ ID NO: 4968035 - DNA, 16 bp, Homo sapiens
tactagtactgtgtac

SEQ ID NO: 4968036 - DNA, 18 bp, Homo sapiens
tactagtactgtgtactg

SEQ ID NO: 4968037 - DNA, 14 bp, Homo sapiens
tactagtgttctgt

SEQ ID NO: 4968038 - DNA, 13 bp, Homo sapiens
tactataaagaga

SEQ ID NO: 4968039 - DNA, 14 bp, Homo sapiens
tactataaagagaa

SEQ ID NO: 4968040 - DNA, 13 bp, Homo sapiens
tactatagtacca

SEQ ID NO: 4968041 - DNA, 16 bp, Homo sapiens
tactatagtaccagta

SEQ ID NO: 4968042 - DNA, 15 bp, Homo sapiens
tactatatttgctag

SEQ ID NO: 4968043 - DNA, 22 bp, Homo sapiens
tactattcagtggcgagaaata

SEQ ID NO: 4968044 - DNA, 19 bp, Homo sapiens
tactatttaaagcctcctc

SEQ ID NO: 4968045 - DNA, 13 bp, Homo sapiens
tactatttagata

SEQ ID NO: 4968046 - DNA, 18 bp, Homo sapiens
tactattttctacaatta

SEQ ID NO: 4968047 - DNA, 17 bp, Homo sapiens
tactattttgacagtta

SEQ ID NO: 4968048 - DNA, 15 bp, Homo sapiens
tactcactgaagcct

SEQ ID NO: 4968049 - DNA, 20 bp, Homo sapiens
tactcagggctcctcccagc

SEQ ID NO: 4968050 - DNA, 21 bp, Homo sapiens
tactcagggctcctcccagct

SEQ ID NO: 4968051 - DNA, 17 bp, Homo sapiens
tactcattgaaatgtca

SEQ ID NO: 4968052 - DNA, 11 bp, Homo sapiens
tactcatttct

SEQ ID NO: 4968053 - DNA, 18 bp, Homo sapiens
tactcatttctaaaagaa

SEQ ID NO: 4968054 - DNA, 15 bp, Homo sapiens
tactccataaacaga

SEQ ID NO: 4968055 - DNA, 14 bp, Homo sapiens
tactccctctcagg

SEQ ID NO: 4968056 - DNA, 21 bp, Homo sapiens
ggactgccagtccccctgccc

SEQ ID NO: 4968057 - DNA, 18 bp, Homo sapiens
ggactgctgctgcctggc

SEQ ID NO: 4968058 - DNA, 20 bp, Homo sapiens
ggactgctgctgcctggcca

SEQ ID NO: 4968059 - DNA, 14 bp, Homo sapiens
ggactggcccctgg

SEQ ID NO: 4968060 - DNA, 16 bp, Homo sapiens
ggactggcccctgggt

SEQ ID NO: 4968061 - DNA, 12 bp, Homo sapiens
ggactgggaggt

SEQ ID NO: 4968062 - DNA, 16 bp, Homo sapiens
ggacttcggaccgctt

SEQ ID NO: 4968063 - DNA, 22 bp, Homo sapiens
ggactttgctgatttcccctct

SEQ ID NO: 4968064 - DNA, 19 bp, Homo sapiens
ggactttgtatactttaaa

SEQ ID NO: 4968065 - DNA, 20 bp, Homo sapiens
ggactttgtatactttaaat

SEQ ID NO: 4968066 - DNA, 22 bp, Homo sapiens
ggagaagagaggagaggagaga

SEQ ID NO: 4968067 - DNA, 14 bp, Homo sapiens
ggagaagggatgga

SEQ ID NO: 4968068 - DNA, 17 bp, Homo sapiens
ggagacactggcccctc

SEQ ID NO: 4968069 - DNA, 19 bp, Homo sapiens
ggagacagccccagagcag

SEQ ID NO: 4968070 - DNA, 23 bp, Homo sapiens
ggagacagccccagagcagggtg

SEQ ID NO: 4968071 - DNA, 16 bp, Homo sapiens
ggagaccctgcaaaca

SEQ ID NO: 4968072 - DNA, 21 bp, Homo sapiens
ggagacctctccttcctaccc

SEQ ID NO: 4968073 - DNA, 15 bp, Homo sapiens
ggagactggggggct

SEQ ID NO: 4968074 - DNA, 20 bp, Homo sapiens
ggagactggtcctgtgtgca

SEQ ID NO: 4968075 - DNA, 16 bp, Homo sapiens
ggagactgtctcaaga

SEQ ID NO: 4968076 - DNA, 14 bp, Homo sapiens
ggagagacacagcg

SEQ ID NO: 4968077 - DNA, 11 bp, Homo sapiens
ggagagagaaa

SEQ ID NO: 4968078 - DNA, 12 bp, Homo sapiens
ggagagagaaag

SEQ ID NO: 4968079 - DNA, 18 bp, Homo sapiens
ggagagagaaagccaggc

SEQ ID NO: 4968080 - DNA, 21 bp, Homo sapiens
ggagagagaaagccaggcagg

SEQ ID NO: 4968081 - DNA, 10 bp, Homo sapiens
ggagagaggc

SEQ ID NO: 4968082 - DNA, 18 bp, Homo sapiens
ggagagaggcagagagcg

SEQ ID NO: 4968083 - DNA, 17 bp, Homo sapiens
ggagagcccctggggcc

SEQ ID NO: 4968084 - DNA, 12 bp, Homo sapiens
ggagaggagaga

SEQ ID NO: 4968085 - DNA, 13 bp, Homo sapiens
ggagaggagagag

SEQ ID NO: 4968086 - DNA, 18 bp, Homo sapiens
ggagaggagagaggcaga

SEQ ID NO: 4968087 - DNA, 20 bp, Homo sapiens
ggagaggatgagagcccaga

SEQ ID NO: 4968088 - DNA, 17 bp, Homo sapiens
ggagatgccatcctctt

SEQ ID NO: 4968089 - DNA, 21 bp, Homo sapiens
ggagattttgaggtaaagata

SEQ ID NO: 4968090 - DNA, 15 bp, Homo sapiens
ggagcacaggtccca

SEQ ID NO: 4968091 - DNA, 15 bp, Homo sapiens
ggagcaggagattga

SEQ ID NO: 4968092 - DNA, 21 bp, Homo sapiens
ggagcaggagattgagaagga

SEQ ID NO: 4968093 - DNA, 23 bp, Homo sapiens
ggagcaggagattgagaaggaga

SEQ ID NO: 4968094 - DNA, 17 bp, Homo sapiens
ggagcagggaaggcctg

SEQ ID NO: 4968095 - DNA, 21 bp, Homo sapiens
ggagcagggaaggcctgactt

SEQ ID NO: 4968096 - DNA, 21 bp, Homo sapiens
ggagcatcccggaggaaatct

SEQ ID NO: 4968097 - DNA, 16 bp, Homo sapiens
ggagcatctcttgagg

SEQ ID NO: 4968098 - DNA, 14 bp, Homo sapiens
ggagcatgggcctg

SEQ ID NO: 4968099 - DNA, 19 bp, Homo sapiens
ggagcatgttttgtataca

SEQ ID NO: 4968100 - DNA, 20 bp, Homo sapiens
ggagcatgttttgtatacaa

SEQ ID NO: 4968101 - DNA, 16 bp, Homo sapiens
ggagccaatggagact

SEQ ID NO: 4968102 - DNA, 23 bp, Homo sapiens
ggagcccacggctaagaggctgc

SEQ ID NO: 4968103 - DNA, 14 bp, Homo sapiens
ggagccccaggcct

SEQ ID NO: 4968104 - DNA, 12 bp, Homo sapiens
ggagccccaggg

SEQ ID NO: 4968105 - DNA, 14 bp, Homo sapiens
ggagccccagggtc

SEQ ID NO: 4968106 - DNA, 22 bp, Homo sapiens
ggagccccgaggccttctctga

SEQ ID NO: 4968107 - DNA, 22 bp, Homo sapiens
ggagcctaggaccactcagccc

SEQ ID NO: 4968108 - DNA, 20 bp, Homo sapiens
ggagcctccactgcctctgg

SEQ ID NO: 4968109 - DNA, 13 bp, Homo sapiens
ggagcctggcaca

SEQ ID NO: 4968110 - DNA, 19 bp, Homo sapiens
ggagcctggcacaggactg

SEQ ID NO: 4968111 - DNA, 12 bp, Homo sapiens
ggagctaaggct

SEQ ID NO: 4968112 - DNA, 13 bp, Homo sapiens
ggagctcctctcc

SEQ ID NO: 4968113 - DNA, 20 bp, Homo sapiens
ggagctcctctcctggagga

SEQ ID NO: 4968114 - DNA, 20 bp, Homo sapiens
ggagctcttcaggcctccct

SEQ ID NO: 4968115 - DNA, 12 bp, Homo sapiens
ggagctgcctgt

SEQ ID NO: 4968116 - DNA, 21 bp, Homo sapiens
ggagctgcctgttcagctcca

SEQ ID NO: 4968117 - DNA, 17 bp, Homo sapiens
ggagctgccttggctca

SEQ ID NO: 4968118 - DNA, 21 bp, Homo sapiens
ggagctgccttggctcagaca

SEQ ID NO: 4968119 - DNA, 13 bp, Homo sapiens
ggagctgctggct

SEQ ID NO: 4968120 - DNA, 20 bp, Homo sapiens
ggagctggggagaggaaaga

SEQ ID NO: 4968121 - DNA, 20 bp, Homo sapiens
ggaggaaaaccaagccgtgg

SEQ ID NO: 4968122 - DNA, 21 bp, Homo sapiens
ggaggaaaaccaagccgtggc

SEQ ID NO: 4968123 - DNA, 12 bp, Homo sapiens
ggaggacctggg

SEQ ID NO: 4968124 - DNA, 20 bp, Homo sapiens
ggaggaggaccctggaaatg

SEQ ID NO: 4968125 - DNA, 20 bp, Homo sapiens
ggaggcaaagctggctcacc

SEQ ID NO: 4968126 - DNA, 21 bp, Homo sapiens
ggaggcaaagctggctcacct

SEQ ID NO: 4968127 - DNA, 16 bp, Homo sapiens
ggaggccccactgatg

SEQ ID NO: 4968128 - DNA, 20 bp, Homo sapiens
ggaggccttccagctgctgt

SEQ ID NO: 4968129 - DNA, 10 bp, Homo sapiens
ggaggctgcg

SEQ ID NO: 4968130 - DNA, 17 bp, Homo sapiens
ggaggctgcgtgccagt

SEQ ID NO: 4968131 - DNA, 16 bp, Homo sapiens
ggagggagcagacagg

SEQ ID NO: 4968132 - DNA, 14 bp, Homo sapiens
ggaggggaagctgc

SEQ ID NO: 4968133 - DNA, 22 bp, Homo sapiens
ggagggtgggggccacctgcct

SEQ ID NO: 4968134 - DNA, 15 bp, Homo sapiens
ggaggtcaggccctg

SEQ ID NO: 4968135 - DNA, 16 bp, Homo sapiens
ggaggtcaggccctgg

SEQ ID NO: 4968136 - DNA, 19 bp, Homo sapiens
ggaggtggggcgaggcagg

SEQ ID NO: 4968137 - DNA, 22 bp, Homo sapiens
ggaggtgtcacatggtgcccct

SEQ ID NO: 4968138 - DNA, 12 bp, Homo sapiens
ggaggttctaag

SEQ ID NO: 4968139 - DNA, 15 bp, Homo sapiens
ggagtccaggcacag

SEQ ID NO: 4968140 - DNA, 17 bp, Homo sapiens
ggagtccaggcacagga

SEQ ID NO: 4968141 - DNA, 22 bp, Homo sapiens
ggagtcccaccttggctgcagg

SEQ ID NO: 4968142 - DNA, 23 bp, Homo sapiens
ggagtcccaccttggctgcaggg

SEQ ID NO: 4968143 - DNA, 13 bp, Homo sapiens
ggagtcccctcac

SEQ ID NO: 4968144 - DNA, 16 bp, Homo sapiens
ggagtgacagaggcag

SEQ ID NO: 4968145 - DNA, 12 bp, Homo sapiens
ggagtgcagtga

SEQ ID NO: 4968146 - DNA, 14 bp, Homo sapiens
ggagtgcagtgagc

SEQ ID NO: 4968147 - DNA, 15 bp, Homo sapiens
ggagtgcagtgagcc

SEQ ID NO: 4968148 - DNA, 19 bp, Homo sapiens
ggagtgcccaccctgggag

SEQ ID NO: 4968149 - DNA, 16 bp, Homo sapiens
ggagtgctggctcaca

SEQ ID NO: 4968150 - DNA, 14 bp, Homo sapiens
ggagtgggcagagc

SEQ ID NO: 4968151 - DNA, 13 bp, Homo sapiens
ggagtggtgcaga

SEQ ID NO: 4968152 - DNA, 16 bp, Homo sapiens
ggagtggtgcagacag

SEQ ID NO: 4968153 - DNA, 15 bp, Homo sapiens
ggagtgtttcatggg

SEQ ID NO: 4968154 - DNA, 21 bp, Homo sapiens
ggagttcgaggctgcagtcag

SEQ ID NO: 4968155 - DNA, 20 bp, Homo sapiens
ggagtttttgtttggagagc

SEQ ID NO: 4968156 - DNA, 17 bp, Homo sapiens
ggataaaataatgctgc

SEQ ID NO: 4968157 - DNA, 14 bp, Homo sapiens
ggataacctatatg

SEQ ID NO: 4968158 - DNA, 15 bp, Homo sapiens
ggataagccagctgc

SEQ ID NO: 4968159 - DNA, 15 bp, Homo sapiens
ggatactgcagggcc

SEQ ID NO: 4968160 - DNA, 21 bp, Homo sapiens
ggatactgcagggccaggact

SEQ ID NO: 4968161 - DNA, 13 bp, Homo sapiens
ggatagcattttt

SEQ ID NO: 4968162 - DNA, 17 bp, Homo sapiens
ggataggagcctgctgg

SEQ ID NO: 4968163 - DNA, 22 bp, Homo sapiens
ggatatccttatcagagctaag

SEQ ID NO: 4968164 - DNA, 11 bp, Homo sapiens
ggatatttaag

SEQ ID NO: 4968165 - DNA, 16 bp, Homo sapiens
ggatcagatgaactct

SEQ ID NO: 4968166 - DNA, 15 bp, Homo sapiens
gcctctgccttagag

SEQ ID NO: 4968167 - DNA, 20 bp, Homo sapiens
gcctcttaaagctgcctgta

SEQ ID NO: 4968168 - DNA, 22 bp, Homo sapiens
gcctcttaaagctgcctgtagt

SEQ ID NO: 4968169 - DNA, 17 bp, Homo sapiens
gcctcttactaatgtaa

SEQ ID NO: 4968170 - DNA, 19 bp, Homo sapiens
gcctcttactaatgtaaaa

SEQ ID NO: 4968171 - DNA, 21 bp, Homo sapiens
gcctgaaggaggtgagagaag

SEQ ID NO: 4968172 - DNA, 17 bp, Homo sapiens
gcctgaagtcacacagt

SEQ ID NO: 4968173 - DNA, 18 bp, Homo sapiens
gcctgaagtcacacagtg

SEQ ID NO: 4968174 - DNA, 13 bp, Homo sapiens
gcctgacttgggg

SEQ ID NO: 4968175 - DNA, 19 bp, Homo sapiens
gcctgagagaattggctca

SEQ ID NO: 4968176 - DNA, 19 bp, Homo sapiens
gcctgagagacatggcttt

SEQ ID NO: 4968177 - DNA, 18 bp, Homo sapiens
gcctgagcaactcttgat

SEQ ID NO: 4968178 - DNA, 14 bp, Homo sapiens
gcctgagctcactc

SEQ ID NO: 4968179 - DNA, 23 bp, Homo sapiens
gcctgagctcactcggcaccctg

SEQ ID NO: 4968180 - DNA, 12 bp, Homo sapiens
gcctgagtcagg

SEQ ID NO: 4968181 - DNA, 22 bp, Homo sapiens
gcctgagtcagggcccagaggc

SEQ ID NO: 4968182 - DNA, 16 bp, Homo sapiens
gcctgatctcttcctg

SEQ ID NO: 4968183 - DNA, 20 bp, Homo sapiens
gcctgatgctccctcccctg

SEQ ID NO: 4968184 - DNA, 15 bp, Homo sapiens
gcctgcaatttcata

SEQ ID NO: 4968185 - DNA, 21 bp, Homo sapiens
gcctgcccaagcccaggccac

SEQ ID NO: 4968186 - DNA, 15 bp, Homo sapiens
gcctgcccaggcccc

SEQ ID NO: 4968187 - DNA, 14 bp, Homo sapiens
gcctgcccctctcc

SEQ ID NO: 4968188 - DNA, 20 bp, Homo sapiens
gcctgccctcatggcccctc

SEQ ID NO: 4968189 - DNA, 12 bp, Homo sapiens
gcctgcctggag

SEQ ID NO: 4968190 - DNA, 14 bp, Homo sapiens
gcctgcgtcttccg

SEQ ID NO: 4968191 - DNA, 15 bp, Homo sapiens
gcctgcgtcttccgc

SEQ ID NO: 4968192 - DNA, 16 bp, Homo sapiens
gcctgcgtcttccgcc

SEQ ID NO: 4968193 - DNA, 18 bp, Homo sapiens
gcctgcgtcttccgcccc

SEQ ID NO: 4968194 - DNA, 23 bp, Homo sapiens
gcctgcgtcttccgcccctgcct

SEQ ID NO: 4968195 - DNA, 23 bp, Homo sapiens
gcctgctaattccccagattgca

SEQ ID NO: 4968196 - DNA, 18 bp, Homo sapiens
gcctgctgcccaggctgt

SEQ ID NO: 4968197 - DNA, 21 bp, Homo sapiens
gcctggacagtatcccacatc

SEQ ID NO: 4968198 - DNA, 15 bp, Homo sapiens
gcctggacctgcctc

SEQ ID NO: 4968199 - DNA, 17 bp, Homo sapiens
gcctggacctgcctcct

SEQ ID NO: 4968200 - DNA, 23 bp, Homo sapiens
gcctggatttctggttctgatgc

SEQ ID NO: 4968201 - DNA, 16 bp, Homo sapiens
gcctggcacacatcag

SEQ ID NO: 4968202 - DNA, 15 bp, Homo sapiens
gcctggcacaggact

SEQ ID NO: 4968203 - DNA, 16 bp, Homo sapiens
gcctggcacaggactg

SEQ ID NO: 4968204 - DNA, 13 bp, Homo sapiens
gcctggcacaggg

SEQ ID NO: 4968205 - DNA, 19 bp, Homo sapiens
gcctggcacagggcagtgg

SEQ ID NO: 4968206 - DNA, 21 bp, Homo sapiens
gcctggcagccgtgccttcag

SEQ ID NO: 4968207 - DNA, 23 bp, Homo sapiens
gcctggcagggaggtcaggccct

SEQ ID NO: 4968208 - DNA, 20 bp, Homo sapiens
gcctggcattcttgtacagt

SEQ ID NO: 4968209 - DNA, 14 bp, Homo sapiens
gcctggccaggagc

SEQ ID NO: 4968210 - DNA, 15 bp, Homo sapiens
gcctggccaggagct

SEQ ID NO: 4968211 - DNA, 14 bp, Homo sapiens
gcctggcccataga

SEQ ID NO: 4968212 - DNA, 16 bp, Homo sapiens
gcctggccctgccctg

SEQ ID NO: 4968213 - DNA, 14 bp, Homo sapiens
gcctggcctggccc

SEQ ID NO: 4968214 - DNA, 16 bp, Homo sapiens
gcctggcctggccctg

SEQ ID NO: 4968215 - DNA, 23 bp, Homo sapiens
gcctggctctttcgtcacccttg

SEQ ID NO: 4968216 - DNA, 20 bp, Homo sapiens
gcctggcttctttctctcag

SEQ ID NO: 4968217 - DNA, 18 bp, Homo sapiens
gcctgggcagccaggctg

SEQ ID NO: 4968218 - DNA, 23 bp, Homo sapiens
gcctgggcagccaggctgccaag

SEQ ID NO: 4968219 - DNA, 21 bp, Homo sapiens
gcctgggctgaccccggtggc

SEQ ID NO: 4968220 - DNA, 14 bp, Homo sapiens
gcctggggcctgag

SEQ ID NO: 4968221 - DNA, 15 bp, Homo sapiens
gcctggggcctgaga

SEQ ID NO: 4968222 - DNA, 15 bp, Homo sapiens
gcctggggcctggca

SEQ ID NO: 4968223 - DNA, 17 bp, Homo sapiens
gcctggggcctggcagg

SEQ ID NO: 4968224 - DNA, 19 bp, Homo sapiens
gcctgggggagttttcctc

SEQ ID NO: 4968225 - DNA, 21 bp, Homo sapiens
gcctgggggagttttcctcta

SEQ ID NO: 4968226 - DNA, 23 bp, Homo sapiens
gcctgggtggatcggcctcctct

SEQ ID NO: 4968227 - DNA, 14 bp, Homo sapiens
gcctggtggcagct

SEQ ID NO: 4968228 - DNA, 15 bp, Homo sapiens
gcctggtggcagctg

SEQ ID NO: 4968229 - DNA, 17 bp, Homo sapiens
gcctggtggcagctgcg

SEQ ID NO: 4968230 - DNA, 18 bp, Homo sapiens
gcctggtggcagctgcgg

SEQ ID NO: 4968231 - DNA, 16 bp, Homo sapiens
gcctgtagttaggaaa

SEQ ID NO: 4968232 - DNA, 19 bp, Homo sapiens
gcctgtagttaggaaataa

SEQ ID NO: 4968233 - DNA, 13 bp, Homo sapiens
gcctgtatacttt

SEQ ID NO: 4968234 - DNA, 19 bp, Homo sapiens
gcctgtatactttagtatg

SEQ ID NO: 4968235 - DNA, 19 bp, Homo sapiens
gcctgtcatccttggtctt

SEQ ID NO: 4968236 - DNA, 13 bp, Homo sapiens
gcctgtccagcct

SEQ ID NO: 4968237 - DNA, 15 bp, Homo sapiens
gcctgtccagcctgg

SEQ ID NO: 4968238 - DNA, 17 bp, Homo sapiens
gcctgtctcatccccag

SEQ ID NO: 4968239 - DNA, 15 bp, Homo sapiens
gcctgtgcaatgcat

SEQ ID NO: 4968240 - DNA, 19 bp, Homo sapiens
gcctgtgcatgtatgtctt

SEQ ID NO: 4968241 - DNA, 16 bp, Homo sapiens
gcctgtggaatgagtg

SEQ ID NO: 4968242 - DNA, 18 bp, Homo sapiens
gcctgtggaatgagtgtg

SEQ ID NO: 4968243 - DNA, 22 bp, Homo sapiens
gcctgtggatgatcaatccttt

SEQ ID NO: 4968244 - DNA, 14 bp, Homo sapiens
gcctgttcagctcc

SEQ ID NO: 4968245 - DNA, 19 bp, Homo sapiens
gccttaaaatggaattgaa

SEQ ID NO: 4968246 - DNA, 16 bp, Homo sapiens
gccttaaagaaagtcg

SEQ ID NO: 4968247 - DNA, 17 bp, Homo sapiens
gccttagaacctttctt

SEQ ID NO: 4968248 - DNA, 15 bp, Homo sapiens
gccttaggcctacct

SEQ ID NO: 4968249 - DNA, 15 bp, Homo sapiens
gccttagggaagctg

SEQ ID NO: 4968250 - DNA, 22 bp, Homo sapiens
gccttagtctcagtttgtgtgt

SEQ ID NO: 4968251 - DNA, 16 bp, Homo sapiens
gccttagtgggccagg

SEQ ID NO: 4968252 - DNA, 19 bp, Homo sapiens
gccttagtgggccagggct

SEQ ID NO: 4968253 - DNA, 20 bp, Homo sapiens
gccttagtgggccagggctg

SEQ ID NO: 4968254 - DNA, 13 bp, Homo sapiens
gccttccagctgc

SEQ ID NO: 4968255 - DNA, 16 bp, Homo sapiens
gccttccagctgctgt

SEQ ID NO: 4968256 - DNA, 18 bp, Homo sapiens
gccttccagctgctgtct

SEQ ID NO: 4968257 - DNA, 23 bp, Homo sapiens
gccttccttcccgccagagggct

SEQ ID NO: 4968258 - DNA, 19 bp, Homo sapiens
gccttccttgaccttcctc

SEQ ID NO: 4968259 - DNA, 21 bp, Homo sapiens
gccttcctttctccaggacca

SEQ ID NO: 4968260 - DNA, 23 bp, Homo sapiens
gccttcgatacaccgggcctgga

SEQ ID NO: 4968261 - DNA, 14 bp, Homo sapiens
gccttgctggacgg

SEQ ID NO: 4968262 - DNA, 15 bp, Homo sapiens
gccttggcctcccaa

SEQ ID NO: 4968263 - DNA, 20 bp, Homo sapiens
gccttggggaggacaaaact

SEQ ID NO: 4968264 - DNA, 21 bp, Homo sapiens
gccttggggaggacaaaactt

SEQ ID NO: 4968265 - DNA, 19 bp, Homo sapiens
gccttgtctcctactcctg

SEQ ID NO: 4968266 - DNA, 23 bp, Homo sapiens
gccttgtctcctactcctgactc

SEQ ID NO: 4968267 - DNA, 17 bp, Homo sapiens
gccttgtgctgttaata

SEQ ID NO: 4968268 - DNA, 13 bp, Homo sapiens
gccttgtgtatat

SEQ ID NO: 4968269 - DNA, 14 bp, Homo sapiens
gcctttctgcagtt

SEQ ID NO: 4968270 - DNA, 12 bp, Homo sapiens
gcctttgacatt

SEQ ID NO: 4968271 - DNA, 13 bp, Homo sapiens
gcctttgacattt

SEQ ID NO: 4968272 - DNA, 14 bp, Homo sapiens
gcctttgagacagt

SEQ ID NO: 4968273 - DNA, 21 bp, Homo sapiens
gcctttgagacagtttcttag

SEQ ID NO: 4968274 - DNA, 15 bp, Homo sapiens
gcctttgcctccccg

SEQ ID NO: 4968275 - DNA, 15 bp, Homo sapiens
gccttttaacatttt

SEQ ID NO: 4968276 - DNA, 12 bp, Homo sapiens
gccttttgaaag

SEQ ID NO: 4968277 - DNA, 12 bp, Homo sapiens
gccttttgtata

SEQ ID NO: 4968278 - DNA, 13 bp, Homo sapiens
gccttttgtatac

SEQ ID NO: 4968279 - DNA, 14 bp, Homo sapiens
gccttttgtataca

SEQ ID NO: 4968280 - DNA, 22 bp, Homo sapiens
gccttttgtatacatcctgggt

SEQ ID NO: 4968281 - DNA, 19 bp, Homo sapiens
gcctttttcattttccaat

SEQ ID NO: 4968282 - DNA, 19 bp, Homo sapiens
gcgaaaatagtttgtttaa

SEQ ID NO: 4968283 - DNA, 20 bp, Homo sapiens
gcgaagtagcttgctccctg

SEQ ID NO: 4968284 - DNA, 20 bp, Homo sapiens
gcgaagtatataaattggct

SEQ ID NO: 4968285 - DNA, 18 bp, Homo sapiens
gcgacaggagtatttttt

SEQ ID NO: 4968286 - DNA, 13 bp, Homo sapiens
gcgaccgccccct

SEQ ID NO: 4968287 - DNA, 12 bp, Homo sapiens
gcgaggcaggcc

SEQ ID NO: 4968288 - DNA, 12 bp, Homo sapiens
gcgagggcagct

SEQ ID NO: 4968289 - DNA, 17 bp, Homo sapiens
gcgagggcagctgctat

SEQ ID NO: 4968290 - DNA, 13 bp, Homo sapiens
gcgatagagtctc

SEQ ID NO: 4968291 - DNA, 20 bp, Homo sapiens
gcgatcccacacaggctggc

SEQ ID NO: 4968292 - DNA, 15 bp, Homo sapiens
gcgatggtctcagaa

SEQ ID NO: 4968293 - DNA, 14 bp, Homo sapiens
gcgattcttctgct

SEQ ID NO: 4968294 - DNA, 23 bp, Homo sapiens
gcgattcttctgcttcagcctcc

SEQ ID NO: 4968295 - DNA, 11 bp, Homo sapiens
gcgcacacaca

SEQ ID NO: 4968296 - DNA, 15 bp, Homo sapiens
gcgcacacacacaca

SEQ ID NO: 4968297 - DNA, 18 bp, Homo sapiens
gcgcagctggactctgca

SEQ ID NO: 4968298 - DNA, 16 bp, Homo sapiens
gcgccactcgcttccc

SEQ ID NO: 4968299 - DNA, 23 bp, Homo sapiens
gcgccactcgcttcccccatagc

SEQ ID NO: 4968300 - DNA, 23 bp, Homo sapiens
gcgccagtgtaatcccccaggag

SEQ ID NO: 4968301 - DNA, 23 bp, Homo sapiens
gcgcccagttgggtggatgcctg

SEQ ID NO: 4968302 - DNA, 16 bp, Homo sapiens
gcgcccttggcttctg

SEQ ID NO: 4968303 - DNA, 12 bp, Homo sapiens
gcgcctgtgacc

SEQ ID NO: 4968304 - DNA, 21 bp, Homo sapiens
gcgccttgtctcctactcctg

SEQ ID NO: 4968305 - DNA, 23 bp, Homo sapiens
gcgccttgtctcctactcctgac

SEQ ID NO: 4968306 - DNA, 21 bp, Homo sapiens
gcgcgatcccacacaggctgg

SEQ ID NO: 4968307 - DNA, 16 bp, Homo sapiens
gcgcggccagccccgg

SEQ ID NO: 4968308 - DNA, 13 bp, Homo sapiens
gcgctacccactt

SEQ ID NO: 4968309 - DNA, 14 bp, Homo sapiens
gcgctatcttcaca

SEQ ID NO: 4968310 - DNA, 19 bp, Homo sapiens
gcgctcagaacagtatctt

SEQ ID NO: 4968311 - DNA, 23 bp, Homo sapiens
gcgctctgtggatgccagggccg

SEQ ID NO: 4968312 - DNA, 19 bp, Homo sapiens
gcggaatgaaccacatctt

SEQ ID NO: 4968313 - DNA, 11 bp, Homo sapiens
gcggacagcca

SEQ ID NO: 4968314 - DNA, 13 bp, Homo sapiens
gcggacagccacg

SEQ ID NO: 4968315 - DNA, 16 bp, Homo sapiens
gcggacagccacggcc

SEQ ID NO: 4968316 - DNA, 19 bp, Homo sapiens
gcggacagccacggccagg

SEQ ID NO: 4968317 - DNA, 20 bp, Homo sapiens
gcggaccccagctgtgagcc

SEQ ID NO: 4968318 - DNA, 21 bp, Homo sapiens
gcggaccccagctgtgagcct

SEQ ID NO: 4968319 - DNA, 18 bp, Homo sapiens
gcggaggctgtgtgcctg

SEQ ID NO: 4968320 - DNA, 17 bp, Homo sapiens
gcggccagccccggccc

SEQ ID NO: 4968321 - DNA, 18 bp, Homo sapiens
gcggccagccccggccct

SEQ ID NO: 4968322 - DNA, 12 bp, Homo sapiens
gcggggacagct

SEQ ID NO: 4968323 - DNA, 15 bp, Homo sapiens
gcggggacagctcct

SEQ ID NO: 4968324 - DNA, 13 bp, Homo sapiens
gcggtccacccag

SEQ ID NO: 4968325 - DNA, 14 bp, Homo sapiens
gcggtccacccagg

SEQ ID NO: 4968326 - DNA, 19 bp, Homo sapiens
gcggtcttcaacatcctgc

SEQ ID NO: 4968327 - DNA, 23 bp, Homo sapiens
gcggtcttcaacatcctgccagc

SEQ ID NO: 4968328 - DNA, 19 bp, Homo sapiens
gcggtgagaggggaacaga

SEQ ID NO: 4968329 - DNA, 15 bp, Homo sapiens
gcggtggccctgtcc

SEQ ID NO: 4968330 - DNA, 23 bp, Homo sapiens
gcggttatgaaattcaccccctt

SEQ ID NO: 4968331 - DNA, 21 bp, Homo sapiens
gcgtcagggttggtgtgctga

SEQ ID NO: 4968332 - DNA, 18 bp, Homo sapiens
gcgtcagtctttttctgt

SEQ ID NO: 4968333 - DNA, 19 bp, Homo sapiens
gcgtcagtctttttctgtt

SEQ ID NO: 4968334 - DNA, 23 bp, Homo sapiens
gcgtcagtctttttctgttgtaa

SEQ ID NO: 4968335 - DNA, 14 bp, Homo sapiens
gcgtcccaagatgt

SEQ ID NO: 4968336 - DNA, 17 bp, Homo sapiens
gcgtcccaagatgttga

SEQ ID NO: 4968337 - DNA, 13 bp, Homo sapiens
gcgtctgtgtgcg

SEQ ID NO: 4968338 - DNA, 20 bp, Homo sapiens
gcgtcttccgcccctgcctg

SEQ ID NO: 4968339 - DNA, 21 bp, Homo sapiens
gcgtcttccgcccctgcctgc

SEQ ID NO: 4968340 - DNA, 22 bp, Homo sapiens
gcgtcttccgcccctgcctgcc

SEQ ID NO: 4968341 - DNA, 12 bp, Homo sapiens
gcgtgaatctgt

SEQ ID NO: 4968342 - DNA, 14 bp, Homo sapiens
gcgtgagccactgc

SEQ ID NO: 4968343 - DNA, 15 bp, Homo sapiens
gcgtgagccactgca

SEQ ID NO: 4968344 - DNA, 14 bp, Homo sapiens
gcgtgcacacacca

SEQ ID NO: 4968345 - DNA, 14 bp, Homo sapiens
gcgtgccgtgtgag

SEQ ID NO: 4968346 - DNA, 17 bp, Homo sapiens
gcgtggactctgcacat

SEQ ID NO: 4968347 - DNA, 13 bp, Homo sapiens
gcgtgggtcagaa

SEQ ID NO: 4968348 - DNA, 14 bp, Homo sapiens
gcgtgggtcagaag

SEQ ID NO: 4968349 - DNA, 15 bp, Homo sapiens
gcgtggttcctttct

SEQ ID NO: 4968350 - DNA, 20 bp, Homo sapiens
gcgtgtgtagagttaagaag

SEQ ID NO: 4968351 - DNA, 21 bp, Homo sapiens
gcgtgtgtagagttaagaagc

SEQ ID NO: 4968352 - DNA, 19 bp, Homo sapiens
gcgttatagtaactcccat

SEQ ID NO: 4968353 - DNA, 22 bp, Homo sapiens
gcgttattggtcggcagccttc

SEQ ID NO: 4968354 - DNA, 15 bp, Homo sapiens
gcgttgttacaggaa

SEQ ID NO: 4968355 - DNA, 16 bp, Homo sapiens
gcgttgttacaggaag

SEQ ID NO: 4968356 - DNA, 14 bp, Homo sapiens
gcgtttagaccaag

SEQ ID NO: 4968357 - DNA, 22 bp, Homo sapiens
gcgtttgaccttttatgtagta

SEQ ID NO: 4968358 - DNA, 18 bp, Homo sapiens
gctaaatgcctaataaac

SEQ ID NO: 4968359 - DNA, 19 bp, Homo sapiens
gctaaatgcctaataaaca

SEQ ID NO: 4968360 - DNA, 23 bp, Homo sapiens
gctaaatggtcgcccaggagaca

SEQ ID NO: 4968361 - DNA, 14 bp, Homo sapiens
gctaacattttaaa

SEQ ID NO: 4968362 - DNA, 17 bp, Homo sapiens
gctaacattttaaataa

SEQ ID NO: 4968363 - DNA, 21 bp, Homo sapiens
gctaacattttaaataaaaga

SEQ ID NO: 4968364 - DNA, 21 bp, Homo sapiens
gctaacccccttctactgagc

SEQ ID NO: 4968365 - DNA, 19 bp, Homo sapiens
gctaagcaagctaacctta

SEQ ID NO: 4968366 - DNA, 15 bp, Homo sapiens
gctaagctaggaatg

SEQ ID NO: 4968367 - DNA, 19 bp, Homo sapiens
gctaagggtgggtgctcag

SEQ ID NO: 4968368 - DNA, 14 bp, Homo sapiens
gctaaggttctaag

SEQ ID NO: 4968369 - DNA, 23 bp, Homo sapiens
gctaagtgatcctcccacctcag

SEQ ID NO: 4968370 - DNA, 19 bp, Homo sapiens
gctaatcaaagccagggtc

SEQ ID NO: 4968371 - DNA, 12 bp, Homo sapiens
gctgctagaact

SEQ ID NO: 4968372 - DNA, 18 bp, Homo sapiens
gctgctagaactttttta

SEQ ID NO: 4968373 - DNA, 19 bp, Homo sapiens
gctgctatttattttccta

SEQ ID NO: 4968374 - DNA, 16 bp, Homo sapiens
gctgctccaggcctgc

SEQ ID NO: 4968375 - DNA, 15 bp, Homo sapiens
gctgctccttggctt

SEQ ID NO: 4968376 - DNA, 10 bp, Homo sapiens
gctgctgacc

SEQ ID NO: 4968377 - DNA, 12 bp, Homo sapiens
gctgctgaccaa

SEQ ID NO: 4968378 - DNA, 21 bp, Homo sapiens
gctgctgaccaattgtgctgc

SEQ ID NO: 4968379 - DNA, 13 bp, Homo sapiens
gctgctgcctggc

SEQ ID NO: 4968380 - DNA, 15 bp, Homo sapiens
gctgctgctgcgccc

SEQ ID NO: 4968381 - DNA, 13 bp, Homo sapiens
gctgctgctgctg

SEQ ID NO: 4968382 - DNA, 11 bp, Homo sapiens
gctgctggctt

SEQ ID NO: 4968383 - DNA, 22 bp, Homo sapiens
gctgctgtccctcccccttgtc

SEQ ID NO: 4968384 - DNA, 20 bp, Homo sapiens
gctgctgttactgttaacca

SEQ ID NO: 4968385 - DNA, 14 bp, Homo sapiens
gctggacagagggg

SEQ ID NO: 4968386 - DNA, 21 bp, Homo sapiens
gctggaccttgaactgggtac

SEQ ID NO: 4968387 - DNA, 15 bp, Homo sapiens
gctggacgtctttct

SEQ ID NO: 4968388 - DNA, 16 bp, Homo sapiens
gctggacgtctttctt

SEQ ID NO: 4968389 - DNA, 20 bp, Homo sapiens
gctggacgtctttctttttt

SEQ ID NO: 4968390 - DNA, 16 bp, Homo sapiens
gctggactctgcatcc

SEQ ID NO: 4968391 - DNA, 12 bp, Homo sapiens
gctggagaagag

SEQ ID NO: 4968392 - DNA, 13 bp, Homo sapiens
gctggagaagaga

SEQ ID NO: 4968393 - DNA, 17 bp, Homo sapiens
gctggagaagagaggag

SEQ ID NO: 4968394 - DNA, 19 bp, Homo sapiens
gctggagcctgagtcaggg

SEQ ID NO: 4968395 - DNA, 14 bp, Homo sapiens
gctggaggtgggag

SEQ ID NO: 4968396 - DNA, 17 bp, Homo sapiens
gctggaggtgggagcag

SEQ ID NO: 4968397 - DNA, 21 bp, Homo sapiens
gctggaggtgggagcaggaga

SEQ ID NO: 4968398 - DNA, 16 bp, Homo sapiens
gctggaggtggggcga

SEQ ID NO: 4968399 - DNA, 15 bp, Homo sapiens
gctggagtgcagtgg

SEQ ID NO: 4968400 - DNA, 19 bp, Homo sapiens
gctggagtgcagtggtgca

SEQ ID NO: 4968401 - DNA, 18 bp, Homo sapiens
gctggatggagcccaggc

SEQ ID NO: 4968402 - DNA, 14 bp, Homo sapiens
gctggcagggctgg

SEQ ID NO: 4968403 - DNA, 22 bp, Homo sapiens
gctggccagcctggggcctggc

SEQ ID NO: 4968404 - DNA, 14 bp, Homo sapiens
gctggcccagccaa

SEQ ID NO: 4968405 - DNA, 16 bp, Homo sapiens
gctggccccagggcac

SEQ ID NO: 4968406 - DNA, 14 bp, Homo sapiens
gctggcctctacca

SEQ ID NO: 4968407 - DNA, 15 bp, Homo sapiens
gctggcctctctagc

SEQ ID NO: 4968408 - DNA, 14 bp, Homo sapiens
gctggcctggacag

SEQ ID NO: 4968409 - DNA, 14 bp, Homo sapiens
gctggctcttctgc

SEQ ID NO: 4968410 - DNA, 17 bp, Homo sapiens
gctggctgttggctggg

SEQ ID NO: 4968411 - DNA, 18 bp, Homo sapiens
gctggctgttggctgggg

SEQ ID NO: 4968412 - DNA, 20 bp, Homo sapiens
gctggctgttggctgggggc

SEQ ID NO: 4968413 - DNA, 13 bp, Homo sapiens
gctgggactacag

SEQ ID NO: 4968414 - DNA, 18 bp, Homo sapiens
gctgggagtagttgtctt

SEQ ID NO: 4968415 - DNA, 19 bp, Homo sapiens
gctgggcatggtaccagcc

SEQ ID NO: 4968416 - DNA, 23 bp, Homo sapiens
gctgggcatggtaccagccctgg

SEQ ID NO: 4968417 - DNA, 17 bp, Homo sapiens
gctgggccccccagctc

SEQ ID NO: 4968418 - DNA, 20 bp, Homo sapiens
gctgggccccccagctcagg

SEQ ID NO: 4968419 - DNA, 22 bp, Homo sapiens
gctgggccccccagctcagggg

SEQ ID NO: 4968420 - DNA, 14 bp, Homo sapiens
gctggggcctcaga

SEQ ID NO: 4968421 - DNA, 22 bp, Homo sapiens
gctgggggaatgagcccagaga

SEQ ID NO: 4968422 - DNA, 15 bp, Homo sapiens
gctgggggcctcagt

SEQ ID NO: 4968423 - DNA, 18 bp, Homo sapiens
gctgggggcctcagtgcc

SEQ ID NO: 4968424 - DNA, 19 bp, Homo sapiens
gctgggggcctcagtgcca

SEQ ID NO: 4968425 - DNA, 14 bp, Homo sapiens
gctgggttggaggg

SEQ ID NO: 4968426 - DNA, 13 bp, Homo sapiens
gctggtaacagtt

SEQ ID NO: 4968427 - DNA, 18 bp, Homo sapiens
gctggtattggtggcttt

SEQ ID NO: 4968428 - DNA, 13 bp, Homo sapiens
gctggtcacagcc

SEQ ID NO: 4968429 - DNA, 17 bp, Homo sapiens
gctggtcacagcctcct

SEQ ID NO: 4968430 - DNA, 20 bp, Homo sapiens
gctggtcacagcctcctctg

SEQ ID NO: 4968431 - DNA, 14 bp, Homo sapiens
gctggtgtcacctg

SEQ ID NO: 4968432 - DNA, 15 bp, Homo sapiens
gctggtgtcacctga

SEQ ID NO: 4968433 - DNA, 22 bp, Homo sapiens
gctggttcagggttggcccctg

SEQ ID NO: 4968434 - DNA, 14 bp, Homo sapiens
gctgtaagctcctt

SEQ ID NO: 4968435 - DNA, 16 bp, Homo sapiens
gctgtacatctatttt

SEQ ID NO: 4968436 - DNA, 17 bp, Homo sapiens
gctgtactgctcaggct

SEQ ID NO: 4968437 - DNA, 20 bp, Homo sapiens
gctgtatcccatgagcctca

SEQ ID NO: 4968438 - DNA, 13 bp, Homo sapiens
gctgtccctcact

SEQ ID NO: 4968439 - DNA, 13 bp, Homo sapiens
gctgtcctccctc

SEQ ID NO: 4968440 - DNA, 14 bp, Homo sapiens
gctgtctgtggctt

SEQ ID NO: 4968441 - DNA, 23 bp, Homo sapiens
gctgtcttctggacaggctctgc

SEQ ID NO: 4968442 - DNA, 16 bp, Homo sapiens
gctgtgaacaggctgg

SEQ ID NO: 4968443 - DNA, 15 bp, Homo sapiens
gctgtgagcccctgg

SEQ ID NO: 4968444 - DNA, 20 bp, Homo sapiens
gctgtgagcccctggtcctg

SEQ ID NO: 4968445 - DNA, 16 bp, Homo sapiens
gctgtgaggcccctgg

SEQ ID NO: 4968446 - DNA, 20 bp, Homo sapiens
gctgtgcaacgccgtgggct

SEQ ID NO: 4968447 - DNA, 23 bp, Homo sapiens
gctgtgcaacgccgtgggctgcg

SEQ ID NO: 4968448 - DNA, 14 bp, Homo sapiens
gctgtgcctctgcc

SEQ ID NO: 4968449 - DNA, 16 bp, Homo sapiens
gctgtgcctctgcctg

SEQ ID NO: 4968450 - DNA, 14 bp, Homo sapiens
gctgtgctcagaga

SEQ ID NO: 4968451 - DNA, 17 bp, Homo sapiens
gctgtggaggattgcta

SEQ ID NO: 4968452 - DNA, 16 bp, Homo sapiens
gctgtgtttaatttga

SEQ ID NO: 4968453 - DNA, 22 bp, Homo sapiens
gctgttaaactgttagcactgt

SEQ ID NO: 4968454 - DNA, 18 bp, Homo sapiens
gctgttaatagatcttag

SEQ ID NO: 4968455 - DNA, 18 bp, Homo sapiens
gctgttaccattcacaat

SEQ ID NO: 4968456 - DNA, 18 bp, Homo sapiens
gctgttactgttaaccat

SEQ ID NO: 4968457 - DNA, 17 bp, Homo sapiens
gctgttctgcactgaaa

SEQ ID NO: 4968458 - DNA, 12 bp, Homo sapiens
gctgttgcttga

SEQ ID NO: 4968459 - DNA, 22 bp, Homo sapiens
gctgttggcagtgagtgagcct

SEQ ID NO: 4968460 - DNA, 15 bp, Homo sapiens
gctgttggctggggg

SEQ ID NO: 4968461 - DNA, 13 bp, Homo sapiens
gctgttgtacatt

SEQ ID NO: 4968462 - DNA, 17 bp, Homo sapiens
gctgtttatggcctcag

SEQ ID NO: 4968463 - DNA, 22 bp, Homo sapiens
gctgtttatggcctcagctgcc

SEQ ID NO: 4968464 - DNA, 14 bp, Homo sapiens
gctgtttttgttgt

SEQ ID NO: 4968465 - DNA, 15 bp, Homo sapiens
gctgtttttgttgtg

SEQ ID NO: 4968466 - DNA, 13 bp, Homo sapiens
gcttaagttccag

SEQ ID NO: 4968467 - DNA, 13 bp, Homo sapiens
gcttaatttctaa

SEQ ID NO: 4968468 - DNA, 14 bp, Homo sapiens
gcttacctgacaca

SEQ ID NO: 4968469 - DNA, 22 bp, Homo sapiens
gcttacctgacctcttgctgtc

SEQ ID NO: 4968470 - DNA, 11 bp, Homo sapiens
gcttactctgt

SEQ ID NO: 4968471 - DNA, 19 bp, Homo sapiens
gcttagtaaaatttatttc

SEQ ID NO: 4968472 - DNA, 23 bp, Homo sapiens
gcttagtatctcatcaacaaaga

SEQ ID NO: 4968473 - DNA, 15 bp, Homo sapiens
gcttatccataaaaa

SEQ ID NO: 4968474 - DNA, 16 bp, Homo sapiens
gcttatccataaaaaa

SEQ ID NO: 4968475 - DNA, 18 bp, Homo sapiens
gcttatgacatcacttgt

SEQ ID NO: 4968476 - DNA, 23 bp, Homo sapiens
gcttatgacatcacttgtacaaa

SEQ ID NO: 4968477 - DNA, 17 bp, Homo sapiens
gcttattgcttagtaaa

SEQ ID NO: 4968478 - DNA, 17 bp, Homo sapiens
gcttattttaatgtgat

SEQ ID NO: 4968479 - DNA, 21 bp, Homo sapiens
gcaggacctcccttccgaccc

SEQ ID NO: 4968480 - DNA, 19 bp, Homo sapiens
gcaggactttgaggcaagt

SEQ ID NO: 4968481 - DNA, 22 bp, Homo sapiens
gcaggagggccctacctgattg

SEQ ID NO: 4968482 - DNA, 15 bp, Homo sapiens
gcaggccaaggtctg

SEQ ID NO: 4968483 - DNA, 16 bp, Homo sapiens
gcaggccaaggtctga

SEQ ID NO: 4968484 - DNA, 11 bp, Homo sapiens
gcaggccctgc

SEQ ID NO: 4968485 - DNA, 19 bp, Homo sapiens
gcaggccctttgaagcctc

SEQ ID NO: 4968486 - DNA, 16 bp, Homo sapiens
gcaggctgagccactc

SEQ ID NO: 4968487 - DNA, 12 bp, Homo sapiens
gcaggctgggcc

SEQ ID NO: 4968488 - DNA, 13 bp, Homo sapiens
gcaggctgggcca

SEQ ID NO: 4968489 - DNA, 14 bp, Homo sapiens
gcaggctgggccat

SEQ ID NO: 4968490 - DNA, 23 bp, Homo sapiens
gcaggctgggccatgtccaaaga

SEQ ID NO: 4968491 - DNA, 15 bp, Homo sapiens
gcagggaaggcctga

SEQ ID NO: 4968492 - DNA, 14 bp, Homo sapiens
gcagggagggcagt

SEQ ID NO: 4968493 - DNA, 18 bp, Homo sapiens
gcagggaggtcaggccct

SEQ ID NO: 4968494 - DNA, 19 bp, Homo sapiens
gcagggccaggactgagcc

SEQ ID NO: 4968495 - DNA, 19 bp, Homo sapiens
gcaggggctacaagaggga

SEQ ID NO: 4968496 - DNA, 12 bp, Homo sapiens
gcaggggctctg

SEQ ID NO: 4968497 - DNA, 14 bp, Homo sapiens
gcaggggctctgga

SEQ ID NO: 4968498 - DNA, 20 bp, Homo sapiens
gcaggggtgacggccctcat

SEQ ID NO: 4968499 - DNA, 18 bp, Homo sapiens
gcagggtctcactctgtc

SEQ ID NO: 4968500 - DNA, 19 bp, Homo sapiens
gcaggtcttgaactcctgg

SEQ ID NO: 4968501 - DNA, 18 bp, Homo sapiens
gcaggtgattggaccagg

SEQ ID NO: 4968502 - DNA, 22 bp, Homo sapiens
gcaggtgattggaccaggccat

SEQ ID NO: 4968503 - DNA, 13 bp, Homo sapiens
gcagtacatggga

SEQ ID NO: 4968504 - DNA, 15 bp, Homo sapiens
gcagtcctttgtaaa

SEQ ID NO: 4968505 - DNA, 16 bp, Homo sapiens
gcagtctcctctttaa

SEQ ID NO: 4968506 - DNA, 17 bp, Homo sapiens
gcagtctcctctttaaa

SEQ ID NO: 4968507 - DNA, 14 bp, Homo sapiens
gcagtgaactattt

SEQ ID NO: 4968508 - DNA, 15 bp, Homo sapiens
gcagtgagtgagcct

SEQ ID NO: 4968509 - DNA, 19 bp, Homo sapiens
gcagtgatatggcagaaga

SEQ ID NO: 4968510 - DNA, 22 bp, Homo sapiens
gcagtgatatggcagaagacac

SEQ ID NO: 4968511 - DNA, 22 bp, Homo sapiens
gcagtgcgcgtgcacgtggaga

SEQ ID NO: 4968512 - DNA, 23 bp, Homo sapiens
gcagtggaggtggggtgtttggg

SEQ ID NO: 4968513 - DNA, 11 bp, Homo sapiens
gcagtgggagc

SEQ ID NO: 4968514 - DNA, 16 bp, Homo sapiens
gcagtgggagctgcct

SEQ ID NO: 4968515 - DNA, 17 bp, Homo sapiens
gcagtgggagctgcctg

SEQ ID NO: 4968516 - DNA, 18 bp, Homo sapiens
gcagtgggagctgcctgt

SEQ ID NO: 4968517 - DNA, 21 bp, Homo sapiens
gcagtgttccccatctgggtc

SEQ ID NO: 4968518 - DNA, 17 bp, Homo sapiens
gcagtgttcgcttggct

SEQ ID NO: 4968519 - DNA, 17 bp, Homo sapiens
gcagttattaacactaa

SEQ ID NO: 4968520 - DNA, 17 bp, Homo sapiens
gcagtttggtatttgcg

SEQ ID NO: 4968521 - DNA, 12 bp, Homo sapiens
gcagtttttcag

SEQ ID NO: 4968522 - DNA, 11 bp, Homo sapiens
gcataaaacag

SEQ ID NO: 4968523 - DNA, 23 bp, Homo sapiens
gcatactgagccaagtataattt

SEQ ID NO: 4968524 - DNA, 18 bp, Homo sapiens
gcatatccaccacctccc

SEQ ID NO: 4968525 - DNA, 14 bp, Homo sapiens
gcatatgttgaata

SEQ ID NO: 4968526 - DNA, 17 bp, Homo sapiens
gcatatgttgaatactt

SEQ ID NO: 4968527 - DNA, 21 bp, Homo sapiens
gcatcaaggtcagcatgagga

SEQ ID NO: 4968528 - DNA, 15 bp, Homo sapiens
gcatcacctgcctgt

SEQ ID NO: 4968529 - DNA, 20 bp, Homo sapiens
gcatcactccccaaggaaga

SEQ ID NO: 4968530 - DNA, 21 bp, Homo sapiens
gcatcagggggaagaagcaga

SEQ ID NO: 4968531 - DNA, 18 bp, Homo sapiens
gcatccaatctcaaggaa

SEQ ID NO: 4968532 - DNA, 19 bp, Homo sapiens
gcatccaatctcaaggaat

SEQ ID NO: 4968533 - DNA, 21 bp, Homo sapiens
gcatcccagcacctgcctcct

SEQ ID NO: 4968534 - DNA, 22 bp, Homo sapiens
gcatcccagcacctgcctcctc

SEQ ID NO: 4968535 - DNA, 20 bp, Homo sapiens
gcatccccttggctgtgagg

SEQ ID NO: 4968536 - DNA, 21 bp, Homo sapiens
gcatccccttggctgtgaggc

SEQ ID NO: 4968537 - DNA, 19 bp, Homo sapiens
gcatcccggaggaaatctg

SEQ ID NO: 4968538 - DNA, 22 bp, Homo sapiens
gcatcccggaggaaatctgcag

SEQ ID NO: 4968539 - DNA, 14 bp, Homo sapiens
gcatccttcctata

SEQ ID NO: 4968540 - DNA, 15 bp, Homo sapiens
gcatccttcctataa

SEQ ID NO: 4968541 - DNA, 19 bp, Homo sapiens
gcatccttcctataacttg

SEQ ID NO: 4968542 - DNA, 19 bp, Homo sapiens
gcatctaagttataagact

SEQ ID NO: 4968543 - DNA, 16 bp, Homo sapiens
gcatctaggtaatttt

SEQ ID NO: 4968544 - DNA, 15 bp, Homo sapiens
gcatctcagcccaca

SEQ ID NO: 4968545 - DNA, 14 bp, Homo sapiens
gcatctctgtactt

SEQ ID NO: 4968546 - DNA, 14 bp, Homo sapiens
gcatctcttgaggc

SEQ ID NO: 4968547 - DNA, 20 bp, Homo sapiens
gcatctgatttgcatattca

SEQ ID NO: 4968548 - DNA, 21 bp, Homo sapiens
gcatctgatttgcatattcat

SEQ ID NO: 4968549 - DNA, 14 bp, Homo sapiens
gcatctgcccctcc

SEQ ID NO: 4968550 - DNA, 18 bp, Homo sapiens
gcatctgcccctccccca

SEQ ID NO: 4968551 - DNA, 22 bp, Homo sapiens
gcatcttatagcactttgaaat

SEQ ID NO: 4968552 - DNA, 20 bp, Homo sapiens
gcatctttagtgctttcttg

SEQ ID NO: 4968553 - DNA, 22 bp, Homo sapiens
gcatctttgccttgggctgctc

SEQ ID NO: 4968554 - DNA, 15 bp, Homo sapiens
gcatgaaatttttaa

SEQ ID NO: 4968555 - DNA, 17 bp, Homo sapiens
gcatgaacaagttttaa

SEQ ID NO: 4968556 - DNA, 14 bp, Homo sapiens
gcatgaagagaagc

SEQ ID NO: 4968557 - DNA, 20 bp, Homo sapiens
gcatgaagagcaaaaatatc

SEQ ID NO: 4968558 - DNA, 14 bp, Homo sapiens
gcatgacagcctct

SEQ ID NO: 4968559 - DNA, 23 bp, Homo sapiens
gcatgagtgctggatattttact

SEQ ID NO: 4968560 - DNA, 16 bp, Homo sapiens
gcatgccccggccacc

SEQ ID NO: 4968561 - DNA, 17 bp, Homo sapiens
gcatgccccggccacct

SEQ ID NO: 4968562 - DNA, 21 bp, Homo sapiens
gcatggcaagtcacatgcgta

SEQ ID NO: 4968563 - DNA, 22 bp, Homo sapiens
gcatggccctggggtcccacga

SEQ ID NO: 4968564 - DNA, 13 bp, Homo sapiens
gcatgggcctggc

SEQ ID NO: 4968565 - DNA, 18 bp, Homo sapiens
gcatggtccctgccttag

SEQ ID NO: 4968566 - DNA, 20 bp, Homo sapiens
gcatgtaccatttgcatggc

SEQ ID NO: 4968567 - DNA, 19 bp, Homo sapiens
gcatgtggtttggttcctc

SEQ ID NO: 4968568 - DNA, 23 bp, Homo sapiens
gcatgtggtttggttcctctctg

SEQ ID NO: 4968569 - DNA, 12 bp, Homo sapiens
gcatgtgtgtat

SEQ ID NO: 4968570 - DNA, 13 bp, Homo sapiens
gcatgtgtgtata

SEQ ID NO: 4968571 - DNA, 15 bp, Homo sapiens
gcatgtgtgtataag

SEQ ID NO: 4968572 - DNA, 11 bp, Homo sapiens
gcatgtgtgtg

SEQ ID NO: 4968573 - DNA, 14 bp, Homo sapiens
gcatgttctctgag

SEQ ID NO: 4968574 - DNA, 15 bp, Homo sapiens
gcatgttctctgagg

SEQ ID NO: 4968575 - DNA, 15 bp, Homo sapiens
gcatgtttcatgttt

SEQ ID NO: 4968576 - DNA, 20 bp, Homo sapiens
gcatgtttcatgttttgtga

SEQ ID NO: 4968577 - DNA, 15 bp, Homo sapiens
gcatgtttccagcag

SEQ ID NO: 4968578 - DNA, 15 bp, Homo sapiens
gcatgtttgaaatga

SEQ ID NO: 4968579 - DNA, 17 bp, Homo sapiens
gcatgttttgtatacaa

SEQ ID NO: 4968580 - DNA, 18 bp, Homo sapiens
gcattaaattcacaaact

SEQ ID NO: 4968581 - DNA, 20 bp, Homo sapiens
gcattaaattttaaggtaga

SEQ ID NO: 4968582 - DNA, 12 bp, Homo sapiens
gcattaatgttt

SEQ ID NO: 4968583 - DNA, 14 bp, Homo sapiens
gcattaatgtttct

SEQ ID NO: 4968584 - DNA, 15 bp, Homo sapiens
gcattacccccaacc

SEQ ID NO: 4968585 - DNA, 17 bp, Homo sapiens
gcattagaattatttaa

SEQ ID NO: 4968586 - DNA, 17 bp, Homo sapiens
gcattagcacagatttt

SEQ ID NO: 4968587 - DNA, 18 bp, Homo sapiens
gcattagggatgcctcct

SEQ ID NO: 4968588 - DNA, 15 bp, Homo sapiens
gcattatataccatt

SEQ ID NO: 4968589 - DNA, 20 bp, Homo sapiens
gccctgccctgaggaaggag

SEQ ID NO: 4968590 - DNA, 14 bp, Homo sapiens
gccctgctcctgca

SEQ ID NO: 4968591 - DNA, 22 bp, Homo sapiens
gccctgctgccgcctcccagcc

SEQ ID NO: 4968592 - DNA, 17 bp, Homo sapiens
gccctggctctgctgtc

SEQ ID NO: 4968593 - DNA, 15 bp, Homo sapiens
gccctgggctcggag

SEQ ID NO: 4968594 - DNA, 21 bp, Homo sapiens
gccctgggctcggaggctgcc

SEQ ID NO: 4968595 - DNA, 14 bp, Homo sapiens
gccctggtccaggg

SEQ ID NO: 4968596 - DNA, 15 bp, Homo sapiens
gccctggtgctgcca

SEQ ID NO: 4968597 - DNA, 16 bp, Homo sapiens
gccctggtgctgccac

SEQ ID NO: 4968598 - DNA, 21 bp, Homo sapiens
gccctggtggcagtgggagct

SEQ ID NO: 4968599 - DNA, 20 bp, Homo sapiens
gccctggtttcactggccca

SEQ ID NO: 4968600 - DNA, 11 bp, Homo sapiens
gccctgtctgt

SEQ ID NO: 4968601 - DNA, 19 bp, Homo sapiens
gcccttagcagggaaacag

SEQ ID NO: 4968602 - DNA, 15 bp, Homo sapiens
gcccttagtccccca

SEQ ID NO: 4968603 - DNA, 23 bp, Homo sapiens
gcccttagtcccccaactctgag

SEQ ID NO: 4968604 - DNA, 18 bp, Homo sapiens
gcccttattttcaagaaa

SEQ ID NO: 4968605 - DNA, 15 bp, Homo sapiens
gcccttcaccccagt

SEQ ID NO: 4968606 - DNA, 21 bp, Homo sapiens
gcccttcaccccagtggccac

SEQ ID NO: 4968607 - DNA, 21 bp, Homo sapiens
gcccttccatgtcgcctctgc

SEQ ID NO: 4968608 - DNA, 22 bp, Homo sapiens
gcccttccatgtcgcctctgca

SEQ ID NO: 4968609 - DNA, 12 bp, Homo sapiens
gcccttcctctc

SEQ ID NO: 4968610 - DNA, 16 bp, Homo sapiens
gcccttcctctccact

SEQ ID NO: 4968611 - DNA, 20 bp, Homo sapiens
gcccttgcagttcagcacca

SEQ ID NO: 4968612 - DNA, 21 bp, Homo sapiens
gcccttgcagttcagcaccac

SEQ ID NO: 4968613 - DNA, 17 bp, Homo sapiens
gccctttgaagcctcag

SEQ ID NO: 4968614 - DNA, 15 bp, Homo sapiens
gccgaaccaaaagaa

SEQ ID NO: 4968615 - DNA, 22 bp, Homo sapiens
gccgacccctagttccctctgc

SEQ ID NO: 4968616 - DNA, 18 bp, Homo sapiens
gccgagatcacgccactg

SEQ ID NO: 4968617 - DNA, 16 bp, Homo sapiens
gccgaggagccaggca

SEQ ID NO: 4968618 - DNA, 20 bp, Homo sapiens
gccgagggtcctggctcctg

SEQ ID NO: 4968619 - DNA, 21 bp, Homo sapiens
gccgatggagacaccaaccga

SEQ ID NO: 4968620 - DNA, 16 bp, Homo sapiens
gccgccatcagcccaa

SEQ ID NO: 4968621 - DNA, 21 bp, Homo sapiens
gccgccattgccaccaggaga

SEQ ID NO: 4968622 - DNA, 23 bp, Homo sapiens
gccgccccctgccccccagcctc

SEQ ID NO: 4968623 - DNA, 17 bp, Homo sapiens
gccgcctaggctcagcg

SEQ ID NO: 4968624 - DNA, 13 bp, Homo sapiens
gccgcctcccagc

SEQ ID NO: 4968625 - DNA, 17 bp, Homo sapiens
gccgcctcccagcctgg

SEQ ID NO: 4968626 - DNA, 19 bp, Homo sapiens
gccgcctgcactcctcagg

SEQ ID NO: 4968627 - DNA, 15 bp, Homo sapiens
gccgccttaagctga

SEQ ID NO: 4968628 - DNA, 20 bp, Homo sapiens
gccgcgtggtgccatcccca

SEQ ID NO: 4968629 - DNA, 15 bp, Homo sapiens
gccgctccaccagca

SEQ ID NO: 4968630 - DNA, 19 bp, Homo sapiens
gccggcttcatgccagcta

SEQ ID NO: 4968631 - DNA, 19 bp, Homo sapiens
gccggggacagaggcctgc

SEQ ID NO: 4968632 - DNA, 22 bp, Homo sapiens
gccggggtggagcatgggcctg

SEQ ID NO: 4968633 - DNA, 15 bp, Homo sapiens
gccgtgaactgtgca

SEQ ID NO: 4968634 - DNA, 16 bp, Homo sapiens
gccgtgaactgtgcat

SEQ ID NO: 4968635 - DNA, 18 bp, Homo sapiens
gccgttgaagaggaaggg

SEQ ID NO: 4968636 - DNA, 22 bp, Homo sapiens
gcctaaaagtgggcttgattct

SEQ ID NO: 4968637 - DNA, 20 bp, Homo sapiens
gcctaaaatcttggaagtac

SEQ ID NO: 4968638 - DNA, 20 bp, Homo sapiens
gcctaaaggatagatcaaag

SEQ ID NO: 4968639 - DNA, 20 bp, Homo sapiens
gcctaaatttaatgctgcct

SEQ ID NO: 4968640 - DNA, 23 bp, Homo sapiens
gcctacagctttgatccctgaca

SEQ ID NO: 4968641 - DNA, 17 bp, Homo sapiens
gcctacaggagtgagca

SEQ ID NO: 4968642 - DNA, 16 bp, Homo sapiens
gcctagcaagctggcc

SEQ ID NO: 4968643 - DNA, 19 bp, Homo sapiens
gcctagcaagctggcctct

SEQ ID NO: 4968644 - DNA, 20 bp, Homo sapiens
gcctaggaccactcagcccc

SEQ ID NO: 4968645 - DNA, 21 bp, Homo sapiens
gcctaggaccactcagcccct

SEQ ID NO: 4968646 - DNA, 22 bp, Homo sapiens
gcctaggaccactcagccccta

SEQ ID NO: 4968647 - DNA, 13 bp, Homo sapiens
gcctaggattcta

SEQ ID NO: 4968648 - DNA, 14 bp, Homo sapiens
gcctaggattctaa

SEQ ID NO: 4968649 - DNA, 15 bp, Homo sapiens
gcctaggattctaaa

SEQ ID NO: 4968650 - DNA, 16 bp, Homo sapiens
gcctaggattctaaaa

SEQ ID NO: 4968651 - DNA, 20 bp, Homo sapiens
gcctaggtgacagagtgaga

SEQ ID NO: 4968652 - DNA, 21 bp, Homo sapiens
gcctagtttttagtaatctgt

SEQ ID NO: 4968653 - DNA, 17 bp, Homo sapiens
gcctatttacctgcagg

SEQ ID NO: 4968654 - DNA, 13 bp, Homo sapiens
gcctcaaaatgtg

SEQ ID NO: 4968655 - DNA, 16 bp, Homo sapiens
gcctcaacctcctggg

SEQ ID NO: 4968656 - DNA, 17 bp, Homo sapiens
gcctcaacctcctgggc

SEQ ID NO: 4968657 - DNA, 20 bp, Homo sapiens
gcctcaccgcttccctcctg

SEQ ID NO: 4968658 - DNA, 15 bp, Homo sapiens
gcctcagcatcctgg

SEQ ID NO: 4968659 - DNA, 12 bp, Homo sapiens
gcctcagcctcc

SEQ ID NO: 4968660 - DNA, 22 bp, Homo sapiens
gcctcagcctcccaaagtgctg

SEQ ID NO: 4968661 - DNA, 23 bp, Homo sapiens
gcctcagcctcccaaagtgctgg

SEQ ID NO: 4968662 - DNA, 16 bp, Homo sapiens
gcctcagcctcccaag

SEQ ID NO: 4968663 - DNA, 14 bp, Homo sapiens
gcctcagctgcctc

SEQ ID NO: 4968664 - DNA, 20 bp, Homo sapiens
gcctcagctgcctcacttcc

SEQ ID NO: 4968665 - DNA, 15 bp, Homo sapiens
gcctcagtatattta

SEQ ID NO: 4968666 - DNA, 16 bp, Homo sapiens
gcctcagtatatttaa

SEQ ID NO: 4968667 - DNA, 15 bp, Homo sapiens
gcctcagtcctcccc

SEQ ID NO: 4968668 - DNA, 19 bp, Homo sapiens
gcctccagaactcactggg

SEQ ID NO: 4968669 - DNA, 11 bp, Homo sapiens
gcctccagcct

SEQ ID NO: 4968670 - DNA, 16 bp, Homo sapiens
gcctccagcctgccca

SEQ ID NO: 4968671 - DNA, 18 bp, Homo sapiens
gcctcccaaagtgctggg

SEQ ID NO: 4968672 - DNA, 21 bp, Homo sapiens
gcctcccaaggagaacaaata

SEQ ID NO: 4968673 - DNA, 12 bp, Homo sapiens
gcctcccacccc

SEQ ID NO: 4968674 - DNA, 21 bp, Homo sapiens
gcctcccgaatagctgggact

SEQ ID NO: 4968675 - DNA, 23 bp, Homo sapiens
gcctcccgagtagctgggactac

SEQ ID NO: 4968676 - DNA, 21 bp, Homo sapiens
gcctccctctctcttctgctc

SEQ ID NO: 4968677 - DNA, 14 bp, Homo sapiens
gcctcctcaccccc

SEQ ID NO: 4968678 - DNA, 17 bp, Homo sapiens
gcctcctcacccccagc

SEQ ID NO: 4968679 - DNA, 15 bp, Homo sapiens
gcctcctcatcccgt

SEQ ID NO: 4968680 - DNA, 22 bp, Homo sapiens
gcctcctcatcccgtgttctcc

SEQ ID NO: 4968681 - DNA, 15 bp, Homo sapiens
gatcacgcctggcta

SEQ ID NO: 4968682 - DNA, 13 bp, Homo sapiens
gatcactgaattt

SEQ ID NO: 4968683 - DNA, 13 bp, Homo sapiens
gatcactgccaca

SEQ ID NO: 4968684 - DNA, 15 bp, Homo sapiens
gatcactgccacact

SEQ ID NO: 4968685 - DNA, 23 bp, Homo sapiens
gatcagagcaggacctcccttcc

SEQ ID NO: 4968686 - DNA, 21 bp, Homo sapiens
gatcagatgctccaagattct

SEQ ID NO: 4968687 - DNA, 13 bp, Homo sapiens
gatcataaggctt

SEQ ID NO: 4968688 - DNA, 19 bp, Homo sapiens
gatcataagtgaatttata

SEQ ID NO: 4968689 - DNA, 13 bp, Homo sapiens
gatcatcatgcag

SEQ ID NO: 4968690 - DNA, 17 bp, Homo sapiens
gatcatccactgtgcca

SEQ ID NO: 4968691 - DNA, 23 bp, Homo sapiens
gatcatcccatctaagctgcagc

SEQ ID NO: 4968692 - DNA, 18 bp, Homo sapiens
gatcatggtgtaataaga

SEQ ID NO: 4968693 - DNA, 23 bp, Homo sapiens
gatcatggtgtaataagacataa

SEQ ID NO: 4968694 - DNA, 19 bp, Homo sapiens
gatcatgttgttaaaatta

SEQ ID NO: 4968695 - DNA, 18 bp, Homo sapiens
gatcattttccccccact

SEQ ID NO: 4968696 - DNA, 20 bp, Homo sapiens
gatccaaattgtgcttctcc

SEQ ID NO: 4968697 - DNA, 17 bp, Homo sapiens
gatccaagctaagcact

SEQ ID NO: 4968698 - DNA, 17 bp, Homo sapiens
gatccaagctggtccca

SEQ ID NO: 4968699 - DNA, 22 bp, Homo sapiens
gatccaatgttagagacttttt

SEQ ID NO: 4968700 - DNA, 19 bp, Homo sapiens
gatccaggaagcatgagtg

SEQ ID NO: 4968701 - DNA, 13 bp, Homo sapiens
gatcccctcagga

SEQ ID NO: 4968702 - DNA, 19 bp, Homo sapiens
gatcctaagcatctaagtt

SEQ ID NO: 4968703 - DNA, 18 bp, Homo sapiens
gatcctcccacctcagcc

SEQ ID NO: 4968704 - DNA, 17 bp, Homo sapiens
gatcctctcctttgaaa

SEQ ID NO: 4968705 - DNA, 20 bp, Homo sapiens
gatcctgtctttaaggaaaa

SEQ ID NO: 4968706 - DNA, 22 bp, Homo sapiens
gatccttagaggtcctctggag

SEQ ID NO: 4968707 - DNA, 23 bp, Homo sapiens
gatctacatgaggaactgtagat

SEQ ID NO: 4968708 - DNA, 14 bp, Homo sapiens
gatctcagctttga

SEQ ID NO: 4968709 - DNA, 20 bp, Homo sapiens
gatctgtcacaccagccata

SEQ ID NO: 4968710 - DNA, 18 bp, Homo sapiens
gatctgtgccccatgcct

SEQ ID NO: 4968711 - DNA, 18 bp, Homo sapiens
gatctgttttgaaggcaa

SEQ ID NO: 4968712 - DNA, 19 bp, Homo sapiens
gatctgttttgaaggcaaa

SEQ ID NO: 4968713 - DNA, 16 bp, Homo sapiens
gcaagcatgcttgtga

SEQ ID NO: 4968714 - DNA, 16 bp, Homo sapiens
gcaagcgacgacagat

SEQ ID NO: 4968715 - DNA, 22 bp, Homo sapiens
gcaagctgccgaaccaaaagaa

SEQ ID NO: 4968716 - DNA, 15 bp, Homo sapiens
gcaaggaaggaaaga

SEQ ID NO: 4968717 - DNA, 15 bp, Homo sapiens
gcaaggaccaggact

SEQ ID NO: 4968718 - DNA, 21 bp, Homo sapiens
gcaaggaccaggactccctcc

SEQ ID NO: 4968719 - DNA, 16 bp, Homo sapiens
gcaaggagcacaagcc

SEQ ID NO: 4968720 - DNA, 14 bp, Homo sapiens
gcaaggccctgctg

SEQ ID NO: 4968721 - DNA, 15 bp, Homo sapiens
gcaaggccctgctgc

SEQ ID NO: 4968722 - DNA, 15 bp, Homo sapiens
gcaaggctatgtgat

SEQ ID NO: 4968723 - DNA, 15 bp, Homo sapiens
gcaagtgagagctgg

SEQ ID NO: 4968724 - DNA, 16 bp, Homo sapiens
gcaagtgagagctggg

SEQ ID NO: 4968725 - DNA, 18 bp, Homo sapiens
gcaagtgagagctgggtg

SEQ ID NO: 4968726 - DNA, 19 bp, Homo sapiens
gcaagttaagagaaacttt

SEQ ID NO: 4968727 - DNA, 14 bp, Homo sapiens
gcaatatgtaaata

SEQ ID NO: 4968728 - DNA, 23 bp, Homo sapiens
gcaatctccccttgatttaaaca

SEQ ID NO: 4968729 - DNA, 18 bp, Homo sapiens
gcaatgaaaggtactata

SEQ ID NO: 4968730 - DNA, 21 bp, Homo sapiens
gcaatgacatctcaggggcca

SEQ ID NO: 4968731 - DNA, 16 bp, Homo sapiens
gcaatgatgaatgaga

SEQ ID NO: 4968732 - DNA, 15 bp, Homo sapiens
gcaatggcagccttg

SEQ ID NO: 4968733 - DNA, 23 bp, Homo sapiens
gcaatggtgtcagtatccaggct

SEQ ID NO: 4968734 - DNA, 16 bp, Homo sapiens
gcaattaggattttga

SEQ ID NO: 4968735 - DNA, 14 bp, Homo sapiens
gcaattcatcccag

SEQ ID NO: 4968736 - DNA, 11 bp, Homo sapiens
gcaattccaat

SEQ ID NO: 4968737 - DNA, 18 bp, Homo sapiens
gcaattggaacaaagtga

SEQ ID NO: 4968738 - DNA, 13 bp, Homo sapiens
gcaatttaaatgt

SEQ ID NO: 4968739 - DNA, 17 bp, Homo sapiens
gcaatttattaaaatga

SEQ ID NO: 4968740 - DNA, 14 bp, Homo sapiens
gcaatttcatatgc

SEQ ID NO: 4968741 - DNA, 22 bp, Homo sapiens
gcaattttctaagcaatttctt

SEQ ID NO: 4968742 - DNA, 14 bp, Homo sapiens
gcaattttgtaacg

SEQ ID NO: 4968743 - DNA, 14 bp, Homo sapiens
gcacaaacattttt

SEQ ID NO: 4968744 - DNA, 18 bp, Homo sapiens
gcacaaacatttttcaac

SEQ ID NO: 4968745 - DNA, 22 bp, Homo sapiens
gcacaaactttagggtaaaaat

SEQ ID NO: 4968746 - DNA, 14 bp, Homo sapiens
gcacaagcagagtg

SEQ ID NO: 4968747 - DNA, 23 bp, Homo sapiens
gcacaagcagagtgcacagctgt

SEQ ID NO: 4968748 - DNA, 22 bp, Homo sapiens
gcacaagccacaagtcttccag

SEQ ID NO: 4968749 - DNA, 15 bp, Homo sapiens
gcacaaggattgaaa

SEQ ID NO: 4968750 - DNA, 18 bp, Homo sapiens
gcacaaggattgaaaatt

SEQ ID NO: 4968751 - DNA, 12 bp, Homo sapiens
gcacacaccaga

SEQ ID NO: 4968752 - DNA, 20 bp, Homo sapiens
gcacacaccagagcccacct

SEQ ID NO: 4968753 - DNA, 22 bp, Homo sapiens
gcacacagaaatatatatacat

SEQ ID NO: 4968754 - DNA, 17 bp, Homo sapiens
gcacaccctcactctgc

SEQ ID NO: 4968755 - DNA, 19 bp, Homo sapiens
gcacaccctcactctgcca

SEQ ID NO: 4968756 - DNA, 20 bp, Homo sapiens
gcacactctgccagcaaaga

SEQ ID NO: 4968757 - DNA, 19 bp, Homo sapiens
gcacagataaaaagtggaa

SEQ ID NO: 4968758 - DNA, 17 bp, Homo sapiens
gcacagcagcctgcttc

SEQ ID NO: 4968759 - DNA, 20 bp, Homo sapiens
gcacagcagcctgcttccca

SEQ ID NO: 4968760 - DNA, 12 bp, Homo sapiens
gcacagctcagg

SEQ ID NO: 4968761 - DNA, 15 bp, Homo sapiens
gcacagctcaggagg

SEQ ID NO: 4968762 - DNA, 16 bp, Homo sapiens
gcacagcttcatttcc

SEQ ID NO: 4968763 - DNA, 16 bp, Homo sapiens
gcacaggatgctggcc

SEQ ID NO: 4968764 - DNA, 14 bp, Homo sapiens
gcacaggccccctt

SEQ ID NO: 4968765 - DNA, 21 bp, Homo sapiens
gcacaggtcccacctccagcc

SEQ ID NO: 4968766 - DNA, 19 bp, Homo sapiens
gcacaggtcgggcgcagga

SEQ ID NO: 4968767 - DNA, 13 bp, Homo sapiens
gcacagtccagga

SEQ ID NO: 4968768 - DNA, 18 bp, Homo sapiens
gcacagtgcatctcagcc

SEQ ID NO: 4968769 - DNA, 19 bp, Homo sapiens
gcacagtgcatctcagccc

SEQ ID NO: 4968770 - DNA, 13 bp, Homo sapiens
gcacagtttgaac

SEQ ID NO: 4968771 - DNA, 14 bp, Homo sapiens
gcacagtttgaaca

SEQ ID NO: 4968772 - DNA, 15 bp, Homo sapiens
gcacatccattccca

SEQ ID NO: 4968773 - DNA, 13 bp, Homo sapiens
gcacatgctggcc

SEQ ID NO: 4968774 - DNA, 16 bp, Homo sapiens
gcacatgctggccagc

SEQ ID NO: 4968775 - DNA, 22 bp, Homo sapiens
gcacatgctggccagcctgggg

SEQ ID NO: 4968776 - DNA, 11 bp, Homo sapiens
gcaccacccta

SEQ ID NO: 4968777 - DNA, 23 bp, Homo sapiens
gcaccactgcactccagcctggg

SEQ ID NO: 4968778 - DNA, 12 bp, Homo sapiens
gcaccagccagc

SEQ ID NO: 4968779 - DNA, 20 bp, Homo sapiens
gcaccatctctgattttcaa

SEQ ID NO: 4968780 - DNA, 19 bp, Homo sapiens
gcacccccctgttctaagg

SEQ ID NO: 4968781 - DNA, 14 bp, Homo sapiens
gcacccggcccctg

SEQ ID NO: 4968782 - DNA, 17 bp, Homo sapiens
gcacccggcccctgctg

SEQ ID NO: 4968783 - DNA, 21 bp, Homo sapiens
gcaccctagttctacctcagg

SEQ ID NO: 4968784 - DNA, 14 bp, Homo sapiens
gcaccctggggcct

SEQ ID NO: 4968785 - DNA, 18 bp, Homo sapiens
gcaccctgtggccctggc

SEQ ID NO: 4968786 - DNA, 15 bp, Homo sapiens
gcacccttcttttct

SEQ ID NO: 4968787 - DNA, 20 bp, Homo sapiens
gcacctaccatcagggacag

SEQ ID NO: 4968788 - DNA, 16 bp, Homo sapiens
gcacctagtccagtga

SEQ ID NO: 4968789 - DNA, 15 bp, Homo sapiens
gcacctcagcctgca

SEQ ID NO: 4968790 - DNA, 18 bp, Homo sapiens
gcacctcagcctgcacag

SEQ ID NO: 4968791 - DNA, 20 bp, Homo sapiens
gcaccttaccaactttctgt

SEQ ID NO: 4968792 - DNA, 16 bp, Homo sapiens
gcacctttgcacagga

SEQ ID NO: 4968793 - DNA, 19 bp, Homo sapiens
gcacctttgcacaggatgc

SEQ ID NO: 4968794 - DNA, 19 bp, Homo sapiens
gcacgacgccctctcccca

SEQ ID NO: 4968795 - DNA, 21 bp, Homo sapiens
gaacccctacatgaaacagaa

SEQ ID NO: 4968796 - DNA, 12 bp, Homo sapiens
gaaccctttgtt

SEQ ID NO: 4968797 - DNA, 21 bp, Homo sapiens
gaaccgagcaaagatcaaaat

SEQ ID NO: 4968798 - DNA, 23 bp, Homo sapiens
gaaccgagcaaagatcaaaataa

SEQ ID NO: 4968799 - DNA, 15 bp, Homo sapiens
gaaccgcacagctca

SEQ ID NO: 4968800 - DNA, 16 bp, Homo sapiens
gaaccgctcacctaga

SEQ ID NO: 4968801 - DNA, 20 bp, Homo sapiens
gaaccgctcacctagagcca

SEQ ID NO: 4968802 - DNA, 22 bp, Homo sapiens
gaaccgctcacctagagccaga

SEQ ID NO: 4968803 - DNA, 19 bp, Homo sapiens
gaaccgttttgaagctact

SEQ ID NO: 4968804 - DNA, 11 bp, Homo sapiens
gaacctcacct

SEQ ID NO: 4968805 - DNA, 12 bp, Homo sapiens
gaacctcccaga

SEQ ID NO: 4968806 - DNA, 15 bp, Homo sapiens
gaacctctgtctcat

SEQ ID NO: 4968807 - DNA, 13 bp, Homo sapiens
gaacctcttcccc

SEQ ID NO: 4968808 - DNA, 17 bp, Homo sapiens
gaacctcttccccagaa

SEQ ID NO: 4968809 - DNA, 15 bp, Homo sapiens
gaaccttccttcctg

SEQ ID NO: 4968810 - DNA, 19 bp, Homo sapiens
gaaccttccttcctgcttg

SEQ ID NO: 4968811 - DNA, 17 bp, Homo sapiens
gaacgcagccctagagc

SEQ ID NO: 4968812 - DNA, 18 bp, Homo sapiens
gaactaagaaacttttgt

SEQ ID NO: 4968813 - DNA, 22 bp, Homo sapiens
gaactaagaaacttttgtaaag

SEQ ID NO: 4968814 - DNA, 23 bp, Homo sapiens
gaactaagaaacttttgtaaaga

SEQ ID NO: 4968815 - DNA, 16 bp, Homo sapiens
gaactaataaatacat

SEQ ID NO: 4968816 - DNA, 16 bp, Homo sapiens
gaactcactggggcct

SEQ ID NO: 4968817 - DNA, 16 bp, Homo sapiens
gaactcagctgtctgt

SEQ ID NO: 4968818 - DNA, 21 bp, Homo sapiens
gaactcagctgtctgtggctt

SEQ ID NO: 4968819 - DNA, 14 bp, Homo sapiens
gaactcctggcctc

SEQ ID NO: 4968820 - DNA, 12 bp, Homo sapiens
gaactccttggc

SEQ ID NO: 4968821 - DNA, 22 bp, Homo sapiens
gaactctatctgggcctgggct

SEQ ID NO: 4968822 - DNA, 14 bp, Homo sapiens
gaactctgacaagg

SEQ ID NO: 4968823 - DNA, 15 bp, Homo sapiens
gaactcttagaaatg

SEQ ID NO: 4968824 - DNA, 18 bp, Homo sapiens
gaactggcaattgtctat

SEQ ID NO: 4968825 - DNA, 12 bp, Homo sapiens
gaactggctgca

SEQ ID NO: 4968826 - DNA, 17 bp, Homo sapiens
gaactgggcctgttgcc

SEQ ID NO: 4968827 - DNA, 19 bp, Homo sapiens
gaactgggtaaatgcaaag

SEQ ID NO: 4968828 - DNA, 13 bp, Homo sapiens
gaactgtccagag

SEQ ID NO: 4968829 - DNA, 16 bp, Homo sapiens
gaactgtccagagagc

SEQ ID NO: 4968830 - DNA, 22 bp, Homo sapiens
gaactgtccagagagcaactct

SEQ ID NO: 4968831 - DNA, 17 bp, Homo sapiens
gaacttgtagctgtaaa

SEQ ID NO: 4968832 - DNA, 18 bp, Homo sapiens
gaacttgtagctgtaaaa

SEQ ID NO: 4968833 - DNA, 15 bp, Homo sapiens
gaacttttttaaata

SEQ ID NO: 4968834 - DNA, 16 bp, Homo sapiens
gaacttttttaaataa

SEQ ID NO: 4968835 - DNA, 23 bp, Homo sapiens
gaacttttttaaataaacttttt

SEQ ID NO: 4968836 - DNA, 20 bp, Homo sapiens
gaagaaaaaaacgaaaacag

SEQ ID NO: 4968837 - DNA, 21 bp, Homo sapiens
gaagaaaaaaatcttctccag

SEQ ID NO: 4968838 - DNA, 9 bp, Homo sapiens
gaagaaaag

SEQ ID NO: 4968839 - DNA, 11 bp, Homo sapiens
gaagaaaagag

SEQ ID NO: 4968840 - DNA, 19 bp, Homo sapiens
gaagaaaagagaagaagaa

SEQ ID NO: 4968841 - DNA, 13 bp, Homo sapiens
gaagaagaaaaaa

SEQ ID NO: 4968842 - DNA, 15 bp, Homo sapiens
gaagaagaagaaaag

SEQ ID NO: 4968843 - DNA, 17 bp, Homo sapiens
gaagaagagaagctgct

SEQ ID NO: 4968844 - DNA, 19 bp, Homo sapiens
gaagaagagaagctgctga

SEQ ID NO: 4968845 - DNA, 14 bp, Homo sapiens
gaagaagcagagag

SEQ ID NO: 4968846 - DNA, 20 bp, Homo sapiens
gaagaaggtggaccttttaa

SEQ ID NO: 4968847 - DNA, 20 bp, Homo sapiens
gagcatctcttgaggccagg

SEQ ID NO: 4968848 - DNA, 19 bp, Homo sapiens
gagcatgtaaaagcggaaa

SEQ ID NO: 4968849 - DNA, 18 bp, Homo sapiens
gagccactctcttccctt

SEQ ID NO: 4968850 - DNA, 19 bp, Homo sapiens
gagccactgcaccgggcca

SEQ ID NO: 4968851 - DNA, 22 bp, Homo sapiens
gagccactgcaccgggccacag

SEQ ID NO: 4968852 - DNA, 14 bp, Homo sapiens
gagccattttgtga

SEQ ID NO: 4968853 - DNA, 21 bp, Homo sapiens
gagcccagaggtaacagaaca

SEQ ID NO: 4968854 - DNA, 23 bp, Homo sapiens
gagcccagaggtaacagaacagc

SEQ ID NO: 4968855 - DNA, 20 bp, Homo sapiens
gagcccagccctgttctggg

SEQ ID NO: 4968856 - DNA, 22 bp, Homo sapiens
gagcccatactcagcctgctgc

SEQ ID NO: 4968857 - DNA, 18 bp, Homo sapiens
gagcccatgttctgcccc

SEQ ID NO: 4968858 - DNA, 18 bp, Homo sapiens
gagccccaggcctctgtg

SEQ ID NO: 4968859 - DNA, 14 bp, Homo sapiens
gagccccagggtct

SEQ ID NO: 4968860 - DNA, 13 bp, Homo sapiens
gagccccgaggcc

SEQ ID NO: 4968861 - DNA, 14 bp, Homo sapiens
gagccccgaggcct

SEQ ID NO: 4968862 - DNA, 18 bp, Homo sapiens
gagccccgcagacctccc

SEQ ID NO: 4968863 - DNA, 22 bp, Homo sapiens
gagccccgcagacctccccagc

SEQ ID NO: 4968864 - DNA, 18 bp, Homo sapiens
gagccccgccctcttcct

SEQ ID NO: 4968865 - DNA, 14 bp, Homo sapiens
gagcccctggtcct

SEQ ID NO: 4968866 - DNA, 16 bp, Homo sapiens
gagccctaaccccttc

SEQ ID NO: 4968867 - DNA, 19 bp, Homo sapiens
gagccctaaccccttccag

SEQ ID NO: 4968868 - DNA, 18 bp, Homo sapiens
gagccctactccctgcag

SEQ ID NO: 4968869 - DNA, 14 bp, Homo sapiens
gagccctggtggca

SEQ ID NO: 4968870 - DNA, 21 bp, Homo sapiens
gagccgagatcacgccactgc

SEQ ID NO: 4968871 - DNA, 19 bp, Homo sapiens
gagccgctgtgagcccctg

SEQ ID NO: 4968872 - DNA, 21 bp, Homo sapiens
gagccgggcacattgagctgt

SEQ ID NO: 4968873 - DNA, 21 bp, Homo sapiens
gagcctagtttttaatagcta

SEQ ID NO: 4968874 - DNA, 13 bp, Homo sapiens
gagcctcagcatc

SEQ ID NO: 4968875 - DNA, 15 bp, Homo sapiens
gagcctcagcatcct

SEQ ID NO: 4968876 - DNA, 21 bp, Homo sapiens
gagcctcagcatcctggcacc

SEQ ID NO: 4968877 - DNA, 17 bp, Homo sapiens
gagcctcccaaggagaa

SEQ ID NO: 4968878 - DNA, 20 bp, Homo sapiens
gagcctcttctgccaagaga

SEQ ID NO: 4968879 - DNA, 15 bp, Homo sapiens
gagcctgatctcttc

SEQ ID NO: 4968880 - DNA, 16 bp, Homo sapiens
gagcctgatctcttcc

SEQ ID NO: 4968881 - DNA, 17 bp, Homo sapiens
gagcctgatctcttcct

SEQ ID NO: 4968882 - DNA, 15 bp, Homo sapiens
gagcctgcctggagc

SEQ ID NO: 4968883 - DNA, 12 bp, Homo sapiens
gagcctgctggt

SEQ ID NO: 4968884 - DNA, 18 bp, Homo sapiens
gagcctggcacaggactg

SEQ ID NO: 4968885 - DNA, 12 bp, Homo sapiens
gagcctggctct

SEQ ID NO: 4968886 - DNA, 19 bp, Homo sapiens
gagccttagccgcccatgc

SEQ ID NO: 4968887 - DNA, 20 bp, Homo sapiens
gagccttcgtgccccccctt

SEQ ID NO: 4968888 - DNA, 16 bp, Homo sapiens
gagcgcatcaggcctg

SEQ ID NO: 4968889 - DNA, 17 bp, Homo sapiens
gagcgcctgtgcacaca

SEQ ID NO: 4968890 - DNA, 15 bp, Homo sapiens
gagcgctacccactt

SEQ ID NO: 4968891 - DNA, 12 bp, Homo sapiens
gagcgggaggca

SEQ ID NO: 4968892 - DNA, 14 bp, Homo sapiens
gagcgggaggcaga

SEQ ID NO: 4968893 - DNA, 16 bp, Homo sapiens
gagcggtctcaggctg

SEQ ID NO: 4968894 - DNA, 17 bp, Homo sapiens
gagcggtctcaggctgg

SEQ ID NO: 4968895 - DNA, 22 bp, Homo sapiens
gagcggtctcaggctggtggga

SEQ ID NO: 4968896 - DNA, 23 bp, Homo sapiens
gagcggtctcaggctggtgggag

SEQ ID NO: 4968897 - DNA, 14 bp, Homo sapiens
gagcggtggccctg

SEQ ID NO: 4968898 - DNA, 17 bp, Homo sapiens
gagcggtggccctgtcc

SEQ ID NO: 4968899 - DNA, 16 bp, Homo sapiens
gagctattaaaactca

SEQ ID NO: 4968900 - DNA, 20 bp, Homo sapiens
gagctattaaaactcagcct

SEQ ID NO: 4968901 - DNA, 22 bp, Homo sapiens
gagctattaaaactcagcctgg

SEQ ID NO: 4968902 - DNA, 22 bp, Homo sapiens
gagctccagagcaacgaccagg

SEQ ID NO: 4968903 - DNA, 16 bp, Homo sapiens
gagctcctctcctgga

SEQ ID NO: 4968904 - DNA, 19 bp, Homo sapiens
gagctcctctcctggagga

SEQ ID NO: 4968905 - DNA, 21 bp, Homo sapiens
gagctcctctgtcctgcttct

SEQ ID NO: 4968906 - DNA, 22 bp, Homo sapiens
gagctcctctgtcctgcttctg

SEQ ID NO: 4968907 - DNA, 16 bp, Homo sapiens
gagctctgcagagcag

SEQ ID NO: 4968908 - DNA, 19 bp, Homo sapiens
gagctcttcaggcctccct

SEQ ID NO: 4968909 - DNA, 22 bp, Homo sapiens
gagctcttcaggcctccctctc

SEQ ID NO: 4968910 - DNA, 14 bp, Homo sapiens
gagctgatgaaact

SEQ ID NO: 4968911 - DNA, 15 bp, Homo sapiens
gagctgcctgttcag

SEQ ID NO: 4968912 - DNA, 22 bp, Homo sapiens
gagctgcctgttcagctccagc

SEQ ID NO: 4968913 - DNA, 22 bp, Homo sapiens
gagctgccttggctcagacatg

SEQ ID NO: 4968914 - DNA, 11 bp, Homo sapiens
gagctggcctc

SEQ ID NO: 4968915 - DNA, 18 bp, Homo sapiens
gagctgggtgtcaagagg

SEQ ID NO: 4968916 - DNA, 16 bp, Homo sapiens
gagctggtgcccggag

SEQ ID NO: 4968917 - DNA, 22 bp, Homo sapiens
gagctgtggaggattgctatct

SEQ ID NO: 4968918 - DNA, 15 bp, Homo sapiens
gagctgtttatgttt

SEQ ID NO: 4968919 - DNA, 16 bp, Homo sapiens
gagctgtttatgtttt

SEQ ID NO: 4968920 - DNA, 14 bp, Homo sapiens
gagcttctggcact

SEQ ID NO: 4968921 - DNA, 20 bp, Homo sapiens
gagcttgctcattaattttg

SEQ ID NO: 4968922 - DNA, 14 bp, Homo sapiens
gaggaaagagagca

SEQ ID NO: 4968923 - DNA, 16 bp, Homo sapiens
gaggaaagagagcagg

SEQ ID NO: 4968924 - DNA, 18 bp, Homo sapiens
gaggaaatctgcagaggg

SEQ ID NO: 4968925 - DNA, 15 bp, Homo sapiens
gaggaactgtacaga

SEQ ID NO: 4968926 - DNA, 19 bp, Homo sapiens
gaggaactgtccagagagc

SEQ ID NO: 4968927 - DNA, 13 bp, Homo sapiens
gaggaagagtctt

SEQ ID NO: 4968928 - DNA, 19 bp, Homo sapiens
gaggaaggaacagcaatgg

SEQ ID NO: 4968929 - DNA, 15 bp, Homo sapiens
gaggaaggattgtaa

SEQ ID NO: 4968930 - DNA, 22 bp, Homo sapiens
gaggaataagaatggagcagta

SEQ ID NO: 4968931 - DNA, 14 bp, Homo sapiens
gaggacaaaacttc

SEQ ID NO: 4968932 - DNA, 22 bp, Homo sapiens
gaggacaaaacttcttgtcaga

SEQ ID NO: 4968933 - DNA, 23 bp, Homo sapiens
gaggacaaaacttcttgtcagac

SEQ ID NO: 4968934 - DNA, 13 bp, Homo sapiens
gaggacagggagg

SEQ ID NO: 4968935 - DNA, 22 bp, Homo sapiens
gaggacagggaggtgaccccag

SEQ ID NO: 4968936 - DNA, 23 bp, Homo sapiens
gaggacagggaggtgaccccagg

SEQ ID NO: 4968937 - DNA, 16 bp, Homo sapiens
gaggacctgaccctac

SEQ ID NO: 4968938 - DNA, 16 bp, Homo sapiens
gaggacctggggcaca

SEQ ID NO: 4968939 - DNA, 18 bp, Homo sapiens
gaggacctggggcacagt

SEQ ID NO: 4968940 - DNA, 20 bp, Homo sapiens
gaggacctgtatttaagcaa

SEQ ID NO: 4968941 - DNA, 22 bp, Homo sapiens
gaggacctgtatttaagcaaat

SEQ ID NO: 4968942 - DNA, 16 bp, Homo sapiens
gaggacggtgcaaccc

SEQ ID NO: 4968943 - DNA, 19 bp, Homo sapiens
gaggactcgcttgtaaata

SEQ ID NO: 4968944 - DNA, 21 bp, Homo sapiens
gaggactcgcttgtaaatacc

SEQ ID NO: 4968945 - DNA, 16 bp, Homo sapiens
gaggacttgtgtctct

SEQ ID NO: 4968946 - DNA, 23 bp, Homo sapiens
gaggacttttctttgtggcttcc

SEQ ID NO: 4968947 - DNA, 11 bp, Homo sapiens
gaggagagagg

SEQ ID NO: 4968948 - DNA, 15 bp, Homo sapiens
gaggagagaggcaga

SEQ ID NO: 4968949 - DNA, 16 bp, Homo sapiens
gaggagagaggcagag

SEQ ID NO: 4968950 - DNA, 21 bp, Homo sapiens
gaggagcatgttttgtataca

SEQ ID NO: 4968951 - DNA, 14 bp, Homo sapiens
gaggagccagacag

SEQ ID NO: 4968952 - DNA, 12 bp, Homo sapiens
gaggagctgctg

SEQ ID NO: 4968953 - DNA, 15 bp, Homo sapiens
gaggagctgctggct

SEQ ID NO: 4968954 - DNA, 19 bp, Homo sapiens
gaggaggatgtccctgggc

SEQ ID NO: 4968955 - DNA, 15 bp, Homo sapiens
gaggaggtgcctgga

SEQ ID NO: 4968956 - DNA, 14 bp, Homo sapiens
cttgtgaaaatgtg

SEQ ID NO: 4968957 - DNA, 16 bp, Homo sapiens
cttgtgaaaatgtgtt

SEQ ID NO: 4968958 - DNA, 14 bp, Homo sapiens
cttgtgaaacacag

SEQ ID NO: 4968959 - DNA, 11 bp, Homo sapiens
cttgtgccata

SEQ ID NO: 4968960 - DNA, 21 bp, Homo sapiens
cttgtgctggatggagcccag

SEQ ID NO: 4968961 - DNA, 14 bp, Homo sapiens
cttgtgctttgctc

SEQ ID NO: 4968962 - DNA, 16 bp, Homo sapiens
cttgtgctttgctctt

SEQ ID NO: 4968963 - DNA, 13 bp, Homo sapiens
cttgtggacacag

SEQ ID NO: 4968964 - DNA, 17 bp, Homo sapiens
cttgtggacacagctct

SEQ ID NO: 4968965 - DNA, 18 bp, Homo sapiens
cttgtggccctctccctt

SEQ ID NO: 4968966 - DNA, 16 bp, Homo sapiens
cttgtggggacccagg

SEQ ID NO: 4968967 - DNA, 20 bp, Homo sapiens
cttgtggttttcaaattgga

SEQ ID NO: 4968968 - DNA, 17 bp, Homo sapiens
cttgtgtctctgtgctt

SEQ ID NO: 4968969 - DNA, 18 bp, Homo sapiens
cttgtgtctctgtgcttt

SEQ ID NO: 4968970 - DNA, 12 bp, Homo sapiens
cttgtgtctgta

SEQ ID NO: 4968971 - DNA, 14 bp, Homo sapiens
cttgtgtgcaaaag

SEQ ID NO: 4968972 - DNA, 13 bp, Homo sapiens
cttgttagaaaac

SEQ ID NO: 4968973 - DNA, 17 bp, Homo sapiens
cttgttattgtgaatga

SEQ ID NO: 4968974 - DNA, 18 bp, Homo sapiens
cttgtttatcagatacat

SEQ ID NO: 4968975 - DNA, 19 bp, Homo sapiens
cttgtttattgagtttgta

SEQ ID NO: 4968976 - DNA, 14 bp, Homo sapiens
cttgtttcttttca

SEQ ID NO: 4968977 - DNA, 22 bp, Homo sapiens
cttgttttataaaattttgctt

SEQ ID NO: 4968978 - DNA, 22 bp, Homo sapiens
cttgttttctttctttaaatgt

SEQ ID NO: 4968979 - DNA, 23 bp, Homo sapiens
cttgttttctttctttaaatgtt

SEQ ID NO: 4968980 - DNA, 13 bp, Homo sapiens
cttgttttgtttg

SEQ ID NO: 4968981 - DNA, 16 bp, Homo sapiens
cttgttttgtttgtct

SEQ ID NO: 4968982 - DNA, 21 bp, Homo sapiens
cttgttttttttttccactta

SEQ ID NO: 4968983 - DNA, 17 bp, Homo sapiens
ctttaaaaaaatttaag

SEQ ID NO: 4968984 - DNA, 13 bp, Homo sapiens
ctttaaaagagag

SEQ ID NO: 4968985 - DNA, 16 bp, Homo sapiens
ctttaaaagagagaga

SEQ ID NO: 4968986 - DNA, 22 bp, Homo sapiens
ctttaaaagagagagagagaaa

SEQ ID NO: 4968987 - DNA, 14 bp, Homo sapiens
ctttaaaagtgatc

SEQ ID NO: 4968988 - DNA, 17 bp, Homo sapiens
ctttaaacagtatttca

SEQ ID NO: 4968989 - DNA, 20 bp, Homo sapiens
ctttaaagatgaactctgaa

SEQ ID NO: 4968990 - DNA, 20 bp, Homo sapiens
ctttaaaggcccagccccta

SEQ ID NO: 4968991 - DNA, 14 bp, Homo sapiens
ctttaaataattta

SEQ ID NO: 4968992 - DNA, 17 bp, Homo sapiens
ctttaaataatttaact

SEQ ID NO: 4968993 - DNA, 18 bp, Homo sapiens
ctttaaataatttaacta

SEQ ID NO: 4968994 - DNA, 19 bp, Homo sapiens
ctttaaatagatacaaatg

SEQ ID NO: 4968995 - DNA, 15 bp, Homo sapiens
ctttaagagagaaat

SEQ ID NO: 4968996 - DNA, 20 bp, Homo sapiens
ctttaagggcatgccttgtg

SEQ ID NO: 4968997 - DNA, 19 bp, Homo sapiens
ctttaatggacttatttct

SEQ ID NO: 4968998 - DNA, 22 bp, Homo sapiens
ctttaatggacttatttcttca

SEQ ID NO: 4968999 - DNA, 19 bp, Homo sapiens
ctttaatgtcacaggcagg

SEQ ID NO: 4969000 - DNA, 23 bp, Homo sapiens
ctttaatgtcacaggcaggtcca

SEQ ID NO: 4969001 - DNA, 19 bp, Homo sapiens
ctttaattctctttcaaag

SEQ ID NO: 4969002 - DNA, 18 bp, Homo sapiens
ctttaatttctgtcagaa

SEQ ID NO: 4969003 - DNA, 19 bp, Homo sapiens
ctttacatgcaatttatta

SEQ ID NO: 4969004 - DNA, 14 bp, Homo sapiens
ctttactttccctt

SEQ ID NO: 4969005 - DNA, 16 bp, Homo sapiens
ctttactttcccttgc

SEQ ID NO: 4969006 - DNA, 18 bp, Homo sapiens
ctttactttcccttgctt

SEQ ID NO: 4969007 - DNA, 14 bp, Homo sapiens
ctttagcgcccagt

SEQ ID NO: 4969008 - DNA, 22 bp, Homo sapiens
ctttagtacctgaaaagtaact

SEQ ID NO: 4969009 - DNA, 17 bp, Homo sapiens
ctttagtatcagtgttt

SEQ ID NO: 4969010 - DNA, 12 bp, Homo sapiens
ctttatacatta

SEQ ID NO: 4969011 - DNA, 23 bp, Homo sapiens
ctttatacattagtaaatgtctt

SEQ ID NO: 4969012 - DNA, 23 bp, Homo sapiens
ctttatcacaaccaccgttacaa

SEQ ID NO: 4969013 - DNA, 21 bp, Homo sapiens
ctttatctaatacctctgtgt

SEQ ID NO: 4969014 - DNA, 21 bp, Homo sapiens
ctgcctctgacacacagctct

SEQ ID NO: 4969015 - DNA, 20 bp, Homo sapiens
ctgcctctgccacactctga

SEQ ID NO: 4969016 - DNA, 21 bp, Homo sapiens
ctgcctctgccacactctgac

SEQ ID NO: 4969017 - DNA, 12 bp, Homo sapiens
ctgcctcttcct

SEQ ID NO: 4969018 - DNA, 16 bp, Homo sapiens
ctgcctgaagtcacac

SEQ ID NO: 4969019 - DNA, 18 bp, Homo sapiens
ctgcctgaagtcacacag

SEQ ID NO: 4969020 - DNA, 22 bp, Homo sapiens
ctgcctgccatgtacctcccct

SEQ ID NO: 4969021 - DNA, 14 bp, Homo sapiens
ctgcctgcccaggc

SEQ ID NO: 4969022 - DNA, 15 bp, Homo sapiens
ctgcctgcccaggcc

SEQ ID NO: 4969023 - DNA, 17 bp, Homo sapiens
ctgcctgcccaggcccc

SEQ ID NO: 4969024 - DNA, 22 bp, Homo sapiens
ctgcctgcccaggcccctgcca

SEQ ID NO: 4969025 - DNA, 18 bp, Homo sapiens
ctgcctgcccgcacagca

SEQ ID NO: 4969026 - DNA, 23 bp, Homo sapiens
ctgcctgcccgcacagcagcctg

SEQ ID NO: 4969027 - DNA, 15 bp, Homo sapiens
ctgcctgcgtcttcc

SEQ ID NO: 4969028 - DNA, 12 bp, Homo sapiens
ctgcctgctttg

SEQ ID NO: 4969029 - DNA, 11 bp, Homo sapiens
ctgcctggagc

SEQ ID NO: 4969030 - DNA, 18 bp, Homo sapiens
ctgcctggccactgctcc

SEQ ID NO: 4969031 - DNA, 21 bp, Homo sapiens
ctgcctggccactgctcccta

SEQ ID NO: 4969032 - DNA, 18 bp, Homo sapiens
ctgcctgtagttaggaaa

SEQ ID NO: 4969033 - DNA, 14 bp, Homo sapiens
ctgcctgtgctgtg

SEQ ID NO: 4969034 - DNA, 18 bp, Homo sapiens
ctgcctgttcagctccag

SEQ ID NO: 4969035 - DNA, 19 bp, Homo sapiens
ctgcctgttcccattcttg

SEQ ID NO: 4969036 - DNA, 20 bp, Homo sapiens
ctgccttagtctcagtttgt

SEQ ID NO: 4969037 - DNA, 21 bp, Homo sapiens
ctgccttctgacggccctgca

SEQ ID NO: 4969038 - DNA, 23 bp, Homo sapiens
ctgccttctgacggccctgcaat

SEQ ID NO: 4969039 - DNA, 21 bp, Homo sapiens
ctgccttgctgttggtcatgt

SEQ ID NO: 4969040 - DNA, 23 bp, Homo sapiens
ctgccttggactgtgtttttcct

SEQ ID NO: 4969041 - DNA, 14 bp, Homo sapiens
ctgccttggcctcc

SEQ ID NO: 4969042 - DNA, 18 bp, Homo sapiens
ctgccttggctcagacat

SEQ ID NO: 4969043 - DNA, 17 bp, Homo sapiens
ctgcgattttgcctgtg

SEQ ID NO: 4969044 - DNA, 12 bp, Homo sapiens
ctgcgcctcagg

SEQ ID NO: 4969045 - DNA, 13 bp, Homo sapiens
ctgcgcctcaggc

SEQ ID NO: 4969046 - DNA, 23 bp, Homo sapiens
ctgcggaccccagctgtgagcct

SEQ ID NO: 4969047 - DNA, 19 bp, Homo sapiens
ctgcggtccacccaggagc

SEQ ID NO: 4969048 - DNA, 23 bp, Homo sapiens
ctgcggtccacccaggagccccg

SEQ ID NO: 4969049 - DNA, 22 bp, Homo sapiens
ctgcgtgccagtcaagaagaaa

SEQ ID NO: 4969050 - DNA, 13 bp, Homo sapiens
ctgcgttctgcaa

SEQ ID NO: 4969051 - DNA, 15 bp, Homo sapiens
ctgcgttctgcaagc

SEQ ID NO: 4969052 - DNA, 16 bp, Homo sapiens
ctgcgttggtccagag

SEQ ID NO: 4969053 - DNA, 15 bp, Homo sapiens
ctgctaccctagatg

SEQ ID NO: 4969054 - DNA, 13 bp, Homo sapiens
ctgctagaacttt

SEQ ID NO: 4969055 - DNA, 14 bp, Homo sapiens
ctgctagaactttt

SEQ ID NO: 4969056 - DNA, 17 bp, Homo sapiens
ctgctagaactttttta

SEQ ID NO: 4969057 - DNA, 16 bp, Homo sapiens
ctgctagcaaatggca

SEQ ID NO: 4969058 - DNA, 16 bp, Homo sapiens
ctgctagtgttctgtc

SEQ ID NO: 4969059 - DNA, 20 bp, Homo sapiens
ctgctatttattttcctaaa

SEQ ID NO: 4969060 - DNA, 21 bp, Homo sapiens
ctgctatttattttcctaaag

SEQ ID NO: 4969061 - DNA, 14 bp, Homo sapiens
ctgctcacatatct

SEQ ID NO: 4969062 - DNA, 19 bp, Homo sapiens
ctgctcaggctgcagctgg

SEQ ID NO: 4969063 - DNA, 16 bp, Homo sapiens
ctgctccaccacatcc

SEQ ID NO: 4969064 - DNA, 13 bp, Homo sapiens
ctgctccacgcgc

SEQ ID NO: 4969065 - DNA, 14 bp, Homo sapiens
ctgctccacgcgct

SEQ ID NO: 4969066 - DNA, 20 bp, Homo sapiens
ctgctccacgcgcttcgact

SEQ ID NO: 4969067 - DNA, 20 bp, Homo sapiens
ctgctccagaatttggaaat

SEQ ID NO: 4969068 - DNA, 21 bp, Homo sapiens
ctgctccagaatttggaaatc

SEQ ID NO: 4969069 - DNA, 22 bp, Homo sapiens
ctgctccagaatttggaaatcc

SEQ ID NO: 4969070 - DNA, 13 bp, Homo sapiens
ctgctccaggcct

SEQ ID NO: 4969071 - DNA, 20 bp, Homo sapiens
ctgctccccagccctggctc

SEQ ID NO: 4969072 - DNA, 17 bp, Homo sapiens
ctgctccctaagccagc

SEQ ID NO: 4969073 - DNA, 14 bp, Homo sapiens
ctgctccctgaagc

SEQ ID NO: 4969074 - DNA, 19 bp, Homo sapiens
ctgctccctgaagccagcc

SEQ ID NO: 4969075 - DNA, 21 bp, Homo sapiens
ctgctccctgaagccagcctt

SEQ ID NO: 4969076 - DNA, 16 bp, Homo sapiens
ctgctccgctgctcct

SEQ ID NO: 4969077 - DNA, 18 bp, Homo sapiens
ctgctccgctgctccttg

SEQ ID NO: 4969078 - DNA, 21 bp, Homo sapiens
ctgctccgctgctccttggct

SEQ ID NO: 4969079 - DNA, 14 bp, Homo sapiens
ctgctcctcatggt

SEQ ID NO: 4969080 - DNA, 22 bp, Homo sapiens
ctgctcgccctcctttctgtgc

SEQ ID NO: 4969081 - DNA, 20 bp, Homo sapiens
ctgctctccaagtctcagtg

SEQ ID NO: 4969082 - DNA, 14 bp, Homo sapiens
ctgctctcctcttg

SEQ ID NO: 4969083 - DNA, 21 bp, Homo sapiens
ctgctgaaaaccatctggcct

SEQ ID NO: 4969084 - DNA, 18 bp, Homo sapiens
ctgctgaaggaataaatt

SEQ ID NO: 4969085 - DNA, 18 bp, Homo sapiens
ctgctgacagacacaggc

SEQ ID NO: 4969086 - DNA, 19 bp, Homo sapiens
ctgctgacagacacaggcc

SEQ ID NO: 4969087 - DNA, 21 bp, Homo sapiens
ctgctgacagacacaggcccg

SEQ ID NO: 4969088 - DNA, 11 bp, Homo sapiens
ctgctgaccaa

SEQ ID NO: 4969089 - DNA, 21 bp, Homo sapiens
ctgctgaccaattgtgctgcc

SEQ ID NO: 4969090 - DNA, 22 bp, Homo sapiens
ctgctgaccaattgtgctgcca

SEQ ID NO: 4969091 - DNA, 16 bp, Homo sapiens
cttccgcccctgcctg

SEQ ID NO: 4969092 - DNA, 18 bp, Homo sapiens
cttccgcccctgcctgcc

SEQ ID NO: 4969093 - DNA, 15 bp, Homo sapiens
cttccgccccttccc

SEQ ID NO: 4969094 - DNA, 19 bp, Homo sapiens
cttccggtagggaggcagc

SEQ ID NO: 4969095 - DNA, 23 bp, Homo sapiens
cttccggtagggaggcagcctcc

SEQ ID NO: 4969096 - DNA, 21 bp, Homo sapiens
cttcctaatttcccttcttgc

SEQ ID NO: 4969097 - DNA, 23 bp, Homo sapiens
cttcctaatttcccttcttgcat

SEQ ID NO: 4969098 - DNA, 22 bp, Homo sapiens
cttcctacaagagcagcctgtg

SEQ ID NO: 4969099 - DNA, 23 bp, Homo sapiens
cttcctacccacacctctgccag

SEQ ID NO: 4969100 - DNA, 22 bp, Homo sapiens
cttcctagttttctcctcccag

SEQ ID NO: 4969101 - DNA, 14 bp, Homo sapiens
cttcctataacttg

SEQ ID NO: 4969102 - DNA, 20 bp, Homo sapiens
cttcctataacttgatgcat

SEQ ID NO: 4969103 - DNA, 16 bp, Homo sapiens
cttcctcactgcccaa

SEQ ID NO: 4969104 - DNA, 18 bp, Homo sapiens
cttcctcatccaccccat

SEQ ID NO: 4969105 - DNA, 17 bp, Homo sapiens
cttcctccagctgcacc

SEQ ID NO: 4969106 - DNA, 13 bp, Homo sapiens
cttcctccctcat

SEQ ID NO: 4969107 - DNA, 10 bp, Homo sapiens
cttcctcctg

SEQ ID NO: 4969108 - DNA, 13 bp, Homo sapiens
cttcctctccact

SEQ ID NO: 4969109 - DNA, 15 bp, Homo sapiens
cttcctctccactgc

SEQ ID NO: 4969110 - DNA, 15 bp, Homo sapiens
cttcctctctccaga

SEQ ID NO: 4969111 - DNA, 15 bp, Homo sapiens
cttcctctggggctc

SEQ ID NO: 4969112 - DNA, 19 bp, Homo sapiens
cttcctcttcggccctcag

SEQ ID NO: 4969113 - DNA, 20 bp, Homo sapiens
cttcctcttcggccctcaga

SEQ ID NO: 4969114 - DNA, 13 bp, Homo sapiens
cttcctgcccctc

SEQ ID NO: 4969115 - DNA, 16 bp, Homo sapiens
cttcctgcccctcttt

SEQ ID NO: 4969116 - DNA, 19 bp, Homo sapiens
cttcctgcccctctttctc

SEQ ID NO: 4969117 - DNA, 22 bp, Homo sapiens
cttcctgcccctctttctcttt

SEQ ID NO: 4969118 - DNA, 23 bp, Homo sapiens
cttcctggggcatctggcgaatc

SEQ ID NO: 4969119 - DNA, 15 bp, Homo sapiens
cttcctgtgggagca

SEQ ID NO: 4969120 - DNA, 16 bp, Homo sapiens
cttccttacccaaact

SEQ ID NO: 4969121 - DNA, 15 bp, Homo sapiens
cttcctttactttcc

SEQ ID NO: 4969122 - DNA, 16 bp, Homo sapiens
cttcctttactttccc

SEQ ID NO: 4969123 - DNA, 21 bp, Homo sapiens
cttcctttactttcccttgct

SEQ ID NO: 4969124 - DNA, 23 bp, Homo sapiens
cttcctttactttcccttgcttt

SEQ ID NO: 4969125 - DNA, 17 bp, Homo sapiens
cttcctttctccaggac

SEQ ID NO: 4969126 - DNA, 16 bp, Homo sapiens
cttcgatacaccgggc

SEQ ID NO: 4969127 - DNA, 16 bp, Homo sapiens
cttcgctcctgtgtct

SEQ ID NO: 4969128 - DNA, 23 bp, Homo sapiens
cttcgtgaacatcccctcccatc

SEQ ID NO: 4969129 - DNA, 19 bp, Homo sapiens
cttctaaacccaatccaaa

SEQ ID NO: 4969130 - DNA, 18 bp, Homo sapiens
cttctaaacttccccatc

SEQ ID NO: 4969131 - DNA, 22 bp, Homo sapiens
cttctaaacttccccatcttct

SEQ ID NO: 4969132 - DNA, 21 bp, Homo sapiens
cttctaataaattatacaaat

SEQ ID NO: 4969133 - DNA, 14 bp, Homo sapiens
cttctaatatattt

SEQ ID NO: 4969134 - DNA, 18 bp, Homo sapiens
cttctaatatatttttat

SEQ ID NO: 4969135 - DNA, 20 bp, Homo sapiens
cttctaatatatttttatat

SEQ ID NO: 4969136 - DNA, 16 bp, Homo sapiens
cttctaatatcattca

SEQ ID NO: 4969137 - DNA, 9 bp, Homo sapiens
cttctagag

SEQ ID NO: 4969138 - DNA, 13 bp, Homo sapiens
cttctagagttca

SEQ ID NO: 4969139 - DNA, 14 bp, Homo sapiens
cttctattttgtaa

SEQ ID NO: 4969140 - DNA, 15 bp, Homo sapiens
cttctcaagttctaa

SEQ ID NO: 4969141 - DNA, 20 bp, Homo sapiens
cttctcattccaacagtgag

SEQ ID NO: 4969142 - DNA, 21 bp, Homo sapiens
cttctcattccaacagtgagt

SEQ ID NO: 4969143 - DNA, 18 bp, Homo sapiens
cttctccaccctgctctc

SEQ ID NO: 4969144 - DNA, 17 bp, Homo sapiens
cttctccactggatgga

SEQ ID NO: 4969145 - DNA, 13 bp, Homo sapiens
cttctccagattt

SEQ ID NO: 4969146 - DNA, 12 bp, Homo sapiens
cttctccaggct

SEQ ID NO: 4969147 - DNA, 13 bp, Homo sapiens
cttctccaggctg

SEQ ID NO: 4969148 - DNA, 14 bp, Homo sapiens
cttctccaggctgt

SEQ ID NO: 4969149 - DNA, 20 bp, Homo sapiens
cttctccaggtctcacgggc

SEQ ID NO: 4969150 - DNA, 12 bp, Homo sapiens
cttctcccagaa

SEQ ID NO: 4969151 - DNA, 13 bp, Homo sapiens
cttctcccagaat

SEQ ID NO: 4969152 - DNA, 23 bp, Homo sapiens
cttctcccagaatcccagccggc

SEQ ID NO: 4969153 - DNA, 22 bp, Homo sapiens
ctgtctcagacttttgtacatc

SEQ ID NO: 4969154 - DNA, 15 bp, Homo sapiens
ctgtctcatccccag

SEQ ID NO: 4969155 - DNA, 17 bp, Homo sapiens
ctgtctcatccccaggg

SEQ ID NO: 4969156 - DNA, 21 bp, Homo sapiens
ctgtctcatccccaggggtcc

SEQ ID NO: 4969157 - DNA, 14 bp, Homo sapiens
ctgtctcatcctcc

SEQ ID NO: 4969158 - DNA, 15 bp, Homo sapiens
ctgtctcatcctcct

SEQ ID NO: 4969159 - DNA, 13 bp, Homo sapiens
ctgtctctgctcg

SEQ ID NO: 4969160 - DNA, 15 bp, Homo sapiens
ctgtctgagactcac

SEQ ID NO: 4969161 - DNA, 22 bp, Homo sapiens
ctgtctgagactcacaggaagg

SEQ ID NO: 4969162 - DNA, 16 bp, Homo sapiens
ctgtctggttttaaca

SEQ ID NO: 4969163 - DNA, 14 bp, Homo sapiens
ctgtctgtacctaa

SEQ ID NO: 4969164 - DNA, 23 bp, Homo sapiens
ctgtcttcacagctctgtgttgc

SEQ ID NO: 4969165 - DNA, 12 bp, Homo sapiens
ctgtcttgtaat

SEQ ID NO: 4969166 - DNA, 19 bp, Homo sapiens
ctgtcttgtaatattttgt

SEQ ID NO: 4969167 - DNA, 18 bp, Homo sapiens
ctgtctttaaaagagaga

SEQ ID NO: 4969168 - DNA, 14 bp, Homo sapiens
ctgtctttggaaaa

SEQ ID NO: 4969169 - DNA, 17 bp, Homo sapiens
ctgtgacttcagctctg

SEQ ID NO: 4969170 - DNA, 16 bp, Homo sapiens
ctgtgagacccccaca

SEQ ID NO: 4969171 - DNA, 20 bp, Homo sapiens
ctgtgagacccccacacctc

SEQ ID NO: 4969172 - DNA, 13 bp, Homo sapiens
ctgtgagcccctg

SEQ ID NO: 4969173 - DNA, 15 bp, Homo sapiens
ctgtgaggcccctgg

SEQ ID NO: 4969174 - DNA, 18 bp, Homo sapiens
ctgtgaggcccctggaca

SEQ ID NO: 4969175 - DNA, 15 bp, Homo sapiens
ctgtgagtaaatatt

SEQ ID NO: 4969176 - DNA, 19 bp, Homo sapiens
ctgtgatcatttattttaa

SEQ ID NO: 4969177 - DNA, 18 bp, Homo sapiens
ctgtgcaacgccgtgggc

SEQ ID NO: 4969178 - DNA, 20 bp, Homo sapiens
ctgtgcacacacacacacat

SEQ ID NO: 4969179 - DNA, 18 bp, Homo sapiens
ctgtgcatagtgctggga

SEQ ID NO: 4969180 - DNA, 16 bp, Homo sapiens
ctgtgcatgtatgtct

SEQ ID NO: 4969181 - DNA, 14 bp, Homo sapiens
ctgtgccatgtgcc

SEQ ID NO: 4969182 - DNA, 18 bp, Homo sapiens
ctgtgccatgtgccaggt

SEQ ID NO: 4969183 - DNA, 15 bp, Homo sapiens
ctgtgcctctgcctg

SEQ ID NO: 4969184 - DNA, 21 bp, Homo sapiens
ctgtgctcggaggccatctcg

SEQ ID NO: 4969185 - DNA, 19 bp, Homo sapiens
ctgtgctctggacaggcat

SEQ ID NO: 4969186 - DNA, 21 bp, Homo sapiens
ctgtgctgacatggctctgga

SEQ ID NO: 4969187 - DNA, 16 bp, Homo sapiens
ctgtggaacccagcag

SEQ ID NO: 4969188 - DNA, 12 bp, Homo sapiens
ctgtggaagcaa

SEQ ID NO: 4969189 - DNA, 22 bp, Homo sapiens
ctgtggaggaaggattgtaaaa

SEQ ID NO: 4969190 - DNA, 17 bp, Homo sapiens
ctgtggaggattgctat

SEQ ID NO: 4969191 - DNA, 16 bp, Homo sapiens
ctgtggcacttgcctg

SEQ ID NO: 4969192 - DNA, 20 bp, Homo sapiens
ctgtggcacttgcctgggtc

SEQ ID NO: 4969193 - DNA, 17 bp, Homo sapiens
ctgtggcatctttgcct

SEQ ID NO: 4969194 - DNA, 20 bp, Homo sapiens
ctgtggcttcccatgtcttt

SEQ ID NO: 4969195 - DNA, 19 bp, Homo sapiens
ctgtgggtccgataatatc

SEQ ID NO: 4969196 - DNA, 17 bp, Homo sapiens
ctgtgtacacctctgga

SEQ ID NO: 4969197 - DNA, 12 bp, Homo sapiens
ctgtgtatatta

SEQ ID NO: 4969198 - DNA, 18 bp, Homo sapiens
ctgtgtatattatttggc

SEQ ID NO: 4969199 - DNA, 20 bp, Homo sapiens
ctgtgtatattatttggcag

SEQ ID NO: 4969200 - DNA, 20 bp, Homo sapiens
ctgtgtcctggttagcagag

SEQ ID NO: 4969201 - DNA, 16 bp, Homo sapiens
ctgtgtccttccctgc

SEQ ID NO: 4969202 - DNA, 17 bp, Homo sapiens
ctgtgtctaagattcta

SEQ ID NO: 4969203 - DNA, 14 bp, Homo sapiens
ctgtgtcttgcaat

SEQ ID NO: 4969204 - DNA, 13 bp, Homo sapiens
ctgtgtgaatgtg

SEQ ID NO: 4969205 - DNA, 14 bp, Homo sapiens
ctgtgtgaatgtgg

SEQ ID NO: 4969206 - DNA, 16 bp, Homo sapiens
ctgtgtgatgaacttt

SEQ ID NO: 4969207 - DNA, 18 bp, Homo sapiens
ctgtgtgatgaactttct

SEQ ID NO: 4969208 - DNA, 17 bp, Homo sapiens
ctgtgtgcagtgaaggt

SEQ ID NO: 4969209 - DNA, 16 bp, Homo sapiens
ctgtgtgcctggggga

SEQ ID NO: 4969210 - DNA, 23 bp, Homo sapiens
ctgtgtgctcctccttggtgcct

SEQ ID NO: 4969211 - DNA, 11 bp, Homo sapiens
ctgtgtggttg

SEQ ID NO: 4969212 - DNA, 14 bp, Homo sapiens
ctgtgtgtgccctg

SEQ ID NO: 4969213 - DNA, 23 bp, Homo sapiens
ctgtgtgtgtgaatgaacactct

SEQ ID NO: 4969214 - DNA, 23 bp, Homo sapiens
ctgtgttgcattattcatttagt

SEQ ID NO: 4969215 - DNA, 18 bp, Homo sapiens
ctgtgttgtattaacaaa

SEQ ID NO: 4969216 - DNA, 21 bp, Homo sapiens
ctgtgtttaatttcttcaaaa

SEQ ID NO: 4969217 - DNA, 14 bp, Homo sapiens
ctgtgtttaatttg

SEQ ID NO: 4969218 - DNA, 16 bp, Homo sapiens
ctgtgtttataaaata

SEQ ID NO: 4969219 - DNA, 13 bp, Homo sapiens
ctgttaaactgtt

SEQ ID NO: 4969220 - DNA, 21 bp, Homo sapiens
ctgttaaactgttagcactgt

SEQ ID NO: 4969221 - DNA, 12 bp, Homo sapiens
ctgttaaccatt

SEQ ID NO: 4969222 - DNA, 16 bp, Homo sapiens
ctgttaatagttcagg

SEQ ID NO: 4969223 - DNA, 19 bp, Homo sapiens
ctgttaatgtatttgttca

SEQ ID NO: 4969224 - DNA, 20 bp, Homo sapiens
ctgttacataacaagaaaat

SEQ ID NO: 4969225 - DNA, 17 bp, Homo sapiens
ctgttaccgcctgtctc

SEQ ID NO: 4969226 - DNA, 18 bp, Homo sapiens
ctgttactgttaaccatt

SEQ ID NO: 4969227 - DNA, 13 bp, Homo sapiens
ctgttagcactgt

SEQ ID NO: 4969228 - DNA, 15 bp, Homo sapiens
ctgttagcactgttg

SEQ ID NO: 4969229 - DNA, 21 bp, Homo sapiens
ctgttagctttttaaaacatt

SEQ ID NO: 4969230 - DNA, 21 bp, Homo sapiens
ctgttatgtactgtactaatt

SEQ ID NO: 4969231 - DNA, 21 bp, Homo sapiens
ctgttatgtctgtttaagaaa

SEQ ID NO: 4969232 - DNA, 14 bp, Homo sapiens
ctgttatttagact

SEQ ID NO: 4969233 - DNA, 17 bp, Homo sapiens
ctgttcaatgtttaatg

SEQ ID NO: 4969234 - DNA, 15 bp, Homo sapiens
ctgttcactctactt

SEQ ID NO: 4969235 - DNA, 15 bp, Homo sapiens
ctgttcagctccagc

SEQ ID NO: 4969236 - DNA, 20 bp, Homo sapiens
ctgttcccatgtagccccct

SEQ ID NO: 4969237 - DNA, 18 bp, Homo sapiens
ctgttcccattcttgcat

SEQ ID NO: 4969238 - DNA, 17 bp, Homo sapiens
ctgttctaaagctctga

SEQ ID NO: 4969239 - DNA, 12 bp, Homo sapiens
ctgttctaaggg

SEQ ID NO: 4969240 - DNA, 15 bp, Homo sapiens
ctgttctcttcttca

SEQ ID NO: 4969241 - DNA, 21 bp, Homo sapiens
ctgttctcttgggaactgaac

SEQ ID NO: 4969242 - DNA, 14 bp, Homo sapiens
ctgttctgcactga

SEQ ID NO: 4969243 - DNA, 17 bp, Homo sapiens
ctgttctgcactgaaaa

SEQ ID NO: 4969244 - DNA, 18 bp, Homo sapiens
ctgttctgcactgaaaag

SEQ ID NO: 4969245 - DNA, 12 bp, Homo sapiens
ctgttcttcctc

SEQ ID NO: 4969246 - DNA, 23 bp, Homo sapiens
ctgttcttcctccagctgcacca

SEQ ID NO: 4969247 - DNA, 12 bp, Homo sapiens
ctgttcttgctg

SEQ ID NO: 4969248 - DNA, 21 bp, Homo sapiens
ctgttgaaaattattttaaac

SEQ ID NO: 4969249 - DNA, 16 bp, Homo sapiens
ctgttgatgtatctga

SEQ ID NO: 4969250 - DNA, 22 bp, Homo sapiens
ctgttgatgtatctgagttgcc

SEQ ID NO: 4969251 - DNA, 23 bp, Homo sapiens
ctgttgatgtatctgagttgcca

SEQ ID NO: 4969252 - DNA, 21 bp, Homo sapiens
ctgttgcaattaggattttga

SEQ ID NO: 4969253 - DNA, 14 bp, Homo sapiens
ctgttgcccaggct

SEQ ID NO: 4969254 - DNA, 16 bp, Homo sapiens
ctgttgcccaggctgg

SEQ ID NO: 4969255 - DNA, 18 bp, Homo sapiens
ctgttgccctttctgtac

SEQ ID NO: 4969256 - DNA, 21 bp, Homo sapiens
ctgttgccctttctgtaccat

SEQ ID NO: 4969257 - DNA, 11 bp, Homo sapiens
ctgttggaagc

SEQ ID NO: 4969258 - DNA, 19 bp, Homo sapiens
ctgttggctgggggcctca

SEQ ID NO: 4969259 - DNA, 15 bp, Homo sapiens
ctgttgtaacttatg

SEQ ID NO: 4969260 - DNA, 17 bp, Homo sapiens
ctgttgtaacttatgta

SEQ ID NO: 4969261 - DNA, 14 bp, Homo sapiens
ctgttgtacattta

SEQ ID NO: 4969262 - DNA, 15 bp, Homo sapiens
ctgttgtacatttat

SEQ ID NO: 4969263 - DNA, 22 bp, Homo sapiens
ctgttgtacatttatgatttaa

SEQ ID NO: 4969264 - DNA, 13 bp, Homo sapiens
ctgtttaagaaaa

SEQ ID NO: 4969265 - DNA, 18 bp, Homo sapiens
ctgtttaatatttaaaca

SEQ ID NO: 4969266 - DNA, 20 bp, Homo sapiens
ctgtttaatatttaaacagc

SEQ ID NO: 4969267 - DNA, 11 bp, Homo sapiens
ctgtttcaagg

SEQ ID NO: 4969268 - DNA, 16 bp, Homo sapiens
ctgtttcccttccctt

SEQ ID NO: 4969269 - DNA, 22 bp, Homo sapiens
ctgtttctcttgagctggcctc

SEQ ID NO: 4969270 - DNA, 12 bp, Homo sapiens
ctgtttcttcct

SEQ ID NO: 4969271 - DNA, 15 bp, Homo sapiens
ctgtttcttgcttgt

SEQ ID NO: 4969272 - DNA, 19 bp, Homo sapiens
ctgtttcttgcttgtacct

SEQ ID NO: 4969273 - DNA, 14 bp, Homo sapiens
ctgtttgattcttt

SEQ ID NO: 4969274 - DNA, 14 bp, Homo sapiens
ctgtttgtttcaag

SEQ ID NO: 4969275 - DNA, 20 bp, Homo sapiens
ctgtttgtttcaagaacctg

SEQ ID NO: 4969276 - DNA, 17 bp, Homo sapiens
ctgttttgggtagctgc

SEQ ID NO: 4969277 - DNA, 20 bp, Homo sapiens
ctgttttgtacatagattta

SEQ ID NO: 4969278 - DNA, 15 bp, Homo sapiens
ctgtttttctgggtg

SEQ ID NO: 4969279 - DNA, 21 bp, Homo sapiens
ctgtttttctgggtggcctcg

SEQ ID NO: 4969280 - DNA, 20 bp, Homo sapiens
cttaaaaaaaaaaaaaagct

SEQ ID NO: 4969281 - DNA, 14 bp, Homo sapiens
cttaaaacaacact

SEQ ID NO: 4969282 - DNA, 18 bp, Homo sapiens
cttaaaatagaaataagt

SEQ ID NO: 4969283 - DNA, 18 bp, Homo sapiens
cttaaaatattcctgcat

SEQ ID NO: 4969284 - DNA, 15 bp, Homo sapiens
cttaaacttgtgaat

SEQ ID NO: 4969285 - DNA, 13 bp, Homo sapiens
cttaaagaaacag

SEQ ID NO: 4969286 - DNA, 16 bp, Homo sapiens
cttaaagaaacagctt

SEQ ID NO: 4969287 - DNA, 17 bp, Homo sapiens
cttaaagaaacagcttt

SEQ ID NO: 4969288 - DNA, 23 bp, Homo sapiens
cttaaagaaacagctttcaagtg

SEQ ID NO: 4969289 - DNA, 12 bp, Homo sapiens
cttaaagaaagt

SEQ ID NO: 4969290 - DNA, 22 bp, Homo sapiens
cttaaagaaagtcgaattaata

SEQ ID NO: 4969291 - DNA, 20 bp, Homo sapiens
cttaaaggcaccatctaata

SEQ ID NO: 4969292 - DNA, 19 bp, Homo sapiens
cttaaataatgcttcagat

SEQ ID NO: 4969293 - DNA, 15 bp, Homo sapiens
cttaaatatagttcc

SEQ ID NO: 4969294 - DNA, 16 bp, Homo sapiens
cttaaatatcttttat

SEQ ID NO: 4969295 - DNA, 21 bp, Homo sapiens
cttaaatgtagcaatggcact

SEQ ID NO: 4969296 - DNA, 13 bp, Homo sapiens
cttaacatattta

SEQ ID NO: 4969297 - DNA, 17 bp, Homo sapiens
cttaacatatttactaa

SEQ ID NO: 4969298 - DNA, 15 bp, Homo sapiens
cttaagcaaaagaaa

SEQ ID NO: 4969299 - DNA, 18 bp, Homo sapiens
cttaatactaccttgaaa

SEQ ID NO: 4969300 - DNA, 14 bp, Homo sapiens
cttaatatatttga

SEQ ID NO: 4969301 - DNA, 20 bp, Homo sapiens
cttaatcaggtcctcagaga

SEQ ID NO: 4969302 - DNA, 14 bp, Homo sapiens
cttaatgttcttat

SEQ ID NO: 4969303 - DNA, 13 bp, Homo sapiens
cttaattaatttg

SEQ ID NO: 4969304 - DNA, 11 bp, Homo sapiens
cttaattatta

SEQ ID NO: 4969305 - DNA, 18 bp, Homo sapiens
cttaattattatttgtgt

SEQ ID NO: 4969306 - DNA, 19 bp, Homo sapiens
cttaattattatttgtgtt

SEQ ID NO: 4969307 - DNA, 12 bp, Homo sapiens
cttaatttctaa

SEQ ID NO: 4969308 - DNA, 19 bp, Homo sapiens
cttaatttttttttcatag

SEQ ID NO: 4969309 - DNA, 17 bp, Homo sapiens
cttacaatcgcaaatca

SEQ ID NO: 4969310 - DNA, 21 bp, Homo sapiens
cttacaatcgcaaatcaaaac

SEQ ID NO: 4969311 - DNA, 21 bp, Homo sapiens
cttacacaaaggggatcataa

SEQ ID NO: 4969312 - DNA, 19 bp, Homo sapiens
cttacactgcctgtatact

SEQ ID NO: 4969313 - DNA, 20 bp, Homo sapiens
cttacactgcctgtatactt

SEQ ID NO: 4969314 - DNA, 21 bp, Homo sapiens
cttacactgcctgtatacttt

SEQ ID NO: 4969315 - DNA, 16 bp, Homo sapiens
cttacataatttttta

SEQ ID NO: 4969316 - DNA, 21 bp, Homo sapiens
cttacattagcagtttgcttt

SEQ ID NO: 4969317 - DNA, 14 bp, Homo sapiens
cttaccaactttct

SEQ ID NO: 4969318 - DNA, 16 bp, Homo sapiens
cttaccaactttctgt

SEQ ID NO: 4969319 - DNA, 13 bp, Homo sapiens
cttaccagaagct

SEQ ID NO: 4969320 - DNA, 21 bp, Homo sapiens
cttacctgacctcttgctgtc

SEQ ID NO: 4969321 - DNA, 16 bp, Homo sapiens
cttacgaatattttca

SEQ ID NO: 4969322 - DNA, 14 bp, Homo sapiens
cttacgctttgtca

SEQ ID NO: 4969323 - DNA, 21 bp, Homo sapiens
cttactattcattaaatgttt

SEQ ID NO: 4969324 - DNA, 11 bp, Homo sapiens
cttactatttc

SEQ ID NO: 4969325 - DNA, 13 bp, Homo sapiens
cttactatttctg

SEQ ID NO: 4969326 - DNA, 22 bp, Homo sapiens
cttactatttctgggtcttttg

SEQ ID NO: 4969327 - DNA, 13 bp, Homo sapiens
cttactcctcctc

SEQ ID NO: 4969328 - DNA, 14 bp, Homo sapiens
cttactcctcctct

SEQ ID NO: 4969329 - DNA, 16 bp, Homo sapiens
cttactcctcctcttt

SEQ ID NO: 4969330 - DNA, 18 bp, Homo sapiens
cttactgtggaggaagga

SEQ ID NO: 4969331 - DNA, 18 bp, Homo sapiens
cttcattctatcaagccc

SEQ ID NO: 4969332 - DNA, 14 bp, Homo sapiens
cttcattctcgtga

SEQ ID NO: 4969333 - DNA, 22 bp, Homo sapiens
cttcattctcgtgagtcattta

SEQ ID NO: 4969334 - DNA, 15 bp, Homo sapiens
cttcattctgcaggg

SEQ ID NO: 4969335 - DNA, 22 bp, Homo sapiens
cttcattgtactacctgtgtat

SEQ ID NO: 4969336 - DNA, 17 bp, Homo sapiens
cttcattgtccctcttc

SEQ ID NO: 4969337 - DNA, 14 bp, Homo sapiens
cttcatttaaaaaa

SEQ ID NO: 4969338 - DNA, 17 bp, Homo sapiens
cttcatttcattgtatg

SEQ ID NO: 4969339 - DNA, 13 bp, Homo sapiens
cttcatttgtgtc

SEQ ID NO: 4969340 - DNA, 17 bp, Homo sapiens
cttccaaaaattattat

SEQ ID NO: 4969341 - DNA, 15 bp, Homo sapiens
cttccaaaattctta

SEQ ID NO: 4969342 - DNA, 21 bp, Homo sapiens
cttccaaagtaaaattgctgt

SEQ ID NO: 4969343 - DNA, 19 bp, Homo sapiens
cttccaaataataaagtct

SEQ ID NO: 4969344 - DNA, 17 bp, Homo sapiens
cttccactgcctctgcc

SEQ ID NO: 4969345 - DNA, 18 bp, Homo sapiens
cttccactgcctctgcct

SEQ ID NO: 4969346 - DNA, 19 bp, Homo sapiens
cttccactgcctctgcctt

SEQ ID NO: 4969347 - DNA, 12 bp, Homo sapiens
cttccagacata

SEQ ID NO: 4969348 - DNA, 18 bp, Homo sapiens
cttccagatcactgccac

SEQ ID NO: 4969349 - DNA, 20 bp, Homo sapiens
cttccagatcactgccacac

SEQ ID NO: 4969350 - DNA, 13 bp, Homo sapiens
cttccagctgctg

SEQ ID NO: 4969351 - DNA, 14 bp, Homo sapiens
cttccagctgctgt

SEQ ID NO: 4969352 - DNA, 21 bp, Homo sapiens
cttccagctgctgtcttctgg

SEQ ID NO: 4969353 - DNA, 16 bp, Homo sapiens
cttccaggtgttactg

SEQ ID NO: 4969354 - DNA, 21 bp, Homo sapiens
cttccataatctggactcctc

SEQ ID NO: 4969355 - DNA, 15 bp, Homo sapiens
cttccatatttggaa

SEQ ID NO: 4969356 - DNA, 17 bp, Homo sapiens
cttccatcccaggacac

SEQ ID NO: 4969357 - DNA, 19 bp, Homo sapiens
cttccatccctacccccta

SEQ ID NO: 4969358 - DNA, 16 bp, Homo sapiens
cttccatctctgactt

SEQ ID NO: 4969359 - DNA, 19 bp, Homo sapiens
cttccatgtcgcctctgca

SEQ ID NO: 4969360 - DNA, 17 bp, Homo sapiens
cttccattttcctacag

SEQ ID NO: 4969361 - DNA, 20 bp, Homo sapiens
cttcccaatcagcactgaaa

SEQ ID NO: 4969362 - DNA, 17 bp, Homo sapiens
cttcccacctccctgcc

SEQ ID NO: 4969363 - DNA, 19 bp, Homo sapiens
cttcccacctccctgccca

SEQ ID NO: 4969364 - DNA, 17 bp, Homo sapiens
cttcccatgtctttctc

SEQ ID NO: 4969365 - DNA, 21 bp, Homo sapiens
cttcccatgtctttctccaaa

SEQ ID NO: 4969366 - DNA, 14 bp, Homo sapiens
cttccccagcgtcc

SEQ ID NO: 4969367 - DNA, 18 bp, Homo sapiens
cttccccatcttctaaac

SEQ ID NO: 4969368 - DNA, 15 bp, Homo sapiens
cttccccctccaatc

SEQ ID NO: 4969369 - DNA, 15 bp, Homo sapiens
cttcccgccagaggg

SEQ ID NO: 4969370 - DNA, 13 bp, Homo sapiens
cttccctatttat

SEQ ID NO: 4969371 - DNA, 22 bp, Homo sapiens
cttccctgattgacctgctccg

SEQ ID NO: 4969372 - DNA, 13 bp, Homo sapiens
cttccctgcacta

SEQ ID NO: 4969373 - DNA, 19 bp, Homo sapiens
cttcccttgccactttgca

SEQ ID NO: 4969374 - DNA, 19 bp, Homo sapiens
cttccgaccctctgggaac

SEQ ID NO: 4969375 - DNA, 22 bp, Homo sapiens
cttccgatggatgaatctccca

SEQ ID NO: 4969376 - DNA, 15 bp, Homo sapiens
cttccgcccctgcct

SEQ ID NO: 4969377 - DNA, 23 bp, Homo sapiens
ctcccagaggtccagcccatctc

SEQ ID NO: 4969378 - DNA, 21 bp, Homo sapiens
ctcccagatcagtcagagccc

SEQ ID NO: 4969379 - DNA, 22 bp, Homo sapiens
ctcccaggcgccccttccccct

SEQ ID NO: 4969380 - DNA, 20 bp, Homo sapiens
ctcccagtccccagcccttc

SEQ ID NO: 4969381 - DNA, 23 bp, Homo sapiens
ctcccatcattacccttccctgc

SEQ ID NO: 4969382 - DNA, 13 bp, Homo sapiens
ctcccatcccctg

SEQ ID NO: 4969383 - DNA, 16 bp, Homo sapiens
ctcccatcccctggac

SEQ ID NO: 4969384 - DNA, 13 bp, Homo sapiens
ctcccatgaagcc

SEQ ID NO: 4969385 - DNA, 16 bp, Homo sapiens
ctcccatgaagccttt

SEQ ID NO: 4969386 - DNA, 11 bp, Homo sapiens
ctccccaaccc

SEQ ID NO: 4969387 - DNA, 23 bp, Homo sapiens
ctccccagaattcacgcctctcc

SEQ ID NO: 4969388 - DNA, 21 bp, Homo sapiens
ctccccagcaagtgagagctg

SEQ ID NO: 4969389 - DNA, 13 bp, Homo sapiens
ctccccagcccct

SEQ ID NO: 4969390 - DNA, 22 bp, Homo sapiens
ctccccagcccctagcccagga

SEQ ID NO: 4969391 - DNA, 16 bp, Homo sapiens
ctccccagccctggct

SEQ ID NO: 4969392 - DNA, 15 bp, Homo sapiens
ctccccatgccacgt

SEQ ID NO: 4969393 - DNA, 12 bp, Homo sapiens
ctccccatggag

SEQ ID NO: 4969394 - DNA, 14 bp, Homo sapiens
ctccccatgtgtcc

SEQ ID NO: 4969395 - DNA, 20 bp, Homo sapiens
ctccccatgtgtcctggttc

SEQ ID NO: 4969396 - DNA, 14 bp, Homo sapiens
ctcccccgccactc

SEQ ID NO: 4969397 - DNA, 15 bp, Homo sapiens
ctccccggcaccctc

SEQ ID NO: 4969398 - DNA, 17 bp, Homo sapiens
ctccccggcaccctctg

SEQ ID NO: 4969399 - DNA, 19 bp, Homo sapiens
ctccccggcaccctctggc

SEQ ID NO: 4969400 - DNA, 18 bp, Homo sapiens
ctcccctcacagcctctg

SEQ ID NO: 4969401 - DNA, 20 bp, Homo sapiens
ctcccctcacagcctctgac

SEQ ID NO: 4969402 - DNA, 14 bp, Homo sapiens
ctcccctccagcct

SEQ ID NO: 4969403 - DNA, 13 bp, Homo sapiens
ctcccctcccctg

SEQ ID NO: 4969404 - DNA, 14 bp, Homo sapiens
ctcccctcccctgc

SEQ ID NO: 4969405 - DNA, 16 bp, Homo sapiens
ctcccctcccctgctg

SEQ ID NO: 4969406 - DNA, 18 bp, Homo sapiens
ctcccctcccctgctgca

SEQ ID NO: 4969407 - DNA, 15 bp, Homo sapiens
ctcccctgccttgct

SEQ ID NO: 4969408 - DNA, 18 bp, Homo sapiens
ctcccctgctgcaggggc

SEQ ID NO: 4969409 - DNA, 20 bp, Homo sapiens
ctcccgaatagctgggacta

SEQ ID NO: 4969410 - DNA, 23 bp, Homo sapiens
ctcccgaatagctgggactacag

SEQ ID NO: 4969411 - DNA, 16 bp, Homo sapiens
ctcccgagtagctggg

SEQ ID NO: 4969412 - DNA, 20 bp, Homo sapiens
ctcccgagtagctgggacta

SEQ ID NO: 4969413 - DNA, 18 bp, Homo sapiens
ctccctaagccagcctgg

SEQ ID NO: 4969414 - DNA, 13 bp, Homo sapiens
ctccctcattcca

SEQ ID NO: 4969415 - DNA, 14 bp, Homo sapiens
ctccctccacctac

SEQ ID NO: 4969416 - DNA, 14 bp, Homo sapiens
ctccctcccctgcc

SEQ ID NO: 4969417 - DNA, 21 bp, Homo sapiens
ctccctcccctgccctggtcc

SEQ ID NO: 4969418 - DNA, 14 bp, Homo sapiens
ctccctctatttat

SEQ ID NO: 4969419 - DNA, 18 bp, Homo sapiens
ctccctctgatttttcat

SEQ ID NO: 4969420 - DNA, 12 bp, Homo sapiens
ctccctcttgtt

SEQ ID NO: 4969421 - DNA, 21 bp, Homo sapiens
ctccctgaaaatgtttttctg

SEQ ID NO: 4969422 - DNA, 23 bp, Homo sapiens
ctccctgaaaatgtttttctgcc

SEQ ID NO: 4969423 - DNA, 15 bp, Homo sapiens
ctccctgccccaaat

SEQ ID NO: 4969424 - DNA, 18 bp, Homo sapiens
ctccctgcccctcccttc

SEQ ID NO: 4969425 - DNA, 22 bp, Homo sapiens
ctccctggagtgtggctgagga

SEQ ID NO: 4969426 - DNA, 23 bp, Homo sapiens
ctccctggagtgtggctgaggag

SEQ ID NO: 4969427 - DNA, 12 bp, Homo sapiens
ctccctggctcc

SEQ ID NO: 4969428 - DNA, 15 bp, Homo sapiens
ctccctggctcccat

SEQ ID NO: 4969429 - DNA, 18 bp, Homo sapiens
ctcccttcaaccattccc

SEQ ID NO: 4969430 - DNA, 19 bp, Homo sapiens
ctcccttcaaccattcccc

SEQ ID NO: 4969431 - DNA, 13 bp, Homo sapiens
ctcccttcagccc

SEQ ID NO: 4969432 - DNA, 17 bp, Homo sapiens
ctccctttccttcctaa

SEQ ID NO: 4969433 - DNA, 21 bp, Homo sapiens
ctccctttttatatcccattt

SEQ ID NO: 4969434 - DNA, 22 bp, Homo sapiens
ctccgaacaccctcgaagcgcg

SEQ ID NO: 4969435 - DNA, 15 bp, Homo sapiens
ctccgcccccagcct

SEQ ID NO: 4969436 - DNA, 21 bp, Homo sapiens
ctccgcccccagcctatgagc

SEQ ID NO: 4969437 - DNA, 18 bp, Homo sapiens
ctccgctgctccttggct

SEQ ID NO: 4969438 - DNA, 22 bp, Homo sapiens
ctccgtccagccgccattgcca

SEQ ID NO: 4969439 - DNA, 22 bp, Homo sapiens
ctccgtccaggagcctgtgcct

SEQ ID NO: 4969440 - DNA, 18 bp, Homo sapiens
ctcctacctgccctggaa

SEQ ID NO: 4969441 - DNA, 13 bp, Homo sapiens
ctcctacctggta

SEQ ID NO: 4969442 - DNA, 19 bp, Homo sapiens
ctcctatttttgtaaactg

SEQ ID NO: 4969443 - DNA, 15 bp, Homo sapiens
ctcctcacacaccct

SEQ ID NO: 4969444 - DNA, 20 bp, Homo sapiens
ctcctcacccccagctttgc

SEQ ID NO: 4969445 - DNA, 18 bp, Homo sapiens
ctcctcacctctggactg

SEQ ID NO: 4969446 - DNA, 11 bp, Homo sapiens
ctcctcccagc

SEQ ID NO: 4969447 - DNA, 12 bp, Homo sapiens
ctcctcccagct

SEQ ID NO: 4969448 - DNA, 23 bp, Homo sapiens
ctcctcccagcttgtaggagctg

SEQ ID NO: 4969449 - DNA, 12 bp, Homo sapiens
ctcctcccagga

SEQ ID NO: 4969450 - DNA, 23 bp, Homo sapiens
ctcctcggaaccgctcacctaga

SEQ ID NO: 4969451 - DNA, 19 bp, Homo sapiens
ctcctcgttcctttctcct

SEQ ID NO: 4969452 - DNA, 17 bp, Homo sapiens
ctcctctagctgtgggg

SEQ ID NO: 4969453 - DNA, 15 bp, Homo sapiens
ctcctctcctggagg

SEQ ID NO: 4969454 - DNA, 18 bp, Homo sapiens
ctcctcttcaactgacca

SEQ ID NO: 4969455 - DNA, 18 bp, Homo sapiens
ctcctcttcaccccggca

SEQ ID NO: 4969456 - DNA, 19 bp, Homo sapiens
ctcctcttcaccccggcag

SEQ ID NO: 4969457 - DNA, 23 bp, Homo sapiens
ctcctcttcttttttttcattat

SEQ ID NO: 4969458 - DNA, 15 bp, Homo sapiens
ctcctcttgccactg

SEQ ID NO: 4969459 - DNA, 12 bp, Homo sapiens
ctcctctttaaa

SEQ ID NO: 4969460 - DNA, 18 bp, Homo sapiens
ctcctctttaaaacaaaa

SEQ ID NO: 4969461 - DNA, 18 bp, Homo sapiens
ctcctgaaccgcacagct

SEQ ID NO: 4969462 - DNA, 20 bp, Homo sapiens
ctcctgaaccgcacagctca

SEQ ID NO: 4969463 - DNA, 16 bp, Homo sapiens
ctcctgaggctttgga

SEQ ID NO: 4969464 - DNA, 17 bp, Homo sapiens
ctcctgaggctttggat

SEQ ID NO: 4969465 - DNA, 20 bp, Homo sapiens
ctcctgaggggcatctgccc

SEQ ID NO: 4969466 - DNA, 12 bp, Homo sapiens
ctcctgcctcag

SEQ ID NO: 4969467 - DNA, 21 bp, Homo sapiens
ctcctgcctcgaactggctgc

SEQ ID NO: 4969468 - DNA, 19 bp, Homo sapiens
ctcctgcctgtagcagtga

SEQ ID NO: 4969469 - DNA, 10 bp, Homo sapiens
ctcctggagg

SEQ ID NO: 4969470 - DNA, 20 bp, Homo sapiens
ctcctggcagaagggagcag

SEQ ID NO: 4969471 - DNA, 18 bp, Homo sapiens
ctcctgggggttctttct

SEQ ID NO: 4969472 - DNA, 23 bp, Homo sapiens
ctcctgggggttctttcttcctc

SEQ ID NO: 4969473 - DNA, 17 bp, Homo sapiens
ctcctgtaagccaaaga

SEQ ID NO: 4969474 - DNA, 13 bp, Homo sapiens
ctcctgtcctccc

SEQ ID NO: 4969475 - DNA, 15 bp, Homo sapiens
ctcctgtcctcccat

SEQ ID NO: 4969476 - DNA, 21 bp, Homo sapiens
ctcctgtcctcccatcccctg

SEQ ID NO: 4969477 - DNA, 16 bp, Homo sapiens
ctcctgtggggaaagg

SEQ ID NO: 4969478 - DNA, 14 bp, Homo sapiens
ctcctgtgtactgt

SEQ ID NO: 4969479 - DNA, 11 bp, Homo sapiens
ctcctgtgtgt

SEQ ID NO: 4969480 - DNA, 16 bp, Homo sapiens
ctcctgtgtgtgcgcc

SEQ ID NO: 4969481 - DNA, 20 bp, Homo sapiens
ctcctgtttcccttcccttc

SEQ ID NO: 4969482 - DNA, 13 bp, Homo sapiens
ctccttcagacac

SEQ ID NO: 4969483 - DNA, 14 bp, Homo sapiens
ctccttcagacacc

SEQ ID NO: 4969484 - DNA, 19 bp, Homo sapiens
ctccttcagacaccctcaa

SEQ ID NO: 4969485 - DNA, 18 bp, Homo sapiens
ctccttcgtatcccgagt

SEQ ID NO: 4969486 - DNA, 19 bp, Homo sapiens
ctccttcgtatcccgagtc

SEQ ID NO: 4969487 - DNA, 22 bp, Homo sapiens
ctgcaattcaaaagttccaaga

SEQ ID NO: 4969488 - DNA, 22 bp, Homo sapiens
ctgcacacaagcccacagcaca

SEQ ID NO: 4969489 - DNA, 13 bp, Homo sapiens
ctgcacagcggcc

SEQ ID NO: 4969490 - DNA, 22 bp, Homo sapiens
ctgcacagtgcatctcagccca

SEQ ID NO: 4969491 - DNA, 12 bp, Homo sapiens
ctgcaccagagc

SEQ ID NO: 4969492 - DNA, 13 bp, Homo sapiens
ctgcaccagagca

SEQ ID NO: 4969493 - DNA, 20 bp, Homo sapiens
ctgcaccagagcaacctctc

SEQ ID NO: 4969494 - DNA, 23 bp, Homo sapiens
ctgcaccctggggcctggacctg

SEQ ID NO: 4969495 - DNA, 17 bp, Homo sapiens
ctgcacccttcttttct

SEQ ID NO: 4969496 - DNA, 12 bp, Homo sapiens
ctgcaccgggcc

SEQ ID NO: 4969497 - DNA, 15 bp, Homo sapiens
ctgcaccgggccaca

SEQ ID NO: 4969498 - DNA, 23 bp, Homo sapiens
ctgcaccgggccacagagaaagt

SEQ ID NO: 4969499 - DNA, 19 bp, Homo sapiens
ctgcactaaagccagcctg

SEQ ID NO: 4969500 - DNA, 14 bp, Homo sapiens
ctgcactcaagctt

SEQ ID NO: 4969501 - DNA, 14 bp, Homo sapiens
ctgcactgaaaagg

SEQ ID NO: 4969502 - DNA, 21 bp, Homo sapiens
ctgcactttgatgtcatgtgt

SEQ ID NO: 4969503 - DNA, 23 bp, Homo sapiens
ctgcactttgatgtcatgtgttc

SEQ ID NO: 4969504 - DNA, 14 bp, Homo sapiens
ctgcagatgccacc

SEQ ID NO: 4969505 - DNA, 19 bp, Homo sapiens
ctgcagatgccaccctagc

SEQ ID NO: 4969506 - DNA, 19 bp, Homo sapiens
ctgcagcacggacaataaa

SEQ ID NO: 4969507 - DNA, 13 bp, Homo sapiens
ctgcagcaggagt

SEQ ID NO: 4969508 - DNA, 20 bp, Homo sapiens
ctgcagcaggagtggtgcag

SEQ ID NO: 4969509 - DNA, 21 bp, Homo sapiens
ctgcagcaggagtggtgcaga

SEQ ID NO: 4969510 - DNA, 20 bp, Homo sapiens
ctgcagcctcaacctcctgg

SEQ ID NO: 4969511 - DNA, 18 bp, Homo sapiens
ctgcagcctttgcctccc

SEQ ID NO: 4969512 - DNA, 15 bp, Homo sapiens
ctgcagctggacaga

SEQ ID NO: 4969513 - DNA, 17 bp, Homo sapiens
ctgcagctggacagagg

SEQ ID NO: 4969514 - DNA, 19 bp, Homo sapiens
ctgcagctggacagagggg

SEQ ID NO: 4969515 - DNA, 19 bp, Homo sapiens
ctgcagcttcctgtcaaca

SEQ ID NO: 4969516 - DNA, 12 bp, Homo sapiens
ctgcagcttggg

SEQ ID NO: 4969517 - DNA, 22 bp, Homo sapiens
ctgcaggaatcaaaaattgaag

SEQ ID NO: 4969518 - DNA, 19 bp, Homo sapiens
ctgcaggacttgagaagac

SEQ ID NO: 4969519 - DNA, 15 bp, Homo sapiens
ctgcaggctgagcca

SEQ ID NO: 4969520 - DNA, 16 bp, Homo sapiens
ctgcagggccaagcac

SEQ ID NO: 4969521 - DNA, 13 bp, Homo sapiens
ctgcagggccagg

SEQ ID NO: 4969522 - DNA, 16 bp, Homo sapiens
ctgcagggccaggact

SEQ ID NO: 4969523 - DNA, 21 bp, Homo sapiens
ctgcagggccaggactgagcc

SEQ ID NO: 4969524 - DNA, 12 bp, Homo sapiens
ctgcagggctgc

SEQ ID NO: 4969525 - DNA, 12 bp, Homo sapiens
ctgcaggggctc

SEQ ID NO: 4969526 - DNA, 17 bp, Homo sapiens
ctgcaggggctctggag

SEQ ID NO: 4969527 - DNA, 23 bp, Homo sapiens
ctgcagggggtgtgtctgctcag

SEQ ID NO: 4969528 - DNA, 14 bp, Homo sapiens
ctgcagtaaatctt

SEQ ID NO: 4969529 - DNA, 23 bp, Homo sapiens
ctgcagtccgtgtggatccaatg

SEQ ID NO: 4969530 - DNA, 17 bp, Homo sapiens
ctgcagtgttcgcttgg

SEQ ID NO: 4969531 - DNA, 15 bp, Homo sapiens
ctgcagtttttcagg

SEQ ID NO: 4969532 - DNA, 18 bp, Homo sapiens
ctgcatcccagcacctgc

SEQ ID NO: 4969533 - DNA, 20 bp, Homo sapiens
ctgcatcccagcacctgcct

SEQ ID NO: 4969534 - DNA, 21 bp, Homo sapiens
ctgcatcccagcacctgcctc

SEQ ID NO: 4969535 - DNA, 15 bp, Homo sapiens
ctgcatccccttggc

SEQ ID NO: 4969536 - DNA, 22 bp, Homo sapiens
ctgcatcttatagcactttgaa

SEQ ID NO: 4969537 - DNA, 23 bp, Homo sapiens
ctgcatcttatagcactttgaaa

SEQ ID NO: 4969538 - DNA, 18 bp, Homo sapiens
ctgcatctttagtgcttt

SEQ ID NO: 4969539 - DNA, 22 bp, Homo sapiens
ctgcatgcctggtctttcctct

SEQ ID NO: 4969540 - DNA, 23 bp, Homo sapiens
ctgcatgcctggtctttcctctg

SEQ ID NO: 4969541 - DNA, 17 bp, Homo sapiens
ctgcattgctagataaa

SEQ ID NO: 4969542 - DNA, 18 bp, Homo sapiens
ctgcattgctagataaaa

SEQ ID NO: 4969543 - DNA, 19 bp, Homo sapiens
ctgcattgctagataaaag

SEQ ID NO: 4969544 - DNA, 17 bp, Homo sapiens
ctgcatttgtgaaatga

SEQ ID NO: 4969545 - DNA, 18 bp, Homo sapiens
ctgcattttcaccccacc

SEQ ID NO: 4969546 - DNA, 21 bp, Homo sapiens
ctgccaaagggaaatatcatt

SEQ ID NO: 4969547 - DNA, 12 bp, Homo sapiens
ctgccaagagag

SEQ ID NO: 4969548 - DNA, 20 bp, Homo sapiens
ctgccacaaccagccaggca

SEQ ID NO: 4969549 - DNA, 12 bp, Homo sapiens
ctgccacacagg

SEQ ID NO: 4969550 - DNA, 16 bp, Homo sapiens
ctgccacactctgacg

SEQ ID NO: 4969551 - DNA, 17 bp, Homo sapiens
ctgccacacttcaggct

SEQ ID NO: 4969552 - DNA, 22 bp, Homo sapiens
ctgccacacttcaggctcttct

SEQ ID NO: 4969553 - DNA, 21 bp, Homo sapiens
ctgccaccctggggagaaagt

SEQ ID NO: 4969554 - DNA, 15 bp, Homo sapiens
ctgccaccctgtagc

SEQ ID NO: 4969555 - DNA, 17 bp, Homo sapiens
ctgccacctccctgacc

SEQ ID NO: 4969556 - DNA, 16 bp, Homo sapiens
ctgccacctctccatc

SEQ ID NO: 4969557 - DNA, 12 bp, Homo sapiens
ctgccactttgc

SEQ ID NO: 4969558 - DNA, 11 bp, Homo sapiens
ctgccagcagc

SEQ ID NO: 4969559 - DNA, 13 bp, Homo sapiens
ctgccagcagcag

SEQ ID NO: 4969560 - DNA, 17 bp, Homo sapiens
ctgccagcagcagcagg

SEQ ID NO: 4969561 - DNA, 12 bp, Homo sapiens
ctgccagggcag

SEQ ID NO: 4969562 - DNA, 13 bp, Homo sapiens
ctgccagggcagt

SEQ ID NO: 4969563 - DNA, 15 bp, Homo sapiens
ctgccagggcagtgc

SEQ ID NO: 4969564 - DNA, 16 bp, Homo sapiens
ctgccagggcagtgct

SEQ ID NO: 4969565 - DNA, 17 bp, Homo sapiens
ctgccagtccccctgcc

SEQ ID NO: 4969566 - DNA, 22 bp, Homo sapiens
ctgccagtccccctgccccagg

SEQ ID NO: 4969567 - DNA, 15 bp, Homo sapiens
ctgccagtgtggagt

SEQ ID NO: 4969568 - DNA, 22 bp, Homo sapiens
ctgccatattctgttggccagt

SEQ ID NO: 4969569 - DNA, 22 bp, Homo sapiens
ctgccatcttagtttggattct

SEQ ID NO: 4969570 - DNA, 23 bp, Homo sapiens
ctgccatcttagtttggattctt

SEQ ID NO: 4969571 - DNA, 22 bp, Homo sapiens
ctgccatgccaggaacctgtcc

SEQ ID NO: 4969572 - DNA, 23 bp, Homo sapiens
ctgccatgtacctcccctgcctt

SEQ ID NO: 4969573 - DNA, 20 bp, Homo sapiens
ctgccattattttctgtcag

SEQ ID NO: 4969574 - DNA, 22 bp, Homo sapiens
ctgccattattttctgtcagat

SEQ ID NO: 4969575 - DNA, 17 bp, Homo sapiens
ctgcccaacctgctctc

SEQ ID NO: 4969576 - DNA, 18 bp, Homo sapiens
ctgcccaagcccaggcca

SEQ ID NO: 4969577 - DNA, 16 bp, Homo sapiens
ctgcccactgctgcag

SEQ ID NO: 4969578 - DNA, 13 bp, Homo sapiens
ctgcccactgttt

SEQ ID NO: 4969579 - DNA, 23 bp, Homo sapiens
ctgcccaggaccatcttcccgag

SEQ ID NO: 4969580 - DNA, 22 bp, Homo sapiens
ctgcccaggccggccagcctca

SEQ ID NO: 4969581 - DNA, 18 bp, Homo sapiens
ctgcccaggctgtgcagc

SEQ ID NO: 4969582 - DNA, 21 bp, Homo sapiens
ctgccccaaacaaatatgcaa

SEQ ID NO: 4969583 - DNA, 19 bp, Homo sapiens
ctgccccagggctcccggc

SEQ ID NO: 4969584 - DNA, 15 bp, Homo sapiens
ctgcccccagcccaa

SEQ ID NO: 4969585 - DNA, 12 bp, Homo sapiens
ctgccccccagc

SEQ ID NO: 4969586 - DNA, 17 bp, Homo sapiens
ctgcccccggccccctg

SEQ ID NO: 4969587 - DNA, 14 bp, Homo sapiens
ctgccccctgctgg

SEQ ID NO: 4969588 - DNA, 22 bp, Homo sapiens
ctgcccctcccccaacccccac

SEQ ID NO: 4969589 - DNA, 13 bp, Homo sapiens
ctgcccctccctt

SEQ ID NO: 4969590 - DNA, 17 bp, Homo sapiens
ctgcccctcccttcaac

SEQ ID NO: 4969591 - DNA, 13 bp, Homo sapiens
ctgcccctctcac

SEQ ID NO: 4969592 - DNA, 12 bp, Homo sapiens
ctgcccctcttt

SEQ ID NO: 4969593 - DNA, 15 bp, Homo sapiens
ctgcccctctttctc

SEQ ID NO: 4969594 - DNA, 17 bp, Homo sapiens
ctgcccctctttctctt

SEQ ID NO: 4969595 - DNA, 22 bp, Homo sapiens
ctgcccgcacaccctcactctg

SEQ ID NO: 4969596 - DNA, 20 bp, Homo sapiens
ctagaggccagccccaccca

SEQ ID NO: 4969597 - DNA, 23 bp, Homo sapiens
ctagaggccagccccacccagga

SEQ ID NO: 4969598 - DNA, 20 bp, Homo sapiens
ctagagtccaaggtttaaag

SEQ ID NO: 4969599 - DNA, 23 bp, Homo sapiens
ctagagtccaaggtttaaagagt

SEQ ID NO: 4969600 - DNA, 19 bp, Homo sapiens
ctagagtcctcactcccag

SEQ ID NO: 4969601 - DNA, 12 bp, Homo sapiens
ctagataaaagc

SEQ ID NO: 4969602 - DNA, 12 bp, Homo sapiens
ctagatagttta

SEQ ID NO: 4969603 - DNA, 15 bp, Homo sapiens
ctagatcataaggct

SEQ ID NO: 4969604 - DNA, 23 bp, Homo sapiens
ctagatgattaaataagattcta

SEQ ID NO: 4969605 - DNA, 21 bp, Homo sapiens
ctagatgtttattcttctaga

SEQ ID NO: 4969606 - DNA, 22 bp, Homo sapiens
ctagatgtttattcttctagag

SEQ ID NO: 4969607 - DNA, 14 bp, Homo sapiens
ctagattcaaaggt

SEQ ID NO: 4969608 - DNA, 16 bp, Homo sapiens
ctagattcaaaggttc

SEQ ID NO: 4969609 - DNA, 17 bp, Homo sapiens
ctagattcaaaggttct

SEQ ID NO: 4969610 - DNA, 22 bp, Homo sapiens
ctagattccattggtccaagat

SEQ ID NO: 4969611 - DNA, 14 bp, Homo sapiens
ctagcaagctggcc

SEQ ID NO: 4969612 - DNA, 17 bp, Homo sapiens
ctagcaagctggcctct

SEQ ID NO: 4969613 - DNA, 18 bp, Homo sapiens
ctagcccaccctgctgcc

SEQ ID NO: 4969614 - DNA, 19 bp, Homo sapiens
ctagcccagcgctctgcct

SEQ ID NO: 4969615 - DNA, 15 bp, Homo sapiens
ctagcccaggagaga

SEQ ID NO: 4969616 - DNA, 20 bp, Homo sapiens
ctagcccaggagagagaaag

SEQ ID NO: 4969617 - DNA, 23 bp, Homo sapiens
ctagcccaggagagagaaagcca

SEQ ID NO: 4969618 - DNA, 21 bp, Homo sapiens
ctagcccctgtggagactggg

SEQ ID NO: 4969619 - DNA, 22 bp, Homo sapiens
ctagcctatttacctgcaggct

SEQ ID NO: 4969620 - DNA, 15 bp, Homo sapiens
ctagcctgcactttg

SEQ ID NO: 4969621 - DNA, 16 bp, Homo sapiens
ctagcctgtttcttcc

SEQ ID NO: 4969622 - DNA, 21 bp, Homo sapiens
ctagccttagaagtcacacag

SEQ ID NO: 4969623 - DNA, 17 bp, Homo sapiens
ctagcctttggctctgg

SEQ ID NO: 4969624 - DNA, 22 bp, Homo sapiens
ctagctaatgtaataactgtga

SEQ ID NO: 4969625 - DNA, 22 bp, Homo sapiens
ctagctgcctagcaagctggcc

SEQ ID NO: 4969626 - DNA, 16 bp, Homo sapiens
ctaggaccactcagcc

SEQ ID NO: 4969627 - DNA, 18 bp, Homo sapiens
ctaggaccactcagcccc

SEQ ID NO: 4969628 - DNA, 20 bp, Homo sapiens
ctaggaccactcagccccta

SEQ ID NO: 4969629 - DNA, 21 bp, Homo sapiens
ctaggaccactcagcccctag

SEQ ID NO: 4969630 - DNA, 13 bp, Homo sapiens
ctaggagggagac

SEQ ID NO: 4969631 - DNA, 22 bp, Homo sapiens
ctaggagggagacactggcccc

SEQ ID NO: 4969632 - DNA, 13 bp, Homo sapiens
ctaggattctaaa

SEQ ID NO: 4969633 - DNA, 14 bp, Homo sapiens
ctaggcctggccag

SEQ ID NO: 4969634 - DNA, 15 bp, Homo sapiens
ctaggcctggccaga

SEQ ID NO: 4969635 - DNA, 18 bp, Homo sapiens
ctaggcctggccagatgc

SEQ ID NO: 4969636 - DNA, 15 bp, Homo sapiens
ctaggcgtgagaagc

SEQ ID NO: 4969637 - DNA, 20 bp, Homo sapiens
ctaggctcagagatgtgcac

SEQ ID NO: 4969638 - DNA, 14 bp, Homo sapiens
ctaggtacttcagg

SEQ ID NO: 4969639 - DNA, 15 bp, Homo sapiens
ctaggtagaaaaagg

SEQ ID NO: 4969640 - DNA, 16 bp, Homo sapiens
ctaggttccctgttct

SEQ ID NO: 4969641 - DNA, 22 bp, Homo sapiens
ctagtaagtaattatgcactaa

SEQ ID NO: 4969642 - DNA, 19 bp, Homo sapiens
ctagtacacttttatgagc

SEQ ID NO: 4969643 - DNA, 20 bp, Homo sapiens
ctagtactgtgtactgtata

SEQ ID NO: 4969644 - DNA, 22 bp, Homo sapiens
ctagtactgtgtactgtataga

SEQ ID NO: 4969645 - DNA, 16 bp, Homo sapiens
ctagtacttgaaaaag

SEQ ID NO: 4969646 - DNA, 21 bp, Homo sapiens
ctagtatttcatgctgggaat

SEQ ID NO: 4969647 - DNA, 20 bp, Homo sapiens
ctagtatttgaattaaaact

SEQ ID NO: 4969648 - DNA, 21 bp, Homo sapiens
ctagtatttgaattaaaactt

SEQ ID NO: 4969649 - DNA, 14 bp, Homo sapiens
ctagtccggaccca

SEQ ID NO: 4969650 - DNA, 21 bp, Homo sapiens
ctagtccggacccacctcacc

SEQ ID NO: 4969651 - DNA, 16 bp, Homo sapiens
ctagtgacagcttgtg

SEQ ID NO: 4969652 - DNA, 19 bp, Homo sapiens
ctagtgaccccttccctgt

SEQ ID NO: 4969653 - DNA, 20 bp, Homo sapiens
ctagtgaccccttccctgtc

SEQ ID NO: 4969654 - DNA, 19 bp, Homo sapiens
ctagtgatgtttttatgat

SEQ ID NO: 4969655 - DNA, 15 bp, Homo sapiens
ctagtggtctttgta

SEQ ID NO: 4969656 - DNA, 19 bp, Homo sapiens
ctagtggtctttgtaagag

SEQ ID NO: 4969657 - DNA, 13 bp, Homo sapiens
ctagtgttctgtc

SEQ ID NO: 4969658 - DNA, 20 bp, Homo sapiens
ctagttccctctgctcagcc

SEQ ID NO: 4969659 - DNA, 16 bp, Homo sapiens
ctagtttactgttttg

SEQ ID NO: 4969660 - DNA, 17 bp, Homo sapiens
ctagtttactgttttga

SEQ ID NO: 4969661 - DNA, 16 bp, Homo sapiens
ctagttttctcctccc

SEQ ID NO: 4969662 - DNA, 14 bp, Homo sapiens
ctagtttttagtaa

SEQ ID NO: 4969663 - DNA, 13 bp, Homo sapiens
ctataaagagaag

SEQ ID NO: 4969664 - DNA, 18 bp, Homo sapiens
ctataaccccagctccct

SEQ ID NO: 4969665 - DNA, 15 bp, Homo sapiens
ctataacttgatgca

SEQ ID NO: 4969666 - DNA, 12 bp, Homo sapiens
ctataatctgtc

SEQ ID NO: 4969667 - DNA, 22 bp, Homo sapiens
ctataatctgtcaaaacactgt

SEQ ID NO: 4969668 - DNA, 13 bp, Homo sapiens
ctataatgtgtgt

SEQ ID NO: 4969669 - DNA, 16 bp, Homo sapiens
ctataatgtgtgtatg

SEQ ID NO: 4969670 - DNA, 16 bp, Homo sapiens
ctatacttgaacaaaa

SEQ ID NO: 4969671 - DNA, 21 bp, Homo sapiens
ctatacttgaacaaaagggtc

SEQ ID NO: 4969672 - DNA, 17 bp, Homo sapiens
ctatagcctaggtgaca

SEQ ID NO: 4969673 - DNA, 19 bp, Homo sapiens
ctatagcctggactttcct

SEQ ID NO: 4969674 - DNA, 17 bp, Homo sapiens
ctatagctaagtacaca

SEQ ID NO: 4969675 - DNA, 13 bp, Homo sapiens
ctatagttctaga

SEQ ID NO: 4969676 - DNA, 15 bp, Homo sapiens
ctatagttctagaca

SEQ ID NO: 4969677 - DNA, 13 bp, Homo sapiens
ctatatacatgtg

SEQ ID NO: 4969678 - DNA, 17 bp, Homo sapiens
ctatatacatgtgtgta

SEQ ID NO: 4969679 - DNA, 17 bp, Homo sapiens
ctatatagaatgctgca

SEQ ID NO: 4969680 - DNA, 15 bp, Homo sapiens
ctatatagagatgtt

SEQ ID NO: 4969681 - DNA, 13 bp, Homo sapiens
ctatatatgtgta

SEQ ID NO: 4969682 - DNA, 14 bp, Homo sapiens
ctatatcatgcttt

SEQ ID NO: 4969683 - DNA, 20 bp, Homo sapiens
ctatatcatgctttaaagtg

SEQ ID NO: 4969684 - DNA, 17 bp, Homo sapiens
ctatatcctgtgactgt

SEQ ID NO: 4969685 - DNA, 23 bp, Homo sapiens
ctatatgaatttaaatataattc

SEQ ID NO: 4969686 - DNA, 18 bp, Homo sapiens
ctatatgatttatagttt

SEQ ID NO: 4969687 - DNA, 19 bp, Homo sapiens
ctatatggcaagaaagctg

SEQ ID NO: 4969688 - DNA, 21 bp, Homo sapiens
ctatatgtagtataaagaaaa

SEQ ID NO: 4969689 - DNA, 18 bp, Homo sapiens
ctatatgtgaatcctctt

SEQ ID NO: 4969690 - DNA, 12 bp, Homo sapiens
ctatatttgcta

SEQ ID NO: 4969691 - DNA, 15 bp, Homo sapiens
ctatcaagtcaatca

SEQ ID NO: 4969692 - DNA, 16 bp, Homo sapiens
ctcagtcctcccctca

SEQ ID NO: 4969693 - DNA, 19 bp, Homo sapiens
ctcagtcctcccctcacag

SEQ ID NO: 4969694 - DNA, 22 bp, Homo sapiens
ctcagtcctcccctcacagcct

SEQ ID NO: 4969695 - DNA, 17 bp, Homo sapiens
ctcagttcccttggcct

SEQ ID NO: 4969696 - DNA, 18 bp, Homo sapiens
ctcagttcccttggcctc

SEQ ID NO: 4969697 - DNA, 20 bp, Homo sapiens
ctcagttcccttggcctcag

SEQ ID NO: 4969698 - DNA, 22 bp, Homo sapiens
ctcagtttgtgtgtcttaatta

SEQ ID NO: 4969699 - DNA, 14 bp, Homo sapiens
ctcatacctctgac

SEQ ID NO: 4969700 - DNA, 21 bp, Homo sapiens
ctcatcaatcaaataagtatt

SEQ ID NO: 4969701 - DNA, 13 bp, Homo sapiens
ctcatccacccca

SEQ ID NO: 4969702 - DNA, 19 bp, Homo sapiens
ctcatccaccccatccctc

SEQ ID NO: 4969703 - DNA, 22 bp, Homo sapiens
ctcatccccaggggtcccagcc

SEQ ID NO: 4969704 - DNA, 23 bp, Homo sapiens
ctcatccccaggggtcccagcca

SEQ ID NO: 4969705 - DNA, 19 bp, Homo sapiens
ctcatccccagtcccaatg

SEQ ID NO: 4969706 - DNA, 19 bp, Homo sapiens
ctcatcccgtgttctcctt

SEQ ID NO: 4969707 - DNA, 14 bp, Homo sapiens
ctcatctgcaccct

SEQ ID NO: 4969708 - DNA, 15 bp, Homo sapiens
ctcatctgcaccctt

SEQ ID NO: 4969709 - DNA, 12 bp, Homo sapiens
cctccatgtggg

SEQ ID NO: 4969710 - DNA, 23 bp, Homo sapiens
cctccatgtgggctagttgggct

SEQ ID NO: 4969711 - DNA, 20 bp, Homo sapiens
cctccattctattttagaat

SEQ ID NO: 4969712 - DNA, 18 bp, Homo sapiens
cctcccaaagtgctgaga

SEQ ID NO: 4969713 - DNA, 16 bp, Homo sapiens
cctcccaaagtgctgg

SEQ ID NO: 4969714 - DNA, 15 bp, Homo sapiens
cctcccaaggagaac

SEQ ID NO: 4969715 - DNA, 15 bp, Homo sapiens
cgctagagcagccca

SEQ ID NO: 4969716 - DNA, 17 bp, Homo sapiens
cgctagagcagcccaaa

SEQ ID NO: 4969717 - DNA, 17 bp, Homo sapiens
cgctcacctagagccag

SEQ ID NO: 4969718 - DNA, 18 bp, Homo sapiens
cgctcacctagagccaga

SEQ ID NO: 4969719 - DNA, 21 bp, Homo sapiens
cgctcagccctccctgcccct

SEQ ID NO: 4969720 - DNA, 15 bp, Homo sapiens
cagatgagaacaaag

SEQ ID NO: 4969721 - DNA, 14 bp, Homo sapiens
cagatgcaccagcc

SEQ ID NO: 4969722 - DNA, 21 bp, Homo sapiens
cagatggcccggatgctgctt

SEQ ID NO: 4969723 - DNA, 20 bp, Homo sapiens
cagatgggaggaaagagagc

SEQ ID NO: 4969724 - DNA, 20 bp, Homo sapiens
cagatgtgggctttgatttc

SEQ ID NO: 4969725 - DNA, 23 bp, Homo sapiens
cagatgtttccagacttccttga

SEQ ID NO: 4969726 - DNA, 15 bp, Homo sapiens
cagattcagtcttgc

SEQ ID NO: 4969727 - DNA, 20 bp, Homo sapiens
cagattcagtcttgccttac

SEQ ID NO: 4969728 - DNA, 18 bp, Homo sapiens
cagattgcaacaggctgg

SEQ ID NO: 4969729 - DNA, 19 bp, Homo sapiens
cagattgcaacaggctggg

SEQ ID NO: 4969730 - DNA, 16 bp, Homo sapiens
cagatttcatacctca

SEQ ID NO: 4969731 - DNA, 20 bp, Homo sapiens
cagattttgataactgttta

SEQ ID NO: 4969732 - DNA, 21 bp, Homo sapiens
cagattttggggttgtgttgt

SEQ ID NO: 4969733 - DNA, 17 bp, Homo sapiens
cagatttttcggaggcc

SEQ ID NO: 4969734 - DNA, 19 bp, Homo sapiens
cagattttttacagctgcc

SEQ ID NO: 4969735 - DNA, 22 bp, Homo sapiens
cagattttttacagctgcctgc

SEQ ID NO: 4969736 - DNA, 21 bp, Homo sapiens
cagcaaaccatttttaaagta

SEQ ID NO: 4969737 - DNA, 20 bp, Homo sapiens
cagcaaagaggactcgcttg

SEQ ID NO: 4969738 - DNA, 18 bp, Homo sapiens
cagcaacacagcctgggc

SEQ ID NO: 4969739 - DNA, 22 bp, Homo sapiens
cagcaacttcttctccatccct

SEQ ID NO: 4969740 - DNA, 14 bp, Homo sapiens
cagcaagaataaaa

SEQ ID NO: 4969741 - DNA, 21 bp, Homo sapiens
cagcaagccctacagagctgt

SEQ ID NO: 4969742 - DNA, 18 bp, Homo sapiens
cagcaaggccctgctgcc

SEQ ID NO: 4969743 - DNA, 21 bp, Homo sapiens
cagcaagtgagagctgggtgt

SEQ ID NO: 4969744 - DNA, 15 bp, Homo sapiens
cagcaatatgtaaat

SEQ ID NO: 4969745 - DNA, 18 bp, Homo sapiens
cagcaatgacatctcagg

SEQ ID NO: 4969746 - DNA, 15 bp, Homo sapiens
cagcaatttaaatgt

SEQ ID NO: 4969747 - DNA, 19 bp, Homo sapiens
cagcacagataaaaagtgg

SEQ ID NO: 4969748 - DNA, 17 bp, Homo sapiens
cagcacagctccctgcc

SEQ ID NO: 4969749 - DNA, 15 bp, Homo sapiens
cagcacatgctggcc

SEQ ID NO: 4969750 - DNA, 18 bp, Homo sapiens
cagcacatgctggccagc

SEQ ID NO: 4969751 - DNA, 21 bp, Homo sapiens
cagcaccaccctagtcccttc

SEQ ID NO: 4969752 - DNA, 15 bp, Homo sapiens
cagcacctgcctcct

SEQ ID NO: 4969753 - DNA, 19 bp, Homo sapiens
cagcacctgcctcctcgtt

SEQ ID NO: 4969754 - DNA, 23 bp, Homo sapiens
cagcacctgtaagaaacagagca

SEQ ID NO: 4969755 - DNA, 15 bp, Homo sapiens
cagcacggacaataa

SEQ ID NO: 4969756 - DNA, 20 bp, Homo sapiens
cagcactactgggtgtcatt

SEQ ID NO: 4969757 - DNA, 13 bp, Homo sapiens
cagcacttgtata

SEQ ID NO: 4969758 - DNA, 21 bp, Homo sapiens
cagcacttgtctcattttaat

SEQ ID NO: 4969759 - DNA, 23 bp, Homo sapiens
cagcacttgtctcattttaatgt

SEQ ID NO: 4969760 - DNA, 13 bp, Homo sapiens
cagcagaggcggt

SEQ ID NO: 4969761 - DNA, 22 bp, Homo sapiens
cagcagaggcggtcttcaacat

SEQ ID NO: 4969762 - DNA, 24 bp, Homo sapiens
cagcagataacaatgcagcaaggc

SEQ ID NO: 4969763 - DNA, 13 bp, Homo sapiens
cagcagcaggtga

SEQ ID NO: 4969764 - DNA, 21 bp, Homo sapiens
cagcagcatttttatttcaga

SEQ ID NO: 4969765 - DNA, 16 bp, Homo sapiens
cagcagcccctgcaca

SEQ ID NO: 4969766 - DNA, 21 bp, Homo sapiens
cagcagccgccttaagctgat

SEQ ID NO: 4969767 - DNA, 15 bp, Homo sapiens
cagcagcctgcttcc

SEQ ID NO: 4969768 - DNA, 22 bp, Homo sapiens
cagcagcctgcttcccacctcc

SEQ ID NO: 4969769 - DNA, 16 bp, Homo sapiens
cagcagcttcaccaga

SEQ ID NO: 4969770 - DNA, 16 bp, Homo sapiens
cagcaggagtggtgca

SEQ ID NO: 4969771 - DNA, 22 bp, Homo sapiens
cagcaggagtggtgcagacaga

SEQ ID NO: 4969772 - DNA, 23 bp, Homo sapiens
cagcaggtgattggaccaggcca

SEQ ID NO: 4969773 - DNA, 14 bp, Homo sapiens
cagcagtgttcccc

SEQ ID NO: 4969774 - DNA, 19 bp, Homo sapiens
cagcagtgttccccatctg

SEQ ID NO: 4969775 - DNA, 22 bp, Homo sapiens
ccctgcagcacggacaataaac

SEQ ID NO: 4969776 - DNA, 14 bp, Homo sapiens
ccctgcagccagct

SEQ ID NO: 4969777 - DNA, 13 bp, Homo sapiens
ccctgcagtgttc

SEQ ID NO: 4969778 - DNA, 12 bp, Homo sapiens
ccctgcatcccc

SEQ ID NO: 4969779 - DNA, 16 bp, Homo sapiens
ccctgccaaactgaag

SEQ ID NO: 4969780 - DNA, 18 bp, Homo sapiens
ccctgccaccctggggag

SEQ ID NO: 4969781 - DNA, 17 bp, Homo sapiens
ccctgccacctccctga

SEQ ID NO: 4969782 - DNA, 18 bp, Homo sapiens
ccctgcccaggccggcca

SEQ ID NO: 4969783 - DNA, 12 bp, Homo sapiens
ccctgccccaaa

SEQ ID NO: 4969784 - DNA, 11 bp, Homo sapiens
ccctgccctct

SEQ ID NO: 4969785 - DNA, 17 bp, Homo sapiens
ccctgccctctccttcc

SEQ ID NO: 4969786 - DNA, 15 bp, Homo sapiens
ccctgccctggtcca

SEQ ID NO: 4969787 - DNA, 13 bp, Homo sapiens
ccctgcctggtca

SEQ ID NO: 4969788 - DNA, 20 bp, Homo sapiens
ccagtctttaaaggcccagc

SEQ ID NO: 4969789 - DNA, 22 bp, Homo sapiens
ccagtctttaaaggcccagccc

SEQ ID NO: 4969790 - DNA, 20 bp, Homo sapiens
ccagtgacctgctgggtaaa

SEQ ID NO: 4969791 - DNA, 22 bp, Homo sapiens
ccagtgacctgctgggtaaact

SEQ ID NO: 4969792 - DNA, 16 bp, Homo sapiens
ccagtgccaaggacct

SEQ ID NO: 4969793 - DNA, 21 bp, Homo sapiens
ccagtgctgtccatgcttctc

SEQ ID NO: 4969794 - DNA, 21 bp, Homo sapiens
ccagtggatgccacagcccag

SEQ ID NO: 4969795 - DNA, 15 bp, Homo sapiens
ccagtggccactcag

SEQ ID NO: 4969796 - DNA, 16 bp, Homo sapiens
ccagtggccactcagc

SEQ ID NO: 4969797 - DNA, 17 bp, Homo sapiens
ccagtggccactcagct

SEQ ID NO: 4969798 - DNA, 13 bp, Homo sapiens
ccagtggggcctg

SEQ ID NO: 4969799 - DNA, 18 bp, Homo sapiens
ccagtggggcctgtggaa

SEQ ID NO: 4969800 - DNA, 14 bp, Homo sapiens
ccagtgtcccctcc

SEQ ID NO: 4969801 - DNA, 21 bp, Homo sapiens
ccagttaaggaccgtggccct

SEQ ID NO: 4969802 - DNA, 21 bp, Homo sapiens
ccagttcaggagtcccaagga

SEQ ID NO: 4969803 - DNA, 17 bp, Homo sapiens
ccagttgggtggatgcc

SEQ ID NO: 4969804 - DNA, 23 bp, Homo sapiens
ccagttgggtggatgcctggtgg

SEQ ID NO: 4969805 - DNA, 20 bp, Homo sapiens
ccataaggtttcgtttctgt

SEQ ID NO: 4969806 - DNA, 14 bp, Homo sapiens
ccataccagctcgc

SEQ ID NO: 4969807 - DNA, 17 bp, Homo sapiens
ccatagaaacatgacac

SEQ ID NO: 4969808 - DNA, 22 bp, Homo sapiens
ccatagaaacatgacactgacc

SEQ ID NO: 4969809 - DNA, 14 bp, Homo sapiens
ccatagatcttctg

SEQ ID NO: 4969810 - DNA, 15 bp, Homo sapiens
ccatagatcttctga

SEQ ID NO: 4969811 - DNA, 16 bp, Homo sapiens
cccagggtcttcccta

SEQ ID NO: 4969812 - DNA, 18 bp, Homo sapiens
cccagggtcttccctacc

SEQ ID NO: 4969813 - DNA, 13 bp, Homo sapiens
cccaggtcctcac

SEQ ID NO: 4969814 - DNA, 16 bp, Homo sapiens
cccaggtgccagcctg

SEQ ID NO: 4969815 - DNA, 18 bp, Homo sapiens
cccagtctggaatgcagt

SEQ ID NO: 4969816 - DNA, 13 bp, Homo sapiens
cccagtgcccaca

SEQ ID NO: 4969817 - DNA, 16 bp, Homo sapiens
cccagtggccactcag

SEQ ID NO: 4969818 - DNA, 22 bp, Homo sapiens
cccagtggccactcagcttcct

SEQ ID NO: 4969819 - DNA, 22 bp, Homo sapiens
cccagttcaggagtcccaagga

SEQ ID NO: 4969820 - DNA, 18 bp, Homo sapiens
cccataaaaatttttcct

SEQ ID NO: 4969821 - DNA, 14 bp, Homo sapiens
cccataactcaatg

SEQ ID NO: 4969822 - DNA, 14 bp, Homo sapiens
cccatactcagcct

SEQ ID NO: 4969823 - DNA, 22 bp, Homo sapiens
cccatactcagcctgctgccca

SEQ ID NO: 4969824 - DNA, 19 bp, Homo sapiens
cccatagaaacatgacact

SEQ ID NO: 4969825 - DNA, 22 bp, Homo sapiens
cccatagaaacatgacactgac

SEQ ID NO: 4969826 - DNA, 23 bp, Homo sapiens
cccatagaaacatgacactgacc

SEQ ID NO: 4969827 - DNA, 16 bp, Homo sapiens
cccatagatcttctga

SEQ ID NO: 4969828 - DNA, 17 bp, Homo sapiens
cccatagatcttctgaa

SEQ ID NO: 4969829 - DNA, 22 bp, Homo sapiens
cccatcacagggttgggcccag

SEQ ID NO: 4969830 - DNA, 22 bp, Homo sapiens
cccatcattacccttccctgca

SEQ ID NO: 4969831 - DNA, 15 bp, Homo sapiens
cccatcccacaccct

SEQ ID NO: 4969832 - DNA, 12 bp, Homo sapiens
cccatccctgcc

SEQ ID NO: 4969833 - DNA, 21 bp, Homo sapiens
cccatctaagctgcagcttcc

SEQ ID NO: 4969834 - DNA, 22 bp, Homo sapiens
cccatctaagctgcagcttcct

SEQ ID NO: 4969835 - DNA, 15 bp, Homo sapiens
cccatctcccaccct

SEQ ID NO: 4969836 - DNA, 18 bp, Homo sapiens
cccatctctccctcccct

SEQ ID NO: 4969837 - DNA, 23 bp, Homo sapiens
cccatctctccctcccctgccat

SEQ ID NO: 4969838 - DNA, 18 bp, Homo sapiens
cccatctgggtccttgca

SEQ ID NO: 4969839 - DNA, 12 bp, Homo sapiens
cccatgaagcct

SEQ ID NO: 4969840 - DNA, 13 bp, Homo sapiens
cccatgaagcctt

SEQ ID NO: 4969841 - DNA, 21 bp, Homo sapiens
cccatgagaccctggtgcctg

SEQ ID NO: 4969842 - DNA, 15 bp, Homo sapiens
cccatgagcctcagc

SEQ ID NO: 4969843 - DNA, 20 bp, Homo sapiens
cccatgagcctcagcatcct

SEQ ID NO: 4969844 - DNA, 14 bp, Homo sapiens
cccatgcaggccct

SEQ ID NO: 4969845 - DNA, 21 bp, Homo sapiens
cccatgccaaagctagggtgg

SEQ ID NO: 4969846 - DNA, 14 bp, Homo sapiens
cccatgcccacctg

SEQ ID NO: 4969847 - DNA, 16 bp, Homo sapiens
cccatgcctgtccagc

SEQ ID NO: 4969848 - DNA, 15 bp, Homo sapiens
cccatggacactcca

SEQ ID NO: 4969849 - DNA, 14 bp, Homo sapiens
cccatggccctgtg

SEQ ID NO: 4969850 - DNA, 22 bp, Homo sapiens
cccatggccctgtgctaatccc

SEQ ID NO: 4969851 - DNA, 22 bp, Homo sapiens
cccatgtagccccctggcctct

SEQ ID NO: 4969852 - DNA, 23 bp, Homo sapiens
cccatgtagccccctggcctctg

SEQ ID NO: 4969853 - DNA, 18 bp, Homo sapiens
cccatgttctgcccccag

SEQ ID NO: 4969854 - DNA, 19 bp, Homo sapiens
cccatgttctgcccccagc

SEQ ID NO: 4969855 - DNA, 13 bp, Homo sapiens
cccattctgcctg

SEQ ID NO: 4969856 - DNA, 14 bp, Homo sapiens
cccattctgcctgc

SEQ ID NO: 4969857 - DNA, 15 bp, Homo sapiens
cccattctgcctgcc

SEQ ID NO: 4969858 - DNA, 21 bp, Homo sapiens
cccattgcatcacctctgtaa

SEQ ID NO: 4969859 - DNA, 21 bp, Homo sapiens
cccattggtgttgtcattgta

SEQ ID NO: 4969860 - DNA, 18 bp, Homo sapiens
ccccaaaacaaagtcttt

SEQ ID NO: 4969861 - DNA, 19 bp, Homo sapiens
ccccaaaacaaagtctttg

SEQ ID NO: 4969862 - DNA, 18 bp, Homo sapiens
ccccaaacaccttccagc

SEQ ID NO: 4969863 - DNA, 22 bp, Homo sapiens
ccccaaacaccttccagctcct

SEQ ID NO: 4969864 - DNA, 22 bp, Homo sapiens
ccccaacaaaccatccagtgac

SEQ ID NO: 4969865 - DNA, 22 bp, Homo sapiens
ccccaacagcgacatagcccat

SEQ ID NO: 4969866 - DNA, 14 bp, Homo sapiens
ccccaacctgctga

SEQ ID NO: 4969867 - DNA, 16 bp, Homo sapiens
ccccaactctgagccc

SEQ ID NO: 4969868 - DNA, 12 bp, Homo sapiens
ccccacccagga

SEQ ID NO: 4969869 - DNA, 14 bp, Homo sapiens
ccccaccccacact

SEQ ID NO: 4969870 - DNA, 14 bp, Homo sapiens
ccccacccctccag

SEQ ID NO: 4969871 - DNA, 15 bp, Homo sapiens
ccccaccctccctgg

SEQ ID NO: 4969872 - DNA, 16 bp, Homo sapiens
ccccaccctccctgga

SEQ ID NO: 4969873 - DNA, 18 bp, Homo sapiens
ccccaccctccctggagt

SEQ ID NO: 4969874 - DNA, 17 bp, Homo sapiens
ccccaccggtccagctg

SEQ ID NO: 4969875 - DNA, 18 bp, Homo sapiens
ccccaccggtccagctgg

SEQ ID NO: 4969876 - DNA, 21 bp, Homo sapiens
ccccaccggtccagctggcct

SEQ ID NO: 4969877 - DNA, 21 bp, Homo sapiens
ccccacggggcctcgggacct

SEQ ID NO: 4969878 - DNA, 15 bp, Homo sapiens
ccccactctccccac

SEQ ID NO: 4969879 - DNA, 18 bp, Homo sapiens
ccccactctccccacact

SEQ ID NO: 4969880 - DNA, 22 bp, Homo sapiens
ccccactgccagcagcagcagg

SEQ ID NO: 4969881 - DNA, 20 bp, Homo sapiens
ccccagcaagtgagagctgg

SEQ ID NO: 4969882 - DNA, 18 bp, Homo sapiens
ccccagcacctcagcctg

SEQ ID NO: 4969883 - DNA, 11 bp, Homo sapiens
ccccagcacta

SEQ ID NO: 4969884 - DNA, 20 bp, Homo sapiens
ccccagcatcactccccaag

SEQ ID NO: 4969885 - DNA, 22 bp, Homo sapiens
ccccagcccaaaggggacaggc

SEQ ID NO: 4969886 - DNA, 15 bp, Homo sapiens
ccccagcccagggtg

SEQ ID NO: 4969887 - DNA, 15 bp, Homo sapiens
ccccagcccctagcc

SEQ ID NO: 4969888 - DNA, 18 bp, Homo sapiens
ccccagcccctagcccag

SEQ ID NO: 4969889 - DNA, 13 bp, Homo sapiens
ccccagccctggc

SEQ ID NO: 4969890 - DNA, 14 bp, Homo sapiens
ccccagcctatgag

SEQ ID NO: 4969891 - DNA, 22 bp, Homo sapiens
ccccagcctatgagcatcctga

SEQ ID NO: 4969892 - DNA, 23 bp, Homo sapiens
ccccagcctatgagcatcctgag

SEQ ID NO: 4969893 - DNA, 18 bp, Homo sapiens
ccccaggaagcccaggag

SEQ ID NO: 4969894 - DNA, 15 bp, Homo sapiens
ccccagggcaccctg

SEQ ID NO: 4969895 - DNA, 22 bp, Homo sapiens
ccccaggggtcccagccacccc

SEQ ID NO: 4969896 - DNA, 16 bp, Homo sapiens
ccccagggtcttccct

SEQ ID NO: 4969897 - DNA, 16 bp, Homo sapiens
ccccatcccacaccct

SEQ ID NO: 4969898 - DNA, 14 bp, Homo sapiens
ccccatctgggtcc

SEQ ID NO: 4969899 - DNA, 13 bp, Homo sapiens
ccccatgcagtct

SEQ ID NO: 4969900 - DNA, 13 bp, Homo sapiens
ccccatgccaaag

SEQ ID NO: 4969901 - DNA, 22 bp, Homo sapiens
ccccatgccaaagctagggtgg

SEQ ID NO: 4969902 - DNA, 20 bp, Homo sapiens
ccccatgcctgtccagcctg

SEQ ID NO: 4969903 - DNA, 18 bp, Homo sapiens
catggtgaaaatgtactg

SEQ ID NO: 4969904 - DNA, 15 bp, Homo sapiens
catggtgtaataaga

SEQ ID NO: 4969905 - DNA, 16 bp, Homo sapiens
catggtgtaataagac

SEQ ID NO: 4969906 - DNA, 22 bp, Homo sapiens
catggtgtaataagacataacg

SEQ ID NO: 4969907 - DNA, 19 bp, Homo sapiens
catggttaaggtaaagtaa

SEQ ID NO: 4969908 - DNA, 18 bp, Homo sapiens
catgtaaagaaatgtctt

SEQ ID NO: 4969909 - DNA, 22 bp, Homo sapiens
catgtaaataccagactgcagg

SEQ ID NO: 4969910 - DNA, 17 bp, Homo sapiens
catgtaaccggcatgtt

SEQ ID NO: 4969911 - DNA, 22 bp, Homo sapiens
catgtaaccggcatgtttccag

SEQ ID NO: 4969912 - DNA, 16 bp, Homo sapiens
catgtaactatagact

SEQ ID NO: 4969913 - DNA, 19 bp, Homo sapiens
catgtaccatttgcatggc

SEQ ID NO: 4969914 - DNA, 18 bp, Homo sapiens
catgtacctcccctgcct

SEQ ID NO: 4969915 - DNA, 13 bp, Homo sapiens
catgtacttgttt

SEQ ID NO: 4969916 - DNA, 21 bp, Homo sapiens
catgtacttgtttgcaagcag

SEQ ID NO: 4969917 - DNA, 12 bp, Homo sapiens
catgtagagaaa

SEQ ID NO: 4969918 - DNA, 19 bp, Homo sapiens
catgtagagaaaagcacac

SEQ ID NO: 4969919 - DNA, 18 bp, Homo sapiens
catgtagccccctggcct

SEQ ID NO: 4969920 - DNA, 16 bp, Homo sapiens
catgtataaatgtgat

SEQ ID NO: 4969921 - DNA, 15 bp, Homo sapiens
catgtatcatctgga

SEQ ID NO: 4969922 - DNA, 13 bp, Homo sapiens
catgtcaaacatg

SEQ ID NO: 4969923 - DNA, 20 bp, Homo sapiens
catgtcaaacatgagatgtg

SEQ ID NO: 4969924 - DNA, 21 bp, Homo sapiens
catgtcaggcctgtgtgtgaa

SEQ ID NO: 4969925 - DNA, 16 bp, Homo sapiens
catgtccaaagaggct

SEQ ID NO: 4969926 - DNA, 18 bp, Homo sapiens
catgtccaaagaggctgc

SEQ ID NO: 4969927 - DNA, 20 bp, Homo sapiens
catgtccaaagaggctgccc

SEQ ID NO: 4969928 - DNA, 16 bp, Homo sapiens
catgtcctatgtgtga

SEQ ID NO: 4969929 - DNA, 19 bp, Homo sapiens
catgtcctttgcgcctgtg

SEQ ID NO: 4969930 - DNA, 15 bp, Homo sapiens
catgtcgcctctgca

SEQ ID NO: 4969931 - DNA, 18 bp, Homo sapiens
catgtcgcctctgcattc

SEQ ID NO: 4969932 - DNA, 20 bp, Homo sapiens
catgtcgcctctgcattcag

SEQ ID NO: 4969933 - DNA, 22 bp, Homo sapiens
catgtctataatcccagcactt

SEQ ID NO: 4969934 - DNA, 13 bp, Homo sapiens
catgtcttgtaca

SEQ ID NO: 4969935 - DNA, 17 bp, Homo sapiens
catgtcttgtacatgtg

SEQ ID NO: 4969936 - DNA, 20 bp, Homo sapiens
catgtctttctccaaagtta

SEQ ID NO: 4969937 - DNA, 17 bp, Homo sapiens
cagtgcccacaggatca

SEQ ID NO: 4969938 - DNA, 22 bp, Homo sapiens
cagtgcccacaggatcagtctg

SEQ ID NO: 4969939 - DNA, 19 bp, Homo sapiens
cagtgctagtgagctgggc

SEQ ID NO: 4969940 - DNA, 18 bp, Homo sapiens
cagtggaaattcaggtga

SEQ ID NO: 4969941 - DNA, 14 bp, Homo sapiens
cagtggagaattat

SEQ ID NO: 4969942 - DNA, 12 bp, Homo sapiens
cagtggcagctg

SEQ ID NO: 4969943 - DNA, 15 bp, Homo sapiens
cagtggcagctgctt

SEQ ID NO: 4969944 - DNA, 13 bp, Homo sapiens
cagtggccactca

SEQ ID NO: 4969945 - DNA, 16 bp, Homo sapiens
cagtgggagctgcctg

SEQ ID NO: 4969946 - DNA, 17 bp, Homo sapiens
cagtgggagctgcctgt

SEQ ID NO: 4969947 - DNA, 20 bp, Homo sapiens
cagtgggagctgcctgttca

SEQ ID NO: 4969948 - DNA, 16 bp, Homo sapiens
cagtggggcctgtgga

SEQ ID NO: 4969949 - DNA, 17 bp, Homo sapiens
cagtggggcctgtggaa

SEQ ID NO: 4969950 - DNA, 21 bp, Homo sapiens
cagtggtatgatcacggctca

SEQ ID NO: 4969951 - DNA, 19 bp, Homo sapiens
cagtgtaatcccccaggag

SEQ ID NO: 4969952 - DNA, 16 bp, Homo sapiens
cagtgtagttaattta

SEQ ID NO: 4969953 - DNA, 15 bp, Homo sapiens
cagtgtcccctccac

SEQ ID NO: 4969954 - DNA, 19 bp, Homo sapiens
cagtgtcccctccactgtc

SEQ ID NO: 4969955 - DNA, 23 bp, Homo sapiens
cagtgtgaagtacaataattcat

SEQ ID NO: 4969956 - DNA, 14 bp, Homo sapiens
cagtgtgtctaaat

SEQ ID NO: 4969957 - DNA, 17 bp, Homo sapiens
cagtgttaaatgaaatt

SEQ ID NO: 4969958 - DNA, 16 bp, Homo sapiens
cagtgttcgcttggct

SEQ ID NO: 4969959 - DNA, 18 bp, Homo sapiens
cagtgttgagccttttcc

SEQ ID NO: 4969960 - DNA, 20 bp, Homo sapiens
cagttaaggaccgtggccct

SEQ ID NO: 4969961 - DNA, 14 bp, Homo sapiens
cagttattttgata

SEQ ID NO: 4969962 - DNA, 19 bp, Homo sapiens
cagttcaatctcccgctgc

SEQ ID NO: 4969963 - DNA, 23 bp, Homo sapiens
cagttcaatctcccgctgctgct

SEQ ID NO: 4969964 - DNA, 16 bp, Homo sapiens
cagttcacaccctgca

SEQ ID NO: 4969965 - DNA, 17 bp, Homo sapiens
cagttcacaccctgcaa

SEQ ID NO: 4969966 - DNA, 17 bp, Homo sapiens
cagttcagcaccaccct

SEQ ID NO: 4969967 - DNA, 17 bp, Homo sapiens
cagttcaggagtcccaa

SEQ ID NO: 4969968 - DNA, 18 bp, Homo sapiens
cagttcatgtttgcttca

SEQ ID NO: 4969969 - DNA, 14 bp, Homo sapiens
cagttcccttggcc

SEQ ID NO: 4969970 - DNA, 15 bp, Homo sapiens
cagttcccttggcct

SEQ ID NO: 4969971 - DNA, 15 bp, Homo sapiens
cagttcctttgtgtg

SEQ ID NO: 4969972 - DNA, 22 bp, Homo sapiens
cagttcctttgtgtgtactcac

SEQ ID NO: 4969973 - DNA, 21 bp, Homo sapiens
cagttctgttatatcccctgc

SEQ ID NO: 4969974 - DNA, 12 bp, Homo sapiens
cagttgccacca

SEQ ID NO: 4969975 - DNA, 16 bp, Homo sapiens
cagttgccaccacctc

SEQ ID NO: 4969976 - DNA, 22 bp, Homo sapiens
cagttgccaccacctctgtggc

SEQ ID NO: 4969977 - DNA, 19 bp, Homo sapiens
cagttgggtggatgcctgg

SEQ ID NO: 4969978 - DNA, 19 bp, Homo sapiens
cagtttagatttcaagaaa

SEQ ID NO: 4969979 - DNA, 17 bp, Homo sapiens
cagtttatcatgaagcc

SEQ ID NO: 4969980 - DNA, 19 bp, Homo sapiens
cagtttatcatgaagcctg

SEQ ID NO: 4969981 - DNA, 22 bp, Homo sapiens
cagtttcttctgcgcctcaggc

SEQ ID NO: 4969982 - DNA, 21 bp, Homo sapiens
cagtttgatcacactatttta

SEQ ID NO: 4969983 - DNA, 22 bp, Homo sapiens
cagtttggagagtcagatcttt

SEQ ID NO: 4969984 - DNA, 16 bp, Homo sapiens
cagtttggtatttgcg

SEQ ID NO: 4969985 - DNA, 16 bp, Homo sapiens
cagtttgtaaatgtta

SEQ ID NO: 4969986 - DNA, 22 bp, Homo sapiens
cagtttgtaaatgttatttctg

SEQ ID NO: 4969987 - DNA, 16 bp, Homo sapiens
cagtttgtgtgtctta

SEQ ID NO: 4969988 - DNA, 23 bp, Homo sapiens
cagtttgtgtgtcttaattatta

SEQ ID NO: 4969989 - DNA, 21 bp, Homo sapiens
cagttttatgctcttttttac

SEQ ID NO: 4969990 - DNA, 21 bp, Homo sapiens
cataaaaaggacatcagcaaa

SEQ ID NO: 4969991 - DNA, 22 bp, Homo sapiens
cataaaatcaaaacaagtgaaa

SEQ ID NO: 4969992 - DNA, 18 bp, Homo sapiens
cataaagcataagtatac

SEQ ID NO: 4969993 - DNA, 22 bp, Homo sapiens
cataaagccatgtttcctcttt

SEQ ID NO: 4969994 - DNA, 22 bp, Homo sapiens
cataaagttagaatctattttc

SEQ ID NO: 4969995 - DNA, 13 bp, Homo sapiens
cataaatgaagca

SEQ ID NO: 4969996 - DNA, 18 bp, Homo sapiens
cataacccacttgtcact

SEQ ID NO: 4969997 - DNA, 13 bp, Homo sapiens
cataactaaattt

SEQ ID NO: 4969998 - DNA, 17 bp, Homo sapiens
cataactaaatttgata

SEQ ID NO: 4969999 - DNA, 19 bp, Homo sapiens
cataactaaatttgatact

SEQ ID NO: 4970000 - DNA, 19 bp, Homo sapiens
cataactgccttgaacctg

SEQ ID NO: 4970001 - DNA, 23 bp, Homo sapiens
cataactgccttgaacctgtgag

SEQ ID NO: 4970002 - DNA, 16 bp, Homo sapiens
cataacttattgctga

SEQ ID NO: 4970003 - DNA, 19 bp, Homo sapiens
cataaggcttcaaaatgtt

SEQ ID NO: 4970004 - DNA, 16 bp, Homo sapiens
cataagtaattcaaga

SEQ ID NO: 4970005 - DNA, 23 bp, Homo sapiens
cataataaaaaattatgacaatg

SEQ ID NO: 4970006 - DNA, 22 bp, Homo sapiens
cataatgaaaatattttttaca

SEQ ID NO: 4970007 - DNA, 21 bp, Homo sapiens
cataatgctaatttaaagaga

SEQ ID NO: 4970008 - DNA, 16 bp, Homo sapiens
cataatgctactgtct

SEQ ID NO: 4970009 - DNA, 11 bp, Homo sapiens
cataattccta

SEQ ID NO: 4970010 - DNA, 17 bp, Homo sapiens
catacacgaaagagaga

SEQ ID NO: 4970011 - DNA, 18 bp, Homo sapiens
catacacttgtataaatg

SEQ ID NO: 4970012 - DNA, 19 bp, Homo sapiens
catacacttgtataaatgt

SEQ ID NO: 4970013 - DNA, 20 bp, Homo sapiens
catacacttgtataaatgta

SEQ ID NO: 4970014 - DNA, 21 bp, Homo sapiens
catacacttgtataaatgtat

SEQ ID NO: 4970015 - DNA, 22 bp, Homo sapiens
cataccagctcgcacccccctg

SEQ ID NO: 4970016 - DNA, 17 bp, Homo sapiens
catacctaagtactgta

SEQ ID NO: 4970017 - DNA, 18 bp, Homo sapiens
catacctaagtactgtaa

SEQ ID NO: 4970018 - DNA, 19 bp, Homo sapiens
catacggtcaggtttaaca

SEQ ID NO: 4970019 - DNA, 23 bp, Homo sapiens
catacggtcaggtttaacatttg

SEQ ID NO: 4970020 - DNA, 23 bp, Homo sapiens
catactacattgagtagacacat

SEQ ID NO: 4970021 - DNA, 18 bp, Homo sapiens
catactactgaaacagat

SEQ ID NO: 4970022 - DNA, 15 bp, Homo sapiens
catactcagcctgct

SEQ ID NO: 4970023 - DNA, 21 bp, Homo sapiens
catactcagcctgctgcccag

SEQ ID NO: 4970024 - DNA, 19 bp, Homo sapiens
catactgagggaccaactg

SEQ ID NO: 4970025 - DNA, 20 bp, Homo sapiens
catactgagggaccaactgg

SEQ ID NO: 4970026 - DNA, 15 bp, Homo sapiens
catactggactcttc

SEQ ID NO: 4970027 - DNA, 18 bp, Homo sapiens
catactggcctggactgt

SEQ ID NO: 4970028 - DNA, 22 bp, Homo sapiens
catactggcctggactgttttc

SEQ ID NO: 4970029 - DNA, 18 bp, Homo sapiens
catacttatctctctgtg

SEQ ID NO: 4970030 - DNA, 22 bp, Homo sapiens
catactttcatcctgactctgc

SEQ ID NO: 4970031 - DNA, 16 bp, Homo sapiens
catactttgtctgaaa

SEQ ID NO: 4970032 - DNA, 19 bp, Homo sapiens
catagaaacatgacactga

SEQ ID NO: 4970033 - DNA, 23 bp, Homo sapiens
catagaaatgtaacttttgtaag

SEQ ID NO: 4970034 - DNA, 16 bp, Homo sapiens
catagatgttttggta

SEQ ID NO: 4970035 - DNA, 16 bp, Homo sapiens
catagcaacaggaaaa

SEQ ID NO: 4970036 - DNA, 14 bp, Homo sapiens
catagcaagacaca

SEQ ID NO: 4970037 - DNA, 19 bp, Homo sapiens
catagcagagaatgaaagg

SEQ ID NO: 4970038 - DNA, 13 bp, Homo sapiens
catagcccatccc

SEQ ID NO: 4970039 - DNA, 23 bp, Homo sapiens
catagcccatccctgcctggtca

SEQ ID NO: 4970040 - DNA, 21 bp, Homo sapiens
catagctacccaaaagagaaa

SEQ ID NO: 4970041 - DNA, 13 bp, Homo sapiens
catagtaaaagaa

SEQ ID NO: 4970042 - DNA, 24 bp, Homo sapiens
catagtaacttcttatggaattga

SEQ ID NO: 4970043 - DNA, 20 bp, Homo sapiens
catagtaagttcagcacttg

SEQ ID NO: 4970044 - DNA, 13 bp, Homo sapiens
catagtagttttt

SEQ ID NO: 4970045 - DNA, 17 bp, Homo sapiens
catagtatggtggctgg

SEQ ID NO: 4970046 - DNA, 18 bp, Homo sapiens
catagtatggtggctggg

SEQ ID NO: 4970047 - DNA, 13 bp, Homo sapiens
catagtcacatgg

SEQ ID NO: 4970048 - DNA, 22 bp, Homo sapiens
catagtgatggttcccctgttc

SEQ ID NO: 4970049 - DNA, 20 bp, Homo sapiens
catataagtttgaaggaaac

SEQ ID NO: 4970050 - DNA, 20 bp, Homo sapiens
catatacctataatgtgtgt

SEQ ID NO: 4970051 - DNA, 21 bp, Homo sapiens
catatacctataatgtgtgta

SEQ ID NO: 4970052 - DNA, 22 bp, Homo sapiens
catatatatgttttaagaggca

SEQ ID NO: 4970053 - DNA, 22 bp, Homo sapiens
catatatttttaaaaaatgaaa

SEQ ID NO: 4970054 - DNA, 23 bp, Homo sapiens
catatcaaaaagtattaaaacta

SEQ ID NO: 4970055 - DNA, 18 bp, Homo sapiens
catatcgctgacttcatg

SEQ ID NO: 4970056 - DNA, 18 bp, Homo sapiens
catatcttaaagaaacag

SEQ ID NO: 4970057 - DNA, 23 bp, Homo sapiens
catatcttgcgaatccaagctcc

SEQ ID NO: 4970058 - DNA, 21 bp, Homo sapiens
catatgatttcactagaaaag

SEQ ID NO: 4970059 - DNA, 17 bp, Homo sapiens
catatgcaccttgtgtc

SEQ ID NO: 4970060 - DNA, 18 bp, Homo sapiens
catatgcaccttgtgtct

SEQ ID NO: 4970061 - DNA, 20 bp, Homo sapiens
catatgcaccttgtgtctgt

SEQ ID NO: 4970062 - DNA, 21 bp, Homo sapiens
catatgcaccttgtgtctgta

SEQ ID NO: 4970063 - DNA, 17 bp, Homo sapiens
catatggactctgcaca

SEQ ID NO: 4970064 - DNA, 17 bp, Homo sapiens
catatgggttagatgtt

SEQ ID NO: 4970065 - DNA, 16 bp, Homo sapiens
catatgttgaatactt

SEQ ID NO: 4970066 - DNA, 19 bp, Homo sapiens
catatgttgaatacttttt

SEQ ID NO: 4970067 - DNA, 17 bp, Homo sapiens
catattccatatttatt

SEQ ID NO: 4970068 - DNA, 16 bp, Homo sapiens
catattctgttggaag

SEQ ID NO: 4970069 - DNA, 17 bp, Homo sapiens
catattctgttggccag

SEQ ID NO: 4970070 - DNA, 18 bp, Homo sapiens
catattctgttggccagt

SEQ ID NO: 4970071 - DNA, 16 bp, Homo sapiens
catattgatgaaaaga

SEQ ID NO: 4970072 - DNA, 17 bp, Homo sapiens
catattggcatggattt

SEQ ID NO: 4970073 - DNA, 16 bp, Homo sapiens
catattggtattcact

SEQ ID NO: 4970074 - DNA, 22 bp, Homo sapiens
catattgtgccaatatgtattg

SEQ ID NO: 4970075 - DNA, 14 bp, Homo sapiens
catatttaaagaca

SEQ ID NO: 4970076 - DNA, 17 bp, Homo sapiens
catatttactaccttat

SEQ ID NO: 4970077 - DNA, 13 bp, Homo sapiens
catatttggaaga

SEQ ID NO: 4970078 - DNA, 16 bp, Homo sapiens
catcaacaagatttcc

SEQ ID NO: 4970079 - DNA, 11 bp, Homo sapiens
catcaattccc

SEQ ID NO: 4970080 - DNA, 11 bp, Homo sapiens
catcacacaca

SEQ ID NO: 4970081 - DNA, 13 bp, Homo sapiens
catcacagcagcc

SEQ ID NO: 4970082 - DNA, 16 bp, Homo sapiens
catcacagcagcctcc

SEQ ID NO: 4970083 - DNA, 19 bp, Homo sapiens
catcacagcagcctccaac

SEQ ID NO: 4970084 - DNA, 22 bp, Homo sapiens
catcacagggttgggcccagat

SEQ ID NO: 4970085 - DNA, 22 bp, Homo sapiens
catcaccgacgcgtctcctgtt

SEQ ID NO: 4970086 - DNA, 14 bp, Homo sapiens
catcacctgcctgt

SEQ ID NO: 4970087 - DNA, 16 bp, Homo sapiens
catcactatccatgca

SEQ ID NO: 4970088 - DNA, 21 bp, Homo sapiens
catcactatccatgcaccaaa

SEQ ID NO: 4970089 - DNA, 20 bp, Homo sapiens
catcactgcttgatgaagca

SEQ ID NO: 4970090 - DNA, 15 bp, Homo sapiens
catcacttgtacaaa

SEQ ID NO: 4970091 - DNA, 15 bp, Homo sapiens
catcacttttcagtg

SEQ ID NO: 4970092 - DNA, 23 bp, Homo sapiens
catcagataagacatatctctaa

SEQ ID NO: 4970093 - DNA, 19 bp, Homo sapiens
catcaggaaggaaatgaca

SEQ ID NO: 4970094 - DNA, 23 bp, Homo sapiens
catcagggcctggggcctgagag

SEQ ID NO: 4970095 - DNA, 14 bp, Homo sapiens
catcagggggaaga

SEQ ID NO: 4970096 - DNA, 21 bp, Homo sapiens
catcagggggaagaagcagag

SEQ ID NO: 4970097 - DNA, 20 bp, Homo sapiens
catcagtattaatactaaaa

SEQ ID NO: 4970098 - DNA, 17 bp, Homo sapiens
catcagtccctatgtat

SEQ ID NO: 4970099 - DNA, 15 bp, Homo sapiens
catcagttattcatt

SEQ ID NO: 4970100 - DNA, 13 bp, Homo sapiens
catcatcagggcc

SEQ ID NO: 4970101 - DNA, 16 bp, Homo sapiens
catcatcagggcctgg

SEQ ID NO: 4970102 - DNA, 14 bp, Homo sapiens
catcatgtctggct

SEQ ID NO: 4970103 - DNA, 13 bp, Homo sapiens
catcattagaaca

SEQ ID NO: 4970104 - DNA, 14 bp, Homo sapiens
catccaaccttccc

SEQ ID NO: 4970105 - DNA, 17 bp, Homo sapiens
catccaactccagcaac

SEQ ID NO: 4970106 - DNA, 15 bp, Homo sapiens
catccaactccagga

SEQ ID NO: 4970107 - DNA, 12 bp, Homo sapiens
catccaccccag

SEQ ID NO: 4970108 - DNA, 14 bp, Homo sapiens
catccaccccatcc

SEQ ID NO: 4970109 - DNA, 18 bp, Homo sapiens
catccactctaccctccc

SEQ ID NO: 4970110 - DNA, 18 bp, Homo sapiens
catccacttacatatatt

SEQ ID NO: 4970111 - DNA, 16 bp, Homo sapiens
catccagacatcatga

SEQ ID NO: 4970112 - DNA, 19 bp, Homo sapiens
catccagtgacaaaccatc

SEQ ID NO: 4970113 - DNA, 16 bp, Homo sapiens
catccatagtagtatg

SEQ ID NO: 4970114 - DNA, 16 bp, Homo sapiens
catccatgtcctatgt

SEQ ID NO: 4970115 - DNA, 19 bp, Homo sapiens
catccatgtttgtaaaact

SEQ ID NO: 4970116 - DNA, 12 bp, Homo sapiens
catccattccca

SEQ ID NO: 4970117 - DNA, 14 bp, Homo sapiens
catccattcccaag

SEQ ID NO: 4970118 - DNA, 20 bp, Homo sapiens
catcccaaccagtgccaagg

SEQ ID NO: 4970119 - DNA, 15 bp, Homo sapiens
catcccagcacctgc

SEQ ID NO: 4970120 - DNA, 20 bp, Homo sapiens
catcccaggatgctgggtgg

SEQ ID NO: 4970121 - DNA, 15 bp, Homo sapiens
catcccatgtattta

SEQ ID NO: 4970122 - DNA, 11 bp, Homo sapiens
catccccaggg

SEQ ID NO: 4970123 - DNA, 19 bp, Homo sapiens
catcccctggactgggagg

SEQ ID NO: 4970124 - DNA, 15 bp, Homo sapiens
catcccggaggaaat

SEQ ID NO: 4970125 - DNA, 16 bp, Homo sapiens
catcccggaggaaatc

SEQ ID NO: 4970126 - DNA, 19 bp, Homo sapiens
catcccggaggaaatctgc

SEQ ID NO: 4970127 - DNA, 13 bp, Homo sapiens
catccctccccag

SEQ ID NO: 4970128 - DNA, 18 bp, Homo sapiens
catccctgaggagccagg

SEQ ID NO: 4970129 - DNA, 16 bp, Homo sapiens
catccctgcctggtca

SEQ ID NO: 4970130 - DNA, 13 bp, Homo sapiens
catccctttccag

SEQ ID NO: 4970131 - DNA, 14 bp, Homo sapiens
catcctaagaaata

SEQ ID NO: 4970132 - DNA, 16 bp, Homo sapiens
catcctaagaaatatg

SEQ ID NO: 4970133 - DNA, 20 bp, Homo sapiens
catcctccgtccagccgcca

SEQ ID NO: 4970134 - DNA, 13 bp, Homo sapiens
catcctctttctc

SEQ ID NO: 4970135 - DNA, 13 bp, Homo sapiens
catcctgagcccc

SEQ ID NO: 4970136 - DNA, 15 bp, Homo sapiens
catcctgccagcccc

SEQ ID NO: 4970137 - DNA, 19 bp, Homo sapiens
catcctgccagccccacac

SEQ ID NO: 4970138 - DNA, 22 bp, Homo sapiens
catcctgccttcatggaactca

SEQ ID NO: 4970139 - DNA, 22 bp, Homo sapiens
catcctgctgcccttaggccac

SEQ ID NO: 4970140 - DNA, 11 bp, Homo sapiens
catcctggctg

SEQ ID NO: 4970141 - DNA, 15 bp, Homo sapiens
catcctgtataagca

SEQ ID NO: 4970142 - DNA, 19 bp, Homo sapiens
catcctgtataagcactga

SEQ ID NO: 4970143 - DNA, 21 bp, Homo sapiens
catccttcaagaactctgggc

SEQ ID NO: 4970144 - DNA, 22 bp, Homo sapiens
catccttcaagaactctgggct

SEQ ID NO: 4970145 - DNA, 23 bp, Homo sapiens
catccttcaagaactctgggctg

SEQ ID NO: 4970146 - DNA, 15 bp, Homo sapiens
catcctttacgtgtt

SEQ ID NO: 4970147 - DNA, 18 bp, Homo sapiens
catcctttgcagggcagc

SEQ ID NO: 4970148 - DNA, 21 bp, Homo sapiens
catcgaatctactaattccac

SEQ ID NO: 4970149 - DNA, 16 bp, Homo sapiens
catcgctcgtgtgttc

SEQ ID NO: 4970150 - DNA, 23 bp, Homo sapiens
catctaatagcgggttactttca

SEQ ID NO: 4970151 - DNA, 11 bp, Homo sapiens
catctattttg

SEQ ID NO: 4970152 - DNA, 17 bp, Homo sapiens
catctattttgatgcag

SEQ ID NO: 4970153 - DNA, 22 bp, Homo sapiens
catctattttgatgcagcattt

SEQ ID NO: 4970154 - DNA, 14 bp, Homo sapiens
catctcaaaattat

SEQ ID NO: 4970155 - DNA, 13 bp, Homo sapiens
catctcagcccac

SEQ ID NO: 4970156 - DNA, 18 bp, Homo sapiens
catctcaggagatttcat

SEQ ID NO: 4970157 - DNA, 15 bp, Homo sapiens
catctcaggggccag

SEQ ID NO: 4970158 - DNA, 16 bp, Homo sapiens
catctcaggggccaga

SEQ ID NO: 4970159 - DNA, 17 bp, Homo sapiens
catctcattccaacttc

SEQ ID NO: 4970160 - DNA, 15 bp, Homo sapiens
catctcccaccctgt

SEQ ID NO: 4970161 - DNA, 21 bp, Homo sapiens
catctcccaccctgtacctca

SEQ ID NO: 4970162 - DNA, 18 bp, Homo sapiens
catctcctataatctgtc

SEQ ID NO: 4970163 - DNA, 19 bp, Homo sapiens
catctcctataatctgtca

SEQ ID NO: 4970164 - DNA, 14 bp, Homo sapiens
catctcggagcatc

SEQ ID NO: 4970165 - DNA, 12 bp, Homo sapiens
catctctcccca

SEQ ID NO: 4970166 - DNA, 15 bp, Homo sapiens
catctctccctcccc

SEQ ID NO: 4970167 - DNA, 14 bp, Homo sapiens
catctgatatctat

SEQ ID NO: 4970168 - DNA, 21 bp, Homo sapiens
catctgcacccttcttttctc

SEQ ID NO: 4970169 - DNA, 15 bp, Homo sapiens
catctgcccctcccc

SEQ ID NO: 4970170 - DNA, 19 bp, Homo sapiens
catctgcccctcccccaac

SEQ ID NO: 4970171 - DNA, 16 bp, Homo sapiens
catctggaatctggag

SEQ ID NO: 4970172 - DNA, 18 bp, Homo sapiens
catctggcctggcctggc

SEQ ID NO: 4970173 - DNA, 23 bp, Homo sapiens
catctggcttattttaatgtgat

SEQ ID NO: 4970174 - DNA, 15 bp, Homo sapiens
catctgggtccttgc

SEQ ID NO: 4970175 - DNA, 19 bp, Homo sapiens
catcttatagcactttgaa

SEQ ID NO: 4970176 - DNA, 20 bp, Homo sapiens
catcttatgctaactgtaga

SEQ ID NO: 4970177 - DNA, 13 bp, Homo sapiens
catcttcccgaga

SEQ ID NO: 4970178 - DNA, 13 bp, Homo sapiens
catcttctgcctt

SEQ ID NO: 4970179 - DNA, 20 bp, Homo sapiens
catcttgaagggcccaggag

SEQ ID NO: 4970180 - DNA, 19 bp, Homo sapiens
catcttgctctgctgacag

SEQ ID NO: 4970181 - DNA, 20 bp, Homo sapiens
catcttgctctgctgacaga

SEQ ID NO: 4970182 - DNA, 12 bp, Homo sapiens
catcttgtgaaa

SEQ ID NO: 4970183 - DNA, 18 bp, Homo sapiens
catcttttttgttaactg

SEQ ID NO: 4970184 - DNA, 11 bp, Homo sapiens
catgaaaattt

SEQ ID NO: 4970185 - DNA, 13 bp, Homo sapiens
catgaaaatttta

SEQ ID NO: 4970186 - DNA, 15 bp, Homo sapiens
catgaaacagaaaca

SEQ ID NO: 4970187 - DNA, 14 bp, Homo sapiens
catgaaatatgcat

SEQ ID NO: 4970188 - DNA, 15 bp, Homo sapiens
catgaaatatgcatc

SEQ ID NO: 4970189 - DNA, 23 bp, Homo sapiens
catgaacagaaaacattctgatt

SEQ ID NO: 4970190 - DNA, 18 bp, Homo sapiens
catgaagagaagcaattt

SEQ ID NO: 4970191 - DNA, 14 bp, Homo sapiens
catgaagagcaaaa

SEQ ID NO: 4970192 - DNA, 17 bp, Homo sapiens
catgaagagcaaaaata

SEQ ID NO: 4970193 - DNA, 19 bp, Homo sapiens
catgaagagcaaaaatatc

SEQ ID NO: 4970194 - DNA, 22 bp, Homo sapiens
catgaagcccaagtgaaatcaa

SEQ ID NO: 4970195 - DNA, 12 bp, Homo sapiens
catgaagcctgt

SEQ ID NO: 4970196 - DNA, 13 bp, Homo sapiens
catgaagcctttt

SEQ ID NO: 4970197 - DNA, 21 bp, Homo sapiens
catgaatcccacccacatgtg

SEQ ID NO: 4970198 - DNA, 22 bp, Homo sapiens
catgaatggtatggaactctct

SEQ ID NO: 4970199 - DNA, 15 bp, Homo sapiens
catgacataacagtg

SEQ ID NO: 4970200 - DNA, 18 bp, Homo sapiens
catgacataacagtgcag

SEQ ID NO: 4970201 - DNA, 18 bp, Homo sapiens
catgacatatgacttgat

SEQ ID NO: 4970202 - DNA, 18 bp, Homo sapiens
catgaccatactgaggga

SEQ ID NO: 4970203 - DNA, 16 bp, Homo sapiens
catgagaacaaacaga

SEQ ID NO: 4970204 - DNA, 20 bp, Homo sapiens
catgagaataagagaaagaa

SEQ ID NO: 4970205 - DNA, 15 bp, Homo sapiens
catgagcctcagcat

SEQ ID NO: 4970206 - DNA, 18 bp, Homo sapiens
catgagcctcagcatcct

SEQ ID NO: 4970207 - DNA, 22 bp, Homo sapiens
catgagcctcagcatcctggca

SEQ ID NO: 4970208 - DNA, 17 bp, Homo sapiens
catgagtccttgaaaat

SEQ ID NO: 4970209 - DNA, 18 bp, Homo sapiens
catgagtccttgaaaata

SEQ ID NO: 4970210 - DNA, 19 bp, Homo sapiens
catgagtccttgaaaatat

SEQ ID NO: 4970211 - DNA, 20 bp, Homo sapiens
catgagtccttgaaaatatt

SEQ ID NO: 4970212 - DNA, 16 bp, Homo sapiens
catgagtttgccctgg

SEQ ID NO: 4970213 - DNA, 23 bp, Homo sapiens
catgatgcagtctcctctttaaa

SEQ ID NO: 4970214 - DNA, 17 bp, Homo sapiens
catgatgtttcttccac

SEQ ID NO: 4970215 - DNA, 16 bp, Homo sapiens
catgattcatgccaat

SEQ ID NO: 4970216 - DNA, 14 bp, Homo sapiens
catgattctattta

SEQ ID NO: 4970217 - DNA, 17 bp, Homo sapiens
catgatttccttgaatg

SEQ ID NO: 4970218 - DNA, 19 bp, Homo sapiens
catgcactgacccttccag

SEQ ID NO: 4970219 - DNA, 22 bp, Homo sapiens
catgcactgacccttccagaca

SEQ ID NO: 4970220 - DNA, 16 bp, Homo sapiens
catgcagcccatgccc

SEQ ID NO: 4970221 - DNA, 20 bp, Homo sapiens
catgcagcccatgcccacct

SEQ ID NO: 4970222 - DNA, 23 bp, Homo sapiens
catgcagcccatgcccacctgcc

SEQ ID NO: 4970223 - DNA, 20 bp, Homo sapiens
catgcagctcaactttctgt

SEQ ID NO: 4970224 - DNA, 19 bp, Homo sapiens
catgcagggggctcctggg

SEQ ID NO: 4970225 - DNA, 19 bp, Homo sapiens
catgcataaatatgcagtg

SEQ ID NO: 4970226 - DNA, 14 bp, Homo sapiens
catgcattcataca

SEQ ID NO: 4970227 - DNA, 21 bp, Homo sapiens
catgcccacctgcccatcaca

SEQ ID NO: 4970228 - DNA, 17 bp, Homo sapiens
catgccccggccacctc

SEQ ID NO: 4970229 - DNA, 20 bp, Homo sapiens
catgcccggtcccacccctc

SEQ ID NO: 4970230 - DNA, 20 bp, Homo sapiens
catgcctgccccaaacaaat

SEQ ID NO: 4970231 - DNA, 16 bp, Homo sapiens
catgcctgtccagcct

SEQ ID NO: 4970232 - DNA, 16 bp, Homo sapiens
catgctatctctgtgt

SEQ ID NO: 4970233 - DNA, 14 bp, Homo sapiens
catgctcctcactg

SEQ ID NO: 4970234 - DNA, 15 bp, Homo sapiens
catgctcctcactgc

SEQ ID NO: 4970235 - DNA, 22 bp, Homo sapiens
catgctctgagaagaggagccc

SEQ ID NO: 4970236 - DNA, 17 bp, Homo sapiens
catgctggccagcctgg

SEQ ID NO: 4970237 - DNA, 23 bp, Homo sapiens
catgctgggaagacgcctgagct

SEQ ID NO: 4970238 - DNA, 22 bp, Homo sapiens
catgcttctcatcttgtgaaat

SEQ ID NO: 4970239 - DNA, 19 bp, Homo sapiens
catgcttgtgaaaatgtgt

SEQ ID NO: 4970240 - DNA, 15 bp, Homo sapiens
catgctttaaagtgt

SEQ ID NO: 4970241 - DNA, 18 bp, Homo sapiens
catgctttaaagtgtaat

SEQ ID NO: 4970242 - DNA, 23 bp, Homo sapiens
catgctttaaagtgtaataatat

SEQ ID NO: 4970243 - DNA, 16 bp, Homo sapiens
catggaccactgtttc

SEQ ID NO: 4970244 - DNA, 14 bp, Homo sapiens
catggagccagctc

SEQ ID NO: 4970245 - DNA, 17 bp, Homo sapiens
catggaggccctcctgt

SEQ ID NO: 4970246 - DNA, 16 bp, Homo sapiens
catggaggttctaagg

SEQ ID NO: 4970247 - DNA, 22 bp, Homo sapiens
catggagtagaggtactagaat

SEQ ID NO: 4970248 - DNA, 18 bp, Homo sapiens
catggcagagtttgtgtg

SEQ ID NO: 4970249 - DNA, 13 bp, Homo sapiens
catggccaggtgg

SEQ ID NO: 4970250 - DNA, 12 bp, Homo sapiens
catggcccctct

SEQ ID NO: 4970251 - DNA, 17 bp, Homo sapiens
catggcccctctgacct

SEQ ID NO: 4970252 - DNA, 14 bp, Homo sapiens
catggctaactggc

SEQ ID NO: 4970253 - DNA, 22 bp, Homo sapiens
catggctttcagaaaacgggaa

SEQ ID NO: 4970254 - DNA, 13 bp, Homo sapiens
catgggaaaggag

SEQ ID NO: 4970255 - DNA, 15 bp, Homo sapiens
catgggagcagtcca

SEQ ID NO: 4970256 - DNA, 20 bp, Homo sapiens
catgggagcagtccatgcat

SEQ ID NO: 4970257 - DNA, 18 bp, Homo sapiens
catgggatacaacctccc

SEQ ID NO: 4970258 - DNA, 22 bp, Homo sapiens
catgggatacaacctccctctt

SEQ ID NO: 4970259 - DNA, 23 bp, Homo sapiens
catgggcctggccacctctctcc

SEQ ID NO: 4970260 - DNA, 13 bp, Homo sapiens
catgggctctgac

SEQ ID NO: 4970261 - DNA, 16 bp, Homo sapiens
catgggcttcactgta

SEQ ID NO: 4970262 - DNA, 17 bp, Homo sapiens
catgggcttcactgtat

SEQ ID NO: 4970263 - DNA, 15 bp, Homo sapiens
catggggaaaaaaat

SEQ ID NO: 4970264 - DNA, 21 bp, Homo sapiens
catggggtggggtagggctga

SEQ ID NO: 4970265 - DNA, 23 bp, Homo sapiens
catgggttatgtgtatgtgccat

SEQ ID NO: 4970266 - DNA, 20 bp, Homo sapiens
catggtagagaatctctccc

SEQ ID NO: 4970267 - DNA, 21 bp, Homo sapiens
catggtcacacactgatgctt

SEQ ID NO: 4970268 - DNA, 13 bp, Homo sapiens
catggtccctgcc

SEQ ID NO: 4970269 - DNA, 17 bp, Homo sapiens
cagacagcaggcagcgc

SEQ ID NO: 4970270 - DNA, 18 bp, Homo sapiens
cagacaggcaagcacctc

SEQ ID NO: 4970271 - DNA, 21 bp, Homo sapiens
cagacaggcaagcacctcctg

SEQ ID NO: 4970272 - DNA, 13 bp, Homo sapiens
cagacataaagcc

SEQ ID NO: 4970273 - DNA, 14 bp, Homo sapiens
cagacataaagcca

SEQ ID NO: 4970274 - DNA, 15 bp, Homo sapiens
cagacataaagccat

SEQ ID NO: 4970275 - DNA, 23 bp, Homo sapiens
cagacatccatgtttgtaaaact

SEQ ID NO: 4970276 - DNA, 23 bp, Homo sapiens
cagaccaacgttactcagggctc

SEQ ID NO: 4970277 - DNA, 20 bp, Homo sapiens
cagaccacatctttatctgt

SEQ ID NO: 4970278 - DNA, 16 bp, Homo sapiens
cagacccctggctttt

SEQ ID NO: 4970279 - DNA, 14 bp, Homo sapiens
cagacccggctgcg

SEQ ID NO: 4970280 - DNA, 16 bp, Homo sapiens
cagacccggctgcgtg

SEQ ID NO: 4970281 - DNA, 21 bp, Homo sapiens
cagacctccccagcccctagc

SEQ ID NO: 4970282 - DNA, 13 bp, Homo sapiens
cagacctgctttt

SEQ ID NO: 4970283 - DNA, 20 bp, Homo sapiens
cagactactattttcttttt

SEQ ID NO: 4970284 - DNA, 20 bp, Homo sapiens
cagactctacagaggccatg

SEQ ID NO: 4970285 - DNA, 21 bp, Homo sapiens
cagactctacagaggccatgg

SEQ ID NO: 4970286 - DNA, 12 bp, Homo sapiens
cagactgcaggt

SEQ ID NO: 4970287 - DNA, 20 bp, Homo sapiens
cagactgcttccaattttct

SEQ ID NO: 4970288 - DNA, 17 bp, Homo sapiens
cagactggaagcacagc

SEQ ID NO: 4970289 - DNA, 23 bp, Homo sapiens
cagactgttagaaaatggacact

SEQ ID NO: 4970290 - DNA, 24 bp, Homo sapiens
cagactgttagaaaatggacactg

SEQ ID NO: 4970291 - DNA, 15 bp, Homo sapiens
cagacttttgtacat

SEQ ID NO: 4970292 - DNA, 11 bp, Homo sapiens
cagagaacagc

SEQ ID NO: 4970293 - DNA, 21 bp, Homo sapiens
cagagaatgaaagggcccaga

SEQ ID NO: 4970294 - DNA, 14 bp, Homo sapiens
cagagaattcttag

SEQ ID NO: 4970295 - DNA, 13 bp, Homo sapiens
cagagaatttcta

SEQ ID NO: 4970296 - DNA, 20 bp, Homo sapiens
cagagacaaaatatttccca

SEQ ID NO: 4970297 - DNA, 15 bp, Homo sapiens
cagagaccaggctgt

SEQ ID NO: 4970298 - DNA, 16 bp, Homo sapiens
cagagaccaggctgtg

SEQ ID NO: 4970299 - DNA, 20 bp, Homo sapiens
cagagaccgtcctcacccct

SEQ ID NO: 4970300 - DNA, 22 bp, Homo sapiens
cagagagaggggagaagcctgg

SEQ ID NO: 4970301 - DNA, 18 bp, Homo sapiens
cagagagccattttgtga

SEQ ID NO: 4970302 - DNA, 22 bp, Homo sapiens
cagagagcggtctcaggctggt

SEQ ID NO: 4970303 - DNA, 23 bp, Homo sapiens
cagagagggtggtgacctctgcc

SEQ ID NO: 4970304 - DNA, 15 bp, Homo sapiens
cagagagtcctgtgc

SEQ ID NO: 4970305 - DNA, 13 bp, Homo sapiens
cagagagtggctc

SEQ ID NO: 4970306 - DNA, 15 bp, Homo sapiens
cagagagtggctcct

SEQ ID NO: 4970307 - DNA, 19 bp, Homo sapiens
cagagatttatataaatgt

SEQ ID NO: 4970308 - DNA, 16 bp, Homo sapiens
cagagcaaaataattt

SEQ ID NO: 4970309 - DNA, 15 bp, Homo sapiens
cagagcaacctctca

SEQ ID NO: 4970310 - DNA, 20 bp, Homo sapiens
cagagcaagatcctgtcttt

SEQ ID NO: 4970311 - DNA, 18 bp, Homo sapiens
cagagcacagcagcccct

SEQ ID NO: 4970312 - DNA, 22 bp, Homo sapiens
cagagcactaggttcaattccc

SEQ ID NO: 4970313 - DNA, 13 bp, Homo sapiens
cagagcagatgca

SEQ ID NO: 4970314 - DNA, 14 bp, Homo sapiens
cagagcagatgcag

SEQ ID NO: 4970315 - DNA, 20 bp, Homo sapiens
cagagcagatgcagagagcc

SEQ ID NO: 4970316 - DNA, 12 bp, Homo sapiens
cagagcaggacc

SEQ ID NO: 4970317 - DNA, 16 bp, Homo sapiens
cagagcaggacctccc

SEQ ID NO: 4970318 - DNA, 18 bp, Homo sapiens
cagagcaggacctccctt

SEQ ID NO: 4970319 - DNA, 21 bp, Homo sapiens
cagagcatttccaacaccaca

SEQ ID NO: 4970320 - DNA, 17 bp, Homo sapiens
cagagccatgctgggaa

SEQ ID NO: 4970321 - DNA, 18 bp, Homo sapiens
cagagcccccaggaagcc

SEQ ID NO: 4970322 - DNA, 23 bp, Homo sapiens
cagagcctcccaaggagaacaaa

SEQ ID NO: 4970323 - DNA, 14 bp, Homo sapiens
cagagcctgcagtt

SEQ ID NO: 4970324 - DNA, 17 bp, Homo sapiens
cagagcggaggctgtgt

SEQ ID NO: 4970325 - DNA, 21 bp, Homo sapiens
cagagctaagggtgggtgctc

SEQ ID NO: 4970326 - DNA, 13 bp, Homo sapiens
cagagctgggagg

SEQ ID NO: 4970327 - DNA, 14 bp, Homo sapiens
cagagctgggaggc

SEQ ID NO: 4970328 - DNA, 19 bp, Homo sapiens
cacttacatatatttttaa

SEQ ID NO: 4970329 - DNA, 15 bp, Homo sapiens
cacttagctatcaga

SEQ ID NO: 4970330 - DNA, 19 bp, Homo sapiens
cacttatcattagaatctt

SEQ ID NO: 4970331 - DNA, 21 bp, Homo sapiens
cacttcgcgtgccctcgctgc

SEQ ID NO: 4970332 - DNA, 22 bp, Homo sapiens
cacttctgccatattctgttgg

SEQ ID NO: 4970333 - DNA, 21 bp, Homo sapiens
cacttctgtgagacccccaca

SEQ ID NO: 4970334 - DNA, 15 bp, Homo sapiens
cacttcttcctttct

SEQ ID NO: 4970335 - DNA, 17 bp, Homo sapiens
cacttcttcctttctct

SEQ ID NO: 4970336 - DNA, 18 bp, Homo sapiens
cacttcttgttccccact

SEQ ID NO: 4970337 - DNA, 18 bp, Homo sapiens
cacttgaacaaaatctgt

SEQ ID NO: 4970338 - DNA, 22 bp, Homo sapiens
cacttgaacaaaatctgttgcc

SEQ ID NO: 4970339 - DNA, 19 bp, Homo sapiens
cacttgatgacccccaacc

SEQ ID NO: 4970340 - DNA, 14 bp, Homo sapiens
cacttgcagactct

SEQ ID NO: 4970341 - DNA, 19 bp, Homo sapiens
cacttgcagactctacaga

SEQ ID NO: 4970342 - DNA, 13 bp, Homo sapiens
cacttgcctgggt

SEQ ID NO: 4970343 - DNA, 17 bp, Homo sapiens
cacttgtacaaaataaa

SEQ ID NO: 4970344 - DNA, 14 bp, Homo sapiens
cacttgtaggataa

SEQ ID NO: 4970345 - DNA, 16 bp, Homo sapiens
cacttgtatatacgca

SEQ ID NO: 4970346 - DNA, 16 bp, Homo sapiens
cacttgtctcatttta

SEQ ID NO: 4970347 - DNA, 18 bp, Homo sapiens
cacttgtgctttgctctt

SEQ ID NO: 4970348 - DNA, 16 bp, Homo sapiens
cacttgttccagctct

SEQ ID NO: 4970349 - DNA, 14 bp, Homo sapiens
cactttacccacct

SEQ ID NO: 4970350 - DNA, 20 bp, Homo sapiens
cactttacccacctagaaca

SEQ ID NO: 4970351 - DNA, 16 bp, Homo sapiens
cactttctaatgtttc

SEQ ID NO: 4970352 - DNA, 11 bp, Homo sapiens
cactttctctt

SEQ ID NO: 4970353 - DNA, 22 bp, Homo sapiens
cactttctcttcttgtttctcc

SEQ ID NO: 4970354 - DNA, 12 bp, Homo sapiens
cactttgaaata

SEQ ID NO: 4970355 - DNA, 23 bp, Homo sapiens
cactttgatgtcatgtgttccct

SEQ ID NO: 4970356 - DNA, 14 bp, Homo sapiens
cactttgcacagct

SEQ ID NO: 4970357 - DNA, 15 bp, Homo sapiens
cactttgcacatttt

SEQ ID NO: 4970358 - DNA, 19 bp, Homo sapiens
cactttgcacgacgccctc

SEQ ID NO: 4970359 - DNA, 13 bp, Homo sapiens
cacttttcagtga

SEQ ID NO: 4970360 - DNA, 13 bp, Homo sapiens
cactttttgaact

SEQ ID NO: 4970361 - DNA, 19 bp, Homo sapiens
cactttttgaactaagaaa

SEQ ID NO: 4970362 - DNA, 19 bp, Homo sapiens
cagaaaaaatgtctgtaaa

SEQ ID NO: 4970363 - DNA, 16 bp, Homo sapiens
cagaaaacgggaagcg

SEQ ID NO: 4970364 - DNA, 15 bp, Homo sapiens
cagaaaactttaaaa

SEQ ID NO: 4970365 - DNA, 14 bp, Homo sapiens
cagaaaatgttgag

SEQ ID NO: 4970366 - DNA, 23 bp, Homo sapiens
cagaaaatgttgagaatcccaaa

SEQ ID NO: 4970367 - DNA, 18 bp, Homo sapiens
cagaaacaaaaacactaa

SEQ ID NO: 4970368 - DNA, 20 bp, Homo sapiens
cagaaacaaaaacactaaaa

SEQ ID NO: 4970369 - DNA, 15 bp, Homo sapiens
cagaaacactgcctt

SEQ ID NO: 4970370 - DNA, 22 bp, Homo sapiens
cagaaacctatcctcactgccc

SEQ ID NO: 4970371 - DNA, 18 bp, Homo sapiens
cagaaagctgtgaacagg

SEQ ID NO: 4970372 - DNA, 21 bp, Homo sapiens
cagaaaggttctgcccgggaa

SEQ ID NO: 4970373 - DNA, 22 bp, Homo sapiens
cagaaatactataacatatgta

SEQ ID NO: 4970374 - DNA, 22 bp, Homo sapiens
cagaaatatatatacatatgta

SEQ ID NO: 4970375 - DNA, 21 bp, Homo sapiens
cagaaattggaacagaatgtt

SEQ ID NO: 4970376 - DNA, 19 bp, Homo sapiens
cagaacacggctcacgctt

SEQ ID NO: 4970377 - DNA, 12 bp, Homo sapiens
cagaacagcttc

SEQ ID NO: 4970378 - DNA, 13 bp, Homo sapiens
cagaacagcttca

SEQ ID NO: 4970379 - DNA, 17 bp, Homo sapiens
cagaacagcttcaggtt

SEQ ID NO: 4970380 - DNA, 24 bp, Homo sapiens
cagaacagcttcaggttatcgaaa

SEQ ID NO: 4970381 - DNA, 12 bp, Homo sapiens
cagaacagggtc

SEQ ID NO: 4970382 - DNA, 14 bp, Homo sapiens
cagaacagggtcat

SEQ ID NO: 4970383 - DNA, 15 bp, Homo sapiens
cagaacagtatcttt

SEQ ID NO: 4970384 - DNA, 15 bp, Homo sapiens
cagaaccatccatag

SEQ ID NO: 4970385 - DNA, 19 bp, Homo sapiens
cagaacccagggctctgcc

SEQ ID NO: 4970386 - DNA, 12 bp, Homo sapiens
cagaacctcttc

SEQ ID NO: 4970387 - DNA, 15 bp, Homo sapiens
cagaacctcttcccc

SEQ ID NO: 4970388 - DNA, 12 bp, Homo sapiens
cagaactaaatg

SEQ ID NO: 4970389 - DNA, 15 bp, Homo sapiens
cagaactcactgggg

SEQ ID NO: 4970390 - DNA, 24 bp, Homo sapiens
cacccaaccctatctcctgacaga

SEQ ID NO: 4970391 - DNA, 12 bp, Homo sapiens
cacccacatgtg

SEQ ID NO: 4970392 - DNA, 13 bp, Homo sapiens
cacccacatgtga

SEQ ID NO: 4970393 - DNA, 22 bp, Homo sapiens
cacccaccatcatgtctggcta

SEQ ID NO: 4970394 - DNA, 14 bp, Homo sapiens
cacccagcctcagt

SEQ ID NO: 4970395 - DNA, 15 bp, Homo sapiens
cacccagcctcagtc

SEQ ID NO: 4970396 - DNA, 23 bp, Homo sapiens
cacccaggagccccgaggccttc

SEQ ID NO: 4970397 - DNA, 24 bp, Homo sapiens
cacccaggagccccgaggccttct

SEQ ID NO: 4970398 - DNA, 15 bp, Homo sapiens
cacccattttcacat

SEQ ID NO: 4970399 - DNA, 11 bp, Homo sapiens
caccccacact

SEQ ID NO: 4970400 - DNA, 18 bp, Homo sapiens
caccccacgccttatccc

SEQ ID NO: 4970401 - DNA, 17 bp, Homo sapiens
caccccatgccaaagct

SEQ ID NO: 4970402 - DNA, 17 bp, Homo sapiens
cacccccacccccagct

SEQ ID NO: 4970403 - DNA, 13 bp, Homo sapiens
cacccccatctct

SEQ ID NO: 4970404 - DNA, 14 bp, Homo sapiens
caccccccaagctg

SEQ ID NO: 4970405 - DNA, 22 bp, Homo sapiens
cacccccttctctgctccacca

SEQ ID NO: 4970406 - DNA, 13 bp, Homo sapiens
caccccggcaggc

SEQ ID NO: 4970407 - DNA, 14 bp, Homo sapiens
caccccggcaggcc

SEQ ID NO: 4970408 - DNA, 18 bp, Homo sapiens
cacccctacccctggctg

SEQ ID NO: 4970409 - DNA, 22 bp, Homo sapiens
cacccctccagaacacggctca

SEQ ID NO: 4970410 - DNA, 16 bp, Homo sapiens
cacccctctgccctca

SEQ ID NO: 4970411 - DNA, 17 bp, Homo sapiens
cacccctgtcctcactg

SEQ ID NO: 4970412 - DNA, 14 bp, Homo sapiens
cacccggcccctgc

SEQ ID NO: 4970413 - DNA, 17 bp, Homo sapiens
caccctagtcccttccc

SEQ ID NO: 4970414 - DNA, 18 bp, Homo sapiens
caccctcaacctcttctg

SEQ ID NO: 4970415 - DNA, 17 bp, Homo sapiens
caccctcactctgccag

SEQ ID NO: 4970416 - DNA, 21 bp, Homo sapiens
caccctcactctgccagggca

SEQ ID NO: 4970417 - DNA, 14 bp, Homo sapiens
caccctccacctct

SEQ ID NO: 4970418 - DNA, 17 bp, Homo sapiens
caccctccacctcttca

SEQ ID NO: 4970419 - DNA, 20 bp, Homo sapiens
caccctcccccgccactcct

SEQ ID NO: 4970420 - DNA, 13 bp, Homo sapiens
caccctccctgga

SEQ ID NO: 4970421 - DNA, 16 bp, Homo sapiens
caccctccctggagtg

SEQ ID NO: 4970422 - DNA, 24 bp, Homo sapiens
caccctcgaagcgcgccactcgct

SEQ ID NO: 4970423 - DNA, 12 bp, Homo sapiens
caccctctggcc

SEQ ID NO: 4970424 - DNA, 15 bp, Homo sapiens
caccctcttcctgtg

SEQ ID NO: 4970425 - DNA, 17 bp, Homo sapiens
caccctgatttcttgct

SEQ ID NO: 4970426 - DNA, 17 bp, Homo sapiens
caccctgcaaggcccac

SEQ ID NO: 4970427 - DNA, 23 bp, Homo sapiens
caccctgcaaggcccacaggagg

SEQ ID NO: 4970428 - DNA, 21 bp, Homo sapiens
caccctggaggatttcatctc

SEQ ID NO: 4970429 - DNA, 17 bp, Homo sapiens
caccctgggagacagac

SEQ ID NO: 4970430 - DNA, 13 bp, Homo sapiens
caccctggggcct

SEQ ID NO: 4970431 - DNA, 14 bp, Homo sapiens
caccctggggcctg

SEQ ID NO: 4970432 - DNA, 20 bp, Homo sapiens
caccctggggcctggacctg

SEQ ID NO: 4970433 - DNA, 17 bp, Homo sapiens
caccctgtctaaaaaac

SEQ ID NO: 4970434 - DNA, 15 bp, Homo sapiens
caccctgtggccctg

SEQ ID NO: 4970435 - DNA, 17 bp, Homo sapiens
caccctgtggccctggc

SEQ ID NO: 4970436 - DNA, 22 bp, Homo sapiens
cacccttcccctccttctccct

SEQ ID NO: 4970437 - DNA, 14 bp, Homo sapiens
cacccttcttttct

SEQ ID NO: 4970438 - DNA, 19 bp, Homo sapiens
cacccttcttttctcatgt

SEQ ID NO: 4970439 - DNA, 19 bp, Homo sapiens
cacccttggacaagacaaa

SEQ ID NO: 4970440 - DNA, 12 bp, Homo sapiens
cacccttggcct

SEQ ID NO: 4970441 - DNA, 21 bp, Homo sapiens
caccgaagtggactggcccct

SEQ ID NO: 4970442 - DNA, 12 bp, Homo sapiens
caccgagtgggg

SEQ ID NO: 4970443 - DNA, 21 bp, Homo sapiens
caccgcggcgcttcccagcac

SEQ ID NO: 4970444 - DNA, 18 bp, Homo sapiens
caccggccgatggagaca

SEQ ID NO: 4970445 - DNA, 15 bp, Homo sapiens
caccgggcactcaga

SEQ ID NO: 4970446 - DNA, 17 bp, Homo sapiens
caccggtccagctggcc

SEQ ID NO: 4970447 - DNA, 18 bp, Homo sapiens
caccggtccagctggcct

SEQ ID NO: 4970448 - DNA, 17 bp, Homo sapiens
cacctaagtctctgtga

SEQ ID NO: 4970449 - DNA, 18 bp, Homo sapiens
cacctaccatcagggaca

SEQ ID NO: 4970450 - DNA, 14 bp, Homo sapiens
cacctagagccaga

SEQ ID NO: 4970451 - DNA, 20 bp, Homo sapiens
cacctagcaattccatcacc

SEQ ID NO: 4970452 - DNA, 15 bp, Homo sapiens
cacctagtccagtga

SEQ ID NO: 4970453 - DNA, 14 bp, Homo sapiens
cacctatgtgccaa

SEQ ID NO: 4970454 - DNA, 17 bp, Homo sapiens
cacctatgtgccaactg

SEQ ID NO: 4970455 - DNA, 12 bp, Homo sapiens
cacctcagcctg

SEQ ID NO: 4970456 - DNA, 14 bp, Homo sapiens
cacctcagcctgca

SEQ ID NO: 4970457 - DNA, 20 bp, Homo sapiens
cacctcagttcccttggcct

SEQ ID NO: 4970458 - DNA, 22 bp, Homo sapiens
cacctcagttcccttggcctca

SEQ ID NO: 4970459 - DNA, 12 bp, Homo sapiens
cacctccagccc

SEQ ID NO: 4970460 - DNA, 16 bp, Homo sapiens
cacctccagcccggga

SEQ ID NO: 4970461 - DNA, 21 bp, Homo sapiens
cacctccagcccgggagccta

SEQ ID NO: 4970462 - DNA, 15 bp, Homo sapiens
cacctccatcccaga

SEQ ID NO: 4970463 - DNA, 12 bp, Homo sapiens
cacctcccagga

SEQ ID NO: 4970464 - DNA, 14 bp, Homo sapiens
cacctccccacgcc

SEQ ID NO: 4970465 - DNA, 21 bp, Homo sapiens
cacctccccacgccctcccct

SEQ ID NO: 4970466 - DNA, 15 bp, Homo sapiens
cacctctacccaaac

SEQ ID NO: 4970467 - DNA, 12 bp, Homo sapiens
cacctctgcgga

SEQ ID NO: 4970468 - DNA, 19 bp, Homo sapiens
cacctctgcggaccccagc

SEQ ID NO: 4970469 - DNA, 21 bp, Homo sapiens
cacctctgcggaccccagctg

SEQ ID NO: 4970470 - DNA, 13 bp, Homo sapiens
cacctctggactg

SEQ ID NO: 4970471 - DNA, 19 bp, Homo sapiens
cacctctggactggctaga

SEQ ID NO: 4970472 - DNA, 19 bp, Homo sapiens
cacctctgtcatttgttgt

SEQ ID NO: 4970473 - DNA, 13 bp, Homo sapiens
cacctctgtgacc

SEQ ID NO: 4970474 - DNA, 15 bp, Homo sapiens
cacctctgtgacctc

SEQ ID NO: 4970475 - DNA, 17 bp, Homo sapiens
cacctctgtgacctcag

SEQ ID NO: 4970476 - DNA, 14 bp, Homo sapiens
cacctcttcacccc

SEQ ID NO: 4970477 - DNA, 14 bp, Homo sapiens
cacctgaagactca

SEQ ID NO: 4970478 - DNA, 19 bp, Homo sapiens
cacctgagtcaccctacct

SEQ ID NO: 4970479 - DNA, 10 bp, Homo sapiens
cacctgcctg

SEQ ID NO: 4970480 - DNA, 11 bp, Homo sapiens
cacctgcctgc

SEQ ID NO: 4970481 - DNA, 20 bp, Homo sapiens
cacctgcctgcgtcttccgc

SEQ ID NO: 4970482 - DNA, 23 bp, Homo sapiens
cacctgcctgcgtcttccgcccc

SEQ ID NO: 4970483 - DNA, 19 bp, Homo sapiens
cacctgggcttaagaaatc

SEQ ID NO: 4970484 - DNA, 20 bp, Homo sapiens
cacctggtactccctctcag

SEQ ID NO: 4970485 - DNA, 18 bp, Homo sapiens
cacctgtaaagtgcctta

SEQ ID NO: 4970486 - DNA, 22 bp, Homo sapiens
cacctgtggaacataaaaagga

SEQ ID NO: 4970487 - DNA, 14 bp, Homo sapiens
caccttcccatgcc

SEQ ID NO: 4970488 - DNA, 12 bp, Homo sapiens
caccttcccttg

SEQ ID NO: 4970489 - DNA, 14 bp, Homo sapiens
caccttcccttgcc

SEQ ID NO: 4970490 - DNA, 19 bp, Homo sapiens
caccttcccttgccacttt

SEQ ID NO: 4970491 - DNA, 16 bp, Homo sapiens
caccttgacagggcac

SEQ ID NO: 4970492 - DNA, 18 bp, Homo sapiens
caccttgacagggcacac

SEQ ID NO: 4970493 - DNA, 13 bp, Homo sapiens
caccttggctcaa

SEQ ID NO: 4970494 - DNA, 14 bp, Homo sapiens
caccttggctcaag

SEQ ID NO: 4970495 - DNA, 14 bp, Homo sapiens
caccttggctgcag

SEQ ID NO: 4970496 - DNA, 15 bp, Homo sapiens
caccttggctgcagg

SEQ ID NO: 4970497 - DNA, 14 bp, Homo sapiens
cacctttaggttct

SEQ ID NO: 4970498 - DNA, 18 bp, Homo sapiens
cacctttgcacaggatgc

SEQ ID NO: 4970499 - DNA, 14 bp, Homo sapiens
cacctttgtgtatt

SEQ ID NO: 4970500 - DNA, 14 bp, Homo sapiens
caccttttttccta

SEQ ID NO: 4970501 - DNA, 18 bp, Homo sapiens
cacacaagaagaagggca

SEQ ID NO: 4970502 - DNA, 14 bp, Homo sapiens
cacacacaaacctt

SEQ ID NO: 4970503 - DNA, 9 bp, Homo sapiens
cacacacac

SEQ ID NO: 4970504 - DNA, 16 bp, Homo sapiens
cacacacacacacaca

SEQ ID NO: 4970505 - DNA, 14 bp, Homo sapiens
cacacacacataca

SEQ ID NO: 4970506 - DNA, 14 bp, Homo sapiens
cacacacacgcacg

SEQ ID NO: 4970507 - DNA, 13 bp, Homo sapiens
cacacacactcta

SEQ ID NO: 4970508 - DNA, 20 bp, Homo sapiens
cacacaccagagcccacctt

SEQ ID NO: 4970509 - DNA, 18 bp, Homo sapiens
cacacacgcacgcacaca

SEQ ID NO: 4970510 - DNA, 23 bp, Homo sapiens
cacacacgcacgcacacacacaa

SEQ ID NO: 4970511 - DNA, 21 bp, Homo sapiens
cacacacgcgcgcgcacacac

SEQ ID NO: 4970512 - DNA, 14 bp, Homo sapiens
cacacactttggct

SEQ ID NO: 4970513 - DNA, 18 bp, Homo sapiens
cacacagaaatatatata

SEQ ID NO: 4970514 - DNA, 12 bp, Homo sapiens
cacacagctctg

SEQ ID NO: 4970515 - DNA, 14 bp, Homo sapiens
cacacagctctgtc

SEQ ID NO: 4970516 - DNA, 23 bp, Homo sapiens
cacacagggtctgcaaggtcttt

SEQ ID NO: 4970517 - DNA, 23 bp, Homo sapiens
cacacagtgagtcgaggacaggg

SEQ ID NO: 4970518 - DNA, 14 bp, Homo sapiens
cacacatccacccc

SEQ ID NO: 4970519 - DNA, 16 bp, Homo sapiens
cacacatccaccccag

SEQ ID NO: 4970520 - DNA, 13 bp, Homo sapiens
cacaccagagccc

SEQ ID NO: 4970521 - DNA, 12 bp, Homo sapiens
cacacccagcct

SEQ ID NO: 4970522 - DNA, 15 bp, Homo sapiens
cacacccagcctcag

SEQ ID NO: 4970523 - DNA, 18 bp, Homo sapiens
cacacccagcctcagtcc

SEQ ID NO: 4970524 - DNA, 21 bp, Homo sapiens
cacaccctcccccgccactcc

SEQ ID NO: 4970525 - DNA, 22 bp, Homo sapiens
cacacctcagttcccttggcct

SEQ ID NO: 4970526 - DNA, 23 bp, Homo sapiens
cacaccttttattgacacagaaa

SEQ ID NO: 4970527 - DNA, 20 bp, Homo sapiens
cacacgaccggggccagcac

SEQ ID NO: 4970528 - DNA, 14 bp, Homo sapiens
cacacgcacgcaca

SEQ ID NO: 4970529 - DNA, 21 bp, Homo sapiens
cacacgcgcgcgcacacacac

SEQ ID NO: 4970530 - DNA, 21 bp, Homo sapiens
cacactaacctgggttccctt

SEQ ID NO: 4970531 - DNA, 19 bp, Homo sapiens
cacactctgccagcaaaga

SEQ ID NO: 4970532 - DNA, 17 bp, Homo sapiens
cacacttgttccagctc

SEQ ID NO: 4970533 - DNA, 20 bp, Homo sapiens
cacacttgttccagctcttt

SEQ ID NO: 4970534 - DNA, 11 bp, Homo sapiens
cacagaaacac

SEQ ID NO: 4970535 - DNA, 15 bp, Homo sapiens
cacagaaacactgcc

SEQ ID NO: 4970536 - DNA, 12 bp, Homo sapiens
cacagaaacctt

SEQ ID NO: 4970537 - DNA, 12 bp, Homo sapiens
cacagaaatata

SEQ ID NO: 4970538 - DNA, 19 bp, Homo sapiens
cacagaaatatatatacat

SEQ ID NO: 4970539 - DNA, 21 bp, Homo sapiens
cacagaaatatatatacatat

SEQ ID NO: 4970540 - DNA, 13 bp, Homo sapiens
cacagaacccttg

SEQ ID NO: 4970541 - DNA, 12 bp, Homo sapiens
cacagacacaca

SEQ ID NO: 4970542 - DNA, 13 bp, Homo sapiens
cacagacacacac

SEQ ID NO: 4970543 - DNA, 18 bp, Homo sapiens
cacagagagggagagcag

SEQ ID NO: 4970544 - DNA, 22 bp, Homo sapiens
cacagagagggagagcagagaa

SEQ ID NO: 4970545 - DNA, 23 bp, Homo sapiens
cacagagagggagagcagagaaa

SEQ ID NO: 4970546 - DNA, 14 bp, Homo sapiens
cacagataaaaagt

SEQ ID NO: 4970547 - DNA, 17 bp, Homo sapiens
cacagatatactttgtg

SEQ ID NO: 4970548 - DNA, 22 bp, Homo sapiens
cacagatgtgggctttgatttc

SEQ ID NO: 4970549 - DNA, 12 bp, Homo sapiens
cacagattttaa

SEQ ID NO: 4970550 - DNA, 18 bp, Homo sapiens
cacagattttaattgtca

SEQ ID NO: 4970551 - DNA, 12 bp, Homo sapiens
cacagcagcctg

SEQ ID NO: 4970552 - DNA, 14 bp, Homo sapiens
cacagcagcctgct

SEQ ID NO: 4970553 - DNA, 18 bp, Homo sapiens
cacagcagcttcaccaga

SEQ ID NO: 4970554 - DNA, 22 bp, Homo sapiens
cacagcagcttcaccagagcat

SEQ ID NO: 4970555 - DNA, 21 bp, Homo sapiens
cacagcctataggccaatgca

SEQ ID NO: 4970556 - DNA, 23 bp, Homo sapiens
cacagcctcctctgtctgccctt

SEQ ID NO: 4970557 - DNA, 12 bp, Homo sapiens
cacagcctgggc

SEQ ID NO: 4970558 - DNA, 14 bp, Homo sapiens
cacagcctgggccc

SEQ ID NO: 4970559 - DNA, 16 bp, Homo sapiens
cacagcgagggcagct

SEQ ID NO: 4970560 - DNA, 23 bp, Homo sapiens
cacagcggagtctgtcctgtgac

SEQ ID NO: 4970561 - DNA, 14 bp, Homo sapiens
cacagcggcccctg

SEQ ID NO: 4970562 - DNA, 16 bp, Homo sapiens
cacagcggcccctgca

SEQ ID NO: 4970563 - DNA, 20 bp, Homo sapiens
cacagcggggccccagggct

SEQ ID NO: 4970564 - DNA, 14 bp, Homo sapiens
cacagctccctgcc

SEQ ID NO: 4970565 - DNA, 15 bp, Homo sapiens
cacagctccctgcca

SEQ ID NO: 4970566 - DNA, 15 bp, Homo sapiens
cacagctctgtcctg

SEQ ID NO: 4970567 - DNA, 16 bp, Homo sapiens
cacagctctgtcctgg

SEQ ID NO: 4970568 - DNA, 18 bp, Homo sapiens
cacagctgagagactttt

SEQ ID NO: 4970569 - DNA, 14 bp, Homo sapiens
cacagctgtagtgg

SEQ ID NO: 4970570 - DNA, 17 bp, Homo sapiens
cacagctgttcttctgt

SEQ ID NO: 4970571 - DNA, 21 bp, Homo sapiens
cacagcttcatttcctgtgtc

SEQ ID NO: 4970572 - DNA, 21 bp, Homo sapiens
cacaggactgattctgggatg

SEQ ID NO: 4970573 - DNA, 19 bp, Homo sapiens
cacaggaggcaagcaagct

SEQ ID NO: 4970574 - DNA, 20 bp, Homo sapiens
cacaggaggcaagcaagctc

SEQ ID NO: 4970575 - DNA, 18 bp, Homo sapiens
cacaggagtgggaaaaca

SEQ ID NO: 4970576 - DNA, 17 bp, Homo sapiens
cacaggatgctgtgttg

SEQ ID NO: 4970577 - DNA, 11 bp, Homo sapiens
cacaggcagct

SEQ ID NO: 4970578 - DNA, 13 bp, Homo sapiens
cacaggcagcttt

SEQ ID NO: 4970579 - DNA, 18 bp, Homo sapiens
cacaggcagctttctaga

SEQ ID NO: 4970580 - DNA, 11 bp, Homo sapiens
cacaggcaggt

SEQ ID NO: 4970581 - DNA, 18 bp, Homo sapiens
cacaggcccggctccagg

SEQ ID NO: 4970582 - DNA, 16 bp, Homo sapiens
cacaggcccttcctct

SEQ ID NO: 4970583 - DNA, 17 bp, Homo sapiens
cacaggcccttcctctc

SEQ ID NO: 4970584 - DNA, 18 bp, Homo sapiens
cacagggttgggcccaga

SEQ ID NO: 4970585 - DNA, 23 bp, Homo sapiens
cacagggttgggcccagatctgg

SEQ ID NO: 4970586 - DNA, 18 bp, Homo sapiens
cacaggtcgggcgcagga

SEQ ID NO: 4970587 - DNA, 13 bp, Homo sapiens
cacaggtctagac

SEQ ID NO: 4970588 - DNA, 18 bp, Homo sapiens
cacagtacagcatgtgcc

SEQ ID NO: 4970589 - DNA, 19 bp, Homo sapiens
cacagtacagcatgtgcct

SEQ ID NO: 4970590 - DNA, 20 bp, Homo sapiens
cacagtacagcatgtgcctt

SEQ ID NO: 4970591 - DNA, 14 bp, Homo sapiens
cacagtagagccag

SEQ ID NO: 4970592 - DNA, 16 bp, Homo sapiens
cacagtagagccagct

SEQ ID NO: 4970593 - DNA, 18 bp, Homo sapiens
cacagtattacttctgct

SEQ ID NO: 4970594 - DNA, 14 bp, Homo sapiens
cacagtcaaaataa

SEQ ID NO: 4970595 - DNA, 22 bp, Homo sapiens
cacagtcaccttctcggcaact

SEQ ID NO: 4970596 - DNA, 16 bp, Homo sapiens
cacagtccaggaacaa

SEQ ID NO: 4970597 - DNA, 15 bp, Homo sapiens
cacagtgaagtgctg

SEQ ID NO: 4970598 - DNA, 16 bp, Homo sapiens
cacagtgacccttccc

SEQ ID NO: 4970599 - DNA, 17 bp, Homo sapiens
cacagtgcatctcagcc

SEQ ID NO: 4970600 - DNA, 13 bp, Homo sapiens
cacagtgggaact

SEQ ID NO: 4970601 - DNA, 14 bp, Homo sapiens
cacagtgttgccca

SEQ ID NO: 4970602 - DNA, 12 bp, Homo sapiens
cacagttgccac

SEQ ID NO: 4970603 - DNA, 14 bp, Homo sapiens
cacagttgccacca

SEQ ID NO: 4970604 - DNA, 12 bp, Homo sapiens
cacagttggcct

SEQ ID NO: 4970605 - DNA, 15 bp, Homo sapiens
cacagttggccttca

SEQ ID NO: 4970606 - DNA, 20 bp, Homo sapiens
cacagtttgatgtcattaat

SEQ ID NO: 4970607 - DNA, 17 bp, Homo sapiens
cacatacacacacacgc

SEQ ID NO: 4970608 - DNA, 13 bp, Homo sapiens
cacatacagtttt

SEQ ID NO: 4970609 - DNA, 21 bp, Homo sapiens
cacatagattaatggcactga

SEQ ID NO: 4970610 - DNA, 22 bp, Homo sapiens
cacatagctacccaaaagagaa

SEQ ID NO: 4970611 - DNA, 23 bp, Homo sapiens
cacatagctacccaaaagagaaa

SEQ ID NO: 4970612 - DNA, 21 bp, Homo sapiens
cacatagtgatggttcccctg

SEQ ID NO: 4970613 - DNA, 14 bp, Homo sapiens
caatatgtattgta

SEQ ID NO: 4970614 - DNA, 16 bp, Homo sapiens
caatatgtattgtaaa

SEQ ID NO: 4970615 - DNA, 22 bp, Homo sapiens
caatatgtattgtaaacatgtg

SEQ ID NO: 4970616 - DNA, 23 bp, Homo sapiens
caatatgtattgtaaacatgtgt

SEQ ID NO: 4970617 - DNA, 14 bp, Homo sapiens
caatattaaatctg

SEQ ID NO: 4970618 - DNA, 16 bp, Homo sapiens
caatattgacatttgt

SEQ ID NO: 4970619 - DNA, 14 bp, Homo sapiens
caatatttatggat

SEQ ID NO: 4970620 - DNA, 22 bp, Homo sapiens
caatatttctgctttctttgat

SEQ ID NO: 4970621 - DNA, 14 bp, Homo sapiens
caatatttttagat

SEQ ID NO: 4970622 - DNA, 15 bp, Homo sapiens
caatcagaatgaaca

SEQ ID NO: 4970623 - DNA, 12 bp, Homo sapiens
caatcagcactg

SEQ ID NO: 4970624 - DNA, 13 bp, Homo sapiens
caatcagcactga

SEQ ID NO: 4970625 - DNA, 15 bp, Homo sapiens
caatcagcactgaaa

SEQ ID NO: 4970626 - DNA, 16 bp, Homo sapiens
caatcagcactgaaaa

SEQ ID NO: 4970627 - DNA, 15 bp, Homo sapiens
caatcatctgtgtga

SEQ ID NO: 4970628 - DNA, 19 bp, Homo sapiens
caatcatctgtgtgaaaat

SEQ ID NO: 4970629 - DNA, 19 bp, Homo sapiens
caatcattgttttgaatat

SEQ ID NO: 4970630 - DNA, 18 bp, Homo sapiens
caatcatttctcactgtg

SEQ ID NO: 4970631 - DNA, 18 bp, Homo sapiens
caatcccaaaagtcacca

SEQ ID NO: 4970632 - DNA, 16 bp, Homo sapiens
caatccccagcccttt

SEQ ID NO: 4970633 - DNA, 17 bp, Homo sapiens
caatcctgtctttctga

SEQ ID NO: 4970634 - DNA, 20 bp, Homo sapiens
caatctcaaggaatctttaa

SEQ ID NO: 4970635 - DNA, 17 bp, Homo sapiens
caatctcccgctgctgc

SEQ ID NO: 4970636 - DNA, 21 bp, Homo sapiens
caatctcttaaattgggttca

SEQ ID NO: 4970637 - DNA, 16 bp, Homo sapiens
caatctggaagaaaaa

SEQ ID NO: 4970638 - DNA, 18 bp, Homo sapiens
caatgaaaggtactatat

SEQ ID NO: 4970639 - DNA, 22 bp, Homo sapiens
caatgacatctcaggggccaga

SEQ ID NO: 4970640 - DNA, 11 bp, Homo sapiens
caatgactact

SEQ ID NO: 4970641 - DNA, 18 bp, Homo sapiens
caatgatagtaagaaaag

SEQ ID NO: 4970642 - DNA, 14 bp, Homo sapiens
caatgatgaatgag

SEQ ID NO: 4970643 - DNA, 20 bp, Homo sapiens
caatgattattttcattaca

SEQ ID NO: 4970644 - DNA, 16 bp, Homo sapiens
caatgcaagagtgatt

SEQ ID NO: 4970645 - DNA, 22 bp, Homo sapiens
caatgcaagagtgattgcagct

SEQ ID NO: 4970646 - DNA, 23 bp, Homo sapiens
caatgcaagagtgattgcagctt

SEQ ID NO: 4970647 - DNA, 14 bp, Homo sapiens
caatgcacatccat

SEQ ID NO: 4970648 - DNA, 14 bp, Homo sapiens
caatgccaagataa

SEQ ID NO: 4970649 - DNA, 14 bp, Homo sapiens
caatgctgatttgg

SEQ ID NO: 4970650 - DNA, 16 bp, Homo sapiens
caatgctgatttggtg

SEQ ID NO: 4970651 - DNA, 12 bp, Homo sapiens
caatgctggctg

SEQ ID NO: 4970652 - DNA, 21 bp, Homo sapiens
caatgctggctgttggctggg

SEQ ID NO: 4970653 - DNA, 15 bp, Homo sapiens
caatggaaacctcac

SEQ ID NO: 4970654 - DNA, 22 bp, Homo sapiens
caatggatttgatgctgtttga

SEQ ID NO: 4970655 - DNA, 11 bp, Homo sapiens
caatggcagcc

SEQ ID NO: 4970656 - DNA, 12 bp, Homo sapiens
caatggcagcct

SEQ ID NO: 4970657 - DNA, 13 bp, Homo sapiens
caatggcagcctt

SEQ ID NO: 4970658 - DNA, 21 bp, Homo sapiens
caatggcctaaaactggcctg

SEQ ID NO: 4970659 - DNA, 15 bp, Homo sapiens
caatgggcactggga

SEQ ID NO: 4970660 - DNA, 18 bp, Homo sapiens
caatgggcactgggatga

SEQ ID NO: 4970661 - DNA, 16 bp, Homo sapiens
caatgggctcttccaa

SEQ ID NO: 4970662 - DNA, 16 bp, Homo sapiens
caatggtcctgacttt

SEQ ID NO: 4970663 - DNA, 21 bp, Homo sapiens
caatggtgtcagtatccaggc

SEQ ID NO: 4970664 - DNA, 14 bp, Homo sapiens
caatgtcaggaaca

SEQ ID NO: 4970665 - DNA, 11 bp, Homo sapiens
caatgttaagg

SEQ ID NO: 4970666 - DNA, 19 bp, Homo sapiens
caatgttaaggaaactctt

SEQ ID NO: 4970667 - DNA, 17 bp, Homo sapiens
caatgttagagactttt

SEQ ID NO: 4970668 - DNA, 20 bp, Homo sapiens
caatgtttatgcaaggaagg

SEQ ID NO: 4970669 - DNA, 15 bp, Homo sapiens
caattaataaaaaat

SEQ ID NO: 4970670 - DNA, 19 bp, Homo sapiens
caattagcctcatagttat

SEQ ID NO: 4970671 - DNA, 16 bp, Homo sapiens
caattaggattttgat

SEQ ID NO: 4970672 - DNA, 15 bp, Homo sapiens
caattatagtttctg

SEQ ID NO: 4970673 - DNA, 18 bp, Homo sapiens
caattatagtttctgagg

SEQ ID NO: 4970674 - DNA, 23 bp, Homo sapiens
caattattgttacacattaagta

SEQ ID NO: 4970675 - DNA, 10 bp, Homo sapiens
caattccaat

SEQ ID NO: 4970676 - DNA, 16 bp, Homo sapiens
caattccaatatttct

SEQ ID NO: 4970677 - DNA, 11 bp, Homo sapiens
caattcccctc

SEQ ID NO: 4970678 - DNA, 22 bp, Homo sapiens
caattccgtcttcttaatctga

SEQ ID NO: 4970679 - DNA, 23 bp, Homo sapiens
caattctcatttgtcacacactt

SEQ ID NO: 4970680 - DNA, 19 bp, Homo sapiens
caattgactgtcactgttc

SEQ ID NO: 4970681 - DNA, 16 bp, Homo sapiens
caattggttaatcttt

SEQ ID NO: 4970682 - DNA, 18 bp, Homo sapiens
caattgtgagccaccacg

SEQ ID NO: 4970683 - DNA, 13 bp, Homo sapiens
caattgtgctgcc

SEQ ID NO: 4970684 - DNA, 14 bp, Homo sapiens
caattgtgctgcca

SEQ ID NO: 4970685 - DNA, 24 bp, Homo sapiens
caattgttgacagttctgaagaat

SEQ ID NO: 4970686 - DNA, 22 bp, Homo sapiens
caattgtttggggttgaaaatt

SEQ ID NO: 4970687 - DNA, 21 bp, Homo sapiens
caattgttttaatctgaaatt

SEQ ID NO: 4970688 - DNA, 13 bp, Homo sapiens
caatttaaatgtt

SEQ ID NO: 4970689 - DNA, 15 bp, Homo sapiens
caatttcaaggttct

SEQ ID NO: 4970690 - DNA, 15 bp, Homo sapiens
caatttcctttatat

SEQ ID NO: 4970691 - DNA, 16 bp, Homo sapiens
caatttcctttatatt

SEQ ID NO: 4970692 - DNA, 19 bp, Homo sapiens
caatttgatacataataaa

SEQ ID NO: 4970693 - DNA, 11 bp, Homo sapiens
caattttgtaa

SEQ ID NO: 4970694 - DNA, 13 bp, Homo sapiens
caatttttaatgg

SEQ ID NO: 4970695 - DNA, 22 bp, Homo sapiens
caatttttaatggcagcagaaa

SEQ ID NO: 4970696 - DNA, 18 bp, Homo sapiens
caatttttgtctcagaag

SEQ ID NO: 4970697 - DNA, 14 bp, Homo sapiens
cacaaaaatgttga

SEQ ID NO: 4970698 - DNA, 20 bp, Homo sapiens
cacaaaactccgcccccagc

SEQ ID NO: 4970699 - DNA, 21 bp, Homo sapiens
cacaaaactccgcccccagcc

SEQ ID NO: 4970700 - DNA, 22 bp, Homo sapiens
cacaaaactccgcccccagcct

SEQ ID NO: 4970701 - DNA, 16 bp, Homo sapiens
cacaaaagtttctctt

SEQ ID NO: 4970702 - DNA, 15 bp, Homo sapiens
cacaaacatttttca

SEQ ID NO: 4970703 - DNA, 12 bp, Homo sapiens
cacaaactgtaa

SEQ ID NO: 4970704 - DNA, 19 bp, Homo sapiens
cacaaacttttatactctt

SEQ ID NO: 4970705 - DNA, 15 bp, Homo sapiens
cacaaagagttctgg

SEQ ID NO: 4970706 - DNA, 21 bp, Homo sapiens
cacaaagagttctggaaaaga

SEQ ID NO: 4970707 - DNA, 19 bp, Homo sapiens
cacaacatttgcagatgtt

SEQ ID NO: 4970708 - DNA, 23 bp, Homo sapiens
cacaaccaccgttacaagtatac

SEQ ID NO: 4970709 - DNA, 15 bp, Homo sapiens
cacaactgacacagg

SEQ ID NO: 4970710 - DNA, 20 bp, Homo sapiens
cacaactgcaataacttctg

SEQ ID NO: 4970711 - DNA, 21 bp, Homo sapiens
cacaactgcaataacttctga

SEQ ID NO: 4970712 - DNA, 22 bp, Homo sapiens
cacaagcagagtgcacagctgt

SEQ ID NO: 4970713 - DNA, 18 bp, Homo sapiens
cacaaggattgaaaattc

SEQ ID NO: 4970714 - DNA, 16 bp, Homo sapiens
cacaagtcctgtgaat

SEQ ID NO: 4970715 - DNA, 20 bp, Homo sapiens
cacaagtcctgtgaatttct

SEQ ID NO: 4970716 - DNA, 21 bp, Homo sapiens
cacaataacactaaaatttta

SEQ ID NO: 4970717 - DNA, 13 bp, Homo sapiens
cacaataagcaaa

SEQ ID NO: 4970718 - DNA, 19 bp, Homo sapiens
cacaatacagataacatta

SEQ ID NO: 4970719 - DNA, 16 bp, Homo sapiens
cacaatgtcagtattt

SEQ ID NO: 4970720 - DNA, 18 bp, Homo sapiens
cacaatgtcagtatttca

SEQ ID NO: 4970721 - DNA, 13 bp, Homo sapiens
cacaatttgcact

SEQ ID NO: 4970722 - DNA, 13 bp, Homo sapiens
cacaatttttaat

SEQ ID NO: 4970723 - DNA, 15 bp, Homo sapiens
cacaatttttaatgg

SEQ ID NO: 4970724 - DNA, 18 bp, Homo sapiens
cacacaaaccttctgcct

SEQ ID NO: 4970725 - DNA, 20 bp, Homo sapiens
caaatccttccaaaaattat

SEQ ID NO: 4970726 - DNA, 19 bp, Homo sapiens
caaatcgtccagcgacctt

SEQ ID NO: 4970727 - DNA, 21 bp, Homo sapiens
caaatcgtccagcgaccttcc

SEQ ID NO: 4970728 - DNA, 12 bp, Homo sapiens
caaatctgtgta

SEQ ID NO: 4970729 - DNA, 15 bp, Homo sapiens
caaatctgtgtatat

SEQ ID NO: 4970730 - DNA, 16 bp, Homo sapiens
caaatctgtgtatatt

SEQ ID NO: 4970731 - DNA, 19 bp, Homo sapiens
caaatcttgaaattaagaa

SEQ ID NO: 4970732 - DNA, 22 bp, Homo sapiens
caaatcttggcaatattcctta

SEQ ID NO: 4970733 - DNA, 14 bp, Homo sapiens
caaatgacatgcac

SEQ ID NO: 4970734 - DNA, 17 bp, Homo sapiens
caaatgacatgcactga

SEQ ID NO: 4970735 - DNA, 22 bp, Homo sapiens
caaatgaccagcagattcaaat

SEQ ID NO: 4970736 - DNA, 19 bp, Homo sapiens
caaatgccttaaaatggaa

SEQ ID NO: 4970737 - DNA, 22 bp, Homo sapiens
caaatgctctctcaaattgtca

SEQ ID NO: 4970738 - DNA, 24 bp, Homo sapiens
caaatgtcttttagaagatagatg

SEQ ID NO: 4970739 - DNA, 14 bp, Homo sapiens
caaatgtggctcct

SEQ ID NO: 4970740 - DNA, 19 bp, Homo sapiens
caaatgttctaagtttcta

SEQ ID NO: 4970741 - DNA, 14 bp, Homo sapiens
caaattaaaaagat

SEQ ID NO: 4970742 - DNA, 18 bp, Homo sapiens
caaattaaaaagattctt

SEQ ID NO: 4970743 - DNA, 21 bp, Homo sapiens
caaattaaaaagattcttttt

SEQ ID NO: 4970744 - DNA, 13 bp, Homo sapiens
caaattaatttta

SEQ ID NO: 4970745 - DNA, 15 bp, Homo sapiens
caaattagggcaatt

SEQ ID NO: 4970746 - DNA, 13 bp, Homo sapiens
caaattataaaaa

SEQ ID NO: 4970747 - DNA, 16 bp, Homo sapiens
caaattatttgtgtaa

SEQ ID NO: 4970748 - DNA, 21 bp, Homo sapiens
caaattggactttcaaaatta

SEQ ID NO: 4970749 - DNA, 22 bp, Homo sapiens
caaattgtcttttgtcatgtgg

SEQ ID NO: 4970750 - DNA, 18 bp, Homo sapiens
caaattgtgcttctcccc

SEQ ID NO: 4970751 - DNA, 17 bp, Homo sapiens
caaatttatcaaagcat

SEQ ID NO: 4970752 - DNA, 18 bp, Homo sapiens
attcaaaggttctaggtt

SEQ ID NO: 4970753 - DNA, 21 bp, Homo sapiens
attcaaaggttctaggtttca

SEQ ID NO: 4970754 - DNA, 20 bp, Homo sapiens
attcaaatgggtgatatcct

SEQ ID NO: 4970755 - DNA, 14 bp, Homo sapiens
attcaaccatggac

SEQ ID NO: 4970756 - DNA, 15 bp, Homo sapiens
attcaagttattgta

SEQ ID NO: 4970757 - DNA, 16 bp, Homo sapiens
attcaagttattgtac

SEQ ID NO: 4970758 - DNA, 15 bp, Homo sapiens
attcaatacaaacaa

SEQ ID NO: 4970759 - DNA, 20 bp, Homo sapiens
attcaatattgacatttgta

SEQ ID NO: 4970760 - DNA, 23 bp, Homo sapiens
attcaatgtttatgcaaggaagg

SEQ ID NO: 4970761 - DNA, 17 bp, Homo sapiens
attcacaaacttttata

SEQ ID NO: 4970762 - DNA, 15 bp, Homo sapiens
atttccttgtgcaaa

SEQ ID NO: 4970763 - DNA, 21 bp, Homo sapiens
atttcgccgttgaagaggaag

SEQ ID NO: 4970764 - DNA, 14 bp, Homo sapiens
atttctaaaaaaca

SEQ ID NO: 4970765 - DNA, 20 bp, Homo sapiens
atttctaaaaagattagcaa

SEQ ID NO: 4970766 - DNA, 21 bp, Homo sapiens
atttctaaagataatattact

SEQ ID NO: 4970767 - DNA, 18 bp, Homo sapiens
atttctaatgttggacac

SEQ ID NO: 4970768 - DNA, 16 bp, Homo sapiens
atttctagcctgcact

SEQ ID NO: 4970769 - DNA, 19 bp, Homo sapiens
atttctagcctgcactttg

SEQ ID NO: 4970770 - DNA, 22 bp, Homo sapiens
atttctcaacaaagcacagtgt

SEQ ID NO: 4970771 - DNA, 23 bp, Homo sapiens
atttctgagtttcattctcctgc

SEQ ID NO: 4970772 - DNA, 16 bp, Homo sapiens
atttctgctttctttg

SEQ ID NO: 4970773 - DNA, 20 bp, Homo sapiens
atttctgggtcttttgctac

SEQ ID NO: 4970774 - DNA, 23 bp, Homo sapiens
atttctgtaaataccattgacac

SEQ ID NO: 4970775 - DNA, 13 bp, Homo sapiens
atttcttcactgt

SEQ ID NO: 4970776 - DNA, 21 bp, Homo sapiens
atttcttgctctatctctcaa

SEQ ID NO: 4970777 - DNA, 16 bp, Homo sapiens
atttctttatatttat

SEQ ID NO: 4970778 - DNA, 19 bp, Homo sapiens
atttctttatatttatcca

SEQ ID NO: 4970779 - DNA, 21 bp, Homo sapiens
atttctttgttatcaaacttc

SEQ ID NO: 4970780 - DNA, 19 bp, Homo sapiens
atttcttttctttttacat

SEQ ID NO: 4970781 - DNA, 20 bp, Homo sapiens
atttcttttctttttacata

SEQ ID NO: 4970782 - DNA, 16 bp, Homo sapiens
atttgaagaacatgtg

SEQ ID NO: 4970783 - DNA, 18 bp, Homo sapiens
atttgaatgttaagcaga

SEQ ID NO: 4970784 - DNA, 21 bp, Homo sapiens
atttgaattaaaacttcttaa

SEQ ID NO: 4970785 - DNA, 13 bp, Homo sapiens
atttgactattct

SEQ ID NO: 4970786 - DNA, 13 bp, Homo sapiens
atttgatacataa

SEQ ID NO: 4970787 - DNA, 14 bp, Homo sapiens
atttgatacataat

SEQ ID NO: 4970788 - DNA, 15 bp, Homo sapiens
atttgatacttatat

SEQ ID NO: 4970789 - DNA, 15 bp, Homo sapiens
atttgatgccaggac

SEQ ID NO: 4970790 - DNA, 20 bp, Homo sapiens
atttgatgtttacaggtgga

SEQ ID NO: 4970791 - DNA, 16 bp, Homo sapiens
atttgattgatttgaa

SEQ ID NO: 4970792 - DNA, 13 bp, Homo sapiens
atttgatttctat

SEQ ID NO: 4970793 - DNA, 21 bp, Homo sapiens
atttgcaatattcctttgggc

SEQ ID NO: 4970794 - DNA, 15 bp, Homo sapiens
atttgcatctgaaat

SEQ ID NO: 4970795 - DNA, 19 bp, Homo sapiens
atttgcattaaattcacaa

SEQ ID NO: 4970796 - DNA, 15 bp, Homo sapiens
atttgccttgcagaa

SEQ ID NO: 4970797 - DNA, 17 bp, Homo sapiens
atttgccttgcagaact

SEQ ID NO: 4970798 - DNA, 19 bp, Homo sapiens
atttgccttgcagaactgc

SEQ ID NO: 4970799 - DNA, 15 bp, Homo sapiens
atttgctactgtaca

SEQ ID NO: 4970800 - DNA, 21 bp, Homo sapiens
atttgctagcagtaaaagatg

SEQ ID NO: 4970801 - DNA, 21 bp, Homo sapiens
atttggaaatcctagtttcct

SEQ ID NO: 4970802 - DNA, 15 bp, Homo sapiens
atttggaatactttt

SEQ ID NO: 4970803 - DNA, 23 bp, Homo sapiens
atttgggaaggtttgtgttttct

SEQ ID NO: 4970804 - DNA, 17 bp, Homo sapiens
atttgggagggaaaagg

SEQ ID NO: 4970805 - DNA, 14 bp, Homo sapiens
atttggggacagat

SEQ ID NO: 4970806 - DNA, 23 bp, Homo sapiens
atttggtacttttgagtgtgtgt

SEQ ID NO: 4970807 - DNA, 16 bp, Homo sapiens
atttggttcattaatt

SEQ ID NO: 4970808 - DNA, 21 bp, Homo sapiens
atttgtacatagttatttatt

SEQ ID NO: 4970809 - DNA, 19 bp, Homo sapiens
atttgtatctctgaagcat

SEQ ID NO: 4970810 - DNA, 23 bp, Homo sapiens
atttgtatctctgaagcatgttt

SEQ ID NO: 4970811 - DNA, 23 bp, Homo sapiens
atttgtgaaatgatggtgaaagt

SEQ ID NO: 4970812 - DNA, 15 bp, Homo sapiens
atttgtgagattcct

SEQ ID NO: 4970813 - DNA, 11 bp, Homo sapiens
atttgtggaat

SEQ ID NO: 4970814 - DNA, 20 bp, Homo sapiens
atttgtgttttaatttaaac

SEQ ID NO: 4970815 - DNA, 14 bp, Homo sapiens
atttgttaaaatta

SEQ ID NO: 4970816 - DNA, 21 bp, Homo sapiens
atttgttaaaattatcaatat

SEQ ID NO: 4970817 - DNA, 22 bp, Homo sapiens
atttgttagttcctgtatgaaa

SEQ ID NO: 4970818 - DNA, 12 bp, Homo sapiens
atttgttcaagt

SEQ ID NO: 4970819 - DNA, 23 bp, Homo sapiens
atttgttcactgaaggtgattca

SEQ ID NO: 4970820 - DNA, 12 bp, Homo sapiens
atttgttcatgt

SEQ ID NO: 4970821 - DNA, 13 bp, Homo sapiens
atttgttcatgtt

SEQ ID NO: 4970822 - DNA, 15 bp, Homo sapiens
atttgttcatgtttg

SEQ ID NO: 4970823 - DNA, 16 bp, Homo sapiens
attttaaaaacataga

SEQ ID NO: 4970824 - DNA, 14 bp, Homo sapiens
attttaaaaataca

SEQ ID NO: 4970825 - DNA, 17 bp, Homo sapiens
attttaaaaatacatat

SEQ ID NO: 4970826 - DNA, 19 bp, Homo sapiens
attttacacagaaacactg

SEQ ID NO: 4970827 - DNA, 19 bp, Homo sapiens
attttacacattagatttt

SEQ ID NO: 4970828 - DNA, 16 bp, Homo sapiens
attttaccagcagaag

SEQ ID NO: 4970829 - DNA, 16 bp, Homo sapiens
attttagaataaattc

SEQ ID NO: 4970830 - DNA, 22 bp, Homo sapiens
attttagatggaataagagaaa

SEQ ID NO: 4970831 - DNA, 18 bp, Homo sapiens
attttaggaacttcagag

SEQ ID NO: 4970832 - DNA, 19 bp, Homo sapiens
attttaggaacttcagaga

SEQ ID NO: 4970833 - DNA, 19 bp, Homo sapiens
attttaggagctaaggctc

SEQ ID NO: 4970834 - DNA, 20 bp, Homo sapiens
attttaggcactcttaaatg

SEQ ID NO: 4970835 - DNA, 13 bp, Homo sapiens
attttagtattca

SEQ ID NO: 4970836 - DNA, 13 bp, Homo sapiens
attttatttccat

SEQ ID NO: 4970837 - DNA, 21 bp, Homo sapiens
attttattttgtgctcattta

SEQ ID NO: 4970838 - DNA, 22 bp, Homo sapiens
attttattttgtgctcatttaa

SEQ ID NO: 4970839 - DNA, 20 bp, Homo sapiens
attttcaacgcagccctgct

SEQ ID NO: 4970840 - DNA, 13 bp, Homo sapiens
attttcaagaaac

SEQ ID NO: 4970841 - DNA, 17 bp, Homo sapiens
attttcaagaaactgag

SEQ ID NO: 4970842 - DNA, 23 bp, Homo sapiens
attttcaagaaactgaggaattt

SEQ ID NO: 4970843 - DNA, 20 bp, Homo sapiens
attttcacaatgtcagtatt

SEQ ID NO: 4970844 - DNA, 16 bp, Homo sapiens
attttcaccccaccct

SEQ ID NO: 4970845 - DNA, 22 bp, Homo sapiens
attttcagtaatgttattttct

SEQ ID NO: 4970846 - DNA, 12 bp, Homo sapiens
attttcagtatt

SEQ ID NO: 4970847 - DNA, 14 bp, Homo sapiens
attttcagtatttt

SEQ ID NO: 4970848 - DNA, 23 bp, Homo sapiens
attttcataacttattgctgatt

SEQ ID NO: 4970849 - DNA, 18 bp, Homo sapiens
attttcatgtatatgtgt

SEQ ID NO: 4970850 - DNA, 16 bp, Homo sapiens
attttcattacaatgg

SEQ ID NO: 4970851 - DNA, 19 bp, Homo sapiens
caaaataaaaagtgacaca

SEQ ID NO: 4970852 - DNA, 22 bp, Homo sapiens
caaaataattttaagaaatcaa

SEQ ID NO: 4970853 - DNA, 15 bp, Homo sapiens
caaaatatttcccat

SEQ ID NO: 4970854 - DNA, 23 bp, Homo sapiens
caaaatgacatctttttaaagct

SEQ ID NO: 4970855 - DNA, 16 bp, Homo sapiens
caaaatggaataaaag

SEQ ID NO: 4970856 - DNA, 22 bp, Homo sapiens
caaaatgttatcttctcaagtt

SEQ ID NO: 4970857 - DNA, 15 bp, Homo sapiens
caaaattaaatctgt

SEQ ID NO: 4970858 - DNA, 22 bp, Homo sapiens
caaaattgatgtgtttatttat

SEQ ID NO: 4970859 - DNA, 13 bp, Homo sapiens
caaaatttgtttg

SEQ ID NO: 4970860 - DNA, 17 bp, Homo sapiens
caaaattttctcatttt

SEQ ID NO: 4970861 - DNA, 16 bp, Homo sapiens
caaaatttttttaatc

SEQ ID NO: 4970862 - DNA, 18 bp, Homo sapiens
caaacaacagaaagtcat

SEQ ID NO: 4970863 - DNA, 22 bp, Homo sapiens
caaacaacagaaagtcattcct

SEQ ID NO: 4970864 - DNA, 17 bp, Homo sapiens
caaacaagaatgtccct

SEQ ID NO: 4970865 - DNA, 20 bp, Homo sapiens
caaacaatctcttaaattgg

SEQ ID NO: 4970866 - DNA, 21 bp, Homo sapiens
caaacaatctcttaaattggg

SEQ ID NO: 4970867 - DNA, 15 bp, Homo sapiens
caaacacctcccagg

SEQ ID NO: 4970868 - DNA, 21 bp, Homo sapiens
caaacaccttccagctcctgt

SEQ ID NO: 4970869 - DNA, 22 bp, Homo sapiens
caaacaccttcttattatatat

SEQ ID NO: 4970870 - DNA, 13 bp, Homo sapiens
caaacagaacagg

SEQ ID NO: 4970871 - DNA, 15 bp, Homo sapiens
caaacagaacagggt

SEQ ID NO: 4970872 - DNA, 17 bp, Homo sapiens
caaacatcactctgctg

SEQ ID NO: 4970873 - DNA, 14 bp, Homo sapiens
caaacatgtattta

SEQ ID NO: 4970874 - DNA, 15 bp, Homo sapiens
caaacatgtatttat

SEQ ID NO: 4970875 - DNA, 21 bp, Homo sapiens
attcaccaaaatagtcttctc

SEQ ID NO: 4970876 - DNA, 16 bp, Homo sapiens
attcaccaaaattatc

SEQ ID NO: 4970877 - DNA, 14 bp, Homo sapiens
attcacttgcattt

SEQ ID NO: 4970878 - DNA, 15 bp, Homo sapiens
attcagaatattcat

SEQ ID NO: 4970879 - DNA, 14 bp, Homo sapiens
attcagagaatatc

SEQ ID NO: 4970880 - DNA, 16 bp, Homo sapiens
attcagagaatatcaa

SEQ ID NO: 4970881 - DNA, 14 bp, Homo sapiens
attcagcaaaccat

SEQ ID NO: 4970882 - DNA, 20 bp, Homo sapiens
attcaggtatgttgccttta

SEQ ID NO: 4970883 - DNA, 19 bp, Homo sapiens
attcaggtgaaaatgttca

SEQ ID NO: 4970884 - DNA, 15 bp, Homo sapiens
attcagtcttgcctt

SEQ ID NO: 4970885 - DNA, 17 bp, Homo sapiens
attcagtcttgccttac

SEQ ID NO: 4970886 - DNA, 13 bp, Homo sapiens
attcagttttcat

SEQ ID NO: 4970887 - DNA, 15 bp, Homo sapiens
attcataaaaactgc

SEQ ID NO: 4970888 - DNA, 16 bp, Homo sapiens
attcatagtaacttct

SEQ ID NO: 4970889 - DNA, 17 bp, Homo sapiens
attcatagtaacttctt

SEQ ID NO: 4970890 - DNA, 16 bp, Homo sapiens
attcatattcttcata

SEQ ID NO: 4970891 - DNA, 15 bp, Homo sapiens
attcatattggaaaa

SEQ ID NO: 4970892 - DNA, 14 bp, Homo sapiens
attcatcagcattt

SEQ ID NO: 4970893 - DNA, 18 bp, Homo sapiens
attcatggaccactgttt

SEQ ID NO: 4970894 - DNA, 12 bp, Homo sapiens
attcattctcat

SEQ ID NO: 4970895 - DNA, 19 bp, Homo sapiens
attcattctgtgatcattt

SEQ ID NO: 4970896 - DNA, 22 bp, Homo sapiens
attcattctgtgatcatttatt

SEQ ID NO: 4970897 - DNA, 13 bp, Homo sapiens
attcattgtctct

SEQ ID NO: 4970898 - DNA, 20 bp, Homo sapiens
attccaaagagtagaattgc

SEQ ID NO: 4970899 - DNA, 15 bp, Homo sapiens
attccaaagctttat

SEQ ID NO: 4970900 - DNA, 15 bp, Homo sapiens
attccaacagtgagt

SEQ ID NO: 4970901 - DNA, 17 bp, Homo sapiens
attccaagactctagag

SEQ ID NO: 4970902 - DNA, 18 bp, Homo sapiens
attccaagactctagagt

SEQ ID NO: 4970903 - DNA, 18 bp, Homo sapiens
attccaatatgatgactc

SEQ ID NO: 4970904 - DNA, 23 bp, Homo sapiens
attccagaagaagagaagctgct

SEQ ID NO: 4970905 - DNA, 15 bp, Homo sapiens
attccagaatgctgt

SEQ ID NO: 4970906 - DNA, 19 bp, Homo sapiens
attccagaatgctgtacat

SEQ ID NO: 4970907 - DNA, 23 bp, Homo sapiens
attccagaatgctgtacatctat

SEQ ID NO: 4970908 - DNA, 18 bp, Homo sapiens
attccagagagtggctcc

SEQ ID NO: 4970909 - DNA, 19 bp, Homo sapiens
attccagagagtggctcct

SEQ ID NO: 4970910 - DNA, 17 bp, Homo sapiens
attccatatttattcaa

SEQ ID NO: 4970911 - DNA, 15 bp, Homo sapiens
attccatccataaat

SEQ ID NO: 4970912 - DNA, 12 bp, Homo sapiens
attccatgctaa

SEQ ID NO: 4970913 - DNA, 17 bp, Homo sapiens
attccatgctaagcaag

SEQ ID NO: 4970914 - DNA, 19 bp, Homo sapiens
attccattgcctagctctt

SEQ ID NO: 4970915 - DNA, 21 bp, Homo sapiens
attcccaactagacattacca

SEQ ID NO: 4970916 - DNA, 22 bp, Homo sapiens
attcccaactgagtgttatttg

SEQ ID NO: 4970917 - DNA, 14 bp, Homo sapiens
attcccaagaaatg

SEQ ID NO: 4970918 - DNA, 16 bp, Homo sapiens
attcccaagaaatgct

SEQ ID NO: 4970919 - DNA, 15 bp, Homo sapiens
attcccaagctctgc

SEQ ID NO: 4970920 - DNA, 17 bp, Homo sapiens
attcccaagctctgctc

SEQ ID NO: 4970921 - DNA, 18 bp, Homo sapiens
attcccaagctctgctcc

SEQ ID NO: 4970922 - DNA, 19 bp, Homo sapiens
attcccaagctctgctcct

SEQ ID NO: 4970923 - DNA, 19 bp, Homo sapiens
attcccagagcaaaataat

SEQ ID NO: 4970924 - DNA, 15 bp, Homo sapiens
attcctaagccactt

SEQ ID NO: 4970925 - DNA, 17 bp, Homo sapiens
attcctcaacgtattgt

SEQ ID NO: 4970926 - DNA, 20 bp, Homo sapiens
attcctgagatttcctcctg

SEQ ID NO: 4970927 - DNA, 18 bp, Homo sapiens
attcctgcatttgtgaaa

SEQ ID NO: 4970928 - DNA, 16 bp, Homo sapiens
attcctgtatgttgtc

SEQ ID NO: 4970929 - DNA, 17 bp, Homo sapiens
attcctgtatgttgtcc

SEQ ID NO: 4970930 - DNA, 14 bp, Homo sapiens
attccttctctgaa

SEQ ID NO: 4970931 - DNA, 16 bp, Homo sapiens
attccttctctgaaca

SEQ ID NO: 4970932 - DNA, 14 bp, Homo sapiens
attccttctggcct

SEQ ID NO: 4970933 - DNA, 14 bp, Homo sapiens
attccttctttgat

SEQ ID NO: 4970934 - DNA, 17 bp, Homo sapiens
attccttctttgataat

SEQ ID NO: 4970935 - DNA, 20 bp, Homo sapiens
attccttctttgataatgtt

SEQ ID NO: 4970936 - DNA, 23 bp, Homo sapiens
attccttctttgataatgttaaa

SEQ ID NO: 4970937 - DNA, 18 bp, Homo sapiens
attccttctttttaaaat

SEQ ID NO: 4970938 - DNA, 20 bp, Homo sapiens
attccttgatcattttggga

SEQ ID NO: 4970939 - DNA, 12 bp, Homo sapiens
attcctttccct

SEQ ID NO: 4970940 - DNA, 16 bp, Homo sapiens
attcctttcccttcct

SEQ ID NO: 4970941 - DNA, 20 bp, Homo sapiens
attcctttcccttcctcttc

SEQ ID NO: 4970942 - DNA, 23 bp, Homo sapiens
attctaaaatgtgatgttctaag

SEQ ID NO: 4970943 - DNA, 19 bp, Homo sapiens
attctaaagagcacttact

SEQ ID NO: 4970944 - DNA, 22 bp, Homo sapiens
attctaaagattctatagttct

SEQ ID NO: 4970945 - DNA, 18 bp, Homo sapiens
attctaacggtctgttct

SEQ ID NO: 4970946 - DNA, 23 bp, Homo sapiens
attctaatgatgatcaattatag

SEQ ID NO: 4970947 - DNA, 12 bp, Homo sapiens
attctaatgtct

SEQ ID NO: 4970948 - DNA, 13 bp, Homo sapiens
attctaatgtctt

SEQ ID NO: 4970949 - DNA, 22 bp, Homo sapiens
attctagatcagatgctccaag

SEQ ID NO: 4970950 - DNA, 13 bp, Homo sapiens
attctatatgaat

SEQ ID NO: 4970951 - DNA, 14 bp, Homo sapiens
attctatatgaatt

SEQ ID NO: 4970952 - DNA, 15 bp, Homo sapiens
attctattaaagtgc

SEQ ID NO: 4970953 - DNA, 18 bp, Homo sapiens
attctattgccttctttg

SEQ ID NO: 4970954 - DNA, 16 bp, Homo sapiens
attctattttagaata

SEQ ID NO: 4970955 - DNA, 19 bp, Homo sapiens
attctcataattcctacag

SEQ ID NO: 4970956 - DNA, 20 bp, Homo sapiens
attctcatctgcacccttct

SEQ ID NO: 4970957 - DNA, 18 bp, Homo sapiens
attctcattgcagaataa

SEQ ID NO: 4970958 - DNA, 15 bp, Homo sapiens
attctcctgcctcag

SEQ ID NO: 4970959 - DNA, 19 bp, Homo sapiens
attctcctgcctcagcctc

SEQ ID NO: 4970960 - DNA, 20 bp, Homo sapiens
attctcctgcctcagcctcc

SEQ ID NO: 4970961 - DNA, 17 bp, Homo sapiens
attctccttttatgtgt

SEQ ID NO: 4970962 - DNA, 19 bp, Homo sapiens
attctctggctgtaaggct

SEQ ID NO: 4970963 - DNA, 20 bp, Homo sapiens
attctctggctgtaaggctc

SEQ ID NO: 4970964 - DNA, 18 bp, Homo sapiens
attctctgtgtctaagat

SEQ ID NO: 4970965 - DNA, 20 bp, Homo sapiens
attctctgtgtctaagattc

SEQ ID NO: 4970966 - DNA, 19 bp, Homo sapiens
attctgagcatactcaaca

SEQ ID NO: 4970967 - DNA, 18 bp, Homo sapiens
attctgaggccctgccca

SEQ ID NO: 4970968 - DNA, 18 bp, Homo sapiens
attctgcagtaaatcttt

SEQ ID NO: 4970969 - DNA, 18 bp, Homo sapiens
attctgcccaaaaatatg

SEQ ID NO: 4970970 - DNA, 17 bp, Homo sapiens
attctgccctccttaat

SEQ ID NO: 4970971 - DNA, 21 bp, Homo sapiens
attctgccgccccctcctgaa

SEQ ID NO: 4970972 - DNA, 16 bp, Homo sapiens
attctgcctctctagg

SEQ ID NO: 4970973 - DNA, 13 bp, Homo sapiens
attctgcctgccc

SEQ ID NO: 4970974 - DNA, 15 bp, Homo sapiens
attctgcctgcccag

SEQ ID NO: 4970975 - DNA, 17 bp, Homo sapiens
attctgcctgcccaggc

SEQ ID NO: 4970976 - DNA, 20 bp, Homo sapiens
attctgctcacatatctgtc

SEQ ID NO: 4970977 - DNA, 14 bp, Homo sapiens
attctggctgaaaa

SEQ ID NO: 4970978 - DNA, 18 bp, Homo sapiens
attctgtgttgcattatt

SEQ ID NO: 4970979 - DNA, 20 bp, Homo sapiens
attctgttaaaatctattct

SEQ ID NO: 4970980 - DNA, 20 bp, Homo sapiens
attcttacactgcctgtata

SEQ ID NO: 4970981 - DNA, 23 bp, Homo sapiens
attcttacactgcctgtatactt

SEQ ID NO: 4970982 - DNA, 14 bp, Homo sapiens
attcttatgcttat

SEQ ID NO: 4970983 - DNA, 22 bp, Homo sapiens
attcttatgtagcaggaaataa

SEQ ID NO: 4970984 - DNA, 13 bp, Homo sapiens
attcttctagagt

SEQ ID NO: 4970985 - DNA, 11 bp, Homo sapiens
attcttctgct

SEQ ID NO: 4970986 - DNA, 20 bp, Homo sapiens
attcttgaaagaattttcct

SEQ ID NO: 4970987 - DNA, 12 bp, Homo sapiens
attcttgtgctt

SEQ ID NO: 4970988 - DNA, 21 bp, Homo sapiens
attctttatttctgtcattca

SEQ ID NO: 4970989 - DNA, 20 bp, Homo sapiens
attcttttctgcaaaataga

SEQ ID NO: 4970990 - DNA, 12 bp, Homo sapiens
attgaaatgtca

SEQ ID NO: 4970991 - DNA, 16 bp, Homo sapiens
attgaaattgtacata

SEQ ID NO: 4970992 - DNA, 19 bp, Homo sapiens
attgaaattgtgaactcat

SEQ ID NO: 4970993 - DNA, 16 bp, Homo sapiens
attgaacacaaactgt

SEQ ID NO: 4970994 - DNA, 15 bp, Homo sapiens
attgaagaaacagat

SEQ ID NO: 4970995 - DNA, 17 bp, Homo sapiens
attgaagaaacagatac

SEQ ID NO: 4970996 - DNA, 13 bp, Homo sapiens
attgaagacaatt

SEQ ID NO: 4970997 - DNA, 19 bp, Homo sapiens
attgaagacaatttgatac

SEQ ID NO: 4970998 - DNA, 17 bp, Homo sapiens
attgaaggaagccaaat

SEQ ID NO: 4970999 - DNA, 13 bp, Homo sapiens
attgaatattgtg

SEQ ID NO: 4971000 - DNA, 14 bp, Homo sapiens
attgaatattgtgt

SEQ ID NO: 4971001 - DNA, 23 bp, Homo sapiens
attgaatattgtgttccttttta

SEQ ID NO: 4971002 - DNA, 16 bp, Homo sapiens
attgacaaatctgtgt

SEQ ID NO: 4971003 - DNA, 13 bp, Homo sapiens
attgacatttgta

SEQ ID NO: 4971004 - DNA, 18 bp, Homo sapiens
attgacatttgtagttga

SEQ ID NO: 4971005 - DNA, 20 bp, Homo sapiens
attgacgattccttctctga

SEQ ID NO: 4971006 - DNA, 22 bp, Homo sapiens
attgactggtttacaggccctg

SEQ ID NO: 4971007 - DNA, 18 bp, Homo sapiens
attgacttcaatgatagt

SEQ ID NO: 4971008 - DNA, 19 bp, Homo sapiens
attgactttcagtaaacat

SEQ ID NO: 4971009 - DNA, 14 bp, Homo sapiens
attgagaaggagag

SEQ ID NO: 4971010 - DNA, 16 bp, Homo sapiens
attgagaaggagagaa

SEQ ID NO: 4971011 - DNA, 14 bp, Homo sapiens
attgagagttttgt

SEQ ID NO: 4971012 - DNA, 16 bp, Homo sapiens
attgagatactttttc

SEQ ID NO: 4971013 - DNA, 22 bp, Homo sapiens
attgagctgatataaattctgt

SEQ ID NO: 4971014 - DNA, 15 bp, Homo sapiens
attgaggaagagtct

SEQ ID NO: 4971015 - DNA, 15 bp, Homo sapiens
attgaggctttgtgt

SEQ ID NO: 4971016 - DNA, 19 bp, Homo sapiens
attgaggctttgtgttgta

SEQ ID NO: 4971017 - DNA, 14 bp, Homo sapiens
attgaggtaagttt

SEQ ID NO: 4971018 - DNA, 16 bp, Homo sapiens
attgaggtaagttttt

SEQ ID NO: 4971019 - DNA, 15 bp, Homo sapiens
attgagtcaaatggt

SEQ ID NO: 4971020 - DNA, 21 bp, Homo sapiens
attgagtttgtaggtaaaatg

SEQ ID NO: 4971021 - DNA, 21 bp, Homo sapiens
attgatactctttctaatgct

SEQ ID NO: 4971022 - DNA, 15 bp, Homo sapiens
attgatcataaactg

SEQ ID NO: 4971023 - DNA, 21 bp, Homo sapiens
attgatgaaaagatttaagca

SEQ ID NO: 4971024 - DNA, 19 bp, Homo sapiens
attgatgtgtttatttata

SEQ ID NO: 4971025 - DNA, 20 bp, Homo sapiens
attgatttgcattgaacaca

SEQ ID NO: 4971026 - DNA, 12 bp, Homo sapiens
attgcaaatctt

SEQ ID NO: 4971027 - DNA, 17 bp, Homo sapiens
attgcaacaggctgggc

SEQ ID NO: 4971028 - DNA, 18 bp, Homo sapiens
attgcaacaggctgggct

SEQ ID NO: 4971029 - DNA, 14 bp, Homo sapiens
attgcataaagcat

SEQ ID NO: 4971030 - DNA, 15 bp, Homo sapiens
attgcataaagcata

SEQ ID NO: 4971031 - DNA, 18 bp, Homo sapiens
attgcatcacctctgtaa

SEQ ID NO: 4971032 - DNA, 19 bp, Homo sapiens
attgcatctcaaaattatt

SEQ ID NO: 4971033 - DNA, 21 bp, Homo sapiens
attgccaccaggagaaccact

SEQ ID NO: 4971034 - DNA, 21 bp, Homo sapiens
attgcccacgctggagtgcag

SEQ ID NO: 4971035 - DNA, 16 bp, Homo sapiens
attgccttctttgaag

SEQ ID NO: 4971036 - DNA, 17 bp, Homo sapiens
attgccttctttgaaga

SEQ ID NO: 4971037 - DNA, 20 bp, Homo sapiens
attgccttctttgaagaagg

SEQ ID NO: 4971038 - DNA, 13 bp, Homo sapiens
attgcgctgctac

SEQ ID NO: 4971039 - DNA, 16 bp, Homo sapiens
attgcggacagccacg

SEQ ID NO: 4971040 - DNA, 20 bp, Homo sapiens
attgcgtttgaccttttatg

SEQ ID NO: 4971041 - DNA, 21 bp, Homo sapiens
attgcgtttgaccttttatgt

SEQ ID NO: 4971042 - DNA, 15 bp, Homo sapiens
attgctactgtccta

SEQ ID NO: 4971043 - DNA, 20 bp, Homo sapiens
attgctactgtcctacccac

SEQ ID NO: 4971044 - DNA, 22 bp, Homo sapiens
attgctactgtcctacccaccc

SEQ ID NO: 4971045 - DNA, 14 bp, Homo sapiens
attgctagtatttg

SEQ ID NO: 4971046 - DNA, 16 bp, Homo sapiens
attgctagtatttgaa

SEQ ID NO: 4971047 - DNA, 19 bp, Homo sapiens
attgctagtatttgaatta

SEQ ID NO: 4971048 - DNA, 23 bp, Homo sapiens
attgctatctggaggccttccag

SEQ ID NO: 4971049 - DNA, 19 bp, Homo sapiens
attgctccctaagactgtg

SEQ ID NO: 4971050 - DNA, 21 bp, Homo sapiens
attgctgaagggcattctttc

SEQ ID NO: 4971051 - DNA, 16 bp, Homo sapiens
attgcttagtaaaatt

SEQ ID NO: 4971052 - DNA, 18 bp, Homo sapiens
attgcttgagcccaggag

SEQ ID NO: 4971053 - DNA, 23 bp, Homo sapiens
attgctttgaagcagttgtgtca

SEQ ID NO: 4971054 - DNA, 14 bp, Homo sapiens
attgctttggtcat

SEQ ID NO: 4971055 - DNA, 16 bp, Homo sapiens
attgcttttttaaata

SEQ ID NO: 4971056 - DNA, 14 bp, Homo sapiens
attggaatctgata

SEQ ID NO: 4971057 - DNA, 21 bp, Homo sapiens
attggagagggctctgtgctg

SEQ ID NO: 4971058 - DNA, 20 bp, Homo sapiens
attggagatgccatcctctt

SEQ ID NO: 4971059 - DNA, 16 bp, Homo sapiens
attggattatcctgag

SEQ ID NO: 4971060 - DNA, 18 bp, Homo sapiens
attggattatttaataac

SEQ ID NO: 4971061 - DNA, 19 bp, Homo sapiens
attggattatttaataaca

SEQ ID NO: 4971062 - DNA, 18 bp, Homo sapiens
attggcatggatttctgt

SEQ ID NO: 4971063 - DNA, 14 bp, Homo sapiens
attggcatggcttt

SEQ ID NO: 4971064 - DNA, 19 bp, Homo sapiens
attggcttgtagaattgtt

SEQ ID NO: 4971065 - DNA, 18 bp, Homo sapiens
attgggagcttgggaatg

SEQ ID NO: 4971066 - DNA, 21 bp, Homo sapiens
attgggagcttgggaatggat

SEQ ID NO: 4971067 - DNA, 22 bp, Homo sapiens
attgggagtccaggcacaggat

SEQ ID NO: 4971068 - DNA, 22 bp, Homo sapiens
attgggggggccaaaaggaaaa

SEQ ID NO: 4971069 - DNA, 14 bp, Homo sapiens
attgggttcatgat

SEQ ID NO: 4971070 - DNA, 18 bp, Homo sapiens
attggtattcactaatct

SEQ ID NO: 4971071 - DNA, 14 bp, Homo sapiens
attggtctaattta

SEQ ID NO: 4971072 - DNA, 20 bp, Homo sapiens
attgtaaaacctgtcaatga

SEQ ID NO: 4971073 - DNA, 19 bp, Homo sapiens
attgtaaaatagcttgtat

SEQ ID NO: 4971074 - DNA, 15 bp, Homo sapiens
attgtaaattttaga

SEQ ID NO: 4971075 - DNA, 20 bp, Homo sapiens
attgtacagctgtttaagat

SEQ ID NO: 4971076 - DNA, 15 bp, Homo sapiens
attgtacataaaaga

SEQ ID NO: 4971077 - DNA, 20 bp, Homo sapiens
attgtacatatttgtggaat

SEQ ID NO: 4971078 - DNA, 18 bp, Homo sapiens
attgtactacctgtgtat

SEQ ID NO: 4971079 - DNA, 21 bp, Homo sapiens
attgtataaactatcagtttg

SEQ ID NO: 4971080 - DNA, 13 bp, Homo sapiens
attgtatgatgtg

SEQ ID NO: 4971081 - DNA, 15 bp, Homo sapiens
attgtcgctattgat

SEQ ID NO: 4971082 - DNA, 17 bp, Homo sapiens
attgtgaactcattgct

SEQ ID NO: 4971083 - DNA, 16 bp, Homo sapiens
attgtgagccaccacg

SEQ ID NO: 4971084 - DNA, 19 bp, Homo sapiens
attgtgccaatatgtattg

SEQ ID NO: 4971085 - DNA, 12 bp, Homo sapiens
attgtgctgcca

SEQ ID NO: 4971086 - DNA, 20 bp, Homo sapiens
attgtgcttcacagtagagc

SEQ ID NO: 4971087 - DNA, 24 bp, Homo sapiens
attgtgcttcacagtagagccagc

SEQ ID NO: 4971088 - DNA, 18 bp, Homo sapiens
attgtgggggaaaaataa

SEQ ID NO: 4971089 - DNA, 14 bp, Homo sapiens
attgtgttgtgaat

SEQ ID NO: 4971090 - DNA, 17 bp, Homo sapiens
attgtgttgtgaatgtt

SEQ ID NO: 4971091 - DNA, 13 bp, Homo sapiens
attgttatttata

SEQ ID NO: 4971092 - DNA, 14 bp, Homo sapiens
attgttcaaacaat

SEQ ID NO: 4971093 - DNA, 18 bp, Homo sapiens
attgttgacaactgtgac

SEQ ID NO: 4971094 - DNA, 18 bp, Homo sapiens
attgttgacagttctgaa

SEQ ID NO: 4971095 - DNA, 16 bp, Homo sapiens
attgttgagctattgc

SEQ ID NO: 4971096 - DNA, 16 bp, Homo sapiens
attgttgctgaaactt

SEQ ID NO: 4971097 - DNA, 17 bp, Homo sapiens
attaaagtgctaaggtt

SEQ ID NO: 4971098 - DNA, 20 bp, Homo sapiens
attaaagtgctaaggttcta

SEQ ID NO: 4971099 - DNA, 22 bp, Homo sapiens
attaaagtgctaaggttctaag

SEQ ID NO: 4971100 - DNA, 18 bp, Homo sapiens
attaaatgaatattttga

SEQ ID NO: 4971101 - DNA, 14 bp, Homo sapiens
attaaatgtcttat

SEQ ID NO: 4971102 - DNA, 13 bp, Homo sapiens
attaaattaagac

SEQ ID NO: 4971103 - DNA, 12 bp, Homo sapiens
attaaatttaat

SEQ ID NO: 4971104 - DNA, 17 bp, Homo sapiens
atgacatgttatatatt

SEQ ID NO: 4971105 - DNA, 15 bp, Homo sapiens
atgaccaaagtcctt

SEQ ID NO: 4971106 - DNA, 18 bp, Homo sapiens
atgaccagatgcgtccca

SEQ ID NO: 4971107 - DNA, 21 bp, Homo sapiens
atgaccagatgcgtcccaaga

SEQ ID NO: 4971108 - DNA, 14 bp, Homo sapiens
atgacctggataac

SEQ ID NO: 4971109 - DNA, 13 bp, Homo sapiens
atgactaattagg

SEQ ID NO: 4971110 - DNA, 18 bp, Homo sapiens
atgactggggtgggaggt

SEQ ID NO: 4971111 - DNA, 22 bp, Homo sapiens
atgagaaaggttgaagcaccaa

SEQ ID NO: 4971112 - DNA, 16 bp, Homo sapiens
atgagaacaaagctgt

SEQ ID NO: 4971113 - DNA, 15 bp, Homo sapiens
atgagaaggcagcca

SEQ ID NO: 4971114 - DNA, 15 bp, Homo sapiens
atgagactctagggt

SEQ ID NO: 4971115 - DNA, 18 bp, Homo sapiens
atgagagcccagaggtaa

SEQ ID NO: 4971116 - DNA, 19 bp, Homo sapiens
atgagatgcgttgttacag

SEQ ID NO: 4971117 - DNA, 12 bp, Homo sapiens
atgagatgctgg

SEQ ID NO: 4971118 - DNA, 14 bp, Homo sapiens
atgagatgtgtgga

SEQ ID NO: 4971119 - DNA, 13 bp, Homo sapiens
atgagcacctcca

SEQ ID NO: 4971120 - DNA, 17 bp, Homo sapiens
atgagcatcctgagccc

SEQ ID NO: 4971121 - DNA, 18 bp, Homo sapiens
atgagcatcctgagcccc

SEQ ID NO: 4971122 - DNA, 12 bp, Homo sapiens
atgagcccagag

SEQ ID NO: 4971123 - DNA, 14 bp, Homo sapiens
atgagcccagagaa

SEQ ID NO: 4971124 - DNA, 14 bp, Homo sapiens
atgagccctaaaaa

SEQ ID NO: 4971125 - DNA, 23 bp, Homo sapiens
atgagccgctgtgagcccctggt

SEQ ID NO: 4971126 - DNA, 19 bp, Homo sapiens
atgagcctcagcatcctgg

SEQ ID NO: 4971127 - DNA, 21 bp, Homo sapiens
atgagcctcagcatcctggca

SEQ ID NO: 4971128 - DNA, 16 bp, Homo sapiens
atgaggaactgtagat

SEQ ID NO: 4971129 - DNA, 21 bp, Homo sapiens
atgaggaactgtagatgatgt

SEQ ID NO: 4971130 - DNA, 18 bp, Homo sapiens
atgaggcaatgtcaggaa

SEQ ID NO: 4971131 - DNA, 18 bp, Homo sapiens
atgaggtcagagcctgca

SEQ ID NO: 4971132 - DNA, 19 bp, Homo sapiens
atgaggtcagagcctgcag

SEQ ID NO: 4971133 - DNA, 16 bp, Homo sapiens
atgaggtcccaggcag

SEQ ID NO: 4971134 - DNA, 16 bp, Homo sapiens
atgaggtctgggctag

SEQ ID NO: 4971135 - DNA, 18 bp, Homo sapiens
atgagtaactattattat

SEQ ID NO: 4971136 - DNA, 18 bp, Homo sapiens
atgagtatacaatatata

SEQ ID NO: 4971137 - DNA, 23 bp, Homo sapiens
atgagtatacaatatataaaaat

SEQ ID NO: 4971138 - DNA, 19 bp, Homo sapiens
atgagtattagttccctgt

SEQ ID NO: 4971139 - DNA, 21 bp, Homo sapiens
atgagtccttgaaaatatttt

SEQ ID NO: 4971140 - DNA, 20 bp, Homo sapiens
atgagttgtgaaagttttga

SEQ ID NO: 4971141 - DNA, 15 bp, Homo sapiens
atgagtttgccctgg

SEQ ID NO: 4971142 - DNA, 14 bp, Homo sapiens
atgagtttgcttat

SEQ ID NO: 4971143 - DNA, 17 bp, Homo sapiens
atgatacaatgaacact

SEQ ID NO: 4971144 - DNA, 21 bp, Homo sapiens
atgatactatcatactactga

SEQ ID NO: 4971145 - DNA, 14 bp, Homo sapiens
atgatatccctgat

SEQ ID NO: 4971146 - DNA, 17 bp, Homo sapiens
atgatcaatcctttatt

SEQ ID NO: 4971147 - DNA, 18 bp, Homo sapiens
atgatcaatcctttatta

SEQ ID NO: 4971148 - DNA, 22 bp, Homo sapiens
atgatctcttcttttggcttcc

SEQ ID NO: 4971149 - DNA, 19 bp, Homo sapiens
atgatctgcctctaaaagc

SEQ ID NO: 4971150 - DNA, 21 bp, Homo sapiens
atgatcttgagtataagaaat

SEQ ID NO: 4971151 - DNA, 19 bp, Homo sapiens
atgatgagaatttctaaaa

SEQ ID NO: 4971152 - DNA, 16 bp, Homo sapiens
atgatgccctgctcca

SEQ ID NO: 4971153 - DNA, 15 bp, Homo sapiens
atgatggatgccaat

SEQ ID NO: 4971154 - DNA, 14 bp, Homo sapiens
atgatgtgttgtga

SEQ ID NO: 4971155 - DNA, 14 bp, Homo sapiens
atgattcagaaatt

SEQ ID NO: 4971156 - DNA, 15 bp, Homo sapiens
atgattcatgttata

SEQ ID NO: 4971157 - DNA, 23 bp, Homo sapiens
atgattctatttatatgtacatg

SEQ ID NO: 4971158 - DNA, 12 bp, Homo sapiens
atgattgtttct

SEQ ID NO: 4971159 - DNA, 14 bp, Homo sapiens
atgatttaataaaa

SEQ ID NO: 4971160 - DNA, 16 bp, Homo sapiens
atgatttaataaaata

SEQ ID NO: 4971161 - DNA, 18 bp, Homo sapiens
atgatttaataaaataat

SEQ ID NO: 4971162 - DNA, 19 bp, Homo sapiens
atgatttaataaaataatt

SEQ ID NO: 4971163 - DNA, 14 bp, Homo sapiens
atgatttatagttt

SEQ ID NO: 4971164 - DNA, 15 bp, Homo sapiens
atgatttatagtttg

SEQ ID NO: 4971165 - DNA, 20 bp, Homo sapiens
atgatttatagtttgtacat

SEQ ID NO: 4971166 - DNA, 18 bp, Homo sapiens
atgatttcactagaaaag

SEQ ID NO: 4971167 - DNA, 19 bp, Homo sapiens
atgatttccttgaatgtgg

SEQ ID NO: 4971168 - DNA, 21 bp, Homo sapiens
atgatttccttgaatgtggct

SEQ ID NO: 4971169 - DNA, 17 bp, Homo sapiens
atgatttgtagtggaaa

SEQ ID NO: 4971170 - DNA, 20 bp, Homo sapiens
atgattttttaaaagaaatt

SEQ ID NO: 4971171 - DNA, 23 bp, Homo sapiens
atgcaaaaagaaatgactaatta

SEQ ID NO: 4971172 - DNA, 12 bp, Homo sapiens
atgcaaaatgga

SEQ ID NO: 4971173 - DNA, 19 bp, Homo sapiens
atgcaaagtacaatgtgtt

SEQ ID NO: 4971174 - DNA, 14 bp, Homo sapiens
atgcaaagttctgt

SEQ ID NO: 4971175 - DNA, 20 bp, Homo sapiens
atgcaagagtgattgcagct

SEQ ID NO: 4971176 - DNA, 13 bp, Homo sapiens
atgcaaggaagga

SEQ ID NO: 4971177 - DNA, 14 bp, Homo sapiens
atgcaaggaaggaa

SEQ ID NO: 4971178 - DNA, 15 bp, Homo sapiens
atgcaaggaaggaaa

SEQ ID NO: 4971179 - DNA, 16 bp, Homo sapiens
atgcaaggaaggaaag

SEQ ID NO: 4971180 - DNA, 22 bp, Homo sapiens
atgcaaggaccaggactccctc

SEQ ID NO: 4971181 - DNA, 12 bp, Homo sapiens
atgcaatttgat

SEQ ID NO: 4971182 - DNA, 19 bp, Homo sapiens
atgcacagatatactttgt

SEQ ID NO: 4971183 - DNA, 18 bp, Homo sapiens
atgcacatatggactctg

SEQ ID NO: 4971184 - DNA, 11 bp, Homo sapiens
atgcaccaaac

SEQ ID NO: 4971185 - DNA, 16 bp, Homo sapiens
atgcactatgaggaat

SEQ ID NO: 4971186 - DNA, 22 bp, Homo sapiens
atgcactgacccttccagacat

SEQ ID NO: 4971187 - DNA, 22 bp, Homo sapiens
atgcagagagccattttgtgaa

SEQ ID NO: 4971188 - DNA, 15 bp, Homo sapiens
atgcagcccatgccc

SEQ ID NO: 4971189 - DNA, 18 bp, Homo sapiens
atgcagccgccttccttg

SEQ ID NO: 4971190 - DNA, 19 bp, Homo sapiens
atgcagccgccttccttga

SEQ ID NO: 4971191 - DNA, 13 bp, Homo sapiens
atgcagtctcctc

SEQ ID NO: 4971192 - DNA, 16 bp, Homo sapiens
atgcagtctcctcttt

SEQ ID NO: 4971193 - DNA, 18 bp, Homo sapiens
atgcagtctcctctttaa

SEQ ID NO: 4971194 - DNA, 14 bp, Homo sapiens
atgcataaatatgc

SEQ ID NO: 4971195 - DNA, 21 bp, Homo sapiens
atgcataaatatgcagtgata

SEQ ID NO: 4971196 - DNA, 15 bp, Homo sapiens
atgcataattcacat

SEQ ID NO: 4971197 - DNA, 16 bp, Homo sapiens
atgcatgacagcctct

SEQ ID NO: 4971198 - DNA, 12 bp, Homo sapiens
atgcatggaaac

SEQ ID NO: 4971199 - DNA, 23 bp, Homo sapiens
atgcatggagggctgccctgtac

SEQ ID NO: 4971200 - DNA, 23 bp, Homo sapiens
atgcatgtggtttggttcctctc

SEQ ID NO: 4971201 - DNA, 12 bp, Homo sapiens
atgcattaaacc

SEQ ID NO: 4971202 - DNA, 22 bp, Homo sapiens
atgccaaagctagggtggccct

SEQ ID NO: 4971203 - DNA, 22 bp, Homo sapiens
atgccaagaaaagggctgacat

SEQ ID NO: 4971204 - DNA, 16 bp, Homo sapiens
atgccaatactagtca

SEQ ID NO: 4971205 - DNA, 22 bp, Homo sapiens
atgccaattagcaattgactgt

SEQ ID NO: 4971206 - DNA, 14 bp, Homo sapiens
atgccacgttccac

SEQ ID NO: 4971207 - DNA, 18 bp, Homo sapiens
atgccagctcagtcccat

SEQ ID NO: 4971208 - DNA, 19 bp, Homo sapiens
atgccagctcagtcccatc

SEQ ID NO: 4971209 - DNA, 21 bp, Homo sapiens
atgccatcctctttctctttt

SEQ ID NO: 4971210 - DNA, 20 bp, Homo sapiens
atgcccacctgcccatcaca

SEQ ID NO: 4971211 - DNA, 17 bp, Homo sapiens
atgcccacgttctttcc

SEQ ID NO: 4971212 - DNA, 21 bp, Homo sapiens
atgcccatttgcctttaaaaa

SEQ ID NO: 4971213 - DNA, 14 bp, Homo sapiens
atgccccaaatata

SEQ ID NO: 4971214 - DNA, 16 bp, Homo sapiens
ataacttgatgcatgt

SEQ ID NO: 4971215 - DNA, 14 bp, Homo sapiens
ataagaagcaaata

SEQ ID NO: 4971216 - DNA, 14 bp, Homo sapiens
ataagacataacgt

SEQ ID NO: 4971217 - DNA, 11 bp, Homo sapiens
ataagattcta

SEQ ID NO: 4971218 - DNA, 19 bp, Homo sapiens
ataagcaaatttcaaaaga

SEQ ID NO: 4971219 - DNA, 17 bp, Homo sapiens
ataagtaattcaagaaa

SEQ ID NO: 4971220 - DNA, 14 bp, Homo sapiens
ataagtgaatttat

SEQ ID NO: 4971221 - DNA, 19 bp, Homo sapiens
ataagtgcacacagaaata

SEQ ID NO: 4971222 - DNA, 21 bp, Homo sapiens
ataagtgcacacagaaatata

SEQ ID NO: 4971223 - DNA, 13 bp, Homo sapiens
ataagttcacaaa

SEQ ID NO: 4971224 - DNA, 15 bp, Homo sapiens
ataagttcacaaaat

SEQ ID NO: 4971225 - DNA, 13 bp, Homo sapiens
ataagtttgaagg

SEQ ID NO: 4971226 - DNA, 19 bp, Homo sapiens
ataagtttgaaggaaacag

SEQ ID NO: 4971227 - DNA, 21 bp, Homo sapiens
ataagtttgaaggaaacagtt

SEQ ID NO: 4971228 - DNA, 13 bp, Homo sapiens
ataataaacataa

SEQ ID NO: 4971229 - DNA, 18 bp, Homo sapiens
ataataaaggactgtaat

SEQ ID NO: 4971230 - DNA, 14 bp, Homo sapiens
ataataatttttat

SEQ ID NO: 4971231 - DNA, 12 bp, Homo sapiens
ataatacctcaa

SEQ ID NO: 4971232 - DNA, 16 bp, Homo sapiens
ataatacctcaatgtt

SEQ ID NO: 4971233 - DNA, 12 bp, Homo sapiens
ataatagattct

SEQ ID NO: 4971234 - DNA, 13 bp, Homo sapiens
ataatagattctc

SEQ ID NO: 4971235 - DNA, 18 bp, Homo sapiens
ataatataccaatgcttt

SEQ ID NO: 4971236 - DNA, 10 bp, Homo sapiens
ataatatata

SEQ ID NO: 4971237 - DNA, 23 bp, Homo sapiens
ataatatattctatttttatact

SEQ ID NO: 4971238 - DNA, 13 bp, Homo sapiens
ataatatgatttt

SEQ ID NO: 4971239 - DNA, 17 bp, Homo sapiens
ataatatggctatgctt

SEQ ID NO: 4971240 - DNA, 22 bp, Homo sapiens
ataatattgttgtataatttcg

SEQ ID NO: 4971241 - DNA, 16 bp, Homo sapiens
ataatattgtttttct

SEQ ID NO: 4971242 - DNA, 13 bp, Homo sapiens
ataatcagcctct

SEQ ID NO: 4971243 - DNA, 15 bp, Homo sapiens
ataatcagcctctta

SEQ ID NO: 4971244 - DNA, 15 bp, Homo sapiens
ataatcccagcactt

SEQ ID NO: 4971245 - DNA, 12 bp, Homo sapiens
ataatctagaac

SEQ ID NO: 4971246 - DNA, 15 bp, Homo sapiens
ataatgataaaacac

SEQ ID NO: 4971247 - DNA, 16 bp, Homo sapiens
ataatgataaaacacc

SEQ ID NO: 4971248 - DNA, 15 bp, Homo sapiens
ataatgctactgtct

SEQ ID NO: 4971249 - DNA, 17 bp, Homo sapiens
ataatgcttaatttcta

SEQ ID NO: 4971250 - DNA, 17 bp, Homo sapiens
ataatggaagagaaatc

SEQ ID NO: 4971251 - DNA, 13 bp, Homo sapiens
ataatgtgtgtat

SEQ ID NO: 4971252 - DNA, 17 bp, Homo sapiens
ataattaggttaacatt

SEQ ID NO: 4971253 - DNA, 13 bp, Homo sapiens
ataattcactcaa

SEQ ID NO: 4971254 - DNA, 20 bp, Homo sapiens
ataattcactcaagcactga

SEQ ID NO: 4971255 - DNA, 16 bp, Homo sapiens
ataattcctacagcac

SEQ ID NO: 4971256 - DNA, 18 bp, Homo sapiens
ataattcctacagcacta

SEQ ID NO: 4971257 - DNA, 13 bp, Homo sapiens
ataattctgtaaa

SEQ ID NO: 4971258 - DNA, 15 bp, Homo sapiens
ataattgttgaaatt

SEQ ID NO: 4971259 - DNA, 20 bp, Homo sapiens
ataattgttgaaattttgca

SEQ ID NO: 4971260 - DNA, 21 bp, Homo sapiens
ataattgttgaaattttgcaa

SEQ ID NO: 4971261 - DNA, 23 bp, Homo sapiens
ataatttaactacccttaattac

SEQ ID NO: 4971262 - DNA, 12 bp, Homo sapiens
ataatttctaat

SEQ ID NO: 4971263 - DNA, 14 bp, Homo sapiens
ataattttaagaaa

SEQ ID NO: 4971264 - DNA, 21 bp, Homo sapiens
ataattttagtgtcatttcca

SEQ ID NO: 4971265 - DNA, 14 bp, Homo sapiens
ataattttctgaaa

SEQ ID NO: 4971266 - DNA, 16 bp, Homo sapiens
ataattttttattcaa

SEQ ID NO: 4971267 - DNA, 18 bp, Homo sapiens
atacaaacctaccaaaat

SEQ ID NO: 4971268 - DNA, 16 bp, Homo sapiens
atacaaattaaaaaga

SEQ ID NO: 4971269 - DNA, 17 bp, Homo sapiens
atacaaattaaaaagat

SEQ ID NO: 4971270 - DNA, 19 bp, Homo sapiens
atacaacaaaggcaagtta

SEQ ID NO: 4971271 - DNA, 22 bp, Homo sapiens
atacaacaaaggcaagttaaga

SEQ ID NO: 4971272 - DNA, 23 bp, Homo sapiens
atacaacaaaggcaagttaagag

SEQ ID NO: 4971273 - DNA, 20 bp, Homo sapiens
atacaacatgtagctgagtt

SEQ ID NO: 4971274 - DNA, 16 bp, Homo sapiens
atacaacctccctctt

SEQ ID NO: 4971275 - DNA, 12 bp, Homo sapiens
atacaagccaaa

SEQ ID NO: 4971276 - DNA, 19 bp, Homo sapiens
atacaagttcttggtccct

SEQ ID NO: 4971277 - DNA, 18 bp, Homo sapiens
atacaatgaacacttata

SEQ ID NO: 4971278 - DNA, 15 bp, Homo sapiens
atacaattctacatt

SEQ ID NO: 4971279 - DNA, 21 bp, Homo sapiens
atacacatatacctataatgt

SEQ ID NO: 4971280 - DNA, 14 bp, Homo sapiens
atacaccgggcctg

SEQ ID NO: 4971281 - DNA, 21 bp, Homo sapiens
atacagaggaaatctgtaaca

SEQ ID NO: 4971282 - DNA, 22 bp, Homo sapiens
atacaggaaaagctgctgacag

SEQ ID NO: 4971283 - DNA, 23 bp, Homo sapiens
atacaggaaaagctgctgacagt

SEQ ID NO: 4971284 - DNA, 17 bp, Homo sapiens
atacagtaactttatgt

SEQ ID NO: 4971285 - DNA, 18 bp, Homo sapiens
atacagtaactttatgtg

SEQ ID NO: 4971286 - DNA, 17 bp, Homo sapiens
atacagtccctaaagaa

SEQ ID NO: 4971287 - DNA, 20 bp, Homo sapiens
atacagtccctaaagaaaaa

SEQ ID NO: 4971288 - DNA, 22 bp, Homo sapiens
atacagtccctaaagaaaaaaa

SEQ ID NO: 4971289 - DNA, 15 bp, Homo sapiens
atacagttcaataaa

SEQ ID NO: 4971290 - DNA, 15 bp, Homo sapiens
atacagttttatgct

SEQ ID NO: 4971291 - DNA, 19 bp, Homo sapiens
atacataactaaatttgat

SEQ ID NO: 4971292 - DNA, 21 bp, Homo sapiens
atacataactaaatttgatac

SEQ ID NO: 4971293 - DNA, 24 bp, Homo sapiens
atacataactaaatttgatactta

SEQ ID NO: 4971294 - DNA, 21 bp, Homo sapiens
atacataagcggcgtaagttt

SEQ ID NO: 4971295 - DNA, 16 bp, Homo sapiens
atacatatcgctgact

SEQ ID NO: 4971296 - DNA, 18 bp, Homo sapiens
atacatatgtagactata

SEQ ID NO: 4971297 - DNA, 21 bp, Homo sapiens
atacatatgtagactatatac

SEQ ID NO: 4971298 - DNA, 22 bp, Homo sapiens
atacatatgtagactatataca

SEQ ID NO: 4971299 - DNA, 12 bp, Homo sapiens
atacatcactgc

SEQ ID NO: 4971300 - DNA, 15 bp, Homo sapiens
atacatcactgcttg

SEQ ID NO: 4971301 - DNA, 15 bp, Homo sapiens
atacatcctgggtaa

SEQ ID NO: 4971302 - DNA, 22 bp, Homo sapiens
atacatgtgtgtatatatgtgt

SEQ ID NO: 4971303 - DNA, 16 bp, Homo sapiens
atacattagtaaatgt

SEQ ID NO: 4971304 - DNA, 17 bp, Homo sapiens
ataccaagtatttatta

SEQ ID NO: 4971305 - DNA, 16 bp, Homo sapiens
ataccagactgcaggt

SEQ ID NO: 4971306 - DNA, 19 bp, Homo sapiens
ataccagcttgtatgcaat

SEQ ID NO: 4971307 - DNA, 21 bp, Homo sapiens
ataccatactcatttctaaaa

SEQ ID NO: 4971308 - DNA, 20 bp, Homo sapiens
ataccattttttaaggaaac

SEQ ID NO: 4971309 - DNA, 15 bp, Homo sapiens
atacccttcttttat

SEQ ID NO: 4971310 - DNA, 14 bp, Homo sapiens
atcagagcaggacc

SEQ ID NO: 4971311 - DNA, 15 bp, Homo sapiens
atcagagcaggacct

SEQ ID NO: 4971312 - DNA, 13 bp, Homo sapiens
atcagagctcctc

SEQ ID NO: 4971313 - DNA, 18 bp, Homo sapiens
atcagagtagaaataaaa

SEQ ID NO: 4971314 - DNA, 23 bp, Homo sapiens
atcagagtagaaataaaagtgaa

SEQ ID NO: 4971315 - DNA, 14 bp, Homo sapiens
atcagatacatcac

SEQ ID NO: 4971316 - DNA, 17 bp, Homo sapiens
atcagatacatcactgc

SEQ ID NO: 4971317 - DNA, 22 bp, Homo sapiens
atcagcacagataaaaagtgga

SEQ ID NO: 4971318 - DNA, 15 bp, Homo sapiens
atcagcacatatttt

SEQ ID NO: 4971319 - DNA, 22 bp, Homo sapiens
atcagctacttaagagaaatgg

SEQ ID NO: 4971320 - DNA, 15 bp, Homo sapiens
atcagctatttactg

SEQ ID NO: 4971321 - DNA, 14 bp, Homo sapiens
atcagggggaagaa

SEQ ID NO: 4971322 - DNA, 20 bp, Homo sapiens
atcaggtcctcagagaattt

SEQ ID NO: 4971323 - DNA, 15 bp, Homo sapiens
atcaggtgctgccat

SEQ ID NO: 4971324 - DNA, 17 bp, Homo sapiens
atcaggtgctgccatcc

SEQ ID NO: 4971325 - DNA, 14 bp, Homo sapiens
atcagtaggctaat

SEQ ID NO: 4971326 - DNA, 19 bp, Homo sapiens
atcagtgtgtctaaatttg

SEQ ID NO: 4971327 - DNA, 23 bp, Homo sapiens
atcagtgtgtctaaatttgaatg

SEQ ID NO: 4971328 - DNA, 20 bp, Homo sapiens
atcagtgttttaaattctga

SEQ ID NO: 4971329 - DNA, 12 bp, Homo sapiens
atcagttaacta

SEQ ID NO: 4971330 - DNA, 14 bp, Homo sapiens
atcagttcctttgt

SEQ ID NO: 4971331 - DNA, 10 bp, Homo sapiens
atcagtttga

SEQ ID NO: 4971332 - DNA, 22 bp, Homo sapiens
atcagtttgatcacactatttt

SEQ ID NO: 4971333 - DNA, 15 bp, Homo sapiens
atcatagaaatgtaa

SEQ ID NO: 4971334 - DNA, 18 bp, Homo sapiens
atcataggtatttcaaaa

SEQ ID NO: 4971335 - DNA, 18 bp, Homo sapiens
atcatatgtgatctgtct

SEQ ID NO: 4971336 - DNA, 22 bp, Homo sapiens
atcatatgtgatctgtcttgta

SEQ ID NO: 4971337 - DNA, 15 bp, Homo sapiens
atcatcagggcctgg

SEQ ID NO: 4971338 - DNA, 15 bp, Homo sapiens
atcatcgaaaattca

SEQ ID NO: 4971339 - DNA, 20 bp, Homo sapiens
atcatcgaaaattcatttca

SEQ ID NO: 4971340 - DNA, 16 bp, Homo sapiens
atcatctataaagaag

SEQ ID NO: 4971341 - DNA, 16 bp, Homo sapiens
atcatctgtgtgaaaa

SEQ ID NO: 4971342 - DNA, 18 bp, Homo sapiens
atcatctgtgtgaaaatg

SEQ ID NO: 4971343 - DNA, 13 bp, Homo sapiens
atcatgaatttta

SEQ ID NO: 4971344 - DNA, 13 bp, Homo sapiens
atcatgacatgtt

SEQ ID NO: 4971345 - DNA, 19 bp, Homo sapiens
atcatgcccggtcccaccc

SEQ ID NO: 4971346 - DNA, 17 bp, Homo sapiens
atcatggtgtaataaga

SEQ ID NO: 4971347 - DNA, 18 bp, Homo sapiens
atcatggtgtaataagac

SEQ ID NO: 4971348 - DNA, 19 bp, Homo sapiens
atcatggtgtaataagaca

SEQ ID NO: 4971349 - DNA, 21 bp, Homo sapiens
atcatggtgtaataagacata

SEQ ID NO: 4971350 - DNA, 19 bp, Homo sapiens
atcatgtcaggcctgtgtg

SEQ ID NO: 4971351 - DNA, 11 bp, Homo sapiens
atcatgttgtt

SEQ ID NO: 4971352 - DNA, 23 bp, Homo sapiens
atcattaccttttaccagctttt

SEQ ID NO: 4971353 - DNA, 18 bp, Homo sapiens
atcattgctttgaagcag

SEQ ID NO: 4971354 - DNA, 23 bp, Homo sapiens
atcattgctttgaagcagttgtg

SEQ ID NO: 4971355 - DNA, 19 bp, Homo sapiens
atcattggaacaactgata

SEQ ID NO: 4971356 - DNA, 13 bp, Homo sapiens
atcattttccccc

SEQ ID NO: 4971357 - DNA, 15 bp, Homo sapiens
atcattttcccccca

SEQ ID NO: 4971358 - DNA, 17 bp, Homo sapiens
atcattttccccccact

SEQ ID NO: 4971359 - DNA, 19 bp, Homo sapiens
atcattttgcctcttttct

SEQ ID NO: 4971360 - DNA, 21 bp, Homo sapiens
atccaaacatgtatttatgta

SEQ ID NO: 4971361 - DNA, 14 bp, Homo sapiens
atccaactccagca

SEQ ID NO: 4971362 - DNA, 14 bp, Homo sapiens
atccaagcctccac

SEQ ID NO: 4971363 - DNA, 19 bp, Homo sapiens
atccaagcctccacagcga

SEQ ID NO: 4971364 - DNA, 13 bp, Homo sapiens
atccaagctccct

SEQ ID NO: 4971365 - DNA, 17 bp, Homo sapiens
atccaagctccctgccc

SEQ ID NO: 4971366 - DNA, 18 bp, Homo sapiens
atccaagctccctgcccc

SEQ ID NO: 4971367 - DNA, 18 bp, Homo sapiens
atccaagctggtcccact

SEQ ID NO: 4971368 - DNA, 18 bp, Homo sapiens
atccacaccaaagggaga

SEQ ID NO: 4971369 - DNA, 16 bp, Homo sapiens
atccacatttctaaaa

SEQ ID NO: 4971370 - DNA, 10 bp, Homo sapiens
atccacccca

SEQ ID NO: 4971371 - DNA, 16 bp, Homo sapiens
atccactctaccctcc

SEQ ID NO: 4971372 - DNA, 19 bp, Homo sapiens
atccactctaccctcccac

SEQ ID NO: 4971373 - DNA, 16 bp, Homo sapiens
atccagacatcatgaa

SEQ ID NO: 4971374 - DNA, 19 bp, Homo sapiens
atccagacccggctgcgtg

SEQ ID NO: 4971375 - DNA, 17 bp, Homo sapiens
atccaggcacagctgag

SEQ ID NO: 4971376 - DNA, 17 bp, Homo sapiens
atccaggttcagcttgt

SEQ ID NO: 4971377 - DNA, 16 bp, Homo sapiens
atccatagtagtatga

SEQ ID NO: 4971378 - DNA, 23 bp, Homo sapiens
atccatatcttaaagaaacagct

SEQ ID NO: 4971379 - DNA, 12 bp, Homo sapiens
atccatccaatc

SEQ ID NO: 4971380 - DNA, 16 bp, Homo sapiens
atccatgtttgtaaaa

SEQ ID NO: 4971381 - DNA, 15 bp, Homo sapiens
atcccaaccagtgcc

SEQ ID NO: 4971382 - DNA, 17 bp, Homo sapiens
atcccaaccagtgccaa

SEQ ID NO: 4971383 - DNA, 17 bp, Homo sapiens
atcccaatcattgttgc

SEQ ID NO: 4971384 - DNA, 14 bp, Homo sapiens
atcccacaccctgg

SEQ ID NO: 4971385 - DNA, 13 bp, Homo sapiens
atcccacatccaa

SEQ ID NO: 4971386 - DNA, 15 bp, Homo sapiens
atcccacccacatgt

SEQ ID NO: 4971387 - DNA, 18 bp, Homo sapiens
atcccacctccatcccag

SEQ ID NO: 4971388 - DNA, 19 bp, Homo sapiens
atcccagccccaattttct

SEQ ID NO: 4971389 - DNA, 14 bp, Homo sapiens
atcccagccggcca

SEQ ID NO: 4971390 - DNA, 24 bp, Homo sapiens
atcccagccggccaatggaaacct

SEQ ID NO: 4971391 - DNA, 12 bp, Homo sapiens
atcccaggacac

SEQ ID NO: 4971392 - DNA, 19 bp, Homo sapiens
atcccatctaagctgcagc

SEQ ID NO: 4971393 - DNA, 16 bp, Homo sapiens
atcccatgagcctcag

SEQ ID NO: 4971394 - DNA, 23 bp, Homo sapiens
atccccaggggtcccagccaccc

SEQ ID NO: 4971395 - DNA, 14 bp, Homo sapiens
atcccccaggagaa

SEQ ID NO: 4971396 - DNA, 14 bp, Homo sapiens
atcccctgagcccc

SEQ ID NO: 4971397 - DNA, 22 bp, Homo sapiens
atcccgaagaatggagaggaac

SEQ ID NO: 4971398 - DNA, 15 bp, Homo sapiens
atcccggaggaaatc

SEQ ID NO: 4971399 - DNA, 18 bp, Homo sapiens
atccctaatgtgtgccat

SEQ ID NO: 4971400 - DNA, 14 bp, Homo sapiens
atccctacccccta

SEQ ID NO: 4971401 - DNA, 16 bp, Homo sapiens
atccctcaccttctga

SEQ ID NO: 4971402 - DNA, 15 bp, Homo sapiens
atccctccccagttc

SEQ ID NO: 4971403 - DNA, 14 bp, Homo sapiens
atccctgtttaata

SEQ ID NO: 4971404 - DNA, 20 bp, Homo sapiens
atccctgtttaatatttaaa

SEQ ID NO: 4971405 - DNA, 16 bp, Homo sapiens
atcccttctcacagca

SEQ ID NO: 4971406 - DNA, 14 bp, Homo sapiens
atccgccttttgta

SEQ ID NO: 4971407 - DNA, 15 bp, Homo sapiens
atccgctctcttcct

SEQ ID NO: 4971408 - DNA, 18 bp, Homo sapiens
atccgctctcttcctgcc

SEQ ID NO: 4971409 - DNA, 19 bp, Homo sapiens
atccgctctcttcctgccc

SEQ ID NO: 4971410 - DNA, 12 bp, Homo sapiens
atcctaagaaat

SEQ ID NO: 4971411 - DNA, 14 bp, Homo sapiens
atcctaagaaatat

SEQ ID NO: 4971412 - DNA, 15 bp, Homo sapiens
atcctaagaaatatg

SEQ ID NO: 4971413 - DNA, 23 bp, Homo sapiens
atcctaagaaatatgtgagattt

SEQ ID NO: 4971414 - DNA, 17 bp, Homo sapiens
atcctaagcatctaagt

SEQ ID NO: 4971415 - DNA, 18 bp, Homo sapiens
atcctaagcatctaagtt

SEQ ID NO: 4971416 - DNA, 18 bp, Homo sapiens
atcctaagggtcgaaagc

SEQ ID NO: 4971417 - DNA, 15 bp, Homo sapiens
atcctagatcctaag

SEQ ID NO: 4971418 - DNA, 16 bp, Homo sapiens
atcctagatcctaagg

SEQ ID NO: 4971419 - DNA, 15 bp, Homo sapiens
atcctatatagaatg

SEQ ID NO: 4971420 - DNA, 18 bp, Homo sapiens
atcctatatagaatgctg

SEQ ID NO: 4971421 - DNA, 20 bp, Homo sapiens
atcctatatagaatgctgca

SEQ ID NO: 4971422 - DNA, 15 bp, Homo sapiens
atcctccgtccagcc

SEQ ID NO: 4971423 - DNA, 16 bp, Homo sapiens
atcctccgtccagccg

SEQ ID NO: 4971424 - DNA, 15 bp, Homo sapiens
atcctctcctttgaa

SEQ ID NO: 4971425 - DNA, 19 bp, Homo sapiens
atcctctggttcttcattt

SEQ ID NO: 4971426 - DNA, 20 bp, Homo sapiens
atcctctttctcttttctag

SEQ ID NO: 4971427 - DNA, 14 bp, Homo sapiens
atcctgaaatttca

SEQ ID NO: 4971428 - DNA, 12 bp, Homo sapiens
atctggcctggc

SEQ ID NO: 4971429 - DNA, 17 bp, Homo sapiens
atctggcttattttaat

SEQ ID NO: 4971430 - DNA, 18 bp, Homo sapiens
atctggcttattttaatg

SEQ ID NO: 4971431 - DNA, 13 bp, Homo sapiens
atctgggcctggg

SEQ ID NO: 4971432 - DNA, 23 bp, Homo sapiens
atctgtacattttgttgtaaaaa

SEQ ID NO: 4971433 - DNA, 20 bp, Homo sapiens
atctgtcaaaacactgtgga

SEQ ID NO: 4971434 - DNA, 17 bp, Homo sapiens
atctgtcatttgagcag

SEQ ID NO: 4971435 - DNA, 22 bp, Homo sapiens
atctgtcatttgagcagggctc

SEQ ID NO: 4971436 - DNA, 13 bp, Homo sapiens
atctgtcttgtaa

SEQ ID NO: 4971437 - DNA, 22 bp, Homo sapiens
atctgtcttgtaatattttgta

SEQ ID NO: 4971438 - DNA, 21 bp, Homo sapiens
atctgtgaaatgctggcattt

SEQ ID NO: 4971439 - DNA, 21 bp, Homo sapiens
atctgtgtatattatttggca

SEQ ID NO: 4971440 - DNA, 13 bp, Homo sapiens
atctgtgtcctgg

SEQ ID NO: 4971441 - DNA, 17 bp, Homo sapiens
atctgtttaaagcatat

SEQ ID NO: 4971442 - DNA, 24 bp, Homo sapiens
atctgtttaaagcatatagagatg

SEQ ID NO: 4971443 - DNA, 17 bp, Homo sapiens
atctgttttgaaggcaa

SEQ ID NO: 4971444 - DNA, 18 bp, Homo sapiens
atcttaaagaaacagctt

SEQ ID NO: 4971445 - DNA, 19 bp, Homo sapiens
atcttaaagaaacagcttt

SEQ ID NO: 4971446 - DNA, 20 bp, Homo sapiens
atcttaaagaaacagctttc

SEQ ID NO: 4971447 - DNA, 20 bp, Homo sapiens
atcttagattctctgtgtct

SEQ ID NO: 4971448 - DNA, 23 bp, Homo sapiens
atcttagattctctgtgtctaag

SEQ ID NO: 4971449 - DNA, 14 bp, Homo sapiens
atcttagtttggat

SEQ ID NO: 4971450 - DNA, 22 bp, Homo sapiens
atcttagtttggattcttatgt

SEQ ID NO: 4971451 - DNA, 23 bp, Homo sapiens
atcttagtttggattcttatgta

SEQ ID NO: 4971452 - DNA, 15 bp, Homo sapiens
atcttatagttctag

SEQ ID NO: 4971453 - DNA, 13 bp, Homo sapiens
atcttatttagga

SEQ ID NO: 4971454 - DNA, 14 bp, Homo sapiens
atcttccatatttg

SEQ ID NO: 4971455 - DNA, 15 bp, Homo sapiens
atcttccatatttgg

SEQ ID NO: 4971456 - DNA, 15 bp, Homo sapiens
atcttctcaagttct

SEQ ID NO: 4971457 - DNA, 18 bp, Homo sapiens
atcttctcaagttctaag

SEQ ID NO: 4971458 - DNA, 23 bp, Homo sapiens
atcttctcaagttctaagattct

SEQ ID NO: 4971459 - DNA, 22 bp, Homo sapiens
atcttctggtttaaacttgttt

SEQ ID NO: 4971460 - DNA, 23 bp, Homo sapiens
atcttgaaattaagaaggcaaaa

SEQ ID NO: 4971461 - DNA, 14 bp, Homo sapiens
atcttgaagggccc

SEQ ID NO: 4971462 - DNA, 21 bp, Homo sapiens
atcttgaatgtggtctcagga

SEQ ID NO: 4971463 - DNA, 17 bp, Homo sapiens
atcttgccggtcatttt

SEQ ID NO: 4971464 - DNA, 21 bp, Homo sapiens
atcttgcgaatccaagctccc

SEQ ID NO: 4971465 - DNA, 22 bp, Homo sapiens
atcttgcgaatccaagctccct

SEQ ID NO: 4971466 - DNA, 21 bp, Homo sapiens
atcttggctatgtaattcttg

SEQ ID NO: 4971467 - DNA, 15 bp, Homo sapiens
atcttgtgaaatggc

SEQ ID NO: 4971468 - DNA, 20 bp, Homo sapiens
atcttgtgaaatggccagga

SEQ ID NO: 4971469 - DNA, 18 bp, Homo sapiens
atcttgtgctagaatact

SEQ ID NO: 4971470 - DNA, 18 bp, Homo sapiens
atcttgtgtgattaactt

SEQ ID NO: 4971471 - DNA, 23 bp, Homo sapiens
atcttgtgtgattaacttattta

SEQ ID NO: 4971472 - DNA, 22 bp, Homo sapiens
atcttgtgttgtccttttgtct

SEQ ID NO: 4971473 - DNA, 13 bp, Homo sapiens
atctttaagcaga

SEQ ID NO: 4971474 - DNA, 17 bp, Homo sapiens
atctttacaaaactaca

SEQ ID NO: 4971475 - DNA, 11 bp, Homo sapiens
atctttcctgt

SEQ ID NO: 4971476 - DNA, 12 bp, Homo sapiens
atctttcctgtc

SEQ ID NO: 4971477 - DNA, 17 bp, Homo sapiens
atctttgcagacaggca

SEQ ID NO: 4971478 - DNA, 14 bp, Homo sapiens
atctttgccttggg

SEQ ID NO: 4971479 - DNA, 17 bp, Homo sapiens
atctttgtgataattta

SEQ ID NO: 4971480 - DNA, 17 bp, Homo sapiens
atcttttaaagtgttac

SEQ ID NO: 4971481 - DNA, 17 bp, Homo sapiens
atcttttatgtttgaat

SEQ ID NO: 4971482 - DNA, 21 bp, Homo sapiens
atcttttatgtttgaatatgg

SEQ ID NO: 4971483 - DNA, 21 bp, Homo sapiens
atcttttttgttaactgattt

SEQ ID NO: 4971484 - DNA, 13 bp, Homo sapiens
atgaaaaacaacc

SEQ ID NO: 4971485 - DNA, 15 bp, Homo sapiens
atgaaaactatacaa

SEQ ID NO: 4971486 - DNA, 12 bp, Homo sapiens
atgaaaactcat

SEQ ID NO: 4971487 - DNA, 22 bp, Homo sapiens
atgaaaagacaagaaaatcagg

SEQ ID NO: 4971488 - DNA, 19 bp, Homo sapiens
atgaaaagattcttctgtg

SEQ ID NO: 4971489 - DNA, 13 bp, Homo sapiens
atgaaaagattta

SEQ ID NO: 4971490 - DNA, 15 bp, Homo sapiens
atgaaaagatttaag

SEQ ID NO: 4971491 - DNA, 18 bp, Homo sapiens
atgaaaatattttttaca

SEQ ID NO: 4971492 - DNA, 20 bp, Homo sapiens
atgaaaatgagttgtgaaag

SEQ ID NO: 4971493 - DNA, 21 bp, Homo sapiens
atgaaaatgagttgtgaaagt

SEQ ID NO: 4971494 - DNA, 13 bp, Homo sapiens
atgaaacagaaac

SEQ ID NO: 4971495 - DNA, 18 bp, Homo sapiens
atgaaacagaaacaaaaa

SEQ ID NO: 4971496 - DNA, 22 bp, Homo sapiens
atgaaacagaaacaaaaacact

SEQ ID NO: 4971497 - DNA, 16 bp, Homo sapiens
atgaaactcacaaatg

SEQ ID NO: 4971498 - DNA, 14 bp, Homo sapiens
atgaaaggtactat

SEQ ID NO: 4971499 - DNA, 21 bp, Homo sapiens
atgaaaggtactatatttgct

SEQ ID NO: 4971500 - DNA, 17 bp, Homo sapiens
atgaaatactatttaaa

SEQ ID NO: 4971501 - DNA, 19 bp, Homo sapiens
atgaaatccttgactggac

SEQ ID NO: 4971502 - DNA, 14 bp, Homo sapiens
atgaaatgaggtca

SEQ ID NO: 4971503 - DNA, 21 bp, Homo sapiens
atgaacaagttttaatgtata

SEQ ID NO: 4971504 - DNA, 13 bp, Homo sapiens
atgaaccacatct

SEQ ID NO: 4971505 - DNA, 21 bp, Homo sapiens
atgaacccttcctgagcttta

SEQ ID NO: 4971506 - DNA, 20 bp, Homo sapiens
atgaactcttagaaatgaag

SEQ ID NO: 4971507 - DNA, 17 bp, Homo sapiens
atgaactttctcttcat

SEQ ID NO: 4971508 - DNA, 13 bp, Homo sapiens
atgaagagcaaaa

SEQ ID NO: 4971509 - DNA, 11 bp, Homo sapiens
atgaagccttt

SEQ ID NO: 4971510 - DNA, 14 bp, Homo sapiens
atgaagccttttga

SEQ ID NO: 4971511 - DNA, 17 bp, Homo sapiens
atgaagccttttgaaag

SEQ ID NO: 4971512 - DNA, 19 bp, Homo sapiens
atgaagcgaaacacagaga

SEQ ID NO: 4971513 - DNA, 21 bp, Homo sapiens
atgaaggagaggcaacatcca

SEQ ID NO: 4971514 - DNA, 22 bp, Homo sapiens
atgaagtaaagccattaaatga

SEQ ID NO: 4971515 - DNA, 18 bp, Homo sapiens
atgaagtgcgtgaatgta

SEQ ID NO: 4971516 - DNA, 20 bp, Homo sapiens
atgaagtgcgtgaatgtatg

SEQ ID NO: 4971517 - DNA, 18 bp, Homo sapiens
atgaagtgttagatagaa

SEQ ID NO: 4971518 - DNA, 15 bp, Homo sapiens
atgaagtttaaaaca

SEQ ID NO: 4971519 - DNA, 19 bp, Homo sapiens
atgaagtttgaacttcata

SEQ ID NO: 4971520 - DNA, 14 bp, Homo sapiens
atgaagttttacat

SEQ ID NO: 4971521 - DNA, 17 bp, Homo sapiens
atgaataaagacaccta

SEQ ID NO: 4971522 - DNA, 18 bp, Homo sapiens
atgaatatcatacaaatc

SEQ ID NO: 4971523 - DNA, 17 bp, Homo sapiens
atgaatctgatttttat

SEQ ID NO: 4971524 - DNA, 23 bp, Homo sapiens
atgaatctttgtttcaggttcag

SEQ ID NO: 4971525 - DNA, 20 bp, Homo sapiens
atgaatgaggtcccaggcag

SEQ ID NO: 4971526 - DNA, 21 bp, Homo sapiens
atgaatggtatggaactctct

SEQ ID NO: 4971527 - DNA, 11 bp, Homo sapiens
atgaatttaaa

SEQ ID NO: 4971528 - DNA, 14 bp, Homo sapiens
atgacaacagaagc

SEQ ID NO: 4971529 - DNA, 17 bp, Homo sapiens
atgacaggcctgaagat

SEQ ID NO: 4971530 - DNA, 22 bp, Homo sapiens
atgacaggcctgaagatattac

SEQ ID NO: 4971531 - DNA, 20 bp, Homo sapiens
atgacatcacttgtacaaaa

SEQ ID NO: 4971532 - DNA, 18 bp, Homo sapiens
atgacatctcaggggcca

SEQ ID NO: 4971533 - DNA, 15 bp, Homo sapiens
atgacatctttttaa

SEQ ID NO: 4971534 - DNA, 12 bp, Homo sapiens
atactcagcctg

SEQ ID NO: 4971535 - DNA, 16 bp, Homo sapiens
atactcagcctgctgc

SEQ ID NO: 4971536 - DNA, 20 bp, Homo sapiens
atactcagcctgctgcccag

SEQ ID NO: 4971537 - DNA, 14 bp, Homo sapiens
atactcatttctaa

SEQ ID NO: 4971538 - DNA, 16 bp, Homo sapiens
atactcatttctaaaa

SEQ ID NO: 4971539 - DNA, 20 bp, Homo sapiens
atactcatttctaaaagaat

SEQ ID NO: 4971540 - DNA, 22 bp, Homo sapiens
atactcatttctaaaagaatat

SEQ ID NO: 4971541 - DNA, 23 bp, Homo sapiens
atactcatttctaaaagaatatt

SEQ ID NO: 4971542 - DNA, 16 bp, Homo sapiens
atactccagtgtacat

SEQ ID NO: 4971543 - DNA, 21 bp, Homo sapiens
atactccagtgtacatagtgt

SEQ ID NO: 4971544 - DNA, 22 bp, Homo sapiens
atactctttctgtatatacttt

SEQ ID NO: 4971545 - DNA, 23 bp, Homo sapiens
atactctttctgtatatactttt

SEQ ID NO: 4971546 - DNA, 15 bp, Homo sapiens
atactgcagggccag

SEQ ID NO: 4971547 - DNA, 14 bp, Homo sapiens
atactggcctggac

SEQ ID NO: 4971548 - DNA, 19 bp, Homo sapiens
atactgtacatgaaagtag

SEQ ID NO: 4971549 - DNA, 22 bp, Homo sapiens
atactgtgtgcttgttttataa

SEQ ID NO: 4971550 - DNA, 19 bp, Homo sapiens
atacttagcaaaaagtggg

SEQ ID NO: 4971551 - DNA, 22 bp, Homo sapiens
atacttagcaaagttttacctg

SEQ ID NO: 4971552 - DNA, 18 bp, Homo sapiens
atacttatctctctgtgc

SEQ ID NO: 4971553 - DNA, 17 bp, Homo sapiens
atacttcatttaaaaaa

SEQ ID NO: 4971554 - DNA, 20 bp, Homo sapiens
atacttcatttaaaaaaatc

SEQ ID NO: 4971555 - DNA, 18 bp, Homo sapiens
atacttgtggttttcaaa

SEQ ID NO: 4971556 - DNA, 14 bp, Homo sapiens
atactttagtatga

SEQ ID NO: 4971557 - DNA, 13 bp, Homo sapiens
atactttgtctga

SEQ ID NO: 4971558 - DNA, 24 bp, Homo sapiens
atactttgtggaccaattattgat

SEQ ID NO: 4971559 - DNA, 15 bp, Homo sapiens
atactttttcttttg

SEQ ID NO: 4971560 - DNA, 18 bp, Homo sapiens
atactttttcttttgtaa

SEQ ID NO: 4971561 - DNA, 14 bp, Homo sapiens
atactttttttcac

SEQ ID NO: 4971562 - DNA, 21 bp, Homo sapiens
atacttttttttctttaaaaa

SEQ ID NO: 4971563 - DNA, 21 bp, Homo sapiens
atagaaaagtagacaatcatt

SEQ ID NO: 4971564 - DNA, 11 bp, Homo sapiens
atagaaacatg

SEQ ID NO: 4971565 - DNA, 14 bp, Homo sapiens
atagaaacatgaca

SEQ ID NO: 4971566 - DNA, 22 bp, Homo sapiens
atagaaataaaggatgtgattg

SEQ ID NO: 4971567 - DNA, 19 bp, Homo sapiens
atagaaataagtggttatt

SEQ ID NO: 4971568 - DNA, 18 bp, Homo sapiens
atagaaatatatacgaac

SEQ ID NO: 4971569 - DNA, 15 bp, Homo sapiens
atagaactgggtaaa

SEQ ID NO: 4971570 - DNA, 19 bp, Homo sapiens
atagaactgggtaaatgca

SEQ ID NO: 4971571 - DNA, 13 bp, Homo sapiens
atagaagctgtag

SEQ ID NO: 4971572 - DNA, 22 bp, Homo sapiens
atagaagtttgtccatttgtaa

SEQ ID NO: 4971573 - DNA, 23 bp, Homo sapiens
atagaagtttgtccatttgtaaa

SEQ ID NO: 4971574 - DNA, 20 bp, Homo sapiens
atagacaatttgcacatctt

SEQ ID NO: 4971575 - DNA, 22 bp, Homo sapiens
atagacactccccgaagtcttt

SEQ ID NO: 4971576 - DNA, 16 bp, Homo sapiens
atagagatgtttttaa

SEQ ID NO: 4971577 - DNA, 22 bp, Homo sapiens
atagagatttgtctaattgcat

SEQ ID NO: 4971578 - DNA, 15 bp, Homo sapiens
atagagcaaaattga

SEQ ID NO: 4971579 - DNA, 16 bp, Homo sapiens
atagagcttttaaaaa

SEQ ID NO: 4971580 - DNA, 14 bp, Homo sapiens
atagagggccaaga

SEQ ID NO: 4971581 - DNA, 19 bp, Homo sapiens
atagaggtatattggaaga

SEQ ID NO: 4971582 - DNA, 14 bp, Homo sapiens
atagagtgtactta

SEQ ID NO: 4971583 - DNA, 19 bp, Homo sapiens
atagagtgtacttaactat

SEQ ID NO: 4971584 - DNA, 13 bp, Homo sapiens
atagagttcatcc

SEQ ID NO: 4971585 - DNA, 13 bp, Homo sapiens
atagatacaaatg

SEQ ID NO: 4971586 - DNA, 13 bp, Homo sapiens
atagatattttca

SEQ ID NO: 4971587 - DNA, 17 bp, Homo sapiens
atagatattttcacaat

SEQ ID NO: 4971588 - DNA, 16 bp, Homo sapiens
atagatgtcttttata

SEQ ID NO: 4971589 - DNA, 21 bp, Homo sapiens
atagattagaaaaattcctaa

SEQ ID NO: 4971590 - DNA, 15 bp, Homo sapiens
atagattctaaagat

SEQ ID NO: 4971591 - DNA, 16 bp, Homo sapiens
atagattctaaagatt

SEQ ID NO: 4971592 - DNA, 21 bp, Homo sapiens
atagatttatttttcagttcc

SEQ ID NO: 4971593 - DNA, 23 bp, Homo sapiens
atagatttatttttcagttccaa

SEQ ID NO: 4971594 - DNA, 14 bp, Homo sapiens
atagcaaattcaaa

SEQ ID NO: 4971595 - DNA, 15 bp, Homo sapiens
atagcaacaggaaaa

SEQ ID NO: 4971596 - DNA, 17 bp, Homo sapiens
atagcaatagcatggat

SEQ ID NO: 4971597 - DNA, 19 bp, Homo sapiens
atagcactttgaaatacct

SEQ ID NO: 4971598 - DNA, 15 bp, Homo sapiens
atagcagcaaaaata

SEQ ID NO: 4971599 - DNA, 23 bp, Homo sapiens
atagcatctcaggagatttcatg

SEQ ID NO: 4971600 - DNA, 13 bp, Homo sapiens
atagcattcataa

SEQ ID NO: 4971601 - DNA, 18 bp, Homo sapiens
atagcatttttgatttat

SEQ ID NO: 4971602 - DNA, 19 bp, Homo sapiens
atagcatttttgatttatg

SEQ ID NO: 4971603 - DNA, 16 bp, Homo sapiens
atagccacatttggaa

SEQ ID NO: 4971604 - DNA, 15 bp, Homo sapiens
atagcctaggtgaca

SEQ ID NO: 4971605 - DNA, 17 bp, Homo sapiens
atagcctaggtgacaga

SEQ ID NO: 4971606 - DNA, 19 bp, Homo sapiens
atagcctatggcagaaaaa

SEQ ID NO: 4971607 - DNA, 15 bp, Homo sapiens
atagctaagtacaca

SEQ ID NO: 4971608 - DNA, 18 bp, Homo sapiens
atagctaagtacacaata

SEQ ID NO: 4971609 - DNA, 15 bp, Homo sapiens
atagctacaggaagc

SEQ ID NO: 4971610 - DNA, 16 bp, Homo sapiens
atagctacaggaagca

SEQ ID NO: 4971611 - DNA, 14 bp, Homo sapiens
atagctacccaaaa

SEQ ID NO: 4971612 - DNA, 16 bp, Homo sapiens
atagctacccaaaaga

SEQ ID NO: 4971613 - DNA, 19 bp, Homo sapiens
atagctacccaaaagagaa

SEQ ID NO: 4971614 - DNA, 21 bp, Homo sapiens
atagctacccaaaagagaaaa

SEQ ID NO: 4971615 - DNA, 22 bp, Homo sapiens
atagctattactgtctggtttt

SEQ ID NO: 4971616 - DNA, 20 bp, Homo sapiens
atagctcaggtgtccctgca

SEQ ID NO: 4971617 - DNA, 17 bp, Homo sapiens
atagctgggactacagg

SEQ ID NO: 4971618 - DNA, 14 bp, Homo sapiens
atagcttttattgt

SEQ ID NO: 4971619 - DNA, 15 bp, Homo sapiens
atagcttttattgta

SEQ ID NO: 4971620 - DNA, 21 bp, Homo sapiens
ataggaaagtatttttttaag

SEQ ID NO: 4971621 - DNA, 20 bp, Homo sapiens
ataggagaggatgagagccc

SEQ ID NO: 4971622 - DNA, 23 bp, Homo sapiens
ataggagaggatgagagcccaga

SEQ ID NO: 4971623 - DNA, 24 bp, Homo sapiens
ataggagaggatgagagcccagag

SEQ ID NO: 4971624 - DNA, 15 bp, Homo sapiens
ataggagcctgctgg

SEQ ID NO: 4971625 - DNA, 15 bp, Homo sapiens
atagggagaaaccaa

SEQ ID NO: 4971626 - DNA, 21 bp, Homo sapiens
atagggctgggcaaggaaaaa

SEQ ID NO: 4971627 - DNA, 16 bp, Homo sapiens
ataggggtgtttattt

SEQ ID NO: 4971628 - DNA, 23 bp, Homo sapiens
ataggtaatcaatgaatattgaa

SEQ ID NO: 4971629 - DNA, 14 bp, Homo sapiens
ataggtctcttctc

SEQ ID NO: 4971630 - DNA, 17 bp, Homo sapiens
ataggtctcttctccca

SEQ ID NO: 4971631 - DNA, 18 bp, Homo sapiens
ataggtctcttctcccag

SEQ ID NO: 4971632 - DNA, 19 bp, Homo sapiens
ataggtgatgtttgctctt

SEQ ID NO: 4971633 - DNA, 23 bp, Homo sapiens
ataggttttcccctcttttgtta

SEQ ID NO: 4971634 - DNA, 13 bp, Homo sapiens
atagtaactccca

SEQ ID NO: 4971635 - DNA, 17 bp, Homo sapiens
atagtaagttcagcact

SEQ ID NO: 4971636 - DNA, 17 bp, Homo sapiens
atagtatggtggctggg

SEQ ID NO: 4971637 - DNA, 18 bp, Homo sapiens
atagtatggtggctgggt

SEQ ID NO: 4971638 - DNA, 18 bp, Homo sapiens
atagtcatttattttaaa

SEQ ID NO: 4971639 - DNA, 18 bp, Homo sapiens
atagtgactatgaacttc

SEQ ID NO: 4971640 - DNA, 14 bp, Homo sapiens
atagtgctatatat

SEQ ID NO: 4971641 - DNA, 20 bp, Homo sapiens
atagtgggcaccccactgca

SEQ ID NO: 4971642 - DNA, 14 bp, Homo sapiens
atagttcaccccct

SEQ ID NO: 4971643 - DNA, 23 bp, Homo sapiens
atagttcctaagaagcttctaat

SEQ ID NO: 4971644 - DNA, 13 bp, Homo sapiens
atagttctagaca

SEQ ID NO: 4971645 - DNA, 14 bp, Homo sapiens
atagttctagacat

SEQ ID NO: 4971646 - DNA, 23 bp, Homo sapiens
atagttctagacatggaggttct

SEQ ID NO: 4971647 - DNA, 22 bp, Homo sapiens
atagttgtcagtattattctac

SEQ ID NO: 4971648 - DNA, 19 bp, Homo sapiens
atagttgtccatattttca

SEQ ID NO: 4971649 - DNA, 17 bp, Homo sapiens
atagtttacctgaataa

SEQ ID NO: 4971650 - DNA, 14 bp, Homo sapiens
atagtttcagatat

SEQ ID NO: 4971651 - DNA, 13 bp, Homo sapiens
atagtttctgagg

SEQ ID NO: 4971652 - DNA, 19 bp, Homo sapiens
atagtttctgaggctttat

SEQ ID NO: 4971653 - DNA, 15 bp, Homo sapiens
atagtttgtacatgc

SEQ ID NO: 4971654 - DNA, 13 bp, Homo sapiens
atagtttgtctat

SEQ ID NO: 4971655 - DNA, 15 bp, Homo sapiens
atagtttgtctattt

SEQ ID NO: 4971656 - DNA, 14 bp, Homo sapiens
atataaagaatata

SEQ ID NO: 4971657 - DNA, 15 bp, Homo sapiens
atataaagaatatat

SEQ ID NO: 4971658 - DNA, 14 bp, Homo sapiens
atataaagtataga

SEQ ID NO: 4971659 - DNA, 13 bp, Homo sapiens
atataaatatttg

SEQ ID NO: 4971660 - DNA, 13 bp, Homo sapiens
atataaattctgt

SEQ ID NO: 4971661 - DNA, 14 bp, Homo sapiens
atataagattttct

SEQ ID NO: 4971662 - DNA, 16 bp, Homo sapiens
atataagccttttata

SEQ ID NO: 4971663 - DNA, 16 bp, Homo sapiens
atataatggaagagaa

SEQ ID NO: 4971664 - DNA, 15 bp, Homo sapiens
atatacagatgaaaa

SEQ ID NO: 4971665 - DNA, 18 bp, Homo sapiens
atatacagatgaaaattt

SEQ ID NO: 4971666 - DNA, 22 bp, Homo sapiens
atatacagatgaaaatttgaga

SEQ ID NO: 4971667 - DNA, 22 bp, Homo sapiens
atatacagtaactttatgtgta

SEQ ID NO: 4971668 - DNA, 16 bp, Homo sapiens
atatacatacacttgt

SEQ ID NO: 4971669 - DNA, 13 bp, Homo sapiens
atatacatgtgtg

SEQ ID NO: 4971670 - DNA, 23 bp, Homo sapiens
atatacatgtgtgtatatatgtg

SEQ ID NO: 4971671 - DNA, 18 bp, Homo sapiens
atatacctataatgtgtg

SEQ ID NO: 4971672 - DNA, 21 bp, Homo sapiens
atatacctataatgtgtgtat

SEQ ID NO: 4971673 - DNA, 18 bp, Homo sapiens
atatactgttcttcattt

SEQ ID NO: 4971674 - DNA, 19 bp, Homo sapiens
atataggtctcttctccca

SEQ ID NO: 4971675 - DNA, 18 bp, Homo sapiens
atatagtgctatatatat

SEQ ID NO: 4971676 - DNA, 22 bp, Homo sapiens
atatagttcctaagaagcttct

SEQ ID NO: 4971677 - DNA, 17 bp, Homo sapiens
atatagtttttaccttt

SEQ ID NO: 4971678 - DNA, 15 bp, Homo sapiens
atatataaaaatata

SEQ ID NO: 4971679 - DNA, 18 bp, Homo sapiens
atatataaagtatagaga

SEQ ID NO: 4971680 - DNA, 13 bp, Homo sapiens
atatataatatat

SEQ ID NO: 4971681 - DNA, 18 bp, Homo sapiens
atatatacagtaacttta

SEQ ID NO: 4971682 - DNA, 21 bp, Homo sapiens
atatatacagtaactttatgt

SEQ ID NO: 4971683 - DNA, 11 bp, Homo sapiens
atatatacata

SEQ ID NO: 4971684 - DNA, 14 bp, Homo sapiens
atatatacatacac

SEQ ID NO: 4971685 - DNA, 15 bp, Homo sapiens
atatataccccccca

SEQ ID NO: 4971686 - DNA, 18 bp, Homo sapiens
atatatagaaatatatac

SEQ ID NO: 4971687 - DNA, 15 bp, Homo sapiens
atatatagtgctata

SEQ ID NO: 4971688 - DNA, 10 bp, Homo sapiens
atatatatat

SEQ ID NO: 4971689 - DNA, 14 bp, Homo sapiens
atatatatataaag

SEQ ID NO: 4971690 - DNA, 15 bp, Homo sapiens
atatatatatataaa

SEQ ID NO: 4971691 - DNA, 13 bp, Homo sapiens
atatatatatatc

SEQ ID NO: 4971692 - DNA, 14 bp, Homo sapiens
atatatatatcagt

SEQ ID NO: 4971693 - DNA, 14 bp, Homo sapiens
atatatatgaataa

SEQ ID NO: 4971694 - DNA, 15 bp, Homo sapiens
atatatatgaataaa

SEQ ID NO: 4971695 - DNA, 17 bp, Homo sapiens
atatatattataaatat

SEQ ID NO: 4971696 - DNA, 10 bp, Homo sapiens
atatatattt

SEQ ID NO: 4971697 - DNA, 15 bp, Homo sapiens
atatatcagtttgat

SEQ ID NO: 4971698 - DNA, 16 bp, Homo sapiens
atatatgaaaactata

SEQ ID NO: 4971699 - DNA, 17 bp, Homo sapiens
atatatgaaaactatac

SEQ ID NO: 4971700 - DNA, 20 bp, Homo sapiens
atatatgaaaactatacaac

SEQ ID NO: 4971701 - DNA, 17 bp, Homo sapiens
atatatgcctttttcct

SEQ ID NO: 4971702 - DNA, 12 bp, Homo sapiens
atatatgtgtat

SEQ ID NO: 4971703 - DNA, 23 bp, Homo sapiens
atatatgtgtatatatacataca

SEQ ID NO: 4971704 - DNA, 15 bp, Homo sapiens
atatatgtgtatgta

SEQ ID NO: 4971705 - DNA, 15 bp, Homo sapiens
atatattcccaatag

SEQ ID NO: 4971706 - DNA, 19 bp, Homo sapiens
atatattgttaatctctgt

SEQ ID NO: 4971707 - DNA, 15 bp, Homo sapiens
atatatttaatgata

SEQ ID NO: 4971708 - DNA, 16 bp, Homo sapiens
atatatttaatgataa

SEQ ID NO: 4971709 - DNA, 19 bp, Homo sapiens
atatatttatttaaagcat

SEQ ID NO: 4971710 - DNA, 21 bp, Homo sapiens
atatattttaccatacattta

SEQ ID NO: 4971711 - DNA, 22 bp, Homo sapiens
atatatttttaaaaaatgaaat

SEQ ID NO: 4971712 - DNA, 15 bp, Homo sapiens
atatcaagatgattc

SEQ ID NO: 4971713 - DNA, 16 bp, Homo sapiens
atatcagcacatattt

SEQ ID NO: 4971714 - DNA, 19 bp, Homo sapiens
atatcatactgttcaatgg

SEQ ID NO: 4971715 - DNA, 18 bp, Homo sapiens
atatcatgtaaagaaatg

SEQ ID NO: 4971716 - DNA, 21 bp, Homo sapiens
atatcatgtaaagaaatgtct

SEQ ID NO: 4971717 - DNA, 16 bp, Homo sapiens
atatcccaagtgcact

SEQ ID NO: 4971718 - DNA, 11 bp, Homo sapiens
atatcccttcc

SEQ ID NO: 4971719 - DNA, 18 bp, Homo sapiens
atatccttatcagagcta

SEQ ID NO: 4971720 - DNA, 15 bp, Homo sapiens
atatcgctgacttca

SEQ ID NO: 4971721 - DNA, 18 bp, Homo sapiens
atatctaatatatatgaa

SEQ ID NO: 4971722 - DNA, 19 bp, Homo sapiens
atatctaatatatatgaat

SEQ ID NO: 4971723 - DNA, 14 bp, Homo sapiens
atatctattaatat

SEQ ID NO: 4971724 - DNA, 18 bp, Homo sapiens
atatctattaatatatgt

SEQ ID NO: 4971725 - DNA, 11 bp, Homo sapiens
atatctgaaaa

SEQ ID NO: 4971726 - DNA, 21 bp, Homo sapiens
atatctggcctaaaatcttgg

SEQ ID NO: 4971727 - DNA, 14 bp, Homo sapiens
atatcttaaagaaa

SEQ ID NO: 4971728 - DNA, 16 bp, Homo sapiens
atatcttaaagaaaca

SEQ ID NO: 4971729 - DNA, 19 bp, Homo sapiens
atatcttaaagaaacagct

SEQ ID NO: 4971730 - DNA, 20 bp, Homo sapiens
atatcttcagctctttttgt

SEQ ID NO: 4971731 - DNA, 17 bp, Homo sapiens
atatcttgcgaatccaa

SEQ ID NO: 4971732 - DNA, 21 bp, Homo sapiens
atatcttttatgtttgaatat

SEQ ID NO: 4971733 - DNA, 15 bp, Homo sapiens
atatgagtacaaatg

SEQ ID NO: 4971734 - DNA, 13 bp, Homo sapiens
atatgagtataca

SEQ ID NO: 4971735 - DNA, 15 bp, Homo sapiens
atatgagtatacaat

SEQ ID NO: 4971736 - DNA, 18 bp, Homo sapiens
atatgagtatacaatata

SEQ ID NO: 4971737 - DNA, 13 bp, Homo sapiens
atatgatctgttt

SEQ ID NO: 4971738 - DNA, 15 bp, Homo sapiens
atatgattggcaata

SEQ ID NO: 4971739 - DNA, 18 bp, Homo sapiens
atatgatttcactagaaa

SEQ ID NO: 4971740 - DNA, 21 bp, Homo sapiens
atatgcaccttgtgtctgtac

SEQ ID NO: 4971741 - DNA, 14 bp, Homo sapiens
atatgctaatttgg

SEQ ID NO: 4971742 - DNA, 15 bp, Homo sapiens
atatgctaatttggg

SEQ ID NO: 4971743 - DNA, 20 bp, Homo sapiens
atatggaacttctaatatat

SEQ ID NO: 4971744 - DNA, 18 bp, Homo sapiens
atatggagaattgctgaa

SEQ ID NO: 4971745 - DNA, 17 bp, Homo sapiens
atatggatttgttacag

SEQ ID NO: 4971746 - DNA, 15 bp, Homo sapiens
atatggcaagaaagc

SEQ ID NO: 4971747 - DNA, 17 bp, Homo sapiens
atatggcaagaaagctg

SEQ ID NO: 4971748 - DNA, 18 bp, Homo sapiens
atatggcaagaaagctgg

SEQ ID NO: 4971749 - DNA, 12 bp, Homo sapiens
atatggcagaag

SEQ ID NO: 4971750 - DNA, 23 bp, Homo sapiens
atatgggttagatgttgccatgt

SEQ ID NO: 4971751 - DNA, 20 bp, Homo sapiens
atatgggtttataattttct

SEQ ID NO: 4971752 - DNA, 14 bp, Homo sapiens
atatgtacatgaga

SEQ ID NO: 4971753 - DNA, 16 bp, Homo sapiens
atatgtagactatata

SEQ ID NO: 4971754 - DNA, 17 bp, Homo sapiens
atatgtagactatatac

SEQ ID NO: 4971755 - DNA, 18 bp, Homo sapiens
atatgtatatttttttaa

SEQ ID NO: 4971756 - DNA, 16 bp, Homo sapiens
atatgtattatttata

SEQ ID NO: 4971757 - DNA, 23 bp, Homo sapiens
atatgtattatttataattccta

SEQ ID NO: 4971758 - DNA, 11 bp, Homo sapiens
atatgtgaatc

SEQ ID NO: 4971759 - DNA, 21 bp, Homo sapiens
atatgtgagattttttattgc

SEQ ID NO: 4971760 - DNA, 22 bp, Homo sapiens
atatgtgagattttttattgct

SEQ ID NO: 4971761 - DNA, 16 bp, Homo sapiens
atatgtgtatgtacgt

SEQ ID NO: 4971762 - DNA, 22 bp, Homo sapiens
atatgtgtatgtacgtttgtat

SEQ ID NO: 4971763 - DNA, 15 bp, Homo sapiens
atatgttgaatactt

SEQ ID NO: 4971764 - DNA, 16 bp, Homo sapiens
atatgttgaatacttt

SEQ ID NO: 4971765 - DNA, 20 bp, Homo sapiens
atatgtttccttgtttatca

SEQ ID NO: 4971766 - DNA, 17 bp, Homo sapiens
atatgtttttaaaggtg

SEQ ID NO: 4971767 - DNA, 23 bp, Homo sapiens
atattaaaaatatggaacttcta

SEQ ID NO: 4971768 - DNA, 12 bp, Homo sapiens
atattaatgtac

SEQ ID NO: 4971769 - DNA, 18 bp, Homo sapiens
atattaatgtacttgttt

SEQ ID NO: 4971770 - DNA, 22 bp, Homo sapiens
atattactcctatttttgtaaa

SEQ ID NO: 4971771 - DNA, 20 bp, Homo sapiens
atattactgtttatttctgt

SEQ ID NO: 4971772 - DNA, 12 bp, Homo sapiens
atattactttat

SEQ ID NO: 4971773 - DNA, 19 bp, Homo sapiens
atattattagaaattagaa

SEQ ID NO: 4971774 - DNA, 12 bp, Homo sapiens
atattatttggc

SEQ ID NO: 4971775 - DNA, 21 bp, Homo sapiens
atattatttggcagtttggta

SEQ ID NO: 4971776 - DNA, 17 bp, Homo sapiens
atattcaaccatggact

SEQ ID NO: 4971777 - DNA, 12 bp, Homo sapiens
atattcatattg

SEQ ID NO: 4971778 - DNA, 18 bp, Homo sapiens
atattcatgcttcttcct

SEQ ID NO: 4971779 - DNA, 21 bp, Homo sapiens
atattcctgcatttgtgaaat

SEQ ID NO: 4971780 - DNA, 16 bp, Homo sapiens
atattctaaaaccatt

SEQ ID NO: 4971781 - DNA, 23 bp, Homo sapiens
atattctaagacttactctaaga

SEQ ID NO: 4971782 - DNA, 18 bp, Homo sapiens
atattctatatgaattta

SEQ ID NO: 4971783 - DNA, 14 bp, Homo sapiens
atattgaagacaat

SEQ ID NO: 4971784 - DNA, 16 bp, Homo sapiens
atattgacatttgtag

SEQ ID NO: 4971785 - DNA, 19 bp, Homo sapiens
atattgaggctttgtgttg

SEQ ID NO: 4971786 - DNA, 17 bp, Homo sapiens
atattgagtcaaatggt

SEQ ID NO: 4971787 - DNA, 14 bp, Homo sapiens
atattgatgaaaag

SEQ ID NO: 4971788 - DNA, 15 bp, Homo sapiens
atattggtattcact

SEQ ID NO: 4971789 - DNA, 13 bp, Homo sapiens
atattgtacataa

SEQ ID NO: 4971790 - DNA, 20 bp, Homo sapiens
atattgtgccaatatgtatt

SEQ ID NO: 4971791 - DNA, 17 bp, Homo sapiens
atattgtgtttgtgtat

SEQ ID NO: 4971792 - DNA, 15 bp, Homo sapiens
atattgttcaaacaa

SEQ ID NO: 4971793 - DNA, 20 bp, Homo sapiens
atattgttcaaacaatatca

SEQ ID NO: 4971794 - DNA, 13 bp, Homo sapiens
atattgtttttct

SEQ ID NO: 4971795 - DNA, 19 bp, Homo sapiens
atatttaatgcattaaacc

SEQ ID NO: 4971796 - DNA, 22 bp, Homo sapiens
atatttaatgcattaaacctgt

SEQ ID NO: 4971797 - DNA, 14 bp, Homo sapiens
atatttaattatta

SEQ ID NO: 4971798 - DNA, 17 bp, Homo sapiens
atatttaattattaact

SEQ ID NO: 4971799 - DNA, 17 bp, Homo sapiens
atatttataaatgagca

SEQ ID NO: 4971800 - DNA, 15 bp, Homo sapiens
atatttatatattta

SEQ ID NO: 4971801 - DNA, 18 bp, Homo sapiens
atatttatgtctatttaa

SEQ ID NO: 4971802 - DNA, 20 bp, Homo sapiens
atatttattaaataaaatca

SEQ ID NO: 4971803 - DNA, 13 bp, Homo sapiens
atatttatttaaa

SEQ ID NO: 4971804 - DNA, 22 bp, Homo sapiens
atatttccctaaaatacattta

SEQ ID NO: 4971805 - DNA, 20 bp, Homo sapiens
atatttgaattttaaatcta

SEQ ID NO: 4971806 - DNA, 21 bp, Homo sapiens
atatttggcttaaatatagtt

SEQ ID NO: 4971807 - DNA, 19 bp, Homo sapiens
atattttaatgcagttgct

SEQ ID NO: 4971808 - DNA, 19 bp, Homo sapiens
atattttcaacgcagccct

SEQ ID NO: 4971809 - DNA, 17 bp, Homo sapiens
atattttgataataata

SEQ ID NO: 4971810 - DNA, 18 bp, Homo sapiens
atattttgataataatat

SEQ ID NO: 4971811 - DNA, 13 bp, Homo sapiens
atattttgtatat

SEQ ID NO: 4971812 - DNA, 16 bp, Homo sapiens
atattttgtattattg

SEQ ID NO: 4971813 - DNA, 18 bp, Homo sapiens
atattttgtattattgct

SEQ ID NO: 4971814 - DNA, 22 bp, Homo sapiens
atattttgtattattgctgttg

SEQ ID NO: 4971815 - DNA, 20 bp, Homo sapiens
atatttttaaaatatttatt

SEQ ID NO: 4971816 - DNA, 14 bp, Homo sapiens
atatttttaaagat

SEQ ID NO: 4971817 - DNA, 15 bp, Homo sapiens
atatttttaaagatc

SEQ ID NO: 4971818 - DNA, 13 bp, Homo sapiens
atatttttagata

SEQ ID NO: 4971819 - DNA, 20 bp, Homo sapiens
atatttttataataaacata

SEQ ID NO: 4971820 - DNA, 20 bp, Homo sapiens
atattttttatatatacagt

SEQ ID NO: 4971821 - DNA, 12 bp, Homo sapiens
atcaaaatgctt

SEQ ID NO: 4971822 - DNA, 13 bp, Homo sapiens
atcaaaatgcttt

SEQ ID NO: 4971823 - DNA, 17 bp, Homo sapiens
atcaaagcatagatgtt

SEQ ID NO: 4971824 - DNA, 15 bp, Homo sapiens
atcaacaagatttcc

SEQ ID NO: 4971825 - DNA, 17 bp, Homo sapiens
atcaacagaagcatttg

SEQ ID NO: 4971826 - DNA, 15 bp, Homo sapiens
atcaactactattca

SEQ ID NO: 4971827 - DNA, 23 bp, Homo sapiens
atcaagttgtaacttatattgaa

SEQ ID NO: 4971828 - DNA, 18 bp, Homo sapiens
atcaatatctaatatata

SEQ ID NO: 4971829 - DNA, 18 bp, Homo sapiens
atcaatgaatattgaagt

SEQ ID NO: 4971830 - DNA, 22 bp, Homo sapiens
atcaatgcaagagtgattgcag

SEQ ID NO: 4971831 - DNA, 13 bp, Homo sapiens
atcacaaaaattt

SEQ ID NO: 4971832 - DNA, 21 bp, Homo sapiens
atcacaaccaccgttacaagt

SEQ ID NO: 4971833 - DNA, 13 bp, Homo sapiens
atcacaatacaga

SEQ ID NO: 4971834 - DNA, 11 bp, Homo sapiens
atcacacacac

SEQ ID NO: 4971835 - DNA, 14 bp, Homo sapiens
atcacagcagcctc

SEQ ID NO: 4971836 - DNA, 18 bp, Homo sapiens
atcacagggttgggccca

SEQ ID NO: 4971837 - DNA, 23 bp, Homo sapiens
atcacagggttgggcccagatct

SEQ ID NO: 4971838 - DNA, 24 bp, Homo sapiens
atcacattgagctgatataaattc

SEQ ID NO: 4971839 - DNA, 20 bp, Homo sapiens
atcaccccaaccccccaaaa

SEQ ID NO: 4971840 - DNA, 22 bp, Homo sapiens
atcaccgacgcgtctcctgttt

SEQ ID NO: 4971841 - DNA, 14 bp, Homo sapiens
atcacctatttcca

SEQ ID NO: 4971842 - DNA, 15 bp, Homo sapiens
atcacctatttccat

SEQ ID NO: 4971843 - DNA, 12 bp, Homo sapiens
atcacctgcctg

SEQ ID NO: 4971844 - DNA, 15 bp, Homo sapiens
atcacgccactgcac

SEQ ID NO: 4971845 - DNA, 21 bp, Homo sapiens
atcactctgctgcttagacat

SEQ ID NO: 4971846 - DNA, 20 bp, Homo sapiens
atcactgccacactctccat

SEQ ID NO: 4971847 - DNA, 21 bp, Homo sapiens
atcactgccacactctccatc

SEQ ID NO: 4971848 - DNA, 16 bp, Homo sapiens
atcacttgtacaaaat

SEQ ID NO: 4971849 - DNA, 15 bp, Homo sapiens
atcacttttcagtga

SEQ ID NO: 4971850 - DNA, 15 bp, Homo sapiens
atcactttttgaact

SEQ ID NO: 4971851 - DNA, 17 bp, Homo sapiens
atcactttttgaactaa

SEQ ID NO: 4971852 - DNA, 22 bp, Homo sapiens
atcactttttgaactaagaaac

SEQ ID NO: 4971853 - DNA, 14 bp, Homo sapiens
atcagaaattttta

SEQ ID NO: 4971854 - DNA, 22 bp, Homo sapiens
atcagaatagccacatttggaa

SEQ ID NO: 4971855 - DNA, 13 bp, Homo sapiens
aaaaaaaaagttc

SEQ ID NO: 4971856 - DNA, 12 bp, Homo sapiens
aaaaaaaagctt

SEQ ID NO: 4971857 - DNA, 14 bp, Homo sapiens
aaaaaaaagcttta

SEQ ID NO: 4971858 - DNA, 12 bp, Homo sapiens
aaaaaaagcttt

SEQ ID NO: 4971859 - DNA, 12 bp, Homo sapiens
aaaaaaatcaca

SEQ ID NO: 4971860 - DNA, 15 bp, Homo sapiens
aaaaaacagaggcca

SEQ ID NO: 4971861 - DNA, 16 bp, Homo sapiens
aaaaaaccacaaaggc

SEQ ID NO: 4971862 - DNA, 10 bp, Homo sapiens
aaaaaagctc

SEQ ID NO: 4971863 - DNA, 11 bp, Homo sapiens
aaaaaagctca

SEQ ID NO: 4971864 - DNA, 11 bp, Homo sapiens
aaaaaagcttt

SEQ ID NO: 4971865 - DNA, 20 bp, Homo sapiens
aaaaaatagatgtcttttat

SEQ ID NO: 4971866 - DNA, 13 bp, Homo sapiens
aaaaaatatttat

SEQ ID NO: 4971867 - DNA, 22 bp, Homo sapiens
aaaaaattagaaattggctgga

SEQ ID NO: 4971868 - DNA, 15 bp, Homo sapiens
aaaaacacctagctt

SEQ ID NO: 4971869 - DNA, 14 bp, Homo sapiens
aaaaacagaggcca

SEQ ID NO: 4971870 - DNA, 16 bp, Homo sapiens
aaaaaccacacaaaga

SEQ ID NO: 4971871 - DNA, 14 bp, Homo sapiens
aaaaagaaaatgaa

SEQ ID NO: 4971872 - DNA, 19 bp, Homo sapiens
aaaaagactttaaaagtga

SEQ ID NO: 4971873 - DNA, 19 bp, Homo sapiens
aaaaagagaattagattat

SEQ ID NO: 4971874 - DNA, 23 bp, Homo sapiens
aaaaagattttcagaaaatatta

SEQ ID NO: 4971875 - DNA, 20 bp, Homo sapiens
aaaaagcataaaaacatttt

SEQ ID NO: 4971876 - DNA, 9 bp, Homo sapiens
aaaaagctc

SEQ ID NO: 4971877 - DNA, 19 bp, Homo sapiens
aaaaagctcatattttgta

SEQ ID NO: 4971878 - DNA, 19 bp, Homo sapiens
aaaaagcttccatgattct

SEQ ID NO: 4971879 - DNA, 21 bp, Homo sapiens
aaaaagggatccgtacattca

SEQ ID NO: 4971880 - DNA, 11 bp, Homo sapiens
aaaaagggtca

SEQ ID NO: 4971881 - DNA, 19 bp, Homo sapiens
aaaaagggtcaatgctatt

SEQ ID NO: 4971882 - DNA, 15 bp, Homo sapiens
aaaaagtgacacagc

SEQ ID NO: 4971883 - DNA, 22 bp, Homo sapiens
aaaaagtggggcagagcctccc

SEQ ID NO: 4971884 - DNA, 12 bp, Homo sapiens
aaaaagtgttta

SEQ ID NO: 4971885 - DNA, 23 bp, Homo sapiens
aaaaagtgtttatttttcatatt

SEQ ID NO: 4971886 - DNA, 20 bp, Homo sapiens
aaaaatcacaatttttaatg

SEQ ID NO: 4971887 - DNA, 20 bp, Homo sapiens
aaaaatcatctattttgatg

SEQ ID NO: 4971888 - DNA, 13 bp, Homo sapiens
aaaaatcttgtgc

SEQ ID NO: 4971889 - DNA, 13 bp, Homo sapiens
aaaaatgcctttg

SEQ ID NO: 4971890 - DNA, 14 bp, Homo sapiens
aaaaatgcctttga

SEQ ID NO: 4971891 - DNA, 15 bp, Homo sapiens
aaaaatgcctttgag

SEQ ID NO: 4971892 - DNA, 19 bp, Homo sapiens
aaaaatgcctttgagacag

SEQ ID NO: 4971893 - DNA, 13 bp, Homo sapiens
aaaaatgtaaata

SEQ ID NO: 4971894 - DNA, 22 bp, Homo sapiens
aaaaattaggacagaaataata

SEQ ID NO: 4971895 - DNA, 13 bp, Homo sapiens
aaaaattccagaa

SEQ ID NO: 4971896 - DNA, 19 bp, Homo sapiens
aaaaattgaagagagatat

SEQ ID NO: 4971897 - DNA, 17 bp, Homo sapiens
aaaaatttgaacactgg

SEQ ID NO: 4971898 - DNA, 22 bp, Homo sapiens
aaaaattttataaaattaagca

SEQ ID NO: 4971899 - DNA, 10 bp, Homo sapiens
aaaacaaaac

SEQ ID NO: 4971900 - DNA, 20 bp, Homo sapiens
aaaacaaaactatacttgaa

SEQ ID NO: 4971901 - DNA, 14 bp, Homo sapiens
aaaacaaccaagcg

SEQ ID NO: 4971902 - DNA, 21 bp, Homo sapiens
aaaacaccgcttctgcctttt

SEQ ID NO: 4971903 - DNA, 22 bp, Homo sapiens
aaaacacctagctttattcttc

SEQ ID NO: 4971904 - DNA, 21 bp, Homo sapiens
aaaacactaaaaataaaaatg

SEQ ID NO: 4971905 - DNA, 20 bp, Homo sapiens
aaaacactgaaaaattatac

SEQ ID NO: 4971906 - DNA, 13 bp, Homo sapiens
aaaacactgtgga

SEQ ID NO: 4971907 - DNA, 18 bp, Homo sapiens
aaaacagaacatcattag

SEQ ID NO: 4971908 - DNA, 21 bp, Homo sapiens
aaaacagaacatcattagaac

SEQ ID NO: 4971909 - DNA, 21 bp, Homo sapiens
aaaacattttttttttaaatc

SEQ ID NO: 4971910 - DNA, 14 bp, Homo sapiens
aaacacgaaacttg

SEQ ID NO: 4971911 - DNA, 24 bp, Homo sapiens
aaacactcagttgttcaataataa

SEQ ID NO: 4971912 - DNA, 23 bp, Homo sapiens
aaacactgccatcttagtttgga

SEQ ID NO: 4971913 - DNA, 13 bp, Homo sapiens
aaacactgccttt

SEQ ID NO: 4971914 - DNA, 13 bp, Homo sapiens
aaacactgtggaa

SEQ ID NO: 4971915 - DNA, 22 bp, Homo sapiens
aaacactgtggaactaataaat

SEQ ID NO: 4971916 - DNA, 17 bp, Homo sapiens
aaacactttgcctcctg

SEQ ID NO: 4971917 - DNA, 13 bp, Homo sapiens
aaacagaaacaaa

SEQ ID NO: 4971918 - DNA, 21 bp, Homo sapiens
aaacagaaacaaaaacactaa

SEQ ID NO: 4971919 - DNA, 12 bp, Homo sapiens
aaacagaacagg

SEQ ID NO: 4971920 - DNA, 15 bp, Homo sapiens
aaacagaacagggtc

SEQ ID NO: 4971921 - DNA, 13 bp, Homo sapiens
aaacagaacatca

SEQ ID NO: 4971922 - DNA, 19 bp, Homo sapiens
aaacagataccatactcat

SEQ ID NO: 4971923 - DNA, 21 bp, Homo sapiens
aaacagatgatgagaatttct

SEQ ID NO: 4971924 - DNA, 14 bp, Homo sapiens
aaacagcagtgttc

SEQ ID NO: 4971925 - DNA, 17 bp, Homo sapiens
aaacagctaatgggaca

SEQ ID NO: 4971926 - DNA, 12 bp, Homo sapiens
aaacagctttca

SEQ ID NO: 4971927 - DNA, 16 bp, Homo sapiens
aaacaggagacaggaa

SEQ ID NO: 4971928 - DNA, 12 bp, Homo sapiens
aaacagtattta

SEQ ID NO: 4971929 - DNA, 14 bp, Homo sapiens
aaacagtatttatt

SEQ ID NO: 4971930 - DNA, 17 bp, Homo sapiens
aaacagtatttattttg

SEQ ID NO: 4971931 - DNA, 18 bp, Homo sapiens
aaacagtatttcattgcc

SEQ ID NO: 4971932 - DNA, 15 bp, Homo sapiens
aaacatatgatttca

SEQ ID NO: 4971933 - DNA, 15 bp, Homo sapiens
aaacatgagatgtgt

SEQ ID NO: 4971934 - DNA, 13 bp, Homo sapiens
aaacatgtattta

SEQ ID NO: 4971935 - DNA, 15 bp, Homo sapiens
aaacatgtatttatg

SEQ ID NO: 4971936 - DNA, 16 bp, Homo sapiens
aaacatgttagaagca

SEQ ID NO: 4971937 - DNA, 17 bp, Homo sapiens
aaacatgttagaagcaa

SEQ ID NO: 4971938 - DNA, 23 bp, Homo sapiens
aaacattctgatttggaaaaaga

SEQ ID NO: 4971939 - DNA, 19 bp, Homo sapiens
aaacattgacgattccttc

SEQ ID NO: 4971940 - DNA, 24 bp, Homo sapiens
aaacattgacgattccttctctga

SEQ ID NO: 4971941 - DNA, 17 bp, Homo sapiens
aaacattgtgttgacat

SEQ ID NO: 4971942 - DNA, 14 bp, Homo sapiens
aaacattttaaaaa

SEQ ID NO: 4971943 - DNA, 18 bp, Homo sapiens
aaaccaaaatgacatctt

SEQ ID NO: 4971944 - DNA, 23 bp, Homo sapiens
aaaccaaaggacattatgtgtgc

SEQ ID NO: 4971945 - DNA, 23 bp, Homo sapiens
aaaccaaattcagggacaaatgg

SEQ ID NO: 4971946 - DNA, 16 bp, Homo sapiens
aaaccaagccgtggct

SEQ ID NO: 4971947 - DNA, 21 bp, Homo sapiens
aaaccaagtcggaacagcaga

SEQ ID NO: 4971948 - DNA, 19 bp, Homo sapiens
aaaccacaaaggccaaact

SEQ ID NO: 4971949 - DNA, 12 bp, Homo sapiens
aaaccacacaaa

SEQ ID NO: 4971950 - DNA, 23 bp, Homo sapiens
aaaccaccagtgcccaaagtctg

SEQ ID NO: 4971951 - DNA, 23 bp, Homo sapiens
aaaccagtttagatttcaagaaa

SEQ ID NO: 4971952 - DNA, 18 bp, Homo sapiens
aaaccatctggcctggcc

SEQ ID NO: 4971953 - DNA, 17 bp, Homo sapiens
aaaccatttttaaagta

SEQ ID NO: 4971954 - DNA, 13 bp, Homo sapiens
aaacccacaaaaa

SEQ ID NO: 4971955 - DNA, 21 bp, Homo sapiens
aaaccctaggttcccggtccc

SEQ ID NO: 4971956 - DNA, 16 bp, Homo sapiens
aaaccgcctagtttac

SEQ ID NO: 4971957 - DNA, 16 bp, Homo sapiens
aaacctagtactgccc

SEQ ID NO: 4971958 - DNA, 12 bp, Homo sapiens
aaacctgaagac

SEQ ID NO: 4971959 - DNA, 15 bp, Homo sapiens
aaacctggatgtcac

SEQ ID NO: 4971960 - DNA, 21 bp, Homo sapiens
aaacctgggattcaggaatgt

SEQ ID NO: 4971961 - DNA, 11 bp, Homo sapiens
aaacctttcaa

SEQ ID NO: 4971962 - DNA, 13 bp, Homo sapiens
aaacctttgcccc

SEQ ID NO: 4971963 - DNA, 20 bp, Homo sapiens
aaaccttttggaaaatctgc

SEQ ID NO: 4971964 - DNA, 15 bp, Homo sapiens
aaaccttttttaaga

SEQ ID NO: 4971965 - DNA, 16 bp, Homo sapiens
aaaccttttttaagat

SEQ ID NO: 4971966 - DNA, 19 bp, Homo sapiens
aaaccttttttaagatttt

SEQ ID NO: 4971967 - DNA, 23 bp, Homo sapiens
aaaccttttttaagatttttctc

SEQ ID NO: 4971968 - DNA, 18 bp, Homo sapiens
aaacgctgtcaaaagttg

SEQ ID NO: 4971969 - DNA, 18 bp, Homo sapiens
aaactaaaagacatttgt

SEQ ID NO: 4971970 - DNA, 17 bp, Homo sapiens
aaactaaatctctaata

SEQ ID NO: 4971971 - DNA, 18 bp, Homo sapiens
aaactacagacctgcttt

SEQ ID NO: 4971972 - DNA, 12 bp, Homo sapiens
aaactactcttt

SEQ ID NO: 4971973 - DNA, 17 bp, Homo sapiens
aaactaggaaatttttt

SEQ ID NO: 4971974 - DNA, 15 bp, Homo sapiens
aaactatctggccat

SEQ ID NO: 4971975 - DNA, 13 bp, Homo sapiens
aaactcaaaactt

SEQ ID NO: 4971976 - DNA, 18 bp, Homo sapiens
aaactcagggacagagcc

SEQ ID NO: 4971977 - DNA, 16 bp, Homo sapiens
aaactccgcccccagc

SEQ ID NO: 4971978 - DNA, 13 bp, Homo sapiens
aaactctttattt

SEQ ID NO: 4971979 - DNA, 12 bp, Homo sapiens
aaactgaaaatc

SEQ ID NO: 4971980 - DNA, 18 bp, Homo sapiens
aaactgaaaatctaatat

SEQ ID NO: 4971981 - DNA, 19 bp, Homo sapiens
aaactgaggaattttcttt

SEQ ID NO: 4971982 - DNA, 23 bp, Homo sapiens
aaactgcttttttttttccagca

SEQ ID NO: 4971983 - DNA, 19 bp, Homo sapiens
aaactggaacggtgaaggt

SEQ ID NO: 4971984 - DNA, 15 bp, Homo sapiens
aaactggagtctgga

SEQ ID NO: 4971985 - DNA, 19 bp, Homo sapiens
aaactgtctttaaaagaga

SEQ ID NO: 4971986 - DNA, 12 bp, Homo sapiens
aaactgttagca

SEQ ID NO: 4971987 - DNA, 16 bp, Homo sapiens
aaactgttagcactgt

SEQ ID NO: 4971988 - DNA, 21 bp, Homo sapiens
aaactgttagcactgttgatg

SEQ ID NO: 4971989 - DNA, 22 bp, Homo sapiens
aaactgttcaagaaataataaa

SEQ ID NO: 4971990 - DNA, 14 bp, Homo sapiens
aaccacggaaaaga

SEQ ID NO: 4971991 - DNA, 16 bp, Homo sapiens
aaccacttcattctgc

SEQ ID NO: 4971992 - DNA, 13 bp, Homo sapiens
aaccactttcctt

SEQ ID NO: 4971993 - DNA, 13 bp, Homo sapiens
aaccagataacat

SEQ ID NO: 4971994 - DNA, 19 bp, Homo sapiens
aaccagggaagctgtccct

SEQ ID NO: 4971995 - DNA, 14 bp, Homo sapiens
aaccatatgatact

SEQ ID NO: 4971996 - DNA, 17 bp, Homo sapiens
aaccatgaagacaggat

SEQ ID NO: 4971997 - DNA, 23 bp, Homo sapiens
aaccattccatttccaagcactt

SEQ ID NO: 4971998 - DNA, 23 bp, Homo sapiens
aaccatttgaagtgtacctgtgt

SEQ ID NO: 4971999 - DNA, 16 bp, Homo sapiens
aacccaagctcctcct

SEQ ID NO: 4972000 - DNA, 18 bp, Homo sapiens
aacccaaggactgaggga

SEQ ID NO: 4972001 - DNA, 17 bp, Homo sapiens
aacccaaggagcacagg

SEQ ID NO: 4972002 - DNA, 20 bp, Homo sapiens
aacccaaggagcacaggtcc

SEQ ID NO: 4972003 - DNA, 14 bp, Homo sapiens
aacccaatccaaat

SEQ ID NO: 4972004 - DNA, 20 bp, Homo sapiens
aacccacttgtcactgacac

SEQ ID NO: 4972005 - DNA, 21 bp, Homo sapiens
aacccacttgtcactgacaca

SEQ ID NO: 4972006 - DNA, 17 bp, Homo sapiens
aacccagcagttctgtt

SEQ ID NO: 4972007 - DNA, 19 bp, Homo sapiens
aacccagggctctgcccca

SEQ ID NO: 4972008 - DNA, 22 bp, Homo sapiens
aacccagggctctgccccagtc

SEQ ID NO: 4972009 - DNA, 15 bp, Homo sapiens
aacccatgagattca

SEQ ID NO: 4972010 - DNA, 18 bp, Homo sapiens
aaccccaacgcacaggaa

SEQ ID NO: 4972011 - DNA, 10 bp, Homo sapiens
aacccccacc

SEQ ID NO: 4972012 - DNA, 18 bp, Homo sapiens
aacccccaccccacactt

SEQ ID NO: 4972013 - DNA, 20 bp, Homo sapiens
aaccctaggttcccggtccc

SEQ ID NO: 4972014 - DNA, 19 bp, Homo sapiens
aaccctatctcctgacaga

SEQ ID NO: 4972015 - DNA, 12 bp, Homo sapiens
aaccctcagagc

SEQ ID NO: 4972016 - DNA, 23 bp, Homo sapiens
aaccctcaggggaaaactgttac

SEQ ID NO: 4972017 - DNA, 21 bp, Homo sapiens
aacccttggagccaatggaga

SEQ ID NO: 4972018 - DNA, 17 bp, Homo sapiens
aaccgagcaaagatcaa

SEQ ID NO: 4972019 - DNA, 14 bp, Homo sapiens
aacctagagaagat

SEQ ID NO: 4972020 - DNA, 18 bp, Homo sapiens
aacctcccagaggtccag

SEQ ID NO: 4972021 - DNA, 19 bp, Homo sapiens
aacctccctcttgttttgt

SEQ ID NO: 4972022 - DNA, 20 bp, Homo sapiens
aacctccctcttgttttgtt

SEQ ID NO: 4972023 - DNA, 23 bp, Homo sapiens
aacctccctcttgttttgtttgt

SEQ ID NO: 4972024 - DNA, 16 bp, Homo sapiens
aacctctacatattta

SEQ ID NO: 4972025 - DNA, 13 bp, Homo sapiens
aacctctgtctca

SEQ ID NO: 4972026 - DNA, 11 bp, Homo sapiens
aacctcttccc

SEQ ID NO: 4972027 - DNA, 12 bp, Homo sapiens
aacctcttcccc

SEQ ID NO: 4972028 - DNA, 14 bp, Homo sapiens
aacctcttccccag

SEQ ID NO: 4972029 - DNA, 21 bp, Homo sapiens
aacctgaaaaaaagtttacaa

SEQ ID NO: 4972030 - DNA, 15 bp, Homo sapiens
aacctgattgtaaac

SEQ ID NO: 4972031 - DNA, 16 bp, Homo sapiens
aacctgattgtaaact

SEQ ID NO: 4972032 - DNA, 20 bp, Homo sapiens
aacctgctctcctcttgcca

SEQ ID NO: 4972033 - DNA, 19 bp, Homo sapiens
aacctggccgcgtttagac

SEQ ID NO: 4972034 - DNA, 17 bp, Homo sapiens
aacctgggattcaggaa

SEQ ID NO: 4972035 - DNA, 21 bp, Homo sapiens
aacctgggattcaggaatgtg

SEQ ID NO: 4972036 - DNA, 23 bp, Homo sapiens
aacctgtcctaaggaaccttcct

SEQ ID NO: 4972037 - DNA, 23 bp, Homo sapiens
aacctgttgctgtgtttaatttg

SEQ ID NO: 4972038 - DNA, 16 bp, Homo sapiens
aaccttatcctgcatt

SEQ ID NO: 4972039 - DNA, 19 bp, Homo sapiens
aaccttatcctgcattgtt

SEQ ID NO: 4972040 - DNA, 22 bp, Homo sapiens
aaccttccatacatttttttct

SEQ ID NO: 4972041 - DNA, 13 bp, Homo sapiens
aaccttgaatgct

SEQ ID NO: 4972042 - DNA, 16 bp, Homo sapiens
aaccttgaatgctgcc

SEQ ID NO: 4972043 - DNA, 17 bp, Homo sapiens
aaccttgaatgctgcca

SEQ ID NO: 4972044 - DNA, 18 bp, Homo sapiens
aacctttcaaatttcaca

SEQ ID NO: 4972045 - DNA, 12 bp, Homo sapiens
aacctttttaaa

SEQ ID NO: 4972046 - DNA, 13 bp, Homo sapiens
aacgatgtgtctg

SEQ ID NO: 4972047 - DNA, 16 bp, Homo sapiens
aacgatgtgtctgtat

SEQ ID NO: 4972048 - DNA, 20 bp, Homo sapiens
aacgatgtgtctgtatttca

SEQ ID NO: 4972049 - DNA, 17 bp, Homo sapiens
aacgcctcccctgcccc

SEQ ID NO: 4972050 - DNA, 17 bp, Homo sapiens
aacgcttaaaggaagtc

SEQ ID NO: 4972051 - DNA, 19 bp, Homo sapiens
aacggccctgcagccagct

SEQ ID NO: 4972052 - DNA, 14 bp, Homo sapiens
aacggttcagtttc

SEQ ID NO: 4972053 - DNA, 15 bp, Homo sapiens
aacgtgatacatttg

SEQ ID NO: 4972054 - DNA, 14 bp, Homo sapiens
aactaaaagacatt

SEQ ID NO: 4972055 - DNA, 21 bp, Homo sapiens
aactaaatttgatacttatat

SEQ ID NO: 4972056 - DNA, 19 bp, Homo sapiens
aactaagaaacttttgtaa

SEQ ID NO: 4972057 - DNA, 23 bp, Homo sapiens
aactaatccttctggcagattca

SEQ ID NO: 4972058 - DNA, 22 bp, Homo sapiens
aactacagacctgctttttgaa

SEQ ID NO: 4972059 - DNA, 13 bp, Homo sapiens
aactacatgagaa

SEQ ID NO: 4972060 - DNA, 15 bp, Homo sapiens
aactacatttatgag

SEQ ID NO: 4972061 - DNA, 17 bp, Homo sapiens
aagaaaagtattttgaa

SEQ ID NO: 4972062 - DNA, 21 bp, Homo sapiens
aagaaaagtattttgaagttt

SEQ ID NO: 4972063 - DNA, 23 bp, Homo sapiens
aagaaaatcagatggagcatgaa

SEQ ID NO: 4972064 - DNA, 12 bp, Homo sapiens
aagaaaatggtt

SEQ ID NO: 4972065 - DNA, 19 bp, Homo sapiens
aagaaaatttttgtagtag

SEQ ID NO: 4972066 - DNA, 19 bp, Homo sapiens
aagaaactgaggaattttc

SEQ ID NO: 4972067 - DNA, 20 bp, Homo sapiens
aagaaactgaggaattttct

SEQ ID NO: 4972068 - DNA, 21 bp, Homo sapiens
aagaaactgaggaattttctt

SEQ ID NO: 4972069 - DNA, 13 bp, Homo sapiens
aagaaacttttgt

SEQ ID NO: 4972070 - DNA, 15 bp, Homo sapiens
aagaaacttttgtaa

SEQ ID NO: 4972071 - DNA, 19 bp, Homo sapiens
aagaaacttttgtaaagaa

SEQ ID NO: 4972072 - DNA, 13 bp, Homo sapiens
aagaaagactcta

SEQ ID NO: 4972073 - DNA, 18 bp, Homo sapiens
aagaaatatgtgagattt

SEQ ID NO: 4972074 - DNA, 19 bp, Homo sapiens
aagaaatatgtgagatttt

SEQ ID NO: 4972075 - DNA, 20 bp, Homo sapiens
aagaaatattccaaatgtct

SEQ ID NO: 4972076 - DNA, 13 bp, Homo sapiens
aagaaatccctgt

SEQ ID NO: 4972077 - DNA, 23 bp, Homo sapiens
aagaaatccctgtttaatattta

SEQ ID NO: 4972078 - DNA, 15 bp, Homo sapiens
aagaaatgactaatt

SEQ ID NO: 4972079 - DNA, 16 bp, Homo sapiens
aagaaatgactaatta

SEQ ID NO: 4972080 - DNA, 23 bp, Homo sapiens
aagaaatgatgttggagaaggga

SEQ ID NO: 4972081 - DNA, 18 bp, Homo sapiens
aagaaatggattctattt

SEQ ID NO: 4972082 - DNA, 16 bp, Homo sapiens
aagaaattgcaataac

SEQ ID NO: 4972083 - DNA, 15 bp, Homo sapiens
aagaaatttattact

SEQ ID NO: 4972084 - DNA, 18 bp, Homo sapiens
aagaaatttattacttgt

SEQ ID NO: 4972085 - DNA, 22 bp, Homo sapiens
aagaaccaaaagttttcctgag

SEQ ID NO: 4972086 - DNA, 9 bp, Homo sapiens
aagaagaag

SEQ ID NO: 4972087 - DNA, 13 bp, Homo sapiens
aagaagaagggca

SEQ ID NO: 4972088 - DNA, 19 bp, Homo sapiens
aagaagagaagctgctgac

SEQ ID NO: 4972089 - DNA, 14 bp, Homo sapiens
aagaagctgttgta

SEQ ID NO: 4972090 - DNA, 22 bp, Homo sapiens
aagaagctgttgtacatttatg

SEQ ID NO: 4972091 - DNA, 15 bp, Homo sapiens
aagaagcttctaata

SEQ ID NO: 4972092 - DNA, 14 bp, Homo sapiens
aagaaggcaaaaat

SEQ ID NO: 4972093 - DNA, 16 bp, Homo sapiens
aagaaggcaaaaatgt

SEQ ID NO: 4972094 - DNA, 21 bp, Homo sapiens
aagaataattcaattttaaag

SEQ ID NO: 4972095 - DNA, 19 bp, Homo sapiens
aagaataggcattaacaca

SEQ ID NO: 4972096 - DNA, 12 bp, Homo sapiens
aagaatatatat

SEQ ID NO: 4972097 - DNA, 18 bp, Homo sapiens
aagaatatgtttccttgt

SEQ ID NO: 4972098 - DNA, 17 bp, Homo sapiens
aagaatattcagagaat

SEQ ID NO: 4972099 - DNA, 17 bp, Homo sapiens
aagaatccacatttcta

SEQ ID NO: 4972100 - DNA, 21 bp, Homo sapiens
aagaatccacatttctaaaat

SEQ ID NO: 4972101 - DNA, 18 bp, Homo sapiens
aagaatgttggtttactt

SEQ ID NO: 4972102 - DNA, 19 bp, Homo sapiens
aagaattcttatacacatt

SEQ ID NO: 4972103 - DNA, 16 bp, Homo sapiens
aacaaagcacagtgtt

SEQ ID NO: 4972104 - DNA, 19 bp, Homo sapiens
aacaaagctgttaaactgt

SEQ ID NO: 4972105 - DNA, 21 bp, Homo sapiens
aacaaaggcaagttaagagaa

SEQ ID NO: 4972106 - DNA, 16 bp, Homo sapiens
aacaaaggttgagatg

SEQ ID NO: 4972107 - DNA, 12 bp, Homo sapiens
aacaaagtcttt

SEQ ID NO: 4972108 - DNA, 12 bp, Homo sapiens
aacaaatatgca

SEQ ID NO: 4972109 - DNA, 18 bp, Homo sapiens
aacaaatatgctaatttg

SEQ ID NO: 4972110 - DNA, 18 bp, Homo sapiens
aacaaattcatattctgt

SEQ ID NO: 4972111 - DNA, 22 bp, Homo sapiens
aacaacctggccgcgtttagac

SEQ ID NO: 4972112 - DNA, 20 bp, Homo sapiens
aacaagatttccttgtgcaa

SEQ ID NO: 4972113 - DNA, 19 bp, Homo sapiens
aacaaggggctgttacata

SEQ ID NO: 4972114 - DNA, 21 bp, Homo sapiens
aacaagtgaaataacaaaatg

SEQ ID NO: 4972115 - DNA, 16 bp, Homo sapiens
aacaataaaacattat

SEQ ID NO: 4972116 - DNA, 17 bp, Homo sapiens
aacaataaaacattatg

SEQ ID NO: 4972117 - DNA, 14 bp, Homo sapiens
aacaataaagagat

SEQ ID NO: 4972118 - DNA, 19 bp, Homo sapiens
aacaataaatgttggcttg

SEQ ID NO: 4972119 - DNA, 13 bp, Homo sapiens
aacaatcacactc

SEQ ID NO: 4972120 - DNA, 18 bp, Homo sapiens
aacaatgaagataaaaag

SEQ ID NO: 4972121 - DNA, 15 bp, Homo sapiens
aacaatgatgccctg

SEQ ID NO: 4972122 - DNA, 21 bp, Homo sapiens
aacaatgttaaggaaactctt

SEQ ID NO: 4972123 - DNA, 22 bp, Homo sapiens
aacaatttcctttatatttagt

SEQ ID NO: 4972124 - DNA, 15 bp, Homo sapiens
aacacaaactgtaaa

SEQ ID NO: 4972125 - DNA, 16 bp, Homo sapiens
aacacaaactgtaaat

SEQ ID NO: 4972126 - DNA, 16 bp, Homo sapiens
aacacaagtcctgtga

SEQ ID NO: 4972127 - DNA, 20 bp, Homo sapiens
aacacacagatacacacaca

SEQ ID NO: 4972128 - DNA, 18 bp, Homo sapiens
aacacactgttgtttagt

SEQ ID NO: 4972129 - DNA, 13 bp, Homo sapiens
aacacagcctggg

SEQ ID NO: 4972130 - DNA, 14 bp, Homo sapiens
aacacagcctgggc

SEQ ID NO: 4972131 - DNA, 19 bp, Homo sapiens
aacacagctgagagacttt

SEQ ID NO: 4972132 - DNA, 13 bp, Homo sapiens
aacacaggcagct

SEQ ID NO: 4972133 - DNA, 19 bp, Homo sapiens
aacacagtcaaaataattc

SEQ ID NO: 4972134 - DNA, 17 bp, Homo sapiens
aacaccacagacacaca

SEQ ID NO: 4972135 - DNA, 23 bp, Homo sapiens
aacaccacagacacacacacgca

SEQ ID NO: 4972136 - DNA, 18 bp, Homo sapiens
aacaccctcgaagcgcgc

SEQ ID NO: 4972137 - DNA, 23 bp, Homo sapiens
aacacctcccaggagacagttca

SEQ ID NO: 4972138 - DNA, 21 bp, Homo sapiens
aacaccttcttattatatata

SEQ ID NO: 4972139 - DNA, 19 bp, Homo sapiens
aacacgaaacttgttattg

SEQ ID NO: 4972140 - DNA, 19 bp, Homo sapiens
aacacgcatggtcaaccct

SEQ ID NO: 4972141 - DNA, 17 bp, Homo sapiens
aacactaactcaccagc

SEQ ID NO: 4972142 - DNA, 21 bp, Homo sapiens
aacactcacatttattctgct

SEQ ID NO: 4972143 - DNA, 23 bp, Homo sapiens
aacactgcctttttatttatatg

SEQ ID NO: 4972144 - DNA, 20 bp, Homo sapiens
aacactggtgtgacctgagg

SEQ ID NO: 4972145 - DNA, 22 bp, Homo sapiens
aacactggtgtgacctgagggc

SEQ ID NO: 4972146 - DNA, 11 bp, Homo sapiens
aacacttccat

SEQ ID NO: 4972147 - DNA, 17 bp, Homo sapiens
aacactttgcctcctgt

SEQ ID NO: 4972148 - DNA, 19 bp, Homo sapiens
aacagaaaacattctgatt

SEQ ID NO: 4972149 - DNA, 15 bp, Homo sapiens
aacagaacagcttca

SEQ ID NO: 4972150 - DNA, 12 bp, Homo sapiens
aacagaacaggg

SEQ ID NO: 4972151 - DNA, 21 bp, Homo sapiens
aacagaactaaatgttctatg

SEQ ID NO: 4972152 - DNA, 15 bp, Homo sapiens
aacagaagcatttgt

SEQ ID NO: 4972153 - DNA, 17 bp, Homo sapiens
aacagaagcatttgtat

SEQ ID NO: 4972154 - DNA, 14 bp, Homo sapiens
aacagaatgtttta

SEQ ID NO: 4972155 - DNA, 18 bp, Homo sapiens
aacagacaacagaagtca

SEQ ID NO: 4972156 - DNA, 20 bp, Homo sapiens
aacagaggaagaatttgtta

SEQ ID NO: 4972157 - DNA, 21 bp, Homo sapiens
aacagatgatgagaatttcta

SEQ ID NO: 4972158 - DNA, 13 bp, Homo sapiens
aacagcagtgttc

SEQ ID NO: 4972159 - DNA, 15 bp, Homo sapiens
aacagcagtgttccc

SEQ ID NO: 4972160 - DNA, 11 bp, Homo sapiens
aacagccatgc

SEQ ID NO: 4972161 - DNA, 16 bp, Homo sapiens
aacagccatgcccgca

SEQ ID NO: 4972162 - DNA, 20 bp, Homo sapiens
aacagcgaagtagcttgctc

SEQ ID NO: 4972163 - DNA, 22 bp, Homo sapiens
aacagctatgggagccccaggg

SEQ ID NO: 4972164 - DNA, 24 bp, Homo sapiens
aacagctcgatccaaattgtgctt

SEQ ID NO: 4972165 - DNA, 15 bp, Homo sapiens
aacagcttcaggtta

SEQ ID NO: 4972166 - DNA, 16 bp, Homo sapiens
aacagctttcaagtgc

SEQ ID NO: 4972167 - DNA, 21 bp, Homo sapiens
aacaggctgttctgcactgaa

SEQ ID NO: 4972168 - DNA, 23 bp, Homo sapiens
aacaggctgttctgcactgaaaa

SEQ ID NO: 4972169 - DNA, 15 bp, Homo sapiens
aacaggtaatataaa

SEQ ID NO: 4972170 - DNA, 17 bp, Homo sapiens
aacagtatttattttgt

SEQ ID NO: 4972171 - DNA, 23 bp, Homo sapiens
aacagtatttattttgtaattat

SEQ ID NO: 4972172 - DNA, 19 bp, Homo sapiens
aacagttaataccattttt

SEQ ID NO: 4972173 - DNA, 15 bp, Homo sapiens
aacataaaaaggaca

SEQ ID NO: 4972174 - DNA, 12 bp, Homo sapiens
aacataaaacaa

SEQ ID NO: 4972175 - DNA, 16 bp, Homo sapiens
aaagacactgcctggg

SEQ ID NO: 4972176 - DNA, 14 bp, Homo sapiens
aaagacatgttgta

SEQ ID NO: 4972177 - DNA, 14 bp, Homo sapiens
aaagactaatttaa

SEQ ID NO: 4972178 - DNA, 20 bp, Homo sapiens
aaagactaatttaaaaaata

SEQ ID NO: 4972179 - DNA, 23 bp, Homo sapiens
aaagactaatttaaaaaataact

SEQ ID NO: 4972180 - DNA, 12 bp, Homo sapiens
aaagagaaaaaa

SEQ ID NO: 4972181 - DNA, 19 bp, Homo sapiens
aaagagaagaagaaaaaaa

SEQ ID NO: 4972182 - DNA, 20 bp, Homo sapiens
aaagagagagagagaaaaaa

SEQ ID NO: 4972183 - DNA, 12 bp, Homo sapiens
aaagagcacaaa

SEQ ID NO: 4972184 - DNA, 18 bp, Homo sapiens
aaagaggctgcccctctc

SEQ ID NO: 4972185 - DNA, 20 bp, Homo sapiens
aaagaggctgcccctctcac

SEQ ID NO: 4972186 - DNA, 22 bp, Homo sapiens
aaagaggctgcccctctcacca

SEQ ID NO: 4972187 - DNA, 14 bp, Homo sapiens
aaagagtctagatt

SEQ ID NO: 4972188 - DNA, 15 bp, Homo sapiens
aaagagtctagattc

SEQ ID NO: 4972189 - DNA, 12 bp, Homo sapiens
aaagagttagaa

SEQ ID NO: 4972190 - DNA, 24 bp, Homo sapiens
aaagagttctggaaaagaactgtt

SEQ ID NO: 4972191 - DNA, 17 bp, Homo sapiens
aaagataatattactgt

SEQ ID NO: 4972192 - DNA, 23 bp, Homo sapiens
aaagatatggagaattgctgaag

SEQ ID NO: 4972193 - DNA, 14 bp, Homo sapiens
aaagatcaaaataa

SEQ ID NO: 4972194 - DNA, 17 bp, Homo sapiens
aaagatcaaaataaaaa

SEQ ID NO: 4972195 - DNA, 12 bp, Homo sapiens
aaagatgaagtt

SEQ ID NO: 4972196 - DNA, 21 bp, Homo sapiens
aaagatggagtttctaaggtc

SEQ ID NO: 4972197 - DNA, 18 bp, Homo sapiens
aaagattagcaaggtcat

SEQ ID NO: 4972198 - DNA, 15 bp, Homo sapiens
aaagattcatgattt

SEQ ID NO: 4972199 - DNA, 12 bp, Homo sapiens
aaagattctttt

SEQ ID NO: 4972200 - DNA, 20 bp, Homo sapiens
aaagatttaagcacaaactt

SEQ ID NO: 4972201 - DNA, 21 bp, Homo sapiens
aaagcaactgttatgaaataa

SEQ ID NO: 4972202 - DNA, 19 bp, Homo sapiens
aaagcacaggagacactgt

SEQ ID NO: 4972203 - DNA, 14 bp, Homo sapiens
aaagcacggactct

SEQ ID NO: 4972204 - DNA, 17 bp, Homo sapiens
aaagcagggaatttcta

SEQ ID NO: 4972205 - DNA, 18 bp, Homo sapiens
aaagcagggaatttctat

SEQ ID NO: 4972206 - DNA, 18 bp, Homo sapiens
aaagcaggggctacaaga

SEQ ID NO: 4972207 - DNA, 18 bp, Homo sapiens
aaagcataaaaacatttt

SEQ ID NO: 4972208 - DNA, 18 bp, Homo sapiens
aaagcataagtatacagt

SEQ ID NO: 4972209 - DNA, 20 bp, Homo sapiens
aaagcatagatgttttggta

SEQ ID NO: 4972210 - DNA, 21 bp, Homo sapiens
aaagcatatgggttagatgtt

SEQ ID NO: 4972211 - DNA, 18 bp, Homo sapiens
aaagccacattatttcta

SEQ ID NO: 4972212 - DNA, 21 bp, Homo sapiens
aaagccacattatttctagtc

SEQ ID NO: 4972213 - DNA, 19 bp, Homo sapiens
aaagccacctctgtcattt

SEQ ID NO: 4972214 - DNA, 13 bp, Homo sapiens
aaagccagggtct

SEQ ID NO: 4972215 - DNA, 14 bp, Homo sapiens
aaagccagggtctc

SEQ ID NO: 4972216 - DNA, 22 bp, Homo sapiens
aaagccagggtctctccctcag

SEQ ID NO: 4972217 - DNA, 15 bp, Homo sapiens
aaagccttagggaag

SEQ ID NO: 4972218 - DNA, 19 bp, Homo sapiens
aaagccttagggaagctgg

SEQ ID NO: 4972219 - DNA, 19 bp, Homo sapiens
aaagccttgtgtatatttg

SEQ ID NO: 4972220 - DNA, 23 bp, Homo sapiens
aaagccttgtgtatatttgtata

SEQ ID NO: 4972221 - DNA, 17 bp, Homo sapiens
aaagcctttagtatcag

SEQ ID NO: 4972222 - DNA, 18 bp, Homo sapiens
aaagcgttggatgtagca

SEQ ID NO: 4972223 - DNA, 20 bp, Homo sapiens
aaagctattagccaggatca

SEQ ID NO: 4972224 - DNA, 13 bp, Homo sapiens
aaagctcctgtcc

SEQ ID NO: 4972225 - DNA, 21 bp, Homo sapiens
aaagctgcctgtagttaggaa

SEQ ID NO: 4972226 - DNA, 14 bp, Homo sapiens
aaagctgttaaact

SEQ ID NO: 4972227 - DNA, 15 bp, Homo sapiens
aaagctgttaaactg

SEQ ID NO: 4972228 - DNA, 20 bp, Homo sapiens
aaagcttatccataaaaaaa

SEQ ID NO: 4972229 - DNA, 12 bp, Homo sapiens
aaagcttcttaa

SEQ ID NO: 4972230 - DNA, 13 bp, Homo sapiens
aaagctttatgat

SEQ ID NO: 4972231 - DNA, 21 bp, Homo sapiens
aaagctttatgattttcataa

SEQ ID NO: 4972232 - DNA, 17 bp, Homo sapiens
aaaggaaaaagctccat

SEQ ID NO: 4972233 - DNA, 19 bp, Homo sapiens
aaaggacagagtatgaaca

SEQ ID NO: 4972234 - DNA, 16 bp, Homo sapiens
aaaggacatcagcaaa

SEQ ID NO: 4972235 - DNA, 15 bp, Homo sapiens
aaaggacattatgtg

SEQ ID NO: 4972236 - DNA, 22 bp, Homo sapiens
aaaggagagactcccatgaagc

SEQ ID NO: 4972237 - DNA, 23 bp, Homo sapiens
aaaggagagactcccatgaagcc

SEQ ID NO: 4972238 - DNA, 14 bp, Homo sapiens
aaaggaggctggca

SEQ ID NO: 4972239 - DNA, 22 bp, Homo sapiens
aaaggcaagttaagagaaactt

SEQ ID NO: 4972240 - DNA, 23 bp, Homo sapiens
aaaggcaagttaagagaaacttt

SEQ ID NO: 4972241 - DNA, 15 bp, Homo sapiens
aaaggcctgcacaca

SEQ ID NO: 4972242 - DNA, 19 bp, Homo sapiens
aaaggctaggtacacagct

SEQ ID NO: 4972243 - DNA, 22 bp, Homo sapiens
aaagggacttggaagctccgct

SEQ ID NO: 4972244 - DNA, 20 bp, Homo sapiens
aaagggcccagagagggtgg

SEQ ID NO: 4972245 - DNA, 19 bp, Homo sapiens
aaaggggatcataaagtta

SEQ ID NO: 4972246 - DNA, 22 bp, Homo sapiens
aaagggtcaatgctatttttgt

SEQ ID NO: 4972247 - DNA, 21 bp, Homo sapiens
aaaggtccacaggtctagact

SEQ ID NO: 4972248 - DNA, 18 bp, Homo sapiens
aaaggtctttttaaacca

SEQ ID NO: 4972249 - DNA, 13 bp, Homo sapiens
aaaggtgtattta

SEQ ID NO: 4972250 - DNA, 20 bp, Homo sapiens
aaaggttctaggtttcaaag

SEQ ID NO: 4972251 - DNA, 21 bp, Homo sapiens
aaaggttcttcatccctttcc

SEQ ID NO: 4972252 - DNA, 15 bp, Homo sapiens
aatgaacactctttt

SEQ ID NO: 4972253 - DNA, 18 bp, Homo sapiens
aatgaacactcttttgct

SEQ ID NO: 4972254 - DNA, 13 bp, Homo sapiens
aatgaacattcca

SEQ ID NO: 4972255 - DNA, 16 bp, Homo sapiens
aatgaaccacatcttg

SEQ ID NO: 4972256 - DNA, 17 bp, Homo sapiens
aatgaagcagctttaaa

SEQ ID NO: 4972257 - DNA, 18 bp, Homo sapiens
aatgaatatctattaata

SEQ ID NO: 4972258 - DNA, 19 bp, Homo sapiens
aatgaatatctattaatat

SEQ ID NO: 4972259 - DNA, 13 bp, Homo sapiens
aatgaatattgaa

SEQ ID NO: 4972260 - DNA, 15 bp, Homo sapiens
aatgaatattgaagt

SEQ ID NO: 4972261 - DNA, 17 bp, Homo sapiens
aatgaatattttgataa

SEQ ID NO: 4972262 - DNA, 19 bp, Homo sapiens
aatgaatgaggtctgggct

SEQ ID NO: 4972263 - DNA, 13 bp, Homo sapiens
aatgacaacagaa

SEQ ID NO: 4972264 - DNA, 13 bp, Homo sapiens
aatgacatctttt

SEQ ID NO: 4972265 - DNA, 20 bp, Homo sapiens
aatgacatctttttaaagct

SEQ ID NO: 4972266 - DNA, 16 bp, Homo sapiens
aatgactaattagggt

SEQ ID NO: 4972267 - DNA, 23 bp, Homo sapiens
aatgactaattagggtacattta

SEQ ID NO: 4972268 - DNA, 15 bp, Homo sapiens
aatgagaaggcagcc

SEQ ID NO: 4972269 - DNA, 13 bp, Homo sapiens
aatgagcccagag

SEQ ID NO: 4972270 - DNA, 18 bp, Homo sapiens
aatgagctattaaaactc

SEQ ID NO: 4972271 - DNA, 15 bp, Homo sapiens
aatgaggattattga

SEQ ID NO: 4972272 - DNA, 16 bp, Homo sapiens
aatgaggtcccaggca

SEQ ID NO: 4972273 - DNA, 16 bp, Homo sapiens
aatgaggtctgggcta

SEQ ID NO: 4972274 - DNA, 14 bp, Homo sapiens
aatgaggtctgttt

SEQ ID NO: 4972275 - DNA, 13 bp, Homo sapiens
aatgagttgtgaa

SEQ ID NO: 4972276 - DNA, 21 bp, Homo sapiens
aatgataagtaaatgctaggt

SEQ ID NO: 4972277 - DNA, 16 bp, Homo sapiens
aatgatactgatggtg

SEQ ID NO: 4972278 - DNA, 15 bp, Homo sapiens
aatgatagctactgt

SEQ ID NO: 4972279 - DNA, 19 bp, Homo sapiens
aatgatagttgattttcaa

SEQ ID NO: 4972280 - DNA, 17 bp, Homo sapiens
aatgatgccctgctcca

SEQ ID NO: 4972281 - DNA, 19 bp, Homo sapiens
aatgatggcaattttgtaa

SEQ ID NO: 4972282 - DNA, 22 bp, Homo sapiens
aatgatggtaggaagaagctct

SEQ ID NO: 4972283 - DNA, 15 bp, Homo sapiens
aatgattattttcat

SEQ ID NO: 4972284 - DNA, 23 bp, Homo sapiens
aatgattattttcattacaatgg

SEQ ID NO: 4972285 - DNA, 16 bp, Homo sapiens
aatgattcatgttata

SEQ ID NO: 4972286 - DNA, 13 bp, Homo sapiens
aatgattgtaaaa

SEQ ID NO: 4972287 - DNA, 22 bp, Homo sapiens
aatgatttcatgctatctctgt

SEQ ID NO: 4972288 - DNA, 14 bp, Homo sapiens
aatgcaaaaccttt

SEQ ID NO: 4972289 - DNA, 21 bp, Homo sapiens
aatgcaagagtgattgcagct

SEQ ID NO: 4972290 - DNA, 16 bp, Homo sapiens
aatgcaatttgattga

SEQ ID NO: 4972291 - DNA, 18 bp, Homo sapiens
aatgcacagatatacttt

SEQ ID NO: 4972292 - DNA, 18 bp, Homo sapiens
aatgcacatccattccca

SEQ ID NO: 4972293 - DNA, 11 bp, Homo sapiens
aatgcacggcc

SEQ ID NO: 4972294 - DNA, 22 bp, Homo sapiens
aatgcagcttgtgtgcaaaagc

SEQ ID NO: 4972295 - DNA, 17 bp, Homo sapiens
aatgcatacagaaatat

SEQ ID NO: 4972296 - DNA, 15 bp, Homo sapiens
aatgcattaaacctg

SEQ ID NO: 4972297 - DNA, 20 bp, Homo sapiens
aatgccatttatttattgat

SEQ ID NO: 4972298 - DNA, 16 bp, Homo sapiens
aatgcctaataaacaa

SEQ ID NO: 4972299 - DNA, 13 bp, Homo sapiens
aatgcctcctgtg

SEQ ID NO: 4972300 - DNA, 15 bp, Homo sapiens
aatgcctcctgtggg

SEQ ID NO: 4972301 - DNA, 19 bp, Homo sapiens
aatgcctttgagacagttt

SEQ ID NO: 4972302 - DNA, 18 bp, Homo sapiens
aatgctatttttgttttt

SEQ ID NO: 4972303 - DNA, 19 bp, Homo sapiens
aatgctatttttgttttta

SEQ ID NO: 4972304 - DNA, 13 bp, Homo sapiens
aatgctgcactaa

SEQ ID NO: 4972305 - DNA, 17 bp, Homo sapiens
aatgctgcacttcctgt

SEQ ID NO: 4972306 - DNA, 22 bp, Homo sapiens
aatgctgccttcccatgaatct

SEQ ID NO: 4972307 - DNA, 23 bp, Homo sapiens
aatgctgccttttctttaacttt

SEQ ID NO: 4972308 - DNA, 15 bp, Homo sapiens
aatgctgtacatcta

SEQ ID NO: 4972309 - DNA, 17 bp, Homo sapiens
aatgctgtacatctatt

SEQ ID NO: 4972310 - DNA, 23 bp, Homo sapiens
aatgctgtacatctattttggat

SEQ ID NO: 4972311 - DNA, 17 bp, Homo sapiens
aatgcttcattcaatat

SEQ ID NO: 4972312 - DNA, 21 bp, Homo sapiens
aatgcttcattcaatattgac

SEQ ID NO: 4972313 - DNA, 14 bp, Homo sapiens
aatgctttttgaat

SEQ ID NO: 4972314 - DNA, 17 bp, Homo sapiens
aatgctttttgaatgtt

SEQ ID NO: 4972315 - DNA, 22 bp, Homo sapiens
aatggaaatcatcgaaaattca

SEQ ID NO: 4972316 - DNA, 15 bp, Homo sapiens
aatggaagagaaatc

SEQ ID NO: 4972317 - DNA, 13 bp, Homo sapiens
aatggagaggaac

SEQ ID NO: 4972318 - DNA, 19 bp, Homo sapiens
aatggatactacatcttta

SEQ ID NO: 4972319 - DNA, 20 bp, Homo sapiens
aatggattggattatttaat

SEQ ID NO: 4972320 - DNA, 23 bp, Homo sapiens
aatggattggattatttaataac

SEQ ID NO: 4972321 - DNA, 21 bp, Homo sapiens
aatggatttgatgctgtttga

SEQ ID NO: 4972322 - DNA, 12 bp, Homo sapiens
aatggcactgat

SEQ ID NO: 4972323 - DNA, 16 bp, Homo sapiens
aatggcagcagaaaac

SEQ ID NO: 4972324 - DNA, 18 bp, Homo sapiens
aatggcagcagaaaactt

SEQ ID NO: 4972325 - DNA, 16 bp, Homo sapiens
aatggcagccttggca

SEQ ID NO: 4972326 - DNA, 20 bp, Homo sapiens
aatggcgtctggaagtccaa

SEQ ID NO: 4972327 - DNA, 15 bp, Homo sapiens
aatgggctcttccaa

SEQ ID NO: 4972328 - DNA, 16 bp, Homo sapiens
aatggtatggaactct

SEQ ID NO: 4972329 - DNA, 15 bp, Homo sapiens
aatggtcgcccagga

SEQ ID NO: 4972330 - DNA, 18 bp, Homo sapiens
aatggtctaaaaataaac

SEQ ID NO: 4972331 - DNA, 17 bp, Homo sapiens
aatggtgcttaagttcc

SEQ ID NO: 4972332 - DNA, 15 bp, Homo sapiens
aatggttctgaaata

SEQ ID NO: 4972333 - DNA, 21 bp, Homo sapiens
aatggtttattttgtattgtg

SEQ ID NO: 4972334 - DNA, 17 bp, Homo sapiens
aatgtaaaaaagaaaaa

SEQ ID NO: 4972335 - DNA, 14 bp, Homo sapiens
aatgtaaaatgatt

SEQ ID NO: 4972336 - DNA, 15 bp, Homo sapiens
aatgtaaactgccat

SEQ ID NO: 4972337 - DNA, 15 bp, Homo sapiens
aatgtaaagatttgc

SEQ ID NO: 4972338 - DNA, 20 bp, Homo sapiens
aatgtaaaggagtcaaaact

SEQ ID NO: 4972339 - DNA, 19 bp, Homo sapiens
aatgtaagattatagattc

SEQ ID NO: 4972340 - DNA, 20 bp, Homo sapiens
aatgtaagattatagattct

SEQ ID NO: 4972341 - DNA, 23 bp, Homo sapiens
aatgtaagattatagattctaaa

SEQ ID NO: 4972342 - DNA, 19 bp, Homo sapiens
aatgtatactatagtacca

SEQ ID NO: 4972343 - DNA, 21 bp, Homo sapiens
aatgtatatacacatatacct

SEQ ID NO: 4972344 - DNA, 20 bp, Homo sapiens
aatgtatatatttagtgctg

SEQ ID NO: 4972345 - DNA, 17 bp, Homo sapiens
aatgtatctgtgaagta

SEQ ID NO: 4972346 - DNA, 14 bp, Homo sapiens
aatgtatttgttca

SEQ ID NO: 4972347 - DNA, 15 bp, Homo sapiens
aatgtcaaaattgtt

SEQ ID NO: 4972348 - DNA, 13 bp, Homo sapiens
aatgtcacaggca

SEQ ID NO: 4972349 - DNA, 14 bp, Homo sapiens
aatgtcacaggcag

SEQ ID NO: 4972350 - DNA, 19 bp, Homo sapiens
aatgtcacgtactgtctga

SEQ ID NO: 4972351 - DNA, 18 bp, Homo sapiens
aatgtcaggaacagaagg

SEQ ID NO: 4972352 - DNA, 20 bp, Homo sapiens
aatgtcaggaacagaaggat

SEQ ID NO: 4972353 - DNA, 12 bp, Homo sapiens
aatgtctaaatg

SEQ ID NO: 4972354 - DNA, 13 bp, Homo sapiens
aatgtctcctccc

SEQ ID NO: 4972355 - DNA, 16 bp, Homo sapiens
aatgtctgctgaggag

SEQ ID NO: 4972356 - DNA, 15 bp, Homo sapiens
aatgtcttttgaata

SEQ ID NO: 4972357 - DNA, 15 bp, Homo sapiens
aatgtgaacttgtag

SEQ ID NO: 4972358 - DNA, 22 bp, Homo sapiens
aatgtgaacttgtagctgtaaa

SEQ ID NO: 4972359 - DNA, 23 bp, Homo sapiens
aatgtgagtttggtctggactga

SEQ ID NO: 4972360 - DNA, 14 bp, Homo sapiens
aatgtgattctaat

SEQ ID NO: 4972361 - DNA, 22 bp, Homo sapiens
aatgtgattctaatgtcttcat

SEQ ID NO: 4972362 - DNA, 21 bp, Homo sapiens
aatgtggcccctgaacaagaa

SEQ ID NO: 4972363 - DNA, 13 bp, Homo sapiens
aatatgctaattt

SEQ ID NO: 4972364 - DNA, 11 bp, Homo sapiens
aatatgcttac

SEQ ID NO: 4972365 - DNA, 14 bp, Homo sapiens
aatatggatttgtt

SEQ ID NO: 4972366 - DNA, 15 bp, Homo sapiens
aatatgtattgtaaa

SEQ ID NO: 4972367 - DNA, 16 bp, Homo sapiens
aatatgtgagattttt

SEQ ID NO: 4972368 - DNA, 18 bp, Homo sapiens
aatatgtgagatttttta

SEQ ID NO: 4972369 - DNA, 19 bp, Homo sapiens
aatatgtgagattttttat

SEQ ID NO: 4972370 - DNA, 14 bp, Homo sapiens
aatatgtgtttact

SEQ ID NO: 4972371 - DNA, 17 bp, Homo sapiens
aatattactcctatttt

SEQ ID NO: 4972372 - DNA, 18 bp, Homo sapiens
aatattagttaatggatt

SEQ ID NO: 4972373 - DNA, 16 bp, Homo sapiens
aatattgaggctttgt

SEQ ID NO: 4972374 - DNA, 20 bp, Homo sapiens
aatattgaggctttgtgttg

SEQ ID NO: 4972375 - DNA, 23 bp, Homo sapiens
aatattgtgaagaaaaataaagt

SEQ ID NO: 4972376 - DNA, 16 bp, Homo sapiens
aatattgttgacaact

SEQ ID NO: 4972377 - DNA, 22 bp, Homo sapiens
aatattgttgacaactgtgact

SEQ ID NO: 4972378 - DNA, 19 bp, Homo sapiens
aatattgttgtataatttc

SEQ ID NO: 4972379 - DNA, 12 bp, Homo sapiens
aatatttaaaca

SEQ ID NO: 4972380 - DNA, 16 bp, Homo sapiens
aatatttaaacagcag

SEQ ID NO: 4972381 - DNA, 17 bp, Homo sapiens
aatatttaaacagcagt

SEQ ID NO: 4972382 - DNA, 23 bp, Homo sapiens
aatatttatgtctatttaagcct

SEQ ID NO: 4972383 - DNA, 11 bp, Homo sapiens
aatatttatta

SEQ ID NO: 4972384 - DNA, 16 bp, Homo sapiens
aatatttgacttgcat

SEQ ID NO: 4972385 - DNA, 21 bp, Homo sapiens
aatatttggtctctatttcat

SEQ ID NO: 4972386 - DNA, 14 bp, Homo sapiens
aatattttgataat

SEQ ID NO: 4972387 - DNA, 15 bp, Homo sapiens
aatattttgataata

SEQ ID NO: 4972388 - DNA, 21 bp, Homo sapiens
aatattttgtattattgctgt

SEQ ID NO: 4972389 - DNA, 14 bp, Homo sapiens
aatatttttagata

SEQ ID NO: 4972390 - DNA, 14 bp, Homo sapiens
aatcaaaaattgaa

SEQ ID NO: 4972391 - DNA, 15 bp, Homo sapiens
aatcaaataagtatt

SEQ ID NO: 4972392 - DNA, 19 bp, Homo sapiens
aatcaaataagtatttata

SEQ ID NO: 4972393 - DNA, 12 bp, Homo sapiens
aatcaacagaag

SEQ ID NO: 4972394 - DNA, 13 bp, Homo sapiens
aatcaacagaagc

SEQ ID NO: 4972395 - DNA, 22 bp, Homo sapiens
aatcaagccatgtataaatgtg

SEQ ID NO: 4972396 - DNA, 22 bp, Homo sapiens
aatcaagttgtaacttatattg

SEQ ID NO: 4972397 - DNA, 14 bp, Homo sapiens
aatcaatgaatatt

SEQ ID NO: 4972398 - DNA, 16 bp, Homo sapiens
aatcaatgaatattga

SEQ ID NO: 4972399 - DNA, 15 bp, Homo sapiens
aatcacaatttttaa

SEQ ID NO: 4972400 - DNA, 17 bp, Homo sapiens
aatcacaatttttaatg

SEQ ID NO: 4972401 - DNA, 15 bp, Homo sapiens
aatcacagttggcct

SEQ ID NO: 4972402 - DNA, 18 bp, Homo sapiens
aatcactctgtccttgga

SEQ ID NO: 4972403 - DNA, 13 bp, Homo sapiens
aatcagaaatttt

SEQ ID NO: 4972404 - DNA, 13 bp, Homo sapiens
aatcagagacaaa

SEQ ID NO: 4972405 - DNA, 17 bp, Homo sapiens
aatcagagtagaaataa

SEQ ID NO: 4972406 - DNA, 18 bp, Homo sapiens
aatcagagtagaaataaa

SEQ ID NO: 4972407 - DNA, 15 bp, Homo sapiens
aatcagatctttatt

SEQ ID NO: 4972408 - DNA, 13 bp, Homo sapiens
aatcagcactgaa

SEQ ID NO: 4972409 - DNA, 17 bp, Homo sapiens
aatcagcactgaaaata

SEQ ID NO: 4972410 - DNA, 18 bp, Homo sapiens
aatcagcattctcactcc

SEQ ID NO: 4972411 - DNA, 13 bp, Homo sapiens
aatcatatgtgat

SEQ ID NO: 4972412 - DNA, 14 bp, Homo sapiens
aatcatatgtgatc

SEQ ID NO: 4972413 - DNA, 23 bp, Homo sapiens
aatcatattgatgaaaagattta

SEQ ID NO: 4972414 - DNA, 15 bp, Homo sapiens
aatcatctattttga

SEQ ID NO: 4972415 - DNA, 23 bp, Homo sapiens
aatcatctattttgatgcagcat

SEQ ID NO: 4972416 - DNA, 16 bp, Homo sapiens
aatcatgtcaggcctg

SEQ ID NO: 4972417 - DNA, 14 bp, Homo sapiens
aatcattgctttga

SEQ ID NO: 4972418 - DNA, 21 bp, Homo sapiens
aatcattgctttgaagcagtt

SEQ ID NO: 4972419 - DNA, 12 bp, Homo sapiens
aatcattgttgc

SEQ ID NO: 4972420 - DNA, 17 bp, Homo sapiens
aatcattgttttgaata

SEQ ID NO: 4972421 - DNA, 20 bp, Homo sapiens
aatcattgttttgaatatta

SEQ ID NO: 4972422 - DNA, 13 bp, Homo sapiens
aatcatttctcac

SEQ ID NO: 4972423 - DNA, 23 bp, Homo sapiens
aatccaagcctccacagcgaggg

SEQ ID NO: 4972424 - DNA, 13 bp, Homo sapiens
aatccaagctccc

SEQ ID NO: 4972425 - DNA, 20 bp, Homo sapiens
aatccaagctccctgcccca

SEQ ID NO: 4972426 - DNA, 22 bp, Homo sapiens
aatccaagctccctgccccaaa

SEQ ID NO: 4972427 - DNA, 16 bp, Homo sapiens
aatccacatttctaaa

SEQ ID NO: 4972428 - DNA, 17 bp, Homo sapiens
aatccagacccggctgc

SEQ ID NO: 4972429 - DNA, 19 bp, Homo sapiens
aatccagacccggctgcgt

SEQ ID NO: 4972430 - DNA, 16 bp, Homo sapiens
aatccaggcacagctg

SEQ ID NO: 4972431 - DNA, 14 bp, Homo sapiens
aatcccaaaagtca

SEQ ID NO: 4972432 - DNA, 13 bp, Homo sapiens
aatcccccaggag

SEQ ID NO: 4972433 - DNA, 14 bp, Homo sapiens
aatcccccaggaga

SEQ ID NO: 4972434 - DNA, 23 bp, Homo sapiens
aatccctagggctggcagaaagg

SEQ ID NO: 4972435 - DNA, 23 bp, Homo sapiens
aatccctgtttaatatttaaaca

SEQ ID NO: 4972436 - DNA, 17 bp, Homo sapiens
aatcctgcaatgaaagg

SEQ ID NO: 4972437 - DNA, 16 bp, Homo sapiens
aatcctggcagcccag

SEQ ID NO: 4972438 - DNA, 22 bp, Homo sapiens
aatcctttgttttctgactaat

SEQ ID NO: 4972439 - DNA, 20 bp, Homo sapiens
aatcgagtgagacaaaattt

SEQ ID NO: 4972440 - DNA, 14 bp, Homo sapiens
aatctaaatctatt

SEQ ID NO: 4972441 - DNA, 15 bp, Homo sapiens
aatctaaatctattt

SEQ ID NO: 4972442 - DNA, 19 bp, Homo sapiens
aatctaaatctatttatta

SEQ ID NO: 4972443 - DNA, 17 bp, Homo sapiens
aatctactaattccaca

SEQ ID NO: 4972444 - DNA, 19 bp, Homo sapiens
aatctagtttacagaaaaa

SEQ ID NO: 4972445 - DNA, 16 bp, Homo sapiens
aatctattctgtgttg

SEQ ID NO: 4972446 - DNA, 21 bp, Homo sapiens
aatctattctgtgttgcatta

SEQ ID NO: 4972447 - DNA, 17 bp, Homo sapiens
aatctattttctatgta

SEQ ID NO: 4972448 - DNA, 21 bp, Homo sapiens
aatctattttctatgtactag

SEQ ID NO: 4972449 - DNA, 23 bp, Homo sapiens
aatctcagaggtagggctgccac

SEQ ID NO: 4972450 - DNA, 16 bp, Homo sapiens
aatctcatacctctga

SEQ ID NO: 4972451 - DNA, 19 bp, Homo sapiens
aatctcatacctctgacca

SEQ ID NO: 4972452 - DNA, 15 bp, Homo sapiens
aatctctctgcagct

SEQ ID NO: 4972453 - DNA, 23 bp, Homo sapiens
aatctgatttttatgatgatgaa

SEQ ID NO: 4972454 - DNA, 18 bp, Homo sapiens
aatctggactcctctgtc

SEQ ID NO: 4972455 - DNA, 16 bp, Homo sapiens
aatctgggaagggaag

SEQ ID NO: 4972456 - DNA, 11 bp, Homo sapiens
aatctgtacat

SEQ ID NO: 4972457 - DNA, 19 bp, Homo sapiens
aatctgtacattttgttgt

SEQ ID NO: 4972458 - DNA, 22 bp, Homo sapiens
aatctgtacattttgttgtaaa

SEQ ID NO: 4972459 - DNA, 14 bp, Homo sapiens
aatctgtcaaaaca

SEQ ID NO: 4972460 - DNA, 16 bp, Homo sapiens
aatctgtcaaaacact

SEQ ID NO: 4972461 - DNA, 21 bp, Homo sapiens
aatctgtcaaaacactgtgga

SEQ ID NO: 4972462 - DNA, 12 bp, Homo sapiens
aatctgttatcc

SEQ ID NO: 4972463 - DNA, 11 bp, Homo sapiens
aatctgttgcc

SEQ ID NO: 4972464 - DNA, 18 bp, Homo sapiens
aatcttatagttctaggc

SEQ ID NO: 4972465 - DNA, 19 bp, Homo sapiens
aatcttgtgctagaatact

SEQ ID NO: 4972466 - DNA, 22 bp, Homo sapiens
aatcttgtgctagaatactttt

SEQ ID NO: 4972467 - DNA, 22 bp, Homo sapiens
aatctttcttttgattcttcct

SEQ ID NO: 4972468 - DNA, 21 bp, Homo sapiens
aatgaaaagtcgttttccaaa

SEQ ID NO: 4972469 - DNA, 20 bp, Homo sapiens
aatgaaacaaataatcacat

SEQ ID NO: 4972470 - DNA, 12 bp, Homo sapiens
aatgaaagatta

SEQ ID NO: 4972471 - DNA, 20 bp, Homo sapiens
aatgaaagattaaacagatg

SEQ ID NO: 4972472 - DNA, 17 bp, Homo sapiens
aatgaaaggtactatat

SEQ ID NO: 4972473 - DNA, 21 bp, Homo sapiens
aatgaaatcctgcttcagtgt

SEQ ID NO: 4972474 - DNA, 17 bp, Homo sapiens
aatgaaatttaaacatt

SEQ ID NO: 4972475 - DNA, 21 bp, Homo sapiens
aagtactgtaataatacctca

SEQ ID NO: 4972476 - DNA, 14 bp, Homo sapiens
aagtactgtttacc

SEQ ID NO: 4972477 - DNA, 19 bp, Homo sapiens
aagtacttctccaccctgc

SEQ ID NO: 4972478 - DNA, 22 bp, Homo sapiens
aagtacttctccaccctgctct

SEQ ID NO: 4972479 - DNA, 21 bp, Homo sapiens
aagtacttgagtgtaatgttt

SEQ ID NO: 4972480 - DNA, 22 bp, Homo sapiens
aagtacttgagtgtaatgtttg

SEQ ID NO: 4972481 - DNA, 12 bp, Homo sapiens
aagtagaagagg

SEQ ID NO: 4972482 - DNA, 18 bp, Homo sapiens
aagtagacaatcattgtt

SEQ ID NO: 4972483 - DNA, 19 bp, Homo sapiens
aagtagacaatcattgttt

SEQ ID NO: 4972484 - DNA, 15 bp, Homo sapiens
aagtagcagtgtgaa

SEQ ID NO: 4972485 - DNA, 21 bp, Homo sapiens
aagtatacagttcaataaact

SEQ ID NO: 4972486 - DNA, 17 bp, Homo sapiens
aagtatagagagaagtt

SEQ ID NO: 4972487 - DNA, 23 bp, Homo sapiens
aagtatagagagaagttcataca

SEQ ID NO: 4972488 - DNA, 22 bp, Homo sapiens
aagtatagcctatggcagaaaa

SEQ ID NO: 4972489 - DNA, 21 bp, Homo sapiens
aagtatgagggaaaatgagta

SEQ ID NO: 4972490 - DNA, 12 bp, Homo sapiens
aagtatgtaaag

SEQ ID NO: 4972491 - DNA, 15 bp, Homo sapiens
aagtattaaaacatt

SEQ ID NO: 4972492 - DNA, 21 bp, Homo sapiens
aagtattaaaacattggatta

SEQ ID NO: 4972493 - DNA, 10 bp, Homo sapiens
aagtatttag

SEQ ID NO: 4972494 - DNA, 13 bp, Homo sapiens
aagtatttgggaa

SEQ ID NO: 4972495 - DNA, 13 bp, Homo sapiens
aagtcacacagtg

SEQ ID NO: 4972496 - DNA, 15 bp, Homo sapiens
aagtcacatgcgtaa

SEQ ID NO: 4972497 - DNA, 19 bp, Homo sapiens
aagtcaccttgtgtgttcc

SEQ ID NO: 4972498 - DNA, 12 bp, Homo sapiens
aagtcactgcac

SEQ ID NO: 4972499 - DNA, 19 bp, Homo sapiens
aagtcagcccaacaggcag

SEQ ID NO: 4972500 - DNA, 21 bp, Homo sapiens
aagtcaggcccttattttcaa

SEQ ID NO: 4972501 - DNA, 16 bp, Homo sapiens
aagtcagtatggtcta

SEQ ID NO: 4972502 - DNA, 15 bp, Homo sapiens
aagtcagtgttgaga

SEQ ID NO: 4972503 - DNA, 17 bp, Homo sapiens
aagtcagtgttgagatg

SEQ ID NO: 4972504 - DNA, 15 bp, Homo sapiens
aagtcatgaagccca

SEQ ID NO: 4972505 - DNA, 17 bp, Homo sapiens
aagtcatgaagcccaag

SEQ ID NO: 4972506 - DNA, 20 bp, Homo sapiens
aagtcatggcaggtacagta

SEQ ID NO: 4972507 - DNA, 15 bp, Homo sapiens
aagtcatgtgcattt

SEQ ID NO: 4972508 - DNA, 19 bp, Homo sapiens
aagtcattccttcttttta

SEQ ID NO: 4972509 - DNA, 12 bp, Homo sapiens
aagtccaatgtg

SEQ ID NO: 4972510 - DNA, 17 bp, Homo sapiens
aagtcgttttccaaact

SEQ ID NO: 4972511 - DNA, 19 bp, Homo sapiens
aagtcgttttccaaactga

SEQ ID NO: 4972512 - DNA, 19 bp, Homo sapiens
aagtctcccttctgtttct

SEQ ID NO: 4972513 - DNA, 15 bp, Homo sapiens
aagtctctaattcta

SEQ ID NO: 4972514 - DNA, 12 bp, Homo sapiens
aagtctgaatca

SEQ ID NO: 4972515 - DNA, 16 bp, Homo sapiens
aagtcttgtataacta

SEQ ID NO: 4972516 - DNA, 14 bp, Homo sapiens
aagtcttttgttcg

SEQ ID NO: 4972517 - DNA, 19 bp, Homo sapiens
aagtgaaataacaaaatgg

SEQ ID NO: 4972518 - DNA, 13 bp, Homo sapiens
aagtgaagactgg

SEQ ID NO: 4972519 - DNA, 15 bp, Homo sapiens
aagtgaataaacttc

SEQ ID NO: 4972520 - DNA, 16 bp, Homo sapiens
aagtgaataaacttca

SEQ ID NO: 4972521 - DNA, 13 bp, Homo sapiens
aagtgaatttata

SEQ ID NO: 4972522 - DNA, 24 bp, Homo sapiens
aagtgacacagcagcttcaccaga

SEQ ID NO: 4972523 - DNA, 19 bp, Homo sapiens
aagtgatcctcccacctca

SEQ ID NO: 4972524 - DNA, 15 bp, Homo sapiens
aagtgattctcctgc

SEQ ID NO: 4972525 - DNA, 17 bp, Homo sapiens
aagtgattctcctgcct

SEQ ID NO: 4972526 - DNA, 18 bp, Homo sapiens
aagtgattctcctgcctc

SEQ ID NO: 4972527 - DNA, 22 bp, Homo sapiens
aagtgcacacagaaatatatat

SEQ ID NO: 4972528 - DNA, 16 bp, Homo sapiens
aagtgcactttctaat

SEQ ID NO: 4972529 - DNA, 18 bp, Homo sapiens
aagtgcatatgaaatcct

SEQ ID NO: 4972530 - DNA, 14 bp, Homo sapiens
aagtgcatttctga

SEQ ID NO: 4972531 - DNA, 23 bp, Homo sapiens
aagtgcatttctgaatagaaatg

SEQ ID NO: 4972532 - DNA, 21 bp, Homo sapiens
aagtgccactcattcctgtag

SEQ ID NO: 4972533 - DNA, 23 bp, Homo sapiens
aagtgcctttctgcagtttttca

SEQ ID NO: 4972534 - DNA, 15 bp, Homo sapiens
aagtgcgtgtgtaga

SEQ ID NO: 4972535 - DNA, 16 bp, Homo sapiens
aagtgcgtgtgtagag

SEQ ID NO: 4972536 - DNA, 23 bp, Homo sapiens
aagtgcgtgtgtagagttaagaa

SEQ ID NO: 4972537 - DNA, 20 bp, Homo sapiens
aagtgctaaggttctaaggc

SEQ ID NO: 4972538 - DNA, 17 bp, Homo sapiens
aagtggaatttcttgtt

SEQ ID NO: 4972539 - DNA, 14 bp, Homo sapiens
aagtggcatgtttt

SEQ ID NO: 4972540 - DNA, 19 bp, Homo sapiens
aagtgggaggtcaggaaac

SEQ ID NO: 4972541 - DNA, 18 bp, Homo sapiens
aagtgtaagttcacaact

SEQ ID NO: 4972542 - DNA, 16 bp, Homo sapiens
aagtgtaataatatga

SEQ ID NO: 4972543 - DNA, 16 bp, Homo sapiens
aagtgtctctgccttg

SEQ ID NO: 4972544 - DNA, 22 bp, Homo sapiens
aagtgttatttttcaaggaagg

SEQ ID NO: 4972545 - DNA, 15 bp, Homo sapiens
aagtgtttatttttc

SEQ ID NO: 4972546 - DNA, 19 bp, Homo sapiens
aagtgtttatttttcatat

SEQ ID NO: 4972547 - DNA, 21 bp, Homo sapiens
aagtgtttctgttattaacaa

SEQ ID NO: 4972548 - DNA, 19 bp, Homo sapiens
aagttaagagaaactttat

SEQ ID NO: 4972549 - DNA, 16 bp, Homo sapiens
aagttagaatctattt

SEQ ID NO: 4972550 - DNA, 19 bp, Homo sapiens
aagttagaatctattttct

SEQ ID NO: 4972551 - DNA, 15 bp, Homo sapiens
aagttataagactct

SEQ ID NO: 4972552 - DNA, 11 bp, Homo sapiens
aagttcacaaa

SEQ ID NO: 4972553 - DNA, 21 bp, Homo sapiens
aagttcatacctaagtactgt

SEQ ID NO: 4972554 - DNA, 15 bp, Homo sapiens
aagttcatattccat

SEQ ID NO: 4972555 - DNA, 21 bp, Homo sapiens
aagttcatattccatatttat

SEQ ID NO: 4972556 - DNA, 19 bp, Homo sapiens
aagttccagtgttctctct

SEQ ID NO: 4972557 - DNA, 19 bp, Homo sapiens
aagttccatgggatacaac

SEQ ID NO: 4972558 - DNA, 14 bp, Homo sapiens
aagttccctacttc

SEQ ID NO: 4972559 - DNA, 14 bp, Homo sapiens
aagttcctttgggt

SEQ ID NO: 4972560 - DNA, 16 bp, Homo sapiens
aagttctaagattcta

SEQ ID NO: 4972561 - DNA, 17 bp, Homo sapiens
aagttctaataatttct

SEQ ID NO: 4972562 - DNA, 18 bp, Homo sapiens
aagttctaataatttcta

SEQ ID NO: 4972563 - DNA, 21 bp, Homo sapiens
aagttctaataatttctaatg

SEQ ID NO: 4972564 - DNA, 16 bp, Homo sapiens
aagttctcaatgtgaa

SEQ ID NO: 4972565 - DNA, 15 bp, Homo sapiens
aagttctgtgtttaa

SEQ ID NO: 4972566 - DNA, 20 bp, Homo sapiens
aagttctgtgtttaatttct

SEQ ID NO: 4972567 - DNA, 23 bp, Homo sapiens
aagttctgtgtttaatttcttca

SEQ ID NO: 4972568 - DNA, 23 bp, Homo sapiens
aagttgacttatagtacatgata

SEQ ID NO: 4972569 - DNA, 20 bp, Homo sapiens
aagttgcactgatattttac

SEQ ID NO: 4972570 - DNA, 14 bp, Homo sapiens
aagttggactaaat

SEQ ID NO: 4972571 - DNA, 18 bp, Homo sapiens
aagttggactaaatgcct

SEQ ID NO: 4972572 - DNA, 18 bp, Homo sapiens
aagttgtgccttttatag

SEQ ID NO: 4972573 - DNA, 12 bp, Homo sapiens
aagtttaaaaca

SEQ ID NO: 4972574 - DNA, 21 bp, Homo sapiens
aagtttacaagtgtatatcag

SEQ ID NO: 4972575 - DNA, 23 bp, Homo sapiens
aagtttacaagtgtatatcagaa

SEQ ID NO: 4972576 - DNA, 18 bp, Homo sapiens
aagtttacattgtaaata

SEQ ID NO: 4972577 - DNA, 12 bp, Homo sapiens
aagtttacattt

SEQ ID NO: 4972578 - DNA, 16 bp, Homo sapiens
aagtttattctcattt

SEQ ID NO: 4972579 - DNA, 12 bp, Homo sapiens
aagtttcaggtg

SEQ ID NO: 4972580 - DNA, 14 bp, Homo sapiens
aagtttcaggtgac

SEQ ID NO: 4972581 - DNA, 15 bp, Homo sapiens
aagtttctaagattc

SEQ ID NO: 4972582 - DNA, 18 bp, Homo sapiens
aagtttctaagattctaa

SEQ ID NO: 4972583 - DNA, 19 bp, Homo sapiens
aagtttctaagattctaaa

SEQ ID NO: 4972584 - DNA, 21 bp, Homo sapiens
aagtttctaagattctaaagg

SEQ ID NO: 4972585 - DNA, 13 bp, Homo sapiens
aagtttgcttaga

SEQ ID NO: 4972586 - DNA, 11 bp, Homo sapiens
aagcttagaac

SEQ ID NO: 4972587 - DNA, 18 bp, Homo sapiens
aagcttatccataaaaaa

SEQ ID NO: 4972588 - DNA, 18 bp, Homo sapiens
aagcttcaaattaaaaca

SEQ ID NO: 4972589 - DNA, 21 bp, Homo sapiens
aagcttcattctccttgttgt

SEQ ID NO: 4972590 - DNA, 16 bp, Homo sapiens
aagcttccatgattct

SEQ ID NO: 4972591 - DNA, 16 bp, Homo sapiens
aagcttctaataaatt

SEQ ID NO: 4972592 - DNA, 18 bp, Homo sapiens
aagcttctaataaattat

SEQ ID NO: 4972593 - DNA, 21 bp, Homo sapiens
aagcttcttaattaatttgat

SEQ ID NO: 4972594 - DNA, 15 bp, Homo sapiens
aagcttgactcccaa

SEQ ID NO: 4972595 - DNA, 17 bp, Homo sapiens
aagcttgactcccaagt

SEQ ID NO: 4972596 - DNA, 16 bp, Homo sapiens
aagctttttcctcctg

SEQ ID NO: 4972597 - DNA, 23 bp, Homo sapiens
aaggaaaaagctccatgtgcctc

SEQ ID NO: 4972598 - DNA, 16 bp, Homo sapiens
aaggaaaagaaaaaaa

SEQ ID NO: 4972599 - DNA, 13 bp, Homo sapiens
aaggaaactctta

SEQ ID NO: 4972600 - DNA, 16 bp, Homo sapiens
aaggaaactcttatct

SEQ ID NO: 4972601 - DNA, 12 bp, Homo sapiens
aaggaaccttcc

SEQ ID NO: 4972602 - DNA, 16 bp, Homo sapiens
aaggaagctccactgt

SEQ ID NO: 4972603 - DNA, 16 bp, Homo sapiens
aaggaaggaaagaaag

SEQ ID NO: 4972604 - DNA, 14 bp, Homo sapiens
aaggaagtgaagag

SEQ ID NO: 4972605 - DNA, 21 bp, Homo sapiens
aaggaatctttaagcagagaa

SEQ ID NO: 4972606 - DNA, 17 bp, Homo sapiens
aaggacatcagcaaaca

SEQ ID NO: 4972607 - DNA, 16 bp, Homo sapiens
aaggacattatgtgtg

SEQ ID NO: 4972608 - DNA, 18 bp, Homo sapiens
aaggacattgcggacagc

SEQ ID NO: 4972609 - DNA, 18 bp, Homo sapiens
aaggacccggaggggcct

SEQ ID NO: 4972610 - DNA, 22 bp, Homo sapiens
aaggacccggaggggcctggca

SEQ ID NO: 4972611 - DNA, 19 bp, Homo sapiens
aaggaccgtggccctgccc

SEQ ID NO: 4972612 - DNA, 23 bp, Homo sapiens
aaggacctcctcttcccccttcc

SEQ ID NO: 4972613 - DNA, 23 bp, Homo sapiens
aaggactgcgggacttgggtctc

SEQ ID NO: 4972614 - DNA, 13 bp, Homo sapiens
aaggagaacaaat

SEQ ID NO: 4972615 - DNA, 18 bp, Homo sapiens
aaggagagactcccatga

SEQ ID NO: 4972616 - DNA, 20 bp, Homo sapiens
aaggagaggcaacatccaaa

SEQ ID NO: 4972617 - DNA, 19 bp, Homo sapiens
aaggagggtacagctgggc

SEQ ID NO: 4972618 - DNA, 15 bp, Homo sapiens
aaggatgtgattgtg

SEQ ID NO: 4972619 - DNA, 15 bp, Homo sapiens
aaggatgttggtgtt

SEQ ID NO: 4972620 - DNA, 21 bp, Homo sapiens
aaggattttttaaagtttttt

SEQ ID NO: 4972621 - DNA, 15 bp, Homo sapiens
aaggcaaaaatgtaa

SEQ ID NO: 4972622 - DNA, 15 bp, Homo sapiens
aaggcaagttaagag

SEQ ID NO: 4972623 - DNA, 17 bp, Homo sapiens
aaggcaagttaagagaa

SEQ ID NO: 4972624 - DNA, 19 bp, Homo sapiens
aaggcaagttaagagaaac

SEQ ID NO: 4972625 - DNA, 16 bp, Homo sapiens
aaggcactctagattc

SEQ ID NO: 4972626 - DNA, 19 bp, Homo sapiens
aaggcactctagattccat

SEQ ID NO: 4972627 - DNA, 17 bp, Homo sapiens
aaggccaaactgctgga

SEQ ID NO: 4972628 - DNA, 21 bp, Homo sapiens
aaggccaataaagagttagaa

SEQ ID NO: 4972629 - DNA, 17 bp, Homo sapiens
aaggccataaaacaggt

SEQ ID NO: 4972630 - DNA, 15 bp, Homo sapiens
aaggcccacaggagg

SEQ ID NO: 4972631 - DNA, 14 bp, Homo sapiens
aaggcccagcccct

SEQ ID NO: 4972632 - DNA, 15 bp, Homo sapiens
aaggcccagccccta

SEQ ID NO: 4972633 - DNA, 18 bp, Homo sapiens
aaggcccagcccctagaa

SEQ ID NO: 4972634 - DNA, 15 bp, Homo sapiens
aaggccctgctgccc

SEQ ID NO: 4972635 - DNA, 18 bp, Homo sapiens
aaggcctaggattctaaa

SEQ ID NO: 4972636 - DNA, 19 bp, Homo sapiens
aaggcctccctagccagca

SEQ ID NO: 4972637 - DNA, 13 bp, Homo sapiens
aaggcctctgtcc

SEQ ID NO: 4972638 - DNA, 15 bp, Homo sapiens
aaggcctgcacacaa

SEQ ID NO: 4972639 - DNA, 12 bp, Homo sapiens
aaggcctgggtg

SEQ ID NO: 4972640 - DNA, 20 bp, Homo sapiens
aaggccttcatggccccagc

SEQ ID NO: 4972641 - DNA, 15 bp, Homo sapiens
aaggccttctcctcc

SEQ ID NO: 4972642 - DNA, 18 bp, Homo sapiens
aaggcgggagcatctctt

SEQ ID NO: 4972643 - DNA, 13 bp, Homo sapiens
aaggctaaaaagt

SEQ ID NO: 4972644 - DNA, 15 bp, Homo sapiens
aaggctccaagacct

SEQ ID NO: 4972645 - DNA, 11 bp, Homo sapiens
aaggctctaga

SEQ ID NO: 4972646 - DNA, 16 bp, Homo sapiens
aaggctctatgagtct

SEQ ID NO: 4972647 - DNA, 16 bp, Homo sapiens
aaggctctgagagtct

SEQ ID NO: 4972648 - DNA, 20 bp, Homo sapiens
aaggctgccaacggggagcg

SEQ ID NO: 4972649 - DNA, 18 bp, Homo sapiens
aaggcttatattcaacca

SEQ ID NO: 4972650 - DNA, 19 bp, Homo sapiens
acacaaaactccgccccca

SEQ ID NO: 4972651 - DNA, 13 bp, Homo sapiens
acacaaaggaagt

SEQ ID NO: 4972652 - DNA, 23 bp, Homo sapiens
acacaaaggggatcataaagtta

SEQ ID NO: 4972653 - DNA, 22 bp, Homo sapiens
acacaagaagaagggcacccta

SEQ ID NO: 4972654 - DNA, 17 bp, Homo sapiens
acacaagcccacagcac

SEQ ID NO: 4972655 - DNA, 15 bp, Homo sapiens
acacacacacacatg

SEQ ID NO: 4972656 - DNA, 14 bp, Homo sapiens
acacacacacatac

SEQ ID NO: 4972657 - DNA, 16 bp, Homo sapiens
acacacacacgcacgc

SEQ ID NO: 4972658 - DNA, 15 bp, Homo sapiens
acacacacatgcaca

SEQ ID NO: 4972659 - DNA, 12 bp, Homo sapiens
acacacacgcac

SEQ ID NO: 4972660 - DNA, 22 bp, Homo sapiens
acacacacgcgtgcacacacca

SEQ ID NO: 4972661 - DNA, 19 bp, Homo sapiens
acacacagatacacacaca

SEQ ID NO: 4972662 - DNA, 17 bp, Homo sapiens
acacacagctctgtcct

SEQ ID NO: 4972663 - DNA, 12 bp, Homo sapiens
acacacatagat

SEQ ID NO: 4972664 - DNA, 14 bp, Homo sapiens
acacacatgcacac

SEQ ID NO: 4972665 - DNA, 16 bp, Homo sapiens
acacacgcacgcacac

SEQ ID NO: 4972666 - DNA, 14 bp, Homo sapiens
acacactcagtgca

SEQ ID NO: 4972667 - DNA, 12 bp, Homo sapiens
acacactgaaag

SEQ ID NO: 4972668 - DNA, 14 bp, Homo sapiens
acacactttttaag

SEQ ID NO: 4972669 - DNA, 14 bp, Homo sapiens
acacagaaacactg

SEQ ID NO: 4972670 - DNA, 16 bp, Homo sapiens
acacagaaatatatat

SEQ ID NO: 4972671 - DNA, 17 bp, Homo sapiens
acacagatacacacaca

SEQ ID NO: 4972672 - DNA, 14 bp, Homo sapiens
acacagcctgggcc

SEQ ID NO: 4972673 - DNA, 17 bp, Homo sapiens
acacagcgtccctagca

SEQ ID NO: 4972674 - DNA, 18 bp, Homo sapiens
acacagcgtccctagcag

SEQ ID NO: 4972675 - DNA, 16 bp, Homo sapiens
acacagctcttctcca

SEQ ID NO: 4972676 - DNA, 20 bp, Homo sapiens
acacagctcttctccaggct

SEQ ID NO: 4972677 - DNA, 11 bp, Homo sapiens
acacagctgtt

SEQ ID NO: 4972678 - DNA, 15 bp, Homo sapiens
acacaggcagctttc

SEQ ID NO: 4972679 - DNA, 16 bp, Homo sapiens
acacaggcccggctcc

SEQ ID NO: 4972680 - DNA, 20 bp, Homo sapiens
acacaggcccggctccaggc

SEQ ID NO: 4972681 - DNA, 17 bp, Homo sapiens
acacaggggaggtgata

SEQ ID NO: 4972682 - DNA, 21 bp, Homo sapiens
acacaggggaggtgatagcat

SEQ ID NO: 4972683 - DNA, 22 bp, Homo sapiens
acacagtattacttctgctaca

SEQ ID NO: 4972684 - DNA, 19 bp, Homo sapiens
acacagtcaaaataattct

SEQ ID NO: 4972685 - DNA, 19 bp, Homo sapiens
acacagtgggaactctgac

SEQ ID NO: 4972686 - DNA, 14 bp, Homo sapiens
acacatataaacat

SEQ ID NO: 4972687 - DNA, 22 bp, Homo sapiens
acacatataaacatcacacaca

SEQ ID NO: 4972688 - DNA, 21 bp, Homo sapiens
acacatatacctataatgtgt

SEQ ID NO: 4972689 - DNA, 14 bp, Homo sapiens
acacatccacccca

SEQ ID NO: 4972690 - DNA, 17 bp, Homo sapiens
acacatccctaatgtgt

SEQ ID NO: 4972691 - DNA, 20 bp, Homo sapiens
acacatccctaatgtgtgcc

SEQ ID NO: 4972692 - DNA, 12 bp, Homo sapiens
acacatgcacac

SEQ ID NO: 4972693 - DNA, 15 bp, Homo sapiens
acacatgcacacaca

SEQ ID NO: 4972694 - DNA, 11 bp, Homo sapiens
acacatttgta

SEQ ID NO: 4972695 - DNA, 18 bp, Homo sapiens
acacatttgtacagaatt

SEQ ID NO: 4972696 - DNA, 18 bp, Homo sapiens
acaccacacccagcctca

SEQ ID NO: 4972697 - DNA, 13 bp, Homo sapiens
acaccacagacac

SEQ ID NO: 4972698 - DNA, 19 bp, Homo sapiens
acaccagagcagatgcaga

SEQ ID NO: 4972699 - DNA, 23 bp, Homo sapiens
acaccagagcccaccttggctca

SEQ ID NO: 4972700 - DNA, 22 bp, Homo sapiens
acacccaaagcatggactaacc

SEQ ID NO: 4972701 - DNA, 12 bp, Homo sapiens
acacccagccca

SEQ ID NO: 4972702 - DNA, 13 bp, Homo sapiens
acacccagcccac

SEQ ID NO: 4972703 - DNA, 12 bp, Homo sapiens
acacccagcctc

SEQ ID NO: 4972704 - DNA, 17 bp, Homo sapiens
acacccagcctcagtcc

SEQ ID NO: 4972705 - DNA, 18 bp, Homo sapiens
acacccgtgagcgcctgt

SEQ ID NO: 4972706 - DNA, 17 bp, Homo sapiens
acaccctcaacctcttc

SEQ ID NO: 4972707 - DNA, 18 bp, Homo sapiens
acaccctcaacctcttct

SEQ ID NO: 4972708 - DNA, 17 bp, Homo sapiens
acaccctcactctgcca

SEQ ID NO: 4972709 - DNA, 14 bp, Homo sapiens
acaccctcccccgc

SEQ ID NO: 4972710 - DNA, 13 bp, Homo sapiens
acacccttagaaa

SEQ ID NO: 4972711 - DNA, 16 bp, Homo sapiens
acaccgggcctggaga

SEQ ID NO: 4972712 - DNA, 21 bp, Homo sapiens
acacctaaaggtgtatttaaa

SEQ ID NO: 4972713 - DNA, 22 bp, Homo sapiens
acacctagctttattcttcaga

SEQ ID NO: 4972714 - DNA, 18 bp, Homo sapiens
acacctcagttcccttgg

SEQ ID NO: 4972715 - DNA, 22 bp, Homo sapiens
acacctcagttcccttggcctc

SEQ ID NO: 4972716 - DNA, 23 bp, Homo sapiens
acacctcagttcccttggcctca

SEQ ID NO: 4972717 - DNA, 12 bp, Homo sapiens
acacctctgcca

SEQ ID NO: 4972718 - DNA, 17 bp, Homo sapiens
acacctgggcttaagaa

SEQ ID NO: 4972719 - DNA, 14 bp, Homo sapiens
acaccttccagctc

SEQ ID NO: 4972720 - DNA, 16 bp, Homo sapiens
acaccttccagctcct

SEQ ID NO: 4972721 - DNA, 18 bp, Homo sapiens
acaccttcttattatata

SEQ ID NO: 4972722 - DNA, 13 bp, Homo sapiens
acacgaaacttgt

SEQ ID NO: 4972723 - DNA, 23 bp, Homo sapiens
acacgaaacttgttattgtgaat

SEQ ID NO: 4972724 - DNA, 14 bp, Homo sapiens
acacgaaagagaga

SEQ ID NO: 4972725 - DNA, 13 bp, Homo sapiens
acacgcacgcaca

SEQ ID NO: 4972726 - DNA, 16 bp, Homo sapiens
acacgcacgcacacac

SEQ ID NO: 4972727 - DNA, 20 bp, Homo sapiens
acacgcacgcacacacacaa

SEQ ID NO: 4972728 - DNA, 20 bp, Homo sapiens
acacgcatggtcaaccctca

SEQ ID NO: 4972729 - DNA, 13 bp, Homo sapiens
acacgcgcgcaca

SEQ ID NO: 4972730 - DNA, 23 bp, Homo sapiens
acacgcgggcgcgatcccacaca

SEQ ID NO: 4972731 - DNA, 22 bp, Homo sapiens
acacggagcccagccctcccca

SEQ ID NO: 4972732 - DNA, 23 bp, Homo sapiens
acacgttcacccatcttatcaag

SEQ ID NO: 4972733 - DNA, 12 bp, Homo sapiens
acactaaaattt

SEQ ID NO: 4972734 - DNA, 14 bp, Homo sapiens
acactaaaatttta

SEQ ID NO: 4972735 - DNA, 15 bp, Homo sapiens
acactaaaattttag

SEQ ID NO: 4972736 - DNA, 17 bp, Homo sapiens
acactaaagatccaaga

SEQ ID NO: 4972737 - DNA, 14 bp, Homo sapiens
acactaaccacgct

SEQ ID NO: 4972738 - DNA, 19 bp, Homo sapiens
acactaaccacgctggacc

SEQ ID NO: 4972739 - DNA, 20 bp, Homo sapiens
acactaaccacgctggacct

SEQ ID NO: 4972740 - DNA, 15 bp, Homo sapiens
acactaacctgggtt

SEQ ID NO: 4972741 - DNA, 17 bp, Homo sapiens
acactaattcctttcta

SEQ ID NO: 4972742 - DNA, 13 bp, Homo sapiens
acactccagtgcc

SEQ ID NO: 4972743 - DNA, 14 bp, Homo sapiens
acactcctagagaa

SEQ ID NO: 4972744 - DNA, 14 bp, Homo sapiens
acactctctggaag

SEQ ID NO: 4972745 - DNA, 23 bp, Homo sapiens
acactctctggaagccctggaga

SEQ ID NO: 4972746 - DNA, 19 bp, Homo sapiens
acactctgccagcaaagag

SEQ ID NO: 4972747 - DNA, 14 bp, Homo sapiens
acactgaaaaatta

SEQ ID NO: 4972748 - DNA, 21 bp, Homo sapiens
acactgaaagctctgttgcaa

SEQ ID NO: 4972749 - DNA, 15 bp, Homo sapiens
acactgcaatcatat

SEQ ID NO: 4972750 - DNA, 20 bp, Homo sapiens
acactgcaatcatatgtgat

SEQ ID NO: 4972751 - DNA, 13 bp, Homo sapiens
acactgcctgggc

SEQ ID NO: 4972752 - DNA, 14 bp, Homo sapiens
acactgcctgggct

SEQ ID NO: 4972753 - DNA, 14 bp, Homo sapiens
acactgcctgtata

SEQ ID NO: 4972754 - DNA, 20 bp, Homo sapiens
acactgcctttttatttata

SEQ ID NO: 4972755 - DNA, 23 bp, Homo sapiens
acactgcctttttatttatatgt

SEQ ID NO: 4972756 - DNA, 13 bp, Homo sapiens
acactggcccctc

SEQ ID NO: 4972757 - DNA, 21 bp, Homo sapiens
acactggtgtgacctgagggc

SEQ ID NO: 4972758 - DNA, 19 bp, Homo sapiens
acactgtggaactaataaa

SEQ ID NO: 4972759 - DNA, 20 bp, Homo sapiens
acactgtggaactaataaat

SEQ ID NO: 4972760 - DNA, 14 bp, Homo sapiens
acagtcaaaataat

SEQ ID NO: 4972761 - DNA, 14 bp, Homo sapiens
acagtcatcatcag

SEQ ID NO: 4972762 - DNA, 20 bp, Homo sapiens
acagtcatcatcagggcctg

SEQ ID NO: 4972763 - DNA, 17 bp, Homo sapiens
acagtcatcgctcgtgt

SEQ ID NO: 4972764 - DNA, 12 bp, Homo sapiens
acagtgagcctg

SEQ ID NO: 4972765 - DNA, 18 bp, Homo sapiens
acagtgagcctgaatttt

SEQ ID NO: 4972766 - DNA, 21 bp, Homo sapiens
acagtgagcctgaattttgtt

SEQ ID NO: 4972767 - DNA, 19 bp, Homo sapiens
acagtgcagggcaaaatat

SEQ ID NO: 4972768 - DNA, 18 bp, Homo sapiens
acagtgggaactctgaca

SEQ ID NO: 4972769 - DNA, 15 bp, Homo sapiens
acagtgtcccccagg

SEQ ID NO: 4972770 - DNA, 16 bp, Homo sapiens
acagtgtcccccaggt

SEQ ID NO: 4972771 - DNA, 14 bp, Homo sapiens
acagtgttaaatga

SEQ ID NO: 4972772 - DNA, 23 bp, Homo sapiens
acagttatttatagtcatttatt

SEQ ID NO: 4972773 - DNA, 15 bp, Homo sapiens
acagttcacaccctg

SEQ ID NO: 4972774 - DNA, 19 bp, Homo sapiens
acagttgccaccacctctg

SEQ ID NO: 4972775 - DNA, 21 bp, Homo sapiens
acagttgccaccacctctgtg

SEQ ID NO: 4972776 - DNA, 22 bp, Homo sapiens
acagttgccaccacctctgtgg

SEQ ID NO: 4972777 - DNA, 23 bp, Homo sapiens
acagttgccaccacctctgtggc

SEQ ID NO: 4972778 - DNA, 20 bp, Homo sapiens
acagttgtctagagatatat

SEQ ID NO: 4972779 - DNA, 18 bp, Homo sapiens
acagtttcttagcttttt

SEQ ID NO: 4972780 - DNA, 22 bp, Homo sapiens
acagtttcttagctttttaatt

SEQ ID NO: 4972781 - DNA, 20 bp, Homo sapiens
acagtttgatgtcattaatg

SEQ ID NO: 4972782 - DNA, 14 bp, Homo sapiens
acagtttgctctag

SEQ ID NO: 4972783 - DNA, 12 bp, Homo sapiens
acagttttatgc

SEQ ID NO: 4972784 - DNA, 20 bp, Homo sapiens
acagttttatgctctttttt

SEQ ID NO: 4972785 - DNA, 14 bp, Homo sapiens
acataaaagaattt

SEQ ID NO: 4972786 - DNA, 15 bp, Homo sapiens
acataacgtttttcc

SEQ ID NO: 4972787 - DNA, 16 bp, Homo sapiens
acataacgtttttcct

SEQ ID NO: 4972788 - DNA, 20 bp, Homo sapiens
acataacgtttttcctttaa

SEQ ID NO: 4972789 - DNA, 22 bp, Homo sapiens
acataacgtttttcctttaaaa

SEQ ID NO: 4972790 - DNA, 13 bp, Homo sapiens
acataactaaatt

SEQ ID NO: 4972791 - DNA, 18 bp, Homo sapiens
acataactaaatttgata

SEQ ID NO: 4972792 - DNA, 15 bp, Homo sapiens
acataagtaattcaa

SEQ ID NO: 4972793 - DNA, 23 bp, Homo sapiens
acataataaaaaattatgacaat

SEQ ID NO: 4972794 - DNA, 19 bp, Homo sapiens
acataatgaaaatattttt

SEQ ID NO: 4972795 - DNA, 20 bp, Homo sapiens
acataatgcttaatttctaa

SEQ ID NO: 4972796 - DNA, 12 bp, Homo sapiens
acataatttttt

SEQ ID NO: 4972797 - DNA, 18 bp, Homo sapiens
acataattttttattcaa

SEQ ID NO: 4972798 - DNA, 19 bp, Homo sapiens
acatacacttgtataaatg

SEQ ID NO: 4972799 - DNA, 15 bp, Homo sapiens
acataccagcttaga

SEQ ID NO: 4972800 - DNA, 14 bp, Homo sapiens
acatacggtcaggt

SEQ ID NO: 4972801 - DNA, 22 bp, Homo sapiens
acatactttcatcctgactctg

SEQ ID NO: 4972802 - DNA, 15 bp, Homo sapiens
acatagatattttca

SEQ ID NO: 4972803 - DNA, 16 bp, Homo sapiens
acatagatattttcac

SEQ ID NO: 4972804 - DNA, 18 bp, Homo sapiens
acatagatattttcacaa

SEQ ID NO: 4972805 - DNA, 22 bp, Homo sapiens
acatagatttatttttcagttc

SEQ ID NO: 4972806 - DNA, 20 bp, Homo sapiens
acatagtaagttcagcactt

SEQ ID NO: 4972807 - DNA, 15 bp, Homo sapiens
acatagttatttatt

SEQ ID NO: 4972808 - DNA, 17 bp, Homo sapiens
acatagttttaaactca

SEQ ID NO: 4972809 - DNA, 19 bp, Homo sapiens
acatagttttaaactcatt

SEQ ID NO: 4972810 - DNA, 23 bp, Homo sapiens
acatatacctataatgtgtgtat

SEQ ID NO: 4972811 - DNA, 17 bp, Homo sapiens
acatatcgctgacttca

SEQ ID NO: 4972812 - DNA, 15 bp, Homo sapiens
acatatgatttcact

SEQ ID NO: 4972813 - DNA, 22 bp, Homo sapiens
acatatgatttcactagaaaag

SEQ ID NO: 4972814 - DNA, 16 bp, Homo sapiens
acatatgcaccttgtg

SEQ ID NO: 4972815 - DNA, 16 bp, Homo sapiens
acatatgtacataaat

SEQ ID NO: 4972816 - DNA, 16 bp, Homo sapiens
acatatgtagactata

SEQ ID NO: 4972817 - DNA, 22 bp, Homo sapiens
acatattccatgtttggaagac

SEQ ID NO: 4972818 - DNA, 19 bp, Homo sapiens
acatatttatataacgtga

SEQ ID NO: 4972819 - DNA, 19 bp, Homo sapiens
acatatttgtggaataatg

SEQ ID NO: 4972820 - DNA, 16 bp, Homo sapiens
acatcactctgctgct

SEQ ID NO: 4972821 - DNA, 13 bp, Homo sapiens
acatcagcaaaca

SEQ ID NO: 4972822 - DNA, 17 bp, Homo sapiens
acatccattcccaagaa

SEQ ID NO: 4972823 - DNA, 14 bp, Homo sapiens
acatcctccgtcca

SEQ ID NO: 4972824 - DNA, 20 bp, Homo sapiens
acatctcaggggccagagga

SEQ ID NO: 4972825 - DNA, 15 bp, Homo sapiens
acatctctgaaagca

SEQ ID NO: 4972826 - DNA, 21 bp, Homo sapiens
acatctggcttattttaatgt

SEQ ID NO: 4972827 - DNA, 16 bp, Homo sapiens
acatcttcagcaaata

SEQ ID NO: 4972828 - DNA, 14 bp, Homo sapiens
acatcttgctctgc

SEQ ID NO: 4972829 - DNA, 16 bp, Homo sapiens
acatcttgctctgctg

SEQ ID NO: 4972830 - DNA, 16 bp, Homo sapiens
acatctttttaaagct

SEQ ID NO: 4972831 - DNA, 19 bp, Homo sapiens
acatctttttaaagcttat

SEQ ID NO: 4972832 - DNA, 15 bp, Homo sapiens
acatgaaaattttaa

SEQ ID NO: 4972833 - DNA, 23 bp, Homo sapiens
acatgaaaattttaaaaatacat

SEQ ID NO: 4972834 - DNA, 13 bp, Homo sapiens
acatgaaacagaa

SEQ ID NO: 4972835 - DNA, 20 bp, Homo sapiens
acatgaatcccacccacatg

SEQ ID NO: 4972836 - DNA, 23 bp, Homo sapiens
acatgaatcccacccacatgtga

SEQ ID NO: 4972837 - DNA, 11 bp, Homo sapiens
acatgacactg

SEQ ID NO: 4972838 - DNA, 13 bp, Homo sapiens
acatgacactgac

SEQ ID NO: 4972839 - DNA, 18 bp, Homo sapiens
acatgaggaactgtagat

SEQ ID NO: 4972840 - DNA, 21 bp, Homo sapiens
acatgaggaactgtagatgat

SEQ ID NO: 4972841 - DNA, 22 bp, Homo sapiens
acatgaggaactgtagatgatg

SEQ ID NO: 4972842 - DNA, 13 bp, Homo sapiens
acatgatttcctt

SEQ ID NO: 4972843 - DNA, 16 bp, Homo sapiens
acatgatttccttgaa

SEQ ID NO: 4972844 - DNA, 15 bp, Homo sapiens
acatgcaaggcactg

SEQ ID NO: 4972845 - DNA, 20 bp, Homo sapiens
acatgcaaggcactgtacta

SEQ ID NO: 4972846 - DNA, 14 bp, Homo sapiens
acatgcactgaccc

SEQ ID NO: 4972847 - DNA, 21 bp, Homo sapiens
acatgcctgccccaaacaaat

SEQ ID NO: 4972848 - DNA, 18 bp, Homo sapiens
acatgctaggatgcggaa

SEQ ID NO: 4972849 - DNA, 19 bp, Homo sapiens
acatgctggccagcctggg

SEQ ID NO: 4972850 - DNA, 19 bp, Homo sapiens
acatggctctggactctaa

SEQ ID NO: 4972851 - DNA, 22 bp, Homo sapiens
acatggctctggactctaaaga

SEQ ID NO: 4972852 - DNA, 23 bp, Homo sapiens
acatggctctggactctaaagac

SEQ ID NO: 4972853 - DNA, 22 bp, Homo sapiens
acatgggaaaggaggcatgcct

SEQ ID NO: 4972854 - DNA, 23 bp, Homo sapiens
acatgggagcagtccatgcatga

SEQ ID NO: 4972855 - DNA, 20 bp, Homo sapiens
acatggggagtgtttcatgg

SEQ ID NO: 4972856 - DNA, 14 bp, Homo sapiens
acatggtactcttg

SEQ ID NO: 4972857 - DNA, 23 bp, Homo sapiens
acatggtactcttgttgagttct

SEQ ID NO: 4972858 - DNA, 13 bp, Homo sapiens
acatgtcttccat

SEQ ID NO: 4972859 - DNA, 16 bp, Homo sapiens
acatgtcttgtacatg

SEQ ID NO: 4972860 - DNA, 19 bp, Homo sapiens
acatgtcttgtacatgtgt

SEQ ID NO: 4972861 - DNA, 22 bp, Homo sapiens
acatgtcttgtacatgtgtagc

SEQ ID NO: 4972862 - DNA, 15 bp, Homo sapiens
acatgtgaaaccttt

SEQ ID NO: 4972863 - DNA, 21 bp, Homo sapiens
acatgtgaaaccttttttaag

SEQ ID NO: 4972864 - DNA, 23 bp, Homo sapiens
acatgtgaaaccttttttaagat

SEQ ID NO: 4972865 - DNA, 18 bp, Homo sapiens
acatgtgcacatgcacgt

SEQ ID NO: 4972866 - DNA, 22 bp, Homo sapiens
acatgtgccagggcaatgatga

SEQ ID NO: 4972867 - DNA, 13 bp, Homo sapiens
acatgtggtttat

SEQ ID NO: 4972868 - DNA, 20 bp, Homo sapiens
acatgtgtagcctatgttgt

SEQ ID NO: 4972869 - DNA, 17 bp, Homo sapiens
acatgtgtagcctgtgc

SEQ ID NO: 4972870 - DNA, 23 bp, Homo sapiens
acccaacggccctgcagccagct

SEQ ID NO: 4972871 - DNA, 19 bp, Homo sapiens
acccaaggagcacaggtcc

SEQ ID NO: 4972872 - DNA, 17 bp, Homo sapiens
acccaagggcagaaagt

SEQ ID NO: 4972873 - DNA, 14 bp, Homo sapiens
acccacaaaaatgt

SEQ ID NO: 4972874 - DNA, 17 bp, Homo sapiens
acccacacctctgccag

SEQ ID NO: 4972875 - DNA, 15 bp, Homo sapiens
acccacctcagcctc

SEQ ID NO: 4972876 - DNA, 17 bp, Homo sapiens
acccacgattttctcca

SEQ ID NO: 4972877 - DNA, 20 bp, Homo sapiens
acccacgattttctccagct

SEQ ID NO: 4972878 - DNA, 20 bp, Homo sapiens
acccactgcttttggtctgt

SEQ ID NO: 4972879 - DNA, 15 bp, Homo sapiens
acccacttgtcactg

SEQ ID NO: 4972880 - DNA, 19 bp, Homo sapiens
acccacttgtcactgacac

SEQ ID NO: 4972881 - DNA, 23 bp, Homo sapiens
acccacttgtcactgacacaaag

SEQ ID NO: 4972882 - DNA, 23 bp, Homo sapiens
acccagcctcagtcctcccctca

SEQ ID NO: 4972883 - DNA, 19 bp, Homo sapiens
acccagcgagccctggtgg

SEQ ID NO: 4972884 - DNA, 17 bp, Homo sapiens
acccagctgccacctct

SEQ ID NO: 4972885 - DNA, 19 bp, Homo sapiens
acccaggagggagggggct

SEQ ID NO: 4972886 - DNA, 16 bp, Homo sapiens
acccaggctccgccct

SEQ ID NO: 4972887 - DNA, 17 bp, Homo sapiens
acccagggctctgcccc

SEQ ID NO: 4972888 - DNA, 14 bp, Homo sapiens
acccatatgttaaa

SEQ ID NO: 4972889 - DNA, 12 bp, Homo sapiens
acccatgaagat

SEQ ID NO: 4972890 - DNA, 13 bp, Homo sapiens
acccatgaggcaa

SEQ ID NO: 4972891 - DNA, 18 bp, Homo sapiens
accccaaacaccttccag

SEQ ID NO: 4972892 - DNA, 20 bp, Homo sapiens
accccaaacaccttccagct

SEQ ID NO: 4972893 - DNA, 23 bp, Homo sapiens
accccaaacaccttccagctcct

SEQ ID NO: 4972894 - DNA, 18 bp, Homo sapiens
accccaagccagcccggc

SEQ ID NO: 4972895 - DNA, 21 bp, Homo sapiens
accccaagccagcccggccgc

SEQ ID NO: 4972896 - DNA, 20 bp, Homo sapiens
accccaagtagtctgctcac

SEQ ID NO: 4972897 - DNA, 21 bp, Homo sapiens
accccacacttgttccagctc

SEQ ID NO: 4972898 - DNA, 21 bp, Homo sapiens
accccaccctagtttccctga

SEQ ID NO: 4972899 - DNA, 13 bp, Homo sapiens
accccaccctccc

SEQ ID NO: 4972900 - DNA, 16 bp, Homo sapiens
accccaccctccctgg

SEQ ID NO: 4972901 - DNA, 20 bp, Homo sapiens
accccaccctccctggagtg

SEQ ID NO: 4972902 - DNA, 12 bp, Homo sapiens
accccacctgca

SEQ ID NO: 4972903 - DNA, 21 bp, Homo sapiens
accccagctgtgagccttggc

SEQ ID NO: 4972904 - DNA, 23 bp, Homo sapiens
accccagtggccactcagcttcc

SEQ ID NO: 4972905 - DNA, 17 bp, Homo sapiens
accccatccagttcatg

SEQ ID NO: 4972906 - DNA, 16 bp, Homo sapiens
accccatgccaaagct

SEQ ID NO: 4972907 - DNA, 15 bp, Homo sapiens
acccccaccccacac

SEQ ID NO: 4972908 - DNA, 14 bp, Homo sapiens
acccccacccccag

SEQ ID NO: 4972909 - DNA, 19 bp, Homo sapiens
acccccacccccagctcaa

SEQ ID NO: 4972910 - DNA, 21 bp, Homo sapiens
acccccagctcaatggactgg

SEQ ID NO: 4972911 - DNA, 15 bp, Homo sapiens
acccccattctcatc

SEQ ID NO: 4972912 - DNA, 11 bp, Homo sapiens
acccccctctg

SEQ ID NO: 4972913 - DNA, 15 bp, Homo sapiens
acccccctgttctaa

SEQ ID NO: 4972914 - DNA, 19 bp, Homo sapiens
acccccctgttctaagggg

SEQ ID NO: 4972915 - DNA, 11 bp, Homo sapiens
accccctcctt

SEQ ID NO: 4972916 - DNA, 23 bp, Homo sapiens
accccctgagatcccctgagccc

SEQ ID NO: 4972917 - DNA, 13 bp, Homo sapiens
acccccttctctg

SEQ ID NO: 4972918 - DNA, 14 bp, Homo sapiens
acccccttctctgc

SEQ ID NO: 4972919 - DNA, 23 bp, Homo sapiens
acccccttctctgctccaccaca

SEQ ID NO: 4972920 - DNA, 17 bp, Homo sapiens
accccgatgtggacctc

SEQ ID NO: 4972921 - DNA, 13 bp, Homo sapiens
accccggcaggcc

SEQ ID NO: 4972922 - DNA, 16 bp, Homo sapiens
accccggcaggccctg

SEQ ID NO: 4972923 - DNA, 19 bp, Homo sapiens
accccggcaggccctgcag

SEQ ID NO: 4972924 - DNA, 19 bp, Homo sapiens
accccggtggcggccccag

SEQ ID NO: 4972925 - DNA, 16 bp, Homo sapiens
acccctacatgaaaca

SEQ ID NO: 4972926 - DNA, 20 bp, Homo sapiens
acccctagttccctctgctc

SEQ ID NO: 4972927 - DNA, 15 bp, Homo sapiens
acccctcactctggc

SEQ ID NO: 4972928 - DNA, 16 bp, Homo sapiens
acccctccatgtgggc

SEQ ID NO: 4972929 - DNA, 17 bp, Homo sapiens
acccctccctctgtcca

SEQ ID NO: 4972930 - DNA, 18 bp, Homo sapiens
acccctccctctgtccac

SEQ ID NO: 4972931 - DNA, 21 bp, Homo sapiens
acccctcctcactggccatcc

SEQ ID NO: 4972932 - DNA, 19 bp, Homo sapiens
acccctggcttttcactgc

SEQ ID NO: 4972933 - DNA, 20 bp, Homo sapiens
acccctggcttttcactgct

SEQ ID NO: 4972934 - DNA, 21 bp, Homo sapiens
acccctggcttttcactgctg

SEQ ID NO: 4972935 - DNA, 16 bp, Homo sapiens
acccctgtcctcactg

SEQ ID NO: 4972936 - DNA, 17 bp, Homo sapiens
acccctgtcctcactgc

SEQ ID NO: 4972937 - DNA, 14 bp, Homo sapiens
accccttagcctcc

SEQ ID NO: 4972938 - DNA, 15 bp, Homo sapiens
accccttagcctccc

SEQ ID NO: 4972939 - DNA, 17 bp, Homo sapiens
accccttagcctccctg

SEQ ID NO: 4972940 - DNA, 15 bp, Homo sapiens
accccttccagatca

SEQ ID NO: 4972941 - DNA, 21 bp, Homo sapiens
accccttccagatcactgcca

SEQ ID NO: 4972942 - DNA, 21 bp, Homo sapiens
acatttgccttgcagaactgc

SEQ ID NO: 4972943 - DNA, 14 bp, Homo sapiens
acatttgccttgct

SEQ ID NO: 4972944 - DNA, 15 bp, Homo sapiens
acatttgccttgctg

SEQ ID NO: 4972945 - DNA, 20 bp, Homo sapiens
acattttaaataaaagaaaa

SEQ ID NO: 4972946 - DNA, 14 bp, Homo sapiens
acattttacattaa

SEQ ID NO: 4972947 - DNA, 14 bp, Homo sapiens
acattttgttctta

SEQ ID NO: 4972948 - DNA, 19 bp, Homo sapiens
acattttgttgtaaaaaga

SEQ ID NO: 4972949 - DNA, 23 bp, Homo sapiens
acattttgttgtaaaaagaaaaa

SEQ ID NO: 4972950 - DNA, 17 bp, Homo sapiens
accaaaagaatttgcac

SEQ ID NO: 4972951 - DNA, 12 bp, Homo sapiens
accaaagttcta

SEQ ID NO: 4972952 - DNA, 15 bp, Homo sapiens
accaaagttctaata

SEQ ID NO: 4972953 - DNA, 20 bp, Homo sapiens
accaaagttctaataatttc

SEQ ID NO: 4972954 - DNA, 23 bp, Homo sapiens
accaacaggctgttctgcactga

SEQ ID NO: 4972955 - DNA, 18 bp, Homo sapiens
accaactgtgttgtatta

SEQ ID NO: 4972956 - DNA, 21 bp, Homo sapiens
accaactgtgttgtattaaca

SEQ ID NO: 4972957 - DNA, 20 bp, Homo sapiens
accaacttggttctgcttca

SEQ ID NO: 4972958 - DNA, 14 bp, Homo sapiens
accaagaaagcagg

SEQ ID NO: 4972959 - DNA, 19 bp, Homo sapiens
accaagctattcctttccc

SEQ ID NO: 4972960 - DNA, 22 bp, Homo sapiens
accaagctattcctttcccttc

SEQ ID NO: 4972961 - DNA, 23 bp, Homo sapiens
accaattattgatatatattata

SEQ ID NO: 4972962 - DNA, 13 bp, Homo sapiens
accaattgtgctg

SEQ ID NO: 4972963 - DNA, 14 bp, Homo sapiens
accaattgtgctgc

SEQ ID NO: 4972964 - DNA, 16 bp, Homo sapiens
accaattgtgctgcca

SEQ ID NO: 4972965 - DNA, 14 bp, Homo sapiens
accacaaaggccaa

SEQ ID NO: 4972966 - DNA, 21 bp, Homo sapiens
accacacccagcccacttctg

SEQ ID NO: 4972967 - DNA, 18 bp, Homo sapiens
accacacccggctaattt

SEQ ID NO: 4972968 - DNA, 13 bp, Homo sapiens
accacaccctgta

SEQ ID NO: 4972969 - DNA, 13 bp, Homo sapiens
accacagacacac

SEQ ID NO: 4972970 - DNA, 16 bp, Homo sapiens
accacagacacacaca

SEQ ID NO: 4972971 - DNA, 15 bp, Homo sapiens
accacagagctgtca

SEQ ID NO: 4972972 - DNA, 24 bp, Homo sapiens
accacatcttgctctgctgacaga

SEQ ID NO: 4972973 - DNA, 18 bp, Homo sapiens
accacatgtgcacatgca

SEQ ID NO: 4972974 - DNA, 20 bp, Homo sapiens
accaccatccaccgctgctc

SEQ ID NO: 4972975 - DNA, 22 bp, Homo sapiens
accaccccgcctgccctcatgg

SEQ ID NO: 4972976 - DNA, 18 bp, Homo sapiens
accaccccggccccctgc

SEQ ID NO: 4972977 - DNA, 20 bp, Homo sapiens
accaccccggccccctgccc

SEQ ID NO: 4972978 - DNA, 14 bp, Homo sapiens
accacctccctcac

SEQ ID NO: 4972979 - DNA, 12 bp, Homo sapiens
accacctctgtg

SEQ ID NO: 4972980 - DNA, 13 bp, Homo sapiens
accacctctgtgg

SEQ ID NO: 4972981 - DNA, 14 bp, Homo sapiens
accacctctgtggc

SEQ ID NO: 4972982 - DNA, 14 bp, Homo sapiens
accacgctggacct

SEQ ID NO: 4972983 - DNA, 17 bp, Homo sapiens
accacgtctgtcttcac

SEQ ID NO: 4972984 - DNA, 18 bp, Homo sapiens
accacgtctgtcttcaca

SEQ ID NO: 4972985 - DNA, 12 bp, Homo sapiens
accactcagccc

SEQ ID NO: 4972986 - DNA, 14 bp, Homo sapiens
accactcagcccct

SEQ ID NO: 4972987 - DNA, 17 bp, Homo sapiens
accactcagcccctagg

SEQ ID NO: 4972988 - DNA, 13 bp, Homo sapiens
accactgtttctt

SEQ ID NO: 4972989 - DNA, 16 bp, Homo sapiens
accactgtttcttgct

SEQ ID NO: 4972990 - DNA, 17 bp, Homo sapiens
accactgtttcttgctt

SEQ ID NO: 4972991 - DNA, 18 bp, Homo sapiens
accactgtttcttgcttg

SEQ ID NO: 4972992 - DNA, 23 bp, Homo sapiens
accactgtttcttgcttgtacct

SEQ ID NO: 4972993 - DNA, 16 bp, Homo sapiens
accacttcactgaaag

SEQ ID NO: 4972994 - DNA, 17 bp, Homo sapiens
accacttcactgaaaga

SEQ ID NO: 4972995 - DNA, 18 bp, Homo sapiens
accacttcactgaaagac

SEQ ID NO: 4972996 - DNA, 13 bp, Homo sapiens
accacttcattct

SEQ ID NO: 4972997 - DNA, 14 bp, Homo sapiens
accacttcattctg

SEQ ID NO: 4972998 - DNA, 13 bp, Homo sapiens
accacttcgaaac

SEQ ID NO: 4972999 - DNA, 17 bp, Homo sapiens
accagaattgtgcaaat

SEQ ID NO: 4973000 - DNA, 16 bp, Homo sapiens
accagacaaggaaata

SEQ ID NO: 4973001 - DNA, 22 bp, Homo sapiens
accagacaccttgacagggcac

SEQ ID NO: 4973002 - DNA, 16 bp, Homo sapiens
accagactgcaggttg

SEQ ID NO: 4973003 - DNA, 18 bp, Homo sapiens
accagagaccgtcctcac

SEQ ID NO: 4973004 - DNA, 16 bp, Homo sapiens
accagagcccaccttg

SEQ ID NO: 4973005 - DNA, 19 bp, Homo sapiens
accagagcccaccttggct

SEQ ID NO: 4973006 - DNA, 15 bp, Homo sapiens
accagaggagccttt

SEQ ID NO: 4973007 - DNA, 16 bp, Homo sapiens
accagaggagcctttt

SEQ ID NO: 4973008 - DNA, 17 bp, Homo sapiens
accagaggagccttttt

SEQ ID NO: 4973009 - DNA, 21 bp, Homo sapiens
accagatgcgtcccaagatgt

SEQ ID NO: 4973010 - DNA, 18 bp, Homo sapiens
accagcccatggccctgt

SEQ ID NO: 4973011 - DNA, 19 bp, Homo sapiens
accagcccatggccctgtg

SEQ ID NO: 4973012 - DNA, 21 bp, Homo sapiens
accagccccactgccagcagc

SEQ ID NO: 4973013 - DNA, 19 bp, Homo sapiens
acagattttaattgtcatg

SEQ ID NO: 4973014 - DNA, 20 bp, Homo sapiens
acagattttaattgtcatgg

SEQ ID NO: 4973015 - DNA, 20 bp, Homo sapiens
acagattttggggttgtgtt

SEQ ID NO: 4973016 - DNA, 17 bp, Homo sapiens
acagcacagctccctgc

SEQ ID NO: 4973017 - DNA, 18 bp, Homo sapiens
acagcacagctccctgcc

SEQ ID NO: 4973018 - DNA, 20 bp, Homo sapiens
acagcactactgggtgtcat

SEQ ID NO: 4973019 - DNA, 22 bp, Homo sapiens
acagcactactgggtgtcattt

SEQ ID NO: 4973020 - DNA, 12 bp, Homo sapiens
acagcagcattt

SEQ ID NO: 4973021 - DNA, 14 bp, Homo sapiens
acagcagcattttt

SEQ ID NO: 4973022 - DNA, 19 bp, Homo sapiens
acagcagcatttttatttc

SEQ ID NO: 4973023 - DNA, 22 bp, Homo sapiens
acagcagcatttttatttcaga

SEQ ID NO: 4973024 - DNA, 18 bp, Homo sapiens
acagcagcccctgcacaa

SEQ ID NO: 4973025 - DNA, 15 bp, Homo sapiens
acagcagcctccaac

SEQ ID NO: 4973026 - DNA, 13 bp, Homo sapiens
acagcagcctgct

SEQ ID NO: 4973027 - DNA, 13 bp, Homo sapiens
acagcagcttcac

SEQ ID NO: 4973028 - DNA, 16 bp, Homo sapiens
acagcagcttcaccag

SEQ ID NO: 4973029 - DNA, 18 bp, Homo sapiens
acagcagcttcaccagag

SEQ ID NO: 4973030 - DNA, 16 bp, Homo sapiens
acagcaggcagcgcca

SEQ ID NO: 4973031 - DNA, 13 bp, Homo sapiens
acagcagtgttcc

SEQ ID NO: 4973032 - DNA, 18 bp, Homo sapiens
acagcatgtgccctcctg

SEQ ID NO: 4973033 - DNA, 15 bp, Homo sapiens
acagccaagtgccaa

SEQ ID NO: 4973034 - DNA, 18 bp, Homo sapiens
acagccaagtgccaaatg

SEQ ID NO: 4973035 - DNA, 17 bp, Homo sapiens
acagccacggccaggcc

SEQ ID NO: 4973036 - DNA, 16 bp, Homo sapiens
acagccatgcccgcat

SEQ ID NO: 4973037 - DNA, 19 bp, Homo sapiens
acagcctcctctgtctgcc

SEQ ID NO: 4973038 - DNA, 23 bp, Homo sapiens
acagcctcctctgtctgcccttc

SEQ ID NO: 4973039 - DNA, 16 bp, Homo sapiens
acagcctctgacccct

SEQ ID NO: 4973040 - DNA, 23 bp, Homo sapiens
acagcctctgacccctcctcact

SEQ ID NO: 4973041 - DNA, 11 bp, Homo sapiens
acagcctggca

SEQ ID NO: 4973042 - DNA, 12 bp, Homo sapiens
acagcctggcac

SEQ ID NO: 4973043 - DNA, 15 bp, Homo sapiens
acagcctgggcccca

SEQ ID NO: 4973044 - DNA, 19 bp, Homo sapiens
acagcgaagtagcttgctc

SEQ ID NO: 4973045 - DNA, 20 bp, Homo sapiens
acagcgacatagcccatccc

SEQ ID NO: 4973046 - DNA, 14 bp, Homo sapiens
acagcgagggcagc

SEQ ID NO: 4973047 - DNA, 15 bp, Homo sapiens
acagcgagggcagct

SEQ ID NO: 4973048 - DNA, 18 bp, Homo sapiens
acagcgagggcagctgct

SEQ ID NO: 4973049 - DNA, 19 bp, Homo sapiens
acagcgagggcagctgcta

SEQ ID NO: 4973050 - DNA, 13 bp, Homo sapiens
acagcggcccctg

SEQ ID NO: 4973051 - DNA, 21 bp, Homo sapiens
acagcgtccctagcagtgaac

SEQ ID NO: 4973052 - DNA, 23 bp, Homo sapiens
acagcgtccctagcagtgaacta

SEQ ID NO: 4973053 - DNA, 21 bp, Homo sapiens
acagctatgggagccccaggg

SEQ ID NO: 4973054 - DNA, 14 bp, Homo sapiens
acagctccccaagt

SEQ ID NO: 4973055 - DNA, 12 bp, Homo sapiens
acagctcctccc

SEQ ID NO: 4973056 - DNA, 14 bp, Homo sapiens
acagctcctcccac

SEQ ID NO: 4973057 - DNA, 12 bp, Homo sapiens
acagctccttct

SEQ ID NO: 4973058 - DNA, 23 bp, Homo sapiens
accctggaaatggactggtttga

SEQ ID NO: 4973059 - DNA, 14 bp, Homo sapiens
accctgggagacag

SEQ ID NO: 4973060 - DNA, 22 bp, Homo sapiens
accctggggcctggacctgcct

SEQ ID NO: 4973061 - DNA, 16 bp, Homo sapiens
accctgtacctcatcc

SEQ ID NO: 4973062 - DNA, 14 bp, Homo sapiens
accctgtggccctg

SEQ ID NO: 4973063 - DNA, 15 bp, Homo sapiens
accctgtggccctgg

SEQ ID NO: 4973064 - DNA, 14 bp, Homo sapiens
acccttaacccaag

SEQ ID NO: 4973065 - DNA, 15 bp, Homo sapiens
acccttaacccaagg

SEQ ID NO: 4973066 - DNA, 18 bp, Homo sapiens
acccttaacccaaggagc

SEQ ID NO: 4973067 - DNA, 23 bp, Homo sapiens
acccttaacccaaggagcacagg

SEQ ID NO: 4973068 - DNA, 18 bp, Homo sapiens
acccttaccccttagcct

SEQ ID NO: 4973069 - DNA, 13 bp, Homo sapiens
acccttccagaca

SEQ ID NO: 4973070 - DNA, 16 bp, Homo sapiens
acccttccagacatac

SEQ ID NO: 4973071 - DNA, 20 bp, Homo sapiens
acccttcccaatcagcactg

SEQ ID NO: 4973072 - DNA, 21 bp, Homo sapiens
acccttcccaatcagcactga

SEQ ID NO: 4973073 - DNA, 23 bp, Homo sapiens
acccttcccaatcagcactgaaa

SEQ ID NO: 4973074 - DNA, 22 bp, Homo sapiens
acccttcccctccttctccctt

SEQ ID NO: 4973075 - DNA, 15 bp, Homo sapiens
acccttccctgcact

SEQ ID NO: 4973076 - DNA, 18 bp, Homo sapiens
acccttcctgagctttat

SEQ ID NO: 4973077 - DNA, 11 bp, Homo sapiens
acccttccttc

SEQ ID NO: 4973078 - DNA, 12 bp, Homo sapiens
acccttggcctg

SEQ ID NO: 4973079 - DNA, 23 bp, Homo sapiens
accgaagtggactggcccctggg

SEQ ID NO: 4973080 - DNA, 17 bp, Homo sapiens
accgacgcgtctcctgt

SEQ ID NO: 4973081 - DNA, 15 bp, Homo sapiens
accgagcaaagatca

SEQ ID NO: 4973082 - DNA, 17 bp, Homo sapiens
accgagtctcttctcca

SEQ ID NO: 4973083 - DNA, 16 bp, Homo sapiens
accgattctttggagt

SEQ ID NO: 4973084 - DNA, 19 bp, Homo sapiens
accgccccctcctctagct

SEQ ID NO: 4973085 - DNA, 19 bp, Homo sapiens
accgcctagtttactgttt

SEQ ID NO: 4973086 - DNA, 16 bp, Homo sapiens
accgcctgtctcttta

SEQ ID NO: 4973087 - DNA, 18 bp, Homo sapiens
accgctcacctagagcca

SEQ ID NO: 4973088 - DNA, 19 bp, Homo sapiens
accgctcacctagagccag

SEQ ID NO: 4973089 - DNA, 16 bp, Homo sapiens
accgctctcttttctg

SEQ ID NO: 4973090 - DNA, 22 bp, Homo sapiens
accgctctcttttctgtacttc

SEQ ID NO: 4973091 - DNA, 15 bp, Homo sapiens
accgcttccctcctg

SEQ ID NO: 4973092 - DNA, 11 bp, Homo sapiens
accggcgcgct

SEQ ID NO: 4973093 - DNA, 22 bp, Homo sapiens
accgggccagtatctatatatg

SEQ ID NO: 4973094 - DNA, 14 bp, Homo sapiens
accggtccagctgg

SEQ ID NO: 4973095 - DNA, 16 bp, Homo sapiens
accggtccagctggcc

SEQ ID NO: 4973096 - DNA, 17 bp, Homo sapiens
accggtccagctggcct

SEQ ID NO: 4973097 - DNA, 15 bp, Homo sapiens
accgtggccctgccc

SEQ ID NO: 4973098 - DNA, 22 bp, Homo sapiens
acctaaaaggaaatctcacccc

SEQ ID NO: 4973099 - DNA, 20 bp, Homo sapiens
acctaaaggtgtatttaaac

SEQ ID NO: 4973100 - DNA, 14 bp, Homo sapiens
acctaagtactgta

SEQ ID NO: 4973101 - DNA, 18 bp, Homo sapiens
acctaagtcctttatgtg

SEQ ID NO: 4973102 - DNA, 16 bp, Homo sapiens
acctaagtctctgtga

SEQ ID NO: 4973103 - DNA, 18 bp, Homo sapiens
acctaagtgacatttgta

SEQ ID NO: 4973104 - DNA, 14 bp, Homo sapiens
acctaccaaaatgg

SEQ ID NO: 4973105 - DNA, 20 bp, Homo sapiens
acctaccactcacatgacac

SEQ ID NO: 4973106 - DNA, 23 bp, Homo sapiens
acctactgttctaaagctctgac

SEQ ID NO: 4973107 - DNA, 13 bp, Homo sapiens
acctagagccaga

SEQ ID NO: 4973108 - DNA, 14 bp, Homo sapiens
acctagtactgccc

SEQ ID NO: 4973109 - DNA, 12 bp, Homo sapiens
acctatttccat

SEQ ID NO: 4973110 - DNA, 19 bp, Homo sapiens
acctcaaaatgtctaagat

SEQ ID NO: 4973111 - DNA, 19 bp, Homo sapiens
acctcaagtgatctgccca

SEQ ID NO: 4973112 - DNA, 14 bp, Homo sapiens
acctcaatgtttga

SEQ ID NO: 4973113 - DNA, 14 bp, Homo sapiens
acctcacagtgacc

SEQ ID NO: 4973114 - DNA, 20 bp, Homo sapiens
acctcaccccgttacagctc

SEQ ID NO: 4973115 - DNA, 15 bp, Homo sapiens
acctcacctagaaat

SEQ ID NO: 4973116 - DNA, 14 bp, Homo sapiens
acctcactctttat

SEQ ID NO: 4973117 - DNA, 16 bp, Homo sapiens
acctcactctttatag

SEQ ID NO: 4973118 - DNA, 11 bp, Homo sapiens
acctcagcctc

SEQ ID NO: 4973119 - DNA, 18 bp, Homo sapiens
acctcaggcactagcctt

SEQ ID NO: 4973120 - DNA, 12 bp, Homo sapiens
acctcaggcagg

SEQ ID NO: 4973121 - DNA, 15 bp, Homo sapiens
acctcaggcaggaag

SEQ ID NO: 4973122 - DNA, 15 bp, Homo sapiens
acctcaggtgatcca

SEQ ID NO: 4973123 - DNA, 20 bp, Homo sapiens
acctcaggtgatccacccac

SEQ ID NO: 4973124 - DNA, 16 bp, Homo sapiens
acctcagttcccttgg

SEQ ID NO: 4973125 - DNA, 18 bp, Homo sapiens
acctcagttcccttggcc

SEQ ID NO: 4973126 - DNA, 21 bp, Homo sapiens
acctcagttcccttggcctca

SEQ ID NO: 4973127 - DNA, 22 bp, Homo sapiens
acctcagttcccttggcctcag

SEQ ID NO: 4973128 - DNA, 14 bp, Homo sapiens
acctcatcccatga

SEQ ID NO: 4973129 - DNA, 17 bp, Homo sapiens
acctcattgacaagaac

SEQ ID NO: 4973130 - DNA, 22 bp, Homo sapiens
acctccagcccgggagcctagg

SEQ ID NO: 4973131 - DNA, 13 bp, Homo sapiens
acctccatgacag

SEQ ID NO: 4973132 - DNA, 18 bp, Homo sapiens
acctccattaaagtctga

SEQ ID NO: 4973133 - DNA, 20 bp, Homo sapiens
acctccattaaagtctgaat

SEQ ID NO: 4973134 - DNA, 21 bp, Homo sapiens
acctccccacgccctcccctc

SEQ ID NO: 4973135 - DNA, 13 bp, Homo sapiens
acctcccctgcct

SEQ ID NO: 4973136 - DNA, 14 bp, Homo sapiens
acctccctcttgtt

SEQ ID NO: 4973137 - DNA, 13 bp, Homo sapiens
acctccctgaccc

SEQ ID NO: 4973138 - DNA, 15 bp, Homo sapiens
acctccctgcccagg

SEQ ID NO: 4973139 - DNA, 18 bp, Homo sapiens
acctcccttccgaccctc

SEQ ID NO: 4973140 - DNA, 13 bp, Homo sapiens
acctcctgcctcg

SEQ ID NO: 4973141 - DNA, 23 bp, Homo sapiens
acctcctgcctcgaactggctgc

SEQ ID NO: 4973142 - DNA, 13 bp, Homo sapiens
acctcctgggcta

SEQ ID NO: 4973143 - DNA, 15 bp, Homo sapiens
acctcctgtggaacc

SEQ ID NO: 4973144 - DNA, 21 bp, Homo sapiens
acctcctgtggaacccagcag

SEQ ID NO: 4973145 - DNA, 16 bp, Homo sapiens
acctctggctgactaa

SEQ ID NO: 4973146 - DNA, 15 bp, Homo sapiens
acctctgtctcatcc

SEQ ID NO: 4973147 - DNA, 15 bp, Homo sapiens
acctctgtgacctca

SEQ ID NO: 4973148 - DNA, 12 bp, Homo sapiens
acctctgtgtgc

SEQ ID NO: 4973149 - DNA, 15 bp, Homo sapiens
acctcttcacccccc

SEQ ID NO: 4973150 - DNA, 14 bp, Homo sapiens
acctcttctggctc

SEQ ID NO: 4973151 - DNA, 18 bp, Homo sapiens
acctcttgctgtctctgc

SEQ ID NO: 4973152 - DNA, 24 bp, Homo sapiens
acctcttgctgtctctgctcgccc

SEQ ID NO: 4973153 - DNA, 18 bp, Homo sapiens
acctgaagactcattctt

SEQ ID NO: 4973154 - DNA, 16 bp, Homo sapiens
acctgaagactgagga

SEQ ID NO: 4973155 - DNA, 12 bp, Homo sapiens
acctgacacaag

SEQ ID NO: 4973156 - DNA, 18 bp, Homo sapiens
acctgacctcttgctgtc

SEQ ID NO: 4973157 - DNA, 20 bp, Homo sapiens
acctgactggttaacagcag

SEQ ID NO: 4973158 - DNA, 22 bp, Homo sapiens
acctgagtcaccctacctgtgc

SEQ ID NO: 4973159 - DNA, 19 bp, Homo sapiens
acctgatcactagcctgtc

SEQ ID NO: 4973160 - DNA, 22 bp, Homo sapiens
acctgatcactagcctgtcatc

SEQ ID NO: 4973161 - DNA, 21 bp, Homo sapiens
acctgatggcacttagctatc

SEQ ID NO: 4973162 - DNA, 14 bp, Homo sapiens
acctgattgtaaac

SEQ ID NO: 4973163 - DNA, 23 bp, Homo sapiens
acctgcactggggagcccgtctc

SEQ ID NO: 4973164 - DNA, 17 bp, Homo sapiens
acctgcaggctgagcca

SEQ ID NO: 4973165 - DNA, 17 bp, Homo sapiens
acctgcatctttagtgc

SEQ ID NO: 4973166 - DNA, 12 bp, Homo sapiens
acctgccctgga

SEQ ID NO: 4973167 - DNA, 13 bp, Homo sapiens
acctgcctcctcg

SEQ ID NO: 4973168 - DNA, 18 bp, Homo sapiens
acgcatggtcaaccctca

SEQ ID NO: 4973169 - DNA, 20 bp, Homo sapiens
acgcccacccaaccccaagc

SEQ ID NO: 4973170 - DNA, 13 bp, Homo sapiens
acgccctcccctc

SEQ ID NO: 4973171 - DNA, 15 bp, Homo sapiens
acgccctcccctccc

SEQ ID NO: 4973172 - DNA, 22 bp, Homo sapiens
acgccctcccctcccctgctgc

SEQ ID NO: 4973173 - DNA, 15 bp, Homo sapiens
acgccctctccccac

SEQ ID NO: 4973174 - DNA, 20 bp, Homo sapiens
acgccggggacagaggcctg

SEQ ID NO: 4973175 - DNA, 22 bp, Homo sapiens
acgccggggacagaggcctgcc

SEQ ID NO: 4973176 - DNA, 14 bp, Homo sapiens
acgcgcgcacacac

SEQ ID NO: 4973177 - DNA, 12 bp, Homo sapiens
acgcgtctcctg

SEQ ID NO: 4973178 - DNA, 16 bp, Homo sapiens
acgctgatacataact

SEQ ID NO: 4973179 - DNA, 20 bp, Homo sapiens
acgctggaccttgaactggg

SEQ ID NO: 4973180 - DNA, 18 bp, Homo sapiens
acgctggagtgcagtgag

SEQ ID NO: 4973181 - DNA, 20 bp, Homo sapiens
acgctgtcaaaagttggact

SEQ ID NO: 4973182 - DNA, 11 bp, Homo sapiens
acgctttgatt

SEQ ID NO: 4973183 - DNA, 14 bp, Homo sapiens
acgctttgattcat

SEQ ID NO: 4973184 - DNA, 15 bp, Homo sapiens
acggagcccagccct

SEQ ID NO: 4973185 - DNA, 21 bp, Homo sapiens
acggcattagcttcctgcccc

SEQ ID NO: 4973186 - DNA, 16 bp, Homo sapiens
acggccaggccagagg

SEQ ID NO: 4973187 - DNA, 22 bp, Homo sapiens
acggccctcatctatgaggaaa

SEQ ID NO: 4973188 - DNA, 12 bp, Homo sapiens
acggccctgcaa

SEQ ID NO: 4973189 - DNA, 15 bp, Homo sapiens
acggcctgatgctcc

SEQ ID NO: 4973190 - DNA, 17 bp, Homo sapiens
acggctaagaggctgct

SEQ ID NO: 4973191 - DNA, 18 bp, Homo sapiens
acggctaagaggctgctg

SEQ ID NO: 4973192 - DNA, 21 bp, Homo sapiens
acgggaagcgctcagaacagt

SEQ ID NO: 4973193 - DNA, 15 bp, Homo sapiens
acggtcaggtttaac

SEQ ID NO: 4973194 - DNA, 14 bp, Homo sapiens
acggttaactgtaa

SEQ ID NO: 4973195 - DNA, 21 bp, Homo sapiens
acggttttttattattgtggt

SEQ ID NO: 4973196 - DNA, 13 bp, Homo sapiens
acgtacacacaca

SEQ ID NO: 4973197 - DNA, 24 bp, Homo sapiens
acgtagcttctaccatgaacagaa

SEQ ID NO: 4973198 - DNA, 23 bp, Homo sapiens
acgtctgacaggcaatgctggct

SEQ ID NO: 4973199 - DNA, 12 bp, Homo sapiens
acgtcttctaaa

SEQ ID NO: 4973200 - DNA, 16 bp, Homo sapiens
acgtggaacctctgtc

SEQ ID NO: 4973201 - DNA, 18 bp, Homo sapiens
acgtggttggggccctgc

SEQ ID NO: 4973202 - DNA, 13 bp, Homo sapiens
acgtgtcttccac

SEQ ID NO: 4973203 - DNA, 19 bp, Homo sapiens
acgtgtcttccactttgca

SEQ ID NO: 4973204 - DNA, 22 bp, Homo sapiens
acgtgttttattcctgtatgtt

SEQ ID NO: 4973205 - DNA, 15 bp, Homo sapiens
acgttactcagggct

SEQ ID NO: 4973206 - DNA, 18 bp, Homo sapiens
acgttcacccatcttatc

SEQ ID NO: 4973207 - DNA, 21 bp, Homo sapiens
acgttcacccatcttatcaag

SEQ ID NO: 4973208 - DNA, 12 bp, Homo sapiens
acgttggtgacg

SEQ ID NO: 4973209 - DNA, 14 bp, Homo sapiens
actaaaatatatat

SEQ ID NO: 4973210 - DNA, 14 bp, Homo sapiens
actaaaatatttat

SEQ ID NO: 4973211 - DNA, 22 bp, Homo sapiens
actaaatatgaaccctttgttt

SEQ ID NO: 4973212 - DNA, 19 bp, Homo sapiens
actaaatcagagacaaaat

SEQ ID NO: 4973213 - DNA, 21 bp, Homo sapiens
actaaatcagagacaaaatat

SEQ ID NO: 4973214 - DNA, 14 bp, Homo sapiens
actaaatctctaat

SEQ ID NO: 4973215 - DNA, 15 bp, Homo sapiens
actaaatgcctagtt

SEQ ID NO: 4973216 - DNA, 20 bp, Homo sapiens
actaaattcgtgattttcaa

SEQ ID NO: 4973217 - DNA, 12 bp, Homo sapiens
actaaatttaaa

SEQ ID NO: 4973218 - DNA, 17 bp, Homo sapiens
actaaatttgatactta

SEQ ID NO: 4973219 - DNA, 14 bp, Homo sapiens
actaaatttgggga

SEQ ID NO: 4973220 - DNA, 21 bp, Homo sapiens
actaaatttggggacagattc

SEQ ID NO: 4973221 - DNA, 15 bp, Homo sapiens
actaacacaaggaca

SEQ ID NO: 4973222 - DNA, 20 bp, Homo sapiens
actaactagacaccaaagtt

SEQ ID NO: 4973223 - DNA, 12 bp, Homo sapiens
actaagaaactt

SEQ ID NO: 4973224 - DNA, 19 bp, Homo sapiens
actaagaaacttttgtaaa

SEQ ID NO: 4973225 - DNA, 16 bp, Homo sapiens
actaagccacaagaaa

SEQ ID NO: 4973226 - DNA, 18 bp, Homo sapiens
actaagccacaagaaatt

SEQ ID NO: 4973227 - DNA, 14 bp, Homo sapiens
actaagcctacctg

SEQ ID NO: 4973228 - DNA, 18 bp, Homo sapiens
actaagcctacctgctct

SEQ ID NO: 4973229 - DNA, 18 bp, Homo sapiens
actaatataaaatgagta

SEQ ID NO: 4973230 - DNA, 19 bp, Homo sapiens
actaatctgggaagggaag

SEQ ID NO: 4973231 - DNA, 12 bp, Homo sapiens
actaatgtaaaa

SEQ ID NO: 4973232 - DNA, 11 bp, Homo sapiens
actacaaatca

SEQ ID NO: 4973233 - DNA, 23 bp, Homo sapiens
actacacatccctaatgtgtgcc

SEQ ID NO: 4973234 - DNA, 15 bp, Homo sapiens
actacacatttttaa

SEQ ID NO: 4973235 - DNA, 22 bp, Homo sapiens
actacacatttttaaattgtta

SEQ ID NO: 4973236 - DNA, 15 bp, Homo sapiens
actacaggcacccac

SEQ ID NO: 4973237 - DNA, 23 bp, Homo sapiens
actacaggtgtgagtcaccaagc

SEQ ID NO: 4973238 - DNA, 20 bp, Homo sapiens
actacatgcagcccatgccc

SEQ ID NO: 4973239 - DNA, 15 bp, Homo sapiens
actacatgtggttta

SEQ ID NO: 4973240 - DNA, 18 bp, Homo sapiens
actacatgtggtttatag

SEQ ID NO: 4973241 - DNA, 21 bp, Homo sapiens
actaccaagaggccctgtctg

SEQ ID NO: 4973242 - DNA, 12 bp, Homo sapiens
actacctgtgta

SEQ ID NO: 4973243 - DNA, 19 bp, Homo sapiens
actactagtttttactttt

SEQ ID NO: 4973244 - DNA, 21 bp, Homo sapiens
actactagtttttacttttat

SEQ ID NO: 4973245 - DNA, 17 bp, Homo sapiens
actactgggtgtcattt

SEQ ID NO: 4973246 - DNA, 15 bp, Homo sapiens
actacttaccatttg

SEQ ID NO: 4973247 - DNA, 20 bp, Homo sapiens
actactttaataaagaatta

SEQ ID NO: 4973248 - DNA, 16 bp, Homo sapiens
actagaactctccatc

SEQ ID NO: 4973249 - DNA, 16 bp, Homo sapiens
actagacgttcatttg

SEQ ID NO: 4973250 - DNA, 11 bp, Homo sapiens
actagactctt

SEQ ID NO: 4973251 - DNA, 12 bp, Homo sapiens
actagagaatgc

SEQ ID NO: 4973252 - DNA, 20 bp, Homo sapiens
actagagaatgcacagatat

SEQ ID NO: 4973253 - DNA, 23 bp, Homo sapiens
actagagaatgcacagatatact

SEQ ID NO: 4973254 - DNA, 16 bp, Homo sapiens
actagcctgtcatcct

SEQ ID NO: 4973255 - DNA, 19 bp, Homo sapiens
actagggattcaggctgct

SEQ ID NO: 4973256 - DNA, 21 bp, Homo sapiens
actaggttcaattccctgaag

SEQ ID NO: 4973257 - DNA, 13 bp, Homo sapiens
actagtactgtgt

SEQ ID NO: 4973258 - DNA, 22 bp, Homo sapiens
actagtactgtgtactgtatag

SEQ ID NO: 4973259 - DNA, 15 bp, Homo sapiens
actagtgacagcttg

SEQ ID NO: 4973260 - DNA, 22 bp, Homo sapiens
actataacatatgtacataaat

SEQ ID NO: 4973261 - DNA, 16 bp, Homo sapiens
actatacttgaacaaa

SEQ ID NO: 4973262 - DNA, 16 bp, Homo sapiens
actatagtttaaaaca

SEQ ID NO: 4973263 - DNA, 13 bp, Homo sapiens
actatatacatgt

SEQ ID NO: 4973264 - DNA, 15 bp, Homo sapiens
actatatacatgtgt

SEQ ID NO: 4973265 - DNA, 21 bp, Homo sapiens
actatatacatgtgtgtatat

SEQ ID NO: 4973266 - DNA, 16 bp, Homo sapiens
actatatagagatgtt

SEQ ID NO: 4973267 - DNA, 18 bp, Homo sapiens
actatatagagatgtttt

SEQ ID NO: 4973268 - DNA, 14 bp, Homo sapiens
actatcataaaatc

SEQ ID NO: 4973269 - DNA, 17 bp, Homo sapiens
actatcatttaataata

SEQ ID NO: 4973270 - DNA, 17 bp, Homo sapiens
actatccatgcaccaaa

SEQ ID NO: 4973271 - DNA, 15 bp, Homo sapiens
actatcctgacttct

SEQ ID NO: 4973272 - DNA, 17 bp, Homo sapiens
actatggaaaatcagct

SEQ ID NO: 4973273 - DNA, 23 bp, Homo sapiens
actatggagcctggcacaggact

SEQ ID NO: 4973274 - DNA, 14 bp, Homo sapiens
actatgtaaactac

SEQ ID NO: 4973275 - DNA, 20 bp, Homo sapiens
actatgttgcccaggcaggt

SEQ ID NO: 4973276 - DNA, 23 bp, Homo sapiens
actatgttgcccaggcaggtctt

SEQ ID NO: 4973277 - DNA, 11 bp, Homo sapiens
actattattat

SEQ ID NO: 4973278 - DNA, 16 bp, Homo sapiens
actattcgaatgaaaa

SEQ ID NO: 4973279 - DNA, 18 bp, Homo sapiens
actattcgaatgaaaaga

SEQ ID NO: 4973280 - DNA, 14 bp, Homo sapiens
ttcaagttattgta

SEQ ID NO: 4973281 - DNA, 17 bp, Homo sapiens
ttcaagttattgtacag

SEQ ID NO: 4973282 - DNA, 22 bp, Homo sapiens
ttcaagttttgggtatgtttaa

SEQ ID NO: 4973283 - DNA, 13 bp, Homo sapiens
ttcaatacaaaca

SEQ ID NO: 4973284 - DNA, 22 bp, Homo sapiens
ttcaatacaaacaatctcttaa

SEQ ID NO: 4973285 - DNA, 20 bp, Homo sapiens
ttcaatctcccgctgctgct

SEQ ID NO: 4973286 - DNA, 16 bp, Homo sapiens
ttcaatgatagtaaga

SEQ ID NO: 4973287 - DNA, 17 bp, Homo sapiens
ttcaatgggctcttcca

SEQ ID NO: 4973288 - DNA, 21 bp, Homo sapiens
ttcaatgtgattctaatgtct

SEQ ID NO: 4973289 - DNA, 17 bp, Homo sapiens
ttcacaaacttttatac

SEQ ID NO: 4973290 - DNA, 16 bp, Homo sapiens
ttcacaatgtcagtat

SEQ ID NO: 4973291 - DNA, 15 bp, Homo sapiens
ttcacagctcctccc

SEQ ID NO: 4973292 - DNA, 23 bp, Homo sapiens
ttcacagctctgtgttgccatgt

SEQ ID NO: 4973293 - DNA, 18 bp, Homo sapiens
ttcacaggtgtggtgtaa

SEQ ID NO: 4973294 - DNA, 18 bp, Homo sapiens
ttcacagtagagccagct

SEQ ID NO: 4973295 - DNA, 19 bp, Homo sapiens
ttcacagtagagccagctt

SEQ ID NO: 4973296 - DNA, 23 bp, Homo sapiens
ttcacagttggctggatgaaatt

SEQ ID NO: 4973297 - DNA, 15 bp, Homo sapiens
ttcacatagctgtct

SEQ ID NO: 4973298 - DNA, 17 bp, Homo sapiens
ttcacattaaaaaatga

SEQ ID NO: 4973299 - DNA, 18 bp, Homo sapiens
ttcacattaaaaaatgaa

SEQ ID NO: 4973300 - DNA, 16 bp, Homo sapiens
ttcaccaaaattatcc

SEQ ID NO: 4973301 - DNA, 16 bp, Homo sapiens
ttcacccatcttatca

SEQ ID NO: 4973302 - DNA, 18 bp, Homo sapiens
ttcacccatcttatcaag

SEQ ID NO: 4973303 - DNA, 14 bp, Homo sapiens
ttcaccccaccctt

SEQ ID NO: 4973304 - DNA, 22 bp, Homo sapiens
ttcaccccagtggccactcagc

SEQ ID NO: 4973305 - DNA, 22 bp, Homo sapiens
ttcaccccccactcaccagtgt

SEQ ID NO: 4973306 - DNA, 21 bp, Homo sapiens
ttcaccccctgagatcccctg

SEQ ID NO: 4973307 - DNA, 16 bp, Homo sapiens
ttcaccccctttcctg

SEQ ID NO: 4973308 - DNA, 19 bp, Homo sapiens
ttcaccccctttcctggac

SEQ ID NO: 4973309 - DNA, 18 bp, Homo sapiens
ttcacccttaacccaagg

SEQ ID NO: 4973310 - DNA, 22 bp, Homo sapiens
ttcacccttaacccaaggagca

SEQ ID NO: 4973311 - DNA, 13 bp, Homo sapiens
ttcacctcctcgc

SEQ ID NO: 4973312 - DNA, 14 bp, Homo sapiens
ttcacgcaacttga

SEQ ID NO: 4973313 - DNA, 22 bp, Homo sapiens
ttcacgcaacttgaaattatat

SEQ ID NO: 4973314 - DNA, 13 bp, Homo sapiens
ttcactagctttg

SEQ ID NO: 4973315 - DNA, 15 bp, Homo sapiens
ttcactcaagcactg

SEQ ID NO: 4973316 - DNA, 14 bp, Homo sapiens
ttcactcactgtca

SEQ ID NO: 4973317 - DNA, 16 bp, Homo sapiens
ttcactgtataaatag

SEQ ID NO: 4973318 - DNA, 19 bp, Homo sapiens
ttcactgtataaataggag

SEQ ID NO: 4973319 - DNA, 18 bp, Homo sapiens
ttcagaaaacgggaagcg

SEQ ID NO: 4973320 - DNA, 14 bp, Homo sapiens
ttcagaaaatatta

SEQ ID NO: 4973321 - DNA, 20 bp, Homo sapiens
ttcagaaaatattatgtgtt

SEQ ID NO: 4973322 - DNA, 13 bp, Homo sapiens
ttcagaaattgga

SEQ ID NO: 4973323 - DNA, 21 bp, Homo sapiens
ttcagaaattggaacagaatg

SEQ ID NO: 4973324 - DNA, 12 bp, Homo sapiens
ttcagaacctct

SEQ ID NO: 4973325 - DNA, 15 bp, Homo sapiens
ttcagaacctcttcc

SEQ ID NO: 4973326 - DNA, 18 bp, Homo sapiens
ttcagatattattgcttt

SEQ ID NO: 4973327 - DNA, 10 bp, Homo sapiens
ttcagcacca

SEQ ID NO: 4973328 - DNA, 16 bp, Homo sapiens
ttcagcaccaccctag

SEQ ID NO: 4973329 - DNA, 17 bp, Homo sapiens
ttcagcacttgtctcat

SEQ ID NO: 4973330 - DNA, 20 bp, Homo sapiens
ttcagcacttgtctcatttt

SEQ ID NO: 4973331 - DNA, 21 bp, Homo sapiens
ttcagcacttgtctcatttta

SEQ ID NO: 4973332 - DNA, 18 bp, Homo sapiens
ttcagctaagggaagaca

SEQ ID NO: 4973333 - DNA, 20 bp, Homo sapiens
ttcagctaagggaagacatt

SEQ ID NO: 4973334 - DNA, 21 bp, Homo sapiens
ttcagctaagggaagacattt

SEQ ID NO: 4973335 - DNA, 12 bp, Homo sapiens
ttcagctccagc

SEQ ID NO: 4973336 - DNA, 22 bp, Homo sapiens
ttcagctccagctcaccagccc

SEQ ID NO: 4973337 - DNA, 23 bp, Homo sapiens
ttcagctccagctcaccagcccc

SEQ ID NO: 4973338 - DNA, 15 bp, Homo sapiens
ttcagctgtcctccc

SEQ ID NO: 4973339 - DNA, 21 bp, Homo sapiens
ttcagctgtcctccctccacc

SEQ ID NO: 4973340 - DNA, 22 bp, Homo sapiens
ttcagcttgtaaatagctcagg

SEQ ID NO: 4973341 - DNA, 18 bp, Homo sapiens
ttcaggagcgcaagatag

SEQ ID NO: 4973342 - DNA, 15 bp, Homo sapiens
ttcaggctcttctcc

SEQ ID NO: 4973343 - DNA, 13 bp, Homo sapiens
ttcaggctgcttg

SEQ ID NO: 4973344 - DNA, 19 bp, Homo sapiens
ttcaggcttcctgcaattt

SEQ ID NO: 4973345 - DNA, 16 bp, Homo sapiens
ttcaggggactcagcc

SEQ ID NO: 4973346 - DNA, 15 bp, Homo sapiens
ttcaggtaacaggca

SEQ ID NO: 4973347 - DNA, 17 bp, Homo sapiens
ttcaggtaacaggcaga

SEQ ID NO: 4973348 - DNA, 16 bp, Homo sapiens
ttcaggtatgttgcct

SEQ ID NO: 4973349 - DNA, 16 bp, Homo sapiens
ttcaggtgacatgtga

SEQ ID NO: 4973350 - DNA, 18 bp, Homo sapiens
ttcaggtgacatgtgaaa

SEQ ID NO: 4973351 - DNA, 23 bp, Homo sapiens
ttcaggtgacatgtgaaaccttt

SEQ ID NO: 4973352 - DNA, 19 bp, Homo sapiens
ttcaggttatcgaaataac

SEQ ID NO: 4973353 - DNA, 22 bp, Homo sapiens
ttcaggttatcgaaataacaat

SEQ ID NO: 4973354 - DNA, 21 bp, Homo sapiens
ttcagtattttggagaaatta

SEQ ID NO: 4973355 - DNA, 20 bp, Homo sapiens
ttcagtgtagttaatttatc

SEQ ID NO: 4973356 - DNA, 20 bp, Homo sapiens
ttcagtgtatggaaataaat

SEQ ID NO: 4973357 - DNA, 10 bp, Homo sapiens
ttcagttcca

SEQ ID NO: 4973358 - DNA, 14 bp, Homo sapiens
ttcagttccaagaa

SEQ ID NO: 4973359 - DNA, 18 bp, Homo sapiens
ttcagttggttgtgtctt

SEQ ID NO: 4973360 - DNA, 21 bp, Homo sapiens
ttcagttttcatttggttcat

SEQ ID NO: 4973361 - DNA, 16 bp, Homo sapiens
ttcataaagtacttga

SEQ ID NO: 4973362 - DNA, 19 bp, Homo sapiens
ttcataacttattgctgat

SEQ ID NO: 4973363 - DNA, 21 bp, Homo sapiens
ttcataacttattgctgattt

SEQ ID NO: 4973364 - DNA, 22 bp, Homo sapiens
ttcataacttattgctgatttt

SEQ ID NO: 4973365 - DNA, 16 bp, Homo sapiens
ttgactcccaagtttc

SEQ ID NO: 4973366 - DNA, 21 bp, Homo sapiens
ttgactgatgctgagattctt

SEQ ID NO: 4973367 - DNA, 16 bp, Homo sapiens
ttgacttgattagtgc

SEQ ID NO: 4973368 - DNA, 22 bp, Homo sapiens
ttgagaagacctcacctagaaa

SEQ ID NO: 4973369 - DNA, 19 bp, Homo sapiens
ttgagaggccctggggttc

SEQ ID NO: 4973370 - DNA, 14 bp, Homo sapiens
ttgagagttctaaa

SEQ ID NO: 4973371 - DNA, 23 bp, Homo sapiens
ttgagatactttttcttttgtaa

SEQ ID NO: 4973372 - DNA, 17 bp, Homo sapiens
ttgagatgtatgaaggc

SEQ ID NO: 4973373 - DNA, 20 bp, Homo sapiens
ttgagattgccccaggtctg

SEQ ID NO: 4973374 - DNA, 11 bp, Homo sapiens
ttgagatttct

SEQ ID NO: 4973375 - DNA, 12 bp, Homo sapiens
ttgagcagggct

SEQ ID NO: 4973376 - DNA, 16 bp, Homo sapiens
ttgagctgatataaat

SEQ ID NO: 4973377 - DNA, 14 bp, Homo sapiens
ttgaggaactgtac

SEQ ID NO: 4973378 - DNA, 19 bp, Homo sapiens
ttgaggaactgtacagaaa

SEQ ID NO: 4973379 - DNA, 15 bp, Homo sapiens
ttgaggagcatgttt

SEQ ID NO: 4973380 - DNA, 13 bp, Homo sapiens
ttgaggctttgtg

SEQ ID NO: 4973381 - DNA, 15 bp, Homo sapiens
ttgaggctttgtgtt

SEQ ID NO: 4973382 - DNA, 14 bp, Homo sapiens
ttgagggcccagag

SEQ ID NO: 4973383 - DNA, 15 bp, Homo sapiens
ttgagggcccagagc

SEQ ID NO: 4973384 - DNA, 21 bp, Homo sapiens
ttgagggcccagagcaggaag

SEQ ID NO: 4973385 - DNA, 23 bp, Homo sapiens
ttgagggcccagagcaggaagca

SEQ ID NO: 4973386 - DNA, 13 bp, Homo sapiens
ttgagggttgggc

SEQ ID NO: 4973387 - DNA, 23 bp, Homo sapiens
ttgaggtagaccaggatttctaa

SEQ ID NO: 4973388 - DNA, 17 bp, Homo sapiens
ttgagtagatattactt

SEQ ID NO: 4973389 - DNA, 21 bp, Homo sapiens
ttgagtagatattactttatc

SEQ ID NO: 4973390 - DNA, 22 bp, Homo sapiens
ttgagtctgtttttttatagtt

SEQ ID NO: 4973391 - DNA, 18 bp, Homo sapiens
ttgagtgtgtgtgtgcat

SEQ ID NO: 4973392 - DNA, 13 bp, Homo sapiens
ttgagtttgtagg

SEQ ID NO: 4973393 - DNA, 19 bp, Homo sapiens
ttgataataaattgaaatt

SEQ ID NO: 4973394 - DNA, 13 bp, Homo sapiens
ttgataatgataa

SEQ ID NO: 4973395 - DNA, 13 bp, Homo sapiens
ttgataatgttaa

SEQ ID NO: 4973396 - DNA, 18 bp, Homo sapiens
ttgataatgttaaatttg

SEQ ID NO: 4973397 - DNA, 17 bp, Homo sapiens
ttgatacataataaaaa

SEQ ID NO: 4973398 - DNA, 23 bp, Homo sapiens
ttgatacataataaaaaattatg

SEQ ID NO: 4973399 - DNA, 16 bp, Homo sapiens
ttgatacccctgggga

SEQ ID NO: 4973400 - DNA, 20 bp, Homo sapiens
ttgatacttatattttcgta

SEQ ID NO: 4973401 - DNA, 13 bp, Homo sapiens
ttgatatatatta

SEQ ID NO: 4973402 - DNA, 14 bp, Homo sapiens
ttgatatatattat

SEQ ID NO: 4973403 - DNA, 16 bp, Homo sapiens
ttgatatgagtataca

SEQ ID NO: 4973404 - DNA, 22 bp, Homo sapiens
ttgatattttcaacgcagccct

SEQ ID NO: 4973405 - DNA, 17 bp, Homo sapiens
ttgatcacactatttta

SEQ ID NO: 4973406 - DNA, 23 bp, Homo sapiens
ttgatcataaactgactatcata

SEQ ID NO: 4973407 - DNA, 11 bp, Homo sapiens
ttgatgaaaag

SEQ ID NO: 4973408 - DNA, 20 bp, Homo sapiens
ttgatgaaaagatttaagca

SEQ ID NO: 4973409 - DNA, 23 bp, Homo sapiens
ttgatgaagcaaggaagatatac

SEQ ID NO: 4973410 - DNA, 20 bp, Homo sapiens
ttgatgaccaaagtcctttt

SEQ ID NO: 4973411 - DNA, 21 bp, Homo sapiens
ttgatgatacaatgaacactt

SEQ ID NO: 4973412 - DNA, 16 bp, Homo sapiens
ttgatgatctttgcag

SEQ ID NO: 4973413 - DNA, 12 bp, Homo sapiens
ttgatgcacaga

SEQ ID NO: 4973414 - DNA, 21 bp, Homo sapiens
ttgatgcacagagaagctggg

SEQ ID NO: 4973415 - DNA, 18 bp, Homo sapiens
ttgatgcaggcacttatt

SEQ ID NO: 4973416 - DNA, 12 bp, Homo sapiens
ttgatgcatgtg

SEQ ID NO: 4973417 - DNA, 12 bp, Homo sapiens
ttgatgtatctg

SEQ ID NO: 4973418 - DNA, 15 bp, Homo sapiens
ttgatgtatctgagt

SEQ ID NO: 4973419 - DNA, 20 bp, Homo sapiens
ttgatgtatctgagttgcca

SEQ ID NO: 4973420 - DNA, 19 bp, Homo sapiens
ttgatgtgacaataatatt

SEQ ID NO: 4973421 - DNA, 11 bp, Homo sapiens
ttgatgtgttt

SEQ ID NO: 4973422 - DNA, 13 bp, Homo sapiens
ttgatgtttgtgg

SEQ ID NO: 4973423 - DNA, 19 bp, Homo sapiens
ttgatgtttgtggcctcag

SEQ ID NO: 4973424 - DNA, 16 bp, Homo sapiens
ttgattaacaaatatg

SEQ ID NO: 4973425 - DNA, 16 bp, Homo sapiens
ttggcgctattacaaa

SEQ ID NO: 4973426 - DNA, 13 bp, Homo sapiens
ttggcgtggagca

SEQ ID NO: 4973427 - DNA, 20 bp, Homo sapiens
ttggctaactatatttgctt

SEQ ID NO: 4973428 - DNA, 14 bp, Homo sapiens
ttggctcagacatg

SEQ ID NO: 4973429 - DNA, 13 bp, Homo sapiens
ttggctctggaga

SEQ ID NO: 4973430 - DNA, 20 bp, Homo sapiens
ttggctctggagacagcccc

SEQ ID NO: 4973431 - DNA, 20 bp, Homo sapiens
ttggctggatgaaattttct

SEQ ID NO: 4973432 - DNA, 14 bp, Homo sapiens
ttggcttaaatata

SEQ ID NO: 4973433 - DNA, 15 bp, Homo sapiens
ttggcttaaatatag

SEQ ID NO: 4973434 - DNA, 17 bp, Homo sapiens
ttggcttactgcagcct

SEQ ID NO: 4973435 - DNA, 21 bp, Homo sapiens
ttggcttccatgatggttatt

SEQ ID NO: 4973436 - DNA, 14 bp, Homo sapiens
ttggcttgactcag

SEQ ID NO: 4973437 - DNA, 21 bp, Homo sapiens
ttggcttgtagaattgttata

SEQ ID NO: 4973438 - DNA, 17 bp, Homo sapiens
ttgggagcttgggaatg

SEQ ID NO: 4973439 - DNA, 19 bp, Homo sapiens
ttgggagcttgggaatgga

SEQ ID NO: 4973440 - DNA, 15 bp, Homo sapiens
ttgggagtccaggca

SEQ ID NO: 4973441 - DNA, 20 bp, Homo sapiens
ttgggagtccaggcacagga

SEQ ID NO: 4973442 - DNA, 18 bp, Homo sapiens
ttgggagttttgaatgtt

SEQ ID NO: 4973443 - DNA, 20 bp, Homo sapiens
ttggggaggacaaaacttct

SEQ ID NO: 4973444 - DNA, 21 bp, Homo sapiens
ttggggccaccaaagctgccc

SEQ ID NO: 4973445 - DNA, 13 bp, Homo sapiens
ttggggccctgcc

SEQ ID NO: 4973446 - DNA, 21 bp, Homo sapiens
ttgggggggccaaaaggaaaa

SEQ ID NO: 4973447 - DNA, 22 bp, Homo sapiens
ttggggtacccactgctctggt

SEQ ID NO: 4973448 - DNA, 13 bp, Homo sapiens
ttggggtctcttt

SEQ ID NO: 4973449 - DNA, 16 bp, Homo sapiens
ttggggttgtgttgtc

SEQ ID NO: 4973450 - DNA, 21 bp, Homo sapiens
ttgggttcatgatgcagtctc

SEQ ID NO: 4973451 - DNA, 15 bp, Homo sapiens
ttggtagattaaata

SEQ ID NO: 4973452 - DNA, 22 bp, Homo sapiens
ttggtccagagcggaggctgtg

SEQ ID NO: 4973453 - DNA, 14 bp, Homo sapiens
ttggtcctgtcccc

SEQ ID NO: 4973454 - DNA, 14 bp, Homo sapiens
ttggtctctatttc

SEQ ID NO: 4973455 - DNA, 18 bp, Homo sapiens
ttggtctctatttcattt

SEQ ID NO: 4973456 - DNA, 20 bp, Homo sapiens
ttggtctgacccactgcttt

SEQ ID NO: 4973457 - DNA, 13 bp, Homo sapiens
ttggtctgtgtga

SEQ ID NO: 4973458 - DNA, 12 bp, Homo sapiens
ttggtgcctggc

SEQ ID NO: 4973459 - DNA, 13 bp, Homo sapiens
ttggtgcctggcc

SEQ ID NO: 4973460 - DNA, 22 bp, Homo sapiens
ttggtgcctggcctggcacaca

SEQ ID NO: 4973461 - DNA, 14 bp, Homo sapiens
ttggtggctttcct

SEQ ID NO: 4973462 - DNA, 23 bp, Homo sapiens
ttggtgtatagaagtttgtccat

SEQ ID NO: 4973463 - DNA, 14 bp, Homo sapiens
ttggtgtgctgagg

SEQ ID NO: 4973464 - DNA, 14 bp, Homo sapiens
ttggttctaaggac

SEQ ID NO: 4973465 - DNA, 18 bp, Homo sapiens
ttggttctaaggacctga

SEQ ID NO: 4973466 - DNA, 19 bp, Homo sapiens
ttggttctgcttcaataaa

SEQ ID NO: 4973467 - DNA, 20 bp, Homo sapiens
ttggtttacatttaaagcat

SEQ ID NO: 4973468 - DNA, 15 bp, Homo sapiens
ttgtaaaaaaaaatg

SEQ ID NO: 4973469 - DNA, 20 bp, Homo sapiens
ttgtaaaaaaaaatgccttt

SEQ ID NO: 4973470 - DNA, 14 bp, Homo sapiens
ttgtaaaaagaaaa

SEQ ID NO: 4973471 - DNA, 15 bp, Homo sapiens
ttgtaaaatagcttg

SEQ ID NO: 4973472 - DNA, 21 bp, Homo sapiens
ttgtaaaatagcttgtatagt

SEQ ID NO: 4973473 - DNA, 15 bp, Homo sapiens
ttgtaaacaaactct

SEQ ID NO: 4973474 - DNA, 16 bp, Homo sapiens
ttgtaaactcaaaata

SEQ ID NO: 4973475 - DNA, 18 bp, Homo sapiens
ttgtaaagaaatttacta

SEQ ID NO: 4973476 - DNA, 13 bp, Homo sapiens
ttgtaaatgttat

SEQ ID NO: 4973477 - DNA, 17 bp, Homo sapiens
ttgtaaatgttatttct

SEQ ID NO: 4973478 - DNA, 19 bp, Homo sapiens
ttgtaacttatattgaaga

SEQ ID NO: 4973479 - DNA, 23 bp, Homo sapiens
ttctgttcctctcttttcctgtt

SEQ ID NO: 4973480 - DNA, 12 bp, Homo sapiens
ttctgttgtaac

SEQ ID NO: 4973481 - DNA, 12 bp, Homo sapiens
ttctgtttcaag

SEQ ID NO: 4973482 - DNA, 12 bp, Homo sapiens
ttctgtttcttc

SEQ ID NO: 4973483 - DNA, 21 bp, Homo sapiens
ttcttaaatatcttttatgtt

SEQ ID NO: 4973484 - DNA, 13 bp, Homo sapiens
ttcttaacaaccg

SEQ ID NO: 4973485 - DNA, 22 bp, Homo sapiens
ttcttaattaatttgattaaca

SEQ ID NO: 4973486 - DNA, 12 bp, Homo sapiens
ttcttacacata

SEQ ID NO: 4973487 - DNA, 16 bp, Homo sapiens
ttcttacacatacagt

SEQ ID NO: 4973488 - DNA, 21 bp, Homo sapiens
ttcttacactgcctgtatact

SEQ ID NO: 4973489 - DNA, 13 bp, Homo sapiens
ttcttacataatt

SEQ ID NO: 4973490 - DNA, 22 bp, Homo sapiens
ttcttaccctgtacatatgtaa

SEQ ID NO: 4973491 - DNA, 12 bp, Homo sapiens
ttcttactcctc

SEQ ID NO: 4973492 - DNA, 15 bp, Homo sapiens
ttcttagctttttaa

SEQ ID NO: 4973493 - DNA, 17 bp, Homo sapiens
ttcttatggaattgatt

SEQ ID NO: 4973494 - DNA, 22 bp, Homo sapiens
ttcttcacctaagtctctgtga

SEQ ID NO: 4973495 - DNA, 20 bp, Homo sapiens
ttcttcagcgtaaaatggtg

SEQ ID NO: 4973496 - DNA, 9 bp, Homo sapiens
ttcttcctt

SEQ ID NO: 4973497 - DNA, 13 bp, Homo sapiens
ttcttcctttctc

SEQ ID NO: 4973498 - DNA, 16 bp, Homo sapiens
ttcttctgttctgcag

SEQ ID NO: 4973499 - DNA, 19 bp, Homo sapiens
ttcttgaaagaattttcct

SEQ ID NO: 4973500 - DNA, 16 bp, Homo sapiens
ttcttgcatccttcct

SEQ ID NO: 4973501 - DNA, 20 bp, Homo sapiens
ttcttgcatccttcctataa

SEQ ID NO: 4973502 - DNA, 17 bp, Homo sapiens
ttcttgctcccttcagc

SEQ ID NO: 4973503 - DNA, 20 bp, Homo sapiens
ttcttgctctatctctcaaa

SEQ ID NO: 4973504 - DNA, 12 bp, Homo sapiens
ttcttgctgcta

SEQ ID NO: 4973505 - DNA, 13 bp, Homo sapiens
ttcttgctgctag

SEQ ID NO: 4973506 - DNA, 14 bp, Homo sapiens
ttcttgctgctaga

SEQ ID NO: 4973507 - DNA, 16 bp, Homo sapiens
ttcttgctgctagaac

SEQ ID NO: 4973508 - DNA, 12 bp, Homo sapiens
ttcttgtacagt

SEQ ID NO: 4973509 - DNA, 16 bp, Homo sapiens
ttcttgtcagacataa

SEQ ID NO: 4973510 - DNA, 19 bp, Homo sapiens
ttcttgtcagacataaagc

SEQ ID NO: 4973511 - DNA, 20 bp, Homo sapiens
ttcttgtcagacataaagcc

SEQ ID NO: 4973512 - DNA, 14 bp, Homo sapiens
ttctttaaatgttt

SEQ ID NO: 4973513 - DNA, 15 bp, Homo sapiens
ttctttatactgtaa

SEQ ID NO: 4973514 - DNA, 16 bp, Homo sapiens
ttctttatactgtaat

SEQ ID NO: 4973515 - DNA, 18 bp, Homo sapiens
ttctttctagtggtcttt

SEQ ID NO: 4973516 - DNA, 16 bp, Homo sapiens
ttctttctatttgact

SEQ ID NO: 4973517 - DNA, 22 bp, Homo sapiens
ttctttgataatgttaaatttg

SEQ ID NO: 4973518 - DNA, 15 bp, Homo sapiens
ttcttttctggccaa

SEQ ID NO: 4973519 - DNA, 14 bp, Homo sapiens
ttcttttcttttta

SEQ ID NO: 4973520 - DNA, 14 bp, Homo sapiens
ttcttttggcttcc

SEQ ID NO: 4973521 - DNA, 13 bp, Homo sapiens
ttcttttgttact

SEQ ID NO: 4973522 - DNA, 14 bp, Homo sapiens
ttcttttgttactg

SEQ ID NO: 4973523 - DNA, 16 bp, Homo sapiens
ttctttttaaaatggt

SEQ ID NO: 4973524 - DNA, 20 bp, Homo sapiens
ttctttttaaaatggtgctt

SEQ ID NO: 4973525 - DNA, 23 bp, Homo sapiens
ttctttttacataactgccttga

SEQ ID NO: 4973526 - DNA, 14 bp, Homo sapiens
ttctttttttgtga

SEQ ID NO: 4973527 - DNA, 18 bp, Homo sapiens
ttgaaaacataatctgca

SEQ ID NO: 4973528 - DNA, 16 bp, Homo sapiens
ttgaaaaccaaaatga

SEQ ID NO: 4973529 - DNA, 21 bp, Homo sapiens
ttgaaaaccaaaatgacatct

SEQ ID NO: 4973530 - DNA, 18 bp, Homo sapiens
ttgaaaacctaaaagaca

SEQ ID NO: 4973531 - DNA, 16 bp, Homo sapiens
ttgaaaacctgacaaa

SEQ ID NO: 4973532 - DNA, 22 bp, Homo sapiens
ttgaaaagctattagccaggat

SEQ ID NO: 4973533 - DNA, 15 bp, Homo sapiens
ttgaaaattatttta

SEQ ID NO: 4973534 - DNA, 21 bp, Homo sapiens
ttgaaaattcaaaaagtgttt

SEQ ID NO: 4973535 - DNA, 19 bp, Homo sapiens
ttgaaaccaccttttatta

SEQ ID NO: 4973536 - DNA, 14 bp, Homo sapiens
ttgaaacctgctct

SEQ ID NO: 4973537 - DNA, 18 bp, Homo sapiens
ttgaaactactacaatga

SEQ ID NO: 4973538 - DNA, 18 bp, Homo sapiens
ttgaaagtgaataaactt

SEQ ID NO: 4973539 - DNA, 21 bp, Homo sapiens
ttgaaagtgaataaacttcag

SEQ ID NO: 4973540 - DNA, 14 bp, Homo sapiens
ttgaaatacctcat

SEQ ID NO: 4973541 - DNA, 22 bp, Homo sapiens
ttgaaatacctcatgtttatga

SEQ ID NO: 4973542 - DNA, 21 bp, Homo sapiens
ttgaaatgaaatttaaacatt

SEQ ID NO: 4973543 - DNA, 14 bp, Homo sapiens
ttctacggatcatc

SEQ ID NO: 4973544 - DNA, 18 bp, Homo sapiens
ttctagaagtttcccttc

SEQ ID NO: 4973545 - DNA, 20 bp, Homo sapiens
ttctagaagtttcccttcct

SEQ ID NO: 4973546 - DNA, 14 bp, Homo sapiens
ttctagagttcaga

SEQ ID NO: 4973547 - DNA, 21 bp, Homo sapiens
ttctaggcactgtagttctaa

SEQ ID NO: 4973548 - DNA, 13 bp, Homo sapiens
ttctaggtttcaa

SEQ ID NO: 4973549 - DNA, 17 bp, Homo sapiens
ttctaggtttcaaagat

SEQ ID NO: 4973550 - DNA, 18 bp, Homo sapiens
ttctagtggtctttgtaa

SEQ ID NO: 4973551 - DNA, 19 bp, Homo sapiens
ttctagtggtctttgtaag

SEQ ID NO: 4973552 - DNA, 14 bp, Homo sapiens
ttctataacagata

SEQ ID NO: 4973553 - DNA, 13 bp, Homo sapiens
ttctataaggcca

SEQ ID NO: 4973554 - DNA, 14 bp, Homo sapiens
ttctataaggccat

SEQ ID NO: 4973555 - DNA, 12 bp, Homo sapiens
ttctatatgaat

SEQ ID NO: 4973556 - DNA, 20 bp, Homo sapiens
ttctatccaaacatgtattt

SEQ ID NO: 4973557 - DNA, 23 bp, Homo sapiens
ttctatcctacaacaagagttta

SEQ ID NO: 4973558 - DNA, 16 bp, Homo sapiens
ttctatggttatgaaa

SEQ ID NO: 4973559 - DNA, 19 bp, Homo sapiens
ttctatggttatgaaagaa

SEQ ID NO: 4973560 - DNA, 18 bp, Homo sapiens
ttctatgtactagtactg

SEQ ID NO: 4973561 - DNA, 15 bp, Homo sapiens
ttctattaaatagtt

SEQ ID NO: 4973562 - DNA, 17 bp, Homo sapiens
ttctattaactttaatt

SEQ ID NO: 4973563 - DNA, 19 bp, Homo sapiens
ttctattgccttctttgaa

SEQ ID NO: 4973564 - DNA, 17 bp, Homo sapiens
ttctatttattatgctt

SEQ ID NO: 4973565 - DNA, 20 bp, Homo sapiens
ttctcaaaagcatttatcat

SEQ ID NO: 4973566 - DNA, 16 bp, Homo sapiens
ttctcaagttctaaga

SEQ ID NO: 4973567 - DNA, 15 bp, Homo sapiens
ttctcagtttgtata

SEQ ID NO: 4973568 - DNA, 17 bp, Homo sapiens
ttctcataattcctaca

SEQ ID NO: 4973569 - DNA, 19 bp, Homo sapiens
ttctcataattcctacagc

SEQ ID NO: 4973570 - DNA, 20 bp, Homo sapiens
ttctcataattcctacagca

SEQ ID NO: 4973571 - DNA, 17 bp, Homo sapiens
ttctcatctgcaccctt

SEQ ID NO: 4973572 - DNA, 15 bp, Homo sapiens
ttctcatcttgtgaa

SEQ ID NO: 4973573 - DNA, 18 bp, Homo sapiens
ttctcatcttgtgaaatg

SEQ ID NO: 4973574 - DNA, 11 bp, Homo sapiens
ttctcattctt

SEQ ID NO: 4973575 - DNA, 19 bp, Homo sapiens
ttctccagctcagaaccca

SEQ ID NO: 4973576 - DNA, 11 bp, Homo sapiens
ttctccaggct

SEQ ID NO: 4973577 - DNA, 20 bp, Homo sapiens
ttctccaggtctcacgggca

SEQ ID NO: 4973578 - DNA, 20 bp, Homo sapiens
ttctcccagaatcccagccg

SEQ ID NO: 4973579 - DNA, 12 bp, Homo sapiens
ttctccccagaa

SEQ ID NO: 4973580 - DNA, 13 bp, Homo sapiens
ttctccccagaat

SEQ ID NO: 4973581 - DNA, 21 bp, Homo sapiens
ttctccttgttgttggttgtt

SEQ ID NO: 4973582 - DNA, 18 bp, Homo sapiens
ttctcctttcacaacctt

SEQ ID NO: 4973583 - DNA, 23 bp, Homo sapiens
ttctcgcaaaaacgtatctccta

SEQ ID NO: 4973584 - DNA, 15 bp, Homo sapiens
ttctctaatcgaaag

SEQ ID NO: 4973585 - DNA, 20 bp, Homo sapiens
ttctctcagccttacatttg

SEQ ID NO: 4973586 - DNA, 16 bp, Homo sapiens
ttctctcttccctcag

SEQ ID NO: 4973587 - DNA, 19 bp, Homo sapiens
ttctctgaacacaggcagc

SEQ ID NO: 4973588 - DNA, 19 bp, Homo sapiens
ttctctgcctttgacattt

SEQ ID NO: 4973589 - DNA, 20 bp, Homo sapiens
ttctctgcctttgacattta

SEQ ID NO: 4973590 - DNA, 21 bp, Homo sapiens
ttctctgcctttgacatttaa

SEQ ID NO: 4973591 - DNA, 11 bp, Homo sapiens
ttctctgctcc

SEQ ID NO: 4973592 - DNA, 15 bp, Homo sapiens
ttctctgctccacca

SEQ ID NO: 4973593 - DNA, 16 bp, Homo sapiens
ttctctgtgtctaaga

SEQ ID NO: 4973594 - DNA, 23 bp, Homo sapiens
ttctctgttctacccgttccaaa

SEQ ID NO: 4973595 - DNA, 15 bp, Homo sapiens
ttctcttgagctggc

SEQ ID NO: 4973596 - DNA, 18 bp, Homo sapiens
ttctcttgagctggcctc

SEQ ID NO: 4973597 - DNA, 20 bp, Homo sapiens
ttctcttgagctggcctctc

SEQ ID NO: 4973598 - DNA, 18 bp, Homo sapiens
ttctcttgagtcacactg

SEQ ID NO: 4973599 - DNA, 23 bp, Homo sapiens
ttctcttgtataagatcctagat

SEQ ID NO: 4973600 - DNA, 13 bp, Homo sapiens
ttctctttcaaag

SEQ ID NO: 4973601 - DNA, 13 bp, Homo sapiens
ttctctttctctc

SEQ ID NO: 4973602 - DNA, 14 bp, Homo sapiens
ttctctttctctct

SEQ ID NO: 4973603 - DNA, 20 bp, Homo sapiens
ttctgacaaactgtgtacat

SEQ ID NO: 4973604 - DNA, 13 bp, Homo sapiens
ttctgactgctga

SEQ ID NO: 4973605 - DNA, 12 bp, Homo sapiens
ttctgagaaaac

SEQ ID NO: 4973606 - DNA, 20 bp, Homo sapiens
ttctgagacatgtgtcaaca

SEQ ID NO: 4973607 - DNA, 13 bp, Homo sapiens
ttctgatgagcaa

SEQ ID NO: 4973608 - DNA, 21 bp, Homo sapiens
ttctgatgtctctaaagcact

SEQ ID NO: 4973609 - DNA, 13 bp, Homo sapiens
ttctgattagctt

SEQ ID NO: 4973610 - DNA, 18 bp, Homo sapiens
ttctgattagctttgtgt

SEQ ID NO: 4973611 - DNA, 24 bp, Homo sapiens
ttctgattttaggagctaaggctc

SEQ ID NO: 4973612 - DNA, 13 bp, Homo sapiens
ttctgcaaaatag

SEQ ID NO: 4973613 - DNA, 12 bp, Homo sapiens
ttctgcaaacaa

SEQ ID NO: 4973614 - DNA, 14 bp, Homo sapiens
ttctgcaaacaaac

SEQ ID NO: 4973615 - DNA, 15 bp, Homo sapiens
ttctgcagtaaatct

SEQ ID NO: 4973616 - DNA, 21 bp, Homo sapiens
ttctgcatatgttgaatactt

SEQ ID NO: 4973617 - DNA, 16 bp, Homo sapiens
ttctgccagggagctt

SEQ ID NO: 4973618 - DNA, 16 bp, Homo sapiens
ttctgcccccagccca

SEQ ID NO: 4973619 - DNA, 15 bp, Homo sapiens
ttctgcctgcccagg

SEQ ID NO: 4973620 - DNA, 17 bp, Homo sapiens
ttctgcctgcccaggcc

SEQ ID NO: 4973621 - DNA, 21 bp, Homo sapiens
ttctgcctgcccaggcccctg

SEQ ID NO: 4973622 - DNA, 23 bp, Homo sapiens
ttctgcctttgatgttacagatt

SEQ ID NO: 4973623 - DNA, 12 bp, Homo sapiens
ttctgccttttc

SEQ ID NO: 4973624 - DNA, 14 bp, Homo sapiens
ttctgcgcctcagg

SEQ ID NO: 4973625 - DNA, 19 bp, Homo sapiens
ttctgctcacatatctgtc

SEQ ID NO: 4973626 - DNA, 16 bp, Homo sapiens
ttctgctccacccttg

SEQ ID NO: 4973627 - DNA, 18 bp, Homo sapiens
ttctgctccacccttggc

SEQ ID NO: 4973628 - DNA, 14 bp, Homo sapiens
ttctgcttcagcct

SEQ ID NO: 4973629 - DNA, 15 bp, Homo sapiens
ttctgcttcagcctc

SEQ ID NO: 4973630 - DNA, 16 bp, Homo sapiens
ttctgcttcagcctcc

SEQ ID NO: 4973631 - DNA, 19 bp, Homo sapiens
ttctgcttcagcctcccga

SEQ ID NO: 4973632 - DNA, 19 bp, Homo sapiens
ttctggaatacatgaaata

SEQ ID NO: 4973633 - DNA, 18 bp, Homo sapiens
ttctggaatttgttcaag

SEQ ID NO: 4973634 - DNA, 20 bp, Homo sapiens
ttctggaatttgttcaagtt

SEQ ID NO: 4973635 - DNA, 20 bp, Homo sapiens
ttctggcctttcctctctcc

SEQ ID NO: 4973636 - DNA, 10 bp, Homo sapiens
ttctggctca

SEQ ID NO: 4973637 - DNA, 18 bp, Homo sapiens
ttctggctgaaaaaggcc

SEQ ID NO: 4973638 - DNA, 14 bp, Homo sapiens
ttctggggaaagac

SEQ ID NO: 4973639 - DNA, 17 bp, Homo sapiens
ttctggggcaggctggg

SEQ ID NO: 4973640 - DNA, 14 bp, Homo sapiens
ttctgggtggcctc

SEQ ID NO: 4973641 - DNA, 17 bp, Homo sapiens
ttctggtgtgttaacat

SEQ ID NO: 4973642 - DNA, 14 bp, Homo sapiens
ttctggttctaaca

SEQ ID NO: 4973643 - DNA, 17 bp, Homo sapiens
ttctgtacttcctgagt

SEQ ID NO: 4973644 - DNA, 15 bp, Homo sapiens
ttctgtagtcattta

SEQ ID NO: 4973645 - DNA, 13 bp, Homo sapiens
ttctgtatacaac

SEQ ID NO: 4973646 - DNA, 21 bp, Homo sapiens
ttctgtatacaaccctggcat

SEQ ID NO: 4973647 - DNA, 16 bp, Homo sapiens
ttctgtatatactttt

SEQ ID NO: 4973648 - DNA, 19 bp, Homo sapiens
ttctgtgagacccccacac

SEQ ID NO: 4973649 - DNA, 16 bp, Homo sapiens
ttctgtggctcacaga

SEQ ID NO: 4973650 - DNA, 23 bp, Homo sapiens
ttctgtgtctttcacagctcctc

SEQ ID NO: 4973651 - DNA, 23 bp, Homo sapiens
ttctgtgtgcaccttaccaactt

SEQ ID NO: 4973652 - DNA, 17 bp, Homo sapiens
ttctgttaaaatctatt

SEQ ID NO: 4973653 - DNA, 19 bp, Homo sapiens
ttctgttatatcccctgct

SEQ ID NO: 4973654 - DNA, 21 bp, Homo sapiens
ttctgttatatcccctgctac

SEQ ID NO: 4973655 - DNA, 13 bp, Homo sapiens
ttccgcactttcc

SEQ ID NO: 4973656 - DNA, 15 bp, Homo sapiens
ttccgcactttccac

SEQ ID NO: 4973657 - DNA, 16 bp, Homo sapiens
ttccgcccctgcctgc

SEQ ID NO: 4973658 - DNA, 14 bp, Homo sapiens
ttccgccccttccc

SEQ ID NO: 4973659 - DNA, 19 bp, Homo sapiens
ttccggtagggaggcagcc

SEQ ID NO: 4973660 - DNA, 21 bp, Homo sapiens
ttccggtagggaggcagcctc

SEQ ID NO: 4973661 - DNA, 21 bp, Homo sapiens
ttccgtaataacacccttcct

SEQ ID NO: 4973662 - DNA, 18 bp, Homo sapiens
ttcctaagaagcttctaa

SEQ ID NO: 4973663 - DNA, 13 bp, Homo sapiens
ttcctaagccact

SEQ ID NO: 4973664 - DNA, 22 bp, Homo sapiens
ttcctacaagagcagcctgtgg

SEQ ID NO: 4973665 - DNA, 20 bp, Homo sapiens
ttcctacagcactactgggt

SEQ ID NO: 4973666 - DNA, 13 bp, Homo sapiens
ttcctacaggcag

SEQ ID NO: 4973667 - DNA, 20 bp, Homo sapiens
ttcctacccacacctctgcc

SEQ ID NO: 4973668 - DNA, 14 bp, Homo sapiens
ttcctaggggtttg

SEQ ID NO: 4973669 - DNA, 18 bp, Homo sapiens
ttcctagttttctcctcc

SEQ ID NO: 4973670 - DNA, 20 bp, Homo sapiens
ttcctataacttgatgcatg

SEQ ID NO: 4973671 - DNA, 21 bp, Homo sapiens
ttcctataacttgatgcatgt

SEQ ID NO: 4973672 - DNA, 18 bp, Homo sapiens
ttcctcatccaccccatc

SEQ ID NO: 4973673 - DNA, 17 bp, Homo sapiens
ttcctccagctgcacca

SEQ ID NO: 4973674 - DNA, 14 bp, Homo sapiens
ttcctcctccccac

SEQ ID NO: 4973675 - DNA, 16 bp, Homo sapiens
ttcctcctccccactt

SEQ ID NO: 4973676 - DNA, 17 bp, Homo sapiens
ttcctctcactaaactt

SEQ ID NO: 4973677 - DNA, 18 bp, Homo sapiens
ttcctctcactaaacttt

SEQ ID NO: 4973678 - DNA, 18 bp, Homo sapiens
ttcctctccactgccttc

SEQ ID NO: 4973679 - DNA, 14 bp, Homo sapiens
ttcctctctccaga

SEQ ID NO: 4973680 - DNA, 15 bp, Homo sapiens
ttcctctctccagat

SEQ ID NO: 4973681 - DNA, 18 bp, Homo sapiens
ttcctctctggtggctct

SEQ ID NO: 4973682 - DNA, 20 bp, Homo sapiens
ttcctgacatcacagcagcc

SEQ ID NO: 4973683 - DNA, 16 bp, Homo sapiens
ttcctgagatttcctc

SEQ ID NO: 4973684 - DNA, 19 bp, Homo sapiens
ttcctgatggtacaggaaa

SEQ ID NO: 4973685 - DNA, 22 bp, Homo sapiens
ttcctgatggtacaggaaagct

SEQ ID NO: 4973686 - DNA, 15 bp, Homo sapiens
ttcctgcatttgtga

SEQ ID NO: 4973687 - DNA, 13 bp, Homo sapiens
ttcctgcccctct

SEQ ID NO: 4973688 - DNA, 18 bp, Homo sapiens
ttcctgcccctctttctc

SEQ ID NO: 4973689 - DNA, 22 bp, Homo sapiens
ttcctgcccctctttctctttc

SEQ ID NO: 4973690 - DNA, 16 bp, Homo sapiens
ttcctgtatgttgtcc

SEQ ID NO: 4973691 - DNA, 22 bp, Homo sapiens
ttcctgttttgtacatagattt

SEQ ID NO: 4973692 - DNA, 12 bp, Homo sapiens
ttccttcctaaa

SEQ ID NO: 4973693 - DNA, 15 bp, Homo sapiens
ttccttctctgaaca

SEQ ID NO: 4973694 - DNA, 16 bp, Homo sapiens
ttccttctctgaacac

SEQ ID NO: 4973695 - DNA, 22 bp, Homo sapiens
ttccttctctgaacacaggcag

SEQ ID NO: 4973696 - DNA, 14 bp, Homo sapiens
ttccttctggcctt

SEQ ID NO: 4973697 - DNA, 17 bp, Homo sapiens
ttccttctgtgaaagta

SEQ ID NO: 4973698 - DNA, 15 bp, Homo sapiens
ttccttgaccttcct

SEQ ID NO: 4973699 - DNA, 19 bp, Homo sapiens
ttccttgaccttcctctgg

SEQ ID NO: 4973700 - DNA, 24 bp, Homo sapiens
ttccttgagacacggagcccagcc

SEQ ID NO: 4973701 - DNA, 13 bp, Homo sapiens
ttccttgtgcaaa

SEQ ID NO: 4973702 - DNA, 14 bp, Homo sapiens
ttccttgtttatca

SEQ ID NO: 4973703 - DNA, 13 bp, Homo sapiens
ttcctttaaaaaa

SEQ ID NO: 4973704 - DNA, 23 bp, Homo sapiens
ttcctttaaaaaaatttaagtgc

SEQ ID NO: 4973705 - DNA, 15 bp, Homo sapiens
ttcctttaaaaaact

SEQ ID NO: 4973706 - DNA, 22 bp, Homo sapiens
ttcctttactttcccttgcttt

SEQ ID NO: 4973707 - DNA, 14 bp, Homo sapiens
ttcctttatattta

SEQ ID NO: 4973708 - DNA, 16 bp, Homo sapiens
ttcctttccccagccc

SEQ ID NO: 4973709 - DNA, 14 bp, Homo sapiens
ttcctttccttttc

SEQ ID NO: 4973710 - DNA, 17 bp, Homo sapiens
ttcctttctctttctct

SEQ ID NO: 4973711 - DNA, 22 bp, Homo sapiens
ttcctttctctttctctcttcc

SEQ ID NO: 4973712 - DNA, 15 bp, Homo sapiens
ttcctttgctctttc

SEQ ID NO: 4973713 - DNA, 13 bp, Homo sapiens
ttcctttgtgtgt

SEQ ID NO: 4973714 - DNA, 20 bp, Homo sapiens
ttccttttaaaacacttcca

SEQ ID NO: 4973715 - DNA, 20 bp, Homo sapiens
ttccttttctattccttctg

SEQ ID NO: 4973716 - DNA, 21 bp, Homo sapiens
ttcctttttctgattagcttt

SEQ ID NO: 4973717 - DNA, 20 bp, Homo sapiens
ttcgataaacaacaaggtgg

SEQ ID NO: 4973718 - DNA, 18 bp, Homo sapiens
ttcgcatggtcacacact

SEQ ID NO: 4973719 - DNA, 19 bp, Homo sapiens
ttcgcatggtcacacactg

SEQ ID NO: 4973720 - DNA, 23 bp, Homo sapiens
ttcgcatggtcacacactgatgc

SEQ ID NO: 4973721 - DNA, 20 bp, Homo sapiens
ttcgcccgagctgtttatgt

SEQ ID NO: 4973722 - DNA, 21 bp, Homo sapiens
ttcgccttaatacttttttat

SEQ ID NO: 4973723 - DNA, 19 bp, Homo sapiens
ttcgcgtgccctcgctgct

SEQ ID NO: 4973724 - DNA, 16 bp, Homo sapiens
ttcggctctgggtggg

SEQ ID NO: 4973725 - DNA, 18 bp, Homo sapiens
ttcgggcgtctgtgtgcg

SEQ ID NO: 4973726 - DNA, 14 bp, Homo sapiens
ttcgtcttctaatt

SEQ ID NO: 4973727 - DNA, 16 bp, Homo sapiens
ttcgtttctgtataca

SEQ ID NO: 4973728 - DNA, 20 bp, Homo sapiens
ttctaaaatcttatagttct

SEQ ID NO: 4973729 - DNA, 23 bp, Homo sapiens
ttctaaacccaatccaaatggcg

SEQ ID NO: 4973730 - DNA, 14 bp, Homo sapiens
ttctaaagattcta

SEQ ID NO: 4973731 - DNA, 16 bp, Homo sapiens
ttctaaagattctata

SEQ ID NO: 4973732 - DNA, 23 bp, Homo sapiens
ttctaaagattctatagttctag

SEQ ID NO: 4973733 - DNA, 16 bp, Homo sapiens
ttctaaagttctaaga

SEQ ID NO: 4973734 - DNA, 18 bp, Homo sapiens
ttctaaagttctaagatt

SEQ ID NO: 4973735 - DNA, 13 bp, Homo sapiens
ttctaaatagcaa

SEQ ID NO: 4973736 - DNA, 20 bp, Homo sapiens
ttctaacaaaaaaatatatt

SEQ ID NO: 4973737 - DNA, 18 bp, Homo sapiens
ttctaaccttgaatgctg

SEQ ID NO: 4973738 - DNA, 16 bp, Homo sapiens
ttctaagactcaaatg

SEQ ID NO: 4973739 - DNA, 21 bp, Homo sapiens
ttctaagactcaaatgttcta

SEQ ID NO: 4973740 - DNA, 21 bp, Homo sapiens
ttctaagacttactctaagat

SEQ ID NO: 4973741 - DNA, 23 bp, Homo sapiens
ttctaagatgtgatattctaaga

SEQ ID NO: 4973742 - DNA, 14 bp, Homo sapiens
ttctaagattctaa

SEQ ID NO: 4973743 - DNA, 15 bp, Homo sapiens
ttctaagattctaaa

SEQ ID NO: 4973744 - DNA, 16 bp, Homo sapiens
ttctaagattctaaag

SEQ ID NO: 4973745 - DNA, 21 bp, Homo sapiens
ttctaaggacctgaaattcca

SEQ ID NO: 4973746 - DNA, 21 bp, Homo sapiens
ttctaaggcctaggattctaa

SEQ ID NO: 4973747 - DNA, 16 bp, Homo sapiens
ttctaaggctctgaga

SEQ ID NO: 4973748 - DNA, 20 bp, Homo sapiens
ttctaagtgaaatttctagc

SEQ ID NO: 4973749 - DNA, 17 bp, Homo sapiens
ttctaagtttctaagat

SEQ ID NO: 4973750 - DNA, 16 bp, Homo sapiens
ttctaataaattatac

SEQ ID NO: 4973751 - DNA, 16 bp, Homo sapiens
ttctaataatttctaa

SEQ ID NO: 4973752 - DNA, 13 bp, Homo sapiens
ttctaatgatgat

SEQ ID NO: 4973753 - DNA, 16 bp, Homo sapiens
ttctaatgctgatatg

SEQ ID NO: 4973754 - DNA, 17 bp, Homo sapiens
ttctaatggaatggttt

SEQ ID NO: 4973755 - DNA, 13 bp, Homo sapiens
ttctaatgtttct

SEQ ID NO: 4973756 - DNA, 12 bp, Homo sapiens
ttctacaattaa

SEQ ID NO: 4973757 - DNA, 17 bp, Homo sapiens
ttctacaattaatagtt

SEQ ID NO: 4973758 - DNA, 19 bp, Homo sapiens
ttctacacagtgggaactc

SEQ ID NO: 4973759 - DNA, 22 bp, Homo sapiens
ttctacacagtgggaactctga

SEQ ID NO: 4973760 - DNA, 17 bp, Homo sapiens
ttctacatttcttagac

SEQ ID NO: 4973761 - DNA, 18 bp, Homo sapiens
ttctaccatttcagagag

SEQ ID NO: 4973762 - DNA, 12 bp, Homo sapiens
ttctacccagcg

SEQ ID NO: 4973763 - DNA, 19 bp, Homo sapiens
ttctacccagcgagccctg

SEQ ID NO: 4973764 - DNA, 21 bp, Homo sapiens
ttctacccagcgagccctggt

SEQ ID NO: 4973765 - DNA, 17 bp, Homo sapiens
ttctacccgttccaaaa

SEQ ID NO: 4973766 - DNA, 22 bp, Homo sapiens
tcaggatatccttatcagagct

SEQ ID NO: 4973767 - DNA, 20 bp, Homo sapiens
tcaggatttaaaaactggaa

SEQ ID NO: 4973768 - DNA, 16 bp, Homo sapiens
tcaggcactagccttt

SEQ ID NO: 4973769 - DNA, 13 bp, Homo sapiens
tcaggccacttga

SEQ ID NO: 4973770 - DNA, 17 bp, Homo sapiens
tcaggcctccctctctc

SEQ ID NO: 4973771 - DNA, 13 bp, Homo sapiens
tcaggcctgtgtg

SEQ ID NO: 4973772 - DNA, 15 bp, Homo sapiens
tcaggctgcttggga

SEQ ID NO: 4973773 - DNA, 21 bp, Homo sapiens
tcagggagcagggaaggcctg

SEQ ID NO: 4973774 - DNA, 19 bp, Homo sapiens
tcagggagtgctggctcac

SEQ ID NO: 4973775 - DNA, 17 bp, Homo sapiens
tcagggcccagaggctg

SEQ ID NO: 4973776 - DNA, 18 bp, Homo sapiens
tcagggcccagaggctga

SEQ ID NO: 4973777 - DNA, 18 bp, Homo sapiens
tcagggcctggggcctga

SEQ ID NO: 4973778 - DNA, 18 bp, Homo sapiens
tcagggctcctcccagct

SEQ ID NO: 4973779 - DNA, 19 bp, Homo sapiens
tcagggggaagaagcagag

SEQ ID NO: 4973780 - DNA, 22 bp, Homo sapiens
tcaggtaacaggcagatacagg

SEQ ID NO: 4973781 - DNA, 12 bp, Homo sapiens
tcaggtccctgc

SEQ ID NO: 4973782 - DNA, 16 bp, Homo sapiens
tcaggtcctcagagaa

SEQ ID NO: 4973783 - DNA, 14 bp, Homo sapiens
tcaggtgaaaatgt

SEQ ID NO: 4973784 - DNA, 17 bp, Homo sapiens
tcaggtgacatgtgaaa

SEQ ID NO: 4973785 - DNA, 21 bp, Homo sapiens
tcaggtgacatgtgaaacctt

SEQ ID NO: 4973786 - DNA, 13 bp, Homo sapiens
tcaggtgctgcca

SEQ ID NO: 4973787 - DNA, 18 bp, Homo sapiens
tcaggtgctgccatccag

SEQ ID NO: 4973788 - DNA, 17 bp, Homo sapiens
tcaggtggggcagcttg

SEQ ID NO: 4973789 - DNA, 19 bp, Homo sapiens
tcaggtggggcagcttgag

SEQ ID NO: 4973790 - DNA, 22 bp, Homo sapiens
tcaggtgttttttatgaagtgc

SEQ ID NO: 4973791 - DNA, 19 bp, Homo sapiens
tcaggttatcgaaataaca

SEQ ID NO: 4973792 - DNA, 21 bp, Homo sapiens
tcaggttatcgaaataacaat

SEQ ID NO: 4973793 - DNA, 19 bp, Homo sapiens
tcaggtttaacatttgcct

SEQ ID NO: 4973794 - DNA, 19 bp, Homo sapiens
tcagtaataaactgtgttt

SEQ ID NO: 4973795 - DNA, 14 bp, Homo sapiens
tcagtaatatttat

SEQ ID NO: 4973796 - DNA, 14 bp, Homo sapiens
tcagtaatttgagg

SEQ ID NO: 4973797 - DNA, 18 bp, Homo sapiens
tcagtaatttgaggacaa

SEQ ID NO: 4973798 - DNA, 22 bp, Homo sapiens
tcagtacttgtgaaacacagct

SEQ ID NO: 4973799 - DNA, 13 bp, Homo sapiens
tcagtatccaggc

SEQ ID NO: 4973800 - DNA, 16 bp, Homo sapiens
tcagtattaatactaa

SEQ ID NO: 4973801 - DNA, 17 bp, Homo sapiens
tcagtattatgtagttg

SEQ ID NO: 4973802 - DNA, 15 bp, Homo sapiens
tcagtatttcagtgt

SEQ ID NO: 4973803 - DNA, 19 bp, Homo sapiens
tcagtattttggagaaatt

SEQ ID NO: 4973804 - DNA, 16 bp, Homo sapiens
tcagtcaatattttta

SEQ ID NO: 4973805 - DNA, 16 bp, Homo sapiens
tcagtcacacacacat

SEQ ID NO: 4973806 - DNA, 20 bp, Homo sapiens
tcagtcagaaaactttaaaa

SEQ ID NO: 4973807 - DNA, 17 bp, Homo sapiens
tcagtcatgcataaata

SEQ ID NO: 4973808 - DNA, 20 bp, Homo sapiens
tcagtcatgcataaatatgc

SEQ ID NO: 4973809 - DNA, 14 bp, Homo sapiens
tcagtccatttata

SEQ ID NO: 4973810 - DNA, 16 bp, Homo sapiens
tcagtccctatgtatt

SEQ ID NO: 4973811 - DNA, 17 bp, Homo sapiens
tcagtccctatgtattt

SEQ ID NO: 4973812 - DNA, 18 bp, Homo sapiens
tcagtccctatgtatttg

SEQ ID NO: 4973813 - DNA, 23 bp, Homo sapiens
tcagtccctatgtatttgcagtt

SEQ ID NO: 4973814 - DNA, 18 bp, Homo sapiens
tcagtcctcccctcacag

SEQ ID NO: 4973815 - DNA, 19 bp, Homo sapiens
tcagtcctcccctcacagc

SEQ ID NO: 4973816 - DNA, 21 bp, Homo sapiens
tcagtcctcccctcacagcct

SEQ ID NO: 4973817 - DNA, 22 bp, Homo sapiens
tcagtcctcccctcacagcctc

SEQ ID NO: 4973818 - DNA, 18 bp, Homo sapiens
tcagtcctgtagttttat

SEQ ID NO: 4973819 - DNA, 22 bp, Homo sapiens
tcagtcctgtagttttatttta

SEQ ID NO: 4973820 - DNA, 22 bp, Homo sapiens
tcagtctgattcccaagctctg

SEQ ID NO: 4973821 - DNA, 23 bp, Homo sapiens
tcagtctgattcccaagctctgc

SEQ ID NO: 4973822 - DNA, 13 bp, Homo sapiens
tcagtctggtggg

SEQ ID NO: 4973823 - DNA, 12 bp, Homo sapiens
tcagtctttttc

SEQ ID NO: 4973824 - DNA, 12 bp, Homo sapiens
tcagtgccacta

SEQ ID NO: 4973825 - DNA, 12 bp, Homo sapiens
tcagtggcagct

SEQ ID NO: 4973826 - DNA, 13 bp, Homo sapiens
tcagtggcagctg

SEQ ID NO: 4973827 - DNA, 16 bp, Homo sapiens
tcagtggcagctgctt

SEQ ID NO: 4973828 - DNA, 17 bp, Homo sapiens
tcagtggcgagaaataa

SEQ ID NO: 4973829 - DNA, 20 bp, Homo sapiens
tcagtggcttcatctgtcaa

SEQ ID NO: 4973830 - DNA, 22 bp, Homo sapiens
tcagtgtatggaaataaatgta

SEQ ID NO: 4973831 - DNA, 19 bp, Homo sapiens
tcagtgtgtctaaatttga

SEQ ID NO: 4973832 - DNA, 13 bp, Homo sapiens
tcagttattcatt

SEQ ID NO: 4973833 - DNA, 15 bp, Homo sapiens
tcagttcccttggcc

SEQ ID NO: 4973834 - DNA, 16 bp, Homo sapiens
tcagttcccttggcct

SEQ ID NO: 4973835 - DNA, 18 bp, Homo sapiens
tcagttcccttggcctca

SEQ ID NO: 4973836 - DNA, 22 bp, Homo sapiens
tcagttcctttgtgtgtactca

SEQ ID NO: 4973837 - DNA, 22 bp, Homo sapiens
tcataaaaagcctgcaatttca

SEQ ID NO: 4973838 - DNA, 23 bp, Homo sapiens
tcataaaatcaaaacaagtgaaa

SEQ ID NO: 4973839 - DNA, 15 bp, Homo sapiens
tcataaagtacttga

SEQ ID NO: 4973840 - DNA, 12 bp, Homo sapiens
tcataaatgaag

SEQ ID NO: 4973841 - DNA, 16 bp, Homo sapiens
tcataaatttacttta

SEQ ID NO: 4973842 - DNA, 14 bp, Homo sapiens
tcataacctagcct

SEQ ID NO: 4973843 - DNA, 21 bp, Homo sapiens
tcataacttattgctgatttt

SEQ ID NO: 4973844 - DNA, 18 bp, Homo sapiens
tcataattcctacagcac

SEQ ID NO: 4973845 - DNA, 15 bp, Homo sapiens
tcatacctaagtact

SEQ ID NO: 4973846 - DNA, 17 bp, Homo sapiens
tcatacctaagtactgt

SEQ ID NO: 4973847 - DNA, 18 bp, Homo sapiens
tcatacctcagaatgtaa

SEQ ID NO: 4973848 - DNA, 22 bp, Homo sapiens
tcatagaaatagtttgagaaat

SEQ ID NO: 4973849 - DNA, 14 bp, Homo sapiens
tcatagtagttttt

SEQ ID NO: 4973850 - DNA, 21 bp, Homo sapiens
tcatagtatggtggctgggtt

SEQ ID NO: 4973851 - DNA, 14 bp, Homo sapiens
tcatagttaacata

SEQ ID NO: 4973852 - DNA, 15 bp, Homo sapiens
tcatatgtgatctgt

SEQ ID NO: 4973853 - DNA, 21 bp, Homo sapiens
tcatatgtgatctgtcttgta

SEQ ID NO: 4973854 - DNA, 23 bp, Homo sapiens
tcatatgtgatctgtcttgtaat

SEQ ID NO: 4973855 - DNA, 18 bp, Homo sapiens
tcatattctaaaaccatt

SEQ ID NO: 4973856 - DNA, 16 bp, Homo sapiens
tcatattctgtctgga

SEQ ID NO: 4973857 - DNA, 14 bp, Homo sapiens
tcatattgatgaaa

SEQ ID NO: 4973858 - DNA, 15 bp, Homo sapiens
tcatattgatgaaaa

SEQ ID NO: 4973859 - DNA, 16 bp, Homo sapiens
tgttaaccaaggaaat

SEQ ID NO: 4973860 - DNA, 17 bp, Homo sapiens
tgttaactcttgtctat

SEQ ID NO: 4973861 - DNA, 19 bp, Homo sapiens
tgttaactcttgtctattt

SEQ ID NO: 4973862 - DNA, 23 bp, Homo sapiens
tgttaagaattgaccatctgctt

SEQ ID NO: 4973863 - DNA, 16 bp, Homo sapiens
tgttaaggaaactctt

SEQ ID NO: 4973864 - DNA, 22 bp, Homo sapiens
tgttaatgtatttgttcatgtt

SEQ ID NO: 4973865 - DNA, 13 bp, Homo sapiens
tgttaatttcagt

SEQ ID NO: 4973866 - DNA, 17 bp, Homo sapiens
tgttacataacaagaaa

SEQ ID NO: 4973867 - DNA, 19 bp, Homo sapiens
tgttacctccaacagaact

SEQ ID NO: 4973868 - DNA, 14 bp, Homo sapiens
tgttactattttct

SEQ ID NO: 4973869 - DNA, 15 bp, Homo sapiens
tgttactattttcta

SEQ ID NO: 4973870 - DNA, 20 bp, Homo sapiens
tgttactattttctacaatt

SEQ ID NO: 4973871 - DNA, 14 bp, Homo sapiens
tgttactcttacga

SEQ ID NO: 4973872 - DNA, 16 bp, Homo sapiens
tgttactgttcttgct

SEQ ID NO: 4973873 - DNA, 24 bp, Homo sapiens
tgttactgttcttgctgctagaac

SEQ ID NO: 4973874 - DNA, 19 bp, Homo sapiens
tgttagatagctgcatgtg

SEQ ID NO: 4973875 - DNA, 13 bp, Homo sapiens
tgttagcactgtt

SEQ ID NO: 4973876 - DNA, 15 bp, Homo sapiens
tgttagcactgttga

SEQ ID NO: 4973877 - DNA, 20 bp, Homo sapiens
tgttagcactgttgatgtat

SEQ ID NO: 4973878 - DNA, 22 bp, Homo sapiens
tgttagcactgttgatgtatct

SEQ ID NO: 4973879 - DNA, 14 bp, Homo sapiens
tgttagcttcctta

SEQ ID NO: 4973880 - DNA, 15 bp, Homo sapiens
tgttagcttccttaa

SEQ ID NO: 4973881 - DNA, 14 bp, Homo sapiens
tgttagttcctgta

SEQ ID NO: 4973882 - DNA, 20 bp, Homo sapiens
tgttagttcctgtatgaaag

SEQ ID NO: 4973883 - DNA, 22 bp, Homo sapiens
tgttagttcctgtatgaaagat

SEQ ID NO: 4973884 - DNA, 19 bp, Homo sapiens
tgttatatcccctgctacc

SEQ ID NO: 4973885 - DNA, 23 bp, Homo sapiens
tgttatatttaatgcattaaacc

SEQ ID NO: 4973886 - DNA, 13 bp, Homo sapiens
tgttatcaaactt

SEQ ID NO: 4973887 - DNA, 18 bp, Homo sapiens
tgttatcccaatcattgt

SEQ ID NO: 4973888 - DNA, 16 bp, Homo sapiens
tgttatcttctcaagt

SEQ ID NO: 4973889 - DNA, 13 bp, Homo sapiens
tgttatgaaataa

SEQ ID NO: 4973890 - DNA, 18 bp, Homo sapiens
tgttatgactatgtaaac

SEQ ID NO: 4973891 - DNA, 20 bp, Homo sapiens
tgttatgactatgtaaacta

SEQ ID NO: 4973892 - DNA, 12 bp, Homo sapiens
tgttatgctatt

SEQ ID NO: 4973893 - DNA, 16 bp, Homo sapiens
tgttatgtactgtact

SEQ ID NO: 4973894 - DNA, 21 bp, Homo sapiens
tgttatgtctgtttaagaaaa

SEQ ID NO: 4973895 - DNA, 22 bp, Homo sapiens
tgttattattacttatttttga

SEQ ID NO: 4973896 - DNA, 12 bp, Homo sapiens
tgttattgtgaa

SEQ ID NO: 4973897 - DNA, 13 bp, Homo sapiens
tgttattgtgaat

SEQ ID NO: 4973898 - DNA, 16 bp, Homo sapiens
tgttattgtgaatgat

SEQ ID NO: 4973899 - DNA, 16 bp, Homo sapiens
tgttattgttttgtta

SEQ ID NO: 4973900 - DNA, 17 bp, Homo sapiens
tgttattttcttctaag

SEQ ID NO: 4973901 - DNA, 18 bp, Homo sapiens
tgttatttttcaaggaag

SEQ ID NO: 4973902 - DNA, 22 bp, Homo sapiens
tgttcaaagccacattatttct

SEQ ID NO: 4973903 - DNA, 18 bp, Homo sapiens
tgttcagaaggttgctct

SEQ ID NO: 4973904 - DNA, 15 bp, Homo sapiens
tgttcagctccagct

SEQ ID NO: 4973905 - DNA, 18 bp, Homo sapiens
tgttcagctccagctcac

SEQ ID NO: 4973906 - DNA, 12 bp, Homo sapiens
tgttcatgtttg

SEQ ID NO: 4973907 - DNA, 22 bp, Homo sapiens
tgttcattaaagcatgaatggt

SEQ ID NO: 4973908 - DNA, 19 bp, Homo sapiens
tgttccctttgtctttcaa

SEQ ID NO: 4973909 - DNA, 19 bp, Homo sapiens
tgttccttagaccttccat

SEQ ID NO: 4973910 - DNA, 23 bp, Homo sapiens
tgttcgcatggtcacacactgat

SEQ ID NO: 4973911 - DNA, 19 bp, Homo sapiens
tgttcgcttggctccatgc

SEQ ID NO: 4973912 - DNA, 13 bp, Homo sapiens
tgttctaaagctc

SEQ ID NO: 4973913 - DNA, 12 bp, Homo sapiens
tgttctaaggct

SEQ ID NO: 4973914 - DNA, 12 bp, Homo sapiens
tgttctaagttt

SEQ ID NO: 4973915 - DNA, 16 bp, Homo sapiens
tgttctaagtttctaa

SEQ ID NO: 4973916 - DNA, 17 bp, Homo sapiens
tgttctaagtttctaag

SEQ ID NO: 4973917 - DNA, 18 bp, Homo sapiens
tgttctaagtttctaaga

SEQ ID NO: 4973918 - DNA, 23 bp, Homo sapiens
tgttctaagtttctaagattcta

SEQ ID NO: 4973919 - DNA, 17 bp, Homo sapiens
tgttctacccgttccaa

SEQ ID NO: 4973920 - DNA, 13 bp, Homo sapiens
tgttctatccaaa

SEQ ID NO: 4973921 - DNA, 19 bp, Homo sapiens
tgttctatccaaacatgta

SEQ ID NO: 4973922 - DNA, 17 bp, Homo sapiens
tgttctatggttatgaa

SEQ ID NO: 4973923 - DNA, 17 bp, Homo sapiens
tgttctcggagtgtgta

SEQ ID NO: 4973924 - DNA, 13 bp, Homo sapiens
tgttctctgagga

SEQ ID NO: 4973925 - DNA, 14 bp, Homo sapiens
tgttctcttcttca

SEQ ID NO: 4973926 - DNA, 15 bp, Homo sapiens
tgttctcttcttcat

SEQ ID NO: 4973927 - DNA, 14 bp, Homo sapiens
tgttctgcactgaa

SEQ ID NO: 4973928 - DNA, 16 bp, Homo sapiens
tgttctgcccccagcc

SEQ ID NO: 4973929 - DNA, 15 bp, Homo sapiens
tgttctgggacacag

SEQ ID NO: 4973930 - DNA, 16 bp, Homo sapiens
tgttcttacacataca

SEQ ID NO: 4973931 - DNA, 20 bp, Homo sapiens
tgttcttatgcaaaatggaa

SEQ ID NO: 4973932 - DNA, 13 bp, Homo sapiens
tgttcttcctcca

SEQ ID NO: 4973933 - DNA, 12 bp, Homo sapiens
tgttcttgctgc

SEQ ID NO: 4973934 - DNA, 13 bp, Homo sapiens
tgttcttgctgct

SEQ ID NO: 4973935 - DNA, 21 bp, Homo sapiens
tgttgaaaattattttaaaca

SEQ ID NO: 4973936 - DNA, 23 bp, Homo sapiens
tgttgaaccaaacctccctgcta

SEQ ID NO: 4973937 - DNA, 15 bp, Homo sapiens
tgttgacaactgtga

SEQ ID NO: 4973938 - DNA, 23 bp, Homo sapiens
tgttgagaatcccaaatttgatt

SEQ ID NO: 4973939 - DNA, 17 bp, Homo sapiens
tgttgatgtatctgagt

SEQ ID NO: 4973940 - DNA, 20 bp, Homo sapiens
tgttgcaattaggattttga

SEQ ID NO: 4973941 - DNA, 15 bp, Homo sapiens
tgttgcccaggcagg

SEQ ID NO: 4973942 - DNA, 19 bp, Homo sapiens
tgttgcccaggcaggtctt

SEQ ID NO: 4973943 - DNA, 20 bp, Homo sapiens
tgttgcccaggctggcgtgc

SEQ ID NO: 4973944 - DNA, 15 bp, Homo sapiens
tgttgccctttctgt

SEQ ID NO: 4973945 - DNA, 18 bp, Homo sapiens
tgttgcctttatggtttc

SEQ ID NO: 4973946 - DNA, 23 bp, Homo sapiens
tgttgcttgaatagcaatagcat

SEQ ID NO: 4973947 - DNA, 21 bp, Homo sapiens
tgttggaagcttgttttccag

SEQ ID NO: 4973948 - DNA, 12 bp, Homo sapiens
tgttggaatgaa

SEQ ID NO: 4973949 - DNA, 15 bp, Homo sapiens
tgttggccaaagcca

SEQ ID NO: 4973950 - DNA, 11 bp, Homo sapiens
tgttggccagg

SEQ ID NO: 4973951 - DNA, 17 bp, Homo sapiens
tgttggctgggggcctc

SEQ ID NO: 4973952 - DNA, 19 bp, Homo sapiens
tgttggctgggggcctcag

SEQ ID NO: 4973953 - DNA, 13 bp, Homo sapiens
tgttgggaaaaag

SEQ ID NO: 4973954 - DNA, 13 bp, Homo sapiens
tgttggtttactt

SEQ ID NO: 4973955 - DNA, 20 bp, Homo sapiens
tgttggtttactttcaaatc

SEQ ID NO: 4973956 - DNA, 15 bp, Homo sapiens
tgttgtaaattagga

SEQ ID NO: 4973957 - DNA, 13 bp, Homo sapiens
tgttgtaattctt

SEQ ID NO: 4973958 - DNA, 15 bp, Homo sapiens
tgttgtaattcttca

SEQ ID NO: 4973959 - DNA, 19 bp, Homo sapiens
tgttgtaattcttcagttg

SEQ ID NO: 4973960 - DNA, 18 bp, Homo sapiens
tgttgtacatttatgatt

SEQ ID NO: 4973961 - DNA, 23 bp, Homo sapiens
tgttgtacatttatgatttaata

SEQ ID NO: 4973962 - DNA, 14 bp, Homo sapiens
tgttgtgatgtatt

SEQ ID NO: 4973963 - DNA, 20 bp, Homo sapiens
tgttgtgatgtattctagct

SEQ ID NO: 4973964 - DNA, 13 bp, Homo sapiens
tgttgtgtgtgca

SEQ ID NO: 4973965 - DNA, 13 bp, Homo sapiens
tgttgttggttgt

SEQ ID NO: 4973966 - DNA, 19 bp, Homo sapiens
tgttgtttgtttttttgcc

SEQ ID NO: 4973967 - DNA, 15 bp, Homo sapiens
ttaatctgaaattct

SEQ ID NO: 4973968 - DNA, 23 bp, Homo sapiens
ttaatctgaaattctaaagagca

SEQ ID NO: 4973969 - DNA, 13 bp, Homo sapiens
ttaatcttcatgg

SEQ ID NO: 4973970 - DNA, 16 bp, Homo sapiens
ttaatcttggatagct

SEQ ID NO: 4973971 - DNA, 14 bp, Homo sapiens
ttaatctttcctga

SEQ ID NO: 4973972 - DNA, 20 bp, Homo sapiens
ttaatgcattaaacctgtct

SEQ ID NO: 4973973 - DNA, 19 bp, Homo sapiens
tgtatgtcttggacactgt

SEQ ID NO: 4973974 - DNA, 14 bp, Homo sapiens
tgtatgtgagagat

SEQ ID NO: 4973975 - DNA, 12 bp, Homo sapiens
tgtatgtgtatt

SEQ ID NO: 4973976 - DNA, 19 bp, Homo sapiens
tgtattaacaaaagttccc

SEQ ID NO: 4973977 - DNA, 12 bp, Homo sapiens
tgtattattgct

SEQ ID NO: 4973978 - DNA, 18 bp, Homo sapiens
tgtattattgctgttgct

SEQ ID NO: 4973979 - DNA, 16 bp, Homo sapiens
tgtgctctcaccagct

SEQ ID NO: 4973980 - DNA, 13 bp, Homo sapiens
tgtgctgaatgtg

SEQ ID NO: 4973981 - DNA, 16 bp, Homo sapiens
tgtgctgccatttgat

SEQ ID NO: 4973982 - DNA, 16 bp, Homo sapiens
tgtgctgggggaatga

SEQ ID NO: 4973983 - DNA, 16 bp, Homo sapiens
tgtgctgtggaagcaa

SEQ ID NO: 4973984 - DNA, 16 bp, Homo sapiens
tgtgcttctccccaga

SEQ ID NO: 4973985 - DNA, 18 bp, Homo sapiens
tgtgcttctccccagaat

SEQ ID NO: 4973986 - DNA, 20 bp, Homo sapiens
tgtgcttctccccagaattc

SEQ ID NO: 4973987 - DNA, 17 bp, Homo sapiens
tgtggaaaatgaaaatt

SEQ ID NO: 4973988 - DNA, 18 bp, Homo sapiens
tgtggaaacctccacagg

SEQ ID NO: 4973989 - DNA, 22 bp, Homo sapiens
tgtggaactaataaatacatac

SEQ ID NO: 4973990 - DNA, 20 bp, Homo sapiens
tgtggaagaaaatggtttat

SEQ ID NO: 4973991 - DNA, 14 bp, Homo sapiens
tgtggacacagctc

SEQ ID NO: 4973992 - DNA, 17 bp, Homo sapiens
tgtggaccactgcatga

SEQ ID NO: 4973993 - DNA, 19 bp, Homo sapiens
tgtggaccactgcatgagc

SEQ ID NO: 4973994 - DNA, 12 bp, Homo sapiens
tgtggactctgg

SEQ ID NO: 4973995 - DNA, 22 bp, Homo sapiens
tgtggactctggtgcctccaga

SEQ ID NO: 4973996 - DNA, 23 bp, Homo sapiens
tgtggactgtggcacttgcctgg

SEQ ID NO: 4973997 - DNA, 12 bp, Homo sapiens
tgtggaggaagg

SEQ ID NO: 4973998 - DNA, 16 bp, Homo sapiens
tgtggaggaaggattg

SEQ ID NO: 4973999 - DNA, 15 bp, Homo sapiens
tgtggatataaaatg

SEQ ID NO: 4974000 - DNA, 15 bp, Homo sapiens
tgtggatccaatgtt

SEQ ID NO: 4974001 - DNA, 22 bp, Homo sapiens
tgtggatgcctgtggaagagtg

SEQ ID NO: 4974002 - DNA, 17 bp, Homo sapiens
tgtggcaaggaaaaaca

SEQ ID NO: 4974003 - DNA, 15 bp, Homo sapiens
tgtggcacttgcctg

SEQ ID NO: 4974004 - DNA, 16 bp, Homo sapiens
tgtggcacttgcctgg

SEQ ID NO: 4974005 - DNA, 15 bp, Homo sapiens
tgtggcagagagaga

SEQ ID NO: 4974006 - DNA, 17 bp, Homo sapiens
tgtggcccctgaacaag

SEQ ID NO: 4974007 - DNA, 18 bp, Homo sapiens
tgtggccgttatctggaa

SEQ ID NO: 4974008 - DNA, 13 bp, Homo sapiens
tgtggcctcagaa

SEQ ID NO: 4974009 - DNA, 20 bp, Homo sapiens
tgtggccttccatttatatg

SEQ ID NO: 4974010 - DNA, 16 bp, Homo sapiens
tgtggctgaggaggcc

SEQ ID NO: 4974011 - DNA, 22 bp, Homo sapiens
tgtggctgaggaggcctccatc

SEQ ID NO: 4974012 - DNA, 15 bp, Homo sapiens
tgtggctgggggcag

SEQ ID NO: 4974013 - DNA, 21 bp, Homo sapiens
tgtggctgggggcaggagggc

SEQ ID NO: 4974014 - DNA, 15 bp, Homo sapiens
tgtgggaaaaaaatg

SEQ ID NO: 4974015 - DNA, 21 bp, Homo sapiens
tgtgggaaaaaaatgaatgag

SEQ ID NO: 4974016 - DNA, 13 bp, Homo sapiens
tgtggggaaaggg

SEQ ID NO: 4974017 - DNA, 15 bp, Homo sapiens
tgtgggtcttccagg

SEQ ID NO: 4974018 - DNA, 12 bp, Homo sapiens
tgtgggtgtagc

SEQ ID NO: 4974019 - DNA, 21 bp, Homo sapiens
tgtggtaggccttttaacatt

SEQ ID NO: 4974020 - DNA, 23 bp, Homo sapiens
tgtggtaggccttttaacatttt

SEQ ID NO: 4974021 - DNA, 24 bp, Homo sapiens
tgtggtaggccttttaacattttg

SEQ ID NO: 4974022 - DNA, 19 bp, Homo sapiens
tgtggtattgaatattgtg

SEQ ID NO: 4974023 - DNA, 11 bp, Homo sapiens
tgtggtctcag

SEQ ID NO: 4974024 - DNA, 15 bp, Homo sapiens
tgtggtggcctcagc

SEQ ID NO: 4974025 - DNA, 13 bp, Homo sapiens
tgtggtgtaattt

SEQ ID NO: 4974026 - DNA, 18 bp, Homo sapiens
tgtggtttggttcctctc

SEQ ID NO: 4974027 - DNA, 22 bp, Homo sapiens
tgtggtttggttcctctctggt

SEQ ID NO: 4974028 - DNA, 14 bp, Homo sapiens
tgtggttttatgga

SEQ ID NO: 4974029 - DNA, 17 bp, Homo sapiens
tgtggttttatggagac

SEQ ID NO: 4974030 - DNA, 21 bp, Homo sapiens
tgtgtaaacacagtcaaaata

SEQ ID NO: 4974031 - DNA, 17 bp, Homo sapiens
tgtgtacaatgtacaca

SEQ ID NO: 4974032 - DNA, 17 bp, Homo sapiens
tgtgtacacctctggat

SEQ ID NO: 4974033 - DNA, 10 bp, Homo sapiens
tgtgtactgt

SEQ ID NO: 4974034 - DNA, 13 bp, Homo sapiens
tgtgtagagttaa

SEQ ID NO: 4974035 - DNA, 14 bp, Homo sapiens
tgtgtagcctgtgc

SEQ ID NO: 4974036 - DNA, 17 bp, Homo sapiens
tgtgtagctttgctctt

SEQ ID NO: 4974037 - DNA, 13 bp, Homo sapiens
tgtgtatatatac

SEQ ID NO: 4974038 - DNA, 17 bp, Homo sapiens
tgtgtatattatttggc

SEQ ID NO: 4974039 - DNA, 12 bp, Homo sapiens
tgtgtatgtgta

SEQ ID NO: 4974040 - DNA, 20 bp, Homo sapiens
tgtgtcaggtggggcagctt

SEQ ID NO: 4974041 - DNA, 14 bp, Homo sapiens
tgtgtcctggttcc

SEQ ID NO: 4974042 - DNA, 14 bp, Homo sapiens
tgtgtccttccctg

SEQ ID NO: 4974043 - DNA, 22 bp, Homo sapiens
tgtgtctaaatttgaatgttaa

SEQ ID NO: 4974044 - DNA, 14 bp, Homo sapiens
tgtgtctgctcagt

SEQ ID NO: 4974045 - DNA, 13 bp, Homo sapiens
tgtgtctgtacac

SEQ ID NO: 4974046 - DNA, 14 bp, Homo sapiens
tgtgtctgtacacg

SEQ ID NO: 4974047 - DNA, 16 bp, Homo sapiens
tgtgtcttaattatta

SEQ ID NO: 4974048 - DNA, 21 bp, Homo sapiens
tgtgtcttgcaatggcagcct

SEQ ID NO: 4974049 - DNA, 18 bp, Homo sapiens
tgtgtctttcacagctcc

SEQ ID NO: 4974050 - DNA, 22 bp, Homo sapiens
tgtgtctttcacagctcctccc

SEQ ID NO: 4974051 - DNA, 22 bp, Homo sapiens
tgtgtgaaaggaagctccactg

SEQ ID NO: 4974052 - DNA, 16 bp, Homo sapiens
tgtgtgaatgaacact

SEQ ID NO: 4974053 - DNA, 22 bp, Homo sapiens
tgtgtgaatgaacactcttttg

SEQ ID NO: 4974054 - DNA, 12 bp, Homo sapiens
tgtgtgaatgtg

SEQ ID NO: 4974055 - DNA, 13 bp, Homo sapiens
tgtgtgaatgtgg

SEQ ID NO: 4974056 - DNA, 16 bp, Homo sapiens
tgtgtgaccaactgtg

SEQ ID NO: 4974057 - DNA, 20 bp, Homo sapiens
tgtgtgaggagctgctggct

SEQ ID NO: 4974058 - DNA, 16 bp, Homo sapiens
tgtgtgatgaactttc

SEQ ID NO: 4974059 - DNA, 17 bp, Homo sapiens
tgtgtgatgaactttct

SEQ ID NO: 4974060 - DNA, 16 bp, Homo sapiens
tgtgtgcaaaagcagt

SEQ ID NO: 4974061 - DNA, 19 bp, Homo sapiens
tgtgtgcacgtacacacac

SEQ ID NO: 4974062 - DNA, 19 bp, Homo sapiens
tgtgtgcatgtgtgtataa

SEQ ID NO: 4974063 - DNA, 16 bp, Homo sapiens
tgtgtggactgtggca

SEQ ID NO: 4974064 - DNA, 14 bp, Homo sapiens
tgtgtggtggcctc

SEQ ID NO: 4974065 - DNA, 11 bp, Homo sapiens
tgtgtgtactc

SEQ ID NO: 4974066 - DNA, 14 bp, Homo sapiens
tgtgtgtatatatg

SEQ ID NO: 4974067 - DNA, 20 bp, Homo sapiens
tgtgtgtgaatgaacactct

SEQ ID NO: 4974068 - DNA, 13 bp, Homo sapiens
tgtgtgtgtgcat

SEQ ID NO: 4974069 - DNA, 13 bp, Homo sapiens
tgtgtgtgtgtgt

SEQ ID NO: 4974070 - DNA, 14 bp, Homo sapiens
tgtgtgtgtgtgtg

SEQ ID NO: 4974071 - DNA, 22 bp, Homo sapiens
tgtgttaagtatgtgtaaaatg

SEQ ID NO: 4974072 - DNA, 16 bp, Homo sapiens
tgtgttccaagtttcc

SEQ ID NO: 4974073 - DNA, 13 bp, Homo sapiens
tgtgttctatcca

SEQ ID NO: 4974074 - DNA, 14 bp, Homo sapiens
tgtgttgcattatt

SEQ ID NO: 4974075 - DNA, 18 bp, Homo sapiens
tgtgttgccatgtgtgct

SEQ ID NO: 4974076 - DNA, 15 bp, Homo sapiens
tgtgttggacagaga

SEQ ID NO: 4974077 - DNA, 12 bp, Homo sapiens
tgtgttgtatta

SEQ ID NO: 4974078 - DNA, 18 bp, Homo sapiens
tgtgttgtcttgaaagat

SEQ ID NO: 4974079 - DNA, 13 bp, Homo sapiens
tgtgttgtgaatg

SEQ ID NO: 4974080 - DNA, 14 bp, Homo sapiens
tgtgtttatttcac

SEQ ID NO: 4974081 - DNA, 18 bp, Homo sapiens
tgtgtttggtttacattt

SEQ ID NO: 4974082 - DNA, 15 bp, Homo sapiens
tgtgtttgtgtattt

SEQ ID NO: 4974083 - DNA, 16 bp, Homo sapiens
tgtgtttttctccagt

SEQ ID NO: 4974084 - DNA, 11 bp, Homo sapiens
tgttaaactgt

SEQ ID NO: 4974085 - DNA, 13 bp, Homo sapiens
tgttaaactgtta

SEQ ID NO: 4974086 - DNA, 20 bp, Homo sapiens
tgttaaactgttagcactgt

SEQ ID NO: 4974087 - DNA, 23 bp, Homo sapiens
tgttaaataatatggctatgctt

SEQ ID NO: 4974088 - DNA, 18 bp, Homo sapiens
tgttaaatgaaattgtaa

SEQ ID NO: 4974089 - DNA, 16 bp, Homo sapiens
tgttaaatttgtaagt

SEQ ID NO: 4974090 - DNA, 18 bp, Homo sapiens
ttatgacatcacttgtac

SEQ ID NO: 4974091 - DNA, 23 bp, Homo sapiens
ttatgacatcacttgtacaaaat

SEQ ID NO: 4974092 - DNA, 15 bp, Homo sapiens
ttatgactatgtaaa

SEQ ID NO: 4974093 - DNA, 13 bp, Homo sapiens
ttatgatttgggt

SEQ ID NO: 4974094 - DNA, 14 bp, Homo sapiens
ttatgcaaaatgga

SEQ ID NO: 4974095 - DNA, 20 bp, Homo sapiens
ttatgcaattaggtttttcc

SEQ ID NO: 4974096 - DNA, 18 bp, Homo sapiens
ttatgcagatagaatcaa

SEQ ID NO: 4974097 - DNA, 16 bp, Homo sapiens
ttatgctaactgtaga

SEQ ID NO: 4974098 - DNA, 21 bp, Homo sapiens
ttatgctcttttttactcatt

SEQ ID NO: 4974099 - DNA, 23 bp, Homo sapiens
ttatggaattgatttgcattgaa

SEQ ID NO: 4974100 - DNA, 19 bp, Homo sapiens
ttatggagacctctccttc

SEQ ID NO: 4974101 - DNA, 12 bp, Homo sapiens
ttatggcctcag

SEQ ID NO: 4974102 - DNA, 19 bp, Homo sapiens
ttatgggaataattgcttt

SEQ ID NO: 4974103 - DNA, 22 bp, Homo sapiens
ttatgggcattgacaaatctgt

SEQ ID NO: 4974104 - DNA, 19 bp, Homo sapiens
ttatggtcctaaaagcaaa

SEQ ID NO: 4974105 - DNA, 20 bp, Homo sapiens
ttatgtactagtgttctgtt

SEQ ID NO: 4974106 - DNA, 12 bp, Homo sapiens
ttatgtactgta

SEQ ID NO: 4974107 - DNA, 18 bp, Homo sapiens
ttatgtactgtactaatt

SEQ ID NO: 4974108 - DNA, 18 bp, Homo sapiens
ttatgtagatatttggct

SEQ ID NO: 4974109 - DNA, 17 bp, Homo sapiens
ttatgtatcagaagaga

SEQ ID NO: 4974110 - DNA, 15 bp, Homo sapiens
ttatgtccactgtgt

SEQ ID NO: 4974111 - DNA, 17 bp, Homo sapiens
ttatgtccactgtgtat

SEQ ID NO: 4974112 - DNA, 13 bp, Homo sapiens
ttatgtcttttat

SEQ ID NO: 4974113 - DNA, 21 bp, Homo sapiens
ttatgtcttttatatttgtat

SEQ ID NO: 4974114 - DNA, 14 bp, Homo sapiens
ttatgtgacatttt

SEQ ID NO: 4974115 - DNA, 19 bp, Homo sapiens
ttatgtgacattttacatt

SEQ ID NO: 4974116 - DNA, 14 bp, Homo sapiens
ttatgtgatcaatt

SEQ ID NO: 4974117 - DNA, 19 bp, Homo sapiens
ttatgtgggttgcctggtg

SEQ ID NO: 4974118 - DNA, 18 bp, Homo sapiens
ttatgtggttttagattt

SEQ ID NO: 4974119 - DNA, 17 bp, Homo sapiens
ttatgtgtgcatgtgtg

SEQ ID NO: 4974120 - DNA, 21 bp, Homo sapiens
ttatgtgtgcatgtgtgtata

SEQ ID NO: 4974121 - DNA, 15 bp, Homo sapiens
ttatgtttgaatatg

SEQ ID NO: 4974122 - DNA, 22 bp, Homo sapiens
ttatgttttttaaaatatttat

SEQ ID NO: 4974123 - DNA, 19 bp, Homo sapiens
ttattaaaatgattgtaaa

SEQ ID NO: 4974124 - DNA, 20 bp, Homo sapiens
ttattaaaatgattgtaaaa

SEQ ID NO: 4974125 - DNA, 21 bp, Homo sapiens
ttattaaaatgattgtaaaat

SEQ ID NO: 4974126 - DNA, 12 bp, Homo sapiens
ttattaaataaa

SEQ ID NO: 4974127 - DNA, 19 bp, Homo sapiens
ttattaaataaaatcaatt

SEQ ID NO: 4974128 - DNA, 15 bp, Homo sapiens
ttattaactacattt

SEQ ID NO: 4974129 - DNA, 18 bp, Homo sapiens
ttattaactacatttatg

SEQ ID NO: 4974130 - DNA, 13 bp, Homo sapiens
ttattatctttaa

SEQ ID NO: 4974131 - DNA, 15 bp, Homo sapiens
ttattattttggggt

SEQ ID NO: 4974132 - DNA, 16 bp, Homo sapiens
ttattcattagctgtg

SEQ ID NO: 4974133 - DNA, 20 bp, Homo sapiens
ttattccagaatgctgtaca

SEQ ID NO: 4974134 - DNA, 17 bp, Homo sapiens
ttattcctgtatgttgt

SEQ ID NO: 4974135 - DNA, 22 bp, Homo sapiens
ttattgaagaaacagataccat

SEQ ID NO: 4974136 - DNA, 23 bp, Homo sapiens
ttattgaaggaagccaaatttat

SEQ ID NO: 4974137 - DNA, 14 bp, Homo sapiens
ttattgagtttgta

SEQ ID NO: 4974138 - DNA, 14 bp, Homo sapiens
ttattgctagtatt

SEQ ID NO: 4974139 - DNA, 16 bp, Homo sapiens
ttattgctagtatttg

SEQ ID NO: 4974140 - DNA, 13 bp, Homo sapiens
ttattgctgattt

SEQ ID NO: 4974141 - DNA, 12 bp, Homo sapiens
ttattgtaaatt

SEQ ID NO: 4974142 - DNA, 21 bp, Homo sapiens
ttattgtataaactatcagtt

SEQ ID NO: 4974143 - DNA, 20 bp, Homo sapiens
ttattgtggtaggcctttta

SEQ ID NO: 4974144 - DNA, 13 bp, Homo sapiens
ttatttaataaca

SEQ ID NO: 4974145 - DNA, 19 bp, Homo sapiens
ttatttaataacattacct

SEQ ID NO: 4974146 - DNA, 15 bp, Homo sapiens
ttatttatatgtact

SEQ ID NO: 4974147 - DNA, 17 bp, Homo sapiens
ttatttattcagcttca

SEQ ID NO: 4974148 - DNA, 13 bp, Homo sapiens
ttatttatttaat

SEQ ID NO: 4974149 - DNA, 19 bp, Homo sapiens
ttatttcagattttgataa

SEQ ID NO: 4974150 - DNA, 17 bp, Homo sapiens
ttatttccaaataaaat

SEQ ID NO: 4974151 - DNA, 19 bp, Homo sapiens
ttatttccaaataaaatga

SEQ ID NO: 4974152 - DNA, 20 bp, Homo sapiens
ttatttccagtgttctatga

SEQ ID NO: 4974153 - DNA, 13 bp, Homo sapiens
ttatttgtgtaat

SEQ ID NO: 4974154 - DNA, 21 bp, Homo sapiens
ttatttgtgtaatagaaaact

SEQ ID NO: 4974155 - DNA, 22 bp, Homo sapiens
ttatttgtgttttaatttaaac

SEQ ID NO: 4974156 - DNA, 19 bp, Homo sapiens
ttatttgtttttcattcat

SEQ ID NO: 4974157 - DNA, 14 bp, Homo sapiens
ttattttaaacaaa

SEQ ID NO: 4974158 - DNA, 14 bp, Homo sapiens
ttattttatgttta

SEQ ID NO: 4974159 - DNA, 13 bp, Homo sapiens
ttattttatttgt

SEQ ID NO: 4974160 - DNA, 18 bp, Homo sapiens
ttattttcaagaaactga

SEQ ID NO: 4974161 - DNA, 12 bp, Homo sapiens
ttattttcagta

SEQ ID NO: 4974162 - DNA, 14 bp, Homo sapiens
ttattttcagtatt

SEQ ID NO: 4974163 - DNA, 14 bp, Homo sapiens
ttattttcattaca

SEQ ID NO: 4974164 - DNA, 18 bp, Homo sapiens
ttattttcttttgaattg

SEQ ID NO: 4974165 - DNA, 22 bp, Homo sapiens
ttattttgaaaagcttcttaat

SEQ ID NO: 4974166 - DNA, 16 bp, Homo sapiens
ttatttttaaaaagaa

SEQ ID NO: 4974167 - DNA, 14 bp, Homo sapiens
ttatttttcaagga

SEQ ID NO: 4974168 - DNA, 14 bp, Homo sapiens
ttattttttacatt

SEQ ID NO: 4974169 - DNA, 18 bp, Homo sapiens
ttattttttacattatta

SEQ ID NO: 4974170 - DNA, 13 bp, Homo sapiens
ttattttttattg

SEQ ID NO: 4974171 - DNA, 12 bp, Homo sapiens
ttcaaaaactgt

SEQ ID NO: 4974172 - DNA, 21 bp, Homo sapiens
ttcaaaaactgttttgggtag

SEQ ID NO: 4974173 - DNA, 13 bp, Homo sapiens
ttcaaaaagtgtt

SEQ ID NO: 4974174 - DNA, 17 bp, Homo sapiens
ttcaaaaagtgtttatt

SEQ ID NO: 4974175 - DNA, 19 bp, Homo sapiens
ttcaaaagacatgttgtaa

SEQ ID NO: 4974176 - DNA, 19 bp, Homo sapiens
ttcaaaatccttccaaaga

SEQ ID NO: 4974177 - DNA, 14 bp, Homo sapiens
ttcaaaatgtatat

SEQ ID NO: 4974178 - DNA, 15 bp, Homo sapiens
ttcaaaatgttatct

SEQ ID NO: 4974179 - DNA, 23 bp, Homo sapiens
ttcaaaatgttatcttctcaagt

SEQ ID NO: 4974180 - DNA, 17 bp, Homo sapiens
ttcaaaattaaatctgt

SEQ ID NO: 4974181 - DNA, 13 bp, Homo sapiens
ttcaaacaagaat

SEQ ID NO: 4974182 - DNA, 20 bp, Homo sapiens
ttagcacagattttaattgt

SEQ ID NO: 4974183 - DNA, 21 bp, Homo sapiens
ttagcacagattttaattgtc

SEQ ID NO: 4974184 - DNA, 22 bp, Homo sapiens
ttagcacagattttaattgtca

SEQ ID NO: 4974185 - DNA, 18 bp, Homo sapiens
ttagcactgttgatgtat

SEQ ID NO: 4974186 - DNA, 15 bp, Homo sapiens
ttagcatcctaagaa

SEQ ID NO: 4974187 - DNA, 23 bp, Homo sapiens
ttagcctggagcacctttccttc

SEQ ID NO: 4974188 - DNA, 14 bp, Homo sapiens
ttagcggagacgga

SEQ ID NO: 4974189 - DNA, 12 bp, Homo sapiens
ttagctttgtgt

SEQ ID NO: 4974190 - DNA, 22 bp, Homo sapiens
ttagctttgtgtttggtttaca

SEQ ID NO: 4974191 - DNA, 18 bp, Homo sapiens
ttaggaaaatcactttgt

SEQ ID NO: 4974192 - DNA, 21 bp, Homo sapiens
ttaggaaaatcactttgtcta

SEQ ID NO: 4974193 - DNA, 14 bp, Homo sapiens
ttagggtacattta

SEQ ID NO: 4974194 - DNA, 15 bp, Homo sapiens
ttagggtactaaatt

SEQ ID NO: 4974195 - DNA, 21 bp, Homo sapiens
ttagggtgaaccacttcattc

SEQ ID NO: 4974196 - DNA, 18 bp, Homo sapiens
ttaggtggcaagctgtga

SEQ ID NO: 4974197 - DNA, 22 bp, Homo sapiens
ttaggttccatcctttacgtgt

SEQ ID NO: 4974198 - DNA, 12 bp, Homo sapiens
ttaggttctaaa

SEQ ID NO: 4974199 - DNA, 17 bp, Homo sapiens
ttagtaaatgtctttgt

SEQ ID NO: 4974200 - DNA, 19 bp, Homo sapiens
ttagtaaatgtctttgtaa

SEQ ID NO: 4974201 - DNA, 21 bp, Homo sapiens
ttagtaaatgtctttgtaagt

SEQ ID NO: 4974202 - DNA, 13 bp, Homo sapiens
ttagtagagacag

SEQ ID NO: 4974203 - DNA, 17 bp, Homo sapiens
ttagtagagacagggtt

SEQ ID NO: 4974204 - DNA, 15 bp, Homo sapiens
ttagtattcattctg

SEQ ID NO: 4974205 - DNA, 22 bp, Homo sapiens
ttagtcccccaactctgagccc

SEQ ID NO: 4974206 - DNA, 22 bp, Homo sapiens
ttagtctcagtttgtgtgtctt

SEQ ID NO: 4974207 - DNA, 15 bp, Homo sapiens
ttagtgacaaaatag

SEQ ID NO: 4974208 - DNA, 14 bp, Homo sapiens
ttagtgcctgtgtg

SEQ ID NO: 4974209 - DNA, 15 bp, Homo sapiens
ttagtgggccagggc

SEQ ID NO: 4974210 - DNA, 16 bp, Homo sapiens
ttagtgggccagggct

SEQ ID NO: 4974211 - DNA, 14 bp, Homo sapiens
ttagttaagtttta

SEQ ID NO: 4974212 - DNA, 13 bp, Homo sapiens
ttagttaatatat

SEQ ID NO: 4974213 - DNA, 14 bp, Homo sapiens
ttagttaatggatt

SEQ ID NO: 4974214 - DNA, 16 bp, Homo sapiens
ttagttatagatgtct

SEQ ID NO: 4974215 - DNA, 13 bp, Homo sapiens
ttagttatagttt

SEQ ID NO: 4974216 - DNA, 15 bp, Homo sapiens
ttagttatagtttca

SEQ ID NO: 4974217 - DNA, 13 bp, Homo sapiens
ttagttccctgtc

SEQ ID NO: 4974218 - DNA, 17 bp, Homo sapiens
ttagtttacaatcagcc

SEQ ID NO: 4974219 - DNA, 21 bp, Homo sapiens
ttataaaaataaatagaaaag

SEQ ID NO: 4974220 - DNA, 13 bp, Homo sapiens
ttataaaatataa

SEQ ID NO: 4974221 - DNA, 16 bp, Homo sapiens
ttataaaattaagcaa

SEQ ID NO: 4974222 - DNA, 12 bp, Homo sapiens
ttataaatcata

SEQ ID NO: 4974223 - DNA, 17 bp, Homo sapiens
ttataaatcatattgat

SEQ ID NO: 4974224 - DNA, 19 bp, Homo sapiens
ttataaatcatattgatga

SEQ ID NO: 4974225 - DNA, 23 bp, Homo sapiens
ttataaatcatattgatgaaaag

SEQ ID NO: 4974226 - DNA, 12 bp, Homo sapiens
ttataagactct

SEQ ID NO: 4974227 - DNA, 14 bp, Homo sapiens
ttataagactctca

SEQ ID NO: 4974228 - DNA, 20 bp, Homo sapiens
ttataagactctcacactca

SEQ ID NO: 4974229 - DNA, 23 bp, Homo sapiens
ttataagcaaatttcaaaagaca

SEQ ID NO: 4974230 - DNA, 15 bp, Homo sapiens
ttataagcattgaaa

SEQ ID NO: 4974231 - DNA, 17 bp, Homo sapiens
ttataagcattgaaatt

SEQ ID NO: 4974232 - DNA, 21 bp, Homo sapiens
ttataataaaggactgtaatc

SEQ ID NO: 4974233 - DNA, 15 bp, Homo sapiens
ttataatactctgtt

SEQ ID NO: 4974234 - DNA, 11 bp, Homo sapiens
ttataatagca

SEQ ID NO: 4974235 - DNA, 19 bp, Homo sapiens
ttatacaaattaaaaagat

SEQ ID NO: 4974236 - DNA, 16 bp, Homo sapiens
ttataccattcagatc

SEQ ID NO: 4974237 - DNA, 18 bp, Homo sapiens
ttatactaacttatttat

SEQ ID NO: 4974238 - DNA, 18 bp, Homo sapiens
ttatactccagtgtacat

SEQ ID NO: 4974239 - DNA, 19 bp, Homo sapiens
ttatactcttcctattttt

SEQ ID NO: 4974240 - DNA, 16 bp, Homo sapiens
ttatactctttctgta

SEQ ID NO: 4974241 - DNA, 14 bp, Homo sapiens
ttatagagaatgat

SEQ ID NO: 4974242 - DNA, 23 bp, Homo sapiens
ttatagagtgtacttaactattc

SEQ ID NO: 4974243 - DNA, 15 bp, Homo sapiens
ttatagatgtctagg

SEQ ID NO: 4974244 - DNA, 17 bp, Homo sapiens
ttatagctattactgtc

SEQ ID NO: 4974245 - DNA, 22 bp, Homo sapiens
ttataggtaatcaatgaatatt

SEQ ID NO: 4974246 - DNA, 18 bp, Homo sapiens
ttataggtgagaaaaaaa

SEQ ID NO: 4974247 - DNA, 16 bp, Homo sapiens
ttatagtacatgataa

SEQ ID NO: 4974248 - DNA, 17 bp, Homo sapiens
ttatagtacatgataaa

SEQ ID NO: 4974249 - DNA, 15 bp, Homo sapiens
ttatagtttgtacat

SEQ ID NO: 4974250 - DNA, 13 bp, Homo sapiens
ttatataaatgta

SEQ ID NO: 4974251 - DNA, 18 bp, Homo sapiens
ttatataaatgtaaaaat

SEQ ID NO: 4974252 - DNA, 23 bp, Homo sapiens
ttatatacagaggaaatctgtaa

SEQ ID NO: 4974253 - DNA, 15 bp, Homo sapiens
ttatatatacagtaa

SEQ ID NO: 4974254 - DNA, 15 bp, Homo sapiens
ttatatatgaaaact

SEQ ID NO: 4974255 - DNA, 14 bp, Homo sapiens
ttatatcccctgct

SEQ ID NO: 4974256 - DNA, 20 bp, Homo sapiens
ttatatggatgattcagaaa

SEQ ID NO: 4974257 - DNA, 19 bp, Homo sapiens
ttatatgtacatgagaagg

SEQ ID NO: 4974258 - DNA, 14 bp, Homo sapiens
ttatatgtactgtt

SEQ ID NO: 4974259 - DNA, 19 bp, Homo sapiens
ttatattaatgtacttgtt

SEQ ID NO: 4974260 - DNA, 14 bp, Homo sapiens
ttatattcaaccat

SEQ ID NO: 4974261 - DNA, 20 bp, Homo sapiens
ttatattgaagacaatttga

SEQ ID NO: 4974262 - DNA, 11 bp, Homo sapiens
ttatatttaat

SEQ ID NO: 4974263 - DNA, 16 bp, Homo sapiens
ttatatttaattatta

SEQ ID NO: 4974264 - DNA, 18 bp, Homo sapiens
ttatatttagttatagtt

SEQ ID NO: 4974265 - DNA, 13 bp, Homo sapiens
ttatatttatcca

SEQ ID NO: 4974266 - DNA, 18 bp, Homo sapiens
ttatattttcgtatgaaa

SEQ ID NO: 4974267 - DNA, 22 bp, Homo sapiens
ttatcaagtttgggtctgtgct

SEQ ID NO: 4974268 - DNA, 16 bp, Homo sapiens
ttatcaatatctaata

SEQ ID NO: 4974269 - DNA, 17 bp, Homo sapiens
ttatcaatatctaatat

SEQ ID NO: 4974270 - DNA, 22 bp, Homo sapiens
ttatcaatatctaatatatatg

SEQ ID NO: 4974271 - DNA, 16 bp, Homo sapiens
ttatcactttttgaac

SEQ ID NO: 4974272 - DNA, 21 bp, Homo sapiens
ttatcagtaagaaaaagaaga

SEQ ID NO: 4974273 - DNA, 21 bp, Homo sapiens
ttatcagtttccagtctcaaa

SEQ ID NO: 4974274 - DNA, 13 bp, Homo sapiens
ttatcatgaagcc

SEQ ID NO: 4974275 - DNA, 19 bp, Homo sapiens
ttatcatgacatgttatat

SEQ ID NO: 4974276 - DNA, 17 bp, Homo sapiens
ttatccatattgagtca

SEQ ID NO: 4974277 - DNA, 19 bp, Homo sapiens
ttatccatattgagtcaaa

SEQ ID NO: 4974278 - DNA, 17 bp, Homo sapiens
ttatccatgacaggcct

SEQ ID NO: 4974279 - DNA, 17 bp, Homo sapiens
ttatcctgaaatttcag

SEQ ID NO: 4974280 - DNA, 13 bp, Homo sapiens
ttatcgaaataac

SEQ ID NO: 4974281 - DNA, 14 bp, Homo sapiens
ttatcgaaataaca

SEQ ID NO: 4974282 - DNA, 14 bp, Homo sapiens
ttatctaaattaaa

SEQ ID NO: 4974283 - DNA, 23 bp, Homo sapiens
ttatctacccaagggcagaaagt

SEQ ID NO: 4974284 - DNA, 19 bp, Homo sapiens
ttatctcagtcatgcataa

SEQ ID NO: 4974285 - DNA, 20 bp, Homo sapiens
ttatctcagtcatgcataaa

SEQ ID NO: 4974286 - DNA, 21 bp, Homo sapiens
ttatctcagtcatgcataaat

SEQ ID NO: 4974287 - DNA, 19 bp, Homo sapiens
ttatctctatttaatattt

SEQ ID NO: 4974288 - DNA, 14 bp, Homo sapiens
ttatctctctgtgc

SEQ ID NO: 4974289 - DNA, 12 bp, Homo sapiens
ttatctctgtgt

SEQ ID NO: 4974290 - DNA, 22 bp, Homo sapiens
ttatcttctcaagttctaagat

SEQ ID NO: 4974291 - DNA, 14 bp, Homo sapiens
ttatgaaataaaga

SEQ ID NO: 4974292 - DNA, 20 bp, Homo sapiens
ttatgaagtgcgtgaatgta

SEQ ID NO: 4974293 - DNA, 16 bp, Homo sapiens
ttatgaagtttaaaac

SEQ ID NO: 4974294 - DNA, 19 bp, Homo sapiens
tcctgcctcagcctcccaa

SEQ ID NO: 4974295 - DNA, 21 bp, Homo sapiens
tcctgcctcgaactggctgca

SEQ ID NO: 4974296 - DNA, 14 bp, Homo sapiens
tcctgcctgcccct

SEQ ID NO: 4974297 - DNA, 13 bp, Homo sapiens
tcctgcctggcca

SEQ ID NO: 4974298 - DNA, 21 bp, Homo sapiens
tcctgccttggcctcccaagt

SEQ ID NO: 4974299 - DNA, 22 bp, Homo sapiens
tcctggaagcgcgagggcctca

SEQ ID NO: 4974300 - DNA, 19 bp, Homo sapiens
tcctggcagcccagagact

SEQ ID NO: 4974301 - DNA, 17 bp, Homo sapiens
tcctgggagtgagctgg

SEQ ID NO: 4974302 - DNA, 15 bp, Homo sapiens
tcctggggcgtccag

SEQ ID NO: 4974303 - DNA, 23 bp, Homo sapiens
tcctgggggttctttcttcctct

SEQ ID NO: 4974304 - DNA, 15 bp, Homo sapiens
tcctggttcccgttt

SEQ ID NO: 4974305 - DNA, 16 bp, Homo sapiens
tcctgtaagccaaaga

SEQ ID NO: 4974306 - DNA, 21 bp, Homo sapiens
tcctgtagttgcgtggactct

SEQ ID NO: 4974307 - DNA, 22 bp, Homo sapiens
tcctgtagttgcgtggactctg

SEQ ID NO: 4974308 - DNA, 17 bp, Homo sapiens
tcctgtagttttatttt

SEQ ID NO: 4974309 - DNA, 19 bp, Homo sapiens
tcctgtatgaaagattgtg

SEQ ID NO: 4974310 - DNA, 13 bp, Homo sapiens
tcctgtatgttgt

SEQ ID NO: 4974311 - DNA, 21 bp, Homo sapiens
tcctgtcctcccatcccctgg

SEQ ID NO: 4974312 - DNA, 14 bp, Homo sapiens
tcctgtgctggggg

SEQ ID NO: 4974313 - DNA, 17 bp, Homo sapiens
tcctgtggaacccagca

SEQ ID NO: 4974314 - DNA, 22 bp, Homo sapiens
tcctgtggaacccagcagttct

SEQ ID NO: 4974315 - DNA, 15 bp, Homo sapiens
tcctgtggggaaagg

SEQ ID NO: 4974316 - DNA, 15 bp, Homo sapiens
tcctgtgtgcagtga

SEQ ID NO: 4974317 - DNA, 18 bp, Homo sapiens
tcctgtttattcccatct

SEQ ID NO: 4974318 - DNA, 11 bp, Homo sapiens
tccttaagtat

SEQ ID NO: 4974319 - DNA, 21 bp, Homo sapiens
tccttaagtatatcatgtaaa

SEQ ID NO: 4974320 - DNA, 17 bp, Homo sapiens
tccttagaccttccata

SEQ ID NO: 4974321 - DNA, 15 bp, Homo sapiens
tccttatcagagcta

SEQ ID NO: 4974322 - DNA, 23 bp, Homo sapiens
tccttcaagaactctgggctgct

SEQ ID NO: 4974323 - DNA, 18 bp, Homo sapiens
tccttccaaaaattatta

SEQ ID NO: 4974324 - DNA, 21 bp, Homo sapiens
tccttcctgttagtggttgtg

SEQ ID NO: 4974325 - DNA, 23 bp, Homo sapiens
tccttcgtatcccgagtctggga

SEQ ID NO: 4974326 - DNA, 21 bp, Homo sapiens
tccttcgtgaacatcccctcc

SEQ ID NO: 4974327 - DNA, 23 bp, Homo sapiens
tccttcgtgaacatcccctccca

SEQ ID NO: 4974328 - DNA, 15 bp, Homo sapiens
tccttctctgaacac

SEQ ID NO: 4974329 - DNA, 18 bp, Homo sapiens
tccttctctgaacacagg

SEQ ID NO: 4974330 - DNA, 20 bp, Homo sapiens
tccttctggcctttcctctc

SEQ ID NO: 4974331 - DNA, 16 bp, Homo sapiens
tccttctttgataatg

SEQ ID NO: 4974332 - DNA, 22 bp, Homo sapiens
tccttgaccttcctctggggct

SEQ ID NO: 4974333 - DNA, 21 bp, Homo sapiens
tccttgagacacggagcccag

SEQ ID NO: 4974334 - DNA, 13 bp, Homo sapiens
tccttgatcattt

SEQ ID NO: 4974335 - DNA, 21 bp, Homo sapiens
tccttgcaaggttaagcaagg

SEQ ID NO: 4974336 - DNA, 22 bp, Homo sapiens
tccttgcacccctcactctggc

SEQ ID NO: 4974337 - DNA, 24 bp, Homo sapiens
tccttgcacccctcactctggcct

SEQ ID NO: 4974338 - DNA, 10 bp, Homo sapiens
tccttggcct

SEQ ID NO: 4974339 - DNA, 23 bp, Homo sapiens
tccttggcctagcccaccctgct

SEQ ID NO: 4974340 - DNA, 16 bp, Homo sapiens
tccttggtctttgtat

SEQ ID NO: 4974341 - DNA, 23 bp, Homo sapiens
tccttggtctttgtatcttccat

SEQ ID NO: 4974342 - DNA, 14 bp, Homo sapiens
tccttggtgcctgg

SEQ ID NO: 4974343 - DNA, 16 bp, Homo sapiens
tcctttaaaaaaattt

SEQ ID NO: 4974344 - DNA, 21 bp, Homo sapiens
tcctttaaaaaaatttaagtg

SEQ ID NO: 4974345 - DNA, 16 bp, Homo sapiens
tcctttacgtgtttaa

SEQ ID NO: 4974346 - DNA, 13 bp, Homo sapiens
tcctttactttcc

SEQ ID NO: 4974347 - DNA, 23 bp, Homo sapiens
tcctttagcgcccagttgggtgg

SEQ ID NO: 4974348 - DNA, 16 bp, Homo sapiens
tcctttatatttagtg

SEQ ID NO: 4974349 - DNA, 16 bp, Homo sapiens
tcctttcacaaccttc

SEQ ID NO: 4974350 - DNA, 18 bp, Homo sapiens
tcctttcacaaccttctg

SEQ ID NO: 4974351 - DNA, 17 bp, Homo sapiens
tcctttccaaggcttct

SEQ ID NO: 4974352 - DNA, 18 bp, Homo sapiens
tcctttccaaggcttctc

SEQ ID NO: 4974353 - DNA, 13 bp, Homo sapiens
tcctttcccaagc

SEQ ID NO: 4974354 - DNA, 21 bp, Homo sapiens
tcctttcccaagccttcgggc

SEQ ID NO: 4974355 - DNA, 17 bp, Homo sapiens
tcctttcccttcctctt

SEQ ID NO: 4974356 - DNA, 15 bp, Homo sapiens
tcctttctccaggac

SEQ ID NO: 4974357 - DNA, 16 bp, Homo sapiens
tcctttctgccgaccc

SEQ ID NO: 4974358 - DNA, 16 bp, Homo sapiens
tcctttctgtgcccta

SEQ ID NO: 4974359 - DNA, 17 bp, Homo sapiens
tcctttctgtgccctac

SEQ ID NO: 4974360 - DNA, 15 bp, Homo sapiens
tcctttgcagggcag

SEQ ID NO: 4974361 - DNA, 21 bp, Homo sapiens
tcctttgtcttcaaactgtga

SEQ ID NO: 4974362 - DNA, 10 bp, Homo sapiens
tcctttgttc

SEQ ID NO: 4974363 - DNA, 22 bp, Homo sapiens
tcctttgttttctgactaatta

SEQ ID NO: 4974364 - DNA, 16 bp, Homo sapiens
tgaaaagacaagaaaa

SEQ ID NO: 4974365 - DNA, 22 bp, Homo sapiens
tgaaaagatgtacctggtggat

SEQ ID NO: 4974366 - DNA, 19 bp, Homo sapiens
tgaaaagctattagccagg

SEQ ID NO: 4974367 - DNA, 16 bp, Homo sapiens
tgaaaagcttcttaat

SEQ ID NO: 4974368 - DNA, 17 bp, Homo sapiens
tgaaaagcttcttaatt

SEQ ID NO: 4974369 - DNA, 23 bp, Homo sapiens
tgaaaagcttcttaattaatttg

SEQ ID NO: 4974370 - DNA, 17 bp, Homo sapiens
tgaaaagtcgttttcca

SEQ ID NO: 4974371 - DNA, 21 bp, Homo sapiens
tgaaaatattttttatatata

SEQ ID NO: 4974372 - DNA, 23 bp, Homo sapiens
tgaaaatattttttatatataca

SEQ ID NO: 4974373 - DNA, 21 bp, Homo sapiens
tgaaaatgaatatctattaat

SEQ ID NO: 4974374 - DNA, 13 bp, Homo sapiens
tgaaaatgtactg

SEQ ID NO: 4974375 - DNA, 14 bp, Homo sapiens
tgaaaatgtcaaag

SEQ ID NO: 4974376 - DNA, 20 bp, Homo sapiens
tgaaaattaggatttcatga

SEQ ID NO: 4974377 - DNA, 16 bp, Homo sapiens
tgaaaattattttaaa

SEQ ID NO: 4974378 - DNA, 18 bp, Homo sapiens
tgaaaattattttaaaca

SEQ ID NO: 4974379 - DNA, 19 bp, Homo sapiens
tgaaaattattttaaacaa

SEQ ID NO: 4974380 - DNA, 18 bp, Homo sapiens
tgaaaattcaaaaagtgt

SEQ ID NO: 4974381 - DNA, 23 bp, Homo sapiens
tgaaaattcaaaaagtgtttatt

SEQ ID NO: 4974382 - DNA, 13 bp, Homo sapiens
tgaaaatttgaga

SEQ ID NO: 4974383 - DNA, 22 bp, Homo sapiens
tgaaaatttgagactatttaaa

SEQ ID NO: 4974384 - DNA, 19 bp, Homo sapiens
tgaaaattttaaaaataca

SEQ ID NO: 4974385 - DNA, 14 bp, Homo sapiens
tgaaaattttacca

SEQ ID NO: 4974386 - DNA, 19 bp, Homo sapiens
tgaaacaaataatcacatt

SEQ ID NO: 4974387 - DNA, 22 bp, Homo sapiens
tgaaacaaataatcacattgac

SEQ ID NO: 4974388 - DNA, 17 bp, Homo sapiens
tgaaacacagctgttct

SEQ ID NO: 4974389 - DNA, 20 bp, Homo sapiens
tgaaacacgaaacttgttat

SEQ ID NO: 4974390 - DNA, 21 bp, Homo sapiens
tgaaacacgaaacttgttatt

SEQ ID NO: 4974391 - DNA, 23 bp, Homo sapiens
tgaaacactcagttgttcaataa

SEQ ID NO: 4974392 - DNA, 23 bp, Homo sapiens
tgaaacactttgcctcctgtgta

SEQ ID NO: 4974393 - DNA, 14 bp, Homo sapiens
tgaaacagaaacaa

SEQ ID NO: 4974394 - DNA, 18 bp, Homo sapiens
tgaaacctagtactgccc

SEQ ID NO: 4974395 - DNA, 16 bp, Homo sapiens
tgaaaccttttttaag

SEQ ID NO: 4974396 - DNA, 20 bp, Homo sapiens
tgaaaccttttttaagattt

SEQ ID NO: 4974397 - DNA, 18 bp, Homo sapiens
tgaaactggcactgaatt

SEQ ID NO: 4974398 - DNA, 19 bp, Homo sapiens
tgaaagatggctgtgcctc

SEQ ID NO: 4974399 - DNA, 11 bp, Homo sapiens
tgaaagcacag

SEQ ID NO: 4974400 - DNA, 22 bp, Homo sapiens
tgaaagcagggaatttctatct

SEQ ID NO: 4974401 - DNA, 17 bp, Homo sapiens
tgaaagccttagggaag

SEQ ID NO: 4974402 - DNA, 16 bp, Homo sapiens
tgaaagggatcatcat

SEQ ID NO: 4974403 - DNA, 17 bp, Homo sapiens
tgaaagggatcatcatg

SEQ ID NO: 4974404 - DNA, 13 bp, Homo sapiens
tgaaagggcccag

SEQ ID NO: 4974405 - DNA, 15 bp, Homo sapiens
tgaaaggtactatat

SEQ ID NO: 4974406 - DNA, 19 bp, Homo sapiens
tgaaaggtactatatttgc

SEQ ID NO: 4974407 - DNA, 20 bp, Homo sapiens
tgaaagttttcagaacctct

SEQ ID NO: 4974408 - DNA, 21 bp, Homo sapiens
tgaaataaagaaattgcaata

SEQ ID NO: 4974409 - DNA, 11 bp, Homo sapiens
tgaaatacctc

SEQ ID NO: 4974410 - DNA, 13 bp, Homo sapiens
tgaaatacctcat

SEQ ID NO: 4974411 - DNA, 17 bp, Homo sapiens
tgaaatacctcatgttt

SEQ ID NO: 4974412 - DNA, 18 bp, Homo sapiens
tgaaataggaaacaagtg

SEQ ID NO: 4974413 - DNA, 16 bp, Homo sapiens
tgaaatagtctgtgtg

SEQ ID NO: 4974414 - DNA, 18 bp, Homo sapiens
tgaaatagtctgtgtgaa

SEQ ID NO: 4974415 - DNA, 22 bp, Homo sapiens
tgaaatcaatgcaagagtgatt

SEQ ID NO: 4974416 - DNA, 20 bp, Homo sapiens
tgaaatccttgactggacct

SEQ ID NO: 4974417 - DNA, 16 bp, Homo sapiens
tgaaatgaaatttaaa

SEQ ID NO: 4974418 - DNA, 17 bp, Homo sapiens
tgaaatgagcacctcca

SEQ ID NO: 4974419 - DNA, 21 bp, Homo sapiens
tgaaatgagcacctccattaa

SEQ ID NO: 4974420 - DNA, 22 bp, Homo sapiens
tgaaatgtcacgtactgtctga

SEQ ID NO: 4974421 - DNA, 20 bp, Homo sapiens
tgaaattatgtgacatttta

SEQ ID NO: 4974422 - DNA, 22 bp, Homo sapiens
tgaaattatgtgacattttaca

SEQ ID NO: 4974423 - DNA, 12 bp, Homo sapiens
tgaaattccaaa

SEQ ID NO: 4974424 - DNA, 14 bp, Homo sapiens
tgaaattccaaagt

SEQ ID NO: 4974425 - DNA, 23 bp, Homo sapiens
tgaaattgtacatatttgtggaa

SEQ ID NO: 4974426 - DNA, 22 bp, Homo sapiens
tgaaatttaaacattaaaaatg

SEQ ID NO: 4974427 - DNA, 22 bp, Homo sapiens
tgaaatttattagttaatatat

SEQ ID NO: 4974428 - DNA, 17 bp, Homo sapiens
tgaaatttatttaatgt

SEQ ID NO: 4974429 - DNA, 22 bp, Homo sapiens
tgaaatttcagattcccagagc

SEQ ID NO: 4974430 - DNA, 14 bp, Homo sapiens
tgaaatttctagcc

SEQ ID NO: 4974431 - DNA, 12 bp, Homo sapiens
tgaaattttgca

SEQ ID NO: 4974432 - DNA, 16 bp, Homo sapiens
tgaaattttgcaaata

SEQ ID NO: 4974433 - DNA, 19 bp, Homo sapiens
tgaaattttgcaaatataa

SEQ ID NO: 4974434 - DNA, 22 bp, Homo sapiens
tgaaattttgcaaatataaaca

SEQ ID NO: 4974435 - DNA, 14 bp, Homo sapiens
tgaacaaaagggtc

SEQ ID NO: 4974436 - DNA, 15 bp, Homo sapiens
tgaacaaaagggtca

SEQ ID NO: 4974437 - DNA, 11 bp, Homo sapiens
tgaacaagaat

SEQ ID NO: 4974438 - DNA, 17 bp, Homo sapiens
tgaacacaggcagcttt

SEQ ID NO: 4974439 - DNA, 13 bp, Homo sapiens
tgaacacttataa

SEQ ID NO: 4974440 - DNA, 20 bp, Homo sapiens
tgaacagaaaacattctgat

SEQ ID NO: 4974441 - DNA, 11 bp, Homo sapiens
tgaacattcca

SEQ ID NO: 4974442 - DNA, 18 bp, Homo sapiens
tgaaccaagatctataaa

SEQ ID NO: 4974443 - DNA, 20 bp, Homo sapiens
tgaaccacatcttgctctgc

SEQ ID NO: 4974444 - DNA, 21 bp, Homo sapiens
tgaaccacatcttgctctgct

SEQ ID NO: 4974445 - DNA, 23 bp, Homo sapiens
tgaaccacatcttgctctgctga

SEQ ID NO: 4974446 - DNA, 17 bp, Homo sapiens
tgaaccaccacacccag

SEQ ID NO: 4974447 - DNA, 15 bp, Homo sapiens
tgaacccttgcttgc

SEQ ID NO: 4974448 - DNA, 19 bp, Homo sapiens
tgaacctgtgagtaaatat

SEQ ID NO: 4974449 - DNA, 23 bp, Homo sapiens
tgaacctgtgagtaaatattgag

SEQ ID NO: 4974450 - DNA, 14 bp, Homo sapiens
tgaactaagaaact

SEQ ID NO: 4974451 - DNA, 18 bp, Homo sapiens
tgaactaagaaacttttg

SEQ ID NO: 4974452 - DNA, 20 bp, Homo sapiens
tgaactcactttcctcctga

SEQ ID NO: 4974453 - DNA, 15 bp, Homo sapiens
tgaactcctggcctc

SEQ ID NO: 4974454 - DNA, 18 bp, Homo sapiens
tgaactctgaactttgga

SEQ ID NO: 4974455 - DNA, 12 bp, Homo sapiens
tgaactcttaga

SEQ ID NO: 4974456 - DNA, 19 bp, Homo sapiens
tgaactgggtacttgtgga

SEQ ID NO: 4974457 - DNA, 23 bp, Homo sapiens
tgaactgggtacttgtggacaca

SEQ ID NO: 4974458 - DNA, 18 bp, Homo sapiens
tgaacttctctcagactt

SEQ ID NO: 4974459 - DNA, 14 bp, Homo sapiens
tgaacttgtagctg

SEQ ID NO: 4974460 - DNA, 22 bp, Homo sapiens
tgaactttctcttcatactttt

SEQ ID NO: 4974461 - DNA, 14 bp, Homo sapiens
tgaagaacatgtga

SEQ ID NO: 4974462 - DNA, 21 bp, Homo sapiens
tgaagaaggtggaccttttaa

SEQ ID NO: 4974463 - DNA, 23 bp, Homo sapiens
tgaagaaggtggaccttttaaag

SEQ ID NO: 4974464 - DNA, 11 bp, Homo sapiens
tgaagaattaa

SEQ ID NO: 4974465 - DNA, 22 bp, Homo sapiens
tgaagacaatttgatacataat

SEQ ID NO: 4974466 - DNA, 20 bp, Homo sapiens
tgaagactcattcttctgta

SEQ ID NO: 4974467 - DNA, 19 bp, Homo sapiens
tgaagagaagcaattttgg

SEQ ID NO: 4974468 - DNA, 17 bp, Homo sapiens
tgaagagacagttattt

SEQ ID NO: 4974469 - DNA, 16 bp, Homo sapiens
tgaagagcaaaaatat

SEQ ID NO: 4974470 - DNA, 16 bp, Homo sapiens
tgaagagcttgctttg

SEQ ID NO: 4974471 - DNA, 18 bp, Homo sapiens
tgaagagcttgctttgat

SEQ ID NO: 4974472 - DNA, 19 bp, Homo sapiens
tgaagagcttgctttgatt

SEQ ID NO: 4974473 - DNA, 15 bp, Homo sapiens
tgacaggtaaactat

SEQ ID NO: 4974474 - DNA, 13 bp, Homo sapiens
tgacagtcatcat

SEQ ID NO: 4974475 - DNA, 15 bp, Homo sapiens
tgacagtcttgtgct

SEQ ID NO: 4974476 - DNA, 16 bp, Homo sapiens
tgacagttctgaagaa

SEQ ID NO: 4974477 - DNA, 17 bp, Homo sapiens
tgacagttctgaagaat

SEQ ID NO: 4974478 - DNA, 18 bp, Homo sapiens
tgacatcacagcagcctc

SEQ ID NO: 4974479 - DNA, 20 bp, Homo sapiens
tgacatcacttgtacaaaat

SEQ ID NO: 4974480 - DNA, 23 bp, Homo sapiens
tgacatcacttgtacaaaataaa

SEQ ID NO: 4974481 - DNA, 14 bp, Homo sapiens
tgacatctcagggg

SEQ ID NO: 4974482 - DNA, 15 bp, Homo sapiens
tgacatctcaggggc

SEQ ID NO: 4974483 - DNA, 18 bp, Homo sapiens
tgacatctcaggggccag

SEQ ID NO: 4974484 - DNA, 19 bp, Homo sapiens
tgacatctcaggggccaga

SEQ ID NO: 4974485 - DNA, 13 bp, Homo sapiens
tgacatgcactga

SEQ ID NO: 4974486 - DNA, 21 bp, Homo sapiens
tgacatgcactgacccttcca

SEQ ID NO: 4974487 - DNA, 13 bp, Homo sapiens
tgacatgtgaaac

SEQ ID NO: 4974488 - DNA, 17 bp, Homo sapiens
tgacatgtgaaaccttt

SEQ ID NO: 4974489 - DNA, 18 bp, Homo sapiens
tgacatgttatatatttt

SEQ ID NO: 4974490 - DNA, 15 bp, Homo sapiens
tgacattaagaatgt

SEQ ID NO: 4974491 - DNA, 21 bp, Homo sapiens
tgacattaagaatgttggttt

SEQ ID NO: 4974492 - DNA, 20 bp, Homo sapiens
tgacattatgtggttttaga

SEQ ID NO: 4974493 - DNA, 22 bp, Homo sapiens
tgacattgtagagcttctggca

SEQ ID NO: 4974494 - DNA, 16 bp, Homo sapiens
tgacatttaatttagt

SEQ ID NO: 4974495 - DNA, 23 bp, Homo sapiens
tgacatttaatttagtgatctta

SEQ ID NO: 4974496 - DNA, 17 bp, Homo sapiens
tgacatttgtagttgag

SEQ ID NO: 4974497 - DNA, 12 bp, Homo sapiens
tgacattttaca

SEQ ID NO: 4974498 - DNA, 14 bp, Homo sapiens
tgacattttacatt

SEQ ID NO: 4974499 - DNA, 16 bp, Homo sapiens
tgacattttacattaa

SEQ ID NO: 4974500 - DNA, 14 bp, Homo sapiens
tgaccaaagtcctt

SEQ ID NO: 4974501 - DNA, 16 bp, Homo sapiens
tgaccaaagtcctttt

SEQ ID NO: 4974502 - DNA, 13 bp, Homo sapiens
tgaccaactgtgt

SEQ ID NO: 4974503 - DNA, 15 bp, Homo sapiens
tgaccaactgtgttg

SEQ ID NO: 4974504 - DNA, 18 bp, Homo sapiens
tgaccaactgtgttgtat

SEQ ID NO: 4974505 - DNA, 18 bp, Homo sapiens
tgaccaattgtgctgcca

SEQ ID NO: 4974506 - DNA, 22 bp, Homo sapiens
tgaccagcctccatgctgcctc

SEQ ID NO: 4974507 - DNA, 16 bp, Homo sapiens
tgaccatactgaggga

SEQ ID NO: 4974508 - DNA, 22 bp, Homo sapiens
tgaccatccactctaccctccc

SEQ ID NO: 4974509 - DNA, 14 bp, Homo sapiens
tgaccatctgcttt

SEQ ID NO: 4974510 - DNA, 13 bp, Homo sapiens
tgacccagtgaga

SEQ ID NO: 4974511 - DNA, 23 bp, Homo sapiens
tgaccccggtggcggccccagca

SEQ ID NO: 4974512 - DNA, 21 bp, Homo sapiens
tgacccctcctcactggccat

SEQ ID NO: 4974513 - DNA, 15 bp, Homo sapiens
tgaccctgaagtgag

SEQ ID NO: 4974514 - DNA, 20 bp, Homo sapiens
tgacccttccagacatacga

SEQ ID NO: 4974515 - DNA, 19 bp, Homo sapiens
tgacccttcccaatcagca

SEQ ID NO: 4974516 - DNA, 23 bp, Homo sapiens
tgacccttcccaatcagcactga

SEQ ID NO: 4974517 - DNA, 20 bp, Homo sapiens
tgacctcaagtgatctgccc

SEQ ID NO: 4974518 - DNA, 14 bp, Homo sapiens
tgacctcactgtga

SEQ ID NO: 4974519 - DNA, 19 bp, Homo sapiens
tgacctcaggcactagcct

SEQ ID NO: 4974520 - DNA, 18 bp, Homo sapiens
tgacctcgtgatccaccc

SEQ ID NO: 4974521 - DNA, 12 bp, Homo sapiens
tgacctctgcct

SEQ ID NO: 4974522 - DNA, 14 bp, Homo sapiens
tgacctctgcctga

SEQ ID NO: 4974523 - DNA, 12 bp, Homo sapiens
tgacctcttgct

SEQ ID NO: 4974524 - DNA, 14 bp, Homo sapiens
tgacctcttgctgt

SEQ ID NO: 4974525 - DNA, 15 bp, Homo sapiens
tgacctcttgctgtc

SEQ ID NO: 4974526 - DNA, 17 bp, Homo sapiens
tgacctcttgctgtctc

SEQ ID NO: 4974527 - DNA, 19 bp, Homo sapiens
tgacctcttgctgtctctg

SEQ ID NO: 4974528 - DNA, 21 bp, Homo sapiens
tgacctcttgctgtctctgct

SEQ ID NO: 4974529 - DNA, 18 bp, Homo sapiens
tgacctgcctctcacaca

SEQ ID NO: 4974530 - DNA, 21 bp, Homo sapiens
tgacctgcctctcacacacat

SEQ ID NO: 4974531 - DNA, 21 bp, Homo sapiens
tgacctgctgggtaaactgtg

SEQ ID NO: 4974532 - DNA, 22 bp, Homo sapiens
tgacctggataacttaggtggc

SEQ ID NO: 4974533 - DNA, 16 bp, Homo sapiens
tgaccttcctctgggg

SEQ ID NO: 4974534 - DNA, 18 bp, Homo sapiens
tgaccttcctctggggct

SEQ ID NO: 4974535 - DNA, 14 bp, Homo sapiens
tgaccttccttcct

SEQ ID NO: 4974536 - DNA, 17 bp, Homo sapiens
tgaccttggagagacac

SEQ ID NO: 4974537 - DNA, 19 bp, Homo sapiens
tgaccttggagagacacag

SEQ ID NO: 4974538 - DNA, 20 bp, Homo sapiens
tgaccttggagagacacagc

SEQ ID NO: 4974539 - DNA, 15 bp, Homo sapiens
tgacgctgatacata

SEQ ID NO: 4974540 - DNA, 21 bp, Homo sapiens
tgacgctgatacataactaaa

SEQ ID NO: 4974541 - DNA, 14 bp, Homo sapiens
tgacggccctgcaa

SEQ ID NO: 4974542 - DNA, 15 bp, Homo sapiens
tgacggtgacaaaga

SEQ ID NO: 4974543 - DNA, 14 bp, Homo sapiens
tgacgtctgaagct

SEQ ID NO: 4974544 - DNA, 15 bp, Homo sapiens
tgactaaattcgtga

SEQ ID NO: 4974545 - DNA, 13 bp, Homo sapiens
tgactaaatttgg

SEQ ID NO: 4974546 - DNA, 14 bp, Homo sapiens
tgactaattagggt

SEQ ID NO: 4974547 - DNA, 17 bp, Homo sapiens
tgactagggattcaggc

SEQ ID NO: 4974548 - DNA, 19 bp, Homo sapiens
tgactagggattcaggctg

SEQ ID NO: 4974549 - DNA, 21 bp, Homo sapiens
tgactagggattcaggctgct

SEQ ID NO: 4974550 - DNA, 23 bp, Homo sapiens
tgactagggattcaggctgcttg

SEQ ID NO: 4974551 - DNA, 14 bp, Homo sapiens
tgagaagccttcag

SEQ ID NO: 4974552 - DNA, 19 bp, Homo sapiens
tgagaagccttcagctcca

SEQ ID NO: 4974553 - DNA, 20 bp, Homo sapiens
tgagaagccttcagctccag

SEQ ID NO: 4974554 - DNA, 15 bp, Homo sapiens
tgagaagctgctcca

SEQ ID NO: 4974555 - DNA, 12 bp, Homo sapiens
tgagaaggagag

SEQ ID NO: 4974556 - DNA, 15 bp, Homo sapiens
tgagaaggagagaaa

SEQ ID NO: 4974557 - DNA, 22 bp, Homo sapiens
tgagaaggagtcagaaactgtt

SEQ ID NO: 4974558 - DNA, 14 bp, Homo sapiens
tgagaaggcagcca

SEQ ID NO: 4974559 - DNA, 21 bp, Homo sapiens
tgagaatcccaaatttgattg

SEQ ID NO: 4974560 - DNA, 16 bp, Homo sapiens
tgagacaaaattttag

SEQ ID NO: 4974561 - DNA, 22 bp, Homo sapiens
tgagacacggagcccagccctc

SEQ ID NO: 4974562 - DNA, 21 bp, Homo sapiens
tgagacagagttttcactctt

SEQ ID NO: 4974563 - DNA, 15 bp, Homo sapiens
tgagacagtttctta

SEQ ID NO: 4974564 - DNA, 18 bp, Homo sapiens
tgagacagtttcttagct

SEQ ID NO: 4974565 - DNA, 20 bp, Homo sapiens
tgagacagtttcttagcttt

SEQ ID NO: 4974566 - DNA, 16 bp, Homo sapiens
tgagacccccacacct

SEQ ID NO: 4974567 - DNA, 21 bp, Homo sapiens
tgagactctagggtccagtgg

SEQ ID NO: 4974568 - DNA, 18 bp, Homo sapiens
tgagactgggtctcgctt

SEQ ID NO: 4974569 - DNA, 16 bp, Homo sapiens
tgagagaattggctca

SEQ ID NO: 4974570 - DNA, 12 bp, Homo sapiens
tgagagactttt

SEQ ID NO: 4974571 - DNA, 23 bp, Homo sapiens
tgagagagatgggagctcctctc

SEQ ID NO: 4974572 - DNA, 20 bp, Homo sapiens
tgagagcccagaggtaacag

SEQ ID NO: 4974573 - DNA, 14 bp, Homo sapiens
tgagaggtttgact

SEQ ID NO: 4974574 - DNA, 15 bp, Homo sapiens
tgagagtctagattc

SEQ ID NO: 4974575 - DNA, 21 bp, Homo sapiens
tgagagtgtctctgataaaag

SEQ ID NO: 4974576 - DNA, 16 bp, Homo sapiens
tgagatcccctgagcc

SEQ ID NO: 4974577 - DNA, 23 bp, Homo sapiens
tgagatgagggatgggcctggca

SEQ ID NO: 4974578 - DNA, 22 bp, Homo sapiens
tgagatgcgttgttacaggaag

SEQ ID NO: 4974579 - DNA, 23 bp, Homo sapiens
tgagatgctggagaagagaggag

SEQ ID NO: 4974580 - DNA, 15 bp, Homo sapiens
tgagattacagagga

SEQ ID NO: 4974581 - DNA, 16 bp, Homo sapiens
tgagattacaggcatg

SEQ ID NO: 4974582 - DNA, 17 bp, Homo sapiens
tgagattggcatggctt

SEQ ID NO: 4974583 - DNA, 17 bp, Homo sapiens
tgagatttcctcctggc

SEQ ID NO: 4974584 - DNA, 14 bp, Homo sapiens
tgagattttggtat

SEQ ID NO: 4974585 - DNA, 16 bp, Homo sapiens
tgagattttttattgc

SEQ ID NO: 4974586 - DNA, 18 bp, Homo sapiens
tgagattttttattgcta

SEQ ID NO: 4974587 - DNA, 19 bp, Homo sapiens
tgagattttttattgctag

SEQ ID NO: 4974588 - DNA, 19 bp, Homo sapiens
tgagcaaatgtggctcctg

SEQ ID NO: 4974589 - DNA, 23 bp, Homo sapiens
tgagcaaggagcacaagccacaa

SEQ ID NO: 4974590 - DNA, 23 bp, Homo sapiens
tgagcactaaggtgtgctctgat

SEQ ID NO: 4974591 - DNA, 14 bp, Homo sapiens
tgagcagaaggaaa

SEQ ID NO: 4974592 - DNA, 18 bp, Homo sapiens
tgagcaggaaggcctggg

SEQ ID NO: 4974593 - DNA, 12 bp, Homo sapiens
tgagcagggctc

SEQ ID NO: 4974594 - DNA, 17 bp, Homo sapiens
tgagcagggctcagcgg

SEQ ID NO: 4974595 - DNA, 15 bp, Homo sapiens
tgagcagtgagcaga

SEQ ID NO: 4974596 - DNA, 16 bp, Homo sapiens
tgagcatcctgagccc

SEQ ID NO: 4974597 - DNA, 17 bp, Homo sapiens
tgagcatcctgagcccc

SEQ ID NO: 4974598 - DNA, 18 bp, Homo sapiens
tgagcatcctgagccccg

SEQ ID NO: 4974599 - DNA, 18 bp, Homo sapiens
tgagcatgtaaaagcgga

SEQ ID NO: 4974600 - DNA, 21 bp, Homo sapiens
tgagccactgcaccgggccac

SEQ ID NO: 4974601 - DNA, 23 bp, Homo sapiens
tgagccactgcaccgggccacag

SEQ ID NO: 4974602 - DNA, 21 bp, Homo sapiens
tgagccagtgctttaatggca

SEQ ID NO: 4974603 - DNA, 13 bp, Homo sapiens
tgagcccagagaa

SEQ ID NO: 4974604 - DNA, 17 bp, Homo sapiens
tgagcccagagaacagc

SEQ ID NO: 4974605 - DNA, 18 bp, Homo sapiens
tgagcccatgttctgccc

SEQ ID NO: 4974606 - DNA, 14 bp, Homo sapiens
tgagccccgccctc

SEQ ID NO: 4974607 - DNA, 21 bp, Homo sapiens
tgagccccgccctcttcctga

SEQ ID NO: 4974608 - DNA, 19 bp, Homo sapiens
tgagccgagatcacgccac

SEQ ID NO: 4974609 - DNA, 21 bp, Homo sapiens
tgagccgagatcacgccactg

SEQ ID NO: 4974610 - DNA, 13 bp, Homo sapiens
tgagcctcagcat

SEQ ID NO: 4974611 - DNA, 18 bp, Homo sapiens
tgagccttcgtgcccccc

SEQ ID NO: 4974612 - DNA, 16 bp, Homo sapiens
tgagcgggaggcagag

SEQ ID NO: 4974613 - DNA, 17 bp, Homo sapiens
tgagctgatataaattc

SEQ ID NO: 4974614 - DNA, 18 bp, Homo sapiens
tgagctggcctctctagc

SEQ ID NO: 4974615 - DNA, 17 bp, Homo sapiens
tgaggaactgtacagaa

SEQ ID NO: 4974616 - DNA, 14 bp, Homo sapiens
tgaggaattttctt

SEQ ID NO: 4974617 - DNA, 22 bp, Homo sapiens
tgaggacaaagtggaggagggc

SEQ ID NO: 4974618 - DNA, 22 bp, Homo sapiens
tgaggagcccatactcagcctg

SEQ ID NO: 4974619 - DNA, 23 bp, Homo sapiens
tgaggagcccatactcagcctgc

SEQ ID NO: 4974620 - DNA, 20 bp, Homo sapiens
tgaggaggatgtccctgggc

SEQ ID NO: 4974621 - DNA, 23 bp, Homo sapiens
tgaggaggatgtccctgggccag

SEQ ID NO: 4974622 - DNA, 14 bp, Homo sapiens
tgaggaggcctcca

SEQ ID NO: 4974623 - DNA, 16 bp, Homo sapiens
tgaggaggcctccatc

SEQ ID NO: 4974624 - DNA, 20 bp, Homo sapiens
tgaggcaacctgattgtaaa

SEQ ID NO: 4974625 - DNA, 16 bp, Homo sapiens
tgaggcaagtgtgggc

SEQ ID NO: 4974626 - DNA, 16 bp, Homo sapiens
tgaggcaatgtcagga

SEQ ID NO: 4974627 - DNA, 17 bp, Homo sapiens
tgaggcaatgtcaggaa

SEQ ID NO: 4974628 - DNA, 13 bp, Homo sapiens
tgaggccaggagt

SEQ ID NO: 4974629 - DNA, 14 bp, Homo sapiens
tgaggccctgccca

SEQ ID NO: 4974630 - DNA, 13 bp, Homo sapiens
tgaggctttggat

SEQ ID NO: 4974631 - DNA, 18 bp, Homo sapiens
tgaggctttggatttgac

SEQ ID NO: 4974632 - DNA, 14 bp, Homo sapiens
tgaggctttgtgtt

SEQ ID NO: 4974633 - DNA, 22 bp, Homo sapiens
tgagggacgtcagacttggctc

SEQ ID NO: 4974634 - DNA, 19 bp, Homo sapiens
tgagggaggacctggggca

SEQ ID NO: 4974635 - DNA, 17 bp, Homo sapiens
tgagggatgggcctggc

SEQ ID NO: 4974636 - DNA, 12 bp, Homo sapiens
tgagggcccaga

SEQ ID NO: 4974637 - DNA, 20 bp, Homo sapiens
tgagggcccagagcaggaag

SEQ ID NO: 4974638 - DNA, 20 bp, Homo sapiens
tgagggttgggctggtgtca

SEQ ID NO: 4974639 - DNA, 15 bp, Homo sapiens
tgaggtcagggagtg

SEQ ID NO: 4974640 - DNA, 16 bp, Homo sapiens
tgaggtcccaggaagt

SEQ ID NO: 4974641 - DNA, 14 bp, Homo sapiens
tgaggtctgtttaa

SEQ ID NO: 4974642 - DNA, 14 bp, Homo sapiens
tgaggtgcctgtcc

SEQ ID NO: 4974643 - DNA, 15 bp, Homo sapiens
tgaggtgcctgtccc

SEQ ID NO: 4974644 - DNA, 15 bp, Homo sapiens
tgagtaactattatt

SEQ ID NO: 4974645 - DNA, 14 bp, Homo sapiens
tgagtagatattac

SEQ ID NO: 4974646 - DNA, 15 bp, Homo sapiens
tgagtagatattact

SEQ ID NO: 4974647 - DNA, 20 bp, Homo sapiens
tgagtatggagcagcctgga

SEQ ID NO: 4974648 - DNA, 14 bp, Homo sapiens
tgagtcaccaagcc

SEQ ID NO: 4974649 - DNA, 22 bp, Homo sapiens
tgagtcaccctacctgtgcctg

SEQ ID NO: 4974650 - DNA, 15 bp, Homo sapiens
tgagtcagggcccag

SEQ ID NO: 4974651 - DNA, 13 bp, Homo sapiens
tgagtcatttaaa

SEQ ID NO: 4974652 - DNA, 16 bp, Homo sapiens
tgagtcatttaaatgt

SEQ ID NO: 4974653 - DNA, 20 bp, Homo sapiens
tgagtcccccagagatgtca

SEQ ID NO: 4974654 - DNA, 16 bp, Homo sapiens
tgagtcgaggacaggg

SEQ ID NO: 4974655 - DNA, 18 bp, Homo sapiens
tgagtcgaggacagggag

SEQ ID NO: 4974656 - DNA, 16 bp, Homo sapiens
tgagtctttggttcta

SEQ ID NO: 4974657 - DNA, 15 bp, Homo sapiens
tgagtggccagggaa

SEQ ID NO: 4974658 - DNA, 17 bp, Homo sapiens
tgagtggccagggaatc

SEQ ID NO: 4974659 - DNA, 15 bp, Homo sapiens
tgagtgggagaaggc

SEQ ID NO: 4974660 - DNA, 22 bp, Homo sapiens
tgagtggggttatctctgtgtt

SEQ ID NO: 4974661 - DNA, 12 bp, Homo sapiens
tgagtgtgacag

SEQ ID NO: 4974662 - DNA, 16 bp, Homo sapiens
tgagtgtgtgtgtgca

SEQ ID NO: 4974663 - DNA, 15 bp, Homo sapiens
tgagttatgatgtaa

SEQ ID NO: 4974664 - DNA, 16 bp, Homo sapiens
tgagttatgttaaaat

SEQ ID NO: 4974665 - DNA, 22 bp, Homo sapiens
tgagttattccttgatcatttt

SEQ ID NO: 4974666 - DNA, 22 bp, Homo sapiens
tgagttctacataagtaattca

SEQ ID NO: 4974667 - DNA, 18 bp, Homo sapiens
tgagttgccaagacaaat

SEQ ID NO: 4974668 - DNA, 18 bp, Homo sapiens
tgagtttcattctcctgc

SEQ ID NO: 4974669 - DNA, 14 bp, Homo sapiens
tgagtttgccctgg

SEQ ID NO: 4974670 - DNA, 18 bp, Homo sapiens
tgagtttggtctggactg

SEQ ID NO: 4974671 - DNA, 18 bp, Homo sapiens
tgagtttgtaggtaaaat

SEQ ID NO: 4974672 - DNA, 18 bp, Homo sapiens
tgataaaacaacagctcg

SEQ ID NO: 4974673 - DNA, 16 bp, Homo sapiens
tgataacagaactttt

SEQ ID NO: 4974674 - DNA, 13 bp, Homo sapiens
tgataataaattg

SEQ ID NO: 4974675 - DNA, 18 bp, Homo sapiens
tgataataaattgaaatt

SEQ ID NO: 4974676 - DNA, 18 bp, Homo sapiens
tgataataatattgtttt

SEQ ID NO: 4974677 - DNA, 15 bp, Homo sapiens
tgataatgttaaatt

SEQ ID NO: 4974678 - DNA, 16 bp, Homo sapiens
tgataatgttaaattt

SEQ ID NO: 4974679 - DNA, 21 bp, Homo sapiens
tgataatgttaaatttgtaag

SEQ ID NO: 4974680 - DNA, 13 bp, Homo sapiens
tgataatttaaga

SEQ ID NO: 4974681 - DNA, 17 bp, Homo sapiens
tgatacaagattagaag

SEQ ID NO: 4974682 - DNA, 22 bp, Homo sapiens
tgatacataactaaatttgata

SEQ ID NO: 4974683 - DNA, 17 bp, Homo sapiens
tgataccagaagggaaa

SEQ ID NO: 4974684 - DNA, 15 bp, Homo sapiens
tgatacccctgggga

SEQ ID NO: 4974685 - DNA, 22 bp, Homo sapiens
tgatacccctggggaacatttc

SEQ ID NO: 4974686 - DNA, 19 bp, Homo sapiens
tgatacgcaacataattaa

SEQ ID NO: 4974687 - DNA, 17 bp, Homo sapiens
tgatactaaaagttctt

SEQ ID NO: 4974688 - DNA, 18 bp, Homo sapiens
tgatactatccagttact

SEQ ID NO: 4974689 - DNA, 20 bp, Homo sapiens
tgatactctttctaatgctg

SEQ ID NO: 4974690 - DNA, 13 bp, Homo sapiens
tgatactgatggt

SEQ ID NO: 4974691 - DNA, 15 bp, Homo sapiens
tgatacttatatttt

SEQ ID NO: 4974692 - DNA, 14 bp, Homo sapiens
tgatacttcactac

SEQ ID NO: 4974693 - DNA, 12 bp, Homo sapiens
tgatataaattc

SEQ ID NO: 4974694 - DNA, 13 bp, Homo sapiens
tgatataaattct

SEQ ID NO: 4974695 - DNA, 15 bp, Homo sapiens
tgatataaattctgt

SEQ ID NO: 4974696 - DNA, 17 bp, Homo sapiens
tgatataaattctgtgg

SEQ ID NO: 4974697 - DNA, 16 bp, Homo sapiens
tgatatatattataaa

SEQ ID NO: 4974698 - DNA, 14 bp, Homo sapiens
tgatatattttcca

SEQ ID NO: 4974699 - DNA, 12 bp, Homo sapiens
tgatatccctga

SEQ ID NO: 4974700 - DNA, 16 bp, Homo sapiens
tgatatgagtatacaa

SEQ ID NO: 4974701 - DNA, 18 bp, Homo sapiens
tgatatggcagaagacac

SEQ ID NO: 4974702 - DNA, 12 bp, Homo sapiens
tgatattctaag

SEQ ID NO: 4974703 - DNA, 22 bp, Homo sapiens
tgatcaattatagtttctgagg

SEQ ID NO: 4974704 - DNA, 16 bp, Homo sapiens
tgatcacgcctggcta

SEQ ID NO: 4974705 - DNA, 19 bp, Homo sapiens
tgatcacggctcactgcag

SEQ ID NO: 4974706 - DNA, 21 bp, Homo sapiens
tgatcacggctcactgcagcc

SEQ ID NO: 4974707 - DNA, 13 bp, Homo sapiens
tgatcatttattt

SEQ ID NO: 4974708 - DNA, 16 bp, Homo sapiens
tgatcattttcccccc

SEQ ID NO: 4974709 - DNA, 20 bp, Homo sapiens
tgatcattttccccccactc

SEQ ID NO: 4974710 - DNA, 17 bp, Homo sapiens
tgatccaagctggtccc

SEQ ID NO: 4974711 - DNA, 15 bp, Homo sapiens
tgatccacccaaccc

SEQ ID NO: 4974712 - DNA, 15 bp, Homo sapiens
tgatccacccacctc

SEQ ID NO: 4974713 - DNA, 16 bp, Homo sapiens
tgatccacccacctca

SEQ ID NO: 4974714 - DNA, 17 bp, Homo sapiens
tgatccacccacctcag

SEQ ID NO: 4974715 - DNA, 18 bp, Homo sapiens
tgatccacccacctcagc

SEQ ID NO: 4974716 - DNA, 19 bp, Homo sapiens
tgatccacccacctcagcc

SEQ ID NO: 4974717 - DNA, 20 bp, Homo sapiens
tgatcctaactgaagagaca

SEQ ID NO: 4974718 - DNA, 18 bp, Homo sapiens
tgatcctcccacctcagc

SEQ ID NO: 4974719 - DNA, 20 bp, Homo sapiens
tgatcctcccacctcagcct

SEQ ID NO: 4974720 - DNA, 13 bp, Homo sapiens
tgatctgtcttgt

SEQ ID NO: 4974721 - DNA, 15 bp, Homo sapiens
tgatctgtcttgtaa

SEQ ID NO: 4974722 - DNA, 19 bp, Homo sapiens
tgatctgtcttgtaatatt

SEQ ID NO: 4974723 - DNA, 23 bp, Homo sapiens
tgatctttgcagacaggcaagca

SEQ ID NO: 4974724 - DNA, 18 bp, Homo sapiens
tgatcttttaaagtgtta

SEQ ID NO: 4974725 - DNA, 19 bp, Homo sapiens
tgatcttttaaagtgttac

SEQ ID NO: 4974726 - DNA, 14 bp, Homo sapiens
tgatgaactttctc

SEQ ID NO: 4974727 - DNA, 14 bp, Homo sapiens
tgatgatgaaaatt

SEQ ID NO: 4974728 - DNA, 14 bp, Homo sapiens
tgatgatgtaattg

SEQ ID NO: 4974729 - DNA, 13 bp, Homo sapiens
tgatgcacagaga

SEQ ID NO: 4974730 - DNA, 20 bp, Homo sapiens
tgatgcacagagaagctggg

SEQ ID NO: 4974731 - DNA, 14 bp, Homo sapiens
tgatgcagcatttg

SEQ ID NO: 4974732 - DNA, 15 bp, Homo sapiens
tgatgcagcatttga

SEQ ID NO: 4974733 - DNA, 13 bp, Homo sapiens
tgatgcaggcact

SEQ ID NO: 4974734 - DNA, 21 bp, Homo sapiens
tgatgcagtctcctctttaaa

SEQ ID NO: 4974735 - DNA, 11 bp, Homo sapiens
tgatgcatgtg

SEQ ID NO: 4974736 - DNA, 15 bp, Homo sapiens
tgatgccgtgatcct

SEQ ID NO: 4974737 - DNA, 17 bp, Homo sapiens
tgatgctccctcccctg

SEQ ID NO: 4974738 - DNA, 20 bp, Homo sapiens
tgatgctccctcccctgccc

SEQ ID NO: 4974739 - DNA, 22 bp, Homo sapiens
tgatgctccctcccctgccctg

SEQ ID NO: 4974740 - DNA, 23 bp, Homo sapiens
tgatgctccctcccctgccctgg

SEQ ID NO: 4974741 - DNA, 22 bp, Homo sapiens
tgatggcaccactgcactccag

SEQ ID NO: 4974742 - DNA, 20 bp, Homo sapiens
tgatgtaccatgaaacaaag

SEQ ID NO: 4974743 - DNA, 13 bp, Homo sapiens
tgatgtattctag

SEQ ID NO: 4974744 - DNA, 21 bp, Homo sapiens
tgatgtattctagctaatgta

SEQ ID NO: 4974745 - DNA, 16 bp, Homo sapiens
tgatgtgacaataata

SEQ ID NO: 4974746 - DNA, 18 bp, Homo sapiens
tgatgtgacaataatatt

SEQ ID NO: 4974747 - DNA, 17 bp, Homo sapiens
tgatgttctaaggctct

SEQ ID NO: 4974748 - DNA, 11 bp, Homo sapiens
tgatgtttgtg

SEQ ID NO: 4974749 - DNA, 19 bp, Homo sapiens
tgatgtttgtggcctcaga

SEQ ID NO: 4974750 - DNA, 14 bp, Homo sapiens
tgattattgcagaa

SEQ ID NO: 4974751 - DNA, 13 bp, Homo sapiens
tgattattttctt

SEQ ID NO: 4974752 - DNA, 12 bp, Homo sapiens
tgattcactgca

SEQ ID NO: 4974753 - DNA, 14 bp, Homo sapiens
tgattcagaaattg

SEQ ID NO: 4974754 - DNA, 16 bp, Homo sapiens
tgattcagaaattgga

SEQ ID NO: 4974755 - DNA, 19 bp, Homo sapiens
tgattcatgccaattagca

SEQ ID NO: 4974756 - DNA, 21 bp, Homo sapiens
tgattcccaagctctgctcct

SEQ ID NO: 4974757 - DNA, 23 bp, Homo sapiens
tgattcccaagctctgctcctct

SEQ ID NO: 4974758 - DNA, 23 bp, Homo sapiens
tgattcctaagccacttgaaatg

SEQ ID NO: 4974759 - DNA, 17 bp, Homo sapiens
tgattctaatgtcttca

SEQ ID NO: 4974760 - DNA, 19 bp, Homo sapiens
tgattctaatgtcttcatt

SEQ ID NO: 4974761 - DNA, 19 bp, Homo sapiens
tgattctcctgcctcagcc

SEQ ID NO: 4974762 - DNA, 21 bp, Homo sapiens
tgattctcctgcctcagcctc

SEQ ID NO: 4974763 - DNA, 19 bp, Homo sapiens
tgattctccttttatgtgt

SEQ ID NO: 4974764 - DNA, 22 bp, Homo sapiens
tgattggacaggcatgggtgca

SEQ ID NO: 4974765 - DNA, 16 bp, Homo sapiens
tgattggaccaggcca

SEQ ID NO: 4974766 - DNA, 16 bp, Homo sapiens
tgattggcttgtagaa

SEQ ID NO: 4974767 - DNA, 21 bp, Homo sapiens
tgattggcttgtagaattgtt

SEQ ID NO: 4974768 - DNA, 14 bp, Homo sapiens
tgattgtggaatgg

SEQ ID NO: 4974769 - DNA, 14 bp, Homo sapiens
tgatttaataaaat

SEQ ID NO: 4974770 - DNA, 17 bp, Homo sapiens
tgatttaataaaataat

SEQ ID NO: 4974771 - DNA, 19 bp, Homo sapiens
tgatttaataaaataattc

SEQ ID NO: 4974772 - DNA, 23 bp, Homo sapiens
tgatttaataaaataattctaaa

SEQ ID NO: 4974773 - DNA, 19 bp, Homo sapiens
tgatttacagcaagtagat

SEQ ID NO: 4974774 - DNA, 13 bp, Homo sapiens
tgatttatgcatg

SEQ ID NO: 4974775 - DNA, 19 bp, Homo sapiens
tgatttccttgaatgtggc

SEQ ID NO: 4974776 - DNA, 23 bp, Homo sapiens
tgatttccttgaatgtggcttga

SEQ ID NO: 4974777 - DNA, 14 bp, Homo sapiens
tgatttctattcaa

SEQ ID NO: 4974778 - DNA, 20 bp, Homo sapiens
tgatttctattcaaggtggc

SEQ ID NO: 4974779 - DNA, 14 bp, Homo sapiens
tgatttgagttgat

SEQ ID NO: 4974780 - DNA, 12 bp, Homo sapiens
tgatttgcattg

SEQ ID NO: 4974781 - DNA, 14 bp, Homo sapiens
tgatttgcattgaa

SEQ ID NO: 4974782 - DNA, 21 bp, Homo sapiens
tgattttaatggattgttaat

SEQ ID NO: 4974783 - DNA, 20 bp, Homo sapiens
tgatttttagatgagattgt

SEQ ID NO: 4974784 - DNA, 16 bp, Homo sapiens
tgattttttaaaagaa

SEQ ID NO: 4974785 - DNA, 12 bp, Homo sapiens
tgcaaaaatgga

SEQ ID NO: 4974786 - DNA, 23 bp, Homo sapiens
tgcaaaagactaatttaaaaaat

SEQ ID NO: 4974787 - DNA, 12 bp, Homo sapiens
tgcaaaatggaa

SEQ ID NO: 4974788 - DNA, 21 bp, Homo sapiens
tgcaaaatttgatgccaggac

SEQ ID NO: 4974789 - DNA, 19 bp, Homo sapiens
tgcaaaatttttttaatct

SEQ ID NO: 4974790 - DNA, 15 bp, Homo sapiens
tgcaaacagaacagg

SEQ ID NO: 4974791 - DNA, 17 bp, Homo sapiens
tgcaaacagaacagggt

SEQ ID NO: 4974792 - DNA, 19 bp, Homo sapiens
tgcaaacagaacagggtca

SEQ ID NO: 4974793 - DNA, 21 bp, Homo sapiens
tgcaaagggtatcaggtgctg

SEQ ID NO: 4974794 - DNA, 14 bp, Homo sapiens
tgcaaattaacagt

SEQ ID NO: 4974795 - DNA, 14 bp, Homo sapiens
tgcaacaggctggg

SEQ ID NO: 4974796 - DNA, 20 bp, Homo sapiens
tgcaacaggctgggcttcag

SEQ ID NO: 4974797 - DNA, 15 bp, Homo sapiens
tgcaacatttacagt

SEQ ID NO: 4974798 - DNA, 15 bp, Homo sapiens
tgcaagagtgattgc

SEQ ID NO: 4974799 - DNA, 17 bp, Homo sapiens
tgcaagagtgattgcag

SEQ ID NO: 4974800 - DNA, 17 bp, Homo sapiens
tgcaaggaccaggactc

SEQ ID NO: 4974801 - DNA, 12 bp, Homo sapiens
tgcaaggcccac

SEQ ID NO: 4974802 - DNA, 15 bp, Homo sapiens
tgcaataacttctga

SEQ ID NO: 4974803 - DNA, 14 bp, Homo sapiens
tgcaatatctgaag

SEQ ID NO: 4974804 - DNA, 23 bp, Homo sapiens
tgcaatcatatgtgatctgtctt

SEQ ID NO: 4974805 - DNA, 19 bp, Homo sapiens
tgcaatcctgtctttctga

SEQ ID NO: 4974806 - DNA, 15 bp, Homo sapiens
tgcaatggcagcctt

SEQ ID NO: 4974807 - DNA, 15 bp, Homo sapiens
tgcaatgggcactgg

SEQ ID NO: 4974808 - DNA, 17 bp, Homo sapiens
tgcaattaggattttga

SEQ ID NO: 4974809 - DNA, 23 bp, Homo sapiens
tgcaattaggtttttccttattt

SEQ ID NO: 4974810 - DNA, 21 bp, Homo sapiens
tgcaattcaaaagttccaaga

SEQ ID NO: 4974811 - DNA, 14 bp, Homo sapiens
tgcaattcccctct

SEQ ID NO: 4974812 - DNA, 17 bp, Homo sapiens
tgcacaaggattgaaaa

SEQ ID NO: 4974813 - DNA, 19 bp, Homo sapiens
tgcacaaggattgaaaatt

SEQ ID NO: 4974814 - DNA, 21 bp, Homo sapiens
tgcacacacacacacatgcac

SEQ ID NO: 4974815 - DNA, 16 bp, Homo sapiens
tgcacacagaaatata

SEQ ID NO: 4974816 - DNA, 17 bp, Homo sapiens
tgcacacagaaatatat

SEQ ID NO: 4974817 - DNA, 18 bp, Homo sapiens
tgcacacagaaatatata

SEQ ID NO: 4974818 - DNA, 23 bp, Homo sapiens
tgcacacagaaatatatatacat

SEQ ID NO: 4974819 - DNA, 13 bp, Homo sapiens
tgcacagagaagc

SEQ ID NO: 4974820 - DNA, 17 bp, Homo sapiens
tgcacagagaagctggg

SEQ ID NO: 4974821 - DNA, 18 bp, Homo sapiens
tgcacagatatactttgt

SEQ ID NO: 4974822 - DNA, 10 bp, Homo sapiens
tgcacagctg

SEQ ID NO: 4974823 - DNA, 18 bp, Homo sapiens
tgcacaggatgctggcct

SEQ ID NO: 4974824 - DNA, 15 bp, Homo sapiens
tgcacagtgcatctc

SEQ ID NO: 4974825 - DNA, 13 bp, Homo sapiens
tgcacatccattc

SEQ ID NO: 4974826 - DNA, 23 bp, Homo sapiens
tgcacatgaatcccacccacatg

SEQ ID NO: 4974827 - DNA, 23 bp, Homo sapiens
tgcacatgtcttgtacatgtgta

SEQ ID NO: 4974828 - DNA, 17 bp, Homo sapiens
tgcacattgttgttttt

SEQ ID NO: 4974829 - DNA, 21 bp, Homo sapiens
tgcaccagagcaacctctcac

SEQ ID NO: 4974830 - DNA, 13 bp, Homo sapiens
tgcaccagccctt

SEQ ID NO: 4974831 - DNA, 16 bp, Homo sapiens
tgcacccttcttttct

SEQ ID NO: 4974832 - DNA, 22 bp, Homo sapiens
tgcaccgggccacagagaaagt

SEQ ID NO: 4974833 - DNA, 17 bp, Homo sapiens
tgcacctagctgtgcaa

SEQ ID NO: 4974834 - DNA, 21 bp, Homo sapiens
tgcaccttaccaactttctgt

SEQ ID NO: 4974835 - DNA, 14 bp, Homo sapiens
tgcaccttgtgtct

SEQ ID NO: 4974836 - DNA, 20 bp, Homo sapiens
tgcacgacgccctctcccca

SEQ ID NO: 4974837 - DNA, 19 bp, Homo sapiens
tgcacgtacacacacatac

SEQ ID NO: 4974838 - DNA, 20 bp, Homo sapiens
tgcacgtggagagctggtgc

SEQ ID NO: 4974839 - DNA, 15 bp, Homo sapiens
tgcacgttgcttcag

SEQ ID NO: 4974840 - DNA, 22 bp, Homo sapiens
tgcactaaagccagcctgacct

SEQ ID NO: 4974841 - DNA, 13 bp, Homo sapiens
tgcactaaatatg

SEQ ID NO: 4974842 - DNA, 17 bp, Homo sapiens
tgcactgacccttccag

SEQ ID NO: 4974843 - DNA, 16 bp, Homo sapiens
tgcactggggagcccg

SEQ ID NO: 4974844 - DNA, 21 bp, Homo sapiens
tgcacttaaggcactctgtta

SEQ ID NO: 4974845 - DNA, 20 bp, Homo sapiens
tgcacttgtgattatttatt

SEQ ID NO: 4974846 - DNA, 21 bp, Homo sapiens
tgcacttgtgattatttatta

SEQ ID NO: 4974847 - DNA, 13 bp, Homo sapiens
tgcagaactgcca

SEQ ID NO: 4974848 - DNA, 21 bp, Homo sapiens
tgcagaactgccattattttc

SEQ ID NO: 4974849 - DNA, 17 bp, Homo sapiens
tgcagagagccattttg

SEQ ID NO: 4974850 - DNA, 23 bp, Homo sapiens
tgcagagagccattttgtgaatg

SEQ ID NO: 4974851 - DNA, 15 bp, Homo sapiens
tgcagaggtcagact

SEQ ID NO: 4974852 - DNA, 18 bp, Homo sapiens
tgcagcacggacaataaa

SEQ ID NO: 4974853 - DNA, 22 bp, Homo sapiens
tgcagcaggagtggtgcagaca

SEQ ID NO: 4974854 - DNA, 16 bp, Homo sapiens
tgggagagcccctggg

SEQ ID NO: 4974855 - DNA, 19 bp, Homo sapiens
tgggagagcccctggggcc

SEQ ID NO: 4974856 - DNA, 23 bp, Homo sapiens
tgggagcaggagattgagaagga

SEQ ID NO: 4974857 - DNA, 19 bp, Homo sapiens
tgggagcagtccatgcatg

SEQ ID NO: 4974858 - DNA, 14 bp, Homo sapiens
tgggagccccaggg

SEQ ID NO: 4974859 - DNA, 13 bp, Homo sapiens
tgggagctcctct

SEQ ID NO: 4974860 - DNA, 22 bp, Homo sapiens
tgggagctcctctcctggagga

SEQ ID NO: 4974861 - DNA, 19 bp, Homo sapiens
tgggagctggttagaaatg

SEQ ID NO: 4974862 - DNA, 17 bp, Homo sapiens
tgggaggtcaggaaact

SEQ ID NO: 4974863 - DNA, 14 bp, Homo sapiens
tgggaggtcttgct

SEQ ID NO: 4974864 - DNA, 22 bp, Homo sapiens
tgggattacaagcgtgagccac

SEQ ID NO: 4974865 - DNA, 17 bp, Homo sapiens
tgggattcaggaatgtg

SEQ ID NO: 4974866 - DNA, 10 bp, Homo sapiens
tgggattgct

SEQ ID NO: 4974867 - DNA, 16 bp, Homo sapiens
tgggatttaatttcca

SEQ ID NO: 4974868 - DNA, 14 bp, Homo sapiens
tgggcaacagagca

SEQ ID NO: 4974869 - DNA, 19 bp, Homo sapiens
tgggcaatgatggcaattt

SEQ ID NO: 4974870 - DNA, 22 bp, Homo sapiens
tgggcactgggatgagccgctg

SEQ ID NO: 4974871 - DNA, 18 bp, Homo sapiens
tgggcagcaatttaaatg

SEQ ID NO: 4974872 - DNA, 16 bp, Homo sapiens
tgggcagcatagcaag

SEQ ID NO: 4974873 - DNA, 16 bp, Homo sapiens
tgggcagccaggctgc

SEQ ID NO: 4974874 - DNA, 19 bp, Homo sapiens
tgggcattgacaaatctgt

SEQ ID NO: 4974875 - DNA, 15 bp, Homo sapiens
tgggccactgtggtg

SEQ ID NO: 4974876 - DNA, 22 bp, Homo sapiens
tgggccagggtctgtgtgaatg

SEQ ID NO: 4974877 - DNA, 19 bp, Homo sapiens
tgggccatgtccaaagagg

SEQ ID NO: 4974878 - DNA, 22 bp, Homo sapiens
tgggcccaagacagatgcccca

SEQ ID NO: 4974879 - DNA, 14 bp, Homo sapiens
tgggcccagatctg

SEQ ID NO: 4974880 - DNA, 12 bp, Homo sapiens
tgggccccagct

SEQ ID NO: 4974881 - DNA, 22 bp, Homo sapiens
tgggcctcctgtgtgtgcgcct

SEQ ID NO: 4974882 - DNA, 18 bp, Homo sapiens
tgggcctgggctagggga

SEQ ID NO: 4974883 - DNA, 22 bp, Homo sapiens
tgggctaagtgatcctcccacc

SEQ ID NO: 4974884 - DNA, 16 bp, Homo sapiens
tgggctcccgtgtttt

SEQ ID NO: 4974885 - DNA, 21 bp, Homo sapiens
tgggctgaccccggtggcggc

SEQ ID NO: 4974886 - DNA, 13 bp, Homo sapiens
tgggctgccctgg

SEQ ID NO: 4974887 - DNA, 16 bp, Homo sapiens
tgggctgccctggtgc

SEQ ID NO: 4974888 - DNA, 19 bp, Homo sapiens
tgggctgccctggtgctgc

SEQ ID NO: 4974889 - DNA, 20 bp, Homo sapiens
tgggctgccctggtgctgcc

SEQ ID NO: 4974890 - DNA, 17 bp, Homo sapiens
tgggctgctacccagaa

SEQ ID NO: 4974891 - DNA, 18 bp, Homo sapiens
tgggcttcagtggcagct

SEQ ID NO: 4974892 - DNA, 17 bp, Homo sapiens
tggggaaaaaaatcatc

SEQ ID NO: 4974893 - DNA, 18 bp, Homo sapiens
tggggaaagacactgcct

SEQ ID NO: 4974894 - DNA, 20 bp, Homo sapiens
tggggaaagacactgcctgg

SEQ ID NO: 4974895 - DNA, 20 bp, Homo sapiens
tggggaaaggggttggggtg

SEQ ID NO: 4974896 - DNA, 18 bp, Homo sapiens
tggggaacatttctgtaa

SEQ ID NO: 4974897 - DNA, 23 bp, Homo sapiens
tggggaacatttctgtaaatacc

SEQ ID NO: 4974898 - DNA, 19 bp, Homo sapiens
tggggacagattcagtctt

SEQ ID NO: 4974899 - DNA, 18 bp, Homo sapiens
tggggacctggtaccctc

SEQ ID NO: 4974900 - DNA, 13 bp, Homo sapiens
tggggaggacctg

SEQ ID NO: 4974901 - DNA, 19 bp, Homo sapiens
tggggagtaggacatacca

SEQ ID NO: 4974902 - DNA, 21 bp, Homo sapiens
tggggataaaatgactactta

SEQ ID NO: 4974903 - DNA, 13 bp, Homo sapiens
tggggcagcttga

SEQ ID NO: 4974904 - DNA, 20 bp, Homo sapiens
tggggcaggctgggccatgt

SEQ ID NO: 4974905 - DNA, 16 bp, Homo sapiens
tggggcctagactctg

SEQ ID NO: 4974906 - DNA, 13 bp, Homo sapiens
tggggcctcagac

SEQ ID NO: 4974907 - DNA, 20 bp, Homo sapiens
tggggcctccagaactcact

SEQ ID NO: 4974908 - DNA, 18 bp, Homo sapiens
tggggcctgagagaattg

SEQ ID NO: 4974909 - DNA, 19 bp, Homo sapiens
tggggcctggacctgcctc

SEQ ID NO: 4974910 - DNA, 22 bp, Homo sapiens
tggggcctgtggaatgagtgtg

SEQ ID NO: 4974911 - DNA, 14 bp, Homo sapiens
tggggcgaggcagg

SEQ ID NO: 4974912 - DNA, 23 bp, Homo sapiens
tggggctctagggttgctggagc

SEQ ID NO: 4974913 - DNA, 13 bp, Homo sapiens
tggggctgggccc

SEQ ID NO: 4974914 - DNA, 14 bp, Homo sapiens
tgggggccacctgc

SEQ ID NO: 4974915 - DNA, 16 bp, Homo sapiens
tgggggcctcagtgcc

SEQ ID NO: 4974916 - DNA, 14 bp, Homo sapiens
tgggggctggcctc

SEQ ID NO: 4974917 - DNA, 20 bp, Homo sapiens
tgggggggccaaaaggaaaa

SEQ ID NO: 4974918 - DNA, 19 bp, Homo sapiens
tggggtacccactgctctg

SEQ ID NO: 4974919 - DNA, 12 bp, Homo sapiens
tggggtattttt

SEQ ID NO: 4974920 - DNA, 20 bp, Homo sapiens
tggggtcctggagcagacca

SEQ ID NO: 4974921 - DNA, 19 bp, Homo sapiens
tggggtctacactgcaatc

SEQ ID NO: 4974922 - DNA, 14 bp, Homo sapiens
tggggtctgacccc

SEQ ID NO: 4974923 - DNA, 11 bp, Homo sapiens
tggggtgacag

SEQ ID NO: 4974924 - DNA, 15 bp, Homo sapiens
tggggtgacagtcat

SEQ ID NO: 4974925 - DNA, 19 bp, Homo sapiens
tggggttatctctgtgtta

SEQ ID NO: 4974926 - DNA, 22 bp, Homo sapiens
tgggtaatccaggcacagctga

SEQ ID NO: 4974927 - DNA, 17 bp, Homo sapiens
tgggtacttgtggacac

SEQ ID NO: 4974928 - DNA, 20 bp, Homo sapiens
tgggtacttgtggacacagc

SEQ ID NO: 4974929 - DNA, 14 bp, Homo sapiens
tgggtcaggccacc

SEQ ID NO: 4974930 - DNA, 12 bp, Homo sapiens
tgggtcagtctg

SEQ ID NO: 4974931 - DNA, 18 bp, Homo sapiens
tgggtccgataatatctt

SEQ ID NO: 4974932 - DNA, 22 bp, Homo sapiens
tgggtctcgctttgttgcccag

SEQ ID NO: 4974933 - DNA, 11 bp, Homo sapiens
tgggtcttcca

SEQ ID NO: 4974934 - DNA, 14 bp, Homo sapiens
tgggtcttccaggg

SEQ ID NO: 4974935 - DNA, 14 bp, Homo sapiens
tgggtgctcagaat

SEQ ID NO: 4974936 - DNA, 15 bp, Homo sapiens
tgggtgctcagaata

SEQ ID NO: 4974937 - DNA, 14 bp, Homo sapiens
tgggtggatgcctg

SEQ ID NO: 4974938 - DNA, 18 bp, Homo sapiens
tgggtggtaccctctgga

SEQ ID NO: 4974939 - DNA, 23 bp, Homo sapiens
tgggtgtcaagagggtctgagga

SEQ ID NO: 4974940 - DNA, 22 bp, Homo sapiens
tgggttaggcattaatgtttct

SEQ ID NO: 4974941 - DNA, 16 bp, Homo sapiens
tgggttcactgcaacc

SEQ ID NO: 4974942 - DNA, 24 bp, Homo sapiens
tgggttcaggggactcagccctga

SEQ ID NO: 4974943 - DNA, 17 bp, Homo sapiens
tgggttcatgatgcagt

SEQ ID NO: 4974944 - DNA, 19 bp, Homo sapiens
tgggttcatgatgcagtct

SEQ ID NO: 4974945 - DNA, 18 bp, Homo sapiens
tgggttccaatcctggct

SEQ ID NO: 4974946 - DNA, 16 bp, Homo sapiens
tgggttggtgcttcta

SEQ ID NO: 4974947 - DNA, 21 bp, Homo sapiens
tggtaacagttcatgtttgct

SEQ ID NO: 4974948 - DNA, 13 bp, Homo sapiens
tggtaattgttgc

SEQ ID NO: 4974949 - DNA, 16 bp, Homo sapiens
tggtaccagccctggg

SEQ ID NO: 4974950 - DNA, 19 bp, Homo sapiens
tggtaccagccctggggct

SEQ ID NO: 4974951 - DNA, 21 bp, Homo sapiens
tggtaccagccctggggctgg

SEQ ID NO: 4974952 - DNA, 15 bp, Homo sapiens
tggtaccctcctggc

SEQ ID NO: 4974953 - DNA, 16 bp, Homo sapiens
tggtactctgaaacac

SEQ ID NO: 4974954 - DNA, 24 bp, Homo sapiens
tggtacttagagtttctgtttgat

SEQ ID NO: 4974955 - DNA, 17 bp, Homo sapiens
tggtagattaaatatag

SEQ ID NO: 4974956 - DNA, 18 bp, Homo sapiens
tggtagattaaatataga

SEQ ID NO: 4974957 - DNA, 17 bp, Homo sapiens
tggtagcttttcccttc

SEQ ID NO: 4974958 - DNA, 18 bp, Homo sapiens
tggtaggccttttaacat

SEQ ID NO: 4974959 - DNA, 22 bp, Homo sapiens
tggtagtaatcacagttggcct

SEQ ID NO: 4974960 - DNA, 18 bp, Homo sapiens
tggtatgatcacggctca

SEQ ID NO: 4974961 - DNA, 16 bp, Homo sapiens
tggtatggctgcagtc

SEQ ID NO: 4974962 - DNA, 18 bp, Homo sapiens
tggtattacactgtattt

SEQ ID NO: 4974963 - DNA, 14 bp, Homo sapiens
tggtcacacactga

SEQ ID NO: 4974964 - DNA, 14 bp, Homo sapiens
tggtcacagcctcc

SEQ ID NO: 4974965 - DNA, 18 bp, Homo sapiens
tggtcacagcctcctctg

SEQ ID NO: 4974966 - DNA, 17 bp, Homo sapiens
tggtcacagggcatgcc

SEQ ID NO: 4974967 - DNA, 18 bp, Homo sapiens
tggtccatgcagggggct

SEQ ID NO: 4974968 - DNA, 22 bp, Homo sapiens
tggtcctaaaagcaaaataaaa

SEQ ID NO: 4974969 - DNA, 20 bp, Homo sapiens
tggtcctgagggtccccacc

SEQ ID NO: 4974970 - DNA, 20 bp, Homo sapiens
tggtcctgtgtgcagtgaag

SEQ ID NO: 4974971 - DNA, 13 bp, Homo sapiens
tggtcgcccagga

SEQ ID NO: 4974972 - DNA, 17 bp, Homo sapiens
tggtctcaaactcttga

SEQ ID NO: 4974973 - DNA, 16 bp, Homo sapiens
tggtctgacccactgc

SEQ ID NO: 4974974 - DNA, 16 bp, Homo sapiens
tggtctggactgacag

SEQ ID NO: 4974975 - DNA, 12 bp, Homo sapiens
tggtctgtgtga

SEQ ID NO: 4974976 - DNA, 15 bp, Homo sapiens
tggtctttgtaagag

SEQ ID NO: 4974977 - DNA, 22 bp, Homo sapiens
tggtctttgtaagagtgtagaa

SEQ ID NO: 4974978 - DNA, 23 bp, Homo sapiens
tggtctttgtaagagtgtagaag

SEQ ID NO: 4974979 - DNA, 22 bp, Homo sapiens
tggtgagaaatttctgtgaaac

SEQ ID NO: 4974980 - DNA, 16 bp, Homo sapiens
tggtgccatccccagg

SEQ ID NO: 4974981 - DNA, 21 bp, Homo sapiens
tggtgccatccccagggggca

SEQ ID NO: 4974982 - DNA, 17 bp, Homo sapiens
tggtgcctggcctggca

SEQ ID NO: 4974983 - DNA, 18 bp, Homo sapiens
tggtgcctggcctggcac

SEQ ID NO: 4974984 - DNA, 17 bp, Homo sapiens
tggtgcttaagttccag

SEQ ID NO: 4974985 - DNA, 16 bp, Homo sapiens
tggtggcaagagcccc

SEQ ID NO: 4974986 - DNA, 15 bp, Homo sapiens
tggtggcacaggccc

SEQ ID NO: 4974987 - DNA, 17 bp, Homo sapiens
tggtggcagtggaggtg

SEQ ID NO: 4974988 - DNA, 19 bp, Homo sapiens
tggtggcccgacagcctgg

SEQ ID NO: 4974989 - DNA, 10 bp, Homo sapiens
tggtggcctc

SEQ ID NO: 4974990 - DNA, 23 bp, Homo sapiens
tggtgggaggggcgcccacctcc

SEQ ID NO: 4974991 - DNA, 16 bp, Homo sapiens
tggtgtaataagacat

SEQ ID NO: 4974992 - DNA, 13 bp, Homo sapiens
tggtgtaatttat

SEQ ID NO: 4974993 - DNA, 16 bp, Homo sapiens
tggtgtgacctgaggg

SEQ ID NO: 4974994 - DNA, 17 bp, Homo sapiens
tggtgtgacctgagggc

SEQ ID NO: 4974995 - DNA, 22 bp, Homo sapiens
tggtgtgtcccattggtgttgt

SEQ ID NO: 4974996 - DNA, 16 bp, Homo sapiens
tggtgtgttggacaga

SEQ ID NO: 4974997 - DNA, 13 bp, Homo sapiens
tggttaagagtcc

SEQ ID NO: 4974998 - DNA, 16 bp, Homo sapiens
tggttaagagtccaag

SEQ ID NO: 4974999 - DNA, 17 bp, Homo sapiens
tggttaatctttcctga

SEQ ID NO: 4975000 - DNA, 15 bp, Homo sapiens
tggttatgaaagaat

SEQ ID NO: 4975001 - DNA, 18 bp, Homo sapiens
tggttatgaaagaatata

SEQ ID NO: 4975002 - DNA, 16 bp, Homo sapiens
tggttcagctaagcta

SEQ ID NO: 4975003 - DNA, 23 bp, Homo sapiens
tggttcagggttggcccctgccc

SEQ ID NO: 4975004 - DNA, 18 bp, Homo sapiens
tggttcccctgttcactc

SEQ ID NO: 4975005 - DNA, 20 bp, Homo sapiens
tggttcccctgttcactcta

SEQ ID NO: 4975006 - DNA, 17 bp, Homo sapiens
tggttctaaggacctga

SEQ ID NO: 4975007 - DNA, 22 bp, Homo sapiens
tggttctaaggacctgaaattc

SEQ ID NO: 4975008 - DNA, 12 bp, Homo sapiens
tggttctggcca

SEQ ID NO: 4975009 - DNA, 15 bp, Homo sapiens
tggttcttcatttat

SEQ ID NO: 4975010 - DNA, 17 bp, Homo sapiens
tggttgccttaaagaaa

SEQ ID NO: 4975011 - DNA, 14 bp, Homo sapiens
tggttgtgtctttt

SEQ ID NO: 4975012 - DNA, 22 bp, Homo sapiens
tggttgttagttatagatgtct

SEQ ID NO: 4975013 - DNA, 20 bp, Homo sapiens
tggtttacaggccctgctcc

SEQ ID NO: 4975014 - DNA, 23 bp, Homo sapiens
tggtttacatttaaagcattgct

SEQ ID NO: 4975015 - DNA, 15 bp, Homo sapiens
tggtttactttcaaa

SEQ ID NO: 4975016 - DNA, 16 bp, Homo sapiens
tggtttactttcaaat

SEQ ID NO: 4975017 - DNA, 18 bp, Homo sapiens
tggtttcactggcccaag

SEQ ID NO: 4975018 - DNA, 18 bp, Homo sapiens
tggtttccacatgctctg

SEQ ID NO: 4975019 - DNA, 18 bp, Homo sapiens
tggtttccagtcatgagc

SEQ ID NO: 4975020 - DNA, 20 bp, Homo sapiens
tggtttcccccttctacatt

SEQ ID NO: 4975021 - DNA, 15 bp, Homo sapiens
tggtttcgaactcct

SEQ ID NO: 4975022 - DNA, 21 bp, Homo sapiens
tggtttctctctacagtgcca

SEQ ID NO: 4975023 - DNA, 23 bp, Homo sapiens
tggttttttttttttttttggct

SEQ ID NO: 4975024 - DNA, 12 bp, Homo sapiens
tgtaaaaagaaa

SEQ ID NO: 4975025 - DNA, 13 bp, Homo sapiens
tgtaaaaagaaaa

SEQ ID NO: 4975026 - DNA, 12 bp, Homo sapiens
tgtaaaatagct

SEQ ID NO: 4975027 - DNA, 21 bp, Homo sapiens
tgtaaaatagcttgtatagtg

SEQ ID NO: 4975028 - DNA, 17 bp, Homo sapiens
tgtaaaatgttgaataa

SEQ ID NO: 4975029 - DNA, 15 bp, Homo sapiens
tgtaaacaaactctt

SEQ ID NO: 4975030 - DNA, 18 bp, Homo sapiens
tgtaaacacagtcaaaat

SEQ ID NO: 4975031 - DNA, 20 bp, Homo sapiens
tgtaaacaggagacaggaag

SEQ ID NO: 4975032 - DNA, 14 bp, Homo sapiens
tgtaaacatgtgtt

SEQ ID NO: 4975033 - DNA, 19 bp, Homo sapiens
tgtaaacgacaagaataat

SEQ ID NO: 4975034 - DNA, 20 bp, Homo sapiens
tgtaaactcaaaatatttgt

SEQ ID NO: 4975035 - DNA, 23 bp, Homo sapiens
tgtaaactcaaaatatttgtaca

SEQ ID NO: 4975036 - DNA, 14 bp, Homo sapiens
tgtaaactgccata

SEQ ID NO: 4975037 - DNA, 18 bp, Homo sapiens
tgtaaagtatgtaaacag

SEQ ID NO: 4975038 - DNA, 12 bp, Homo sapiens
tgtaaatacata

SEQ ID NO: 4975039 - DNA, 14 bp, Homo sapiens
tgtaaataccagga

SEQ ID NO: 4975040 - DNA, 19 bp, Homo sapiens
tgtaaataccattgacaca

SEQ ID NO: 4975041 - DNA, 16 bp, Homo sapiens
tgtaaatagtatttga

SEQ ID NO: 4975042 - DNA, 15 bp, Homo sapiens
tgtaaatattctata

SEQ ID NO: 4975043 - DNA, 20 bp, Homo sapiens
tgtaaatattctatatgaat

SEQ ID NO: 4975044 - DNA, 20 bp, Homo sapiens
tgtaacacagctgagagact

SEQ ID NO: 4975045 - DNA, 19 bp, Homo sapiens
tgtaacctgttgctgtgtt

SEQ ID NO: 4975046 - DNA, 20 bp, Homo sapiens
tgtaactatagactggaaaa

SEQ ID NO: 4975047 - DNA, 23 bp, Homo sapiens
tgtaacttatattgaagacaatt

SEQ ID NO: 4975048 - DNA, 17 bp, Homo sapiens
tgtaacttatgtagata

SEQ ID NO: 4975049 - DNA, 15 bp, Homo sapiens
tgtaagagtgtagaa

SEQ ID NO: 4975050 - DNA, 19 bp, Homo sapiens
tgtaagagtgtagaagcat

SEQ ID NO: 4975051 - DNA, 21 bp, Homo sapiens
tgtaagagtgtagaagcattc

SEQ ID NO: 4975052 - DNA, 21 bp, Homo sapiens
tgtaagattatagattctaaa

SEQ ID NO: 4975053 - DNA, 22 bp, Homo sapiens
tgtaagattatagattctaaag

SEQ ID NO: 4975054 - DNA, 23 bp, Homo sapiens
tgtaagattatagattctaaaga

SEQ ID NO: 4975055 - DNA, 19 bp, Homo sapiens
tgtaagcaggagagaaatt

SEQ ID NO: 4975056 - DNA, 18 bp, Homo sapiens
tgtaagccaaagaaatga

SEQ ID NO: 4975057 - DNA, 20 bp, Homo sapiens
tgtaagccaaagaaatgaac

SEQ ID NO: 4975058 - DNA, 19 bp, Homo sapiens
tgtaagtcagtgttgagat

SEQ ID NO: 4975059 - DNA, 14 bp, Homo sapiens
tgtaagttcacaac

SEQ ID NO: 4975060 - DNA, 14 bp, Homo sapiens
tgtaagtttcaggt

SEQ ID NO: 4975061 - DNA, 21 bp, Homo sapiens
tgtaagtttcaggtgacatgt

SEQ ID NO: 4975062 - DNA, 15 bp, Homo sapiens
tgtaataagacataa

SEQ ID NO: 4975063 - DNA, 14 bp, Homo sapiens
tgtaataatacctc

SEQ ID NO: 4975064 - DNA, 17 bp, Homo sapiens
tgtaataatacctcaat

SEQ ID NO: 4975065 - DNA, 20 bp, Homo sapiens
tgtaataatacctcaatgtt

SEQ ID NO: 4975066 - DNA, 14 bp, Homo sapiens
tgtaataattgctc

SEQ ID NO: 4975067 - DNA, 14 bp, Homo sapiens
tgtaatctctctgc

SEQ ID NO: 4975068 - DNA, 20 bp, Homo sapiens
tgtaatcttatttaggaagt

SEQ ID NO: 4975069 - DNA, 21 bp, Homo sapiens
tgtaatgaaaatgaatatcta

SEQ ID NO: 4975070 - DNA, 16 bp, Homo sapiens
tgtaattatgatttgg

SEQ ID NO: 4975071 - DNA, 19 bp, Homo sapiens
tgtaattgacggtttttta

SEQ ID NO: 4975072 - DNA, 18 bp, Homo sapiens
tgctggcatcaagaggtg

SEQ ID NO: 4975073 - DNA, 15 bp, Homo sapiens
tgctggccagcctgg

SEQ ID NO: 4975074 - DNA, 17 bp, Homo sapiens
tgctggccagcctgggg

SEQ ID NO: 4975075 - DNA, 18 bp, Homo sapiens
tgctggccagcctggggc

SEQ ID NO: 4975076 - DNA, 14 bp, Homo sapiens
tgctggcctttgct

SEQ ID NO: 4975077 - DNA, 13 bp, Homo sapiens
tgctggctcttct

SEQ ID NO: 4975078 - DNA, 13 bp, Homo sapiens
tgctggctgcctt

SEQ ID NO: 4975079 - DNA, 14 bp, Homo sapiens
tgctggctgcctta

SEQ ID NO: 4975080 - DNA, 21 bp, Homo sapiens
tgctggctgttggctgggggc

SEQ ID NO: 4975081 - DNA, 21 bp, Homo sapiens
tgctgggattacaagcgtgag

SEQ ID NO: 4975082 - DNA, 22 bp, Homo sapiens
tgctgggggaatgagcccagag

SEQ ID NO: 4975083 - DNA, 16 bp, Homo sapiens
tgctgggtaaactgtg

SEQ ID NO: 4975084 - DNA, 19 bp, Homo sapiens
tgctggtcacagcctcctc

SEQ ID NO: 4975085 - DNA, 20 bp, Homo sapiens
tgctggtcacagcctcctct

SEQ ID NO: 4975086 - DNA, 17 bp, Homo sapiens
tgctgtaacttaaaata

SEQ ID NO: 4975087 - DNA, 21 bp, Homo sapiens
tgctgtacatctattttggat

SEQ ID NO: 4975088 - DNA, 16 bp, Homo sapiens
tgctgtagatgacaac

SEQ ID NO: 4975089 - DNA, 12 bp, Homo sapiens
tgctgtccctcc

SEQ ID NO: 4975090 - DNA, 13 bp, Homo sapiens
tgctgtccctccc

SEQ ID NO: 4975091 - DNA, 16 bp, Homo sapiens
tgctgtctctgctcgc

SEQ ID NO: 4975092 - DNA, 18 bp, Homo sapiens
tgctgtgttaaataaacc

SEQ ID NO: 4975093 - DNA, 14 bp, Homo sapiens
tgctgttactgtta

SEQ ID NO: 4975094 - DNA, 22 bp, Homo sapiens
tgctgttctcttgggaactgaa

SEQ ID NO: 4975095 - DNA, 13 bp, Homo sapiens
tgctgttgcttga

SEQ ID NO: 4975096 - DNA, 16 bp, Homo sapiens
tgctgttggtcatgtg

SEQ ID NO: 4975097 - DNA, 18 bp, Homo sapiens
tgctgtttcacaatacct

SEQ ID NO: 4975098 - DNA, 21 bp, Homo sapiens
tgctgtttgtagtgaaataat

SEQ ID NO: 4975099 - DNA, 15 bp, Homo sapiens
tgcttaagttccagc

SEQ ID NO: 4975100 - DNA, 15 bp, Homo sapiens
tgcttaatttctaaa

SEQ ID NO: 4975101 - DNA, 17 bp, Homo sapiens
tgcttagacataacaaa

SEQ ID NO: 4975102 - DNA, 16 bp, Homo sapiens
tgcttagagactatca

SEQ ID NO: 4975103 - DNA, 16 bp, Homo sapiens
tgcttagtaaaattta

SEQ ID NO: 4975104 - DNA, 21 bp, Homo sapiens
tgcttagtatctcatcaacaa

SEQ ID NO: 4975105 - DNA, 22 bp, Homo sapiens
tgcttcaataaatctttggaaa

SEQ ID NO: 4975106 - DNA, 15 bp, Homo sapiens
tgcttcaatcccagc

SEQ ID NO: 4975107 - DNA, 15 bp, Homo sapiens
tgcttcaattaataa

SEQ ID NO: 4975108 - DNA, 20 bp, Homo sapiens
tgcttcacagtagagccagc

SEQ ID NO: 4975109 - DNA, 22 bp, Homo sapiens
tgcttcacagtagagccagctt

SEQ ID NO: 4975110 - DNA, 18 bp, Homo sapiens
tgcttcataaatgaagca

SEQ ID NO: 4975111 - DNA, 20 bp, Homo sapiens
tgcttcataaatgaagcagc

SEQ ID NO: 4975112 - DNA, 19 bp, Homo sapiens
tgcttcattcaatattgac

SEQ ID NO: 4975113 - DNA, 14 bp, Homo sapiens
tgcttcccacctcc

SEQ ID NO: 4975114 - DNA, 19 bp, Homo sapiens
tgcttcccacctccctgcc

SEQ ID NO: 4975115 - DNA, 22 bp, Homo sapiens
tgcttccggtagggaggcagcc

SEQ ID NO: 4975116 - DNA, 15 bp, Homo sapiens
tgcttctcacttttt

SEQ ID NO: 4975117 - DNA, 19 bp, Homo sapiens
tgcttgatgaagcaaggaa

SEQ ID NO: 4975118 - DNA, 18 bp, Homo sapiens
tgcttgctcatatgcatg

SEQ ID NO: 4975119 - DNA, 22 bp, Homo sapiens
tgcttgtacctctggctgacta

SEQ ID NO: 4975120 - DNA, 12 bp, Homo sapiens
tgcttgtgttaa

SEQ ID NO: 4975121 - DNA, 13 bp, Homo sapiens
tgctttaaagata

SEQ ID NO: 4975122 - DNA, 14 bp, Homo sapiens
tgctttattccaga

SEQ ID NO: 4975123 - DNA, 19 bp, Homo sapiens
tgctttgaagcagttgtgt

SEQ ID NO: 4975124 - DNA, 17 bp, Homo sapiens
tgctttgatttacagca

SEQ ID NO: 4975125 - DNA, 14 bp, Homo sapiens
tgctttgctcttgt

SEQ ID NO: 4975126 - DNA, 17 bp, Homo sapiens
tgctttgggctgccctg

SEQ ID NO: 4975127 - DNA, 13 bp, Homo sapiens
tgcttttaattaa

SEQ ID NO: 4975128 - DNA, 21 bp, Homo sapiens
tgcttttattttgaaaagctt

SEQ ID NO: 4975129 - DNA, 20 bp, Homo sapiens
tgctttttgaaatgaaattt

SEQ ID NO: 4975130 - DNA, 14 bp, Homo sapiens
tgcttttttaaata

SEQ ID NO: 4975131 - DNA, 17 bp, Homo sapiens
tgcttttttaaatatta

SEQ ID NO: 4975132 - DNA, 14 bp, Homo sapiens
tggaaaaatgtttg

SEQ ID NO: 4975133 - DNA, 20 bp, Homo sapiens
tggaaacatttatattttta

SEQ ID NO: 4975134 - DNA, 16 bp, Homo sapiens
tggaaagaatctaata

SEQ ID NO: 4975135 - DNA, 15 bp, Homo sapiens
tggaaataaatgtat

SEQ ID NO: 4975136 - DNA, 23 bp, Homo sapiens
tggaaataaatgtatcatagaaa

SEQ ID NO: 4975137 - DNA, 14 bp, Homo sapiens
tggaaatattttga

SEQ ID NO: 4975138 - DNA, 22 bp, Homo sapiens
tggaaatcctagtttcctctcc

SEQ ID NO: 4975139 - DNA, 23 bp, Homo sapiens
tggaacatcctttgcagggcagc

SEQ ID NO: 4975140 - DNA, 20 bp, Homo sapiens
tggaacctctgtctcatcct

SEQ ID NO: 4975141 - DNA, 18 bp, Homo sapiens
tggaacgctaatgaaaca

SEQ ID NO: 4975142 - DNA, 20 bp, Homo sapiens
tggaacggtgaaggtgacag

SEQ ID NO: 4975143 - DNA, 21 bp, Homo sapiens
tggaactctatctgggcctgg

SEQ ID NO: 4975144 - DNA, 21 bp, Homo sapiens
tggaacttctaatatattttt

SEQ ID NO: 4975145 - DNA, 22 bp, Homo sapiens
tggaagaaaaaaatcttctcca

SEQ ID NO: 4975146 - DNA, 18 bp, Homo sapiens
tggaagacaaaatgtttt

SEQ ID NO: 4975147 - DNA, 14 bp, Homo sapiens
tggaagagaaatct

SEQ ID NO: 4975148 - DNA, 23 bp, Homo sapiens
tggaagaggaacagcactgggga

SEQ ID NO: 4975149 - DNA, 16 bp, Homo sapiens
tggaagctaatttgca

SEQ ID NO: 4975150 - DNA, 13 bp, Homo sapiens
tggaagctccgct

SEQ ID NO: 4975151 - DNA, 19 bp, Homo sapiens
tggaagggttctggctgcc

SEQ ID NO: 4975152 - DNA, 20 bp, Homo sapiens
tggaagtaaccatttgcact

SEQ ID NO: 4975153 - DNA, 14 bp, Homo sapiens
tggaatacatgaaa

SEQ ID NO: 4975154 - DNA, 17 bp, Homo sapiens
tggaataggaataagct

SEQ ID NO: 4975155 - DNA, 18 bp, Homo sapiens
tggaatctggagaccagg

SEQ ID NO: 4975156 - DNA, 17 bp, Homo sapiens
tggaatgagtgtgcatg

SEQ ID NO: 4975157 - DNA, 22 bp, Homo sapiens
tggaatggtacatgtcttccat

SEQ ID NO: 4975158 - DNA, 21 bp, Homo sapiens
tggaattaaaaggatagtatt

SEQ ID NO: 4975159 - DNA, 13 bp, Homo sapiens
tggaattcttcct

SEQ ID NO: 4975160 - DNA, 23 bp, Homo sapiens
tggaattgatttgcattgaacac

SEQ ID NO: 4975161 - DNA, 19 bp, Homo sapiens
tggaatttaccagttaatt

SEQ ID NO: 4975162 - DNA, 14 bp, Homo sapiens
tggaatttcttgtt

SEQ ID NO: 4975163 - DNA, 15 bp, Homo sapiens
tggaatttgttcaag

SEQ ID NO: 4975164 - DNA, 16 bp, Homo sapiens
tggacaagaggtacag

SEQ ID NO: 4975165 - DNA, 16 bp, Homo sapiens
tggacaatcatgaaat

SEQ ID NO: 4975166 - DNA, 14 bp, Homo sapiens
tggacacagctctt

SEQ ID NO: 4975167 - DNA, 16 bp, Homo sapiens
tggacacagctcttct

SEQ ID NO: 4975168 - DNA, 18 bp, Homo sapiens
tggacacctttaggttct

SEQ ID NO: 4975169 - DNA, 19 bp, Homo sapiens
tggacactccagtgccagc

SEQ ID NO: 4975170 - DNA, 15 bp, Homo sapiens
tggacagagaagggc

SEQ ID NO: 4975171 - DNA, 19 bp, Homo sapiens
tggacagaggggactctgg

SEQ ID NO: 4975172 - DNA, 16 bp, Homo sapiens
tggacaggcatgttct

SEQ ID NO: 4975173 - DNA, 20 bp, Homo sapiens
tggacagttcacaccctgca

SEQ ID NO: 4975174 - DNA, 22 bp, Homo sapiens
tggacatggcaggccgatttgg

SEQ ID NO: 4975175 - DNA, 19 bp, Homo sapiens
tggacatttgccttgctgg

SEQ ID NO: 4975176 - DNA, 19 bp, Homo sapiens
tggaccaattattgatata

SEQ ID NO: 4975177 - DNA, 22 bp, Homo sapiens
tggaccaattattgatatatat

SEQ ID NO: 4975178 - DNA, 12 bp, Homo sapiens
tggaccactgca

SEQ ID NO: 4975179 - DNA, 15 bp, Homo sapiens
tggaccactgggcaa

SEQ ID NO: 4975180 - DNA, 22 bp, Homo sapiens
tggaccactgtttcttgcttgt

SEQ ID NO: 4975181 - DNA, 17 bp, Homo sapiens
tggaccagtggtgcctt

SEQ ID NO: 4975182 - DNA, 20 bp, Homo sapiens
tggcatgttttgtgcatttg

SEQ ID NO: 4975183 - DNA, 13 bp, Homo sapiens
tggcattatgtcc

SEQ ID NO: 4975184 - DNA, 18 bp, Homo sapiens
tggcattatgtccactgt

SEQ ID NO: 4975185 - DNA, 15 bp, Homo sapiens
tggcattcttgtaca

SEQ ID NO: 4975186 - DNA, 16 bp, Homo sapiens
tggccaaattatttgt

SEQ ID NO: 4975187 - DNA, 18 bp, Homo sapiens
tggccaaattatttgtgt

SEQ ID NO: 4975188 - DNA, 20 bp, Homo sapiens
tggccaaattatttgtgtaa

SEQ ID NO: 4975189 - DNA, 12 bp, Homo sapiens
tggccactcagc

SEQ ID NO: 4975190 - DNA, 18 bp, Homo sapiens
tggccagagctgggaggc

SEQ ID NO: 4975191 - DNA, 23 bp, Homo sapiens
tggccagagctgggaggcatggc

SEQ ID NO: 4975192 - DNA, 15 bp, Homo sapiens
tggccagatgcacca

SEQ ID NO: 4975193 - DNA, 18 bp, Homo sapiens
tggccagatgcaccagcc

SEQ ID NO: 4975194 - DNA, 21 bp, Homo sapiens
tggccagatgcaccagccctt

SEQ ID NO: 4975195 - DNA, 17 bp, Homo sapiens
tggccaggcagatctgt

SEQ ID NO: 4975196 - DNA, 19 bp, Homo sapiens
tggccaggcagatctgtgc

SEQ ID NO: 4975197 - DNA, 20 bp, Homo sapiens
tggccaggcagatctgtgcc

SEQ ID NO: 4975198 - DNA, 17 bp, Homo sapiens
tggccaggctggtctca

SEQ ID NO: 4975199 - DNA, 16 bp, Homo sapiens
tggccaggtggccact

SEQ ID NO: 4975200 - DNA, 14 bp, Homo sapiens
tggccatccctgtg

SEQ ID NO: 4975201 - DNA, 23 bp, Homo sapiens
tggcccatagaaacatgacactg

SEQ ID NO: 4975202 - DNA, 14 bp, Homo sapiens
tggccccagggcac

SEQ ID NO: 4975203 - DNA, 12 bp, Homo sapiens
tggcccctctga

SEQ ID NO: 4975204 - DNA, 18 bp, Homo sapiens
tggcccctctgacctgca

SEQ ID NO: 4975205 - DNA, 18 bp, Homo sapiens
tggcccgacagcctggca

SEQ ID NO: 4975206 - DNA, 21 bp, Homo sapiens
tggccctgccctctccttcct

SEQ ID NO: 4975207 - DNA, 13 bp, Homo sapiens
tggccctgtccct

SEQ ID NO: 4975208 - DNA, 13 bp, Homo sapiens
tggccctgtgcta

SEQ ID NO: 4975209 - DNA, 22 bp, Homo sapiens
tggcccttgcagttcagcacca

SEQ ID NO: 4975210 - DNA, 13 bp, Homo sapiens
tggccggctgtgc

SEQ ID NO: 4975211 - DNA, 20 bp, Homo sapiens
tggccggctgtgctcagaga

SEQ ID NO: 4975212 - DNA, 21 bp, Homo sapiens
tggcctaaaactggcctgact

SEQ ID NO: 4975213 - DNA, 18 bp, Homo sapiens
tggcctagcccaccctgc

SEQ ID NO: 4975214 - DNA, 22 bp, Homo sapiens
tggcctagcccaccctgctgcc

SEQ ID NO: 4975215 - DNA, 20 bp, Homo sapiens
tggcctatgcacatatggac

SEQ ID NO: 4975216 - DNA, 14 bp, Homo sapiens
tggcctcagctgcc

SEQ ID NO: 4975217 - DNA, 18 bp, Homo sapiens
tggcctcagctgcctcac

SEQ ID NO: 4975218 - DNA, 23 bp, Homo sapiens
tggcctcgggacacctgccctgc

SEQ ID NO: 4975219 - DNA, 16 bp, Homo sapiens
tggcctgcactaattt

SEQ ID NO: 4975220 - DNA, 11 bp, Homo sapiens
tggcctggaca

SEQ ID NO: 4975221 - DNA, 13 bp, Homo sapiens
tggcctggccagg

SEQ ID NO: 4975222 - DNA, 17 bp, Homo sapiens
tggcctggccaggagct

SEQ ID NO: 4975223 - DNA, 21 bp, Homo sapiens
tggcctggccaggagctcttc

SEQ ID NO: 4975224 - DNA, 20 bp, Homo sapiens
tggcctggccctgccctgag

SEQ ID NO: 4975225 - DNA, 14 bp, Homo sapiens
tggcctggcctggc

SEQ ID NO: 4975226 - DNA, 18 bp, Homo sapiens
tggcctggcctggccctg

SEQ ID NO: 4975227 - DNA, 19 bp, Homo sapiens
tggcctggcctggccctgc

SEQ ID NO: 4975228 - DNA, 21 bp, Homo sapiens
tggcctggtatggctgcagtc

SEQ ID NO: 4975229 - DNA, 12 bp, Homo sapiens
tggcctgtctca

SEQ ID NO: 4975230 - DNA, 14 bp, Homo sapiens
tggcctgtctcatc

SEQ ID NO: 4975231 - DNA, 22 bp, Homo sapiens
tggcgtgcagtggtgcgatctg

SEQ ID NO: 4975232 - DNA, 14 bp, Homo sapiens
tggcgtggagcagg

SEQ ID NO: 4975233 - DNA, 20 bp, Homo sapiens
tggctaaatgcctaataaac

SEQ ID NO: 4975234 - DNA, 19 bp, Homo sapiens
tggctagaggccagcccca

SEQ ID NO: 4975235 - DNA, 18 bp, Homo sapiens
tggctagagtcctcactc

SEQ ID NO: 4975236 - DNA, 21 bp, Homo sapiens
tggctagagtcctcactccca

SEQ ID NO: 4975237 - DNA, 21 bp, Homo sapiens
tggctatatggcaagaaagct

SEQ ID NO: 4975238 - DNA, 14 bp, Homo sapiens
tggctcacagtaca

SEQ ID NO: 4975239 - DNA, 17 bp, Homo sapiens
tggctcccacaggccct

SEQ ID NO: 4975240 - DNA, 20 bp, Homo sapiens
tggctcccatgaccatactg

SEQ ID NO: 4975241 - DNA, 14 bp, Homo sapiens
tggctcctcccggt

SEQ ID NO: 4975242 - DNA, 14 bp, Homo sapiens
tggctcctttacaa

SEQ ID NO: 4975243 - DNA, 22 bp, Homo sapiens
tggctctgaggtgcctgtccca

SEQ ID NO: 4975244 - DNA, 23 bp, Homo sapiens
tggctctgcaatgggcactggga

SEQ ID NO: 4975245 - DNA, 19 bp, Homo sapiens
tggctcttgatacccccct

SEQ ID NO: 4975246 - DNA, 15 bp, Homo sapiens
tggctgaaaaaggcc

SEQ ID NO: 4975247 - DNA, 15 bp, Homo sapiens
tggctgactaaattt

SEQ ID NO: 4975248 - DNA, 13 bp, Homo sapiens
tggctgagggcag

SEQ ID NO: 4975249 - DNA, 15 bp, Homo sapiens
tggctgagggcagct

SEQ ID NO: 4975250 - DNA, 23 bp, Homo sapiens
tggctgagggcagctgcgcgggc

SEQ ID NO: 4975251 - DNA, 18 bp, Homo sapiens
tggctggaaggggtccag

SEQ ID NO: 4975252 - DNA, 16 bp, Homo sapiens
tggctgggggcaggag

SEQ ID NO: 4975253 - DNA, 20 bp, Homo sapiens
tggctgggggcctcagtgcc

SEQ ID NO: 4975254 - DNA, 19 bp, Homo sapiens
tggctgtaaggctctagat

SEQ ID NO: 4975255 - DNA, 18 bp, Homo sapiens
tggctgtgcctctgcctg

SEQ ID NO: 4975256 - DNA, 19 bp, Homo sapiens
tggctgtgctctcaccagc

SEQ ID NO: 4975257 - DNA, 13 bp, Homo sapiens
tggctgttggctg

SEQ ID NO: 4975258 - DNA, 16 bp, Homo sapiens
tggctgttggctgggg

SEQ ID NO: 4975259 - DNA, 11 bp, Homo sapiens
tggctgtttgg

SEQ ID NO: 4975260 - DNA, 16 bp, Homo sapiens
tggctgtttggacttt

SEQ ID NO: 4975261 - DNA, 19 bp, Homo sapiens
tggcttaaatatagttcct

SEQ ID NO: 4975262 - DNA, 18 bp, Homo sapiens
tggcttcccgctcagccc

SEQ ID NO: 4975263 - DNA, 19 bp, Homo sapiens
tggcttcccgctcagccct

SEQ ID NO: 4975264 - DNA, 11 bp, Homo sapiens
tggcttcctcc

SEQ ID NO: 4975265 - DNA, 17 bp, Homo sapiens
tggcttctgtgatgagc

SEQ ID NO: 4975266 - DNA, 22 bp, Homo sapiens
tggcttctgtgatgagctgatc

SEQ ID NO: 4975267 - DNA, 19 bp, Homo sapiens
tggcttgactcaggattta

SEQ ID NO: 4975268 - DNA, 12 bp, Homo sapiens
tggcttgtagaa

SEQ ID NO: 4975269 - DNA, 24 bp, Homo sapiens
tggcttgtatcaacactgttactt

SEQ ID NO: 4975270 - DNA, 15 bp, Homo sapiens
tggctttcagaaaac

SEQ ID NO: 4975271 - DNA, 17 bp, Homo sapiens
tggctttccttgtggca

SEQ ID NO: 4975272 - DNA, 14 bp, Homo sapiens
tggcttttcactgc

SEQ ID NO: 4975273 - DNA, 22 bp, Homo sapiens
tggcttttcactgctggctgcc

SEQ ID NO: 4975274 - DNA, 22 bp, Homo sapiens
tggcttttttaaaaaagcaaca

SEQ ID NO: 4975275 - DNA, 19 bp, Homo sapiens
tgggaaaaaaatgaatgag

SEQ ID NO: 4975276 - DNA, 23 bp, Homo sapiens
tgcagcaggagtggtgcagacag

SEQ ID NO: 4975277 - DNA, 18 bp, Homo sapiens
tgcagcatggtccctgcc

SEQ ID NO: 4975278 - DNA, 11 bp, Homo sapiens
tgcagccagct

SEQ ID NO: 4975279 - DNA, 21 bp, Homo sapiens
tgcagcccatgcccacctgcc

SEQ ID NO: 4975280 - DNA, 23 bp, Homo sapiens
tgcagcccatgcccacctgccca

SEQ ID NO: 4975281 - DNA, 18 bp, Homo sapiens
tgcagcctcaacctcctg

SEQ ID NO: 4975282 - DNA, 23 bp, Homo sapiens
tgcagcctttgcctccccggctc

SEQ ID NO: 4975283 - DNA, 19 bp, Homo sapiens
tgcagcgcagctggactct

SEQ ID NO: 4975284 - DNA, 16 bp, Homo sapiens
tgcagctgatgttgga

SEQ ID NO: 4975285 - DNA, 18 bp, Homo sapiens
tgcagcttcctgtcaaca

SEQ ID NO: 4975286 - DNA, 18 bp, Homo sapiens
tgcagcttgggagagccc

SEQ ID NO: 4975287 - DNA, 23 bp, Homo sapiens
tgcagcttgggagagcccctggg

SEQ ID NO: 4975288 - DNA, 15 bp, Homo sapiens
tgcagctttatgttc

SEQ ID NO: 4975289 - DNA, 14 bp, Homo sapiens
tgcaggaatcaaaa

SEQ ID NO: 4975290 - DNA, 20 bp, Homo sapiens
tgcaggaatcaaaaattgaa

SEQ ID NO: 4975291 - DNA, 22 bp, Homo sapiens
tgcaggccctttgaagcctcag

SEQ ID NO: 4975292 - DNA, 13 bp, Homo sapiens
tgcagggagtccg

SEQ ID NO: 4975293 - DNA, 14 bp, Homo sapiens
tgcaggggctctgg

SEQ ID NO: 4975294 - DNA, 19 bp, Homo sapiens
tgcaggggctctggagaga

SEQ ID NO: 4975295 - DNA, 13 bp, Homo sapiens
tgcaggggtgacg

SEQ ID NO: 4975296 - DNA, 22 bp, Homo sapiens
tgcaggtgctattgttactctt

SEQ ID NO: 4975297 - DNA, 21 bp, Homo sapiens
tgcagtaaatcttttacaact

SEQ ID NO: 4975298 - DNA, 16 bp, Homo sapiens
tgcagtaggggaggag

SEQ ID NO: 4975299 - DNA, 18 bp, Homo sapiens
tgcagtaggggaggagca

SEQ ID NO: 4975300 - DNA, 15 bp, Homo sapiens
tgcagtcatcagaag

SEQ ID NO: 4975301 - DNA, 16 bp, Homo sapiens
tgcagtcatcagaagt

SEQ ID NO: 4975302 - DNA, 12 bp, Homo sapiens
tgcataaatatg

SEQ ID NO: 4975303 - DNA, 14 bp, Homo sapiens
tgcataaatatgca

SEQ ID NO: 4975304 - DNA, 17 bp, Homo sapiens
tgcatactgagccaagt

SEQ ID NO: 4975305 - DNA, 19 bp, Homo sapiens
tgcatactggactcttcaa

SEQ ID NO: 4975306 - DNA, 20 bp, Homo sapiens
tgcatactggactcttcaaa

SEQ ID NO: 4975307 - DNA, 22 bp, Homo sapiens
tgcatagaactgggtaaatgca

SEQ ID NO: 4975308 - DNA, 19 bp, Homo sapiens
tgcatagaggtaccagcaa

SEQ ID NO: 4975309 - DNA, 13 bp, Homo sapiens
tgcatagtgctgg

SEQ ID NO: 4975310 - DNA, 15 bp, Homo sapiens
tgcatatgaaatcct

SEQ ID NO: 4975311 - DNA, 19 bp, Homo sapiens
tgcatatgttgaatacttt

SEQ ID NO: 4975312 - DNA, 13 bp, Homo sapiens
tgcatcaggtcct

SEQ ID NO: 4975313 - DNA, 14 bp, Homo sapiens
tgcatcagtattaa

SEQ ID NO: 4975314 - DNA, 13 bp, Homo sapiens
tgcatccaactcc

SEQ ID NO: 4975315 - DNA, 16 bp, Homo sapiens
tgcatccaactccagg

SEQ ID NO: 4975316 - DNA, 14 bp, Homo sapiens
tgcatccttcctat

SEQ ID NO: 4975317 - DNA, 20 bp, Homo sapiens
tgcatgaagagaagcaattt

SEQ ID NO: 4975318 - DNA, 23 bp, Homo sapiens
tgcatgaagagaagcaattttgg

SEQ ID NO: 4975319 - DNA, 15 bp, Homo sapiens
tgcatgacttgtagc

SEQ ID NO: 4975320 - DNA, 15 bp, Homo sapiens
tgcatgagcttttat

SEQ ID NO: 4975321 - DNA, 14 bp, Homo sapiens
tgcatgcctggtct

SEQ ID NO: 4975322 - DNA, 16 bp, Homo sapiens
tgcatggaggccctcc

SEQ ID NO: 4975323 - DNA, 17 bp, Homo sapiens
tgcatggggaaagagat

SEQ ID NO: 4975324 - DNA, 23 bp, Homo sapiens
tgcatggggtggggtagggctga

SEQ ID NO: 4975325 - DNA, 14 bp, Homo sapiens
tgcatgtatgtctt

SEQ ID NO: 4975326 - DNA, 24 bp, Homo sapiens
tgcatgtggtttggttcctctctg

SEQ ID NO: 4975327 - DNA, 13 bp, Homo sapiens
tgcatgtgtgtat

SEQ ID NO: 4975328 - DNA, 14 bp, Homo sapiens
tgcatgtgtgtata

SEQ ID NO: 4975329 - DNA, 15 bp, Homo sapiens
tgcatgtgtgtataa

SEQ ID NO: 4975330 - DNA, 19 bp, Homo sapiens
tgcatgtgtgtataagtgc

SEQ ID NO: 4975331 - DNA, 14 bp, Homo sapiens
tgcatgttaccatc

SEQ ID NO: 4975332 - DNA, 16 bp, Homo sapiens
tgcattaaattcacaa

SEQ ID NO: 4975333 - DNA, 21 bp, Homo sapiens
tgcattagagcccatttcaat

SEQ ID NO: 4975334 - DNA, 20 bp, Homo sapiens
tgcattcctttgtcttcaaa

SEQ ID NO: 4975335 - DNA, 14 bp, Homo sapiens
tgcattctattgcc

SEQ ID NO: 4975336 - DNA, 15 bp, Homo sapiens
tgcattctattgcct

SEQ ID NO: 4975337 - DNA, 18 bp, Homo sapiens
tgcattctattgccttct

SEQ ID NO: 4975338 - DNA, 19 bp, Homo sapiens
tgcattctgcctctctagg

SEQ ID NO: 4975339 - DNA, 17 bp, Homo sapiens
tgcattgaacacaaact

SEQ ID NO: 4975340 - DNA, 23 bp, Homo sapiens
tgcattgaacacaaactgtaaat

SEQ ID NO: 4975341 - DNA, 20 bp, Homo sapiens
tgcattgaccgcgactaatt

SEQ ID NO: 4975342 - DNA, 14 bp, Homo sapiens
tgcatttcctgaca

SEQ ID NO: 4975343 - DNA, 18 bp, Homo sapiens
tgcatttgtaaatgctgt

SEQ ID NO: 4975344 - DNA, 12 bp, Homo sapiens
tgccaaatgctc

SEQ ID NO: 4975345 - DNA, 13 bp, Homo sapiens
tgccaactcctca

SEQ ID NO: 4975346 - DNA, 22 bp, Homo sapiens
tgccaactgttcagctgtcctc

SEQ ID NO: 4975347 - DNA, 13 bp, Homo sapiens
tgccaagacaaat

SEQ ID NO: 4975348 - DNA, 14 bp, Homo sapiens
tgccaagacaaatc

SEQ ID NO: 4975349 - DNA, 20 bp, Homo sapiens
tgccaaggccagagtggcct

SEQ ID NO: 4975350 - DNA, 18 bp, Homo sapiens
tgccaatactagtcaccc

SEQ ID NO: 4975351 - DNA, 21 bp, Homo sapiens
tgccaatattaaatctgctgg

SEQ ID NO: 4975352 - DNA, 17 bp, Homo sapiens
tgccacaaccagccagg

SEQ ID NO: 4975353 - DNA, 16 bp, Homo sapiens
tgccacacttcaggct

SEQ ID NO: 4975354 - DNA, 22 bp, Homo sapiens
tgccacacttcaggctcttctc

SEQ ID NO: 4975355 - DNA, 15 bp, Homo sapiens
tgccaccacctctgt

SEQ ID NO: 4975356 - DNA, 19 bp, Homo sapiens
tgccaccacctctgtggca

SEQ ID NO: 4975357 - DNA, 22 bp, Homo sapiens
tgccaccacctctgtggcattg

SEQ ID NO: 4975358 - DNA, 14 bp, Homo sapiens
tgccaccagagacc

SEQ ID NO: 4975359 - DNA, 19 bp, Homo sapiens
tgccaccagagaccgtcct

SEQ ID NO: 4975360 - DNA, 17 bp, Homo sapiens
tgccaccaggagaacca

SEQ ID NO: 4975361 - DNA, 14 bp, Homo sapiens
tgccaccccaccct

SEQ ID NO: 4975362 - DNA, 15 bp, Homo sapiens
tgccaccccaccctc

SEQ ID NO: 4975363 - DNA, 19 bp, Homo sapiens
tgccaccccaccctccctg

SEQ ID NO: 4975364 - DNA, 22 bp, Homo sapiens
tgccaccccaccctccctggag

SEQ ID NO: 4975365 - DNA, 19 bp, Homo sapiens
tgccaccctggggagaaag

SEQ ID NO: 4975366 - DNA, 14 bp, Homo sapiens
tgccacctccctga

SEQ ID NO: 4975367 - DNA, 22 bp, Homo sapiens
tgccactacggaatagttggct

SEQ ID NO: 4975368 - DNA, 12 bp, Homo sapiens
tgccactttgca

SEQ ID NO: 4975369 - DNA, 20 bp, Homo sapiens
tgccactttgcacattttga

SEQ ID NO: 4975370 - DNA, 20 bp, Homo sapiens
tgccagaagatcccctcagg

SEQ ID NO: 4975371 - DNA, 12 bp, Homo sapiens
tgccagagccgg

SEQ ID NO: 4975372 - DNA, 20 bp, Homo sapiens
tgccagaggaatcctggcag

SEQ ID NO: 4975373 - DNA, 23 bp, Homo sapiens
tgccagaggaatcctggcagccc

SEQ ID NO: 4975374 - DNA, 23 bp, Homo sapiens
tgccagcaatgacatctcagggg

SEQ ID NO: 4975375 - DNA, 22 bp, Homo sapiens
tgccagcctgaggcagccactt

SEQ ID NO: 4975376 - DNA, 17 bp, Homo sapiens
tgccagctcagtcccat

SEQ ID NO: 4975377 - DNA, 14 bp, Homo sapiens
tgccaggaacctgt

SEQ ID NO: 4975378 - DNA, 17 bp, Homo sapiens
tgccatagtcacatggc

SEQ ID NO: 4975379 - DNA, 19 bp, Homo sapiens
tgccatagtcacatggcct

SEQ ID NO: 4975380 - DNA, 12 bp, Homo sapiens
tgccatccaggt

SEQ ID NO: 4975381 - DNA, 15 bp, Homo sapiens
tgccatccaggttca

SEQ ID NO: 4975382 - DNA, 21 bp, Homo sapiens
tgccatccaggttcagcttgt

SEQ ID NO: 4975383 - DNA, 17 bp, Homo sapiens
tgccatcctctttctct

SEQ ID NO: 4975384 - DNA, 17 bp, Homo sapiens
tgccatgtacctcccct

SEQ ID NO: 4975385 - DNA, 21 bp, Homo sapiens
tgccatgtacctcccctgcct

SEQ ID NO: 4975386 - DNA, 16 bp, Homo sapiens
tgccattatccctgaa

SEQ ID NO: 4975387 - DNA, 20 bp, Homo sapiens
tgccattattttctgtcaga

SEQ ID NO: 4975388 - DNA, 21 bp, Homo sapiens
tgccattattttctgtcagat

SEQ ID NO: 4975389 - DNA, 18 bp, Homo sapiens
tgccattcatagagagcc

SEQ ID NO: 4975390 - DNA, 14 bp, Homo sapiens
tgccatttaaaaag

SEQ ID NO: 4975391 - DNA, 13 bp, Homo sapiens
tgccatttgatac

SEQ ID NO: 4975392 - DNA, 16 bp, Homo sapiens
tgcccaaagagcacaa

SEQ ID NO: 4975393 - DNA, 18 bp, Homo sapiens
tgcccaacctgctctcct

SEQ ID NO: 4975394 - DNA, 24 bp, Homo sapiens
tgcccaacctgctctcctcttgcc

SEQ ID NO: 4975395 - DNA, 15 bp, Homo sapiens
tgcccaattggagga

SEQ ID NO: 4975396 - DNA, 16 bp, Homo sapiens
tgcccaattggaggaa

SEQ ID NO: 4975397 - DNA, 16 bp, Homo sapiens
tgcccacaggatcagt

SEQ ID NO: 4975398 - DNA, 19 bp, Homo sapiens
tgcccacaggatcagtctg

SEQ ID NO: 4975399 - DNA, 18 bp, Homo sapiens
tgcccaccctgggagaca

SEQ ID NO: 4975400 - DNA, 22 bp, Homo sapiens
tgcccaccctgggagacagacc

SEQ ID NO: 4975401 - DNA, 22 bp, Homo sapiens
tgcccacctcagcctcccaaag

SEQ ID NO: 4975402 - DNA, 11 bp, Homo sapiens
tgcccagaact

SEQ ID NO: 4975403 - DNA, 13 bp, Homo sapiens
tgcccaggcaggt

SEQ ID NO: 4975404 - DNA, 15 bp, Homo sapiens
tgcccaggcaggtct

SEQ ID NO: 4975405 - DNA, 16 bp, Homo sapiens
tgcccaggcaggtctt

SEQ ID NO: 4975406 - DNA, 11 bp, Homo sapiens
tgcccaggccc

SEQ ID NO: 4975407 - DNA, 15 bp, Homo sapiens
tgcccaggcccctgc

SEQ ID NO: 4975408 - DNA, 15 bp, Homo sapiens
tgcccaggccggcca

SEQ ID NO: 4975409 - DNA, 17 bp, Homo sapiens
tgcccaggcctgcctgt

SEQ ID NO: 4975410 - DNA, 23 bp, Homo sapiens
tgcgtacgtttcctgagaagtgt

SEQ ID NO: 4975411 - DNA, 15 bp, Homo sapiens
tgcgtgccgtgtgag

SEQ ID NO: 4975412 - DNA, 17 bp, Homo sapiens
tgcgtgccgtgtgagtg

SEQ ID NO: 4975413 - DNA, 18 bp, Homo sapiens
tgcgtgccgtgtgagtgt

SEQ ID NO: 4975414 - DNA, 21 bp, Homo sapiens
tgcgtgtgtagagttaagaag

SEQ ID NO: 4975415 - DNA, 24 bp, Homo sapiens
tgcgtgtgtagagttaagaagctg

SEQ ID NO: 4975416 - DNA, 13 bp, Homo sapiens
tgcgttactaatt

SEQ ID NO: 4975417 - DNA, 20 bp, Homo sapiens
tgctaaatggtcgcccagga

SEQ ID NO: 4975418 - DNA, 20 bp, Homo sapiens
tgctaagcaagctaacctta

SEQ ID NO: 4975419 - DNA, 12 bp, Homo sapiens
tgctaaggttct

SEQ ID NO: 4975420 - DNA, 14 bp, Homo sapiens
tgctaaggttctaa

SEQ ID NO: 4975421 - DNA, 16 bp, Homo sapiens
tgctaaggttctaagg

SEQ ID NO: 4975422 - DNA, 17 bp, Homo sapiens
tgctaaggttctaaggc

SEQ ID NO: 4975423 - DNA, 18 bp, Homo sapiens
tgctaaggttctaaggcc

SEQ ID NO: 4975424 - DNA, 13 bp, Homo sapiens
tgctaatcttctt

SEQ ID NO: 4975425 - DNA, 20 bp, Homo sapiens
tgctaatcttcttatgcaat

SEQ ID NO: 4975426 - DNA, 19 bp, Homo sapiens
tgctacagaggaaacaata

SEQ ID NO: 4975427 - DNA, 15 bp, Homo sapiens
tgctaccgttgactt

SEQ ID NO: 4975428 - DNA, 18 bp, Homo sapiens
tgctactaagttcacatt

SEQ ID NO: 4975429 - DNA, 22 bp, Homo sapiens
tgctactgtacataaacaatga

SEQ ID NO: 4975430 - DNA, 10 bp, Homo sapiens
tgctagaact

SEQ ID NO: 4975431 - DNA, 12 bp, Homo sapiens
tgctagaacttt

SEQ ID NO: 4975432 - DNA, 13 bp, Homo sapiens
tgctagaactttt

SEQ ID NO: 4975433 - DNA, 14 bp, Homo sapiens
tgctagaacttttt

SEQ ID NO: 4975434 - DNA, 16 bp, Homo sapiens
tgctagaactttttta

SEQ ID NO: 4975435 - DNA, 19 bp, Homo sapiens
tgctagaacttttttaaat

SEQ ID NO: 4975436 - DNA, 13 bp, Homo sapiens
tgctagaatactt

SEQ ID NO: 4975437 - DNA, 13 bp, Homo sapiens
tgctagataaaag

SEQ ID NO: 4975438 - DNA, 18 bp, Homo sapiens
tgctagcagtaaaagatg

SEQ ID NO: 4975439 - DNA, 17 bp, Homo sapiens
tgctagctatgtgacct

SEQ ID NO: 4975440 - DNA, 16 bp, Homo sapiens
tgctagtatttgaatt

SEQ ID NO: 4975441 - DNA, 22 bp, Homo sapiens
tgctagtatttgaattaaaact

SEQ ID NO: 4975442 - DNA, 15 bp, Homo sapiens
tgctagtgttctgtc

SEQ ID NO: 4975443 - DNA, 20 bp, Homo sapiens
tgctatcctgccaaaatcat

SEQ ID NO: 4975444 - DNA, 20 bp, Homo sapiens
tgctatctggaggccttcca

SEQ ID NO: 4975445 - DNA, 16 bp, Homo sapiens
tgctatgttactattt

SEQ ID NO: 4975446 - DNA, 20 bp, Homo sapiens
tgctattggaggatcagttt

SEQ ID NO: 4975447 - DNA, 18 bp, Homo sapiens
tgctatttattttcctaa

SEQ ID NO: 4975448 - DNA, 19 bp, Homo sapiens
tgctatttttgtttttaga

SEQ ID NO: 4975449 - DNA, 21 bp, Homo sapiens
tgctcaataaatgattcttag

SEQ ID NO: 4975450 - DNA, 15 bp, Homo sapiens
tgctcacatatctgt

SEQ ID NO: 4975451 - DNA, 17 bp, Homo sapiens
tgctcaccatgcttcca

SEQ ID NO: 4975452 - DNA, 12 bp, Homo sapiens
tgctcaggctgc

SEQ ID NO: 4975453 - DNA, 21 bp, Homo sapiens
tgctcaggctgcagctggaca

SEQ ID NO: 4975454 - DNA, 14 bp, Homo sapiens
tgctccaagattct

SEQ ID NO: 4975455 - DNA, 16 bp, Homo sapiens
tgctccaagattctag

SEQ ID NO: 4975456 - DNA, 14 bp, Homo sapiens
tgctccaccacatc

SEQ ID NO: 4975457 - DNA, 17 bp, Homo sapiens
tgctccacccttggcct

SEQ ID NO: 4975458 - DNA, 18 bp, Homo sapiens
tgctccacccttggcctg

SEQ ID NO: 4975459 - DNA, 14 bp, Homo sapiens
tgctccagaatttg

SEQ ID NO: 4975460 - DNA, 20 bp, Homo sapiens
tgctccagaatttggaaatc

SEQ ID NO: 4975461 - DNA, 21 bp, Homo sapiens
tgctccagaatttggaaatcc

SEQ ID NO: 4975462 - DNA, 15 bp, Homo sapiens
tgctccagcaacaca

SEQ ID NO: 4975463 - DNA, 19 bp, Homo sapiens
tgctccagcaacacagcct

SEQ ID NO: 4975464 - DNA, 14 bp, Homo sapiens
tgctccaggcctgc

SEQ ID NO: 4975465 - DNA, 20 bp, Homo sapiens
tgctccaggcctgcagcagg

SEQ ID NO: 4975466 - DNA, 20 bp, Homo sapiens
tgctccctaagccagcctgg

SEQ ID NO: 4975467 - DNA, 13 bp, Homo sapiens
tgctccctcccct

SEQ ID NO: 4975468 - DNA, 14 bp, Homo sapiens
tgctccctcccctg

SEQ ID NO: 4975469 - DNA, 20 bp, Homo sapiens
tgctccctcccctgccctgg

SEQ ID NO: 4975470 - DNA, 14 bp, Homo sapiens
tgctccctgaagcc

SEQ ID NO: 4975471 - DNA, 15 bp, Homo sapiens
tgctccctgaagcca

SEQ ID NO: 4975472 - DNA, 18 bp, Homo sapiens
tgctccctgaagccagcc

SEQ ID NO: 4975473 - DNA, 22 bp, Homo sapiens
tgctccctgaagccagccttct

SEQ ID NO: 4975474 - DNA, 15 bp, Homo sapiens
tgctcccttcagccc

SEQ ID NO: 4975475 - DNA, 14 bp, Homo sapiens
tgctcctctcccca

SEQ ID NO: 4975476 - DNA, 15 bp, Homo sapiens
tgctccttggcttac

SEQ ID NO: 4975477 - DNA, 17 bp, Homo sapiens
tgctccttggcttacct

SEQ ID NO: 4975478 - DNA, 19 bp, Homo sapiens
tgctccttggcttacctga

SEQ ID NO: 4975479 - DNA, 23 bp, Homo sapiens
tgctcgccctcctttctgtgccc

SEQ ID NO: 4975480 - DNA, 17 bp, Homo sapiens
tgctctcccctgccctg

SEQ ID NO: 4975481 - DNA, 14 bp, Homo sapiens
tgctctcctcttgc

SEQ ID NO: 4975482 - DNA, 19 bp, Homo sapiens
tgctctcgcacctttccaa

SEQ ID NO: 4975483 - DNA, 22 bp, Homo sapiens
tgctctcgcacctttccaaagt

SEQ ID NO: 4975484 - DNA, 17 bp, Homo sapiens
tgctctgaaatctcctt

SEQ ID NO: 4975485 - DNA, 19 bp, Homo sapiens
tgctctgatcatccactgt

SEQ ID NO: 4975486 - DNA, 14 bp, Homo sapiens
tgctctgctgacag

SEQ ID NO: 4975487 - DNA, 22 bp, Homo sapiens
tgctcttgtcccacgtgtcttc

SEQ ID NO: 4975488 - DNA, 15 bp, Homo sapiens
tgctcttgtttttat

SEQ ID NO: 4975489 - DNA, 21 bp, Homo sapiens
tgctgaaaaccatctggcctg

SEQ ID NO: 4975490 - DNA, 18 bp, Homo sapiens
tgctgaagggcattcttt

SEQ ID NO: 4975491 - DNA, 19 bp, Homo sapiens
tgctgacagacacaggccc

SEQ ID NO: 4975492 - DNA, 20 bp, Homo sapiens
tgctgaccaattgtgctgcc

SEQ ID NO: 4975493 - DNA, 21 bp, Homo sapiens
tgctgaccaattgtgctgcca

SEQ ID NO: 4975494 - DNA, 22 bp, Homo sapiens
tgctgaccaattgtgctgccat

SEQ ID NO: 4975495 - DNA, 22 bp, Homo sapiens
tgctgactgtactcctcccagg

SEQ ID NO: 4975496 - DNA, 17 bp, Homo sapiens
tgctgagcctctgctcc

SEQ ID NO: 4975497 - DNA, 15 bp, Homo sapiens
tgctgagctgtttat

SEQ ID NO: 4975498 - DNA, 16 bp, Homo sapiens
tgctgatttcccctct

SEQ ID NO: 4975499 - DNA, 17 bp, Homo sapiens
taaacagcagtgttccc

SEQ ID NO: 4975500 - DNA, 18 bp, Homo sapiens
taaacaggagacaggaag

SEQ ID NO: 4975501 - DNA, 14 bp, Homo sapiens
taaacataaaacaa

SEQ ID NO: 4975502 - DNA, 16 bp, Homo sapiens
taaacataatgaaaat

SEQ ID NO: 4975503 - DNA, 16 bp, Homo sapiens
taaacatcacacacac

SEQ ID NO: 4975504 - DNA, 17 bp, Homo sapiens
taaacatccttcaagaa

SEQ ID NO: 4975505 - DNA, 15 bp, Homo sapiens
taaacattaaatgtc

SEQ ID NO: 4975506 - DNA, 18 bp, Homo sapiens
taaacattaaatgtctta

SEQ ID NO: 4975507 - DNA, 22 bp, Homo sapiens
taaacattaatcaatcatctgt

SEQ ID NO: 4975508 - DNA, 18 bp, Homo sapiens
taaacattcttttaactt

SEQ ID NO: 4975509 - DNA, 20 bp, Homo sapiens
taaacattgacgattccttc

SEQ ID NO: 4975510 - DNA, 19 bp, Homo sapiens
taaacgcaagctgagctgg

SEQ ID NO: 4975511 - DNA, 14 bp, Homo sapiens
taaactactctttg

SEQ ID NO: 4975512 - DNA, 14 bp, Homo sapiens
taaactatattttc

SEQ ID NO: 4975513 - DNA, 17 bp, Homo sapiens
taaactatcagtttgtc

SEQ ID NO: 4975514 - DNA, 15 bp, Homo sapiens
taaactcaaaactta

SEQ ID NO: 4975515 - DNA, 14 bp, Homo sapiens
taaactcaaaatat

SEQ ID NO: 4975516 - DNA, 21 bp, Homo sapiens
taaactcaaaatatttgtaca

SEQ ID NO: 4975517 - DNA, 20 bp, Homo sapiens
taaactcagggacagagcca

SEQ ID NO: 4975518 - DNA, 15 bp, Homo sapiens
taaactctaaacatt

SEQ ID NO: 4975519 - DNA, 11 bp, Homo sapiens
taaactgccat

SEQ ID NO: 4975520 - DNA, 13 bp, Homo sapiens
taaactgccatat

SEQ ID NO: 4975521 - DNA, 12 bp, Homo sapiens
taaactgtgttt

SEQ ID NO: 4975522 - DNA, 13 bp, Homo sapiens
taaacttcagcac

SEQ ID NO: 4975523 - DNA, 16 bp, Homo sapiens
taaacttcagcaccat

SEQ ID NO: 4975524 - DNA, 17 bp, Homo sapiens
taaacttgtttgctgtg

SEQ ID NO: 4975525 - DNA, 20 bp, Homo sapiens
taaacttgtttgctgtgaac

SEQ ID NO: 4975526 - DNA, 18 bp, Homo sapiens
taaactttttttcaatgt

SEQ ID NO: 4975527 - DNA, 12 bp, Homo sapiens
taaagaaaactg

SEQ ID NO: 4975528 - DNA, 13 bp, Homo sapiens
taaagaaaacttc

SEQ ID NO: 4975529 - DNA, 19 bp, Homo sapiens
taaagaaacagctttcaag

SEQ ID NO: 4975530 - DNA, 23 bp, Homo sapiens
taaagaaacagctttcaagtgcc

SEQ ID NO: 4975531 - DNA, 21 bp, Homo sapiens
taaagaaagtcgaattaatag

SEQ ID NO: 4975532 - DNA, 17 bp, Homo sapiens
taaagaaatttactata

SEQ ID NO: 4975533 - DNA, 21 bp, Homo sapiens
taaagacagggaagagcagaa

SEQ ID NO: 4975534 - DNA, 13 bp, Homo sapiens
taaagaccaaact

SEQ ID NO: 4975535 - DNA, 19 bp, Homo sapiens
taaagacccagggggagaa

SEQ ID NO: 4975536 - DNA, 17 bp, Homo sapiens
taaagacgatttgtcag

SEQ ID NO: 4975537 - DNA, 13 bp, Homo sapiens
taaagagtctaga

SEQ ID NO: 4975538 - DNA, 21 bp, Homo sapiens
taaagagtctagattcaaagg

SEQ ID NO: 4975539 - DNA, 14 bp, Homo sapiens
taaagataattgct

SEQ ID NO: 4975540 - DNA, 20 bp, Homo sapiens
taaagatatggagaattgct

SEQ ID NO: 4975541 - DNA, 21 bp, Homo sapiens
taaagattctatagttctaga

SEQ ID NO: 4975542 - DNA, 19 bp, Homo sapiens
taaagcaaaaaatgaatgt

SEQ ID NO: 4975543 - DNA, 22 bp, Homo sapiens
taaagcaactgttatgaaataa

SEQ ID NO: 4975544 - DNA, 17 bp, Homo sapiens
taaagcataagtataca

SEQ ID NO: 4975545 - DNA, 20 bp, Homo sapiens
taaagcattgctgttatgtc

SEQ ID NO: 4975546 - DNA, 13 bp, Homo sapiens
taaagcattgctt

SEQ ID NO: 4975547 - DNA, 14 bp, Homo sapiens
taaagccagcctga

SEQ ID NO: 4975548 - DNA, 23 bp, Homo sapiens
taaagcccgcctgacagaaacca

SEQ ID NO: 4975549 - DNA, 21 bp, Homo sapiens
taaagcctcaaggttttaggt

SEQ ID NO: 4975550 - DNA, 17 bp, Homo sapiens
taaagcgatatacagat

SEQ ID NO: 4975551 - DNA, 12 bp, Homo sapiens
taaaggactgta

SEQ ID NO: 4975552 - DNA, 19 bp, Homo sapiens
taaaggcaccatctaatag

SEQ ID NO: 4975553 - DNA, 17 bp, Homo sapiens
taaaggcccagccccta

SEQ ID NO: 4975554 - DNA, 15 bp, Homo sapiens
taaagggcctgcctg

SEQ ID NO: 4975555 - DNA, 20 bp, Homo sapiens
taaagtatagagagaagttc

SEQ ID NO: 4975556 - DNA, 13 bp, Homo sapiens
taaagtatgtaaa

SEQ ID NO: 4975557 - DNA, 22 bp, Homo sapiens
taaagtatgtaaagtatgtaaa

SEQ ID NO: 4975558 - DNA, 12 bp, Homo sapiens
taaagtattttt

SEQ ID NO: 4975559 - DNA, 20 bp, Homo sapiens
taaagtgctaaggttctaag

SEQ ID NO: 4975560 - DNA, 22 bp, Homo sapiens
taaagtgctaaggttctaaggc

SEQ ID NO: 4975561 - DNA, 21 bp, Homo sapiens
taaagtgggttattctggagt

SEQ ID NO: 4975562 - DNA, 22 bp, Homo sapiens
taaagtgggttattctggagtt

SEQ ID NO: 4975563 - DNA, 20 bp, Homo sapiens
taaagtgttctgccagatct

SEQ ID NO: 4975564 - DNA, 15 bp, Homo sapiens
taaagtgtttcagct

SEQ ID NO: 4975565 - DNA, 18 bp, Homo sapiens
taaagtgtttcagctaag

SEQ ID NO: 4975566 - DNA, 14 bp, Homo sapiens
taaagttagaatct

SEQ ID NO: 4975567 - DNA, 19 bp, Homo sapiens
taaagttagaatctatttt

SEQ ID NO: 4975568 - DNA, 22 bp, Homo sapiens
taaagttagaatctattttcta

SEQ ID NO: 4975569 - DNA, 12 bp, Homo sapiens
taaagttctaag

SEQ ID NO: 4975570 - DNA, 16 bp, Homo sapiens
taaagttctaagattc

SEQ ID NO: 4975571 - DNA, 17 bp, Homo sapiens
taaagttctaagattct

SEQ ID NO: 4975572 - DNA, 22 bp, Homo sapiens
taaagttctaagattctgattt

SEQ ID NO: 4975573 - DNA, 14 bp, Homo sapiens
taaagttggaattt

SEQ ID NO: 4975574 - DNA, 18 bp, Homo sapiens
taaagttggaatttacca

SEQ ID NO: 4975575 - DNA, 15 bp, Homo sapiens
gtgtcttaattatta

SEQ ID NO: 4975576 - DNA, 13 bp, Homo sapiens
gtgtgaatgaaca

SEQ ID NO: 4975577 - DNA, 15 bp, Homo sapiens
gtgtgaatgtgggca

SEQ ID NO: 4975578 - DNA, 22 bp, Homo sapiens
gtgtgacaaggattgctactgt

SEQ ID NO: 4975579 - DNA, 13 bp, Homo sapiens
gtgtgacagggcc

SEQ ID NO: 4975580 - DNA, 15 bp, Homo sapiens
gtgtgacattccagg

SEQ ID NO: 4975581 - DNA, 16 bp, Homo sapiens
gtgtgaccaactgtgt

SEQ ID NO: 4975582 - DNA, 15 bp, Homo sapiens
gtgtgacctgagggc

SEQ ID NO: 4975583 - DNA, 13 bp, Homo sapiens
gtgtgagtcacca

SEQ ID NO: 4975584 - DNA, 21 bp, Homo sapiens
gtgtgatcttaatatatttga

SEQ ID NO: 4975585 - DNA, 22 bp, Homo sapiens
gtgtgatcttaatatatttgaa

SEQ ID NO: 4975586 - DNA, 20 bp, Homo sapiens
gtgtgcacaaatatttattt

SEQ ID NO: 4975587 - DNA, 16 bp, Homo sapiens
gtgtgcccccttcaag

SEQ ID NO: 4975588 - DNA, 22 bp, Homo sapiens
gtgtgcctcagtatatttaaac

SEQ ID NO: 4975589 - DNA, 14 bp, Homo sapiens
gtgtggctccttcc

SEQ ID NO: 4975590 - DNA, 13 bp, Homo sapiens
gtgtggtggcctc

SEQ ID NO: 4975591 - DNA, 20 bp, Homo sapiens
gtgtgtagagttaagaagct

SEQ ID NO: 4975592 - DNA, 22 bp, Homo sapiens
gtgtgtataagtgcacacagaa

SEQ ID NO: 4975593 - DNA, 21 bp, Homo sapiens
gtgtgtgcgcctacaggagtg

SEQ ID NO: 4975594 - DNA, 13 bp, Homo sapiens
gtgtgtgtatgtg

SEQ ID NO: 4975595 - DNA, 13 bp, Homo sapiens
gtgtgtgtgaatg

SEQ ID NO: 4975596 - DNA, 10 bp, Homo sapiens
gtgtgtgtgt

SEQ ID NO: 4975597 - DNA, 13 bp, Homo sapiens
gtgtgtgtgtggc

SEQ ID NO: 4975598 - DNA, 15 bp, Homo sapiens
gtgtgtgtgtgtgta

SEQ ID NO: 4975599 - DNA, 13 bp, Homo sapiens
gtgtgttggacag

SEQ ID NO: 4975600 - DNA, 16 bp, Homo sapiens
gtgtgttgtcttgaaa

SEQ ID NO: 4975601 - DNA, 16 bp, Homo sapiens
gtgttacttatggaag

SEQ ID NO: 4975602 - DNA, 14 bp, Homo sapiens
gtgttactttttgt

SEQ ID NO: 4975603 - DNA, 17 bp, Homo sapiens
gtgttccaagtttccaa

SEQ ID NO: 4975604 - DNA, 19 bp, Homo sapiens
gtgttccccatctgggtcc

SEQ ID NO: 4975605 - DNA, 20 bp, Homo sapiens
gtgttccctttgtctttcaa

SEQ ID NO: 4975606 - DNA, 21 bp, Homo sapiens
gtgttccctttgtctttcaaa

SEQ ID NO: 4975607 - DNA, 23 bp, Homo sapiens
gtgttctatccaaacatgtattt

SEQ ID NO: 4975608 - DNA, 11 bp, Homo sapiens
gtgttctcctt

SEQ ID NO: 4975609 - DNA, 23 bp, Homo sapiens
gtgttctgtttgttattgttttg

SEQ ID NO: 4975610 - DNA, 12 bp, Homo sapiens
gtgttgaaaacc

SEQ ID NO: 4975611 - DNA, 21 bp, Homo sapiens
gtgttgaaaaccaaaatgaca

SEQ ID NO: 4975612 - DNA, 17 bp, Homo sapiens
gtgttgaaaatgttcag

SEQ ID NO: 4975613 - DNA, 20 bp, Homo sapiens
gtgttgtaattcttcagttg

SEQ ID NO: 4975614 - DNA, 21 bp, Homo sapiens
gtgttgtcattgtaaacaaac

SEQ ID NO: 4975615 - DNA, 13 bp, Homo sapiens
gtgtttataaaat

SEQ ID NO: 4975616 - DNA, 18 bp, Homo sapiens
gtgtttccatattttata

SEQ ID NO: 4975617 - DNA, 17 bp, Homo sapiens
gtgtttctattgacttc

SEQ ID NO: 4975618 - DNA, 16 bp, Homo sapiens
gtgtttggtttacatt

SEQ ID NO: 4975619 - DNA, 17 bp, Homo sapiens
gtgtttggtttacattt

SEQ ID NO: 4975620 - DNA, 15 bp, Homo sapiens
gtgttttaattccaa

SEQ ID NO: 4975621 - DNA, 16 bp, Homo sapiens
gtgttttagatggttt

SEQ ID NO: 4975622 - DNA, 18 bp, Homo sapiens
gttaaaactgtacattta

SEQ ID NO: 4975623 - DNA, 19 bp, Homo sapiens
gttaaaactgtacatttaa

SEQ ID NO: 4975624 - DNA, 22 bp, Homo sapiens
gttaaaactgtacatttaaaat

SEQ ID NO: 4975625 - DNA, 21 bp, Homo sapiens
gttaaactgttagcactgttg

SEQ ID NO: 4975626 - DNA, 19 bp, Homo sapiens
gttaaatagagtatatgca

SEQ ID NO: 4975627 - DNA, 17 bp, Homo sapiens
gttaaatgaaattgtaa

SEQ ID NO: 4975628 - DNA, 18 bp, Homo sapiens
gttaaatgaaattgtaaa

SEQ ID NO: 4975629 - DNA, 16 bp, Homo sapiens
gttaaatttgtaagtt

SEQ ID NO: 4975630 - DNA, 19 bp, Homo sapiens
gttaaatttgtaagtttca

SEQ ID NO: 4975631 - DNA, 19 bp, Homo sapiens
gttaagaagctgttgtaca

SEQ ID NO: 4975632 - DNA, 20 bp, Homo sapiens
gttaagcattaccactcagg

SEQ ID NO: 4975633 - DNA, 14 bp, Homo sapiens
gttaaggaaactct

SEQ ID NO: 4975634 - DNA, 19 bp, Homo sapiens
gttaaggaaactcttatct

SEQ ID NO: 4975635 - DNA, 18 bp, Homo sapiens
gttaatacgcaggcatct

SEQ ID NO: 4975636 - DNA, 23 bp, Homo sapiens
gttaatctctgttatgtactgta

SEQ ID NO: 4975637 - DNA, 18 bp, Homo sapiens
gttaatgatagctactgt

SEQ ID NO: 4975638 - DNA, 20 bp, Homo sapiens
gttaatgtatttgttcatgt

SEQ ID NO: 4975639 - DNA, 19 bp, Homo sapiens
gttaattccaattatatga

SEQ ID NO: 4975640 - DNA, 16 bp, Homo sapiens
gttacaaactacagac

SEQ ID NO: 4975641 - DNA, 22 bp, Homo sapiens
gttacaagtatacttatatttc

SEQ ID NO: 4975642 - DNA, 12 bp, Homo sapiens
gttacacccttt

SEQ ID NO: 4975643 - DNA, 22 bp, Homo sapiens
gttacaccctttcttgacaaaa

SEQ ID NO: 4975644 - DNA, 23 bp, Homo sapiens
gttaccacacatctatgatataa

SEQ ID NO: 4975645 - DNA, 14 bp, Homo sapiens
gttactcagggctc

SEQ ID NO: 4975646 - DNA, 9 bp, Homo sapiens
gttactgtt

SEQ ID NO: 4975647 - DNA, 18 bp, Homo sapiens
gttactgttaaccattta

SEQ ID NO: 4975648 - DNA, 16 bp, Homo sapiens
gttactgttcttgctg

SEQ ID NO: 4975649 - DNA, 19 bp, Homo sapiens
gttactgttcttgctgcta

SEQ ID NO: 4975650 - DNA, 14 bp, Homo sapiens
gttagaatctattt

SEQ ID NO: 4975651 - DNA, 19 bp, Homo sapiens
gttagaatgagatctgaat

SEQ ID NO: 4975652 - DNA, 22 bp, Homo sapiens
gttagactgacttgtttgtctt

SEQ ID NO: 4975653 - DNA, 20 bp, Homo sapiens
gttagagacttttttctagt

SEQ ID NO: 4975654 - DNA, 22 bp, Homo sapiens
gttaggaaataaaacctttcaa

SEQ ID NO: 4975655 - DNA, 23 bp, Homo sapiens
gttaggaaataaaacctttcaaa

SEQ ID NO: 4975656 - DNA, 18 bp, Homo sapiens
gttaggcattaatgtttc

SEQ ID NO: 4975657 - DNA, 17 bp, Homo sapiens
gttagtgttttaagaaa

SEQ ID NO: 4975658 - DNA, 19 bp, Homo sapiens
gttagttatagatgtctag

SEQ ID NO: 4975659 - DNA, 14 bp, Homo sapiens
gttataagactctc

SEQ ID NO: 4975660 - DNA, 17 bp, Homo sapiens
gttatagtaactcccat

SEQ ID NO: 4975661 - DNA, 17 bp, Homo sapiens
gttatatattttttgta

SEQ ID NO: 4975662 - DNA, 17 bp, Homo sapiens
gttatcgaaataacaat

SEQ ID NO: 4975663 - DNA, 18 bp, Homo sapiens
gttatcgaaataacaatg

SEQ ID NO: 4975664 - DNA, 23 bp, Homo sapiens
gttatcgaaataacaatgttaag

SEQ ID NO: 4975665 - DNA, 14 bp, Homo sapiens
gttatctctgtgtt

SEQ ID NO: 4975666 - DNA, 18 bp, Homo sapiens
gttatcttctcaagttct

SEQ ID NO: 4975667 - DNA, 22 bp, Homo sapiens
gttatcttctcaagttctaaga

SEQ ID NO: 4975668 - DNA, 13 bp, Homo sapiens
gttatgaaagaat

SEQ ID NO: 4975669 - DNA, 22 bp, Homo sapiens
gttattcattctgtgatcattt

SEQ ID NO: 4975670 - DNA, 20 bp, Homo sapiens
gttttagattttctggttct

SEQ ID NO: 4975671 - DNA, 16 bp, Homo sapiens
gttttaggtagaaaaa

SEQ ID NO: 4975672 - DNA, 12 bp, Homo sapiens
gttttaggttct

SEQ ID NO: 4975673 - DNA, 13 bp, Homo sapiens
gttttaggttcta

SEQ ID NO: 4975674 - DNA, 11 bp, Homo sapiens
gttttatcaag

SEQ ID NO: 4975675 - DNA, 22 bp, Homo sapiens
gttttatcatgacatgttatat

SEQ ID NO: 4975676 - DNA, 14 bp, Homo sapiens
gttttattcattgg

SEQ ID NO: 4975677 - DNA, 22 bp, Homo sapiens
gttttcatggtgaaaatgtact

SEQ ID NO: 4975678 - DNA, 16 bp, Homo sapiens
gttttcatttggttca

SEQ ID NO: 4975679 - DNA, 23 bp, Homo sapiens
gttttccacccataatcctttct

SEQ ID NO: 4975680 - DNA, 16 bp, Homo sapiens
gttttctcctcccagg

SEQ ID NO: 4975681 - DNA, 20 bp, Homo sapiens
gttttctcctgcctgtgctg

SEQ ID NO: 4975682 - DNA, 17 bp, Homo sapiens
gttttctctcggctccc

SEQ ID NO: 4975683 - DNA, 20 bp, Homo sapiens
gttttctctttgtggggctt

SEQ ID NO: 4975684 - DNA, 16 bp, Homo sapiens
gttttctttctttaaa

SEQ ID NO: 4975685 - DNA, 14 bp, Homo sapiens
gttttgaaaagcta

SEQ ID NO: 4975686 - DNA, 18 bp, Homo sapiens
gttttgaagctactgtgt

SEQ ID NO: 4975687 - DNA, 15 bp, Homo sapiens
gttttgaaggcaaaa

SEQ ID NO: 4975688 - DNA, 13 bp, Homo sapiens
gttttgcactttt

SEQ ID NO: 4975689 - DNA, 18 bp, Homo sapiens
gttttggatcttgaatgt

SEQ ID NO: 4975690 - DNA, 21 bp, Homo sapiens
gttttgggggtgtgagtgttt

SEQ ID NO: 4975691 - DNA, 18 bp, Homo sapiens
gttttgggtagctgccac

SEQ ID NO: 4975692 - DNA, 11 bp, Homo sapiens
gttttgtttgt

SEQ ID NO: 4975693 - DNA, 12 bp, Homo sapiens
gttttgtttgtc

SEQ ID NO: 4975694 - DNA, 22 bp, Homo sapiens
gttttgtttgtctctccttttc

SEQ ID NO: 4975695 - DNA, 12 bp, Homo sapiens
gttttgttttgg

SEQ ID NO: 4975696 - DNA, 13 bp, Homo sapiens
gtttttaaaagtt

SEQ ID NO: 4975697 - DNA, 23 bp, Homo sapiens
gtttttaaatagagtttgctatt

SEQ ID NO: 4975698 - DNA, 20 bp, Homo sapiens
gtttttaatagctatggaat

SEQ ID NO: 4975699 - DNA, 17 bp, Homo sapiens
gtttttacagctgtgtt

SEQ ID NO: 4975700 - DNA, 20 bp, Homo sapiens
gtttttacctgtcacattgc

SEQ ID NO: 4975701 - DNA, 23 bp, Homo sapiens
gtttttacctgtcacattgcatt

SEQ ID NO: 4975702 - DNA, 17 bp, Homo sapiens
gtttttccttatttgct

SEQ ID NO: 4975703 - DNA, 14 bp, Homo sapiens
gtttttctgccagg

SEQ ID NO: 4975704 - DNA, 16 bp, Homo sapiens
gttttttcctttgctc

SEQ ID NO: 4975705 - DNA, 21 bp, Homo sapiens
gtttttttttttaaaaaaaga

SEQ ID NO: 4975706 - DNA, 23 bp, Homo sapiens
gtttttttttttaaaaaaagaaa

SEQ ID NO: 4975707 - DNA, 22 bp, Homo sapiens
taaaaaaaaaaaaaagctttat

SEQ ID NO: 4975708 - DNA, 21 bp, Homo sapiens
taaaaaaaaaagttacagaaa

SEQ ID NO: 4975709 - DNA, 23 bp, Homo sapiens
taaaaaaaaatagatgtctttta

SEQ ID NO: 4975710 - DNA, 13 bp, Homo sapiens
taaaaaaagaaaa

SEQ ID NO: 4975711 - DNA, 14 bp, Homo sapiens
taaaaaaagaaaat

SEQ ID NO: 4975712 - DNA, 15 bp, Homo sapiens
taaaaaaagagaatt

SEQ ID NO: 4975713 - DNA, 15 bp, Homo sapiens
taaaaaatggaaaga

SEQ ID NO: 4975714 - DNA, 18 bp, Homo sapiens
taaaaaccagacaaggaa

SEQ ID NO: 4975715 - DNA, 20 bp, Homo sapiens
taaaaagaaaaaccactccc

SEQ ID NO: 4975716 - DNA, 23 bp, Homo sapiens
taaaaagaaaaaccactcccagt

SEQ ID NO: 4975717 - DNA, 19 bp, Homo sapiens
taaaaagcctgcaatttca

SEQ ID NO: 4975718 - DNA, 13 bp, Homo sapiens
taaaaatatatat

SEQ ID NO: 4975719 - DNA, 23 bp, Homo sapiens
taaaaatatggaacttctaatat

SEQ ID NO: 4975720 - DNA, 18 bp, Homo sapiens
taaaaatgtaaatattct

SEQ ID NO: 4975721 - DNA, 19 bp, Homo sapiens
taaaaatgtaaatattcta

SEQ ID NO: 4975722 - DNA, 18 bp, Homo sapiens
taaaacagctgtctctaa

SEQ ID NO: 4975723 - DNA, 21 bp, Homo sapiens
taaaacagtatttattttgta

SEQ ID NO: 4975724 - DNA, 12 bp, Homo sapiens
taaaacattatg

SEQ ID NO: 4975725 - DNA, 21 bp, Homo sapiens
taaaacattggattatcctga

SEQ ID NO: 4975726 - DNA, 21 bp, Homo sapiens
taaaaccccagccaactcatt

SEQ ID NO: 4975727 - DNA, 16 bp, Homo sapiens
taaaacctttcaaatt

SEQ ID NO: 4975728 - DNA, 20 bp, Homo sapiens
taaaacgctgtcaaaagttg

SEQ ID NO: 4975729 - DNA, 12 bp, Homo sapiens
taaaactgcttt

SEQ ID NO: 4975730 - DNA, 16 bp, Homo sapiens
taaaactggcctgact

SEQ ID NO: 4975731 - DNA, 21 bp, Homo sapiens
taaaacttcttaaatatcttt

SEQ ID NO: 4975732 - DNA, 17 bp, Homo sapiens
taaaagaatattcagag

SEQ ID NO: 4975733 - DNA, 15 bp, Homo sapiens
taaaagcaaaataaa

SEQ ID NO: 4975734 - DNA, 21 bp, Homo sapiens
taaaagcaaaataaaaactat

SEQ ID NO: 4975735 - DNA, 15 bp, Homo sapiens
taaaaggatagtatt

SEQ ID NO: 4975736 - DNA, 19 bp, Homo sapiens
taaaaggcaaatgtgtaca

SEQ ID NO: 4975737 - DNA, 17 bp, Homo sapiens
taaaagggcaaatctgc

SEQ ID NO: 4975738 - DNA, 19 bp, Homo sapiens
taaaagggggtccgtggaa

SEQ ID NO: 4975739 - DNA, 18 bp, Homo sapiens
taaaagtgaatgaaagat

SEQ ID NO: 4975740 - DNA, 23 bp, Homo sapiens
taaaagtgggcttgattctgcag

SEQ ID NO: 4975741 - DNA, 15 bp, Homo sapiens
taaaagtttcaatgt

SEQ ID NO: 4975742 - DNA, 15 bp, Homo sapiens
taaaataaacagttg

SEQ ID NO: 4975743 - DNA, 17 bp, Homo sapiens
taaaataaacagttgtg

SEQ ID NO: 4975744 - DNA, 14 bp, Homo sapiens
taaaataaattagt

SEQ ID NO: 4975745 - DNA, 15 bp, Homo sapiens
taaaataattctaaa

SEQ ID NO: 4975746 - DNA, 17 bp, Homo sapiens
taaaatagaaataagtg

SEQ ID NO: 4975747 - DNA, 23 bp, Homo sapiens
taaaatagagtgtagtttacaga

SEQ ID NO: 4975748 - DNA, 13 bp, Homo sapiens
taaaatattcctg

SEQ ID NO: 4975749 - DNA, 15 bp, Homo sapiens
taaaatatttatctg

SEQ ID NO: 4975750 - DNA, 13 bp, Homo sapiens
taaaatatttatt

SEQ ID NO: 4975751 - DNA, 22 bp, Homo sapiens
gttcagcacttgtctcatttta

SEQ ID NO: 4975752 - DNA, 18 bp, Homo sapiens
gttcaggggactcagccc

SEQ ID NO: 4975753 - DNA, 19 bp, Homo sapiens
gttcaggggactcagccct

SEQ ID NO: 4975754 - DNA, 19 bp, Homo sapiens
gttcagggttggcccctgc

SEQ ID NO: 4975755 - DNA, 20 bp, Homo sapiens
gttcagggttggcccctgcc

SEQ ID NO: 4975756 - DNA, 18 bp, Homo sapiens
gttcaggtaacaggcaga

SEQ ID NO: 4975757 - DNA, 18 bp, Homo sapiens
gttcagtttcttctgcgc

SEQ ID NO: 4975758 - DNA, 22 bp, Homo sapiens
gttcatacactaaccaaatctc

SEQ ID NO: 4975759 - DNA, 16 bp, Homo sapiens
gttcatacatttgagg

SEQ ID NO: 4975760 - DNA, 13 bp, Homo sapiens
gttcatacctaag

SEQ ID NO: 4975761 - DNA, 17 bp, Homo sapiens
gttcatacctaagtact

SEQ ID NO: 4975762 - DNA, 19 bp, Homo sapiens
gttcatacctaagtactgt

SEQ ID NO: 4975763 - DNA, 19 bp, Homo sapiens
gttcatattccatatttat

SEQ ID NO: 4975764 - DNA, 16 bp, Homo sapiens
gttcatcccagcccca

SEQ ID NO: 4975765 - DNA, 14 bp, Homo sapiens
gttcatgagaatct

SEQ ID NO: 4975766 - DNA, 19 bp, Homo sapiens
gttcatgagaatctatatt

SEQ ID NO: 4975767 - DNA, 17 bp, Homo sapiens
gttcatgatgcagtctc

SEQ ID NO: 4975768 - DNA, 16 bp, Homo sapiens
gttcatgccaccatgg

SEQ ID NO: 4975769 - DNA, 15 bp, Homo sapiens
gttcatgtagagaaa

SEQ ID NO: 4975770 - DNA, 24 bp, Homo sapiens
gttcatgtttgcttcataaatgaa

SEQ ID NO: 4975771 - DNA, 16 bp, Homo sapiens
gttcattaaagcatga

SEQ ID NO: 4975772 - DNA, 15 bp, Homo sapiens
gttcatttgtttgtt

SEQ ID NO: 4975773 - DNA, 16 bp, Homo sapiens
gttccaagagtctaaa

SEQ ID NO: 4975774 - DNA, 20 bp, Homo sapiens
gttccaagagtctaaagatg

SEQ ID NO: 4975775 - DNA, 17 bp, Homo sapiens
gttccaagtccaataag

SEQ ID NO: 4975776 - DNA, 14 bp, Homo sapiens
gttccacagttgcc

SEQ ID NO: 4975777 - DNA, 12 bp, Homo sapiens
gttccagctctt

SEQ ID NO: 4975778 - DNA, 14 bp, Homo sapiens
gttccagctctttg

SEQ ID NO: 4975779 - DNA, 21 bp, Homo sapiens
gttccatctcctataatctgt

SEQ ID NO: 4975780 - DNA, 19 bp, Homo sapiens
gttcccatgtagccccctg

SEQ ID NO: 4975781 - DNA, 15 bp, Homo sapiens
gttcccctgttcact

SEQ ID NO: 4975782 - DNA, 16 bp, Homo sapiens
gttcccgtttctccac

SEQ ID NO: 4975783 - DNA, 19 bp, Homo sapiens
gttcccgtttctccaccta

SEQ ID NO: 4975784 - DNA, 20 bp, Homo sapiens
gttccctacttcctgtgact

SEQ ID NO: 4975785 - DNA, 16 bp, Homo sapiens
gttccctctgctcagc

SEQ ID NO: 4975786 - DNA, 17 bp, Homo sapiens
gttccctctgctcagcc

SEQ ID NO: 4975787 - DNA, 15 bp, Homo sapiens
gttccctgaaacacg

SEQ ID NO: 4975788 - DNA, 15 bp, Homo sapiens
gttccctgttcttcc

SEQ ID NO: 4975789 - DNA, 15 bp, Homo sapiens
gttcccttggcctca

SEQ ID NO: 4975790 - DNA, 20 bp, Homo sapiens
gttccctttgtctttcaaac

SEQ ID NO: 4975791 - DNA, 19 bp, Homo sapiens
gttcctaagaagcttctaa

SEQ ID NO: 4975792 - DNA, 22 bp, Homo sapiens
gttcctctctggtggctctttg

SEQ ID NO: 4975793 - DNA, 20 bp, Homo sapiens
gttcctgacatcacagcagc

SEQ ID NO: 4975794 - DNA, 23 bp, Homo sapiens
gttcctgacatcacagcagcctc

SEQ ID NO: 4975795 - DNA, 13 bp, Homo sapiens
gttccttagacct

SEQ ID NO: 4975796 - DNA, 23 bp, Homo sapiens
gttcctttccttttctttaaaga

SEQ ID NO: 4975797 - DNA, 14 bp, Homo sapiens
gttcgcatggtcac

SEQ ID NO: 4975798 - DNA, 14 bp, Homo sapiens
gttcgttggttata

SEQ ID NO: 4975799 - DNA, 10 bp, Homo sapiens
gttctaaagc

SEQ ID NO: 4975800 - DNA, 14 bp, Homo sapiens
gttctaaagctctg

SEQ ID NO: 4975801 - DNA, 18 bp, Homo sapiens
gttctaaagttctaagat

SEQ ID NO: 4975802 - DNA, 17 bp, Homo sapiens
gttctaagactcaaatg

SEQ ID NO: 4975803 - DNA, 21 bp, Homo sapiens
gttctaagatgtgatattcta

SEQ ID NO: 4975804 - DNA, 15 bp, Homo sapiens
gttctaagattctga

SEQ ID NO: 4975805 - DNA, 20 bp, Homo sapiens
gttctaaggcctaggattct

SEQ ID NO: 4975806 - DNA, 22 bp, Homo sapiens
gttctaaggcctaggattctaa

SEQ ID NO: 4975807 - DNA, 23 bp, Homo sapiens
gttctaaggcctaggattctaaa

SEQ ID NO: 4975808 - DNA, 13 bp, Homo sapiens
gttctaaggctct

SEQ ID NO: 4975809 - DNA, 21 bp, Homo sapiens
gttctaagtttctaagattct

SEQ ID NO: 4975810 - DNA, 18 bp, Homo sapiens
gttctacccgttccaaaa

SEQ ID NO: 4975811 - DNA, 20 bp, Homo sapiens
gttctagacatggaggttct

SEQ ID NO: 4975812 - DNA, 16 bp, Homo sapiens
gttctaggtttcaaag

SEQ ID NO: 4975813 - DNA, 19 bp, Homo sapiens
gttctaggtttcaaagatg

SEQ ID NO: 4975814 - DNA, 22 bp, Homo sapiens
gttctaggtttcaaagatgctg

SEQ ID NO: 4975815 - DNA, 16 bp, Homo sapiens
gttctatggttatgaa

SEQ ID NO: 4975816 - DNA, 16 bp, Homo sapiens
gttctcaatgtgaaaa

SEQ ID NO: 4975817 - DNA, 13 bp, Homo sapiens
gttctccttttcc

SEQ ID NO: 4975818 - DNA, 14 bp, Homo sapiens
gttctctgaggaca

SEQ ID NO: 4975819 - DNA, 13 bp, Homo sapiens
gttctgcactgaa

SEQ ID NO: 4975820 - DNA, 21 bp, Homo sapiens
gttctgcagacacgccttccc

SEQ ID NO: 4975821 - DNA, 23 bp, Homo sapiens
gttctgcttcaaggcttccactg

SEQ ID NO: 4975822 - DNA, 12 bp, Homo sapiens
gttctggccaga

SEQ ID NO: 4975823 - DNA, 20 bp, Homo sapiens
gttctggctgccccaacctg

SEQ ID NO: 4975824 - DNA, 22 bp, Homo sapiens
gttctgtgtctttcacagctcc

SEQ ID NO: 4975825 - DNA, 21 bp, Homo sapiens
gttctgtgtttaatttcttca

SEQ ID NO: 4975826 - DNA, 19 bp, Homo sapiens
gttcttatgcaaaatggaa

SEQ ID NO: 4975827 - DNA, 21 bp, Homo sapiens
gttcttctgttctgcagacac

SEQ ID NO: 4975828 - DNA, 15 bp, Homo sapiens
gttcttgctgctaga

SEQ ID NO: 4975829 - DNA, 18 bp, Homo sapiens
gttcttgctgctagaact

SEQ ID NO: 4975830 - DNA, 19 bp, Homo sapiens
gttcttgctgctagaactt

SEQ ID NO: 4975831 - DNA, 22 bp, Homo sapiens
gttcttgctgctagaacttttt

SEQ ID NO: 4975832 - DNA, 15 bp, Homo sapiens
gttctttctggagtc

SEQ ID NO: 4975833 - DNA, 17 bp, Homo sapiens
gttctttcttcctctgc

SEQ ID NO: 4975834 - DNA, 19 bp, Homo sapiens
gttctttcttcctctgctg

SEQ ID NO: 4975835 - DNA, 21 bp, Homo sapiens
gttctttgagggactgcctct

SEQ ID NO: 4975836 - DNA, 22 bp, Homo sapiens
gttctttgagggactgcctctg

SEQ ID NO: 4975837 - DNA, 17 bp, Homo sapiens
gttgaaaaccaaaatga

SEQ ID NO: 4975838 - DNA, 18 bp, Homo sapiens
gttgaataaaagtgcaca

SEQ ID NO: 4975839 - DNA, 17 bp, Homo sapiens
gttgaatactttttaca

SEQ ID NO: 4975840 - DNA, 15 bp, Homo sapiens
gttgaatgacaacag

SEQ ID NO: 4975841 - DNA, 19 bp, Homo sapiens
gttgaatgacaacagaagc

SEQ ID NO: 4975842 - DNA, 15 bp, Homo sapiens
gttgacaactgtgac

SEQ ID NO: 4975843 - DNA, 19 bp, Homo sapiens
gttgagaatcccaaatttg

SEQ ID NO: 4975844 - DNA, 15 bp, Homo sapiens
gttgagcccctggag

SEQ ID NO: 4975845 - DNA, 21 bp, Homo sapiens
gttgaggcagggcaaatgaca

SEQ ID NO: 4975846 - DNA, 20 bp, Homo sapiens
gttgatatttcgaaagctgc

SEQ ID NO: 4975847 - DNA, 17 bp, Homo sapiens
gttgatttttactgtgt

SEQ ID NO: 4975848 - DNA, 17 bp, Homo sapiens
gttgccaagacaaatca

SEQ ID NO: 4975849 - DNA, 20 bp, Homo sapiens
gttgccaagacaaatcaaca

SEQ ID NO: 4975850 - DNA, 12 bp, Homo sapiens
gttgcccaggct

SEQ ID NO: 4975851 - DNA, 13 bp, Homo sapiens
gttgcccaggctg

SEQ ID NO: 4975852 - DNA, 14 bp, Homo sapiens
gttgcccaggctgg

SEQ ID NO: 4975853 - DNA, 15 bp, Homo sapiens
gttgcccaggctggc

SEQ ID NO: 4975854 - DNA, 21 bp, Homo sapiens
gttgcctaagcattgcctggc

SEQ ID NO: 4975855 - DNA, 17 bp, Homo sapiens
gttgcctaagtattaaa

SEQ ID NO: 4975856 - DNA, 16 bp, Homo sapiens
gttgcctaataaacat

SEQ ID NO: 4975857 - DNA, 18 bp, Homo sapiens
gttgccttaaagaaagtc

SEQ ID NO: 4975858 - DNA, 19 bp, Homo sapiens
gttgctgaaacttgctgag

SEQ ID NO: 4975859 - DNA, 15 bp, Homo sapiens
gttgctgtttcacaa

SEQ ID NO: 4975860 - DNA, 18 bp, Homo sapiens
gttggaaatattcatgct

SEQ ID NO: 4975861 - DNA, 14 bp, Homo sapiens
gttggaccccagag

SEQ ID NO: 4975862 - DNA, 17 bp, Homo sapiens
ggtgccagcctgaggca

SEQ ID NO: 4975863 - DNA, 13 bp, Homo sapiens
ggtgcctgtccca

SEQ ID NO: 4975864 - DNA, 21 bp, Homo sapiens
ggtgctaaatggtcgcccagg

SEQ ID NO: 4975865 - DNA, 15 bp, Homo sapiens
ggtgctgccatccag

SEQ ID NO: 4975866 - DNA, 22 bp, Homo sapiens
ggtgctggaggtgggagcagga

SEQ ID NO: 4975867 - DNA, 12 bp, Homo sapiens
ggtggcaagtgc

SEQ ID NO: 4975868 - DNA, 11 bp, Homo sapiens
ggtggcagctg

SEQ ID NO: 4975869 - DNA, 15 bp, Homo sapiens
ggtggcatacgcctg

SEQ ID NO: 4975870 - DNA, 20 bp, Homo sapiens
ggtggcccgacagcctggca

SEQ ID NO: 4975871 - DNA, 12 bp, Homo sapiens
ggtggcctcagc

SEQ ID NO: 4975872 - DNA, 21 bp, Homo sapiens
ggtgggaaccatgaagacagg

SEQ ID NO: 4975873 - DNA, 13 bp, Homo sapiens
ggtgggagcagga

SEQ ID NO: 4975874 - DNA, 16 bp, Homo sapiens
ggtgggagcaggagat

SEQ ID NO: 4975875 - DNA, 16 bp, Homo sapiens
ggtggggcgaggcagg

SEQ ID NO: 4975876 - DNA, 16 bp, Homo sapiens
ggtggtaccctctgga

SEQ ID NO: 4975877 - DNA, 20 bp, Homo sapiens
ggtggtgggaaccatgaaga

SEQ ID NO: 4975878 - DNA, 15 bp, Homo sapiens
ggtgtaataagacat

SEQ ID NO: 4975879 - DNA, 12 bp, Homo sapiens
ggtgtagccagg

SEQ ID NO: 4975880 - DNA, 19 bp, Homo sapiens
ggtgtcacatggtgcccct

SEQ ID NO: 4975881 - DNA, 19 bp, Homo sapiens
ggtgtcacctgaagactca

SEQ ID NO: 4975882 - DNA, 17 bp, Homo sapiens
ggtgtcagtatccaggc

SEQ ID NO: 4975883 - DNA, 20 bp, Homo sapiens
gggtcagaggacctgtattt

SEQ ID NO: 4975884 - DNA, 15 bp, Homo sapiens
gggtcaggcagccag

SEQ ID NO: 4975885 - DNA, 21 bp, Homo sapiens
gggtcatcctgtgctcggagg

SEQ ID NO: 4975886 - DNA, 16 bp, Homo sapiens
gggtcccagccacccc

SEQ ID NO: 4975887 - DNA, 14 bp, Homo sapiens
gggtcgaaagctct

SEQ ID NO: 4975888 - DNA, 14 bp, Homo sapiens
gggtctctccctca

SEQ ID NO: 4975889 - DNA, 18 bp, Homo sapiens
gggtctctccctcaggtg

SEQ ID NO: 4975890 - DNA, 21 bp, Homo sapiens
gggtctcttttgtaaattaaa

SEQ ID NO: 4975891 - DNA, 21 bp, Homo sapiens
gggtctgaggaatccagaccc

SEQ ID NO: 4975892 - DNA, 21 bp, Homo sapiens
gggtcttcagcattccctccc

SEQ ID NO: 4975893 - DNA, 13 bp, Homo sapiens
gggtgacagtcat

SEQ ID NO: 4975894 - DNA, 18 bp, Homo sapiens
gggtgagatgctggagaa

SEQ ID NO: 4975895 - DNA, 17 bp, Homo sapiens
gggtggatgcctggtgg

SEQ ID NO: 4975896 - DNA, 16 bp, Homo sapiens
gggtgggggccacctg

SEQ ID NO: 4975897 - DNA, 16 bp, Homo sapiens
gggtggggtagggctg

SEQ ID NO: 4975898 - DNA, 17 bp, Homo sapiens
gggtggggtagggctga

SEQ ID NO: 4975899 - DNA, 14 bp, Homo sapiens
gggtgggtgctcag

SEQ ID NO: 4975900 - DNA, 16 bp, Homo sapiens
gggtgggtgctcagaa

SEQ ID NO: 4975901 - DNA, 13 bp, Homo sapiens
gggtgtagccagg

SEQ ID NO: 4975902 - DNA, 13 bp, Homo sapiens
gggttatctctgt

SEQ ID NO: 4975903 - DNA, 19 bp, Homo sapiens
gggttatgtatcagaagag

SEQ ID NO: 4975904 - DNA, 22 bp, Homo sapiens
gggttcaagcgattcttctgct

SEQ ID NO: 4975905 - DNA, 13 bp, Homo sapiens
gggttcaggggac

SEQ ID NO: 4975906 - DNA, 15 bp, Homo sapiens
gggttctgctgggac

SEQ ID NO: 4975907 - DNA, 14 bp, Homo sapiens
gggttctttcttcc

SEQ ID NO: 4975908 - DNA, 20 bp, Homo sapiens
gggtttcaccatgttggcca

SEQ ID NO: 4975909 - DNA, 13 bp, Homo sapiens
ggtaaaatgtatt

SEQ ID NO: 4975910 - DNA, 17 bp, Homo sapiens
ggtaaaatgtatttttc

SEQ ID NO: 4975911 - DNA, 17 bp, Homo sapiens
ggtaaatgcaaagttct

SEQ ID NO: 4975912 - DNA, 15 bp, Homo sapiens
ggtaaattaagacat

SEQ ID NO: 4975913 - DNA, 16 bp, Homo sapiens
ggtaacagaacagctt

SEQ ID NO: 4975914 - DNA, 18 bp, Homo sapiens
ggtaacagaacagcttca

SEQ ID NO: 4975915 - DNA, 21 bp, Homo sapiens
ggtaacagaacagcttcaggt

SEQ ID NO: 4975916 - DNA, 13 bp, Homo sapiens
ggtaacaggcaga

SEQ ID NO: 4975917 - DNA, 23 bp, Homo sapiens
ggtaagaagccgggaacagacaa

SEQ ID NO: 4975918 - DNA, 20 bp, Homo sapiens
ggtaatcaatgaatattgaa

SEQ ID NO: 4975919 - DNA, 22 bp, Homo sapiens
ggtaattgttgctaatcttctt

SEQ ID NO: 4975920 - DNA, 20 bp, Homo sapiens
ggtaatttttaccctaatgt

SEQ ID NO: 4975921 - DNA, 14 bp, Homo sapiens
ggtactaaatttaa

SEQ ID NO: 4975922 - DNA, 17 bp, Homo sapiens
ggtacttgtggacacag

SEQ ID NO: 4975923 - DNA, 22 bp, Homo sapiens
ggtacttgtggacacagctctt

SEQ ID NO: 4975924 - DNA, 19 bp, Homo sapiens
ggtagaccaggatttctaa

SEQ ID NO: 4975925 - DNA, 17 bp, Homo sapiens
ggtagggaggcagcctc

SEQ ID NO: 4975926 - DNA, 15 bp, Homo sapiens
ggtatatctgggctg

SEQ ID NO: 4975927 - DNA, 19 bp, Homo sapiens
ggtatcaggtgctgccatc

SEQ ID NO: 4975928 - DNA, 21 bp, Homo sapiens
ggtatggaagggtttgtggct

SEQ ID NO: 4975929 - DNA, 18 bp, Homo sapiens
ggtatgtttaatctgtta

SEQ ID NO: 4975930 - DNA, 14 bp, Homo sapiens
ggtatttataatat

SEQ ID NO: 4975931 - DNA, 18 bp, Homo sapiens
ggtattttgtttctttta

SEQ ID NO: 4975932 - DNA, 13 bp, Homo sapiens
ggtcaatcccaaa

SEQ ID NO: 4975933 - DNA, 16 bp, Homo sapiens
ggtcaatgctattttt

SEQ ID NO: 4975934 - DNA, 14 bp, Homo sapiens
ggtcacacactgat

SEQ ID NO: 4975935 - DNA, 19 bp, Homo sapiens
ggtcacacgaccggggcca

SEQ ID NO: 4975936 - DNA, 16 bp, Homo sapiens
ggtcacagcctcctct

SEQ ID NO: 4975937 - DNA, 17 bp, Homo sapiens
ggtcacagcctcctctg

SEQ ID NO: 4975938 - DNA, 18 bp, Homo sapiens
ggtcacaggactctgcct

SEQ ID NO: 4975939 - DNA, 15 bp, Homo sapiens
ggtcagagcctgcag

SEQ ID NO: 4975940 - DNA, 18 bp, Homo sapiens
ggtcagaggacctgtatt

SEQ ID NO: 4975941 - DNA, 19 bp, Homo sapiens
ggtcaggcagccagtgaga

SEQ ID NO: 4975942 - DNA, 14 bp, Homo sapiens
ggtcaggccctggt

SEQ ID NO: 4975943 - DNA, 16 bp, Homo sapiens
ggtcagggagtgctgg

SEQ ID NO: 4975944 - DNA, 20 bp, Homo sapiens
ggtcagggagtgctggctca

SEQ ID NO: 4975945 - DNA, 19 bp, Homo sapiens
ggtcaggtttaacatttgc

SEQ ID NO: 4975946 - DNA, 19 bp, Homo sapiens
ggtcatgtttgcaggggtg

SEQ ID NO: 4975947 - DNA, 15 bp, Homo sapiens
ggtccacccaggagc

SEQ ID NO: 4975948 - DNA, 17 bp, Homo sapiens
ggtccacccaggagccc

SEQ ID NO: 4975949 - DNA, 22 bp, Homo sapiens
ggtccacccaggagccccgagg

SEQ ID NO: 4975950 - DNA, 13 bp, Homo sapiens
ggtccagctggcc

SEQ ID NO: 4975951 - DNA, 15 bp, Homo sapiens
ggtccagctggcctg

SEQ ID NO: 4975952 - DNA, 18 bp, Homo sapiens
ggtccagctggcctggac

SEQ ID NO: 4975953 - DNA, 16 bp, Homo sapiens
ggtcccacctccagcc

SEQ ID NO: 4975954 - DNA, 22 bp, Homo sapiens
ggtcccactcagtccatagcag

SEQ ID NO: 4975955 - DNA, 14 bp, Homo sapiens
ggtcccaggcagag

SEQ ID NO: 4975956 - DNA, 13 bp, Homo sapiens
ggtccctgcctta

SEQ ID NO: 4975957 - DNA, 14 bp, Homo sapiens
ggtccctgccttag

SEQ ID NO: 4975958 - DNA, 21 bp, Homo sapiens
ggtccggacactcctagagaa

SEQ ID NO: 4975959 - DNA, 23 bp, Homo sapiens
ggtcctccatcccaacagccatg

SEQ ID NO: 4975960 - DNA, 15 bp, Homo sapiens
ggtcctctggagccc

SEQ ID NO: 4975961 - DNA, 21 bp, Homo sapiens
ggtcctggagcagaccacccc

SEQ ID NO: 4975962 - DNA, 22 bp, Homo sapiens
ggtcctggccagatggcccgga

SEQ ID NO: 4975963 - DNA, 14 bp, Homo sapiens
ggtcctggctcctg

SEQ ID NO: 4975964 - DNA, 12 bp, Homo sapiens
ggtcctgtcccc

SEQ ID NO: 4975965 - DNA, 16 bp, Homo sapiens
ggtccttgcacccctc

SEQ ID NO: 4975966 - DNA, 15 bp, Homo sapiens
ggtcggaacccaagc

SEQ ID NO: 4975967 - DNA, 15 bp, Homo sapiens
ggtctaaaaataaac

SEQ ID NO: 4975968 - DNA, 16 bp, Homo sapiens
ggtctacactgcaatc

SEQ ID NO: 4975969 - DNA, 19 bp, Homo sapiens
ggtctcacagtgttgccca

SEQ ID NO: 4975970 - DNA, 21 bp, Homo sapiens
ggtctcacagtgttgcccagg

SEQ ID NO: 4975971 - DNA, 21 bp, Homo sapiens
ggtctcactatgttgcccagg

SEQ ID NO: 4975972 - DNA, 22 bp, Homo sapiens
ggtctcactctgtcgcccagtc

SEQ ID NO: 4975973 - DNA, 19 bp, Homo sapiens
ggtctcgctttgttgccca

SEQ ID NO: 4975974 - DNA, 14 bp, Homo sapiens
ggtctctatttcat

SEQ ID NO: 4975975 - DNA, 17 bp, Homo sapiens
ggtctctccctcaggtg

SEQ ID NO: 4975976 - DNA, 16 bp, Homo sapiens
ggtctcttctcccaga

SEQ ID NO: 4975977 - DNA, 10 bp, Homo sapiens
ggtctctttt

SEQ ID NO: 4975978 - DNA, 22 bp, Homo sapiens
ggtctgagccacagcagcattt

SEQ ID NO: 4975979 - DNA, 19 bp, Homo sapiens
ggtctgaggaatccagacc

SEQ ID NO: 4975980 - DNA, 16 bp, Homo sapiens
ggtctggactgacagc

SEQ ID NO: 4975981 - DNA, 22 bp, Homo sapiens
ggtctgggcggcgggcggctgg

SEQ ID NO: 4975982 - DNA, 17 bp, Homo sapiens
ggtctgtgtgaatgtgg

SEQ ID NO: 4975983 - DNA, 17 bp, Homo sapiens
ggtcttccctacctcag

SEQ ID NO: 4975984 - DNA, 21 bp, Homo sapiens
ggtcttgaactcctggcctca

SEQ ID NO: 4975985 - DNA, 17 bp, Homo sapiens
ggtgacaagagcctgat

SEQ ID NO: 4975986 - DNA, 19 bp, Homo sapiens
ggtgacagtcatcatcagg

SEQ ID NO: 4975987 - DNA, 15 bp, Homo sapiens
ggtgacatgtgaaac

SEQ ID NO: 4975988 - DNA, 14 bp, Homo sapiens
ggtgacctctgcct

SEQ ID NO: 4975989 - DNA, 19 bp, Homo sapiens
ggtgacggccctcatctat

SEQ ID NO: 4975990 - DNA, 22 bp, Homo sapiens
ggtgagatgctggagaagagag

SEQ ID NO: 4975991 - DNA, 23 bp, Homo sapiens
ggtgatccacccacctcagcctc

SEQ ID NO: 4975992 - DNA, 24 bp, Homo sapiens
ggtgatccacccacctcagcctcc

SEQ ID NO: 4975993 - DNA, 23 bp, Homo sapiens
ggtgcagacagaagtctcctcaa

SEQ ID NO: 4975994 - DNA, 17 bp, Homo sapiens
gggctatggacacaggg

SEQ ID NO: 4975995 - DNA, 17 bp, Homo sapiens
gggctcagcggggacag

SEQ ID NO: 4975996 - DNA, 21 bp, Homo sapiens
gggctcagcggggacagctcc

SEQ ID NO: 4975997 - DNA, 22 bp, Homo sapiens
gggctcaggtcacataaaactt

SEQ ID NO: 4975998 - DNA, 12 bp, Homo sapiens
gggctcctccca

SEQ ID NO: 4975999 - DNA, 21 bp, Homo sapiens
gggctctgcaattcccctctg

SEQ ID NO: 4976000 - DNA, 23 bp, Homo sapiens
gggctctgcaattcccctctgct

SEQ ID NO: 4976001 - DNA, 12 bp, Homo sapiens
gggctctgcccc

SEQ ID NO: 4976002 - DNA, 14 bp, Homo sapiens
gggctctgccccag

SEQ ID NO: 4976003 - DNA, 13 bp, Homo sapiens
gggctctggagag

SEQ ID NO: 4976004 - DNA, 15 bp, Homo sapiens
gggctctggagagaa

SEQ ID NO: 4976005 - DNA, 13 bp, Homo sapiens
gggctgccctgag

SEQ ID NO: 4976006 - DNA, 14 bp, Homo sapiens
gggctgccctgaga

SEQ ID NO: 4976007 - DNA, 11 bp, Homo sapiens
gggctgctcct

SEQ ID NO: 4976008 - DNA, 15 bp, Homo sapiens
gggcttaagaaatct

SEQ ID NO: 4976009 - DNA, 16 bp, Homo sapiens
gggcttcactgtataa

SEQ ID NO: 4976010 - DNA, 14 bp, Homo sapiens
gggcttcagtggca

SEQ ID NO: 4976011 - DNA, 17 bp, Homo sapiens
gggcttcagtggcagct

SEQ ID NO: 4976012 - DNA, 14 bp, Homo sapiens
gggcttggcgtgga

SEQ ID NO: 4976013 - DNA, 20 bp, Homo sapiens
gggcttggcgtggagcaggc

SEQ ID NO: 4976014 - DNA, 13 bp, Homo sapiens
gggcttgtgaaca

SEQ ID NO: 4976015 - DNA, 22 bp, Homo sapiens
ggggaaagacactgcctgggct

SEQ ID NO: 4976016 - DNA, 17 bp, Homo sapiens
ggggaagaagcagagag

SEQ ID NO: 4976017 - DNA, 15 bp, Homo sapiens
ggggaagctgcagct

SEQ ID NO: 4976018 - DNA, 19 bp, Homo sapiens
ggggaatgagcccagagaa

SEQ ID NO: 4976019 - DNA, 21 bp, Homo sapiens
ggggaatgagcccagagaaca

SEQ ID NO: 4976020 - DNA, 23 bp, Homo sapiens
ggggaatgagcccagagaacagc

SEQ ID NO: 4976021 - DNA, 18 bp, Homo sapiens
ggggaatgtttgcctctg

SEQ ID NO: 4976022 - DNA, 22 bp, Homo sapiens
ggggaatgtttgcctctgcctc

SEQ ID NO: 4976023 - DNA, 12 bp, Homo sapiens
ggggacagctcc

SEQ ID NO: 4976024 - DNA, 13 bp, Homo sapiens
ggggacccaggct

SEQ ID NO: 4976025 - DNA, 14 bp, Homo sapiens
ggggacccaggctc

SEQ ID NO: 4976026 - DNA, 19 bp, Homo sapiens
ggggacccaggctccgccc

SEQ ID NO: 4976027 - DNA, 20 bp, Homo sapiens
ggggactctgagcgggaggc

SEQ ID NO: 4976028 - DNA, 21 bp, Homo sapiens
ggggactctgagcgggaggca

SEQ ID NO: 4976029 - DNA, 15 bp, Homo sapiens
ggggactctgggcta

SEQ ID NO: 4976030 - DNA, 16 bp, Homo sapiens
ggggactctgggctat

SEQ ID NO: 4976031 - DNA, 22 bp, Homo sapiens
ggggactctgggctatggacac

SEQ ID NO: 4976032 - DNA, 20 bp, Homo sapiens
ggggataaaatgactactta

SEQ ID NO: 4976033 - DNA, 15 bp, Homo sapiens
ggggatcataaagtt

SEQ ID NO: 4976034 - DNA, 19 bp, Homo sapiens
ggggatcataaagttagaa

SEQ ID NO: 4976035 - DNA, 19 bp, Homo sapiens
ggggcacagtccaggaaca

SEQ ID NO: 4976036 - DNA, 15 bp, Homo sapiens
ggggcagagcctccc

SEQ ID NO: 4976037 - DNA, 16 bp, Homo sapiens
ggggcaggagggccct

SEQ ID NO: 4976038 - DNA, 14 bp, Homo sapiens
ggggcaggctgggc

SEQ ID NO: 4976039 - DNA, 17 bp, Homo sapiens
ggggcatgaccagatgc

SEQ ID NO: 4976040 - DNA, 15 bp, Homo sapiens
ggggccacctgcctg

SEQ ID NO: 4976041 - DNA, 12 bp, Homo sapiens
ggggccagagga

SEQ ID NO: 4976042 - DNA, 23 bp, Homo sapiens
ggggccagaggaactgtccagag

SEQ ID NO: 4976043 - DNA, 14 bp, Homo sapiens
ggggccccagggct

SEQ ID NO: 4976044 - DNA, 18 bp, Homo sapiens
ggggccgtgggggttgag

SEQ ID NO: 4976045 - DNA, 23 bp, Homo sapiens
ggggcctacagctttgatccctg

SEQ ID NO: 4976046 - DNA, 14 bp, Homo sapiens
ggggcctcagacga

SEQ ID NO: 4976047 - DNA, 15 bp, Homo sapiens
ggggcctgagagaat

SEQ ID NO: 4976048 - DNA, 14 bp, Homo sapiens
ggggcctggacctg

SEQ ID NO: 4976049 - DNA, 16 bp, Homo sapiens
ggggcctggacctgcc

SEQ ID NO: 4976050 - DNA, 12 bp, Homo sapiens
ggggcctggcag

SEQ ID NO: 4976051 - DNA, 12 bp, Homo sapiens
ggggcctgtgga

SEQ ID NO: 4976052 - DNA, 17 bp, Homo sapiens
ggggcgtgaggtcccag

SEQ ID NO: 4976053 - DNA, 16 bp, Homo sapiens
ggggctctcagctcag

SEQ ID NO: 4976054 - DNA, 22 bp, Homo sapiens
ggggcttagggtcggaacccaa

SEQ ID NO: 4976055 - DNA, 20 bp, Homo sapiens
ggggcttataataaaggact

SEQ ID NO: 4976056 - DNA, 11 bp, Homo sapiens
ggggcttggcg

SEQ ID NO: 4976057 - DNA, 19 bp, Homo sapiens
ggggcttggcgtggagcag

SEQ ID NO: 4976058 - DNA, 12 bp, Homo sapiens
gggggaatgagc

SEQ ID NO: 4976059 - DNA, 21 bp, Homo sapiens
gggggaatgagcccagagaac

SEQ ID NO: 4976060 - DNA, 13 bp, Homo sapiens
gggggccacctgc

SEQ ID NO: 4976061 - DNA, 12 bp, Homo sapiens
gggggcctcagt

SEQ ID NO: 4976062 - DNA, 18 bp, Homo sapiens
gggggcctcagtgccact

SEQ ID NO: 4976063 - DNA, 21 bp, Homo sapiens
gggggtcaccggccgatggag

SEQ ID NO: 4976064 - DNA, 13 bp, Homo sapiens
ggggtcaggcagc

SEQ ID NO: 4976065 - DNA, 19 bp, Homo sapiens
ggggtctcttttgtaaatt

SEQ ID NO: 4976066 - DNA, 18 bp, Homo sapiens
ggggtgacggccctcatc

SEQ ID NO: 4976067 - DNA, 20 bp, Homo sapiens
ggggtgtttgggaggctgcg

SEQ ID NO: 4976068 - DNA, 22 bp, Homo sapiens
ggggttctttcttcctctgctg

SEQ ID NO: 4976069 - DNA, 18 bp, Homo sapiens
ggggtttgccatttgata

SEQ ID NO: 4976070 - DNA, 13 bp, Homo sapiens
gggtaaactgtgg

SEQ ID NO: 4976071 - DNA, 15 bp, Homo sapiens
gggtacccactgctc

SEQ ID NO: 4976072 - DNA, 12 bp, Homo sapiens
gggtactaaatt

SEQ ID NO: 4976073 - DNA, 23 bp, Homo sapiens
gggtacttgtggacacagctctt

SEQ ID NO: 4976074 - DNA, 12 bp, Homo sapiens
gggtagtgagca

SEQ ID NO: 4976075 - DNA, 12 bp, Homo sapiens
ggcctggccaga

SEQ ID NO: 4976076 - DNA, 14 bp, Homo sapiens
ggcctggccaggag

SEQ ID NO: 4976077 - DNA, 17 bp, Homo sapiens
ggcctggccaggagctc

SEQ ID NO: 4976078 - DNA, 12 bp, Homo sapiens
ggcctggccctg

SEQ ID NO: 4976079 - DNA, 13 bp, Homo sapiens
ggcctggccctgc

SEQ ID NO: 4976080 - DNA, 14 bp, Homo sapiens
ggcctggccctgcc

SEQ ID NO: 4976081 - DNA, 18 bp, Homo sapiens
ggcctggccctgccctga

SEQ ID NO: 4976082 - DNA, 13 bp, Homo sapiens
ggcctggcctggc

SEQ ID NO: 4976083 - DNA, 18 bp, Homo sapiens
ggcctggcctggccctgc

SEQ ID NO: 4976084 - DNA, 17 bp, Homo sapiens
ggcctggggcctgagag

SEQ ID NO: 4976085 - DNA, 15 bp, Homo sapiens
ggcctgttgcccttt

SEQ ID NO: 4976086 - DNA, 16 bp, Homo sapiens
ggccttctctgaagga

SEQ ID NO: 4976087 - DNA, 21 bp, Homo sapiens
ggccttttaacattttgttct

SEQ ID NO: 4976088 - DNA, 16 bp, Homo sapiens
ggcgaccgccctccgc

SEQ ID NO: 4976089 - DNA, 18 bp, Homo sapiens
ggcgagagaggagccaga

SEQ ID NO: 4976090 - DNA, 12 bp, Homo sapiens
ggcgcccacctc

SEQ ID NO: 4976091 - DNA, 13 bp, Homo sapiens
ggcgcccctgcca

SEQ ID NO: 4976092 - DNA, 22 bp, Homo sapiens
ggcgcccctgccacctccctga

SEQ ID NO: 4976093 - DNA, 18 bp, Homo sapiens
ggcgcccttggcttctgt

SEQ ID NO: 4976094 - DNA, 20 bp, Homo sapiens
ggcgctgggtattggaaatg

SEQ ID NO: 4976095 - DNA, 13 bp, Homo sapiens
ggcggagccggcc

SEQ ID NO: 4976096 - DNA, 16 bp, Homo sapiens
ggcggcgggcggctgg

SEQ ID NO: 4976097 - DNA, 20 bp, Homo sapiens
ggcggtcttcaacatcctgc

SEQ ID NO: 4976098 - DNA, 17 bp, Homo sapiens
ggcgtccaggccgcgcc

SEQ ID NO: 4976099 - DNA, 14 bp, Homo sapiens
ggcgtctgtgtgcg

SEQ ID NO: 4976100 - DNA, 15 bp, Homo sapiens
ggcgtggagcaggcg

SEQ ID NO: 4976101 - DNA, 20 bp, Homo sapiens
ggctaaatgcctaataaaca

SEQ ID NO: 4976102 - DNA, 12 bp, Homo sapiens
ggctaccctccc

SEQ ID NO: 4976103 - DNA, 23 bp, Homo sapiens
ggctactgcagctttacatgcaa

SEQ ID NO: 4976104 - DNA, 14 bp, Homo sapiens
ggctagagtcctca

SEQ ID NO: 4976105 - DNA, 19 bp, Homo sapiens
ggctagagtcctcactccc

SEQ ID NO: 4976106 - DNA, 21 bp, Homo sapiens
ggctcaagtcctcttttctga

SEQ ID NO: 4976107 - DNA, 13 bp, Homo sapiens
ggctcactgcagc

SEQ ID NO: 4976108 - DNA, 15 bp, Homo sapiens
ggctcactgcagcct

SEQ ID NO: 4976109 - DNA, 17 bp, Homo sapiens
ggctcagatgaaatgca

SEQ ID NO: 4976110 - DNA, 14 bp, Homo sapiens
ggctccagaaatgt

SEQ ID NO: 4976111 - DNA, 11 bp, Homo sapiens
ggctccatgct

SEQ ID NO: 4976112 - DNA, 20 bp, Homo sapiens
ggctcccacaggcccttcct

SEQ ID NO: 4976113 - DNA, 19 bp, Homo sapiens
ggctcccatgaccatactg

SEQ ID NO: 4976114 - DNA, 22 bp, Homo sapiens
ggctccccatgtgtcctggttc

SEQ ID NO: 4976115 - DNA, 13 bp, Homo sapiens
ggctcctcccagc

SEQ ID NO: 4976116 - DNA, 12 bp, Homo sapiens
ggctcctgaggg

SEQ ID NO: 4976117 - DNA, 17 bp, Homo sapiens
ggctcggaggctgcccc

SEQ ID NO: 4976118 - DNA, 19 bp, Homo sapiens
ggctctagggttgctggag

SEQ ID NO: 4976119 - DNA, 17 bp, Homo sapiens
ggctctgaggtgcctgt

SEQ ID NO: 4976120 - DNA, 20 bp, Homo sapiens
ggctctgaggtgcctgtccc

SEQ ID NO: 4976121 - DNA, 23 bp, Homo sapiens
ggctctgaggtgcctgtcccacc

SEQ ID NO: 4976122 - DNA, 20 bp, Homo sapiens
ggctctgcaatgggcactgg

SEQ ID NO: 4976123 - DNA, 16 bp, Homo sapiens
ggctctgcacccctct

SEQ ID NO: 4976124 - DNA, 16 bp, Homo sapiens
ggctctggactctaaa

SEQ ID NO: 4976125 - DNA, 12 bp, Homo sapiens
ggctctggagac

SEQ ID NO: 4976126 - DNA, 18 bp, Homo sapiens
ggctctgtggcttgctag

SEQ ID NO: 4976127 - DNA, 15 bp, Homo sapiens
ggctcttctcctttc

SEQ ID NO: 4976128 - DNA, 16 bp, Homo sapiens
ggctgaggaggcctcc

SEQ ID NO: 4976129 - DNA, 14 bp, Homo sapiens
ggctgaggcaggag

SEQ ID NO: 4976130 - DNA, 18 bp, Homo sapiens
ggctgcaaagggtatcag

SEQ ID NO: 4976131 - DNA, 24 bp, Homo sapiens
ggctgcaaagggtatcaggtgctg

SEQ ID NO: 4976132 - DNA, 13 bp, Homo sapiens
ggctgcagggagt

SEQ ID NO: 4976133 - DNA, 17 bp, Homo sapiens
ggctgcagggagtccga

SEQ ID NO: 4976134 - DNA, 22 bp, Homo sapiens
ggctgcagtcctccggttgcat

SEQ ID NO: 4976135 - DNA, 13 bp, Homo sapiens
ggctgccaccaag

SEQ ID NO: 4976136 - DNA, 19 bp, Homo sapiens
ggctgccccaacctgctga

SEQ ID NO: 4976137 - DNA, 19 bp, Homo sapiens
ggctgcccccggccccctg

SEQ ID NO: 4976138 - DNA, 14 bp, Homo sapiens
ggctgccctgagaa

SEQ ID NO: 4976139 - DNA, 15 bp, Homo sapiens
ggctgccctggtgct

SEQ ID NO: 4976140 - DNA, 16 bp, Homo sapiens
ggctgccctggtgctg

SEQ ID NO: 4976141 - DNA, 23 bp, Homo sapiens
ggctgctgaaaaccatctggcct

SEQ ID NO: 4976142 - DNA, 15 bp, Homo sapiens
ggctggatgtggtgg

SEQ ID NO: 4976143 - DNA, 20 bp, Homo sapiens
ggctggccccagggcaccct

SEQ ID NO: 4976144 - DNA, 16 bp, Homo sapiens
ggctggcgtgcagtgg

SEQ ID NO: 4976145 - DNA, 23 bp, Homo sapiens
ggctgggcaaggaaaaagaaaat

SEQ ID NO: 4976146 - DNA, 19 bp, Homo sapiens
ggctgggccccccagctca

SEQ ID NO: 4976147 - DNA, 19 bp, Homo sapiens
ggacctgaaattccaaagt

SEQ ID NO: 4976148 - DNA, 23 bp, Homo sapiens
ggacctgcctcctgcctgcccct

SEQ ID NO: 4976149 - DNA, 17 bp, Homo sapiens
ggacctggtaccctcct

SEQ ID NO: 4976150 - DNA, 23 bp, Homo sapiens
ggacctgtatttaagcaaatact

SEQ ID NO: 4976151 - DNA, 18 bp, Homo sapiens
ggaccttgaactgggtac

SEQ ID NO: 4976152 - DNA, 24 bp, Homo sapiens
ggacgccgggccggccctagccca

SEQ ID NO: 4976153 - DNA, 15 bp, Homo sapiens
ggacgctttgtctgt

SEQ ID NO: 4976154 - DNA, 22 bp, Homo sapiens
ggactcaatgcactgacattgt

SEQ ID NO: 4976155 - DNA, 14 bp, Homo sapiens
ggactcctctgtcc

SEQ ID NO: 4976156 - DNA, 16 bp, Homo sapiens
ggactcgcttgtaaat

SEQ ID NO: 4976157 - DNA, 17 bp, Homo sapiens
ggactctgaagcctctg

SEQ ID NO: 4976158 - DNA, 19 bp, Homo sapiens
ggactctgagcgggaggca

SEQ ID NO: 4976159 - DNA, 21 bp, Homo sapiens
ggactctgagcgggaggcaga

SEQ ID NO: 4976160 - DNA, 21 bp, Homo sapiens
ggactgacagcatgtgccctc

SEQ ID NO: 4976161 - DNA, 17 bp, Homo sapiens
ggactgagcctggccca

SEQ ID NO: 4976162 - DNA, 17 bp, Homo sapiens
ggactgagggactctga

SEQ ID NO: 4976163 - DNA, 12 bp, Homo sapiens
ggactgcctctg

SEQ ID NO: 4976164 - DNA, 16 bp, Homo sapiens
ggactgctgctgcctg

SEQ ID NO: 4976165 - DNA, 15 bp, Homo sapiens
ggactggcccctggg

SEQ ID NO: 4976166 - DNA, 17 bp, Homo sapiens
ggactggcccctgggtc

SEQ ID NO: 4976167 - DNA, 19 bp, Homo sapiens
ggactggctagagtcctca

SEQ ID NO: 4976168 - DNA, 23 bp, Homo sapiens
ggactggctagagtcctcactcc

SEQ ID NO: 4976169 - DNA, 11 bp, Homo sapiens
ggactgggagg

SEQ ID NO: 4976170 - DNA, 15 bp, Homo sapiens
ggactgtcatagaaa

SEQ ID NO: 4976171 - DNA, 19 bp, Homo sapiens
ggactgtggcacttgcctg

SEQ ID NO: 4976172 - DNA, 17 bp, Homo sapiens
ggacttagaaagcaggg

SEQ ID NO: 4976173 - DNA, 18 bp, Homo sapiens
ggacttagaaagcagggg

SEQ ID NO: 4976174 - DNA, 22 bp, Homo sapiens
ggagaaaaggaaaagaaaaaaa

SEQ ID NO: 4976175 - DNA, 13 bp, Homo sapiens
ggagaactagaga

SEQ ID NO: 4976176 - DNA, 15 bp, Homo sapiens
ggagaagagaggaga

SEQ ID NO: 4976177 - DNA, 16 bp, Homo sapiens
ggagaagagaggagag

SEQ ID NO: 4976178 - DNA, 19 bp, Homo sapiens
ggagaagagttgaggaact

SEQ ID NO: 4976179 - DNA, 14 bp, Homo sapiens
ggagacagccccag

SEQ ID NO: 4976180 - DNA, 13 bp, Homo sapiens
ggagaccctgcaa

SEQ ID NO: 4976181 - DNA, 23 bp, Homo sapiens
ggagaccctgcaaacagaacagg

SEQ ID NO: 4976182 - DNA, 19 bp, Homo sapiens
ggagacgtggaacctctgt

SEQ ID NO: 4976183 - DNA, 23 bp, Homo sapiens
ggagacgtggaacctctgtctca

SEQ ID NO: 4976184 - DNA, 16 bp, Homo sapiens
ggagacttgccagagc

SEQ ID NO: 4976185 - DNA, 16 bp, Homo sapiens
ggagagaaagtgggtg

SEQ ID NO: 4976186 - DNA, 18 bp, Homo sapiens
ggagagaaagtgggtgag

SEQ ID NO: 4976187 - DNA, 17 bp, Homo sapiens
ggagagactcccatgaa

SEQ ID NO: 4976188 - DNA, 18 bp, Homo sapiens
ggagagactcccatgaag

SEQ ID NO: 4976189 - DNA, 20 bp, Homo sapiens
ggagagactcccatgaagcc

SEQ ID NO: 4976190 - DNA, 21 bp, Homo sapiens
ggagagactcccatgaagcct

SEQ ID NO: 4976191 - DNA, 22 bp, Homo sapiens
ggagagactcccatgaagcctt

SEQ ID NO: 4976192 - DNA, 17 bp, Homo sapiens
ggagagagaaagccagg

SEQ ID NO: 4976193 - DNA, 13 bp, Homo sapiens
ggagagaggcaga

SEQ ID NO: 4976194 - DNA, 16 bp, Homo sapiens
ggagagaggcagagag

SEQ ID NO: 4976195 - DNA, 16 bp, Homo sapiens
ggagaggaactccttg

SEQ ID NO: 4976196 - DNA, 13 bp, Homo sapiens
ggagaggatgaga

SEQ ID NO: 4976197 - DNA, 21 bp, Homo sapiens
ggagaggatgagagcccagag

SEQ ID NO: 4976198 - DNA, 22 bp, Homo sapiens
ggagaggatgagagcccagagg

SEQ ID NO: 4976199 - DNA, 17 bp, Homo sapiens
ggagattgagaaggaga

SEQ ID NO: 4976200 - DNA, 20 bp, Homo sapiens
ggagcagacaggaggaatca

SEQ ID NO: 4976201 - DNA, 15 bp, Homo sapiens
ggagcagaccacccc

SEQ ID NO: 4976202 - DNA, 18 bp, Homo sapiens
ggcatctgcccctccccc

SEQ ID NO: 4976203 - DNA, 19 bp, Homo sapiens
ggcatgccccggccacctc

SEQ ID NO: 4976204 - DNA, 21 bp, Homo sapiens
ggcatgccccggccacctctg

SEQ ID NO: 4976205 - DNA, 22 bp, Homo sapiens
ggcatgccccggccacctctgc

SEQ ID NO: 4976206 - DNA, 16 bp, Homo sapiens
ggcatgcggtcgggca

SEQ ID NO: 4976207 - DNA, 17 bp, Homo sapiens
ggcatggtaccagccct

SEQ ID NO: 4976208 - DNA, 16 bp, Homo sapiens
ggcatgtttccagcag

SEQ ID NO: 4976209 - DNA, 19 bp, Homo sapiens
ggcatgttttgtgcatttg

SEQ ID NO: 4976210 - DNA, 16 bp, Homo sapiens
ggcattaacacaaagg

SEQ ID NO: 4976211 - DNA, 17 bp, Homo sapiens
ggcattagaattattta

SEQ ID NO: 4976212 - DNA, 18 bp, Homo sapiens
ggcattcttgtacagtgt

SEQ ID NO: 4976213 - DNA, 17 bp, Homo sapiens
ggcattgacaaatctgt

SEQ ID NO: 4976214 - DNA, 19 bp, Homo sapiens
ggccaaaaggaaaaagctc

SEQ ID NO: 4976215 - DNA, 12 bp, Homo sapiens
ggccaaactgct

SEQ ID NO: 4976216 - DNA, 14 bp, Homo sapiens
ggccaaactgctgg

SEQ ID NO: 4976217 - DNA, 17 bp, Homo sapiens
ggccaagataggacctt

SEQ ID NO: 4976218 - DNA, 16 bp, Homo sapiens
ggccaaggccttctcc

SEQ ID NO: 4976219 - DNA, 18 bp, Homo sapiens
ggccaaggccttctcctc

SEQ ID NO: 4976220 - DNA, 21 bp, Homo sapiens
ggccaaggggagtcaccttcc

SEQ ID NO: 4976221 - DNA, 23 bp, Homo sapiens
ggccaagtccgcagaagccctga

SEQ ID NO: 4976222 - DNA, 13 bp, Homo sapiens
ggccaatccccag

SEQ ID NO: 4976223 - DNA, 17 bp, Homo sapiens
ggccaatggaaacctca

SEQ ID NO: 4976224 - DNA, 22 bp, Homo sapiens
ggccaatggaaacctcacgctg

SEQ ID NO: 4976225 - DNA, 18 bp, Homo sapiens
ggccaccaaagctgccca

SEQ ID NO: 4976226 - DNA, 13 bp, Homo sapiens
ggccacctgcctg

SEQ ID NO: 4976227 - DNA, 14 bp, Homo sapiens
ggccacctgcctgc

SEQ ID NO: 4976228 - DNA, 21 bp, Homo sapiens
ggccacctgcctgcgtcttcc

SEQ ID NO: 4976229 - DNA, 20 bp, Homo sapiens
ggccactgctccctaagcca

SEQ ID NO: 4976230 - DNA, 16 bp, Homo sapiens
ggccagagctgggagg

SEQ ID NO: 4976231 - DNA, 17 bp, Homo sapiens
ggccagagctgggaggc

SEQ ID NO: 4976232 - DNA, 21 bp, Homo sapiens
ggccagagctgggaggcatgg

SEQ ID NO: 4976233 - DNA, 19 bp, Homo sapiens
ggccagagggagtgacaga

SEQ ID NO: 4976234 - DNA, 22 bp, Homo sapiens
ggccagagggagtgacagaggc

SEQ ID NO: 4976235 - DNA, 17 bp, Homo sapiens
ggccagatgcaccagcc

SEQ ID NO: 4976236 - DNA, 19 bp, Homo sapiens
ggccagatgcaccagccct

SEQ ID NO: 4976237 - DNA, 13 bp, Homo sapiens
ggccagccccacc

SEQ ID NO: 4976238 - DNA, 15 bp, Homo sapiens
ggccagccccaccca

SEQ ID NO: 4976239 - DNA, 21 bp, Homo sapiens
ggccagccccacccaggaggg

SEQ ID NO: 4976240 - DNA, 11 bp, Homo sapiens
ggccagccccg

SEQ ID NO: 4976241 - DNA, 20 bp, Homo sapiens
ggccagcctggggcctggca

SEQ ID NO: 4976242 - DNA, 15 bp, Homo sapiens
ggccaggagctcttc

SEQ ID NO: 4976243 - DNA, 15 bp, Homo sapiens
ggccaggcagatctg

SEQ ID NO: 4976244 - DNA, 14 bp, Homo sapiens
ggccaggctggtct

SEQ ID NO: 4976245 - DNA, 22 bp, Homo sapiens
ggccagggtctgtgtgaatgtg

SEQ ID NO: 4976246 - DNA, 11 bp, Homo sapiens
ggccaggtcac

SEQ ID NO: 4976247 - DNA, 19 bp, Homo sapiens
ggccagtcctgcctggcca

SEQ ID NO: 4976248 - DNA, 14 bp, Homo sapiens
ggccagtggggcct

SEQ ID NO: 4976249 - DNA, 16 bp, Homo sapiens
ggccagtggggcctgt

SEQ ID NO: 4976250 - DNA, 15 bp, Homo sapiens
ggccatgtccaaaga

SEQ ID NO: 4976251 - DNA, 23 bp, Homo sapiens
ggccatgtccaaagaggctgccc

SEQ ID NO: 4976252 - DNA, 21 bp, Homo sapiens
ggcccaaggcggcccctcccg

SEQ ID NO: 4976253 - DNA, 11 bp, Homo sapiens
ggcccagagag

SEQ ID NO: 4976254 - DNA, 13 bp, Homo sapiens
ggcccagaggctg

SEQ ID NO: 4976255 - DNA, 23 bp, Homo sapiens
ggcccagaggctgagttttctct

SEQ ID NO: 4976256 - DNA, 12 bp, Homo sapiens
ggcccagcccct

SEQ ID NO: 4976257 - DNA, 13 bp, Homo sapiens
ggcccagccccta

SEQ ID NO: 4976258 - DNA, 22 bp, Homo sapiens
ggcccatagaaacatgacactg

SEQ ID NO: 4976259 - DNA, 20 bp, Homo sapiens
ggccccagcacctcagcctg

SEQ ID NO: 4976260 - DNA, 17 bp, Homo sapiens
ggccccagggctaccct

SEQ ID NO: 4976261 - DNA, 19 bp, Homo sapiens
ggccccccagctcaggggc

SEQ ID NO: 4976262 - DNA, 11 bp, Homo sapiens
ggccccctgcc

SEQ ID NO: 4976263 - DNA, 17 bp, Homo sapiens
ggccccggatcagagca

SEQ ID NO: 4976264 - DNA, 18 bp, Homo sapiens
ggccccggatcagagcag

SEQ ID NO: 4976265 - DNA, 24 bp, Homo sapiens
ggccccggatcagagcaggacctc

SEQ ID NO: 4976266 - DNA, 17 bp, Homo sapiens
ggcccctgccaccctgg

SEQ ID NO: 4976267 - DNA, 14 bp, Homo sapiens
tcaatcctctaagc

SEQ ID NO: 4976268 - DNA, 18 bp, Homo sapiens
tcaatctcccgctgctgc

SEQ ID NO: 4976269 - DNA, 22 bp, Homo sapiens
tcaatgcaagagtgattgcagc

SEQ ID NO: 4976270 - DNA, 21 bp, Homo sapiens
tcaatggagtatgtctgatgg

SEQ ID NO: 4976271 - DNA, 20 bp, Homo sapiens
tcaatggatttgatgctgtt

SEQ ID NO: 4976272 - DNA, 23 bp, Homo sapiens
tcaatggcctaaaactggcctga

SEQ ID NO: 4976273 - DNA, 14 bp, Homo sapiens
tcaatgggcaatga

SEQ ID NO: 4976274 - DNA, 12 bp, Homo sapiens
tcaatgtgaaaa

SEQ ID NO: 4976275 - DNA, 16 bp, Homo sapiens
tcaatgtgattctaat

SEQ ID NO: 4976276 - DNA, 14 bp, Homo sapiens
tcaattatagtttc

SEQ ID NO: 4976277 - DNA, 16 bp, Homo sapiens
tcaattatagtttctg

SEQ ID NO: 4976278 - DNA, 18 bp, Homo sapiens
tcaattatagtttctgag

SEQ ID NO: 4976279 - DNA, 15 bp, Homo sapiens
tcaattcaatttgga

SEQ ID NO: 4976280 - DNA, 13 bp, Homo sapiens
tcaattttaaaga

SEQ ID NO: 4976281 - DNA, 13 bp, Homo sapiens
tcaattttgactt

SEQ ID NO: 4976282 - DNA, 18 bp, Homo sapiens
tcaattttgacttaatgt

SEQ ID NO: 4976283 - DNA, 23 bp, Homo sapiens
tcacaaaaatttgaacactggct

SEQ ID NO: 4976284 - DNA, 21 bp, Homo sapiens
tcacaaacttttatactcttt

SEQ ID NO: 4976285 - DNA, 18 bp, Homo sapiens
tcacaaagagttctggaa

SEQ ID NO: 4976286 - DNA, 14 bp, Homo sapiens
tcacaataaaagct

SEQ ID NO: 4976287 - DNA, 19 bp, Homo sapiens
tcacaatgtcagtatttca

SEQ ID NO: 4976288 - DNA, 13 bp, Homo sapiens
tcacaatttttaa

SEQ ID NO: 4976289 - DNA, 15 bp, Homo sapiens
tcacaatttttaatg

SEQ ID NO: 4976290 - DNA, 14 bp, Homo sapiens
tcacacacatagat

SEQ ID NO: 4976291 - DNA, 15 bp, Homo sapiens
tcacacaccctgagg

SEQ ID NO: 4976292 - DNA, 12 bp, Homo sapiens
tcacacactgat

SEQ ID NO: 4976293 - DNA, 22 bp, Homo sapiens
tcacacagtattacttctgcta

SEQ ID NO: 4976294 - DNA, 22 bp, Homo sapiens
tcacacatccagacatcatgaa

SEQ ID NO: 4976295 - DNA, 13 bp, Homo sapiens
tcacaccagccat

SEQ ID NO: 4976296 - DNA, 12 bp, Homo sapiens
tcacaccctgca

SEQ ID NO: 4976297 - DNA, 14 bp, Homo sapiens
tcacaccctgcaag

SEQ ID NO: 4976298 - DNA, 20 bp, Homo sapiens
tcacaccctgcaaggcccac

SEQ ID NO: 4976299 - DNA, 16 bp, Homo sapiens
tcacacttctgtgaga

SEQ ID NO: 4976300 - DNA, 23 bp, Homo sapiens
tcacacttctgtgagacccccac

SEQ ID NO: 4976301 - DNA, 17 bp, Homo sapiens
tcacagcacatgctggc

SEQ ID NO: 4976302 - DNA, 20 bp, Homo sapiens
tcacagcacatgctggccag

SEQ ID NO: 4976303 - DNA, 21 bp, Homo sapiens
tcacagcacatgctggccagc

SEQ ID NO: 4976304 - DNA, 15 bp, Homo sapiens
tcacagcctcctctg

SEQ ID NO: 4976305 - DNA, 12 bp, Homo sapiens
tcacagcctctg

SEQ ID NO: 4976306 - DNA, 16 bp, Homo sapiens
tcacagcctctgaccc

SEQ ID NO: 4976307 - DNA, 20 bp, Homo sapiens
tcacagggcatgccccggcc

SEQ ID NO: 4976308 - DNA, 12 bp, Homo sapiens
tcacagggccaa

SEQ ID NO: 4976309 - DNA, 17 bp, Homo sapiens
tcacagggttgggccca

SEQ ID NO: 4976310 - DNA, 21 bp, Homo sapiens
tcacaggtgtggtgtaattta

SEQ ID NO: 4976311 - DNA, 21 bp, Homo sapiens
tcacaggttggaagagaatca

SEQ ID NO: 4976312 - DNA, 14 bp, Homo sapiens
tcacagtagagcca

SEQ ID NO: 4976313 - DNA, 16 bp, Homo sapiens
tcacagtagagccagc

SEQ ID NO: 4976314 - DNA, 17 bp, Homo sapiens
tcacagtagagccagct

SEQ ID NO: 4976315 - DNA, 18 bp, Homo sapiens
tcacagtagagccagctt

SEQ ID NO: 4976316 - DNA, 20 bp, Homo sapiens
tcacagtagagccagcttgg

SEQ ID NO: 4976317 - DNA, 21 bp, Homo sapiens
tcacagtagagccagcttggg

SEQ ID NO: 4976318 - DNA, 17 bp, Homo sapiens
tcacagtcccactgtgc

SEQ ID NO: 4976319 - DNA, 18 bp, Homo sapiens
tcacagtcccactgtgca

SEQ ID NO: 4976320 - DNA, 22 bp, Homo sapiens
tcacagtcccactgtgcaggtg

SEQ ID NO: 4976321 - DNA, 15 bp, Homo sapiens
tcacatatctgtcat

SEQ ID NO: 4976322 - DNA, 13 bp, Homo sapiens
tcacatcagataa

SEQ ID NO: 4976323 - DNA, 17 bp, Homo sapiens
tcacatcagataagaca

SEQ ID NO: 4976324 - DNA, 14 bp, Homo sapiens
tcacatcttatgct

SEQ ID NO: 4976325 - DNA, 13 bp, Homo sapiens
tcacatgacctga

SEQ ID NO: 4976326 - DNA, 21 bp, Homo sapiens
tcacatggcctatgcacatat

SEQ ID NO: 4976327 - DNA, 22 bp, Homo sapiens
tcacattaatggtctaaaaata

SEQ ID NO: 4976328 - DNA, 13 bp, Homo sapiens
tcacattagaatt

SEQ ID NO: 4976329 - DNA, 15 bp, Homo sapiens
tcacattagaattag

SEQ ID NO: 4976330 - DNA, 22 bp, Homo sapiens
tcacattgcattctattgcctt

SEQ ID NO: 4976331 - DNA, 23 bp, Homo sapiens
tcacattgtaactgaacttcagg

SEQ ID NO: 4976332 - DNA, 11 bp, Homo sapiens
tcacattgttt

SEQ ID NO: 4976333 - DNA, 16 bp, Homo sapiens
tcaccacatgtgcaca

SEQ ID NO: 4976334 - DNA, 18 bp, Homo sapiens
tcaccagaattgtgcaaa

SEQ ID NO: 4976335 - DNA, 15 bp, Homo sapiens
tcaccagatttgcta

SEQ ID NO: 4976336 - DNA, 21 bp, Homo sapiens
tcaccagccccactgccagca

SEQ ID NO: 4976337 - DNA, 22 bp, Homo sapiens
tcaccagccccactgccagcag

SEQ ID NO: 4976338 - DNA, 23 bp, Homo sapiens
tcaccagccccactgccagcagc

SEQ ID NO: 4976339 - DNA, 13 bp, Homo sapiens
tcaccagccccag

SEQ ID NO: 4976340 - DNA, 17 bp, Homo sapiens
tcaccagccccagtgcc

SEQ ID NO: 4976341 - DNA, 19 bp, Homo sapiens
tcacccaggctggagtgca

SEQ ID NO: 4976342 - DNA, 12 bp, Homo sapiens
tcaccccaccct

SEQ ID NO: 4976343 - DNA, 12 bp, Homo sapiens
tcaccccatccc

SEQ ID NO: 4976344 - DNA, 14 bp, Homo sapiens
tcaccccctgagat

SEQ ID NO: 4976345 - DNA, 13 bp, Homo sapiens
tcaccctccacct

SEQ ID NO: 4976346 - DNA, 15 bp, Homo sapiens
tcaccctccacctct

SEQ ID NO: 4976347 - DNA, 23 bp, Homo sapiens
tcacccttaacccaaggagcaca

SEQ ID NO: 4976348 - DNA, 16 bp, Homo sapiens
tcaccgagtgggggca

SEQ ID NO: 4976349 - DNA, 19 bp, Homo sapiens
tcaccgcttccctcctgcc

SEQ ID NO: 4976350 - DNA, 12 bp, Homo sapiens
tcacctcctcta

SEQ ID NO: 4976351 - DNA, 18 bp, Homo sapiens
tcacctctacccaaaccc

SEQ ID NO: 4976352 - DNA, 23 bp, Homo sapiens
tcacctctacccaaaccctaggt

SEQ ID NO: 4976353 - DNA, 19 bp, Homo sapiens
tcacctctggactggctag

SEQ ID NO: 4976354 - DNA, 13 bp, Homo sapiens
tcacctctgtaat

SEQ ID NO: 4976355 - DNA, 16 bp, Homo sapiens
tcacctgaagactcat

SEQ ID NO: 4976356 - DNA, 23 bp, Homo sapiens
tcacctgaagactcattcttctg

SEQ ID NO: 4976357 - DNA, 12 bp, Homo sapiens
tcacctgcctgt

SEQ ID NO: 4976358 - DNA, 17 bp, Homo sapiens
tcacctttgtgtatttt

SEQ ID NO: 4976359 - DNA, 16 bp, Homo sapiens
tcacgcaacttgaaat

SEQ ID NO: 4976360 - DNA, 13 bp, Homo sapiens
tcacggctcactg

SEQ ID NO: 4976361 - DNA, 20 bp, Homo sapiens
tcacggctcactgcagcctc

SEQ ID NO: 4976362 - DNA, 19 bp, Homo sapiens
tcactaatactaattcatt

SEQ ID NO: 4976363 - DNA, 21 bp, Homo sapiens
tcactatgttgcccaggcagg

SEQ ID NO: 4976364 - DNA, 18 bp, Homo sapiens
tcactcattgctgagcct

SEQ ID NO: 4976365 - DNA, 22 bp, Homo sapiens
tcactcattgctgagcctctgc

SEQ ID NO: 4976366 - DNA, 14 bp, Homo sapiens
tcactcccagtcca

SEQ ID NO: 4976367 - DNA, 21 bp, Homo sapiens
tcactccccatgccacgttcc

SEQ ID NO: 4976368 - DNA, 17 bp, Homo sapiens
tcactcggcaccctgca

SEQ ID NO: 4976369 - DNA, 12 bp, Homo sapiens
tcactctgccag

SEQ ID NO: 4976370 - DNA, 22 bp, Homo sapiens
tcactctgggcacactctgcca

SEQ ID NO: 4976371 - DNA, 22 bp, Homo sapiens
tcactctgtcgcccagtctgga

SEQ ID NO: 4976372 - DNA, 14 bp, Homo sapiens
tcactctttatagt

SEQ ID NO: 4976373 - DNA, 14 bp, Homo sapiens
tcactgacacaaag

SEQ ID NO: 4976374 - DNA, 19 bp, Homo sapiens
tcactgacacaaaggaagt

SEQ ID NO: 4976375 - DNA, 17 bp, Homo sapiens
tcactgatgtacaatta

SEQ ID NO: 4976376 - DNA, 20 bp, Homo sapiens
tcactgccacactctccatc

SEQ ID NO: 4976377 - DNA, 17 bp, Homo sapiens
tcactgccactttgcac

SEQ ID NO: 4976378 - DNA, 14 bp, Homo sapiens
taaatgaaattgta

SEQ ID NO: 4976379 - DNA, 16 bp, Homo sapiens
taaatgcaaagttctg

SEQ ID NO: 4976380 - DNA, 12 bp, Homo sapiens
taaatgtatata

SEQ ID NO: 4976381 - DNA, 14 bp, Homo sapiens
taaatgtatataca

SEQ ID NO: 4976382 - DNA, 15 bp, Homo sapiens
taaatgtatatacac

SEQ ID NO: 4976383 - DNA, 18 bp, Homo sapiens
taaatgtatatacacata

SEQ ID NO: 4976384 - DNA, 14 bp, Homo sapiens
taaatgtcttatat

SEQ ID NO: 4976385 - DNA, 23 bp, Homo sapiens
taaatgtgatatgattggcaata

SEQ ID NO: 4976386 - DNA, 16 bp, Homo sapiens
taaatgttatttctgc

SEQ ID NO: 4976387 - DNA, 11 bp, Homo sapiens
taaatgtttga

SEQ ID NO: 4976388 - DNA, 22 bp, Homo sapiens
taaatgtttgacacaattggaa

SEQ ID NO: 4976389 - DNA, 14 bp, Homo sapiens
taaatgttttataa

SEQ ID NO: 4976390 - DNA, 22 bp, Homo sapiens
taaattaggaggctcaacaata

SEQ ID NO: 4976391 - DNA, 15 bp, Homo sapiens
taaattatacaaatt

SEQ ID NO: 4976392 - DNA, 16 bp, Homo sapiens
taaattatggtattaa

SEQ ID NO: 4976393 - DNA, 17 bp, Homo sapiens
taaattcccaacttctc

SEQ ID NO: 4976394 - DNA, 13 bp, Homo sapiens
taaattctttatt

SEQ ID NO: 4976395 - DNA, 13 bp, Homo sapiens
taaattgaaattg

SEQ ID NO: 4976396 - DNA, 18 bp, Homo sapiens
taaattgcataaagcata

SEQ ID NO: 4976397 - DNA, 15 bp, Homo sapiens
taaattgctccttga

SEQ ID NO: 4976398 - DNA, 21 bp, Homo sapiens
taaattgttagcttccttaag

SEQ ID NO: 4976399 - DNA, 15 bp, Homo sapiens
taaatttaaagatat

SEQ ID NO: 4976400 - DNA, 20 bp, Homo sapiens
taaatttaaagatattgttc

SEQ ID NO: 4976401 - DNA, 18 bp, Homo sapiens
taaatttaaatttaaaga

SEQ ID NO: 4976402 - DNA, 15 bp, Homo sapiens
taaatttaattcttc

SEQ ID NO: 4976403 - DNA, 22 bp, Homo sapiens
taaatttgaatgttaagcagat

SEQ ID NO: 4976404 - DNA, 13 bp, Homo sapiens
taaatttgatact

SEQ ID NO: 4976405 - DNA, 14 bp, Homo sapiens
taaatttgatactt

SEQ ID NO: 4976406 - DNA, 17 bp, Homo sapiens
taaatttgatacttata

SEQ ID NO: 4976407 - DNA, 20 bp, Homo sapiens
taaatttgatttacatatat

SEQ ID NO: 4976408 - DNA, 22 bp, Homo sapiens
taaatttgatttacatatatta

SEQ ID NO: 4976409 - DNA, 15 bp, Homo sapiens
taaatttgtaagttt

SEQ ID NO: 4976410 - DNA, 17 bp, Homo sapiens
taaatttgtaagtttca

SEQ ID NO: 4976411 - DNA, 18 bp, Homo sapiens
taaatttgtaagtttcag

SEQ ID NO: 4976412 - DNA, 19 bp, Homo sapiens
taaatttgtaagtttcagg

SEQ ID NO: 4976413 - DNA, 20 bp, Homo sapiens
taaatttgtaagtttcaggt

SEQ ID NO: 4976414 - DNA, 19 bp, Homo sapiens
taaattttgagttctacat

SEQ ID NO: 4976415 - DNA, 20 bp, Homo sapiens
taacaaaaaaatatatttaa

SEQ ID NO: 4976416 - DNA, 22 bp, Homo sapiens
taacaaaacactcggcatttca

SEQ ID NO: 4976417 - DNA, 12 bp, Homo sapiens
taacaaaagatg

SEQ ID NO: 4976418 - DNA, 15 bp, Homo sapiens
taacaaaagatgaaa

SEQ ID NO: 4976419 - DNA, 21 bp, Homo sapiens
taacaaacatcactctgctgc

SEQ ID NO: 4976420 - DNA, 17 bp, Homo sapiens
taacaaatatgctaatt

SEQ ID NO: 4976421 - DNA, 17 bp, Homo sapiens
taacaatgaagataaaa

SEQ ID NO: 4976422 - DNA, 20 bp, Homo sapiens
taacaatgcagcaaggccct

SEQ ID NO: 4976423 - DNA, 22 bp, Homo sapiens
taacaatgttaaggaaactctt

SEQ ID NO: 4976424 - DNA, 13 bp, Homo sapiens
taacacccttcct

SEQ ID NO: 4976425 - DNA, 19 bp, Homo sapiens
taacactatgtttatttac

SEQ ID NO: 4976426 - DNA, 16 bp, Homo sapiens
taacagaacagcttca

SEQ ID NO: 4976427 - DNA, 17 bp, Homo sapiens
taacagaacagcttcag

SEQ ID NO: 4976428 - DNA, 18 bp, Homo sapiens
taacagaacagcttcagg

SEQ ID NO: 4976429 - DNA, 22 bp, Homo sapiens
taacagattttggggttgtgtt

SEQ ID NO: 4976430 - DNA, 19 bp, Homo sapiens
taacaggtattttgtttct

SEQ ID NO: 4976431 - DNA, 23 bp, Homo sapiens
taacaggtattttgtttctttta

SEQ ID NO: 4976432 - DNA, 23 bp, Homo sapiens
taacagtccccgtggccatccct

SEQ ID NO: 4976433 - DNA, 19 bp, Homo sapiens
taacatagtaagttcagca

SEQ ID NO: 4976434 - DNA, 13 bp, Homo sapiens
taacatatttact

SEQ ID NO: 4976435 - DNA, 22 bp, Homo sapiens
taacatatttactaagccacaa

SEQ ID NO: 4976436 - DNA, 23 bp, Homo sapiens
taacatatttactaagccacaag

SEQ ID NO: 4976437 - DNA, 19 bp, Homo sapiens
taacatcactatccatgca

SEQ ID NO: 4976438 - DNA, 12 bp, Homo sapiens
taacattacctt

SEQ ID NO: 4976439 - DNA, 17 bp, Homo sapiens
taacattaccttactgt

SEQ ID NO: 4976440 - DNA, 12 bp, Homo sapiens
taacattattta

SEQ ID NO: 4976441 - DNA, 15 bp, Homo sapiens
taacattatttatat

SEQ ID NO: 4976442 - DNA, 18 bp, Homo sapiens
taacattccaagactcta

SEQ ID NO: 4976443 - DNA, 12 bp, Homo sapiens
taacatttgcct

SEQ ID NO: 4976444 - DNA, 15 bp, Homo sapiens
taacatttgccttgc

SEQ ID NO: 4976445 - DNA, 16 bp, Homo sapiens
taacatttgccttgca

SEQ ID NO: 4976446 - DNA, 23 bp, Homo sapiens
taacatttgccttgcagaactgc

SEQ ID NO: 4976447 - DNA, 11 bp, Homo sapiens
taacattttgt

SEQ ID NO: 4976448 - DNA, 12 bp, Homo sapiens
taacattttgtt

SEQ ID NO: 4976449 - DNA, 23 bp, Homo sapiens
taaccacaaagcacagtttgaac

SEQ ID NO: 4976450 - DNA, 13 bp, Homo sapiens
tattgacacagaa

SEQ ID NO: 4976451 - DNA, 16 bp, Homo sapiens
tattgacacagaaaat

SEQ ID NO: 4976452 - DNA, 18 bp, Homo sapiens
tattgacacagaaaatgt

SEQ ID NO: 4976453 - DNA, 23 bp, Homo sapiens
tattgacacagaaaatgttgaga

SEQ ID NO: 4976454 - DNA, 16 bp, Homo sapiens
tattgacatttgtagt

SEQ ID NO: 4976455 - DNA, 19 bp, Homo sapiens
tattgagatttcttaaata

SEQ ID NO: 4976456 - DNA, 20 bp, Homo sapiens
tattgaggctttgtgttgta

SEQ ID NO: 4976457 - DNA, 15 bp, Homo sapiens
tattgatagtactct

SEQ ID NO: 4976458 - DNA, 17 bp, Homo sapiens
tattttgaaaagcttct

SEQ ID NO: 4976459 - DNA, 15 bp, Homo sapiens
tattttgaagtttac

SEQ ID NO: 4976460 - DNA, 20 bp, Homo sapiens
tattttgataataaattgaa

SEQ ID NO: 4976461 - DNA, 23 bp, Homo sapiens
tattttgatgcagcatttgataa

SEQ ID NO: 4976462 - DNA, 20 bp, Homo sapiens
tattttggattgtatattgt

SEQ ID NO: 4976463 - DNA, 21 bp, Homo sapiens
tattttgtaaactcaaaatat

SEQ ID NO: 4976464 - DNA, 20 bp, Homo sapiens
tattttgtattattgctgtt

SEQ ID NO: 4976465 - DNA, 17 bp, Homo sapiens
tattttgtattgtggta

SEQ ID NO: 4976466 - DNA, 17 bp, Homo sapiens
tattttgtgctcattta

SEQ ID NO: 4976467 - DNA, 23 bp, Homo sapiens
tattttgtgtgaccaactgtgtt

SEQ ID NO: 4976468 - DNA, 17 bp, Homo sapiens
tattttgtttcttttaa

SEQ ID NO: 4976469 - DNA, 23 bp, Homo sapiens
tatttttaaaaaatgaaatcctt

SEQ ID NO: 4976470 - DNA, 19 bp, Homo sapiens
tatttttaaaaagaaatct

SEQ ID NO: 4976471 - DNA, 12 bp, Homo sapiens
tatttttatcca

SEQ ID NO: 4976472 - DNA, 14 bp, Homo sapiens
tatttttcaaggaa

SEQ ID NO: 4976473 - DNA, 13 bp, Homo sapiens
tatttttcagaga

SEQ ID NO: 4976474 - DNA, 17 bp, Homo sapiens
tatttttcagttccaag

SEQ ID NO: 4976475 - DNA, 11 bp, Homo sapiens
tatttttcata

SEQ ID NO: 4976476 - DNA, 13 bp, Homo sapiens
tatttttcatatt

SEQ ID NO: 4976477 - DNA, 13 bp, Homo sapiens
tattttttattgt

SEQ ID NO: 4976478 - DNA, 16 bp, Homo sapiens
tatttttttaatttaa

SEQ ID NO: 4976479 - DNA, 17 bp, Homo sapiens
tcaaaaactttggagtc

SEQ ID NO: 4976480 - DNA, 15 bp, Homo sapiens
tcaaaaagtgtttat

SEQ ID NO: 4976481 - DNA, 19 bp, Homo sapiens
tcaaaaagtgtttattttt

SEQ ID NO: 4976482 - DNA, 20 bp, Homo sapiens
tcaaaaattatctatagcta

SEQ ID NO: 4976483 - DNA, 18 bp, Homo sapiens
tcaaaactcacaagtgct

SEQ ID NO: 4976484 - DNA, 17 bp, Homo sapiens
tcaaaacttggtatttt

SEQ ID NO: 4976485 - DNA, 21 bp, Homo sapiens
tcaaaagacatgttgtaaatt

SEQ ID NO: 4976486 - DNA, 17 bp, Homo sapiens
tcaaaagcatttatcat

SEQ ID NO: 4976487 - DNA, 22 bp, Homo sapiens
tcaaaagttccaagagtctaaa

SEQ ID NO: 4976488 - DNA, 20 bp, Homo sapiens
tcaaaataaaaagtgacaca

SEQ ID NO: 4976489 - DNA, 16 bp, Homo sapiens
tcaaaatatttgtaca

SEQ ID NO: 4976490 - DNA, 23 bp, Homo sapiens
tcaaaatccaaaaagaaatgatg

SEQ ID NO: 4976491 - DNA, 18 bp, Homo sapiens
tcaaaatccttccaaaga

SEQ ID NO: 4976492 - DNA, 19 bp, Homo sapiens
tcaaaatccttccaaagaa

SEQ ID NO: 4976493 - DNA, 13 bp, Homo sapiens
tcaaaatgtatat

SEQ ID NO: 4976494 - DNA, 14 bp, Homo sapiens
tcaaaatgtatata

SEQ ID NO: 4976495 - DNA, 22 bp, Homo sapiens
tcaaaatgttatcttctcaagt

SEQ ID NO: 4976496 - DNA, 14 bp, Homo sapiens
tcaaaattaaatct

SEQ ID NO: 4976497 - DNA, 15 bp, Homo sapiens
tcaaaattaaatctg

SEQ ID NO: 4976498 - DNA, 22 bp, Homo sapiens
tcaaaattgtttaaaaattctt

SEQ ID NO: 4976499 - DNA, 17 bp, Homo sapiens
tcaaacatgagatgtgt

SEQ ID NO: 4976500 - DNA, 14 bp, Homo sapiens
tcaaactaaaagac

SEQ ID NO: 4976501 - DNA, 17 bp, Homo sapiens
tcaaactaaaagacatt

SEQ ID NO: 4976502 - DNA, 21 bp, Homo sapiens
tcaaactaaaagacatttgtt

SEQ ID NO: 4976503 - DNA, 22 bp, Homo sapiens
tcaaactccaaggttcccttgt

SEQ ID NO: 4976504 - DNA, 19 bp, Homo sapiens
tcaaactggggcctccaga

SEQ ID NO: 4976505 - DNA, 20 bp, Homo sapiens
tcaaactggggcctccagaa

SEQ ID NO: 4976506 - DNA, 22 bp, Homo sapiens
tcaaactggggcctccagaact

SEQ ID NO: 4976507 - DNA, 15 bp, Homo sapiens
tcaaagagagaaaat

SEQ ID NO: 4976508 - DNA, 16 bp, Homo sapiens
tcaaagctttttccag

SEQ ID NO: 4976509 - DNA, 22 bp, Homo sapiens
tcaaagtttcctaatcagaaat

SEQ ID NO: 4976510 - DNA, 19 bp, Homo sapiens
tcaaagttttgaaaagcta

SEQ ID NO: 4976511 - DNA, 20 bp, Homo sapiens
tcaaataagtatttataata

SEQ ID NO: 4976512 - DNA, 21 bp, Homo sapiens
tcaaatatgagtacaaatgcc

SEQ ID NO: 4976513 - DNA, 13 bp, Homo sapiens
tcaaatgttctaa

SEQ ID NO: 4976514 - DNA, 19 bp, Homo sapiens
tcaaatgttctaagtttct

SEQ ID NO: 4976515 - DNA, 20 bp, Homo sapiens
tcaaattaaaacagctgcat

SEQ ID NO: 4976516 - DNA, 15 bp, Homo sapiens
tcaacaaagaaatat

SEQ ID NO: 4976517 - DNA, 15 bp, Homo sapiens
tcaacaataaaacat

SEQ ID NO: 4976518 - DNA, 14 bp, Homo sapiens
tcaacagaagcatt

SEQ ID NO: 4976519 - DNA, 15 bp, Homo sapiens
tcaacagaagcattt

SEQ ID NO: 4976520 - DNA, 22 bp, Homo sapiens
tcaacagaagcatttgtatttt

SEQ ID NO: 4976521 - DNA, 15 bp, Homo sapiens
tcaacatcctgccag

SEQ ID NO: 4976522 - DNA, 16 bp, Homo sapiens
tcaacatcctgccagc

SEQ ID NO: 4976523 - DNA, 15 bp, Homo sapiens
tcaaccatggacttt

SEQ ID NO: 4976524 - DNA, 17 bp, Homo sapiens
tcaaccatggactttat

SEQ ID NO: 4976525 - DNA, 18 bp, Homo sapiens
tcaaccccttcgctcctg

SEQ ID NO: 4976526 - DNA, 15 bp, Homo sapiens
tcaacctcctgggct

SEQ ID NO: 4976527 - DNA, 16 bp, Homo sapiens
tcaacctcctgggcta

SEQ ID NO: 4976528 - DNA, 18 bp, Homo sapiens
tcaacctcctgtggaacc

SEQ ID NO: 4976529 - DNA, 15 bp, Homo sapiens
tcaaccttaagacct

SEQ ID NO: 4976530 - DNA, 23 bp, Homo sapiens
tcaaccttaagacctactgttct

SEQ ID NO: 4976531 - DNA, 17 bp, Homo sapiens
tcaactactattcaaaa

SEQ ID NO: 4976532 - DNA, 12 bp, Homo sapiens
tcaagaaactga

SEQ ID NO: 4976533 - DNA, 17 bp, Homo sapiens
tcaagaaactgaggaat

SEQ ID NO: 4976534 - DNA, 20 bp, Homo sapiens
tcaagaaactgaggaatttt

SEQ ID NO: 4976535 - DNA, 14 bp, Homo sapiens
tcaagaacctggaa

SEQ ID NO: 4976536 - DNA, 18 bp, Homo sapiens
tcaagaagaaaaaggttt

SEQ ID NO: 4976537 - DNA, 16 bp, Homo sapiens
tcaagagctgccctcc

SEQ ID NO: 4976538 - DNA, 12 bp, Homo sapiens
tcaagaggctga

SEQ ID NO: 4976539 - DNA, 20 bp, Homo sapiens
tcaagagggcactggtggcc

SEQ ID NO: 4976540 - DNA, 13 bp, Homo sapiens
tcaagcactgata

SEQ ID NO: 4976541 - DNA, 16 bp, Homo sapiens
tcaagccatgtataaa

SEQ ID NO: 4976542 - DNA, 15 bp, Homo sapiens
tcaagcgattctcct

SEQ ID NO: 4976543 - DNA, 18 bp, Homo sapiens
tcaagcgattcttctgct

SEQ ID NO: 4976544 - DNA, 19 bp, Homo sapiens
tcaagcgattcttctgctt

SEQ ID NO: 4976545 - DNA, 18 bp, Homo sapiens
tcaaggaaggttcatgta

SEQ ID NO: 4976546 - DNA, 21 bp, Homo sapiens
tcaaggcactctagattccat

SEQ ID NO: 4976547 - DNA, 20 bp, Homo sapiens
tcaaggcttatattcaacca

SEQ ID NO: 4976548 - DNA, 11 bp, Homo sapiens
tcaaggttcta

SEQ ID NO: 4976549 - DNA, 14 bp, Homo sapiens
tcaagtctctgctg

SEQ ID NO: 4976550 - DNA, 19 bp, Homo sapiens
tcaagtctctgctggccca

SEQ ID NO: 4976551 - DNA, 20 bp, Homo sapiens
tcaagtgatctgcccacctc

SEQ ID NO: 4976552 - DNA, 18 bp, Homo sapiens
tcaagtgattctcctgcc

SEQ ID NO: 4976553 - DNA, 13 bp, Homo sapiens
tcaagttattgta

SEQ ID NO: 4976554 - DNA, 15 bp, Homo sapiens
tcaagttctaagatt

SEQ ID NO: 4976555 - DNA, 17 bp, Homo sapiens
tcaagttctaagattct

SEQ ID NO: 4976556 - DNA, 12 bp, Homo sapiens
tcaataaactta

SEQ ID NO: 4976557 - DNA, 15 bp, Homo sapiens
tcaataaagaaaact

SEQ ID NO: 4976558 - DNA, 16 bp, Homo sapiens
tcaataaatgtctgtt

SEQ ID NO: 4976559 - DNA, 21 bp, Homo sapiens
tcaatatctaatatatatgaa

SEQ ID NO: 4976560 - DNA, 13 bp, Homo sapiens
tcaatatgcttac

SEQ ID NO: 4976561 - DNA, 16 bp, Homo sapiens
tcaatattgacatttg

SEQ ID NO: 4976562 - DNA, 18 bp, Homo sapiens
tcaatattgacatttgta

SEQ ID NO: 4976563 - DNA, 15 bp, Homo sapiens
tcaatcatctgtgtg

SEQ ID NO: 4976564 - DNA, 16 bp, Homo sapiens
tcaatcatctgtgtga

SEQ ID NO: 4976565 - DNA, 19 bp, Homo sapiens
tcaatcatttctcactgtg

SEQ ID NO: 4976566 - DNA, 20 bp, Homo sapiens
tatcagctacttaagagaaa

SEQ ID NO: 4976567 - DNA, 21 bp, Homo sapiens
tatcagctacttaagagaaat

SEQ ID NO: 4976568 - DNA, 17 bp, Homo sapiens
tatcaggtgctgccatc

SEQ ID NO: 4976569 - DNA, 20 bp, Homo sapiens
tatcagtcaatatttttaga

SEQ ID NO: 4976570 - DNA, 21 bp, Homo sapiens
tatcagtcaatatttttagat

SEQ ID NO: 4976571 - DNA, 22 bp, Homo sapiens
tatcagtttgatcacactattt

SEQ ID NO: 4976572 - DNA, 22 bp, Homo sapiens
tatcatacaaatcagttagttt

SEQ ID NO: 4976573 - DNA, 15 bp, Homo sapiens
tatcatactgttcaa

SEQ ID NO: 4976574 - DNA, 23 bp, Homo sapiens
tatcatagaaatgtaacttttgt

SEQ ID NO: 4976575 - DNA, 22 bp, Homo sapiens
tatcatgctttaaagtgtaata

SEQ ID NO: 4976576 - DNA, 22 bp, Homo sapiens
tatcatgtaaagaaatgtctta

SEQ ID NO: 4976577 - DNA, 14 bp, Homo sapiens
tatccaaacatgta

SEQ ID NO: 4976578 - DNA, 18 bp, Homo sapiens
tatccaaccaacttggtt

SEQ ID NO: 4976579 - DNA, 18 bp, Homo sapiens
tatccactttgcacagct

SEQ ID NO: 4976580 - DNA, 22 bp, Homo sapiens
tatccatgacaggcctgaagat

SEQ ID NO: 4976581 - DNA, 14 bp, Homo sapiens
tatcccagaaatta

SEQ ID NO: 4976582 - DNA, 13 bp, Homo sapiens
tatcccctgctac

SEQ ID NO: 4976583 - DNA, 17 bp, Homo sapiens
tatcccgagtctgggac

SEQ ID NO: 4976584 - DNA, 23 bp, Homo sapiens
tagctgcctagcaagctggcctc

SEQ ID NO: 4976585 - DNA, 15 bp, Homo sapiens
tagctgggactacag

SEQ ID NO: 4976586 - DNA, 21 bp, Homo sapiens
tagctgtctgctcagacagaa

SEQ ID NO: 4976587 - DNA, 13 bp, Homo sapiens
tagctgtgggggt

SEQ ID NO: 4976588 - DNA, 13 bp, Homo sapiens
tagcttgtatagt

SEQ ID NO: 4976589 - DNA, 21 bp, Homo sapiens
tagctttgtgtttggtttaca

SEQ ID NO: 4976590 - DNA, 22 bp, Homo sapiens
tagctttgtgtttggtttacat

SEQ ID NO: 4976591 - DNA, 17 bp, Homo sapiens
tagctttttaaaacatt

SEQ ID NO: 4976592 - DNA, 18 bp, Homo sapiens
tagctttttaaaacatta

SEQ ID NO: 4976593 - DNA, 14 bp, Homo sapiens
taggaaataaaacc

SEQ ID NO: 4976594 - DNA, 17 bp, Homo sapiens
taggaagttgacttata

SEQ ID NO: 4976595 - DNA, 22 bp, Homo sapiens
taggaagttgacttatagtaca

SEQ ID NO: 4976596 - DNA, 16 bp, Homo sapiens
taggaagttttctgta

SEQ ID NO: 4976597 - DNA, 18 bp, Homo sapiens
taggaccactcagcccct

SEQ ID NO: 4976598 - DNA, 13 bp, Homo sapiens
taggaccttgggc

SEQ ID NO: 4976599 - DNA, 14 bp, Homo sapiens
taggagaccaaggc

SEQ ID NO: 4976600 - DNA, 22 bp, Homo sapiens
taggagaggatgagagcccaga

SEQ ID NO: 4976601 - DNA, 16 bp, Homo sapiens
taggagctaaggctct

SEQ ID NO: 4976602 - DNA, 18 bp, Homo sapiens
taggagtgtgtgacattc

SEQ ID NO: 4976603 - DNA, 20 bp, Homo sapiens
taggagtgtgtgacattcca

SEQ ID NO: 4976604 - DNA, 18 bp, Homo sapiens
taggatgaaaagattctt

SEQ ID NO: 4976605 - DNA, 18 bp, Homo sapiens
taggcattaacacaaagg

SEQ ID NO: 4976606 - DNA, 20 bp, Homo sapiens
taggcattaacacaaaggag

SEQ ID NO: 4976607 - DNA, 14 bp, Homo sapiens
taggccatgaaaaa

SEQ ID NO: 4976608 - DNA, 16 bp, Homo sapiens
taggccttttaacatt

SEQ ID NO: 4976609 - DNA, 15 bp, Homo sapiens
tagggcaattggaac

SEQ ID NO: 4976610 - DNA, 20 bp, Homo sapiens
tagggctgggcaaggaaaaa

SEQ ID NO: 4976611 - DNA, 19 bp, Homo sapiens
tagggtactaaatttaaat

SEQ ID NO: 4976612 - DNA, 12 bp, Homo sapiens
tcactgcccgca

SEQ ID NO: 4976613 - DNA, 19 bp, Homo sapiens
tcactgcccgcacaccctc

SEQ ID NO: 4976614 - DNA, 18 bp, Homo sapiens
tcactgctccctgaagcc

SEQ ID NO: 4976615 - DNA, 19 bp, Homo sapiens
tcactgctccctgaagcca

SEQ ID NO: 4976616 - DNA, 14 bp, Homo sapiens
tcactgctggctgc

SEQ ID NO: 4976617 - DNA, 21 bp, Homo sapiens
tcactgcttgatgaagcaagg

SEQ ID NO: 4976618 - DNA, 17 bp, Homo sapiens
tcactggggcctacagc

SEQ ID NO: 4976619 - DNA, 20 bp, Homo sapiens
tcactgtagaatgatttcat

SEQ ID NO: 4976620 - DNA, 19 bp, Homo sapiens
tcactgtataaataggaga

SEQ ID NO: 4976621 - DNA, 14 bp, Homo sapiens
tcactgtcaatgat

SEQ ID NO: 4976622 - DNA, 16 bp, Homo sapiens
tcactgtgtacataat

SEQ ID NO: 4976623 - DNA, 20 bp, Homo sapiens
tcactgttgaaaattatttt

SEQ ID NO: 4976624 - DNA, 15 bp, Homo sapiens
tcactgttgcccagg

SEQ ID NO: 4976625 - DNA, 16 bp, Homo sapiens
tcactgttgcccaggc

SEQ ID NO: 4976626 - DNA, 19 bp, Homo sapiens
tcactgttgcccaggctgg

SEQ ID NO: 4976627 - DNA, 13 bp, Homo sapiens
tcacttagccatg

SEQ ID NO: 4976628 - DNA, 17 bp, Homo sapiens
tcacttgtacaaaataa

SEQ ID NO: 4976629 - DNA, 13 bp, Homo sapiens
tcacttgtgcttt

SEQ ID NO: 4976630 - DNA, 15 bp, Homo sapiens
tcacttgtgctttgc

SEQ ID NO: 4976631 - DNA, 20 bp, Homo sapiens
tcacttgtgctttgctcttg

SEQ ID NO: 4976632 - DNA, 19 bp, Homo sapiens
tcactttgtctaactcaga

SEQ ID NO: 4976633 - DNA, 16 bp, Homo sapiens
tcacttttcagtgatg

SEQ ID NO: 4976634 - DNA, 12 bp, Homo sapiens
tcacttttcctc

SEQ ID NO: 4976635 - DNA, 17 bp, Homo sapiens
tcactttttgaactaag

SEQ ID NO: 4976636 - DNA, 21 bp, Homo sapiens
tcactttttgaactaagaaac

SEQ ID NO: 4976637 - DNA, 22 bp, Homo sapiens
tcactttttgaactaagaaact

SEQ ID NO: 4976638 - DNA, 18 bp, Homo sapiens
tcagaaaactttaaaaaa

SEQ ID NO: 4976639 - DNA, 16 bp, Homo sapiens
tcagaaactagaaatg

SEQ ID NO: 4976640 - DNA, 12 bp, Homo sapiens
tcagaaactgtt

SEQ ID NO: 4976641 - DNA, 21 bp, Homo sapiens
tcagaaattggaacagaatgt

SEQ ID NO: 4976642 - DNA, 19 bp, Homo sapiens
tcagaaatttttatcagtt

SEQ ID NO: 4976643 - DNA, 15 bp, Homo sapiens
tcagaacagtatctt

SEQ ID NO: 4976644 - DNA, 14 bp, Homo sapiens
tcagaacccagggc

SEQ ID NO: 4976645 - DNA, 16 bp, Homo sapiens
tcagaacccagggctc

SEQ ID NO: 4976646 - DNA, 22 bp, Homo sapiens
tcagaacccagggctctgcccc

SEQ ID NO: 4976647 - DNA, 16 bp, Homo sapiens
tcagaacctcttcccc

SEQ ID NO: 4976648 - DNA, 17 bp, Homo sapiens
tcagaagagaggggaag

SEQ ID NO: 4976649 - DNA, 20 bp, Homo sapiens
tcagaataaggcaggcattg

SEQ ID NO: 4976650 - DNA, 23 bp, Homo sapiens
tcagacaccctcaacctcttctg

SEQ ID NO: 4976651 - DNA, 18 bp, Homo sapiens
tcagacagaacccctaca

SEQ ID NO: 4976652 - DNA, 12 bp, Homo sapiens
tcagacataaag

SEQ ID NO: 4976653 - DNA, 14 bp, Homo sapiens
tcagacataaagcc

SEQ ID NO: 4976654 - DNA, 22 bp, Homo sapiens
tcagacatccatgtttgtaaaa

SEQ ID NO: 4976655 - DNA, 14 bp, Homo sapiens
tcagacatgttttc

SEQ ID NO: 4976656 - DNA, 20 bp, Homo sapiens
tcagaccttggatcagatga

SEQ ID NO: 4976657 - DNA, 19 bp, Homo sapiens
tcagactaagaaatattcc

SEQ ID NO: 4976658 - DNA, 21 bp, Homo sapiens
tcagactaagaaatattccaa

SEQ ID NO: 4976659 - DNA, 16 bp, Homo sapiens
tcagactctcagccca

SEQ ID NO: 4976660 - DNA, 14 bp, Homo sapiens
tcagacttttgtac

SEQ ID NO: 4976661 - DNA, 13 bp, Homo sapiens
tcagagaatttct

SEQ ID NO: 4976662 - DNA, 14 bp, Homo sapiens
tcagagacaaaata

SEQ ID NO: 4976663 - DNA, 22 bp, Homo sapiens
tcagagacaaaatatttcccat

SEQ ID NO: 4976664 - DNA, 16 bp, Homo sapiens
tcagagaggccttttg

SEQ ID NO: 4976665 - DNA, 18 bp, Homo sapiens
tcagagatttatataaat

SEQ ID NO: 4976666 - DNA, 13 bp, Homo sapiens
tcagagcaggacc

SEQ ID NO: 4976667 - DNA, 18 bp, Homo sapiens
tcagagcccctacagcat

SEQ ID NO: 4976668 - DNA, 12 bp, Homo sapiens
tcagagcctgca

SEQ ID NO: 4976669 - DNA, 17 bp, Homo sapiens
tcagagggggactgctg

SEQ ID NO: 4976670 - DNA, 18 bp, Homo sapiens
tcagaggtagggctgcca

SEQ ID NO: 4976671 - DNA, 15 bp, Homo sapiens
tcagatacatcactg

SEQ ID NO: 4976672 - DNA, 19 bp, Homo sapiens
tcagatacatcactgcttg

SEQ ID NO: 4976673 - DNA, 21 bp, Homo sapiens
tcagatacatcactgcttgat

SEQ ID NO: 4976674 - DNA, 14 bp, Homo sapiens
tcagatctgtctga

SEQ ID NO: 4976675 - DNA, 16 bp, Homo sapiens
tcagatctttctcctt

SEQ ID NO: 4976676 - DNA, 16 bp, Homo sapiens
tcagatgcagtttgga

SEQ ID NO: 4976677 - DNA, 16 bp, Homo sapiens
tcagatgctccaagat

SEQ ID NO: 4976678 - DNA, 18 bp, Homo sapiens
tcagatgctccaagattc

SEQ ID NO: 4976679 - DNA, 19 bp, Homo sapiens
tcagatggaaatattttga

SEQ ID NO: 4976680 - DNA, 14 bp, Homo sapiens
tcagattcccagag

SEQ ID NO: 4976681 - DNA, 21 bp, Homo sapiens
tcagattcccagagcaaaata

SEQ ID NO: 4976682 - DNA, 22 bp, Homo sapiens
tcagattcccagagcaaaataa

SEQ ID NO: 4976683 - DNA, 15 bp, Homo sapiens
tcagcaaacaggatc

SEQ ID NO: 4976684 - DNA, 22 bp, Homo sapiens
tcagcaaaccatttttaaagta

SEQ ID NO: 4976685 - DNA, 20 bp, Homo sapiens
tcagcacagataaaaagtgg

SEQ ID NO: 4976686 - DNA, 22 bp, Homo sapiens
tcagcacagataaaaagtggaa

SEQ ID NO: 4976687 - DNA, 21 bp, Homo sapiens
tcagcactgaaaataccatca

SEQ ID NO: 4976688 - DNA, 15 bp, Homo sapiens
tcagcacttgtctca

SEQ ID NO: 4976689 - DNA, 14 bp, Homo sapiens
tcagcagctagaaa

SEQ ID NO: 4976690 - DNA, 16 bp, Homo sapiens
tcagcatcctggcacc

SEQ ID NO: 4976691 - DNA, 18 bp, Homo sapiens
tcagcatcctggcacccg

SEQ ID NO: 4976692 - DNA, 15 bp, Homo sapiens
tcagcatctgtgatg

SEQ ID NO: 4976693 - DNA, 17 bp, Homo sapiens
tcagcattctcactcct

SEQ ID NO: 4976694 - DNA, 23 bp, Homo sapiens
tcagcattctcactcctacctgg

SEQ ID NO: 4976695 - DNA, 16 bp, Homo sapiens
tcagcccagaagaaaa

SEQ ID NO: 4976696 - DNA, 14 bp, Homo sapiens
tcagcccctaggag

SEQ ID NO: 4976697 - DNA, 13 bp, Homo sapiens
tcagccctccctg

SEQ ID NO: 4976698 - DNA, 13 bp, Homo sapiens
tcagcctcccaaa

SEQ ID NO: 4976699 - DNA, 14 bp, Homo sapiens
tcagcctcccaaag

SEQ ID NO: 4976700 - DNA, 22 bp, Homo sapiens
tcagcctcccgagtagctggga

SEQ ID NO: 4976701 - DNA, 20 bp, Homo sapiens
tcagcctccggagtagctgg

SEQ ID NO: 4976702 - DNA, 22 bp, Homo sapiens
tcagcctcttaaagctgcctgt

SEQ ID NO: 4976703 - DNA, 18 bp, Homo sapiens
tcagccttacatttgtga

SEQ ID NO: 4976704 - DNA, 23 bp, Homo sapiens
tcagcggggacagctccttctgt

SEQ ID NO: 4976705 - DNA, 16 bp, Homo sapiens
tcagcgtaaaatggtg

SEQ ID NO: 4976706 - DNA, 22 bp, Homo sapiens
tcagctaagggaagacatttct

SEQ ID NO: 4976707 - DNA, 18 bp, Homo sapiens
tcagctagcttttaggaa

SEQ ID NO: 4976708 - DNA, 23 bp, Homo sapiens
tcagctccagggaatccaagcct

SEQ ID NO: 4976709 - DNA, 19 bp, Homo sapiens
tcagctccaggtggctctg

SEQ ID NO: 4976710 - DNA, 14 bp, Homo sapiens
tcagctctctgtat

SEQ ID NO: 4976711 - DNA, 21 bp, Homo sapiens
tcatcgaatctactaattcca

SEQ ID NO: 4976712 - DNA, 17 bp, Homo sapiens
tcatctatgaggaaagg

SEQ ID NO: 4976713 - DNA, 21 bp, Homo sapiens
tcatctattcaagcacttaca

SEQ ID NO: 4976714 - DNA, 12 bp, Homo sapiens
tcatctattttg

SEQ ID NO: 4976715 - DNA, 13 bp, Homo sapiens
tcatctattttga

SEQ ID NO: 4976716 - DNA, 14 bp, Homo sapiens
tcatctattttgat

SEQ ID NO: 4976717 - DNA, 21 bp, Homo sapiens
tcatctggataggagcctgct

SEQ ID NO: 4976718 - DNA, 23 bp, Homo sapiens
tcatctggataggagcctgctgg

SEQ ID NO: 4976719 - DNA, 17 bp, Homo sapiens
tcatctgtgtgaaaatg

SEQ ID NO: 4976720 - DNA, 19 bp, Homo sapiens
tcatctgtgtgaaaatggg

SEQ ID NO: 4976721 - DNA, 17 bp, Homo sapiens
tcatctgtttttctttt

SEQ ID NO: 4976722 - DNA, 16 bp, Homo sapiens
tcatcttactgtacct

SEQ ID NO: 4976723 - DNA, 20 bp, Homo sapiens
tcatgaattcttatgcttat

SEQ ID NO: 4976724 - DNA, 13 bp, Homo sapiens
tcatgaattttac

SEQ ID NO: 4976725 - DNA, 14 bp, Homo sapiens
tcatgaattttaca

SEQ ID NO: 4976726 - DNA, 16 bp, Homo sapiens
tcatgacaagcatttt

SEQ ID NO: 4976727 - DNA, 14 bp, Homo sapiens
tcatgacatgttat

SEQ ID NO: 4976728 - DNA, 17 bp, Homo sapiens
tcatgacatgttatata

SEQ ID NO: 4976729 - DNA, 19 bp, Homo sapiens
tcatgatgcagtctcctct

SEQ ID NO: 4976730 - DNA, 11 bp, Homo sapiens
tcatgattttt

SEQ ID NO: 4976731 - DNA, 14 bp, Homo sapiens
tcatgcataaatat

SEQ ID NO: 4976732 - DNA, 15 bp, Homo sapiens
tcatgcataaatatg

SEQ ID NO: 4976733 - DNA, 21 bp, Homo sapiens
tcatgccagctacttcctcct

SEQ ID NO: 4976734 - DNA, 23 bp, Homo sapiens
tcatgccagctacttcctcctcc

SEQ ID NO: 4976735 - DNA, 20 bp, Homo sapiens
tcatgctttaaagtgtaata

SEQ ID NO: 4976736 - DNA, 14 bp, Homo sapiens
tcatggcccctctg

SEQ ID NO: 4976737 - DNA, 14 bp, Homo sapiens
tcatggtgtaataa

SEQ ID NO: 4976738 - DNA, 21 bp, Homo sapiens
tcatggtgtaataagacataa

SEQ ID NO: 4976739 - DNA, 19 bp, Homo sapiens
tcatgtaaagaaatgtctt

SEQ ID NO: 4976740 - DNA, 17 bp, Homo sapiens
tcatgtacaagatgaag

SEQ ID NO: 4976741 - DNA, 19 bp, Homo sapiens
tcatgtatcatctggatag

SEQ ID NO: 4976742 - DNA, 14 bp, Homo sapiens
tcatgtcaggcctg

SEQ ID NO: 4976743 - DNA, 13 bp, Homo sapiens
tcatgtctggcta

SEQ ID NO: 4976744 - DNA, 13 bp, Homo sapiens
tcatgttggtcaa

SEQ ID NO: 4976745 - DNA, 13 bp, Homo sapiens
tcatgttgttaaa

SEQ ID NO: 4976746 - DNA, 15 bp, Homo sapiens
tcatgtttatgaaaa

SEQ ID NO: 4976747 - DNA, 21 bp, Homo sapiens
tcatgtttggtgcatagaact

SEQ ID NO: 4976748 - DNA, 14 bp, Homo sapiens
tcattaattctata

SEQ ID NO: 4976749 - DNA, 19 bp, Homo sapiens
tcattacccttccctgcac

SEQ ID NO: 4976750 - DNA, 17 bp, Homo sapiens
tcattactcttaaggaa

SEQ ID NO: 4976751 - DNA, 15 bp, Homo sapiens
tcattactgggcctt

SEQ ID NO: 4976752 - DNA, 17 bp, Homo sapiens
tcattagctgtgatttt

SEQ ID NO: 4976753 - DNA, 16 bp, Homo sapiens
tcattcaatattgaca

SEQ ID NO: 4976754 - DNA, 16 bp, Homo sapiens
tcattcactagctttg

SEQ ID NO: 4976755 - DNA, 13 bp, Homo sapiens
tcattccattgcc

SEQ ID NO: 4976756 - DNA, 20 bp, Homo sapiens
tcattccattgcctagctct

SEQ ID NO: 4976757 - DNA, 23 bp, Homo sapiens
tcattctcataattcctacagca

SEQ ID NO: 4976758 - DNA, 12 bp, Homo sapiens
tcattctcctgc

SEQ ID NO: 4976759 - DNA, 15 bp, Homo sapiens
tcattctcctgcctg

SEQ ID NO: 4976760 - DNA, 13 bp, Homo sapiens
tcattctgcattg

SEQ ID NO: 4976761 - DNA, 16 bp, Homo sapiens
tcattctgcattgcta

SEQ ID NO: 4976762 - DNA, 19 bp, Homo sapiens
tcattctgcattgctagat

SEQ ID NO: 4976763 - DNA, 16 bp, Homo sapiens
tcattctgtgatcatt

SEQ ID NO: 4976764 - DNA, 12 bp, Homo sapiens
tcattcttctgt

SEQ ID NO: 4976765 - DNA, 11 bp, Homo sapiens
tcattgaaatg

SEQ ID NO: 4976766 - DNA, 17 bp, Homo sapiens
tcattgaaatgtcacgt

SEQ ID NO: 4976767 - DNA, 14 bp, Homo sapiens
tcattgagagtttt

SEQ ID NO: 4976768 - DNA, 23 bp, Homo sapiens
tcattgcctgtgtatggaaaaac

SEQ ID NO: 4976769 - DNA, 15 bp, Homo sapiens
tcattgctgagcctc

SEQ ID NO: 4976770 - DNA, 23 bp, Homo sapiens
tcattgctttgaagcagttgtgt

SEQ ID NO: 4976771 - DNA, 18 bp, Homo sapiens
tcattggaacaactgata

SEQ ID NO: 4976772 - DNA, 17 bp, Homo sapiens
tcattggtctaatttat

SEQ ID NO: 4976773 - DNA, 21 bp, Homo sapiens
tcattgtactacctgtgtata

SEQ ID NO: 4976774 - DNA, 14 bp, Homo sapiens
tcattgtatgatgt

SEQ ID NO: 4976775 - DNA, 16 bp, Homo sapiens
tcattgtccctcttca

SEQ ID NO: 4976776 - DNA, 22 bp, Homo sapiens
tcattgttatttatacaagatt

SEQ ID NO: 4976777 - DNA, 23 bp, Homo sapiens
tcatttaagtttcaaacttacta

SEQ ID NO: 4976778 - DNA, 22 bp, Homo sapiens
tcatttactaaacatatgattt

SEQ ID NO: 4976779 - DNA, 16 bp, Homo sapiens
tcatttagaacttgca

SEQ ID NO: 4976780 - DNA, 18 bp, Homo sapiens
tcatttccccataactca

SEQ ID NO: 4976781 - DNA, 22 bp, Homo sapiens
tcatttccccataactcaatgg

SEQ ID NO: 4976782 - DNA, 13 bp, Homo sapiens
tcatttcctgtgt

SEQ ID NO: 4976783 - DNA, 17 bp, Homo sapiens
tcatttctaaaagaata

SEQ ID NO: 4976784 - DNA, 24 bp, Homo sapiens
tcatttctcactgtgtacataatg

SEQ ID NO: 4976785 - DNA, 18 bp, Homo sapiens
tcatttggttcattaatt

SEQ ID NO: 4976786 - DNA, 14 bp, Homo sapiens
tcatttgtcacaca

SEQ ID NO: 4976787 - DNA, 13 bp, Homo sapiens
tcatttgtgtcaa

SEQ ID NO: 4976788 - DNA, 22 bp, Homo sapiens
tcatttgttgtgatgtcttttc

SEQ ID NO: 4976789 - DNA, 14 bp, Homo sapiens
tcattttccaatac

SEQ ID NO: 4976790 - DNA, 15 bp, Homo sapiens
tcattttccccccac

SEQ ID NO: 4976791 - DNA, 19 bp, Homo sapiens
tcattttccccccactctc

SEQ ID NO: 4976792 - DNA, 20 bp, Homo sapiens
tcattttctataacagatat

SEQ ID NO: 4976793 - DNA, 22 bp, Homo sapiens
tccaaaaagattttcagaaaat

SEQ ID NO: 4976794 - DNA, 15 bp, Homo sapiens
tccaaacatgtattt

SEQ ID NO: 4976795 - DNA, 18 bp, Homo sapiens
tccaaagaggctgcccct

SEQ ID NO: 4976796 - DNA, 13 bp, Homo sapiens
tccaaaggaggct

SEQ ID NO: 4976797 - DNA, 13 bp, Homo sapiens
tccaaagtctcta

SEQ ID NO: 4976798 - DNA, 22 bp, Homo sapiens
tccaaatgtcctccagaagcct

SEQ ID NO: 4976799 - DNA, 12 bp, Homo sapiens
tccataccagct

SEQ ID NO: 4976800 - DNA, 23 bp, Homo sapiens
tccatatcttaaagaaacagctt

SEQ ID NO: 4976801 - DNA, 21 bp, Homo sapiens
tccatatcttgcgaatccaag

SEQ ID NO: 4976802 - DNA, 22 bp, Homo sapiens
tccatatcttgcgaatccaagc

SEQ ID NO: 4976803 - DNA, 14 bp, Homo sapiens
tccatatttattca

SEQ ID NO: 4976804 - DNA, 11 bp, Homo sapiens
tccatccaatc

SEQ ID NO: 4976805 - DNA, 17 bp, Homo sapiens
tccatcccaacagccat

SEQ ID NO: 4976806 - DNA, 23 bp, Homo sapiens
tccatcccaaccagtgccaagga

SEQ ID NO: 4976807 - DNA, 15 bp, Homo sapiens
tccatcccaggacac

SEQ ID NO: 4976808 - DNA, 22 bp, Homo sapiens
tccatcccaggacaccacaccc

SEQ ID NO: 4976809 - DNA, 23 bp, Homo sapiens
tccatccctctaatgagactgac

SEQ ID NO: 4976810 - DNA, 21 bp, Homo sapiens
tccatctcctataatctgtca

SEQ ID NO: 4976811 - DNA, 15 bp, Homo sapiens
tccatgacaggcctg

SEQ ID NO: 4976812 - DNA, 13 bp, Homo sapiens
tccatgctcctca

SEQ ID NO: 4976813 - DNA, 21 bp, Homo sapiens
tccatgctcctcactgcccgc

SEQ ID NO: 4976814 - DNA, 23 bp, Homo sapiens
tccatgcttctcatcttgtgaaa

SEQ ID NO: 4976815 - DNA, 13 bp, Homo sapiens
tccatgtttgtaa

SEQ ID NO: 4976816 - DNA, 16 bp, Homo sapiens
tccatgtttgtaaaac

SEQ ID NO: 4976817 - DNA, 19 bp, Homo sapiens
tccatgtttgtaaaactac

SEQ ID NO: 4976818 - DNA, 10 bp, Homo sapiens
tccattccca

SEQ ID NO: 4976819 - DNA, 15 bp, Homo sapiens
tccattggtccaaga

SEQ ID NO: 4976820 - DNA, 16 bp, Homo sapiens
tccattggtccaagat

SEQ ID NO: 4976821 - DNA, 16 bp, Homo sapiens
tccatttatatatgaa

SEQ ID NO: 4976822 - DNA, 23 bp, Homo sapiens
tccatttatatatgaaaactata

SEQ ID NO: 4976823 - DNA, 13 bp, Homo sapiens
tccatttgtaatt

SEQ ID NO: 4976824 - DNA, 15 bp, Homo sapiens
tcccaaacgcctccc

SEQ ID NO: 4976825 - DNA, 21 bp, Homo sapiens
tcccaaacgcctcccctgccc

SEQ ID NO: 4976826 - DNA, 19 bp, Homo sapiens
tcccaaagtgctgagatta

SEQ ID NO: 4976827 - DNA, 21 bp, Homo sapiens
tcccaaagtgctgggattaca

SEQ ID NO: 4976828 - DNA, 17 bp, Homo sapiens
tcccaaatttgattgat

SEQ ID NO: 4976829 - DNA, 17 bp, Homo sapiens
tcccaaccagtgccaag

SEQ ID NO: 4976830 - DNA, 18 bp, Homo sapiens
tcccaaccagtgccaagg

SEQ ID NO: 4976831 - DNA, 14 bp, Homo sapiens
tcccaagatgttga

SEQ ID NO: 4976832 - DNA, 23 bp, Homo sapiens
tcccaagatgttgatttttactg

SEQ ID NO: 4976833 - DNA, 15 bp, Homo sapiens
tcccaagctctgctc

SEQ ID NO: 4976834 - DNA, 13 bp, Homo sapiens
tcccaaggaaagc

SEQ ID NO: 4976835 - DNA, 18 bp, Homo sapiens
tcccaaggagaacaaata

SEQ ID NO: 4976836 - DNA, 22 bp, Homo sapiens
tcccaaggctctgagcaaatgt

SEQ ID NO: 4976837 - DNA, 13 bp, Homo sapiens
tcccaagtccaca

SEQ ID NO: 4976838 - DNA, 23 bp, Homo sapiens
tcccaagtttccatagcaacagg

SEQ ID NO: 4976839 - DNA, 20 bp, Homo sapiens
tcccaatgcacatccattcc

SEQ ID NO: 4976840 - DNA, 22 bp, Homo sapiens
tcccaatgcacatccattccca

SEQ ID NO: 4976841 - DNA, 17 bp, Homo sapiens
tcccacaggcccttcct

SEQ ID NO: 4976842 - DNA, 19 bp, Homo sapiens
tcccacatccaactccagc

SEQ ID NO: 4976843 - DNA, 20 bp, Homo sapiens
tcccacatccaactccagca

SEQ ID NO: 4976844 - DNA, 20 bp, Homo sapiens
tcccacccccatctctccct

SEQ ID NO: 4976845 - DNA, 21 bp, Homo sapiens
tcccacccccttctctgctcc

SEQ ID NO: 4976846 - DNA, 14 bp, Homo sapiens
tcccacctcagcct

SEQ ID NO: 4976847 - DNA, 15 bp, Homo sapiens
tcccacctcagcctc

SEQ ID NO: 4976848 - DNA, 14 bp, Homo sapiens
tcccacctccagtc

SEQ ID NO: 4976849 - DNA, 20 bp, Homo sapiens
tcccacctccctgcccaggc

SEQ ID NO: 4976850 - DNA, 18 bp, Homo sapiens
tcccacctctgtgacctc

SEQ ID NO: 4976851 - DNA, 20 bp, Homo sapiens
tcccacctctgtgacctcag

SEQ ID NO: 4976852 - DNA, 16 bp, Homo sapiens
tcccaccttggctgca

SEQ ID NO: 4976853 - DNA, 17 bp, Homo sapiens
tcccaccttggctgcag

SEQ ID NO: 4976854 - DNA, 19 bp, Homo sapiens
tcccaccttggctgcaggg

SEQ ID NO: 4976855 - DNA, 20 bp, Homo sapiens
tcccacctttcgggccatgt

SEQ ID NO: 4976856 - DNA, 18 bp, Homo sapiens
tcccacgaatttgctggg

SEQ ID NO: 4976857 - DNA, 20 bp, Homo sapiens
tcccacgaatttgctgggga

SEQ ID NO: 4976858 - DNA, 21 bp, Homo sapiens
tcccacgaatttgctggggaa

SEQ ID NO: 4976859 - DNA, 14 bp, Homo sapiens
tcccacgtgggaga

SEQ ID NO: 4976860 - DNA, 13 bp, Homo sapiens
tcccactcacccc

SEQ ID NO: 4976861 - DNA, 12 bp, Homo sapiens
tcccagaaatta

SEQ ID NO: 4976862 - DNA, 16 bp, Homo sapiens
tcccagaatcccagcc

SEQ ID NO: 4976863 - DNA, 20 bp, Homo sapiens
tcccagactactattttctt

SEQ ID NO: 4976864 - DNA, 14 bp, Homo sapiens
tcccagaggtccag

SEQ ID NO: 4976865 - DNA, 23 bp, Homo sapiens
tcccagaggtccagcccatctcg

SEQ ID NO: 4976866 - DNA, 12 bp, Homo sapiens
tcccagccaccc

SEQ ID NO: 4976867 - DNA, 21 bp, Homo sapiens
tcccagccggccaatggaaac

SEQ ID NO: 4976868 - DNA, 22 bp, Homo sapiens
tcccagccggccaatggaaacc

SEQ ID NO: 4976869 - DNA, 23 bp, Homo sapiens
tcccagccggccaatggaaacct

SEQ ID NO: 4976870 - DNA, 17 bp, Homo sapiens
tcccagctgtgctctgg

SEQ ID NO: 4976871 - DNA, 21 bp, Homo sapiens
tcccagctgtgctctggacag

SEQ ID NO: 4976872 - DNA, 22 bp, Homo sapiens
tcccagctgtgctctggacagg

SEQ ID NO: 4976873 - DNA, 11 bp, Homo sapiens
tcccaggaact

SEQ ID NO: 4976874 - DNA, 16 bp, Homo sapiens
tcccaggagacagttc

SEQ ID NO: 4976875 - DNA, 15 bp, Homo sapiens
tcccaggatgctggg

SEQ ID NO: 4976876 - DNA, 22 bp, Homo sapiens
tcccaggtgttaacattccaag

SEQ ID NO: 4976877 - DNA, 23 bp, Homo sapiens
tcccaggtgttaacattccaaga

SEQ ID NO: 4976878 - DNA, 23 bp, Homo sapiens
tcccagtccccagcccttcacat

SEQ ID NO: 4976879 - DNA, 16 bp, Homo sapiens
tcccagtctctggcag

SEQ ID NO: 4976880 - DNA, 15 bp, Homo sapiens
tcccagttcaggagt

SEQ ID NO: 4976881 - DNA, 20 bp, Homo sapiens
tcccagttcaggagtcccaa

SEQ ID NO: 4976882 - DNA, 23 bp, Homo sapiens
tcccatcattacccttccctgca

SEQ ID NO: 4976883 - DNA, 13 bp, Homo sapiens
tcccatcccctgg

SEQ ID NO: 4976884 - DNA, 17 bp, Homo sapiens
tcccatctaagctgcag

SEQ ID NO: 4976885 - DNA, 22 bp, Homo sapiens
tcccatctaagctgcagcttcc

SEQ ID NO: 4976886 - DNA, 13 bp, Homo sapiens
tcccatgaagcct

SEQ ID NO: 4976887 - DNA, 19 bp, Homo sapiens
tcccatgaagccttttgaa

SEQ ID NO: 4976888 - DNA, 22 bp, Homo sapiens
tcccatgagaccctggtgcctg

SEQ ID NO: 4976889 - DNA, 17 bp, Homo sapiens
tcccatgagcctcagca

SEQ ID NO: 4976890 - DNA, 19 bp, Homo sapiens
tcccatgagcctcagcatc

SEQ ID NO: 4976891 - DNA, 15 bp, Homo sapiens
tcccatgcaggccct

SEQ ID NO: 4976892 - DNA, 16 bp, Homo sapiens
tcccatgcaggccctt

SEQ ID NO: 4976893 - DNA, 15 bp, Homo sapiens
tcccatggacactcc

SEQ ID NO: 4976894 - DNA, 13 bp, Homo sapiens
tcccatgtagccc

SEQ ID NO: 4976895 - DNA, 21 bp, Homo sapiens
tcccatgtagccccctggcct

SEQ ID NO: 4976896 - DNA, 22 bp, Homo sapiens
tcccatgtagccccctggcctc

SEQ ID NO: 4976897 - DNA, 20 bp, Homo sapiens
tcccattaatcatttcccca

SEQ ID NO: 4976898 - DNA, 21 bp, Homo sapiens
tcccattaatcatttccccat

SEQ ID NO: 4976899 - DNA, 22 bp, Homo sapiens
tcccattgcatcacctctgtaa

SEQ ID NO: 4976900 - DNA, 17 bp, Homo sapiens
tccccaaaacaaagtct

SEQ ID NO: 4976901 - DNA, 21 bp, Homo sapiens
tccccaaaacaaagtctttgg

SEQ ID NO: 4976902 - DNA, 21 bp, Homo sapiens
tccccaacccccattctcatc

SEQ ID NO: 4976903 - DNA, 14 bp, Homo sapiens
tccccacccctacc

SEQ ID NO: 4976904 - DNA, 19 bp, Homo sapiens
tccccacccctacccctgg

SEQ ID NO: 4976905 - DNA, 17 bp, Homo sapiens
tcccttccactgcctct

SEQ ID NO: 4976906 - DNA, 19 bp, Homo sapiens
tcccttccactgcctctgc

SEQ ID NO: 4976907 - DNA, 12 bp, Homo sapiens
tcccttcccctc

SEQ ID NO: 4976908 - DNA, 21 bp, Homo sapiens
tcccttcccctccctggctcc

SEQ ID NO: 4976909 - DNA, 20 bp, Homo sapiens
tcccttccctaaagtgatgg

SEQ ID NO: 4976910 - DNA, 16 bp, Homo sapiens
tcccttccgaccctct

SEQ ID NO: 4976911 - DNA, 20 bp, Homo sapiens
tcccttccgaccctctggga

SEQ ID NO: 4976912 - DNA, 22 bp, Homo sapiens
tcccttccgaccctctgggaac

SEQ ID NO: 4976913 - DNA, 22 bp, Homo sapiens
tcccttgatgcacagagaagct

SEQ ID NO: 4976914 - DNA, 13 bp, Homo sapiens
tcccttgccactt

SEQ ID NO: 4976915 - DNA, 22 bp, Homo sapiens
tcccttgcttttccctcttttc

SEQ ID NO: 4976916 - DNA, 12 bp, Homo sapiens
tcccttggcctc

SEQ ID NO: 4976917 - DNA, 13 bp, Homo sapiens
tcccttggcctca

SEQ ID NO: 4976918 - DNA, 19 bp, Homo sapiens
tcccttggtggcaagagcc

SEQ ID NO: 4976919 - DNA, 15 bp, Homo sapiens
tccctttccccagca

SEQ ID NO: 4976920 - DNA, 14 bp, Homo sapiens
tccctttccttcca

SEQ ID NO: 4976921 - DNA, 17 bp, Homo sapiens
tccctttccttccatcc

SEQ ID NO: 4976922 - DNA, 17 bp, Homo sapiens
tccctttccttcctaat

SEQ ID NO: 4976923 - DNA, 21 bp, Homo sapiens
tccgaaagggacttggaagct

SEQ ID NO: 4976924 - DNA, 22 bp, Homo sapiens
tccgaaagggacttggaagctc

SEQ ID NO: 4976925 - DNA, 19 bp, Homo sapiens
tccgaacaccctcgaagcg

SEQ ID NO: 4976926 - DNA, 17 bp, Homo sapiens
tccgaccagacaccttg

SEQ ID NO: 4976927 - DNA, 17 bp, Homo sapiens
tccgaccctctgggaac

SEQ ID NO: 4976928 - DNA, 16 bp, Homo sapiens
tccgcactttccactt

SEQ ID NO: 4976929 - DNA, 23 bp, Homo sapiens
tccgcactttccacttcttcctt

SEQ ID NO: 4976930 - DNA, 12 bp, Homo sapiens
tccgcccccagc

SEQ ID NO: 4976931 - DNA, 15 bp, Homo sapiens
tccgcccccagccta

SEQ ID NO: 4976932 - DNA, 16 bp, Homo sapiens
tccgcccccagcctat

SEQ ID NO: 4976933 - DNA, 14 bp, Homo sapiens
tccgcccctgcctg

SEQ ID NO: 4976934 - DNA, 19 bp, Homo sapiens
tccgcccctgcctgccatg

SEQ ID NO: 4976935 - DNA, 15 bp, Homo sapiens
tccgccccttccctt

SEQ ID NO: 4976936 - DNA, 14 bp, Homo sapiens
gagggttgggctgg

SEQ ID NO: 4976937 - DNA, 15 bp, Homo sapiens
gagggttgggctggt

SEQ ID NO: 4976938 - DNA, 21 bp, Homo sapiens
gagggttttaggtagaaaaac

SEQ ID NO: 4976939 - DNA, 18 bp, Homo sapiens
gaggtaacagaacagctt

SEQ ID NO: 4976940 - DNA, 14 bp, Homo sapiens
gaggtatattggaa

SEQ ID NO: 4976941 - DNA, 22 bp, Homo sapiens
gaggtcaggaaacttttaactg

SEQ ID NO: 4976942 - DNA, 12 bp, Homo sapiens
gaggtccagccc

SEQ ID NO: 4976943 - DNA, 14 bp, Homo sapiens
gaggtccagcccat

SEQ ID NO: 4976944 - DNA, 13 bp, Homo sapiens
gaggtcccaggaa

SEQ ID NO: 4976945 - DNA, 12 bp, Homo sapiens
gaggtcccaggc

SEQ ID NO: 4976946 - DNA, 14 bp, Homo sapiens
gaggtcccaggcag

SEQ ID NO: 4976947 - DNA, 22 bp, Homo sapiens
gaggtcgaccccaaagcccctt

SEQ ID NO: 4976948 - DNA, 19 bp, Homo sapiens
gaggtggccagagctggga

SEQ ID NO: 4976949 - DNA, 15 bp, Homo sapiens
gaggtgggagcagga

SEQ ID NO: 4976950 - DNA, 18 bp, Homo sapiens
gaggtgggagcaggagat

SEQ ID NO: 4976951 - DNA, 18 bp, Homo sapiens
gaggtggggcgaggcagg

SEQ ID NO: 4976952 - DNA, 14 bp, Homo sapiens
gaggttgggtgggc

SEQ ID NO: 4976953 - DNA, 21 bp, Homo sapiens
gaggtttcacccttaacccaa

SEQ ID NO: 4976954 - DNA, 15 bp, Homo sapiens
gagtaaatattgagg

SEQ ID NO: 4976955 - DNA, 21 bp, Homo sapiens
gagtaactattattataggta

SEQ ID NO: 4976956 - DNA, 23 bp, Homo sapiens
gagtaatgcatacagaaatataa

SEQ ID NO: 4976957 - DNA, 14 bp, Homo sapiens
gagtacaaatgcct

SEQ ID NO: 4976958 - DNA, 14 bp, Homo sapiens
gagtagaattgcat

SEQ ID NO: 4976959 - DNA, 18 bp, Homo sapiens
gagtagatattactttat

SEQ ID NO: 4976960 - DNA, 12 bp, Homo sapiens
gagtagctggga

SEQ ID NO: 4976961 - DNA, 19 bp, Homo sapiens
gagtagctgggactacagg

SEQ ID NO: 4976962 - DNA, 20 bp, Homo sapiens
gagtagttgatgttgcattt

SEQ ID NO: 4976963 - DNA, 18 bp, Homo sapiens
gagtatacaatatataaa

SEQ ID NO: 4976964 - DNA, 19 bp, Homo sapiens
gagtatacaatatataaaa

SEQ ID NO: 4976965 - DNA, 14 bp, Homo sapiens
gagtatatgcactt

SEQ ID NO: 4976966 - DNA, 17 bp, Homo sapiens
gagtatcaggtctccca

SEQ ID NO: 4976967 - DNA, 19 bp, Homo sapiens
gagtcaaatggtaggcatt

SEQ ID NO: 4976968 - DNA, 15 bp, Homo sapiens
gagtcaccaagccca

SEQ ID NO: 4976969 - DNA, 14 bp, Homo sapiens
gagtcaccttccag

SEQ ID NO: 4976970 - DNA, 22 bp, Homo sapiens
gagtcagacattttaagatggt

SEQ ID NO: 4976971 - DNA, 15 bp, Homo sapiens
gagtcagggcccaga

SEQ ID NO: 4976972 - DNA, 22 bp, Homo sapiens
gagtcagggcccagaggctgag

SEQ ID NO: 4976973 - DNA, 20 bp, Homo sapiens
gagtcatttaaatgtgtaca

SEQ ID NO: 4976974 - DNA, 15 bp, Homo sapiens
gagtccaagaatcca

SEQ ID NO: 4976975 - DNA, 15 bp, Homo sapiens
gagtccaggcacagg

SEQ ID NO: 4976976 - DNA, 12 bp, Homo sapiens
gagtcccacctt

SEQ ID NO: 4976977 - DNA, 13 bp, Homo sapiens
gagtcccaccttg

SEQ ID NO: 4976978 - DNA, 20 bp, Homo sapiens
gagtcccccctcccacctcc

SEQ ID NO: 4976979 - DNA, 17 bp, Homo sapiens
gagtcccctcacctcct

SEQ ID NO: 4976980 - DNA, 17 bp, Homo sapiens
gagtcgaggacagggag

SEQ ID NO: 4976981 - DNA, 19 bp, Homo sapiens
gagtcgtcatcacttttca

SEQ ID NO: 4976982 - DNA, 13 bp, Homo sapiens
gagtctagattca

SEQ ID NO: 4976983 - DNA, 23 bp, Homo sapiens
gagtctagattcaaaggttctag

SEQ ID NO: 4976984 - DNA, 20 bp, Homo sapiens
gagtctagcactcattttct

SEQ ID NO: 4976985 - DNA, 19 bp, Homo sapiens
gagtctcactgttgcccag

SEQ ID NO: 4976986 - DNA, 12 bp, Homo sapiens
gagtctcttctc

SEQ ID NO: 4976987 - DNA, 17 bp, Homo sapiens
gagtctggagtgggcag

SEQ ID NO: 4976988 - DNA, 22 bp, Homo sapiens
gagtctgttgtgtgtcatgcca

SEQ ID NO: 4976989 - DNA, 22 bp, Homo sapiens
gagtctttgaagctgaaaatat

SEQ ID NO: 4976990 - DNA, 22 bp, Homo sapiens
gagaaagtacttctccaccctg

SEQ ID NO: 4976991 - DNA, 23 bp, Homo sapiens
gagaaagtacttctccaccctgc

SEQ ID NO: 4976992 - DNA, 22 bp, Homo sapiens
gagaacaaagctgttaaactgt

SEQ ID NO: 4976993 - DNA, 12 bp, Homo sapiens
gagaacaaatat

SEQ ID NO: 4976994 - DNA, 18 bp, Homo sapiens
gagaacaggtggttttta

SEQ ID NO: 4976995 - DNA, 19 bp, Homo sapiens
gagaaccactacatgcagc

SEQ ID NO: 4976996 - DNA, 24 bp, Homo sapiens
gagaacgcagccctagagcctgcc

SEQ ID NO: 4976997 - DNA, 15 bp, Homo sapiens
gagaactcctgactg

SEQ ID NO: 4976998 - DNA, 15 bp, Homo sapiens
gagaactgtggccgt

SEQ ID NO: 4976999 - DNA, 22 bp, Homo sapiens
gagaagataattgttgaaattt

SEQ ID NO: 4977000 - DNA, 19 bp, Homo sapiens
gagaagcatatagaggcaa

SEQ ID NO: 4977001 - DNA, 14 bp, Homo sapiens
gagaagccttcagc

SEQ ID NO: 4977002 - DNA, 14 bp, Homo sapiens
gagaagctgcatcc

SEQ ID NO: 4977003 - DNA, 19 bp, Homo sapiens
gagaagctgctccaggcct

SEQ ID NO: 4977004 - DNA, 13 bp, Homo sapiens
gagaagctgctga

SEQ ID NO: 4977005 - DNA, 11 bp, Homo sapiens
gagaaggcagc

SEQ ID NO: 4977006 - DNA, 18 bp, Homo sapiens
gagaataagagaaagaaa

SEQ ID NO: 4977007 - DNA, 12 bp, Homo sapiens
gagaatgcacag

SEQ ID NO: 4977008 - DNA, 16 bp, Homo sapiens
gagaatgcacagatat

SEQ ID NO: 4977009 - DNA, 17 bp, Homo sapiens
gagaatgcacagatata

SEQ ID NO: 4977010 - DNA, 14 bp, Homo sapiens
gagaattgggggct

SEQ ID NO: 4977011 - DNA, 18 bp, Homo sapiens
gagacaaaatatttccca

SEQ ID NO: 4977012 - DNA, 16 bp, Homo sapiens
gagacacagcgtccct

SEQ ID NO: 4977013 - DNA, 17 bp, Homo sapiens
gagacactggcccctca

SEQ ID NO: 4977014 - DNA, 20 bp, Homo sapiens
gagacactgtgctataaatc

SEQ ID NO: 4977015 - DNA, 14 bp, Homo sapiens
gagacagaatgtat

SEQ ID NO: 4977016 - DNA, 21 bp, Homo sapiens
gagacagaatgtatctgtgaa

SEQ ID NO: 4977017 - DNA, 22 bp, Homo sapiens
gagacagggttttgccatgttg

SEQ ID NO: 4977018 - DNA, 22 bp, Homo sapiens
gagacagtttcttagcttttta

SEQ ID NO: 4977019 - DNA, 20 bp, Homo sapiens
gagacatggctttcagaaaa

SEQ ID NO: 4977020 - DNA, 21 bp, Homo sapiens
gagacatggctttcagaaaac

SEQ ID NO: 4977021 - DNA, 14 bp, Homo sapiens
gagacccccacacc

SEQ ID NO: 4977022 - DNA, 16 bp, Homo sapiens
gagaccgtcctcaccc

SEQ ID NO: 4977023 - DNA, 12 bp, Homo sapiens
gagaccttaccc

SEQ ID NO: 4977024 - DNA, 18 bp, Homo sapiens
gagaccttacccctggct

SEQ ID NO: 4977025 - DNA, 22 bp, Homo sapiens
gagaccttacccctggctgttt

SEQ ID NO: 4977026 - DNA, 21 bp, Homo sapiens
gagacgtggaacctctgtctc

SEQ ID NO: 4977027 - DNA, 16 bp, Homo sapiens
gagactagattgcctt

SEQ ID NO: 4977028 - DNA, 14 bp, Homo sapiens
gagactatggagcc

SEQ ID NO: 4977029 - DNA, 13 bp, Homo sapiens
gagactatttaaa

SEQ ID NO: 4977030 - DNA, 14 bp, Homo sapiens
gagactggggggct

SEQ ID NO: 4977031 - DNA, 18 bp, Homo sapiens
gagactggggggcttgaa

SEQ ID NO: 4977032 - DNA, 13 bp, Homo sapiens
gagactgtccctg

SEQ ID NO: 4977033 - DNA, 13 bp, Homo sapiens
gagacttgtatga

SEQ ID NO: 4977034 - DNA, 16 bp, Homo sapiens
gagacttttttctagt

SEQ ID NO: 4977035 - DNA, 16 bp, Homo sapiens
gagagaaagccaggca

SEQ ID NO: 4977036 - DNA, 21 bp, Homo sapiens
gagagaaagccaggcaggtag

SEQ ID NO: 4977037 - DNA, 17 bp, Homo sapiens
gagagaaagtgggtgag

SEQ ID NO: 4977038 - DNA, 13 bp, Homo sapiens
gagagagaaaaaa

SEQ ID NO: 4977039 - DNA, 12 bp, Homo sapiens
gagagagaaagc

SEQ ID NO: 4977040 - DNA, 15 bp, Homo sapiens
gagagagaaagccag

SEQ ID NO: 4977041 - DNA, 18 bp, Homo sapiens
gagagagaaagccaggca

SEQ ID NO: 4977042 - DNA, 15 bp, Homo sapiens
gagagagagagagaa

SEQ ID NO: 4977043 - DNA, 13 bp, Homo sapiens
gagagaggcagag

SEQ ID NO: 4977044 - DNA, 14 bp, Homo sapiens
gagagatatatctg

SEQ ID NO: 4977045 - DNA, 18 bp, Homo sapiens
gagagatgggagctcctc

SEQ ID NO: 4977046 - DNA, 20 bp, Homo sapiens
gagagcaactctgagatcta

SEQ ID NO: 4977047 - DNA, 14 bp, Homo sapiens
gagagccattttgt

SEQ ID NO: 4977048 - DNA, 14 bp, Homo sapiens
gagagcccagaggt

SEQ ID NO: 4977049 - DNA, 20 bp, Homo sapiens
gagagcccggcgcccctgcc

SEQ ID NO: 4977050 - DNA, 13 bp, Homo sapiens
gagagcctgctgc

SEQ ID NO: 4977051 - DNA, 18 bp, Homo sapiens
gagagcttagcctggagc

SEQ ID NO: 4977052 - DNA, 22 bp, Homo sapiens
gagaggaactccttggcctagc

SEQ ID NO: 4977053 - DNA, 11 bp, Homo sapiens
gagaggagaga

SEQ ID NO: 4977054 - DNA, 18 bp, Homo sapiens
gagaggagagaggcagag

SEQ ID NO: 4977055 - DNA, 13 bp, Homo sapiens
gagaggagccaga

SEQ ID NO: 4977056 - DNA, 14 bp, Homo sapiens
gagaggatgagagc

SEQ ID NO: 4977057 - DNA, 20 bp, Homo sapiens
gagaggatgagagcccagag

SEQ ID NO: 4977058 - DNA, 23 bp, Homo sapiens
gagcgtcagggttggtgtgctga

SEQ ID NO: 4977059 - DNA, 20 bp, Homo sapiens
gagcgttagactgacttgtt

SEQ ID NO: 4977060 - DNA, 11 bp, Homo sapiens
gagctaaggct

SEQ ID NO: 4977061 - DNA, 18 bp, Homo sapiens
gagctaagggtgggtgct

SEQ ID NO: 4977062 - DNA, 15 bp, Homo sapiens
gagctcctctcctgg

SEQ ID NO: 4977063 - DNA, 19 bp, Homo sapiens
gagctcctctgtcctgctt

SEQ ID NO: 4977064 - DNA, 16 bp, Homo sapiens
gagctcttcaggcctc

SEQ ID NO: 4977065 - DNA, 23 bp, Homo sapiens
gagctgaggtttcacccttaacc

SEQ ID NO: 4977066 - DNA, 17 bp, Homo sapiens
gagctgatataaattct

SEQ ID NO: 4977067 - DNA, 19 bp, Homo sapiens
gagctgatataaattctgt

SEQ ID NO: 4977068 - DNA, 21 bp, Homo sapiens
gagctgatgaaactcacaaat

SEQ ID NO: 4977069 - DNA, 21 bp, Homo sapiens
gagctgccctccttgtccacc

SEQ ID NO: 4977070 - DNA, 15 bp, Homo sapiens
gagctgccttggctc

SEQ ID NO: 4977071 - DNA, 16 bp, Homo sapiens
gagctggcctctctag

SEQ ID NO: 4977072 - DNA, 12 bp, Homo sapiens
gagctgggaggc

SEQ ID NO: 4977073 - DNA, 17 bp, Homo sapiens
gagctgggaggcatggc

SEQ ID NO: 4977074 - DNA, 18 bp, Homo sapiens
gagctgggaggcatggcc

SEQ ID NO: 4977075 - DNA, 15 bp, Homo sapiens
gagctggggacctgg

SEQ ID NO: 4977076 - DNA, 19 bp, Homo sapiens
gagctggggacctggtacc

SEQ ID NO: 4977077 - DNA, 15 bp, Homo sapiens
gagctggtgcccgga

SEQ ID NO: 4977078 - DNA, 21 bp, Homo sapiens
gagctggtgcccggagattgg

SEQ ID NO: 4977079 - DNA, 13 bp, Homo sapiens
gagcttgctttga

SEQ ID NO: 4977080 - DNA, 19 bp, Homo sapiens
gagcttgctttgatttaca

SEQ ID NO: 4977081 - DNA, 11 bp, Homo sapiens
gagctttatgg

SEQ ID NO: 4977082 - DNA, 16 bp, Homo sapiens
gaggaaagagtcttca

SEQ ID NO: 4977083 - DNA, 21 bp, Homo sapiens
gaggaaagagtcttcaacata

SEQ ID NO: 4977084 - DNA, 23 bp, Homo sapiens
gaggaactccttggcctagccca

SEQ ID NO: 4977085 - DNA, 16 bp, Homo sapiens
gaggaactgtccagag

SEQ ID NO: 4977086 - DNA, 17 bp, Homo sapiens
gaggaactgtccagaga

SEQ ID NO: 4977087 - DNA, 18 bp, Homo sapiens
gaggaactgtccagagag

SEQ ID NO: 4977088 - DNA, 21 bp, Homo sapiens
gaggaactgtccagagagcaa

SEQ ID NO: 4977089 - DNA, 18 bp, Homo sapiens
gaggaataattatttatt

SEQ ID NO: 4977090 - DNA, 22 bp, Homo sapiens
gaggaatcatgtcaggcctgtg

SEQ ID NO: 4977091 - DNA, 16 bp, Homo sapiens
gaggaatcctggcagc

SEQ ID NO: 4977092 - DNA, 22 bp, Homo sapiens
gaggaatttatacctcaaacta

SEQ ID NO: 4977093 - DNA, 15 bp, Homo sapiens
gaggacaaaacttct

SEQ ID NO: 4977094 - DNA, 15 bp, Homo sapiens
gaggacaaccattcc

SEQ ID NO: 4977095 - DNA, 14 bp, Homo sapiens
gaggacaggcggga

SEQ ID NO: 4977096 - DNA, 20 bp, Homo sapiens
gaggactcgcttgtaaatac

SEQ ID NO: 4977097 - DNA, 12 bp, Homo sapiens
gaggagagaggc

SEQ ID NO: 4977098 - DNA, 17 bp, Homo sapiens
gaggagagaggcagaga

SEQ ID NO: 4977099 - DNA, 13 bp, Homo sapiens
gaggagccttttt

SEQ ID NO: 4977100 - DNA, 23 bp, Homo sapiens
gaggaggatgtccctgggccagg

SEQ ID NO: 4977101 - DNA, 13 bp, Homo sapiens
gaggaggcctcca

SEQ ID NO: 4977102 - DNA, 15 bp, Homo sapiens
gaggaggtgtgagga

SEQ ID NO: 4977103 - DNA, 14 bp, Homo sapiens
gaggatcagttttt

SEQ ID NO: 4977104 - DNA, 17 bp, Homo sapiens
gaggatgagagcccaga

SEQ ID NO: 4977105 - DNA, 18 bp, Homo sapiens
gaggatgagagcccagag

SEQ ID NO: 4977106 - DNA, 20 bp, Homo sapiens
gaggatgagagcccagaggt

SEQ ID NO: 4977107 - DNA, 22 bp, Homo sapiens
gaccttccataatgctactgtc

SEQ ID NO: 4977108 - DNA, 12 bp, Homo sapiens
gaccttcctcat

SEQ ID NO: 4977109 - DNA, 14 bp, Homo sapiens
gaccttcctcatcc

SEQ ID NO: 4977110 - DNA, 23 bp, Homo sapiens
gaccttcctcatccaccccatcc

SEQ ID NO: 4977111 - DNA, 17 bp, Homo sapiens
gaccttcctctggggct

SEQ ID NO: 4977112 - DNA, 23 bp, Homo sapiens
gaccttgaactgggtacttgtgg

SEQ ID NO: 4977113 - DNA, 13 bp, Homo sapiens
gaccttgggccaa

SEQ ID NO: 4977114 - DNA, 18 bp, Homo sapiens
gacgccctctccccaccc

SEQ ID NO: 4977115 - DNA, 13 bp, Homo sapiens
gacgcctgagctc

SEQ ID NO: 4977116 - DNA, 14 bp, Homo sapiens
gacgcgtctcctgt

SEQ ID NO: 4977117 - DNA, 14 bp, Homo sapiens
gacggagtcccacc

SEQ ID NO: 4977118 - DNA, 23 bp, Homo sapiens
gacggagtcccaccttggctgca

SEQ ID NO: 4977119 - DNA, 12 bp, Homo sapiens
gacggccctgca

SEQ ID NO: 4977120 - DNA, 21 bp, Homo sapiens
gacggtgacaaagatggctca

SEQ ID NO: 4977121 - DNA, 14 bp, Homo sapiens
gacgtctttctttt

SEQ ID NO: 4977122 - DNA, 23 bp, Homo sapiens
gacgtttctcatttgtttttctc

SEQ ID NO: 4977123 - DNA, 14 bp, Homo sapiens
gactaaattcgtga

SEQ ID NO: 4977124 - DNA, 19 bp, Homo sapiens
gactaaccccaacgcacag

SEQ ID NO: 4977125 - DNA, 21 bp, Homo sapiens
gactaactagacaccaaagtt

SEQ ID NO: 4977126 - DNA, 23 bp, Homo sapiens
gactaactagacaccaaagttct

SEQ ID NO: 4977127 - DNA, 21 bp, Homo sapiens
gactaagcctacctgctctcc

SEQ ID NO: 4977128 - DNA, 21 bp, Homo sapiens
gactaattagggtacatttat

SEQ ID NO: 4977129 - DNA, 12 bp, Homo sapiens
gactaatttcaa

SEQ ID NO: 4977130 - DNA, 13 bp, Homo sapiens
gactaatttcaaa

SEQ ID NO: 4977131 - DNA, 15 bp, Homo sapiens
gactacaaaaatgaa

SEQ ID NO: 4977132 - DNA, 15 bp, Homo sapiens
gactacaggcaccca

SEQ ID NO: 4977133 - DNA, 18 bp, Homo sapiens
gactacaggtgtgagtca

SEQ ID NO: 4977134 - DNA, 21 bp, Homo sapiens
gactacaggtgtgagtcacca

SEQ ID NO: 4977135 - DNA, 14 bp, Homo sapiens
gactacttagcatc

SEQ ID NO: 4977136 - DNA, 21 bp, Homo sapiens
gactacttagcatcctaagaa

SEQ ID NO: 4977137 - DNA, 14 bp, Homo sapiens
gactagatgatgga

SEQ ID NO: 4977138 - DNA, 17 bp, Homo sapiens
gactagggattcaggct

SEQ ID NO: 4977139 - DNA, 18 bp, Homo sapiens
gactagggattcaggctg

SEQ ID NO: 4977140 - DNA, 21 bp, Homo sapiens
gactagggattcaggctgctt

SEQ ID NO: 4977141 - DNA, 12 bp, Homo sapiens
gactatatacat

SEQ ID NO: 4977142 - DNA, 13 bp, Homo sapiens
gactatatacatg

SEQ ID NO: 4977143 - DNA, 20 bp, Homo sapiens
gactatggagcctggcacag

SEQ ID NO: 4977144 - DNA, 22 bp, Homo sapiens
gactatttgcttatttaataaa

SEQ ID NO: 4977145 - DNA, 18 bp, Homo sapiens
gactcaaatgttctaagt

SEQ ID NO: 4977146 - DNA, 14 bp, Homo sapiens
gactcaatgcactg

SEQ ID NO: 4977147 - DNA, 17 bp, Homo sapiens
gactcaatgcactgaca

SEQ ID NO: 4977148 - DNA, 11 bp, Homo sapiens
gactcagccct

SEQ ID NO: 4977149 - DNA, 15 bp, Homo sapiens
gactcagccctgagg

SEQ ID NO: 4977150 - DNA, 16 bp, Homo sapiens
gactcagccctgaggt

SEQ ID NO: 4977151 - DNA, 20 bp, Homo sapiens
gactcagggccatgcctgcc

SEQ ID NO: 4977152 - DNA, 22 bp, Homo sapiens
gactcatcaatcaaataagtat

SEQ ID NO: 4977153 - DNA, 17 bp, Homo sapiens
gactccaagaacaattg

SEQ ID NO: 4977154 - DNA, 19 bp, Homo sapiens
gactccacgatcctgccac

SEQ ID NO: 4977155 - DNA, 21 bp, Homo sapiens
gactcccaagtttccatagca

SEQ ID NO: 4977156 - DNA, 22 bp, Homo sapiens
gactcccaagtttccatagcaa

SEQ ID NO: 4977157 - DNA, 16 bp, Homo sapiens
gactcccatgaagcct

SEQ ID NO: 4977158 - DNA, 12 bp, Homo sapiens
gactccctcctc

SEQ ID NO: 4977159 - DNA, 19 bp, Homo sapiens
gactccctcctcacctctg

SEQ ID NO: 4977160 - DNA, 20 bp, Homo sapiens
gactccctcctcacctctgg

SEQ ID NO: 4977161 - DNA, 24 bp, Homo sapiens
gactccctcctcacctctggactg

SEQ ID NO: 4977162 - DNA, 22 bp, Homo sapiens
gactcccttaaaatagaaataa

SEQ ID NO: 4977163 - DNA, 16 bp, Homo sapiens
gactcctacctgccct

SEQ ID NO: 4977164 - DNA, 21 bp, Homo sapiens
gactctaaattctttatttct

SEQ ID NO: 4977165 - DNA, 16 bp, Homo sapiens
gactctcagcccagaa

SEQ ID NO: 4977166 - DNA, 16 bp, Homo sapiens
gactctgaagcctctg

SEQ ID NO: 4977167 - DNA, 14 bp, Homo sapiens
gactctgcacatga

SEQ ID NO: 4977168 - DNA, 19 bp, Homo sapiens
gactctgcatcccagcacc

SEQ ID NO: 4977169 - DNA, 22 bp, Homo sapiens
gactctgcatcccagcacctgc

SEQ ID NO: 4977170 - DNA, 18 bp, Homo sapiens
gactctggtgcctccaga

SEQ ID NO: 4977171 - DNA, 17 bp, Homo sapiens
gactctgtaacatcact

SEQ ID NO: 4977172 - DNA, 15 bp, Homo sapiens
gactcttcaaaaact

SEQ ID NO: 4977173 - DNA, 17 bp, Homo sapiens
gactcttcaaaaactgt

SEQ ID NO: 4977174 - DNA, 21 bp, Homo sapiens
gactgacttgtttgtcttcca

SEQ ID NO: 4977175 - DNA, 23 bp, Homo sapiens
gactgagcctggcccatagaaac

SEQ ID NO: 4977176 - DNA, 18 bp, Homo sapiens
gactgcaagaggctcctg

SEQ ID NO: 4977177 - DNA, 21 bp, Homo sapiens
gactgcaggttggaccccaga

SEQ ID NO: 4977178 - DNA, 22 bp, Homo sapiens
gactgcaggttggaccccagag

SEQ ID NO: 4977179 - DNA, 13 bp, Homo sapiens
cttggcttctgtg

SEQ ID NO: 4977180 - DNA, 17 bp, Homo sapiens
cttggcttctgtgatga

SEQ ID NO: 4977181 - DNA, 10 bp, Homo sapiens
cttgggaatg

SEQ ID NO: 4977182 - DNA, 14 bp, Homo sapiens
cttgggagttttga

SEQ ID NO: 4977183 - DNA, 20 bp, Homo sapiens
cttgggccaaatccgctctc

SEQ ID NO: 4977184 - DNA, 23 bp, Homo sapiens
cttggggaggacaaaacttcttg

SEQ ID NO: 4977185 - DNA, 23 bp, Homo sapiens
cttggggccaccaaagctgccca

SEQ ID NO: 4977186 - DNA, 22 bp, Homo sapiens
cttgggggaacgatgtgtctgt

SEQ ID NO: 4977187 - DNA, 20 bp, Homo sapiens
cttggtgaatttttttttcc

SEQ ID NO: 4977188 - DNA, 22 bp, Homo sapiens
cttggtgaatttttttttccta

SEQ ID NO: 4977189 - DNA, 18 bp, Homo sapiens
cttgtaaaaattaaaagt

SEQ ID NO: 4977190 - DNA, 14 bp, Homo sapiens
cttgtaaataccag

SEQ ID NO: 4977191 - DNA, 18 bp, Homo sapiens
cttgtaaatagctcaggt

SEQ ID NO: 4977192 - DNA, 21 bp, Homo sapiens
cttgtaaatagctcaggtgtc

SEQ ID NO: 4977193 - DNA, 16 bp, Homo sapiens
cttgtaatttttattt

SEQ ID NO: 4977194 - DNA, 13 bp, Homo sapiens
cttgtacaaaata

SEQ ID NO: 4977195 - DNA, 19 bp, Homo sapiens
cttgtacatgtgtagcctg

SEQ ID NO: 4977196 - DNA, 22 bp, Homo sapiens
cttgtacatgtgtagcctgtgc

SEQ ID NO: 4977197 - DNA, 14 bp, Homo sapiens
cttgtagctgtaaa

SEQ ID NO: 4977198 - DNA, 21 bp, Homo sapiens
cttgtaggagctgaggtttca

SEQ ID NO: 4977199 - DNA, 15 bp, Homo sapiens
cttgtataaatgtat

SEQ ID NO: 4977200 - DNA, 15 bp, Homo sapiens
cttgtatagtgtaaa

SEQ ID NO: 4977201 - DNA, 18 bp, Homo sapiens
cttgtatcctctggttct

SEQ ID NO: 4977202 - DNA, 22 bp, Homo sapiens
cttgtcactggtagaccaaaat

SEQ ID NO: 4977203 - DNA, 15 bp, Homo sapiens
cttgtctcattttaa

SEQ ID NO: 4977204 - DNA, 18 bp, Homo sapiens
cttgtctcattttaatgt

SEQ ID NO: 4977205 - DNA, 18 bp, Homo sapiens
cttgtcttttcaaaatat

SEQ ID NO: 4977206 - DNA, 19 bp, Homo sapiens
cttgtgaaacacagctgtt

SEQ ID NO: 4977207 - DNA, 15 bp, Homo sapiens
cttgtgaatgcttct

SEQ ID NO: 4977208 - DNA, 17 bp, Homo sapiens
cttgtgaatgcttctca

SEQ ID NO: 4977209 - DNA, 19 bp, Homo sapiens
cttgtgaatgcttctcact

SEQ ID NO: 4977210 - DNA, 23 bp, Homo sapiens
cttgtgctggatggagcccaggc

SEQ ID NO: 4977211 - DNA, 17 bp, Homo sapiens
cttgtgctttgctcttg

SEQ ID NO: 4977212 - DNA, 23 bp, Homo sapiens
cttgtgctttgctcttgtcccac

SEQ ID NO: 4977213 - DNA, 15 bp, Homo sapiens
cttgtggacacagct

SEQ ID NO: 4977214 - DNA, 18 bp, Homo sapiens
cttgtggacacagctctt

SEQ ID NO: 4977215 - DNA, 20 bp, Homo sapiens
cttgtggggacccaggctcc

SEQ ID NO: 4977216 - DNA, 21 bp, Homo sapiens
cttgtggggacccaggctccg

SEQ ID NO: 4977217 - DNA, 15 bp, Homo sapiens
cttgtgtctgtacac

SEQ ID NO: 4977218 - DNA, 19 bp, Homo sapiens
cttgtgttaagtatgtgta

SEQ ID NO: 4977219 - DNA, 20 bp, Homo sapiens
cttgtgttgtccttttgtct

SEQ ID NO: 4977220 - DNA, 23 bp, Homo sapiens
cttgttagaaaacaaaattttat

SEQ ID NO: 4977221 - DNA, 20 bp, Homo sapiens
cttgttatattaagcagaaa

SEQ ID NO: 4977222 - DNA, 13 bp, Homo sapiens
cttgttattgtga

SEQ ID NO: 4977223 - DNA, 21 bp, Homo sapiens
cttgtttatcagatacatcac

SEQ ID NO: 4977224 - DNA, 12 bp, Homo sapiens
cttgtttattga

SEQ ID NO: 4977225 - DNA, 22 bp, Homo sapiens
cttgttttccagtctcttgtac

SEQ ID NO: 4977226 - DNA, 21 bp, Homo sapiens
cttgttttctttctttaaatg

SEQ ID NO: 4977227 - DNA, 15 bp, Homo sapiens
cttgttttgtttgtc

SEQ ID NO: 4977228 - DNA, 19 bp, Homo sapiens
cttgttttttttttccact

SEQ ID NO: 4977229 - DNA, 20 bp, Homo sapiens
cttgttttttttttccactt

SEQ ID NO: 4977230 - DNA, 20 bp, Homo sapiens
ctttaaaaaaaaaagttaca

SEQ ID NO: 4977231 - DNA, 18 bp, Homo sapiens
ctttaaaaaaatttaagt

SEQ ID NO: 4977232 - DNA, 17 bp, Homo sapiens
ctttaaaacaaaacaaa

SEQ ID NO: 4977233 - DNA, 21 bp, Homo sapiens
ctttaaaagagagagagagaa

SEQ ID NO: 4977234 - DNA, 13 bp, Homo sapiens
ctttaaactcagg

SEQ ID NO: 4977235 - DNA, 16 bp, Homo sapiens
ctttaaaggcccagcc

SEQ ID NO: 4977236 - DNA, 18 bp, Homo sapiens
ctttaaagggcctgcctg

SEQ ID NO: 4977237 - DNA, 19 bp, Homo sapiens
ctttaaagggcctgcctgg

SEQ ID NO: 4977238 - DNA, 17 bp, Homo sapiens
ctttaaagtgtaataat

SEQ ID NO: 4977239 - DNA, 19 bp, Homo sapiens
ctttaaagtgtaataatat

SEQ ID NO: 4977240 - DNA, 15 bp, Homo sapiens
ctttaaataatttaa

SEQ ID NO: 4977241 - DNA, 11 bp, Homo sapiens
ctttaaatgtt

SEQ ID NO: 4977242 - DNA, 17 bp, Homo sapiens
ctttaagagagaaatct

SEQ ID NO: 4977243 - DNA, 17 bp, Homo sapiens
ctttaagggcatgcctt

SEQ ID NO: 4977244 - DNA, 19 bp, Homo sapiens
ctttaagggcatgccttgt

SEQ ID NO: 4977245 - DNA, 18 bp, Homo sapiens
ctttaatgtcacaggcag

SEQ ID NO: 4977246 - DNA, 20 bp, Homo sapiens
ctttaatgtcacaggcaggt

SEQ ID NO: 4977247 - DNA, 22 bp, Homo sapiens
ctttaatgtcacaggcaggtcc

SEQ ID NO: 4977248 - DNA, 21 bp, Homo sapiens
ctttacaggtatttataatat

SEQ ID NO: 4977249 - DNA, 17 bp, Homo sapiens
ctttacatgcaatttat

SEQ ID NO: 4977250 - DNA, 18 bp, Homo sapiens
ctttacccacctagaaca

SEQ ID NO: 4977251 - DNA, 14 bp, Homo sapiens
ctttacttttaaac

SEQ ID NO: 4977252 - DNA, 17 bp, Homo sapiens
ctttagaagtgcatttc

SEQ ID NO: 4977253 - DNA, 19 bp, Homo sapiens
ctttagaagtgcatttctg

SEQ ID NO: 4977254 - DNA, 19 bp, Homo sapiens
ctttagtacctgaaaagta

SEQ ID NO: 4977255 - DNA, 22 bp, Homo sapiens
ctttagtatgacgctgatacat

SEQ ID NO: 4977256 - DNA, 15 bp, Homo sapiens
ctttagtgtatttat

SEQ ID NO: 4977257 - DNA, 20 bp, Homo sapiens
ctttataagtcattgtatgt

SEQ ID NO: 4977258 - DNA, 20 bp, Homo sapiens
ctttatacattagtaaatgt

SEQ ID NO: 4977259 - DNA, 20 bp, Homo sapiens
ctttatagtgcacaaaatga

SEQ ID NO: 4977260 - DNA, 13 bp, Homo sapiens
ctttatatttagt

SEQ ID NO: 4977261 - DNA, 13 bp, Homo sapiens
ctttatctgttct

SEQ ID NO: 4977262 - DNA, 18 bp, Homo sapiens
ctttatctgttcttgcta

SEQ ID NO: 4977263 - DNA, 20 bp, Homo sapiens
ctttatgataatagattctc

SEQ ID NO: 4977264 - DNA, 14 bp, Homo sapiens
ctttatgtgtaaat

SEQ ID NO: 4977265 - DNA, 13 bp, Homo sapiens
ctttattaccagt

SEQ ID NO: 4977266 - DNA, 14 bp, Homo sapiens
ctttattgcttttt

SEQ ID NO: 4977267 - DNA, 19 bp, Homo sapiens
ctttcaaaattaaatctgt

SEQ ID NO: 4977268 - DNA, 23 bp, Homo sapiens
ctttcaagtgcctttctgcagtt

SEQ ID NO: 4977269 - DNA, 14 bp, Homo sapiens
ctttcacaaccttc

SEQ ID NO: 4977270 - DNA, 24 bp, Homo sapiens
ctttcacattgtttgctgctattg

SEQ ID NO: 4977271 - DNA, 20 bp, Homo sapiens
ctttcagaaaacgggaagcg

SEQ ID NO: 4977272 - DNA, 15 bp, Homo sapiens
ctttccaaggcttct

SEQ ID NO: 4977273 - DNA, 20 bp, Homo sapiens
ctttccacttcttcctttct

SEQ ID NO: 4977274 - DNA, 13 bp, Homo sapiens
ctttccagttaag

SEQ ID NO: 4977275 - DNA, 12 bp, Homo sapiens
ctttccattttg

SEQ ID NO: 4977276 - DNA, 15 bp, Homo sapiens
ctttcccaagccttc

SEQ ID NO: 4977277 - DNA, 16 bp, Homo sapiens
ctttcccaccctgttc

SEQ ID NO: 4977278 - DNA, 22 bp, Homo sapiens
ctttcccaccctgttcccagtc

SEQ ID NO: 4977279 - DNA, 20 bp, Homo sapiens
ctttccccagcatcactccc

SEQ ID NO: 4977280 - DNA, 13 bp, Homo sapiens
ctttccccagccc

SEQ ID NO: 4977281 - DNA, 15 bp, Homo sapiens
ctttccccagcccag

SEQ ID NO: 4977282 - DNA, 16 bp, Homo sapiens
ctttccccagcccagg

SEQ ID NO: 4977283 - DNA, 13 bp, Homo sapiens
ctttcccttgctt

SEQ ID NO: 4977284 - DNA, 16 bp, Homo sapiens
ctttcccttgcttttc

SEQ ID NO: 4977285 - DNA, 21 bp, Homo sapiens
ctttcccttgcttttccctct

SEQ ID NO: 4977286 - DNA, 17 bp, Homo sapiens
ctttcctcctttatcac

SEQ ID NO: 4977287 - DNA, 12 bp, Homo sapiens
gaaaactttaaa

SEQ ID NO: 4977288 - DNA, 16 bp, Homo sapiens
gaaaagagaagaagaa

SEQ ID NO: 4977289 - DNA, 10 bp, Homo sapiens
gaaaagcata

SEQ ID NO: 4977290 - DNA, 19 bp, Homo sapiens
gaaaagctattagccagga

SEQ ID NO: 4977291 - DNA, 17 bp, Homo sapiens
gaaaagctgctgacagt

SEQ ID NO: 4977292 - DNA, 15 bp, Homo sapiens
gaaaaggaaaagaaa

SEQ ID NO: 4977293 - DNA, 17 bp, Homo sapiens
gaaaaggaaaagaaaaa

SEQ ID NO: 4977294 - DNA, 12 bp, Homo sapiens
gaaaagtatttt

SEQ ID NO: 4977295 - DNA, 14 bp, Homo sapiens
gaaaagtattttga

SEQ ID NO: 4977296 - DNA, 18 bp, Homo sapiens
gaaaagtattttgaagtt

SEQ ID NO: 4977297 - DNA, 19 bp, Homo sapiens
gaaaagtattttgaagttt

SEQ ID NO: 4977298 - DNA, 17 bp, Homo sapiens
gacaggcaatgctggct

SEQ ID NO: 4977299 - DNA, 20 bp, Homo sapiens
gacaggcatgttctctgagg

SEQ ID NO: 4977300 - DNA, 21 bp, Homo sapiens
gacaggcctcacctctaccca

SEQ ID NO: 4977301 - DNA, 24 bp, Homo sapiens
gacaggcgagagaggagccagaca

SEQ ID NO: 4977302 - DNA, 16 bp, Homo sapiens
gacagggaggtgaccc

SEQ ID NO: 4977303 - DNA, 14 bp, Homo sapiens
gacagggcatggcc

SEQ ID NO: 4977304 - DNA, 22 bp, Homo sapiens
gacagggcatggccaggtggcc

SEQ ID NO: 4977305 - DNA, 11 bp, Homo sapiens
gacagggccag

SEQ ID NO: 4977306 - DNA, 19 bp, Homo sapiens
gacagggccagtggggcct

SEQ ID NO: 4977307 - DNA, 17 bp, Homo sapiens
gacagggtttcaccatg

SEQ ID NO: 4977308 - DNA, 22 bp, Homo sapiens
gacagggttttgccatgttggc

SEQ ID NO: 4977309 - DNA, 14 bp, Homo sapiens
gacaggtaaattaa

SEQ ID NO: 4977310 - DNA, 22 bp, Homo sapiens
gacagtcactgccactttgcac

SEQ ID NO: 4977311 - DNA, 15 bp, Homo sapiens
gacagtcttgtgctt

SEQ ID NO: 4977312 - DNA, 23 bp, Homo sapiens
gacagtgttgaaaatgttcagaa

SEQ ID NO: 4977313 - DNA, 17 bp, Homo sapiens
gacagtttatcatgaag

SEQ ID NO: 4977314 - DNA, 21 bp, Homo sapiens
gacagtttcttagctttttaa

SEQ ID NO: 4977315 - DNA, 15 bp, Homo sapiens
gacagtttgtaaatg

SEQ ID NO: 4977316 - DNA, 17 bp, Homo sapiens
gacatacgaaacacaaa

SEQ ID NO: 4977317 - DNA, 18 bp, Homo sapiens
gacatcacagcagcctcc

SEQ ID NO: 4977318 - DNA, 21 bp, Homo sapiens
gacatcagttcctttgtgtgt

SEQ ID NO: 4977319 - DNA, 16 bp, Homo sapiens
gacatccgttgtgctt

SEQ ID NO: 4977320 - DNA, 19 bp, Homo sapiens
gacatcctgtataagcact

SEQ ID NO: 4977321 - DNA, 17 bp, Homo sapiens
gacatctcaggggccag

SEQ ID NO: 4977322 - DNA, 18 bp, Homo sapiens
gacatctggaatctggag

SEQ ID NO: 4977323 - DNA, 13 bp, Homo sapiens
gacatctttttaa

SEQ ID NO: 4977324 - DNA, 19 bp, Homo sapiens
gacatctttttaaagctta

SEQ ID NO: 4977325 - DNA, 19 bp, Homo sapiens
gacatgatttccttgaatg

SEQ ID NO: 4977326 - DNA, 20 bp, Homo sapiens
gacatgatttccttgaatgt

SEQ ID NO: 4977327 - DNA, 14 bp, Homo sapiens
gacatgcactgacc

SEQ ID NO: 4977328 - DNA, 16 bp, Homo sapiens
gacatgcactgaccct

SEQ ID NO: 4977329 - DNA, 14 bp, Homo sapiens
gacatggaggttct

SEQ ID NO: 4977330 - DNA, 16 bp, Homo sapiens
gacatggaggttctaa

SEQ ID NO: 4977331 - DNA, 14 bp, Homo sapiens
gacatgtgaaacct

SEQ ID NO: 4977332 - DNA, 16 bp, Homo sapiens
gacattatgtgtgcat

SEQ ID NO: 4977333 - DNA, 13 bp, Homo sapiens
gacattggagatg

SEQ ID NO: 4977334 - DNA, 19 bp, Homo sapiens
gacattgtagagcttctgg

SEQ ID NO: 4977335 - DNA, 22 bp, Homo sapiens
gacatttcttttctttttacat

SEQ ID NO: 4977336 - DNA, 20 bp, Homo sapiens
gaccaacgttactcagggct

SEQ ID NO: 4977337 - DNA, 19 bp, Homo sapiens
gaccaactgggcccaagac

SEQ ID NO: 4977338 - DNA, 15 bp, Homo sapiens
gaccaactgtgttgt

SEQ ID NO: 4977339 - DNA, 18 bp, Homo sapiens
gaccaactgtgttgtatt

SEQ ID NO: 4977340 - DNA, 19 bp, Homo sapiens
gaccaactgtgttgtatta

SEQ ID NO: 4977341 - DNA, 16 bp, Homo sapiens
gaccaaggaacaaaaa

SEQ ID NO: 4977342 - DNA, 23 bp, Homo sapiens
gaccaaggaacaaaaaaaccaca

SEQ ID NO: 4977343 - DNA, 20 bp, Homo sapiens
gaccaattattgatatatat

SEQ ID NO: 4977344 - DNA, 17 bp, Homo sapiens
gaccaattgtgctgcca

SEQ ID NO: 4977345 - DNA, 19 bp, Homo sapiens
gaccaccccgcctgccctc

SEQ ID NO: 4977346 - DNA, 19 bp, Homo sapiens
gaccactcagcccctagga

SEQ ID NO: 4977347 - DNA, 18 bp, Homo sapiens
gaccactgtttcttgctt

SEQ ID NO: 4977348 - DNA, 19 bp, Homo sapiens
gaccactgtttcttgcttg

SEQ ID NO: 4977349 - DNA, 21 bp, Homo sapiens
gaccagacaccttgacagggc

SEQ ID NO: 4977350 - DNA, 19 bp, Homo sapiens
gaccagaggagccttttta

SEQ ID NO: 4977351 - DNA, 21 bp, Homo sapiens
gaccagcctccatgctgcctc

SEQ ID NO: 4977352 - DNA, 17 bp, Homo sapiens
gaccaggactccctcct

SEQ ID NO: 4977353 - DNA, 19 bp, Homo sapiens
gaccaggactccctcctca

SEQ ID NO: 4977354 - DNA, 21 bp, Homo sapiens
gaccaggactccctcctcacc

SEQ ID NO: 4977355 - DNA, 19 bp, Homo sapiens
gaccaggccattctgccgc

SEQ ID NO: 4977356 - DNA, 14 bp, Homo sapiens
gaccagggagcctt

SEQ ID NO: 4977357 - DNA, 19 bp, Homo sapiens
gaccagggccgaggaggtg

SEQ ID NO: 4977358 - DNA, 21 bp, Homo sapiens
gaccagggccgaggaggtgcc

SEQ ID NO: 4977359 - DNA, 15 bp, Homo sapiens
gaccagtggtgcctt

SEQ ID NO: 4977360 - DNA, 22 bp, Homo sapiens
gaccagtggtttccagtcatga

SEQ ID NO: 4977361 - DNA, 17 bp, Homo sapiens
gaccatttaacatgcaa

SEQ ID NO: 4977362 - DNA, 17 bp, Homo sapiens
gacccaccccacctgca

SEQ ID NO: 4977363 - DNA, 16 bp, Homo sapiens
gacccacctcaccccg

SEQ ID NO: 4977364 - DNA, 12 bp, Homo sapiens
gacccaggctcc

SEQ ID NO: 4977365 - DNA, 16 bp, Homo sapiens
gacccaggctccgccc

SEQ ID NO: 4977366 - DNA, 23 bp, Homo sapiens
gacccaggctccgcccttagtcc

SEQ ID NO: 4977367 - DNA, 12 bp, Homo sapiens
gacccagtgaga

SEQ ID NO: 4977368 - DNA, 18 bp, Homo sapiens
gaccccagctgtgagcct

SEQ ID NO: 4977369 - DNA, 17 bp, Homo sapiens
gaccccaggctggacat

SEQ ID NO: 4977370 - DNA, 13 bp, Homo sapiens
gacccccacacct

SEQ ID NO: 4977371 - DNA, 22 bp, Homo sapiens
gaccccggtggcggccccagca

SEQ ID NO: 4977372 - DNA, 13 bp, Homo sapiens
gacccctccatgt

SEQ ID NO: 4977373 - DNA, 23 bp, Homo sapiens
gacccctcctcactggccatccc

SEQ ID NO: 4977374 - DNA, 14 bp, Homo sapiens
gaagctgaaaatat

SEQ ID NO: 4977375 - DNA, 18 bp, Homo sapiens
gaagctgcagcttgggag

SEQ ID NO: 4977376 - DNA, 18 bp, Homo sapiens
gaagctgctccaggcctg

SEQ ID NO: 4977377 - DNA, 22 bp, Homo sapiens
gaagctgctgaccaattgtgct

SEQ ID NO: 4977378 - DNA, 22 bp, Homo sapiens
gaagctggcctgagaggggaag

SEQ ID NO: 4977379 - DNA, 13 bp, Homo sapiens
gaagctgttgtac

SEQ ID NO: 4977380 - DNA, 18 bp, Homo sapiens
gaagctgttgtacattta

SEQ ID NO: 4977381 - DNA, 15 bp, Homo sapiens
gaagcttcagaagtt

SEQ ID NO: 4977382 - DNA, 13 bp, Homo sapiens
gaagcttctaata

SEQ ID NO: 4977383 - DNA, 15 bp, Homo sapiens
gaagcttgactccca

SEQ ID NO: 4977384 - DNA, 19 bp, Homo sapiens
gaaggaaagaaagaaggaa

SEQ ID NO: 4977385 - DNA, 23 bp, Homo sapiens
gaaggacccggaggggcctggca

SEQ ID NO: 4977386 - DNA, 17 bp, Homo sapiens
gaaggaggggaagctgc

SEQ ID NO: 4977387 - DNA, 18 bp, Homo sapiens
gaaggaggggaagctgca

SEQ ID NO: 4977388 - DNA, 19 bp, Homo sapiens
gaaggaggggaagctgcag

SEQ ID NO: 4977389 - DNA, 20 bp, Homo sapiens
gaaggagggtacagctgggc

SEQ ID NO: 4977390 - DNA, 14 bp, Homo sapiens
gaaggattgtaaaa

SEQ ID NO: 4977391 - DNA, 19 bp, Homo sapiens
gaaggattttttaaagttt

SEQ ID NO: 4977392 - DNA, 22 bp, Homo sapiens
gaaggcagggggaaggtggggt

SEQ ID NO: 4977393 - DNA, 17 bp, Homo sapiens
gaaggcatcagtcccta

SEQ ID NO: 4977394 - DNA, 20 bp, Homo sapiens
gaaggcctccctagccagca

SEQ ID NO: 4977395 - DNA, 18 bp, Homo sapiens
gaaggcctcttggagacc

SEQ ID NO: 4977396 - DNA, 23 bp, Homo sapiens
gaagggcaggaaggagagcctgc

SEQ ID NO: 4977397 - DNA, 18 bp, Homo sapiens
gaagggccagtcctgcct

SEQ ID NO: 4977398 - DNA, 19 bp, Homo sapiens
gaagggccagtcctgcctg

SEQ ID NO: 4977399 - DNA, 13 bp, Homo sapiens
gaagggcccagga

SEQ ID NO: 4977400 - DNA, 19 bp, Homo sapiens
gaaggggaagcactcgtgt

SEQ ID NO: 4977401 - DNA, 21 bp, Homo sapiens
gaagggtttgtggctgggggc

SEQ ID NO: 4977402 - DNA, 14 bp, Homo sapiens
gaaggtgacagcag

SEQ ID NO: 4977403 - DNA, 14 bp, Homo sapiens
gaaggtgctggagg

SEQ ID NO: 4977404 - DNA, 18 bp, Homo sapiens
gaaggtgctggaggtggg

SEQ ID NO: 4977405 - DNA, 22 bp, Homo sapiens
gaaggtttgtgttttctctgga

SEQ ID NO: 4977406 - DNA, 13 bp, Homo sapiens
gaaggttttaagt

SEQ ID NO: 4977407 - DNA, 12 bp, Homo sapiens
gaagtaaagcct

SEQ ID NO: 4977408 - DNA, 19 bp, Homo sapiens
gaagtagcttgctccctgt

SEQ ID NO: 4977409 - DNA, 20 bp, Homo sapiens
gaagtagttctgtttggtgt

SEQ ID NO: 4977410 - DNA, 19 bp, Homo sapiens
gaagtcatgaagcccaagt

SEQ ID NO: 4977411 - DNA, 14 bp, Homo sapiens
gaagtccaatgtgg

SEQ ID NO: 4977412 - DNA, 22 bp, Homo sapiens
gaagtgatactatccagttact

SEQ ID NO: 4977413 - DNA, 23 bp, Homo sapiens
gaagtgcatttctgaatagaaat

SEQ ID NO: 4977414 - DNA, 20 bp, Homo sapiens
gaagttactttatgtttgtc

SEQ ID NO: 4977415 - DNA, 16 bp, Homo sapiens
gaagtttacattgtaa

SEQ ID NO: 4977416 - DNA, 21 bp, Homo sapiens
gaagtttacatttttatttat

SEQ ID NO: 4977417 - DNA, 20 bp, Homo sapiens
gaagtttgtccatttgtaaa

SEQ ID NO: 4977418 - DNA, 21 bp, Homo sapiens
gaataaaaggcttgaagctgt

SEQ ID NO: 4977419 - DNA, 13 bp, Homo sapiens
gaataaacttcag

SEQ ID NO: 4977420 - DNA, 18 bp, Homo sapiens
gaataaacttcagcacca

SEQ ID NO: 4977421 - DNA, 14 bp, Homo sapiens
gaataaagacacct

SEQ ID NO: 4977422 - DNA, 20 bp, Homo sapiens
gaataaattcccaacttctc

SEQ ID NO: 4977423 - DNA, 16 bp, Homo sapiens
gaataagaatggagca

SEQ ID NO: 4977424 - DNA, 22 bp, Homo sapiens
gaataataattaggttaacatt

SEQ ID NO: 4977425 - DNA, 14 bp, Homo sapiens
gaataatgtaaaat

SEQ ID NO: 4977426 - DNA, 22 bp, Homo sapiens
gaataatgtaaaatgttgaata

SEQ ID NO: 4977427 - DNA, 20 bp, Homo sapiens
gaataattatttatttaata

SEQ ID NO: 4977428 - DNA, 22 bp, Homo sapiens
gaataccattaaaactgctttt

SEQ ID NO: 4977429 - DNA, 14 bp, Homo sapiens
gaatactttttaca

SEQ ID NO: 4977430 - DNA, 20 bp, Homo sapiens
gaatactttttacaattaaa

SEQ ID NO: 4977431 - DNA, 16 bp, Homo sapiens
gaatagaagcaaatta

SEQ ID NO: 4977432 - DNA, 15 bp, Homo sapiens
gaatagatgctgact

SEQ ID NO: 4977433 - DNA, 15 bp, Homo sapiens
gaatagccacatttg

SEQ ID NO: 4977434 - DNA, 15 bp, Homo sapiens
gaatagctgggacta

SEQ ID NO: 4977435 - DNA, 20 bp, Homo sapiens
gaataggcattaacacaaag

SEQ ID NO: 4977436 - DNA, 22 bp, Homo sapiens
gaatatacagcaggtgctcaat

SEQ ID NO: 4977437 - DNA, 22 bp, Homo sapiens
gaatataggtctcttctcccag

SEQ ID NO: 4977438 - DNA, 13 bp, Homo sapiens
gaatatatttatt

SEQ ID NO: 4977439 - DNA, 19 bp, Homo sapiens
gaatatccatgtacttgtt

SEQ ID NO: 4977440 - DNA, 16 bp, Homo sapiens
gaatattcatattgga

SEQ ID NO: 4977441 - DNA, 21 bp, Homo sapiens
gaatattttcagtaatgttat

SEQ ID NO: 4977442 - DNA, 21 bp, Homo sapiens
gaatcaaaaattgaagagaga

SEQ ID NO: 4977443 - DNA, 17 bp, Homo sapiens
gaatcagagtagaaata

SEQ ID NO: 4977444 - DNA, 19 bp, Homo sapiens
gaatcatacttagcaaagt

SEQ ID NO: 4977445 - DNA, 20 bp, Homo sapiens
gaatcatgtcaggcctgtgt

SEQ ID NO: 4977446 - DNA, 16 bp, Homo sapiens
gaatccaagctccctg

SEQ ID NO: 4977447 - DNA, 17 bp, Homo sapiens
gaatcccaaatttgatt

SEQ ID NO: 4977448 - DNA, 18 bp, Homo sapiens
gaatcccacccacatgtg

SEQ ID NO: 4977449 - DNA, 13 bp, Homo sapiens
gaatcccagccgg

SEQ ID NO: 4977450 - DNA, 16 bp, Homo sapiens
gaatccccgaaggtgc

SEQ ID NO: 4977451 - DNA, 16 bp, Homo sapiens
gaatcccctccctgtc

SEQ ID NO: 4977452 - DNA, 12 bp, Homo sapiens
gaatcctggcag

SEQ ID NO: 4977453 - DNA, 13 bp, Homo sapiens
gaatcctggcagc

SEQ ID NO: 4977454 - DNA, 14 bp, Homo sapiens
gaatcctttgcctg

SEQ ID NO: 4977455 - DNA, 18 bp, Homo sapiens
gaatctacccccagatcc

SEQ ID NO: 4977456 - DNA, 12 bp, Homo sapiens
gaatctattttc

SEQ ID NO: 4977457 - DNA, 15 bp, Homo sapiens
gaatctattttctat

SEQ ID NO: 4977458 - DNA, 19 bp, Homo sapiens
gaatctattttctatgtac

SEQ ID NO: 4977459 - DNA, 18 bp, Homo sapiens
gaatctcccactccagcg

SEQ ID NO: 4977460 - DNA, 16 bp, Homo sapiens
gaatctggagaccagg

SEQ ID NO: 4977461 - DNA, 22 bp, Homo sapiens
gaatctggagaccagggagcct

SEQ ID NO: 4977462 - DNA, 15 bp, Homo sapiens
gaatgaaaaaacagt

SEQ ID NO: 4977463 - DNA, 20 bp, Homo sapiens
gaatgaacactcttttgctt

SEQ ID NO: 4977464 - DNA, 16 bp, Homo sapiens
gaatgaattaaataaa

SEQ ID NO: 4977465 - DNA, 20 bp, Homo sapiens
gaatgagcccagagaacagc

SEQ ID NO: 4977466 - DNA, 14 bp, Homo sapiens
gaatgagtgtgcat

SEQ ID NO: 4977467 - DNA, 20 bp, Homo sapiens
gaatgattcatgttatattt

SEQ ID NO: 4977468 - DNA, 15 bp, Homo sapiens
gaatgctgccagtgt

SEQ ID NO: 4977469 - DNA, 17 bp, Homo sapiens
gaatgctgtacatctat

SEQ ID NO: 4977470 - DNA, 14 bp, Homo sapiens
gaatgctgtgttaa

SEQ ID NO: 4977471 - DNA, 21 bp, Homo sapiens
gaatggaagggttctggctgc

SEQ ID NO: 4977472 - DNA, 19 bp, Homo sapiens
gaatggacatcctgtataa

SEQ ID NO: 4977473 - DNA, 21 bp, Homo sapiens
gaatggactttggaagcaggg

SEQ ID NO: 4977474 - DNA, 21 bp, Homo sapiens
gaatggagcagtacatgggaa

SEQ ID NO: 4977475 - DNA, 22 bp, Homo sapiens
gaatgtaaaagaacttactgat

SEQ ID NO: 4977476 - DNA, 14 bp, Homo sapiens
gaatgtactctgtt

SEQ ID NO: 4977477 - DNA, 14 bp, Homo sapiens
gaatgtatctgtga

SEQ ID NO: 4977478 - DNA, 16 bp, Homo sapiens
gaatgtatttatttgg

SEQ ID NO: 4977479 - DNA, 14 bp, Homo sapiens
gaatgtgaaagcac

SEQ ID NO: 4977480 - DNA, 18 bp, Homo sapiens
gaatgtggcttgagaaat

SEQ ID NO: 4977481 - DNA, 16 bp, Homo sapiens
gaatgtggtctcagga

SEQ ID NO: 4977482 - DNA, 16 bp, Homo sapiens
gaatgtttgcctctgc

SEQ ID NO: 4977483 - DNA, 19 bp, Homo sapiens
gaatgtttgcctctgcctc

SEQ ID NO: 4977484 - DNA, 14 bp, Homo sapiens
gaattaaaacttct

SEQ ID NO: 4977485 - DNA, 13 bp, Homo sapiens
gaacacaggcagc

SEQ ID NO: 4977486 - DNA, 14 bp, Homo sapiens
gaacacaggcagct

SEQ ID NO: 4977487 - DNA, 19 bp, Homo sapiens
gaacacaggcagctttcta

SEQ ID NO: 4977488 - DNA, 19 bp, Homo sapiens
gaacactaactcaccagcc

SEQ ID NO: 4977489 - DNA, 16 bp, Homo sapiens
gaacactcttttgctt

SEQ ID NO: 4977490 - DNA, 17 bp, Homo sapiens
gaacagacaacagaagt

SEQ ID NO: 4977491 - DNA, 16 bp, Homo sapiens
gaacagactggaagca

SEQ ID NO: 4977492 - DNA, 22 bp, Homo sapiens
gaacagactggaagcacagctt

SEQ ID NO: 4977493 - DNA, 15 bp, Homo sapiens
gaacagcttcaggtt

SEQ ID NO: 4977494 - DNA, 20 bp, Homo sapiens
gaacatcctttgcagggcag

SEQ ID NO: 4977495 - DNA, 23 bp, Homo sapiens
gaacatcctttgcagggcagccc

SEQ ID NO: 4977496 - DNA, 19 bp, Homo sapiens
gaacatgtgagaggtttga

SEQ ID NO: 4977497 - DNA, 20 bp, Homo sapiens
gaaccacatcttgctctgct

SEQ ID NO: 4977498 - DNA, 18 bp, Homo sapiens
gaaccaccacacccagcc

SEQ ID NO: 4977499 - DNA, 21 bp, Homo sapiens
gaaccacgcgggggccttgag

SEQ ID NO: 4977500 - DNA, 18 bp, Homo sapiens
gaaccatgaagacaggat

SEQ ID NO: 4977501 - DNA, 19 bp, Homo sapiens
gaacccagcagttctgtta

SEQ ID NO: 4977502 - DNA, 12 bp, Homo sapiens
gaacccagggct

SEQ ID NO: 4977503 - DNA, 18 bp, Homo sapiens
gaacccagggctctgccc

SEQ ID NO: 4977504 - DNA, 20 bp, Homo sapiens
gaacccagggctctgcccca

SEQ ID NO: 4977505 - DNA, 17 bp, Homo sapiens
gaaccgagcaaagatca

SEQ ID NO: 4977506 - DNA, 14 bp, Homo sapiens
gaaccgcacagctc

SEQ ID NO: 4977507 - DNA, 17 bp, Homo sapiens
gaaccgcacagctcagg

SEQ ID NO: 4977508 - DNA, 21 bp, Homo sapiens
gaaccgcacagctcaggaggc

SEQ ID NO: 4977509 - DNA, 18 bp, Homo sapiens
gaacctcccagaggtcca

SEQ ID NO: 4977510 - DNA, 19 bp, Homo sapiens
gaacctcccagaggtccag

SEQ ID NO: 4977511 - DNA, 16 bp, Homo sapiens
gaacctgtcctaagga

SEQ ID NO: 4977512 - DNA, 14 bp, Homo sapiens
gaaccttgctgtcc

SEQ ID NO: 4977513 - DNA, 15 bp, Homo sapiens
gaaccttgctgtcct

SEQ ID NO: 4977514 - DNA, 16 bp, Homo sapiens
gaaccttgctgtcctg

SEQ ID NO: 4977515 - DNA, 17 bp, Homo sapiens
gaaccttgctgtcctga

SEQ ID NO: 4977516 - DNA, 16 bp, Homo sapiens
gaacgcagccctagag

SEQ ID NO: 4977517 - DNA, 20 bp, Homo sapiens
gaacgcagccctagagcctg

SEQ ID NO: 4977518 - DNA, 22 bp, Homo sapiens
gaacggagccccaggcctctgt

SEQ ID NO: 4977519 - DNA, 13 bp, Homo sapiens
gaactaaatgttc

SEQ ID NO: 4977520 - DNA, 14 bp, Homo sapiens
gaactaaatgttct

SEQ ID NO: 4977521 - DNA, 19 bp, Homo sapiens
gaactagactgcctgggtt

SEQ ID NO: 4977522 - DNA, 21 bp, Homo sapiens
gaactagcatatagccattga

SEQ ID NO: 4977523 - DNA, 15 bp, Homo sapiens
gaactataaagaagt

SEQ ID NO: 4977524 - DNA, 14 bp, Homo sapiens
gaactcactggggc

SEQ ID NO: 4977525 - DNA, 18 bp, Homo sapiens
gaactcagatctgtctga

SEQ ID NO: 4977526 - DNA, 23 bp, Homo sapiens
gaactcctaaacctttgcccctg

SEQ ID NO: 4977527 - DNA, 20 bp, Homo sapiens
gaactccttggcctagccca

SEQ ID NO: 4977528 - DNA, 11 bp, Homo sapiens
gaactctgaca

SEQ ID NO: 4977529 - DNA, 18 bp, Homo sapiens
gaactgaactaatccttc

SEQ ID NO: 4977530 - DNA, 18 bp, Homo sapiens
gaactgccattattttct

SEQ ID NO: 4977531 - DNA, 23 bp, Homo sapiens
gaactgccattattttctgtcag

SEQ ID NO: 4977532 - DNA, 11 bp, Homo sapiens
gaactggctgc

SEQ ID NO: 4977533 - DNA, 22 bp, Homo sapiens
gaactgggtacttgtggacaca

SEQ ID NO: 4977534 - DNA, 17 bp, Homo sapiens
gaactgtccagagagca

SEQ ID NO: 4977535 - DNA, 18 bp, Homo sapiens
gaactgtccagagagcaa

SEQ ID NO: 4977536 - DNA, 18 bp, Homo sapiens
gaactgtgcatagtgctg

SEQ ID NO: 4977537 - DNA, 22 bp, Homo sapiens
gaactgtgcatagtgctgggat

SEQ ID NO: 4977538 - DNA, 20 bp, Homo sapiens
gaacttatcctaaaacaaat

SEQ ID NO: 4977539 - DNA, 23 bp, Homo sapiens
gaacttccaggtgttactgtaat

SEQ ID NO: 4977540 - DNA, 14 bp, Homo sapiens
gaacttctaatata

SEQ ID NO: 4977541 - DNA, 17 bp, Homo sapiens
gaacttctctcagactt

SEQ ID NO: 4977542 - DNA, 17 bp, Homo sapiens
gaacttgaatgtgtcag

SEQ ID NO: 4977543 - DNA, 21 bp, Homo sapiens
gaacttgcagctgatgttgga

SEQ ID NO: 4977544 - DNA, 15 bp, Homo sapiens
gaacttgtagctgta

SEQ ID NO: 4977545 - DNA, 21 bp, Homo sapiens
gaacttttttaaataaacttt

SEQ ID NO: 4977546 - DNA, 22 bp, Homo sapiens
gaacttttttaaataaactttt

SEQ ID NO: 4977547 - DNA, 16 bp, Homo sapiens
gaagaaaaaaatcttc

SEQ ID NO: 4977548 - DNA, 16 bp, Homo sapiens
gaagaaaatggtttat

SEQ ID NO: 4977549 - DNA, 17 bp, Homo sapiens
gaagaaacactttctct

SEQ ID NO: 4977550 - DNA, 18 bp, Homo sapiens
gaagaaacactttctctt

SEQ ID NO: 4977551 - DNA, 22 bp, Homo sapiens
gaagaactagcatatagccatt

SEQ ID NO: 4977552 - DNA, 14 bp, Homo sapiens
gaagaagaaaaaaa

SEQ ID NO: 4977553 - DNA, 16 bp, Homo sapiens
gaagaagggcacccta

SEQ ID NO: 4977554 - DNA, 15 bp, Homo sapiens
gaagaatggagagga

SEQ ID NO: 4977555 - DNA, 16 bp, Homo sapiens
gaagaattaagataca

SEQ ID NO: 4977556 - DNA, 18 bp, Homo sapiens
gaagacaatttgatacat

SEQ ID NO: 4977557 - DNA, 21 bp, Homo sapiens
gaagacaccagagcagatgca

SEQ ID NO: 4977558 - DNA, 21 bp, Homo sapiens
gaagacactgatgggcaaccc

SEQ ID NO: 4977559 - DNA, 19 bp, Homo sapiens
gaagacctcacctagaaat

SEQ ID NO: 4977560 - DNA, 16 bp, Homo sapiens
gaagactcattcttct

SEQ ID NO: 4977561 - DNA, 18 bp, Homo sapiens
gaagactcattcttctgt

SEQ ID NO: 4977562 - DNA, 15 bp, Homo sapiens
gaagactggaagcta

SEQ ID NO: 4977563 - DNA, 15 bp, Homo sapiens
gaagagaagctgctg

SEQ ID NO: 4977564 - DNA, 16 bp, Homo sapiens
gaagagcaaaaatatc

SEQ ID NO: 4977565 - DNA, 14 bp, Homo sapiens
gaagagcttgcttt

SEQ ID NO: 4977566 - DNA, 17 bp, Homo sapiens
gaagaggaactgggcct

SEQ ID NO: 4977567 - DNA, 15 bp, Homo sapiens
gaagaggagccctca

SEQ ID NO: 4977568 - DNA, 22 bp, Homo sapiens
gaagagtcttggtttctctcta

SEQ ID NO: 4977569 - DNA, 14 bp, Homo sapiens
gaagagtgtgtgtg

SEQ ID NO: 4977570 - DNA, 17 bp, Homo sapiens
gaagataattgttgaaa

SEQ ID NO: 4977571 - DNA, 19 bp, Homo sapiens
gaagataattgttgaaatt

SEQ ID NO: 4977572 - DNA, 15 bp, Homo sapiens
gaagatatacatgaa

SEQ ID NO: 4977573 - DNA, 13 bp, Homo sapiens
gaagatgcagctc

SEQ ID NO: 4977574 - DNA, 22 bp, Homo sapiens
gaagatgctccagcaacacagc

SEQ ID NO: 4977575 - DNA, 15 bp, Homo sapiens
gaagattttcagtct

SEQ ID NO: 4977576 - DNA, 21 bp, Homo sapiens
cttctggcctttcctctctcc

SEQ ID NO: 4977577 - DNA, 21 bp, Homo sapiens
cttctggggcaggctgggcca

SEQ ID NO: 4977578 - DNA, 22 bp, Homo sapiens
cttctggggcaggctgggccat

SEQ ID NO: 4977579 - DNA, 18 bp, Homo sapiens
cttagcagggaaacagct

SEQ ID NO: 4977580 - DNA, 21 bp, Homo sapiens
cttagcagggaaacagctaat

SEQ ID NO: 4977581 - DNA, 19 bp, Homo sapiens
cttagcatcctaagaaata

SEQ ID NO: 4977582 - DNA, 22 bp, Homo sapiens
cttagcctggagcacctttcct

SEQ ID NO: 4977583 - DNA, 17 bp, Homo sapiens
cttagctttttaattgt

SEQ ID NO: 4977584 - DNA, 12 bp, Homo sapiens
cttaggccttcc

SEQ ID NO: 4977585 - DNA, 17 bp, Homo sapiens
ctgtcctaaggaacctt

SEQ ID NO: 4977586 - DNA, 14 bp, Homo sapiens
ctgtcctacccacc

SEQ ID NO: 4977587 - DNA, 14 bp, Homo sapiens
ctgtcctcactgct

SEQ ID NO: 4977588 - DNA, 16 bp, Homo sapiens
ctgtcctcactgctcc

SEQ ID NO: 4977589 - DNA, 21 bp, Homo sapiens
ctgtcctcactgctccctgaa

SEQ ID NO: 4977590 - DNA, 16 bp, Homo sapiens
ctgtcctcccatcccc

SEQ ID NO: 4977591 - DNA, 18 bp, Homo sapiens
ctgtcctcccatcccctg

SEQ ID NO: 4977592 - DNA, 19 bp, Homo sapiens
ctgtcctcccatcccctgg

SEQ ID NO: 4977593 - DNA, 18 bp, Homo sapiens
ctgtcctctcccctccag

SEQ ID NO: 4977594 - DNA, 19 bp, Homo sapiens
ctgtcctctcccctccagc

SEQ ID NO: 4977595 - DNA, 22 bp, Homo sapiens
ctgtcctctcccctccagcctt

SEQ ID NO: 4977596 - DNA, 16 bp, Homo sapiens
ctgtcctgatctgtga

SEQ ID NO: 4977597 - DNA, 13 bp, Homo sapiens
ctgtcctgcttct

SEQ ID NO: 4977598 - DNA, 14 bp, Homo sapiens
ctgtcctgcttctg

SEQ ID NO: 4977599 - DNA, 15 bp, Homo sapiens
ctgctggcccagcca

SEQ ID NO: 4977600 - DNA, 22 bp, Homo sapiens
ctgctggcccagccaaaccctg

SEQ ID NO: 4977601 - DNA, 14 bp, Homo sapiens
ctgctggctgcctt

SEQ ID NO: 4977602 - DNA, 16 bp, Homo sapiens
ctgctggtcacagcct

SEQ ID NO: 4977603 - DNA, 13 bp, Homo sapiens
ctgctggttcagg

SEQ ID NO: 4977604 - DNA, 23 bp, Homo sapiens
ctgctggttcagggttggcccct

SEQ ID NO: 4977605 - DNA, 23 bp, Homo sapiens
ctgcttagtatctcatcaacaaa

SEQ ID NO: 4977606 - DNA, 14 bp, Homo sapiens
ctgcttcagcctcc

SEQ ID NO: 4977607 - DNA, 12 bp, Homo sapiens
ctgcttcagtgg

SEQ ID NO: 4977608 - DNA, 11 bp, Homo sapiens
ctgcttcccac

SEQ ID NO: 4977609 - DNA, 16 bp, Homo sapiens
ctgcttcccacctccc

SEQ ID NO: 4977610 - DNA, 24 bp, Homo sapiens
ctgcttcccacctccctgcccagg

SEQ ID NO: 4977611 - DNA, 20 bp, Homo sapiens
ctgcttgagttcccagatgg

SEQ ID NO: 4977612 - DNA, 21 bp, Homo sapiens
ctgcttgataggaattcatct

SEQ ID NO: 4977613 - DNA, 17 bp, Homo sapiens
ctgctttaaagggcctg

SEQ ID NO: 4977614 - DNA, 19 bp, Homo sapiens
ctgctttaaagggcctgcc

SEQ ID NO: 4977615 - DNA, 14 bp, Homo sapiens
ctgctttctttgat

SEQ ID NO: 4977616 - DNA, 22 bp, Homo sapiens
ctgctttgggatttaatttcca

SEQ ID NO: 4977617 - DNA, 17 bp, Homo sapiens
ctgctttgggctgccct

SEQ ID NO: 4977618 - DNA, 18 bp, Homo sapiens
ctgctttgggctgccctg

SEQ ID NO: 4977619 - DNA, 16 bp, Homo sapiens
ctggtccatgcagggg

SEQ ID NO: 4977620 - DNA, 15 bp, Homo sapiens
ctggtcccactcagt

SEQ ID NO: 4977621 - DNA, 18 bp, Homo sapiens
ctggtcccactcagtcca

SEQ ID NO: 4977622 - DNA, 16 bp, Homo sapiens
ctggtccggacactcc

SEQ ID NO: 4977623 - DNA, 20 bp, Homo sapiens
ctggtccggacactcctaga

SEQ ID NO: 4977624 - DNA, 21 bp, Homo sapiens
ctggtcctgagggtccccacc

SEQ ID NO: 4977625 - DNA, 23 bp, Homo sapiens
ctggtctcaaactcttgacctca

SEQ ID NO: 4977626 - DNA, 18 bp, Homo sapiens
ctggtcttgtggaattgg

SEQ ID NO: 4977627 - DNA, 15 bp, Homo sapiens
ctggtcttgttagaa

SEQ ID NO: 4977628 - DNA, 20 bp, Homo sapiens
ctggtcttgttagaaaacaa

SEQ ID NO: 4977629 - DNA, 14 bp, Homo sapiens
ctggtgaggagcac

SEQ ID NO: 4977630 - DNA, 22 bp, Homo sapiens
ctggtgctgccacacttcaggc

SEQ ID NO: 4977631 - DNA, 12 bp, Homo sapiens
ctggtggcagct

SEQ ID NO: 4977632 - DNA, 18 bp, Homo sapiens
ctggtggcagtgggagct

SEQ ID NO: 4977633 - DNA, 17 bp, Homo sapiens
ctggtggctctttgggc

SEQ ID NO: 4977634 - DNA, 16 bp, Homo sapiens
ctggtgtgacctgagg

SEQ ID NO: 4977635 - DNA, 18 bp, Homo sapiens
ctggttcccgtttctcca

SEQ ID NO: 4977636 - DNA, 18 bp, Homo sapiens
ctggtttcactggcccaa

SEQ ID NO: 4977637 - DNA, 15 bp, Homo sapiens
ctggtttctcattct

SEQ ID NO: 4977638 - DNA, 13 bp, Homo sapiens
ctggttttaacaa

SEQ ID NO: 4977639 - DNA, 12 bp, Homo sapiens
ctgtaaatacca

SEQ ID NO: 4977640 - DNA, 23 bp, Homo sapiens
ctgtaacaggtattttgtttctt

SEQ ID NO: 4977641 - DNA, 19 bp, Homo sapiens
ctgtaacatactggcctgg

SEQ ID NO: 4977642 - DNA, 22 bp, Homo sapiens
ctgtaacatcactatccatgca

SEQ ID NO: 4977643 - DNA, 15 bp, Homo sapiens
ctgtaacttaaaata

SEQ ID NO: 4977644 - DNA, 21 bp, Homo sapiens
ctgtaagactcattccctaga

SEQ ID NO: 4977645 - DNA, 15 bp, Homo sapiens
ctgtaagccaaagaa

SEQ ID NO: 4977646 - DNA, 19 bp, Homo sapiens
ctgtaagccaaagaaatga

SEQ ID NO: 4977647 - DNA, 22 bp, Homo sapiens
ctgtaagccaaagaaatgaaca

SEQ ID NO: 4977648 - DNA, 16 bp, Homo sapiens
ctgtaagcctgcaagc

SEQ ID NO: 4977649 - DNA, 15 bp, Homo sapiens
ctgtaaggctctaga

SEQ ID NO: 4977650 - DNA, 20 bp, Homo sapiens
ctgtaaggctctagatcata

SEQ ID NO: 4977651 - DNA, 14 bp, Homo sapiens
ctgtaataatacct

SEQ ID NO: 4977652 - DNA, 16 bp, Homo sapiens
ctgtaataatacctca

SEQ ID NO: 4977653 - DNA, 17 bp, Homo sapiens
ctgtaataatacctcaa

SEQ ID NO: 4977654 - DNA, 18 bp, Homo sapiens
ctgtacacgtgtcctgta

SEQ ID NO: 4977655 - DNA, 21 bp, Homo sapiens
ctgtacactgacttgagacca

SEQ ID NO: 4977656 - DNA, 15 bp, Homo sapiens
ctgtacatatgtaaa

SEQ ID NO: 4977657 - DNA, 20 bp, Homo sapiens
ctgtacatatttgagactag

SEQ ID NO: 4977658 - DNA, 14 bp, Homo sapiens
ctgtacatctattt

SEQ ID NO: 4977659 - DNA, 14 bp, Homo sapiens
ctgtacatttaaaa

SEQ ID NO: 4977660 - DNA, 18 bp, Homo sapiens
ctgtacattttgttgtaa

SEQ ID NO: 4977661 - DNA, 21 bp, Homo sapiens
ctgtacattttgttgtaaaaa

SEQ ID NO: 4977662 - DNA, 16 bp, Homo sapiens
ctgtacgtctgacagg

SEQ ID NO: 4977663 - DNA, 15 bp, Homo sapiens
ctgtactcctcccag

SEQ ID NO: 4977664 - DNA, 16 bp, Homo sapiens
ctgtactcctcccagg

SEQ ID NO: 4977665 - DNA, 19 bp, Homo sapiens
ctgtactcctcccaggcgc

SEQ ID NO: 4977666 - DNA, 21 bp, Homo sapiens
ctgtactcctcccaggcgccc

SEQ ID NO: 4977667 - DNA, 14 bp, Homo sapiens
ctgtactgctcagg

SEQ ID NO: 4977668 - DNA, 17 bp, Homo sapiens
ctgtactgttctgtgtc

SEQ ID NO: 4977669 - DNA, 13 bp, Homo sapiens
ctgtagatgatgt

SEQ ID NO: 4977670 - DNA, 18 bp, Homo sapiens
ctgtagtagccctttctg

SEQ ID NO: 4977671 - DNA, 16 bp, Homo sapiens
ctgtagtcatttacta

SEQ ID NO: 4977672 - DNA, 22 bp, Homo sapiens
ctgtagtcctagccactcagga

SEQ ID NO: 4977673 - DNA, 19 bp, Homo sapiens
ctgtagttctaagactcaa

SEQ ID NO: 4977674 - DNA, 20 bp, Homo sapiens
ctgtagttgcgtggactctg

SEQ ID NO: 4977675 - DNA, 18 bp, Homo sapiens
ctgtataaacattaaatg

SEQ ID NO: 4977676 - DNA, 19 bp, Homo sapiens
ctgtataaacattaaatgt

SEQ ID NO: 4977677 - DNA, 16 bp, Homo sapiens
ctgtataaataggaga

SEQ ID NO: 4977678 - DNA, 15 bp, Homo sapiens
ctgtataagcactga

SEQ ID NO: 4977679 - DNA, 19 bp, Homo sapiens
ctgtataagcactgaaaaa

SEQ ID NO: 4977680 - DNA, 17 bp, Homo sapiens
ctgtatagacagtttgt

SEQ ID NO: 4977681 - DNA, 18 bp, Homo sapiens
ctgtatagacagtttgta

SEQ ID NO: 4977682 - DNA, 22 bp, Homo sapiens
ctgtatagacagtttgtaaatg

SEQ ID NO: 4977683 - DNA, 23 bp, Homo sapiens
ctgtatagacagtttgtaaatgt

SEQ ID NO: 4977684 - DNA, 15 bp, Homo sapiens
ctgtatatacttttt

SEQ ID NO: 4977685 - DNA, 15 bp, Homo sapiens
ctgtatcccatgagc

SEQ ID NO: 4977686 - DNA, 18 bp, Homo sapiens
ctgtatcccatgagcctc

SEQ ID NO: 4977687 - DNA, 20 bp, Homo sapiens
ctgtatcccatgagcctcag

SEQ ID NO: 4977688 - DNA, 22 bp, Homo sapiens
ctgtatcccatgagcctcagca

SEQ ID NO: 4977689 - DNA, 23 bp, Homo sapiens
ctgtatcccatgagcctcagcat

SEQ ID NO: 4977690 - DNA, 19 bp, Homo sapiens
ctgtatgaaagattgtggg

SEQ ID NO: 4977691 - DNA, 18 bp, Homo sapiens
ctgtatgttgtccaattg

SEQ ID NO: 4977692 - DNA, 21 bp, Homo sapiens
ctgtattgtgctgattgtgga

SEQ ID NO: 4977693 - DNA, 23 bp, Homo sapiens
ctgtatttatgtgtgaggagctg

SEQ ID NO: 4977694 - DNA, 14 bp, Homo sapiens
ctgtatttcatgtg

SEQ ID NO: 4977695 - DNA, 17 bp, Homo sapiens
ctgtatttcatgtggct

SEQ ID NO: 4977696 - DNA, 19 bp, Homo sapiens
ctgtatttcatgtggctgt

SEQ ID NO: 4977697 - DNA, 14 bp, Homo sapiens
ctgtatttgtatct

SEQ ID NO: 4977698 - DNA, 23 bp, Homo sapiens
ctgtatttgtatctctgaagcat

SEQ ID NO: 4977699 - DNA, 18 bp, Homo sapiens
ctgtcaaaacactgtgga

SEQ ID NO: 4977700 - DNA, 21 bp, Homo sapiens
ctgtcaagtgggatctgtcac

SEQ ID NO: 4977701 - DNA, 13 bp, Homo sapiens
ctgtcacaccagc

SEQ ID NO: 4977702 - DNA, 14 bp, Homo sapiens
ctgtcacattgcat

SEQ ID NO: 4977703 - DNA, 15 bp, Homo sapiens
ctgtcacattgcatt

SEQ ID NO: 4977704 - DNA, 19 bp, Homo sapiens
ctgtcacattgcattctat

SEQ ID NO: 4977705 - DNA, 23 bp, Homo sapiens
ctgtcactcattgctgagcctct

SEQ ID NO: 4977706 - DNA, 16 bp, Homo sapiens
ctgtcagatgagaaca

SEQ ID NO: 4977707 - DNA, 21 bp, Homo sapiens
ctgtcagatgagaacaaagct

SEQ ID NO: 4977708 - DNA, 22 bp, Homo sapiens
ctgtcagatgagaacaaagctg

SEQ ID NO: 4977709 - DNA, 23 bp, Homo sapiens
ctgtcagatgagaacaaagctgt

SEQ ID NO: 4977710 - DNA, 14 bp, Homo sapiens
ctgtcatagaaatt

SEQ ID NO: 4977711 - DNA, 18 bp, Homo sapiens
ctgtcatgaaatcagcaa

SEQ ID NO: 4977712 - DNA, 20 bp, Homo sapiens
ctgtcatgaaatcagcaaga

SEQ ID NO: 4977713 - DNA, 14 bp, Homo sapiens
ctgtcatttgagca

SEQ ID NO: 4977714 - DNA, 22 bp, Homo sapiens
ctgtcatttgagcagggctcag

SEQ ID NO: 4977715 - DNA, 18 bp, Homo sapiens
ctgtccaaaggaggctgg

SEQ ID NO: 4977716 - DNA, 20 bp, Homo sapiens
ctgtccaaaggaggctggca

SEQ ID NO: 4977717 - DNA, 21 bp, Homo sapiens
ctgtccaaaggaggctggcag

SEQ ID NO: 4977718 - DNA, 16 bp, Homo sapiens
ctgtccaccagcccat

SEQ ID NO: 4977719 - DNA, 15 bp, Homo sapiens
ctgtccagcctgggc

SEQ ID NO: 4977720 - DNA, 17 bp, Homo sapiens
ctgtccagcctgggcag

SEQ ID NO: 4977721 - DNA, 18 bp, Homo sapiens
ctgtccaggcactgctgc

SEQ ID NO: 4977722 - DNA, 23 bp, Homo sapiens
ctgtccaggcactgctgcccagc

SEQ ID NO: 4977723 - DNA, 16 bp, Homo sapiens
ctgtccatgcttctca

SEQ ID NO: 4977724 - DNA, 15 bp, Homo sapiens
ctgtcccatgcaggc

SEQ ID NO: 4977725 - DNA, 18 bp, Homo sapiens
ctgtcccatggacactcc

SEQ ID NO: 4977726 - DNA, 22 bp, Homo sapiens
ctgtcccctggggtctctgctg

SEQ ID NO: 4977727 - DNA, 16 bp, Homo sapiens
ctgtccctcccacctc

SEQ ID NO: 4977728 - DNA, 18 bp, Homo sapiens
ctgtccctcccacctctg

SEQ ID NO: 4977729 - DNA, 11 bp, Homo sapiens
ctggccaggca

SEQ ID NO: 4977730 - DNA, 13 bp, Homo sapiens
ctggccaggcaga

SEQ ID NO: 4977731 - DNA, 21 bp, Homo sapiens
ctggccaggcagatctgtgcc

SEQ ID NO: 4977732 - DNA, 17 bp, Homo sapiens
ctggccagttggaacca

SEQ ID NO: 4977733 - DNA, 20 bp, Homo sapiens
ctggcccagccaaaccctgt

SEQ ID NO: 4977734 - DNA, 23 bp, Homo sapiens
ctggcccagccaaaccctgtctg

SEQ ID NO: 4977735 - DNA, 16 bp, Homo sapiens
ctggcccatagaaaca

SEQ ID NO: 4977736 - DNA, 17 bp, Homo sapiens
ctggcccatagaaacat

SEQ ID NO: 4977737 - DNA, 21 bp, Homo sapiens
ctggcccatagaaacatgaca

SEQ ID NO: 4977738 - DNA, 15 bp, Homo sapiens
ctggccccagggcac

SEQ ID NO: 4977739 - DNA, 19 bp, Homo sapiens
ctggccctcgacactcacc

SEQ ID NO: 4977740 - DNA, 16 bp, Homo sapiens
ctggccctgccctgag

SEQ ID NO: 4977741 - DNA, 17 bp, Homo sapiens
ctggccgagggtcctgg

SEQ ID NO: 4977742 - DNA, 16 bp, Homo sapiens
ctggcctaaaatcttg

SEQ ID NO: 4977743 - DNA, 22 bp, Homo sapiens
ctggcctcaagtgattctcctg

SEQ ID NO: 4977744 - DNA, 17 bp, Homo sapiens
ctggcctctctagcaca

SEQ ID NO: 4977745 - DNA, 18 bp, Homo sapiens
ctggcctctctagcacaa

SEQ ID NO: 4977746 - DNA, 12 bp, Homo sapiens
ctggcctgactt

SEQ ID NO: 4977747 - DNA, 19 bp, Homo sapiens
ctggcctgagaggggaagc

SEQ ID NO: 4977748 - DNA, 14 bp, Homo sapiens
ctggcctggactgt

SEQ ID NO: 4977749 - DNA, 22 bp, Homo sapiens
ctggcctggactgttttctctc

SEQ ID NO: 4977750 - DNA, 16 bp, Homo sapiens
ctggcctggcacacat

SEQ ID NO: 4977751 - DNA, 22 bp, Homo sapiens
ctggcctggcacacatcaggag

SEQ ID NO: 4977752 - DNA, 14 bp, Homo sapiens
ctggcctggccctg

SEQ ID NO: 4977753 - DNA, 16 bp, Homo sapiens
ctggcctggccctgcc

SEQ ID NO: 4977754 - DNA, 19 bp, Homo sapiens
ctggccttgaaaccacctt

SEQ ID NO: 4977755 - DNA, 15 bp, Homo sapiens
ctggcctttcctctc

SEQ ID NO: 4977756 - DNA, 16 bp, Homo sapiens
ctggctagagtcctca

SEQ ID NO: 4977757 - DNA, 17 bp, Homo sapiens
ctggctagagtcctcac

SEQ ID NO: 4977758 - DNA, 19 bp, Homo sapiens
ctggctagagtcctcactc

SEQ ID NO: 4977759 - DNA, 21 bp, Homo sapiens
ctggctagagtcctcactccc

SEQ ID NO: 4977760 - DNA, 19 bp, Homo sapiens
ctggctcacagtacagcat

SEQ ID NO: 4977761 - DNA, 22 bp, Homo sapiens
ctggctcacagtacagcatgtg

SEQ ID NO: 4977762 - DNA, 15 bp, Homo sapiens
ctggctcccacaggc

SEQ ID NO: 4977763 - DNA, 18 bp, Homo sapiens
ctggctcccacaggccct

SEQ ID NO: 4977764 - DNA, 20 bp, Homo sapiens
ctggctccgtccaggagcct

SEQ ID NO: 4977765 - DNA, 15 bp, Homo sapiens
ctggctcctttacaa

SEQ ID NO: 4977766 - DNA, 17 bp, Homo sapiens
ctggctcctttacaaaa

SEQ ID NO: 4977767 - DNA, 14 bp, Homo sapiens
ctggctctgctgtc

SEQ ID NO: 4977768 - DNA, 15 bp, Homo sapiens
ctggctctgtggctt

SEQ ID NO: 4977769 - DNA, 16 bp, Homo sapiens
ctggctcttctgccca

SEQ ID NO: 4977770 - DNA, 20 bp, Homo sapiens
ctggctcttgtgctggatgg

SEQ ID NO: 4977771 - DNA, 23 bp, Homo sapiens
ctggctctttcgtcacccttgga

SEQ ID NO: 4977772 - DNA, 17 bp, Homo sapiens
ctggctgtaaggctcta

SEQ ID NO: 4977773 - DNA, 21 bp, Homo sapiens
ctggctgtactgctcaggctg

SEQ ID NO: 4977774 - DNA, 19 bp, Homo sapiens
ctggctgttggctgggggc

SEQ ID NO: 4977775 - DNA, 22 bp, Homo sapiens
ctggcttttcactgctggctgc

SEQ ID NO: 4977776 - DNA, 21 bp, Homo sapiens
ctgggaaatgagaaggcagcc

SEQ ID NO: 4977777 - DNA, 22 bp, Homo sapiens
ctgggaaatgagaaggcagcca

SEQ ID NO: 4977778 - DNA, 23 bp, Homo sapiens
ctgggaacctcccagaggtccag

SEQ ID NO: 4977779 - DNA, 19 bp, Homo sapiens
ctgggaagctgagggcaaa

SEQ ID NO: 4977780 - DNA, 13 bp, Homo sapiens
ctgggaaggcctc

SEQ ID NO: 4977781 - DNA, 13 bp, Homo sapiens
ctgggacacagtt

SEQ ID NO: 4977782 - DNA, 15 bp, Homo sapiens
ctgggactacaggca

SEQ ID NO: 4977783 - DNA, 17 bp, Homo sapiens
ctgggactacaggcacc

SEQ ID NO: 4977784 - DNA, 21 bp, Homo sapiens
ctgggactacaggcacccacc

SEQ ID NO: 4977785 - DNA, 14 bp, Homo sapiens
ctgggagctctgca

SEQ ID NO: 4977786 - DNA, 19 bp, Homo sapiens
ctgggaggcatggccctgg

SEQ ID NO: 4977787 - DNA, 22 bp, Homo sapiens
ctgggaggcatggccctggggt

SEQ ID NO: 4977788 - DNA, 21 bp, Homo sapiens
ctgggagtagttgtctttcct

SEQ ID NO: 4977789 - DNA, 19 bp, Homo sapiens
ctgggagtgggtggaggca

SEQ ID NO: 4977790 - DNA, 22 bp, Homo sapiens
ctgggatgagccgctgtgagcc

SEQ ID NO: 4977791 - DNA, 17 bp, Homo sapiens
ctgggattacaggtgtg

SEQ ID NO: 4977792 - DNA, 17 bp, Homo sapiens
ctgggcaaggaaaaaga

SEQ ID NO: 4977793 - DNA, 18 bp, Homo sapiens
ctgggcaaggaaaaagaa

SEQ ID NO: 4977794 - DNA, 13 bp, Homo sapiens
ctgggcagacctt

SEQ ID NO: 4977795 - DNA, 16 bp, Homo sapiens
ctgggcagccaggctg

SEQ ID NO: 4977796 - DNA, 18 bp, Homo sapiens
ctgggcagccaggctgcc

SEQ ID NO: 4977797 - DNA, 13 bp, Homo sapiens
ctgggccagggtc

SEQ ID NO: 4977798 - DNA, 17 bp, Homo sapiens
ctgggccagggtctgtg

SEQ ID NO: 4977799 - DNA, 22 bp, Homo sapiens
ctgggccagggtctgtgtgaat

SEQ ID NO: 4977800 - DNA, 23 bp, Homo sapiens
ctgggccatgtccaaagaggctg

SEQ ID NO: 4977801 - DNA, 12 bp, Homo sapiens
ctgggcctgggc

SEQ ID NO: 4977802 - DNA, 16 bp, Homo sapiens
ctgggcctgggctagg

SEQ ID NO: 4977803 - DNA, 20 bp, Homo sapiens
ctgggctaggggacatcaga

SEQ ID NO: 4977804 - DNA, 20 bp, Homo sapiens
ctgggctaggtagaaaaagg

SEQ ID NO: 4977805 - DNA, 15 bp, Homo sapiens
ctgggctatggacac

SEQ ID NO: 4977806 - DNA, 18 bp, Homo sapiens
ctgggctatggacacagg

SEQ ID NO: 4977807 - DNA, 13 bp, Homo sapiens
ctgggctcggagg

SEQ ID NO: 4977808 - DNA, 18 bp, Homo sapiens
ctgggctcggaggctgcc

SEQ ID NO: 4977809 - DNA, 20 bp, Homo sapiens
ctgggcttcagtggcagctg

SEQ ID NO: 4977810 - DNA, 18 bp, Homo sapiens
ctggggaaagacactgcc

SEQ ID NO: 4977811 - DNA, 20 bp, Homo sapiens
ctggggaaagacactgcctg

SEQ ID NO: 4977812 - DNA, 22 bp, Homo sapiens
ctggggaaagacactgcctggg

SEQ ID NO: 4977813 - DNA, 14 bp, Homo sapiens
ctggggaacatttc

SEQ ID NO: 4977814 - DNA, 12 bp, Homo sapiens
ctggggagcccg

SEQ ID NO: 4977815 - DNA, 12 bp, Homo sapiens
ctggggaggagc

SEQ ID NO: 4977816 - DNA, 17 bp, Homo sapiens
ctggggatgtgggaggg

SEQ ID NO: 4977817 - DNA, 21 bp, Homo sapiens
ctggggcacagtccaggaaca

SEQ ID NO: 4977818 - DNA, 14 bp, Homo sapiens
ctggggcaggctgc

SEQ ID NO: 4977819 - DNA, 16 bp, Homo sapiens
ctggggcaggctgggc

SEQ ID NO: 4977820 - DNA, 21 bp, Homo sapiens
ctggggcaggctgggccatgt

SEQ ID NO: 4977821 - DNA, 17 bp, Homo sapiens
ctggggcctggacctgc

SEQ ID NO: 4977822 - DNA, 19 bp, Homo sapiens
ctggggctgttgaagtcac

SEQ ID NO: 4977823 - DNA, 21 bp, Homo sapiens
ctgggggaatgagcccagaga

SEQ ID NO: 4977824 - DNA, 20 bp, Homo sapiens
ctgggggacccaatgtagga

SEQ ID NO: 4977825 - DNA, 23 bp, Homo sapiens
ctgggggttctttcttcctctgc

SEQ ID NO: 4977826 - DNA, 19 bp, Homo sapiens
ctggggtcaccctctccag

SEQ ID NO: 4977827 - DNA, 21 bp, Homo sapiens
ctggggtgggaggtcttgcta

SEQ ID NO: 4977828 - DNA, 16 bp, Homo sapiens
ctgggtaaatgcaaag

SEQ ID NO: 4977829 - DNA, 17 bp, Homo sapiens
ctgggtactgaaagcct

SEQ ID NO: 4977830 - DNA, 18 bp, Homo sapiens
ctgggtactgaaagcctt

SEQ ID NO: 4977831 - DNA, 16 bp, Homo sapiens
ctgggtacttgtggac

SEQ ID NO: 4977832 - DNA, 15 bp, Homo sapiens
ctgggtattggaaat

SEQ ID NO: 4977833 - DNA, 13 bp, Homo sapiens
ctgggtcagtctg

SEQ ID NO: 4977834 - DNA, 18 bp, Homo sapiens
ctgggtcagtctggtggg

SEQ ID NO: 4977835 - DNA, 21 bp, Homo sapiens
ctgggtcagtctggtgggagg

SEQ ID NO: 4977836 - DNA, 19 bp, Homo sapiens
ctggtaaactatttgtctt

SEQ ID NO: 4977837 - DNA, 19 bp, Homo sapiens
ctggtactccctctcagga

SEQ ID NO: 4977838 - DNA, 16 bp, Homo sapiens
ctggtatggctgcagt

SEQ ID NO: 4977839 - DNA, 11 bp, Homo sapiens
ctgcactgaaa

SEQ ID NO: 4977840 - DNA, 18 bp, Homo sapiens
ctgcactgaaaaggttct

SEQ ID NO: 4977841 - DNA, 22 bp, Homo sapiens
ctgcactggggagcccgtctca

SEQ ID NO: 4977842 - DNA, 14 bp, Homo sapiens
ctgcacttcctgtt

SEQ ID NO: 4977843 - DNA, 14 bp, Homo sapiens
ctgcacttgcagac

SEQ ID NO: 4977844 - DNA, 18 bp, Homo sapiens
ctgcacttgcagactcta

SEQ ID NO: 4977845 - DNA, 23 bp, Homo sapiens
ctgcacttgcagactctacagag

SEQ ID NO: 4977846 - DNA, 20 bp, Homo sapiens
ctgcactttgatgtcatgtg

SEQ ID NO: 4977847 - DNA, 22 bp, Homo sapiens
ctgcactttgatgtcatgtgtt

SEQ ID NO: 4977848 - DNA, 20 bp, Homo sapiens
ctgcagagcaggaaacatga

SEQ ID NO: 4977849 - DNA, 20 bp, Homo sapiens
ctgcagcacggacaataaac

SEQ ID NO: 4977850 - DNA, 20 bp, Homo sapiens
ctgcagcatggtccctgcct

SEQ ID NO: 4977851 - DNA, 22 bp, Homo sapiens
ctgcagccagctcacgtccagg

SEQ ID NO: 4977852 - DNA, 23 bp, Homo sapiens
ctgcagcctcaacctcctgggct

SEQ ID NO: 4977853 - DNA, 12 bp, Homo sapiens
ctgcagctgccg

SEQ ID NO: 4977854 - DNA, 22 bp, Homo sapiens
ctgcagctgccgggcctgattt

SEQ ID NO: 4977855 - DNA, 12 bp, Homo sapiens
ctgcagcttcct

SEQ ID NO: 4977856 - DNA, 13 bp, Homo sapiens
ctgcagcttggga

SEQ ID NO: 4977857 - DNA, 22 bp, Homo sapiens
ctgcagcttgggagagcccctg

SEQ ID NO: 4977858 - DNA, 12 bp, Homo sapiens
ctgcagctttac

SEQ ID NO: 4977859 - DNA, 23 bp, Homo sapiens
ctgcaggacttgagaagacctca

SEQ ID NO: 4977860 - DNA, 14 bp, Homo sapiens
ctgcagggccagga

SEQ ID NO: 4977861 - DNA, 19 bp, Homo sapiens
ctgcaggggctctggagag

SEQ ID NO: 4977862 - DNA, 21 bp, Homo sapiens
ctgcaggggctctggagagaa

SEQ ID NO: 4977863 - DNA, 19 bp, Homo sapiens
ctgcaggttggaccccaga

SEQ ID NO: 4977864 - DNA, 21 bp, Homo sapiens
ctgcagtcagtcatgatggca

SEQ ID NO: 4977865 - DNA, 19 bp, Homo sapiens
ctgcagtcctccggttgca

SEQ ID NO: 4977866 - DNA, 19 bp, Homo sapiens
ctgcagtgttcgcttggct

SEQ ID NO: 4977867 - DNA, 14 bp, Homo sapiens
ctgcagtttttcag

SEQ ID NO: 4977868 - DNA, 18 bp, Homo sapiens
ctgcagtttttcaggagc

SEQ ID NO: 4977869 - DNA, 12 bp, Homo sapiens
ctgcatcccctt

SEQ ID NO: 4977870 - DNA, 16 bp, Homo sapiens
ctgcatccccttggct

SEQ ID NO: 4977871 - DNA, 22 bp, Homo sapiens
ctgcatgtggcttttttaaaaa

SEQ ID NO: 4977872 - DNA, 13 bp, Homo sapiens
ctgcattagaaaa

SEQ ID NO: 4977873 - DNA, 15 bp, Homo sapiens
ctgcattagaaaaag

SEQ ID NO: 4977874 - DNA, 18 bp, Homo sapiens
ctgcattattctctttta

SEQ ID NO: 4977875 - DNA, 21 bp, Homo sapiens
ctgcattgctagataaaagct

SEQ ID NO: 4977876 - DNA, 14 bp, Homo sapiens
ctgcatttgtgaaa

SEQ ID NO: 4977877 - DNA, 15 bp, Homo sapiens
ctgcatttgtgaaat

SEQ ID NO: 4977878 - DNA, 22 bp, Homo sapiens
ctgcatttgtgaaatgatggtg

SEQ ID NO: 4977879 - DNA, 17 bp, Homo sapiens
ctgcattttcaccccac

SEQ ID NO: 4977880 - DNA, 15 bp, Homo sapiens
ctgccaaggccagag

SEQ ID NO: 4977881 - DNA, 18 bp, Homo sapiens
ctgccaaggccagagtgg

SEQ ID NO: 4977882 - DNA, 21 bp, Homo sapiens
ctgccaaggccagagtggcct

SEQ ID NO: 4977883 - DNA, 23 bp, Homo sapiens
ctgccaaggccagagtggcctgg

SEQ ID NO: 4977884 - DNA, 21 bp, Homo sapiens
ctgccacaccagtcacatgac

SEQ ID NO: 4977885 - DNA, 18 bp, Homo sapiens
ctgccacactctgacgca

SEQ ID NO: 4977886 - DNA, 14 bp, Homo sapiens
ctgccaccagagac

SEQ ID NO: 4977887 - DNA, 21 bp, Homo sapiens
ctgccagaagatcccctcagg

SEQ ID NO: 4977888 - DNA, 23 bp, Homo sapiens
ctgccagaagatcccctcaggac

SEQ ID NO: 4977889 - DNA, 13 bp, Homo sapiens
ctgccagccccac

SEQ ID NO: 4977890 - DNA, 15 bp, Homo sapiens
ctgccagccccacac

SEQ ID NO: 4977891 - DNA, 18 bp, Homo sapiens
ctgccagccccacacagc

SEQ ID NO: 4977892 - DNA, 19 bp, Homo sapiens
ctgccagccccacacagct

SEQ ID NO: 4977893 - DNA, 12 bp, Homo sapiens
ctgccagggagc

SEQ ID NO: 4977894 - DNA, 17 bp, Homo sapiens
ctgccagggcagtgcta

SEQ ID NO: 4977895 - DNA, 15 bp, Homo sapiens
ctgccagtgtggaac

SEQ ID NO: 4977896 - DNA, 12 bp, Homo sapiens
ctgccatccagg

SEQ ID NO: 4977897 - DNA, 23 bp, Homo sapiens
ctgccatgccaggaacctgtcct

SEQ ID NO: 4977898 - DNA, 18 bp, Homo sapiens
ctgccatgtacctcccct

SEQ ID NO: 4977899 - DNA, 22 bp, Homo sapiens
ctgccatgtacctcccctgcct

SEQ ID NO: 4977900 - DNA, 19 bp, Homo sapiens
ctgccattattttctgtca

SEQ ID NO: 4977901 - DNA, 21 bp, Homo sapiens
ctgccattattttctgtcaga

SEQ ID NO: 4977902 - DNA, 17 bp, Homo sapiens
ctgcccaaaaatatggt

SEQ ID NO: 4977903 - DNA, 14 bp, Homo sapiens
ctgcccaagcccag

SEQ ID NO: 4977904 - DNA, 16 bp, Homo sapiens
ctgcccaagcccaggc

SEQ ID NO: 4977905 - DNA, 21 bp, Homo sapiens
ctgcccacctcagcctcccaa

SEQ ID NO: 4977906 - DNA, 23 bp, Homo sapiens
ctgcccactgtttctcttgagct

SEQ ID NO: 4977907 - DNA, 19 bp, Homo sapiens
ctgcccaggcccctgccac

SEQ ID NO: 4977908 - DNA, 20 bp, Homo sapiens
ctgcccaggcccctgccacc

SEQ ID NO: 4977909 - DNA, 18 bp, Homo sapiens
ctgcccaggcctgcctgt

SEQ ID NO: 4977910 - DNA, 19 bp, Homo sapiens
ctgcccaggcctgcctgtt

SEQ ID NO: 4977911 - DNA, 18 bp, Homo sapiens
ctgcccatcacagggttg

SEQ ID NO: 4977912 - DNA, 21 bp, Homo sapiens
ctgcccattcaccaaaattat

SEQ ID NO: 4977913 - DNA, 15 bp, Homo sapiens
ctgccccaaacaaat

SEQ ID NO: 4977914 - DNA, 17 bp, Homo sapiens
ctgccccaacctgctga

SEQ ID NO: 4977915 - DNA, 12 bp, Homo sapiens
ctgcccccacga

SEQ ID NO: 4977916 - DNA, 14 bp, Homo sapiens
ctgcccccagccca

SEQ ID NO: 4977917 - DNA, 16 bp, Homo sapiens
ctgcccccagcccaaa

SEQ ID NO: 4977918 - DNA, 18 bp, Homo sapiens
ctgcccccagcccaaagg

SEQ ID NO: 4977919 - DNA, 15 bp, Homo sapiens
ctgccccctgctggc

SEQ ID NO: 4977920 - DNA, 14 bp, Homo sapiens
ctgcccctccccca

SEQ ID NO: 4977921 - DNA, 17 bp, Homo sapiens
ctgcccctctcaccaaa

SEQ ID NO: 4977922 - DNA, 16 bp, Homo sapiens
ctgcccgcacaccctc

SEQ ID NO: 4977923 - DNA, 16 bp, Homo sapiens
ctgcccgcacagcagc

SEQ ID NO: 4977924 - DNA, 20 bp, Homo sapiens
ctgcccgcacagcagcctgc

SEQ ID NO: 4977925 - DNA, 21 bp, Homo sapiens
ctgcccgggcgcggccagccc

SEQ ID NO: 4977926 - DNA, 12 bp, Homo sapiens
ctgccctcatgg

SEQ ID NO: 4977927 - DNA, 16 bp, Homo sapiens
ctgccctccctggagc

SEQ ID NO: 4977928 - DNA, 19 bp, Homo sapiens
ctgccctgagaagctgctc

SEQ ID NO: 4977929 - DNA, 22 bp, Homo sapiens
ctgccctgctgccgcctcccag

SEQ ID NO: 4977930 - DNA, 23 bp, Homo sapiens
ctgccctggaacatcctttgcag

SEQ ID NO: 4977931 - DNA, 12 bp, Homo sapiens
ctgccctggtgc

SEQ ID NO: 4977932 - DNA, 16 bp, Homo sapiens
ctgccctggtgctgcc

SEQ ID NO: 4977933 - DNA, 13 bp, Homo sapiens
ctgcccttgggcc

SEQ ID NO: 4977934 - DNA, 14 bp, Homo sapiens
ctgccgcctcccag

SEQ ID NO: 4977935 - DNA, 20 bp, Homo sapiens
ctgccggtttgaaaatatgc

SEQ ID NO: 4977936 - DNA, 17 bp, Homo sapiens
ctgcctagcaagctggc

SEQ ID NO: 4977937 - DNA, 20 bp, Homo sapiens
ctgcctagcaagctggcctc

SEQ ID NO: 4977938 - DNA, 15 bp, Homo sapiens
ctgcctcaccgcttc

SEQ ID NO: 4977939 - DNA, 14 bp, Homo sapiens
ctgcctcacttcct

SEQ ID NO: 4977940 - DNA, 11 bp, Homo sapiens
ctgcctcctcg

SEQ ID NO: 4977941 - DNA, 13 bp, Homo sapiens
ctgcctcctgcct

SEQ ID NO: 4977942 - DNA, 19 bp, Homo sapiens
ctgcctcgaaacacagaaa

SEQ ID NO: 4977943 - DNA, 21 bp, Homo sapiens
ctgcctctcacacacatagat

SEQ ID NO: 4977944 - DNA, 14 bp, Homo sapiens
ctgcctctctagga

SEQ ID NO: 4977945 - DNA, 15 bp, Homo sapiens
ctgcctctgacacac

SEQ ID NO: 4977946 - DNA, 23 bp, Homo sapiens
ctgcctctgacacacagctctgt

SEQ ID NO: 4977947 - DNA, 12 bp, Homo sapiens
ctgcctctgcca

SEQ ID NO: 4977948 - DNA, 14 bp, Homo sapiens
ctgcctctgccaca

SEQ ID NO: 4977949 - DNA, 14 bp, Homo sapiens
ctctgcatcccagc

SEQ ID NO: 4977950 - DNA, 20 bp, Homo sapiens
ctctgcatcccagcacctgc

SEQ ID NO: 4977951 - DNA, 23 bp, Homo sapiens
ctctgcatcccagcacctgcctc

SEQ ID NO: 4977952 - DNA, 17 bp, Homo sapiens
ctctgccacactctgac

SEQ ID NO: 4977953 - DNA, 14 bp, Homo sapiens
ctctgccaccagag

SEQ ID NO: 4977954 - DNA, 17 bp, Homo sapiens
ctctgccagaagatccc

SEQ ID NO: 4977955 - DNA, 23 bp, Homo sapiens
ctctgccagaagatcccctcagg

SEQ ID NO: 4977956 - DNA, 18 bp, Homo sapiens
ctctgccagggcagtgct

SEQ ID NO: 4977957 - DNA, 17 bp, Homo sapiens
ctctgccccctgctggc

SEQ ID NO: 4977958 - DNA, 15 bp, Homo sapiens
ctctgcctcctcttc

SEQ ID NO: 4977959 - DNA, 16 bp, Homo sapiens
ctctgcctcctcttca

SEQ ID NO: 4977960 - DNA, 20 bp, Homo sapiens
ctctgcctctgacacacagc

SEQ ID NO: 4977961 - DNA, 21 bp, Homo sapiens
ctctgcctgaagtcacacagt

SEQ ID NO: 4977962 - DNA, 19 bp, Homo sapiens
ctctgcctttgacatttaa

SEQ ID NO: 4977963 - DNA, 14 bp, Homo sapiens
ctctgcggacccca

SEQ ID NO: 4977964 - DNA, 20 bp, Homo sapiens
ctctgcggaccccagctgtg

SEQ ID NO: 4977965 - DNA, 13 bp, Homo sapiens
ctctgctcagcca

SEQ ID NO: 4977966 - DNA, 16 bp, Homo sapiens
ctctgctcagccaagc

SEQ ID NO: 4977967 - DNA, 12 bp, Homo sapiens
ctctgctccacc

SEQ ID NO: 4977968 - DNA, 15 bp, Homo sapiens
ctctgctccaccaca

SEQ ID NO: 4977969 - DNA, 16 bp, Homo sapiens
ctctgctccaccacat

SEQ ID NO: 4977970 - DNA, 13 bp, Homo sapiens
ctctgctccccag

SEQ ID NO: 4977971 - DNA, 21 bp, Homo sapiens
ctctgctcctctccccagcaa

SEQ ID NO: 4977972 - DNA, 13 bp, Homo sapiens
ctctgctgacaga

SEQ ID NO: 4977973 - DNA, 14 bp, Homo sapiens
ctctgctgacagac

SEQ ID NO: 4977974 - DNA, 19 bp, Homo sapiens
ctctgctgacagacacagg

SEQ ID NO: 4977975 - DNA, 20 bp, Homo sapiens
ctctgctgacagacacaggc

SEQ ID NO: 4977976 - DNA, 11 bp, Homo sapiens
ctctgctgctt

SEQ ID NO: 4977977 - DNA, 14 bp, Homo sapiens
ctctgctggcccag

SEQ ID NO: 4977978 - DNA, 18 bp, Homo sapiens
ctctgcttgcctggagac

SEQ ID NO: 4977979 - DNA, 17 bp, Homo sapiens
ctctggagacagcccca

SEQ ID NO: 4977980 - DNA, 19 bp, Homo sapiens
ctctggagacagccccaga

SEQ ID NO: 4977981 - DNA, 20 bp, Homo sapiens
ctctggagacagccccagag

SEQ ID NO: 4977982 - DNA, 12 bp, Homo sapiens
ctctggagagaa

SEQ ID NO: 4977983 - DNA, 13 bp, Homo sapiens
ctctggagagaaa

SEQ ID NO: 4977984 - DNA, 19 bp, Homo sapiens
ctctggaggggtgtggctc

SEQ ID NO: 4977985 - DNA, 19 bp, Homo sapiens
ctctggcagttctggaatg

SEQ ID NO: 4977986 - DNA, 14 bp, Homo sapiens
ctctggccacaaca

SEQ ID NO: 4977987 - DNA, 12 bp, Homo sapiens
ctctggctctca

SEQ ID NO: 4977988 - DNA, 13 bp, Homo sapiens
ctctggctctcat

SEQ ID NO: 4977989 - DNA, 16 bp, Homo sapiens
ctctggctctcatggg

SEQ ID NO: 4977990 - DNA, 20 bp, Homo sapiens
ctctggctgtaaggctctag

SEQ ID NO: 4977991 - DNA, 23 bp, Homo sapiens
ctctgggaaatgagaaggcagcc

SEQ ID NO: 4977992 - DNA, 13 bp, Homo sapiens
ctctgggaacctc

SEQ ID NO: 4977993 - DNA, 23 bp, Homo sapiens
ctctgggaacctcccagaggtcc

SEQ ID NO: 4977994 - DNA, 20 bp, Homo sapiens
ctctgggctatggacacagg

SEQ ID NO: 4977995 - DNA, 15 bp, Homo sapiens
ctctggttatctaat

SEQ ID NO: 4977996 - DNA, 15 bp, Homo sapiens
ctctgtaacatcact

SEQ ID NO: 4977997 - DNA, 13 bp, Homo sapiens
ctctgtcctggga

SEQ ID NO: 4977998 - DNA, 22 bp, Homo sapiens
ctctgtcctgggagtgagctgg

SEQ ID NO: 4977999 - DNA, 15 bp, Homo sapiens
ctctgtctacaaata

SEQ ID NO: 4978000 - DNA, 10 bp, Homo sapiens
ctctgtctca

SEQ ID NO: 4978001 - DNA, 23 bp, Homo sapiens
ctctgtctcagacttttgtacat

SEQ ID NO: 4978002 - DNA, 18 bp, Homo sapiens
ctctgtctcatcctcctg

SEQ ID NO: 4978003 - DNA, 22 bp, Homo sapiens
ctctgtctcatcctcctggaac

SEQ ID NO: 4978004 - DNA, 14 bp, Homo sapiens
ctctgtgctgtgga

SEQ ID NO: 4978005 - DNA, 22 bp, Homo sapiens
ctctgtgtcaggtggggcagct

SEQ ID NO: 4978006 - DNA, 14 bp, Homo sapiens
ctctgtgtccttcc

SEQ ID NO: 4978007 - DNA, 18 bp, Homo sapiens
ctctgtgtctaagattct

SEQ ID NO: 4978008 - DNA, 19 bp, Homo sapiens
ctctgttatgtactgtact

SEQ ID NO: 4978009 - DNA, 16 bp, Homo sapiens
ctctgtttctccttct

SEQ ID NO: 4978010 - DNA, 22 bp, Homo sapiens
ctcttacgaatattttcagtaa

SEQ ID NO: 4978011 - DNA, 16 bp, Homo sapiens
ctcttactaatgtaaa

SEQ ID NO: 4978012 - DNA, 18 bp, Homo sapiens
ctcttactacactgagga

SEQ ID NO: 4978013 - DNA, 22 bp, Homo sapiens
ctcttactttcctttccccagc

SEQ ID NO: 4978014 - DNA, 23 bp, Homo sapiens
ctcttactttcctttccccagcc

SEQ ID NO: 4978015 - DNA, 20 bp, Homo sapiens
ctcttattgcccacgctgga

SEQ ID NO: 4978016 - DNA, 17 bp, Homo sapiens
ctcttcagactctcagc

SEQ ID NO: 4978017 - DNA, 23 bp, Homo sapiens
ctcttcagactctcagcccagaa

SEQ ID NO: 4978018 - DNA, 14 bp, Homo sapiens
ctcttcaggcctcc

SEQ ID NO: 4978019 - DNA, 18 bp, Homo sapiens
ctcttcaggcctccctct

SEQ ID NO: 4978020 - DNA, 13 bp, Homo sapiens
ctcttcatacttt

SEQ ID NO: 4978021 - DNA, 14 bp, Homo sapiens
ctcttcccttcaac

SEQ ID NO: 4978022 - DNA, 17 bp, Homo sapiens
ctcttccctttccccag

SEQ ID NO: 4978023 - DNA, 13 bp, Homo sapiens
ctcttcctgcccc

SEQ ID NO: 4978024 - DNA, 16 bp, Homo sapiens
ctcttcctgcccctct

SEQ ID NO: 4978025 - DNA, 21 bp, Homo sapiens
ctcttcctgcccctctttctc

SEQ ID NO: 4978026 - DNA, 17 bp, Homo sapiens
ctcttcctgtgatccac

SEQ ID NO: 4978027 - DNA, 16 bp, Homo sapiens
ctcttcgaagccttgc

SEQ ID NO: 4978028 - DNA, 16 bp, Homo sapiens
ctcttcggccctcaga

SEQ ID NO: 4978029 - DNA, 19 bp, Homo sapiens
ctcttctattttgtaaact

SEQ ID NO: 4978030 - DNA, 15 bp, Homo sapiens
ctcttctcccagaat

SEQ ID NO: 4978031 - DNA, 12 bp, Homo sapiens
ctcattcttctg

SEQ ID NO: 4978032 - DNA, 14 bp, Homo sapiens
ctcattcttctgta

SEQ ID NO: 4978033 - DNA, 10 bp, Homo sapiens
ctcattgaaa

SEQ ID NO: 4978034 - DNA, 13 bp, Homo sapiens
ctcattgaaatgt

SEQ ID NO: 4978035 - DNA, 15 bp, Homo sapiens
ctcattgaaatgtca

SEQ ID NO: 4978036 - DNA, 17 bp, Homo sapiens
ctcattgacaagaactg

SEQ ID NO: 4978037 - DNA, 18 bp, Homo sapiens
ctcattgctgagcctctg

SEQ ID NO: 4978038 - DNA, 19 bp, Homo sapiens
ctcattgctgagcctctgc

SEQ ID NO: 4978039 - DNA, 17 bp, Homo sapiens
ctcatttgtcacacact

SEQ ID NO: 4978040 - DNA, 18 bp, Homo sapiens
ctcatttgtcacacactt

SEQ ID NO: 4978041 - DNA, 15 bp, Homo sapiens
ctcatttgtttttct

SEQ ID NO: 4978042 - DNA, 18 bp, Homo sapiens
ctcatttttttaatttat

SEQ ID NO: 4978043 - DNA, 14 bp, Homo sapiens
ctccaaaggccccc

SEQ ID NO: 4978044 - DNA, 15 bp, Homo sapiens
ctccaagattctaga

SEQ ID NO: 4978045 - DNA, 18 bp, Homo sapiens
ctccaagattctagatga

SEQ ID NO: 4978046 - DNA, 18 bp, Homo sapiens
ctccaagctccatctcca

SEQ ID NO: 4978047 - DNA, 15 bp, Homo sapiens
ctccaagtctcagtg

SEQ ID NO: 4978048 - DNA, 19 bp, Homo sapiens
ctccaatgtctgctgagga

SEQ ID NO: 4978049 - DNA, 20 bp, Homo sapiens
ctccaatgtctgctgaggag

SEQ ID NO: 4978050 - DNA, 14 bp, Homo sapiens
ctccacagcgaggg

SEQ ID NO: 4978051 - DNA, 20 bp, Homo sapiens
ctccacagcgagggcagctg

SEQ ID NO: 4978052 - DNA, 21 bp, Homo sapiens
ctccacagcgagggcagctgc

SEQ ID NO: 4978053 - DNA, 13 bp, Homo sapiens
ctccaccacatcc

SEQ ID NO: 4978054 - DNA, 12 bp, Homo sapiens
ctccacccttgg

SEQ ID NO: 4978055 - DNA, 15 bp, Homo sapiens
ctccacctagactgt

SEQ ID NO: 4978056 - DNA, 12 bp, Homo sapiens
ctccaccttccc

SEQ ID NO: 4978057 - DNA, 14 bp, Homo sapiens
ctccaccttcccac

SEQ ID NO: 4978058 - DNA, 20 bp, Homo sapiens
ctccacgatcctgccaccct

SEQ ID NO: 4978059 - DNA, 16 bp, Homo sapiens
ctccactgcctctgga

SEQ ID NO: 4978060 - DNA, 18 bp, Homo sapiens
ctccactgtcaccctcca

SEQ ID NO: 4978061 - DNA, 22 bp, Homo sapiens
ctccactgtgcctttgcaaatc

SEQ ID NO: 4978062 - DNA, 17 bp, Homo sapiens
ctccagaatttggaaat

SEQ ID NO: 4978063 - DNA, 20 bp, Homo sapiens
ctccagacccctggcttttc

SEQ ID NO: 4978064 - DNA, 19 bp, Homo sapiens
ctccagatgtttccagact

SEQ ID NO: 4978065 - DNA, 18 bp, Homo sapiens
ctccagcaacacagcctg

SEQ ID NO: 4978066 - DNA, 16 bp, Homo sapiens
ctccagcccgggagcc

SEQ ID NO: 4978067 - DNA, 21 bp, Homo sapiens
ctccagcctttggccttggct

SEQ ID NO: 4978068 - DNA, 14 bp, Homo sapiens
ctccagctcaccag

SEQ ID NO: 4978069 - DNA, 15 bp, Homo sapiens
ctccagctcaccagc

SEQ ID NO: 4978070 - DNA, 20 bp, Homo sapiens
ctccagctcaccagccccag

SEQ ID NO: 4978071 - DNA, 24 bp, Homo sapiens
ctccagctcagaacccagggctct

SEQ ID NO: 4978072 - DNA, 11 bp, Homo sapiens
ctccaggacca

SEQ ID NO: 4978073 - DNA, 16 bp, Homo sapiens
ctccaggcaccatctc

SEQ ID NO: 4978074 - DNA, 15 bp, Homo sapiens
ctccaggcctgcagc

SEQ ID NO: 4978075 - DNA, 22 bp, Homo sapiens
ctccaggctgtatcccatgagc

SEQ ID NO: 4978076 - DNA, 20 bp, Homo sapiens
ctccagggaatccaagcctc

SEQ ID NO: 4978077 - DNA, 22 bp, Homo sapiens
ctccagggaatccaagcctcca

SEQ ID NO: 4978078 - DNA, 17 bp, Homo sapiens
ctccaggtcagctgccc

SEQ ID NO: 4978079 - DNA, 17 bp, Homo sapiens
ctccaggtctcacgggc

SEQ ID NO: 4978080 - DNA, 22 bp, Homo sapiens
ctccagtgctgtccatgcttct

SEQ ID NO: 4978081 - DNA, 21 bp, Homo sapiens
ctccagtgtacatagtgtaat

SEQ ID NO: 4978082 - DNA, 22 bp, Homo sapiens
ctccatcaccctcttcctgtga

SEQ ID NO: 4978083 - DNA, 22 bp, Homo sapiens
ctccatcccaacagccatgccc

SEQ ID NO: 4978084 - DNA, 13 bp, Homo sapiens
ctccatcctgctg

SEQ ID NO: 4978085 - DNA, 13 bp, Homo sapiens
ctccatctccact

SEQ ID NO: 4978086 - DNA, 15 bp, Homo sapiens
ctccatgctgcctcc

SEQ ID NO: 4978087 - DNA, 16 bp, Homo sapiens
ctccatgctgcctcca

SEQ ID NO: 4978088 - DNA, 17 bp, Homo sapiens
ctccattctattttaga

SEQ ID NO: 4978089 - DNA, 22 bp, Homo sapiens
ctcccaagacttcattgtccct

SEQ ID NO: 4978090 - DNA, 20 bp, Homo sapiens
ctcccaagctatctaaagtt

SEQ ID NO: 4978091 - DNA, 22 bp, Homo sapiens
ctcccaagtagctgggattaca

SEQ ID NO: 4978092 - DNA, 14 bp, Homo sapiens
ctcccacaggccct

SEQ ID NO: 4978093 - DNA, 16 bp, Homo sapiens
ctcccacaggcccttc

SEQ ID NO: 4978094 - DNA, 22 bp, Homo sapiens
ctcccacccccatctctccctc

SEQ ID NO: 4978095 - DNA, 13 bp, Homo sapiens
ctcccaccctgta

SEQ ID NO: 4978096 - DNA, 23 bp, Homo sapiens
ctcccaccctgtacctcatccca

SEQ ID NO: 4978097 - DNA, 17 bp, Homo sapiens
ctcccacctcagcctcc

SEQ ID NO: 4978098 - DNA, 13 bp, Homo sapiens
ctcccacctctgt

SEQ ID NO: 4978099 - DNA, 21 bp, Homo sapiens
ctcccacctctgtgacctcag

SEQ ID NO: 4978100 - DNA, 13 bp, Homo sapiens
ctcccagaatccc

SEQ ID NO: 4978101 - DNA, 20 bp, Homo sapiens
ctcccagaatcccagccggc

SEQ ID NO: 4978102 - DNA, 19 bp, Homo sapiens
ctcccagaggtccagccca

SEQ ID NO: 4978103 - DNA, 20 bp, Homo sapiens
ctcccagaggtccagcccat

SEQ ID NO: 4978104 - DNA, 19 bp, Homo sapiens
ctcccagcttgtaggagct

SEQ ID NO: 4978105 - DNA, 19 bp, Homo sapiens
ctcccaggagacagttcaa

SEQ ID NO: 4978106 - DNA, 20 bp, Homo sapiens
ctcccaggcgccccttcccc

SEQ ID NO: 4978107 - DNA, 20 bp, Homo sapiens
ctaaagtatgtaaagtatgt

SEQ ID NO: 4978108 - DNA, 13 bp, Homo sapiens
ctaaagttctaag

SEQ ID NO: 4978109 - DNA, 15 bp, Homo sapiens
ctaaagttctaagat

SEQ ID NO: 4978110 - DNA, 14 bp, Homo sapiens
ctaaatctatttat

SEQ ID NO: 4978111 - DNA, 21 bp, Homo sapiens
ctaaatgcctagtttttagta

SEQ ID NO: 4978112 - DNA, 15 bp, Homo sapiens
ctaaattctttattt

SEQ ID NO: 4978113 - DNA, 19 bp, Homo sapiens
ctaaattctttatttctgt

SEQ ID NO: 4978114 - DNA, 14 bp, Homo sapiens
ctaaatttaaattt

SEQ ID NO: 4978115 - DNA, 15 bp, Homo sapiens
ctaaatttaatgctg

SEQ ID NO: 4978116 - DNA, 17 bp, Homo sapiens
ctaaatttaatgctgcc

SEQ ID NO: 4978117 - DNA, 14 bp, Homo sapiens
ctaaatttgatact

SEQ ID NO: 4978118 - DNA, 18 bp, Homo sapiens
ctaaatttgatacttata

SEQ ID NO: 4978119 - DNA, 18 bp, Homo sapiens
ctaaatttggggacagat

SEQ ID NO: 4978120 - DNA, 20 bp, Homo sapiens
ctaacaaaagatgaaagcag

SEQ ID NO: 4978121 - DNA, 23 bp, Homo sapiens
ctaacacggtgctcattttttct

SEQ ID NO: 4978122 - DNA, 21 bp, Homo sapiens
ctaacatttttgataaagcct

SEQ ID NO: 4978123 - DNA, 17 bp, Homo sapiens
ctaaccccaacgcacag

SEQ ID NO: 4978124 - DNA, 19 bp, Homo sapiens
ctaaccccaacgcacagga

SEQ ID NO: 4978125 - DNA, 22 bp, Homo sapiens
ctaaccccaacgcacaggaaaa

SEQ ID NO: 4978126 - DNA, 17 bp, Homo sapiens
ctaacctgggttccctt

SEQ ID NO: 4978127 - DNA, 21 bp, Homo sapiens
ctaaccttgaatgctgccagt

SEQ ID NO: 4978128 - DNA, 22 bp, Homo sapiens
ctaactttagaagtgcatttct

SEQ ID NO: 4978129 - DNA, 23 bp, Homo sapiens
ctaactttagaagtgcatttctg

SEQ ID NO: 4978130 - DNA, 16 bp, Homo sapiens
ctaagaaacttttgta

SEQ ID NO: 4978131 - DNA, 17 bp, Homo sapiens
ctaagaaacttttgtaa

SEQ ID NO: 4978132 - DNA, 16 bp, Homo sapiens
ctaagaaatatgtgag

SEQ ID NO: 4978133 - DNA, 14 bp, Homo sapiens
ctaagaagcttcta

SEQ ID NO: 4978134 - DNA, 21 bp, Homo sapiens
ctaagaagcttctaataaatt

SEQ ID NO: 4978135 - DNA, 22 bp, Homo sapiens
ctaagaagcttctaataaatta

SEQ ID NO: 4978136 - DNA, 15 bp, Homo sapiens
ctaagacacaaatgc

SEQ ID NO: 4978137 - DNA, 16 bp, Homo sapiens
ctaagactcaaatgtt

SEQ ID NO: 4978138 - DNA, 19 bp, Homo sapiens
ctaagactcaaatgttcta

SEQ ID NO: 4978139 - DNA, 17 bp, Homo sapiens
ctaagacttactctaag

SEQ ID NO: 4978140 - DNA, 12 bp, Homo sapiens
ctaagaggctgc

SEQ ID NO: 4978141 - DNA, 12 bp, Homo sapiens
ctaagatcttag

SEQ ID NO: 4978142 - DNA, 16 bp, Homo sapiens
ctaagatcttagattc

SEQ ID NO: 4978143 - DNA, 17 bp, Homo sapiens
ctaagatcttagattct

SEQ ID NO: 4978144 - DNA, 19 bp, Homo sapiens
ctaagatgtgatattctaa

SEQ ID NO: 4978145 - DNA, 22 bp, Homo sapiens
ctaagatgtgatattctaagac

SEQ ID NO: 4978146 - DNA, 12 bp, Homo sapiens
ctaagattctaa

SEQ ID NO: 4978147 - DNA, 18 bp, Homo sapiens
ctaagattctaaaggtcc

SEQ ID NO: 4978148 - DNA, 13 bp, Homo sapiens
ctaagattctaat

SEQ ID NO: 4978149 - DNA, 18 bp, Homo sapiens
ctaagattctagatcaga

SEQ ID NO: 4978150 - DNA, 14 bp, Homo sapiens
ctaagcatctaagt

SEQ ID NO: 4978151 - DNA, 16 bp, Homo sapiens
ctaagcattgcctggc

SEQ ID NO: 4978152 - DNA, 16 bp, Homo sapiens
ctaagcctacctgctc

SEQ ID NO: 4978153 - DNA, 20 bp, Homo sapiens
ctaagcctacctgctctcca

SEQ ID NO: 4978154 - DNA, 23 bp, Homo sapiens
ctaagcctacctgctctccaagt

SEQ ID NO: 4978155 - DNA, 17 bp, Homo sapiens
ctaagctgcagcttcct

SEQ ID NO: 4978156 - DNA, 22 bp, Homo sapiens
ctaaggacctgaaattccaaag

SEQ ID NO: 4978157 - DNA, 20 bp, Homo sapiens
ctaaggatgtcacagggcca

SEQ ID NO: 4978158 - DNA, 22 bp, Homo sapiens
ctaaggcctaggattctaaaat

SEQ ID NO: 4978159 - DNA, 18 bp, Homo sapiens
ctaaggctctatgagtct

SEQ ID NO: 4978160 - DNA, 21 bp, Homo sapiens
ctaaggctctatgagtctaga

SEQ ID NO: 4978161 - DNA, 13 bp, Homo sapiens
ctaaggctctgag

SEQ ID NO: 4978162 - DNA, 15 bp, Homo sapiens
ctaaggctctgagag

SEQ ID NO: 4978163 - DNA, 22 bp, Homo sapiens
ctaaggctctgagagtctagat

SEQ ID NO: 4978164 - DNA, 23 bp, Homo sapiens
ctaaggctctgagagtctagatt

SEQ ID NO: 4978165 - DNA, 18 bp, Homo sapiens
ctaagggaagacatttct

SEQ ID NO: 4978166 - DNA, 18 bp, Homo sapiens
ctaagggggaggggaagt

SEQ ID NO: 4978167 - DNA, 17 bp, Homo sapiens
ctaagggtcgaaagctc

SEQ ID NO: 4978168 - DNA, 19 bp, Homo sapiens
ctaagggtcgaaagctcta

SEQ ID NO: 4978169 - DNA, 14 bp, Homo sapiens
ctaagggtgggtgc

SEQ ID NO: 4978170 - DNA, 19 bp, Homo sapiens
ctaagggtgggtgctcaga

SEQ ID NO: 4978171 - DNA, 20 bp, Homo sapiens
ctaattttacacattagatt

SEQ ID NO: 4978172 - DNA, 17 bp, Homo sapiens
ctaattttagtattcat

SEQ ID NO: 4978173 - DNA, 20 bp, Homo sapiens
ctaattttctcaaaagcatt

SEQ ID NO: 4978174 - DNA, 19 bp, Homo sapiens
ctacaagagcagcctgtgg

SEQ ID NO: 4978175 - DNA, 21 bp, Homo sapiens
ctacaagagcagcctgtggca

SEQ ID NO: 4978176 - DNA, 22 bp, Homo sapiens
ctacaagagcagcctgtggcat

SEQ ID NO: 4978177 - DNA, 23 bp, Homo sapiens
ctacaagagcagcctgtggcatc

SEQ ID NO: 4978178 - DNA, 21 bp, Homo sapiens
ctacaattaatagtttgtcta

SEQ ID NO: 4978179 - DNA, 19 bp, Homo sapiens
ctacacagtgggaactctg

SEQ ID NO: 4978180 - DNA, 22 bp, Homo sapiens
ctacacagtgggaactctgaca

SEQ ID NO: 4978181 - DNA, 21 bp, Homo sapiens
ctacactgcaatcatatgtga

SEQ ID NO: 4978182 - DNA, 23 bp, Homo sapiens
ctacagagccgagcaatatttat

SEQ ID NO: 4978183 - DNA, 19 bp, Homo sapiens
ctacagcactactgggtgt

SEQ ID NO: 4978184 - DNA, 20 bp, Homo sapiens
ctacagcactactgggtgtc

SEQ ID NO: 4978185 - DNA, 21 bp, Homo sapiens
ctacagctaatcagcattctc

SEQ ID NO: 4978186 - DNA, 19 bp, Homo sapiens
ctacagctcttaaatgtag

SEQ ID NO: 4978187 - DNA, 18 bp, Homo sapiens
ctacaggaagcaccccat

SEQ ID NO: 4978188 - DNA, 22 bp, Homo sapiens
ctacaggaagcaccccatgcca

SEQ ID NO: 4978189 - DNA, 14 bp, Homo sapiens
ctacaggagtgagc

SEQ ID NO: 4978190 - DNA, 20 bp, Homo sapiens
ctacaggcagtctctctctt

SEQ ID NO: 4978191 - DNA, 18 bp, Homo sapiens
ctacagtgccaactcctc

SEQ ID NO: 4978192 - DNA, 21 bp, Homo sapiens
ctacagttatgttcagtcaca

SEQ ID NO: 4978193 - DNA, 12 bp, Homo sapiens
ctacataaattg

SEQ ID NO: 4978194 - DNA, 14 bp, Homo sapiens
ctacatcttctgcc

SEQ ID NO: 4978195 - DNA, 16 bp, Homo sapiens
ctacatcttctgcctt

SEQ ID NO: 4978196 - DNA, 14 bp, Homo sapiens
ctacatgaaacaga

SEQ ID NO: 4978197 - DNA, 16 bp, Homo sapiens
ctacatgaaacagaaa

SEQ ID NO: 4978198 - DNA, 18 bp, Homo sapiens
ctacatgaaacagaaaca

SEQ ID NO: 4978199 - DNA, 22 bp, Homo sapiens
ctacatgcaaggcactgtacta

SEQ ID NO: 4978200 - DNA, 15 bp, Homo sapiens
ctacatgcagcccat

SEQ ID NO: 4978201 - DNA, 23 bp, Homo sapiens
ctacatgcagcccatgcccacct

SEQ ID NO: 4978202 - DNA, 15 bp, Homo sapiens
ctaccaaagcacctt

SEQ ID NO: 4978203 - DNA, 13 bp, Homo sapiens
ctaccatttcaga

SEQ ID NO: 4978204 - DNA, 20 bp, Homo sapiens
ctacccacacctctgccaga

SEQ ID NO: 4978205 - DNA, 17 bp, Homo sapiens
ctacccaccctcctttc

SEQ ID NO: 4978206 - DNA, 22 bp, Homo sapiens
ctacccaccctcctttcaccac

SEQ ID NO: 4978207 - DNA, 15 bp, Homo sapiens
ctacccactatcctt

SEQ ID NO: 4978208 - DNA, 19 bp, Homo sapiens
ctacccactatccttcgtg

SEQ ID NO: 4978209 - DNA, 21 bp, Homo sapiens
ctacccagagattgcttctca

SEQ ID NO: 4978210 - DNA, 17 bp, Homo sapiens
ctacccagcgagccctg

SEQ ID NO: 4978211 - DNA, 13 bp, Homo sapiens
ctacccctggctg

SEQ ID NO: 4978212 - DNA, 14 bp, Homo sapiens
ctacccctggctgt

SEQ ID NO: 4978213 - DNA, 17 bp, Homo sapiens
ctacccgcatcttctgt

SEQ ID NO: 4978214 - DNA, 15 bp, Homo sapiens
ctacccgttccaaaa

SEQ ID NO: 4978215 - DNA, 13 bp, Homo sapiens
ctaccctcccacc

SEQ ID NO: 4978216 - DNA, 14 bp, Homo sapiens
ctaccctcccaccc

SEQ ID NO: 4978217 - DNA, 19 bp, Homo sapiens
ctaccctcccacccccttc

SEQ ID NO: 4978218 - DNA, 13 bp, Homo sapiens
ctacccttaatta

SEQ ID NO: 4978219 - DNA, 16 bp, Homo sapiens
ctaccctttttctcca

SEQ ID NO: 4978220 - DNA, 18 bp, Homo sapiens
ctaccctttttctccagc

SEQ ID NO: 4978221 - DNA, 13 bp, Homo sapiens
ctaccgagttcaa

SEQ ID NO: 4978222 - DNA, 17 bp, Homo sapiens
ctacctcaggcagctca

SEQ ID NO: 4978223 - DNA, 23 bp, Homo sapiens
ctacctcaggcaggaagggcagg

SEQ ID NO: 4978224 - DNA, 19 bp, Homo sapiens
ctaccttgaaaataagaat

SEQ ID NO: 4978225 - DNA, 17 bp, Homo sapiens
ctactataaagagaaga

SEQ ID NO: 4978226 - DNA, 17 bp, Homo sapiens
ctactccctgcagatgc

SEQ ID NO: 4978227 - DNA, 13 bp, Homo sapiens
ctactctgtgtca

SEQ ID NO: 4978228 - DNA, 21 bp, Homo sapiens
ctactctgtgtcaggtggggc

SEQ ID NO: 4978229 - DNA, 14 bp, Homo sapiens
ctactctttgattt

SEQ ID NO: 4978230 - DNA, 12 bp, Homo sapiens
ctactgaaacag

SEQ ID NO: 4978231 - DNA, 14 bp, Homo sapiens
ctactgcagcttta

SEQ ID NO: 4978232 - DNA, 18 bp, Homo sapiens
ctactgggtgtcatttca

SEQ ID NO: 4978233 - DNA, 23 bp, Homo sapiens
ctactgggtgtcatttcattcca

SEQ ID NO: 4978234 - DNA, 20 bp, Homo sapiens
ctactgtctttggaaaaatg

SEQ ID NO: 4978235 - DNA, 17 bp, Homo sapiens
ctactgtgtgtgtgaat

SEQ ID NO: 4978236 - DNA, 19 bp, Homo sapiens
ctactgtgtgtgtgaatga

SEQ ID NO: 4978237 - DNA, 22 bp, Homo sapiens
ctactgttctaaagctctgaca

SEQ ID NO: 4978238 - DNA, 22 bp, Homo sapiens
ccccagctaccctttttctcca

SEQ ID NO: 4978239 - DNA, 14 bp, Homo sapiens
ccccagctcagggg

SEQ ID NO: 4978240 - DNA, 15 bp, Homo sapiens
ccccagctgtgagcc

SEQ ID NO: 4978241 - DNA, 21 bp, Homo sapiens
ccccagctgtgagccttggct

SEQ ID NO: 4978242 - DNA, 17 bp, Homo sapiens
ccccaggcctctgtgtc

SEQ ID NO: 4978243 - DNA, 19 bp, Homo sapiens
ccccaggctggacatgctg

SEQ ID NO: 4978244 - DNA, 11 bp, Homo sapiens
ccccagggcac

SEQ ID NO: 4978245 - DNA, 14 bp, Homo sapiens
ccccagggcaccct

SEQ ID NO: 4978246 - DNA, 17 bp, Homo sapiens
ccccaggtggaaggcag

SEQ ID NO: 4978247 - DNA, 14 bp, Homo sapiens
ccccagtgcccaca

SEQ ID NO: 4978248 - DNA, 20 bp, Homo sapiens
ccccagtgcccacaggatca

SEQ ID NO: 4978249 - DNA, 16 bp, Homo sapiens
ccccataactcaatgg

SEQ ID NO: 4978250 - DNA, 22 bp, Homo sapiens
ccccataattttttttttcctt

SEQ ID NO: 4978251 - DNA, 12 bp, Homo sapiens
ccccatagccac

SEQ ID NO: 4978252 - DNA, 12 bp, Homo sapiens
ccccatctctcc

SEQ ID NO: 4978253 - DNA, 16 bp, Homo sapiens
ccccatctctccctcc

SEQ ID NO: 4978254 - DNA, 19 bp, Homo sapiens
ccccatctctccctcccct

SEQ ID NO: 4978255 - DNA, 19 bp, Homo sapiens
ccccatctgggtccttgca

SEQ ID NO: 4978256 - DNA, 15 bp, Homo sapiens
ccccatgaggaagga

SEQ ID NO: 4978257 - DNA, 18 bp, Homo sapiens
ccccatgaggaaggaaca

SEQ ID NO: 4978258 - DNA, 16 bp, Homo sapiens
ccccatgccacgttcc

SEQ ID NO: 4978259 - DNA, 14 bp, Homo sapiens
ctcctgcctgcccc

SEQ ID NO: 4978260 - DNA, 18 bp, Homo sapiens
ctcctgcctgtagcagtg

SEQ ID NO: 4978261 - DNA, 18 bp, Homo sapiens
ctcctggaaccttgctgt

SEQ ID NO: 4978262 - DNA, 19 bp, Homo sapiens
ctcctggaaccttgctgtc

SEQ ID NO: 4978263 - DNA, 20 bp, Homo sapiens
ctcctggaaccttgctgtcc

SEQ ID NO: 4978264 - DNA, 19 bp, Homo sapiens
ctcctggcctcaagtgatt

SEQ ID NO: 4978265 - DNA, 13 bp, Homo sapiens
ctcctgggctcag

SEQ ID NO: 4978266 - DNA, 20 bp, Homo sapiens
ctcctgtaacatactggcct

SEQ ID NO: 4978267 - DNA, 22 bp, Homo sapiens
ctcctgtaacatactggcctgg

SEQ ID NO: 4978268 - DNA, 12 bp, Homo sapiens
ctcctgtcctcc

SEQ ID NO: 4978269 - DNA, 16 bp, Homo sapiens
ctcctgtgtactgtgt

SEQ ID NO: 4978270 - DNA, 17 bp, Homo sapiens
ctcctgtgtactgtgtc

SEQ ID NO: 4978271 - DNA, 15 bp, Homo sapiens
ctcctgtgtcttgca

SEQ ID NO: 4978272 - DNA, 19 bp, Homo sapiens
ctcctgtgtgtgcgcctac

SEQ ID NO: 4978273 - DNA, 18 bp, Homo sapiens
ctcctgtttattcccatc

SEQ ID NO: 4978274 - DNA, 18 bp, Homo sapiens
ctcctgtttcccttccct

SEQ ID NO: 4978275 - DNA, 17 bp, Homo sapiens
ctccttcccatcgctgt

SEQ ID NO: 4978276 - DNA, 14 bp, Homo sapiens
ctccttccttaccc

SEQ ID NO: 4978277 - DNA, 19 bp, Homo sapiens
ctccttccttacccaaact

SEQ ID NO: 4978278 - DNA, 23 bp, Homo sapiens
ctccttccttacccaaactgttc

SEQ ID NO: 4978279 - DNA, 20 bp, Homo sapiens
ctccttctgtcctactctgt

SEQ ID NO: 4978280 - DNA, 15 bp, Homo sapiens
ctccttgaatatctt

SEQ ID NO: 4978281 - DNA, 20 bp, Homo sapiens
ctccttgaatatctttcgat

SEQ ID NO: 4978282 - DNA, 14 bp, Homo sapiens
ctccttggcctagc

SEQ ID NO: 4978283 - DNA, 13 bp, Homo sapiens
ctccttggcttac

SEQ ID NO: 4978284 - DNA, 17 bp, Homo sapiens
ctccttggcttacctga

SEQ ID NO: 4978285 - DNA, 15 bp, Homo sapiens
ctccttggtgcctgg

SEQ ID NO: 4978286 - DNA, 15 bp, Homo sapiens
ctccttgtccaccca

SEQ ID NO: 4978287 - DNA, 20 bp, Homo sapiens
ctcctttcacaaccttctgt

SEQ ID NO: 4978288 - DNA, 15 bp, Homo sapiens
ctcctttcaccacat

SEQ ID NO: 4978289 - DNA, 12 bp, Homo sapiens
ctcctttctgtg

SEQ ID NO: 4978290 - DNA, 19 bp, Homo sapiens
ctcctttgaaacctgctct

SEQ ID NO: 4978291 - DNA, 23 bp, Homo sapiens
ctcctttgctgaggcctccagct

SEQ ID NO: 4978292 - DNA, 19 bp, Homo sapiens
ctccttttcttttgttact

SEQ ID NO: 4978293 - DNA, 20 bp, Homo sapiens
ctccttttcttttgttactg

SEQ ID NO: 4978294 - DNA, 14 bp, Homo sapiens
ctcgaaacacagaa

SEQ ID NO: 4978295 - DNA, 15 bp, Homo sapiens
ctcgaactggctgca

SEQ ID NO: 4978296 - DNA, 13 bp, Homo sapiens
ctcgaagcgcgcc

SEQ ID NO: 4978297 - DNA, 20 bp, Homo sapiens
ctcgaagcgcgccactcgct

SEQ ID NO: 4978298 - DNA, 15 bp, Homo sapiens
ctcgatccaaattgt

SEQ ID NO: 4978299 - DNA, 16 bp, Homo sapiens
ctcgcacccccctgtt

SEQ ID NO: 4978300 - DNA, 17 bp, Homo sapiens
ctcgcacccccctgttc

SEQ ID NO: 4978301 - DNA, 20 bp, Homo sapiens
ctcgcacccccctgttctaa

SEQ ID NO: 4978302 - DNA, 21 bp, Homo sapiens
ctcgcacccccctgttctaag

SEQ ID NO: 4978303 - DNA, 15 bp, Homo sapiens
ctcgcacctttccaa

SEQ ID NO: 4978304 - DNA, 17 bp, Homo sapiens
ctcgccccaccggcgcg

SEQ ID NO: 4978305 - DNA, 17 bp, Homo sapiens
ctcgccctcctttctgt

SEQ ID NO: 4978306 - DNA, 19 bp, Homo sapiens
ctcgccctcctttctgtgc

SEQ ID NO: 4978307 - DNA, 19 bp, Homo sapiens
ctcgcttcccccatagcca

SEQ ID NO: 4978308 - DNA, 11 bp, Homo sapiens
ctcgcttgtaa

SEQ ID NO: 4978309 - DNA, 20 bp, Homo sapiens
ctcgcttgtaaataccagga

SEQ ID NO: 4978310 - DNA, 21 bp, Homo sapiens
ctcgcttgtaaataccaggat

SEQ ID NO: 4978311 - DNA, 22 bp, Homo sapiens
ctcggcctggtcaggccctggt

SEQ ID NO: 4978312 - DNA, 19 bp, Homo sapiens
ctcggctccccatgtgtcc

SEQ ID NO: 4978313 - DNA, 15 bp, Homo sapiens
ctcgggacacctgcc

SEQ ID NO: 4978314 - DNA, 13 bp, Homo sapiens
ctcggggagcctt

SEQ ID NO: 4978315 - DNA, 14 bp, Homo sapiens
ctcggggagcctta

SEQ ID NO: 4978316 - DNA, 18 bp, Homo sapiens
ctcgtatatgtctcaggt

SEQ ID NO: 4978317 - DNA, 20 bp, Homo sapiens
ctcgtatatgtctcaggtcc

SEQ ID NO: 4978318 - DNA, 15 bp, Homo sapiens
ctcgttcctttctcc

SEQ ID NO: 4978319 - DNA, 21 bp, Homo sapiens
ctcgtttttcttcttaagact

SEQ ID NO: 4978320 - DNA, 13 bp, Homo sapiens
ctctaaaagcacc

SEQ ID NO: 4978321 - DNA, 19 bp, Homo sapiens
ctctaaagaccaaacttca

SEQ ID NO: 4978322 - DNA, 14 bp, Homo sapiens
ctctaagatcttag

SEQ ID NO: 4978323 - DNA, 19 bp, Homo sapiens
ctctaagatcttagattct

SEQ ID NO: 4978324 - DNA, 17 bp, Homo sapiens
ctctaatcgaaagaaaa

SEQ ID NO: 4978325 - DNA, 17 bp, Homo sapiens
ctctacaattggaagat

SEQ ID NO: 4978326 - DNA, 16 bp, Homo sapiens
ctctacagaggccatg

SEQ ID NO: 4978327 - DNA, 18 bp, Homo sapiens
ctctacatcttctgcctt

SEQ ID NO: 4978328 - DNA, 14 bp, Homo sapiens
ctctaccctcccac

SEQ ID NO: 4978329 - DNA, 16 bp, Homo sapiens
ctctacttagcatgtc

SEQ ID NO: 4978330 - DNA, 17 bp, Homo sapiens
ctctacttagcatgtcc

SEQ ID NO: 4978331 - DNA, 12 bp, Homo sapiens
ctctagaatctg

SEQ ID NO: 4978332 - DNA, 16 bp, Homo sapiens
ctctagagtccaaggt

SEQ ID NO: 4978333 - DNA, 18 bp, Homo sapiens
ctctagggttgctggagc

SEQ ID NO: 4978334 - DNA, 14 bp, Homo sapiens
ctctatctgggcct

SEQ ID NO: 4978335 - DNA, 13 bp, Homo sapiens
ctctatgagtcta

SEQ ID NO: 4978336 - DNA, 14 bp, Homo sapiens
ctctatgagtctag

SEQ ID NO: 4978337 - DNA, 15 bp, Homo sapiens
ctctatgagtctaga

SEQ ID NO: 4978338 - DNA, 16 bp, Homo sapiens
ctctatgagtctagat

SEQ ID NO: 4978339 - DNA, 15 bp, Homo sapiens
ctctatttaatattt

SEQ ID NO: 4978340 - DNA, 12 bp, Homo sapiens
ctctcacacaca

SEQ ID NO: 4978341 - DNA, 21 bp, Homo sapiens
ctctcacacacatagattaat

SEQ ID NO: 4978342 - DNA, 15 bp, Homo sapiens
ctctcactaaacttt

SEQ ID NO: 4978343 - DNA, 12 bp, Homo sapiens
ctctcactcccc

SEQ ID NO: 4978344 - DNA, 14 bp, Homo sapiens
ctctcagcccagaa

SEQ ID NO: 4978345 - DNA, 19 bp, Homo sapiens
ctctcagccttacatttgt

SEQ ID NO: 4978346 - DNA, 12 bp, Homo sapiens
ctctcagctcca

SEQ ID NO: 4978347 - DNA, 16 bp, Homo sapiens
ctctcaggatccaagc

SEQ ID NO: 4978348 - DNA, 12 bp, Homo sapiens
ctctccactgcc

SEQ ID NO: 4978349 - DNA, 16 bp, Homo sapiens
ctctccactgccttcg

SEQ ID NO: 4978350 - DNA, 12 bp, Homo sapiens
ctctccccacac

SEQ ID NO: 4978351 - DNA, 14 bp, Homo sapiens
ctctccccacacta

SEQ ID NO: 4978352 - DNA, 14 bp, Homo sapiens
ctctccccacccct

SEQ ID NO: 4978353 - DNA, 19 bp, Homo sapiens
ctctccccacccctacccc

SEQ ID NO: 4978354 - DNA, 14 bp, Homo sapiens
ctctcccctccagc

SEQ ID NO: 4978355 - DNA, 15 bp, Homo sapiens
ctctcccctccagcc

SEQ ID NO: 4978356 - DNA, 16 bp, Homo sapiens
ctctccgaccagacac

SEQ ID NO: 4978357 - DNA, 12 bp, Homo sapiens
ctctcctgtaag

SEQ ID NO: 4978358 - DNA, 13 bp, Homo sapiens
ctctccttttctt

SEQ ID NO: 4978359 - DNA, 19 bp, Homo sapiens
ctctccttttcttttgtta

SEQ ID NO: 4978360 - DNA, 21 bp, Homo sapiens
ctctccttttcttttgttact

SEQ ID NO: 4978361 - DNA, 15 bp, Homo sapiens
ctctctacagtgcca

SEQ ID NO: 4978362 - DNA, 12 bp, Homo sapiens
ctctctccagat

SEQ ID NO: 4978363 - DNA, 18 bp, Homo sapiens
ctctctcttctgctccac

SEQ ID NO: 4978364 - DNA, 18 bp, Homo sapiens
ctctctgtataaacatta

SEQ ID NO: 4978365 - DNA, 12 bp, Homo sapiens
ctctcttccctc

SEQ ID NO: 4978366 - DNA, 14 bp, Homo sapiens
ctctcttccctcag

SEQ ID NO: 4978367 - DNA, 15 bp, Homo sapiens
ctctcttccctcaga

SEQ ID NO: 4978368 - DNA, 21 bp, Homo sapiens
ctctcttcctgcccctctttc

SEQ ID NO: 4978369 - DNA, 20 bp, Homo sapiens
ctctcttgccgaggagccag

SEQ ID NO: 4978370 - DNA, 14 bp, Homo sapiens
ctctcttttctgta

SEQ ID NO: 4978371 - DNA, 18 bp, Homo sapiens
ctctgaacacaggcagct

SEQ ID NO: 4978372 - DNA, 20 bp, Homo sapiens
ctagattcaaaggttctagg

SEQ ID NO: 4978373 - DNA, 23 bp, Homo sapiens
ctagattccattggtccaagatt

SEQ ID NO: 4978374 - DNA, 18 bp, Homo sapiens
ctagcactcattttctat

SEQ ID NO: 4978375 - DNA, 17 bp, Homo sapiens
ctagcagtaaaagatga

SEQ ID NO: 4978376 - DNA, 20 bp, Homo sapiens
ctagccagcacttgtatata

SEQ ID NO: 4978377 - DNA, 23 bp, Homo sapiens
ctagccaggaagtacttccacct

SEQ ID NO: 4978378 - DNA, 12 bp, Homo sapiens
ctagcccaccct

SEQ ID NO: 4978379 - DNA, 17 bp, Homo sapiens
ctagcccaccctgctgc

SEQ ID NO: 4978380 - DNA, 21 bp, Homo sapiens
ctagcccaccctgctgccttc

SEQ ID NO: 4978381 - DNA, 13 bp, Homo sapiens
ctagcccctgtgg

SEQ ID NO: 4978382 - DNA, 20 bp, Homo sapiens
ctagcccctgtggagactgg

SEQ ID NO: 4978383 - DNA, 19 bp, Homo sapiens
ctagcctgcactttgatgt

SEQ ID NO: 4978384 - DNA, 22 bp, Homo sapiens
ctagccttaatcaggtcctcag

SEQ ID NO: 4978385 - DNA, 18 bp, Homo sapiens
ctagcctttggctctgga

SEQ ID NO: 4978386 - DNA, 19 bp, Homo sapiens
ctagcctttggctctggag

SEQ ID NO: 4978387 - DNA, 14 bp, Homo sapiens
ctagctgtgcaaga

SEQ ID NO: 4978388 - DNA, 19 bp, Homo sapiens
ctagctttatatatggaca

SEQ ID NO: 4978389 - DNA, 20 bp, Homo sapiens
ctagctttatatatggacat

SEQ ID NO: 4978390 - DNA, 22 bp, Homo sapiens
ctagctttatatatggacatgg

SEQ ID NO: 4978391 - DNA, 17 bp, Homo sapiens
ctaggaccactcagccc

SEQ ID NO: 4978392 - DNA, 22 bp, Homo sapiens
ctaggacccctccatgtgggct

SEQ ID NO: 4978393 - DNA, 20 bp, Homo sapiens
ctaggagaagagttgaggaa

SEQ ID NO: 4978394 - DNA, 16 bp, Homo sapiens
ctaggagaccaaggcg

SEQ ID NO: 4978395 - DNA, 23 bp, Homo sapiens
ctaggagggagacactggcccct

SEQ ID NO: 4978396 - DNA, 20 bp, Homo sapiens
ctaggcactgtagttctaag

SEQ ID NO: 4978397 - DNA, 21 bp, Homo sapiens
ctaggcactgtagttctaaga

SEQ ID NO: 4978398 - DNA, 13 bp, Homo sapiens
ctaggcctggcca

SEQ ID NO: 4978399 - DNA, 19 bp, Homo sapiens
ctaggcctggccagatgca

SEQ ID NO: 4978400 - DNA, 12 bp, Homo sapiens
ctaggctcagag

SEQ ID NO: 4978401 - DNA, 13 bp, Homo sapiens
ctaggctcagaga

SEQ ID NO: 4978402 - DNA, 22 bp, Homo sapiens
ctaggctcagagatgtgcaccc

SEQ ID NO: 4978403 - DNA, 13 bp, Homo sapiens
ctaggctccaccc

SEQ ID NO: 4978404 - DNA, 16 bp, Homo sapiens
ctagggattcaggctg

SEQ ID NO: 4978405 - DNA, 18 bp, Homo sapiens
ctagggattcaggctgct

SEQ ID NO: 4978406 - DNA, 17 bp, Homo sapiens
ctagggtggcccttgca

SEQ ID NO: 4978407 - DNA, 15 bp, Homo sapiens
ctagggttgctggag

SEQ ID NO: 4978408 - DNA, 23 bp, Homo sapiens
ctaggtctcggactaagcctacc

SEQ ID NO: 4978409 - DNA, 14 bp, Homo sapiens
ctaggtgacagagt

SEQ ID NO: 4978410 - DNA, 15 bp, Homo sapiens
ctaggttcaattccc

SEQ ID NO: 4978411 - DNA, 19 bp, Homo sapiens
ctaggttcccggtcccgag

SEQ ID NO: 4978412 - DNA, 21 bp, Homo sapiens
ctagtaagtaattatgcacta

SEQ ID NO: 4978413 - DNA, 15 bp, Homo sapiens
ctagtactgtgtact

SEQ ID NO: 4978414 - DNA, 12 bp, Homo sapiens
ctagtatttgaa

SEQ ID NO: 4978415 - DNA, 18 bp, Homo sapiens
ctagtatttgaattaaaa

SEQ ID NO: 4978416 - DNA, 23 bp, Homo sapiens
ctagtatttgaattaaaacttct

SEQ ID NO: 4978417 - DNA, 24 bp, Homo sapiens
ctagtatttgaattaaaacttctt

SEQ ID NO: 4978418 - DNA, 14 bp, Homo sapiens
ctagtccagtgacc

SEQ ID NO: 4978419 - DNA, 14 bp, Homo sapiens
ctagtcccttcccc

SEQ ID NO: 4978420 - DNA, 20 bp, Homo sapiens
ctagtcccttcccctccctg

SEQ ID NO: 4978421 - DNA, 21 bp, Homo sapiens
ctagtcccttcccctccctgg

SEQ ID NO: 4978422 - DNA, 23 bp, Homo sapiens
ctagtcccttcccctccctggct

SEQ ID NO: 4978423 - DNA, 15 bp, Homo sapiens
ctagtccggacccac

SEQ ID NO: 4978424 - DNA, 12 bp, Homo sapiens
ctagtctctcct

SEQ ID NO: 4978425 - DNA, 14 bp, Homo sapiens
ctagtgagctgggc

SEQ ID NO: 4978426 - DNA, 18 bp, Homo sapiens
ctagtgagctgggcatgg

SEQ ID NO: 4978427 - DNA, 15 bp, Homo sapiens
ctagtgttctgtcta

SEQ ID NO: 4978428 - DNA, 18 bp, Homo sapiens
ctagtgttctgtttgtta

SEQ ID NO: 4978429 - DNA, 18 bp, Homo sapiens
ctagttccctctgctcag

SEQ ID NO: 4978430 - DNA, 21 bp, Homo sapiens
ctagttccctctgctcagcca

SEQ ID NO: 4978431 - DNA, 14 bp, Homo sapiens
ctagtttacagaaa

SEQ ID NO: 4978432 - DNA, 20 bp, Homo sapiens
ctagttttctcctcccagga

SEQ ID NO: 4978433 - DNA, 22 bp, Homo sapiens
ctagtttttagtaatctgtaca

SEQ ID NO: 4978434 - DNA, 20 bp, Homo sapiens
ctataaagcgatatacagat

SEQ ID NO: 4978435 - DNA, 12 bp, Homo sapiens
ctataacagata

SEQ ID NO: 4978436 - DNA, 22 bp, Homo sapiens
ctataaccccagctccctagga

SEQ ID NO: 4978437 - DNA, 19 bp, Homo sapiens
ctataatcccagcactttg

SEQ ID NO: 4978438 - DNA, 13 bp, Homo sapiens
ctataatctgtca

SEQ ID NO: 4978439 - DNA, 18 bp, Homo sapiens
ctatacatctctccccaa

SEQ ID NO: 4978440 - DNA, 14 bp, Homo sapiens
ctatggttatgaaa

SEQ ID NO: 4978441 - DNA, 17 bp, Homo sapiens
ctatgtactagtactgt

SEQ ID NO: 4978442 - DNA, 19 bp, Homo sapiens
ctatgtactagtactgtgt

SEQ ID NO: 4978443 - DNA, 22 bp, Homo sapiens
ctatgtatttgcagttcacctg

SEQ ID NO: 4978444 - DNA, 18 bp, Homo sapiens
ctatgttactattttcta

SEQ ID NO: 4978445 - DNA, 14 bp, Homo sapiens
ctatgttgcccagg

SEQ ID NO: 4978446 - DNA, 17 bp, Homo sapiens
ctatgttgcccaggcag

SEQ ID NO: 4978447 - DNA, 19 bp, Homo sapiens
ctattaaagtgctaaggtt

SEQ ID NO: 4978448 - DNA, 11 bp, Homo sapiens
ctattaatata

SEQ ID NO: 4978449 - DNA, 12 bp, Homo sapiens
ctattacaaata

SEQ ID NO: 4978450 - DNA, 23 bp, Homo sapiens
ctattactgtctggttttaacaa

SEQ ID NO: 4978451 - DNA, 16 bp, Homo sapiens
ctattagccaggatca

SEQ ID NO: 4978452 - DNA, 21 bp, Homo sapiens
ctattaggtgcaatttcaagg

SEQ ID NO: 4978453 - DNA, 20 bp, Homo sapiens
ctattattttcactgtagaa

SEQ ID NO: 4978454 - DNA, 17 bp, Homo sapiens
ctattcattaaatgttt

SEQ ID NO: 4978455 - DNA, 15 bp, Homo sapiens
ctattccaaaaaggt

SEQ ID NO: 4978456 - DNA, 17 bp, Homo sapiens
ctattccttctggcctt

SEQ ID NO: 4978457 - DNA, 12 bp, Homo sapiens
ctattcctttcc

SEQ ID NO: 4978458 - DNA, 14 bp, Homo sapiens
ctattcctttccct

SEQ ID NO: 4978459 - DNA, 16 bp, Homo sapiens
ctattcctttcccttc

SEQ ID NO: 4978460 - DNA, 19 bp, Homo sapiens
ctattctcaaagtttccta

SEQ ID NO: 4978461 - DNA, 12 bp, Homo sapiens
ctattctctctt

SEQ ID NO: 4978462 - DNA, 17 bp, Homo sapiens
ctattctgagaaaacaa

SEQ ID NO: 4978463 - DNA, 14 bp, Homo sapiens
ctattgacttcaat

SEQ ID NO: 4978464 - DNA, 16 bp, Homo sapiens
ctattgacttcaatga

SEQ ID NO: 4978465 - DNA, 18 bp, Homo sapiens
ctattgatactctttcta

SEQ ID NO: 4978466 - DNA, 21 bp, Homo sapiens
ctattgcaaaggttccaactg

SEQ ID NO: 4978467 - DNA, 22 bp, Homo sapiens
ctattgcaaaggttccaactgt

SEQ ID NO: 4978468 - DNA, 14 bp, Homo sapiens
ctattgcatttata

SEQ ID NO: 4978469 - DNA, 19 bp, Homo sapiens
ctattgccttctttgaaga

SEQ ID NO: 4978470 - DNA, 15 bp, Homo sapiens
ctatttaaagcctcc

SEQ ID NO: 4978471 - DNA, 12 bp, Homo sapiens
ctatttaatatt

SEQ ID NO: 4978472 - DNA, 14 bp, Homo sapiens
ctatttaatattta

SEQ ID NO: 4978473 - DNA, 21 bp, Homo sapiens
ctatttatgccttgatgattt

SEQ ID NO: 4978474 - DNA, 22 bp, Homo sapiens
ctatttattaagttctcaatgt

SEQ ID NO: 4978475 - DNA, 13 bp, Homo sapiens
ctatttcattttt

SEQ ID NO: 4978476 - DNA, 21 bp, Homo sapiens
ctatttctttatatttatcca

SEQ ID NO: 4978477 - DNA, 22 bp, Homo sapiens
ctatttgccatgggcttcactg

SEQ ID NO: 4978478 - DNA, 20 bp, Homo sapiens
ctattttaaaataaattagt

SEQ ID NO: 4978479 - DNA, 15 bp, Homo sapiens
ctattttagaataaa

SEQ ID NO: 4978480 - DNA, 16 bp, Homo sapiens
ctattttctatgtact

SEQ ID NO: 4978481 - DNA, 15 bp, Homo sapiens
ctattttctttttta

SEQ ID NO: 4978482 - DNA, 15 bp, Homo sapiens
ctatttttgtaaact

SEQ ID NO: 4978483 - DNA, 20 bp, Homo sapiens
ctcaaaactggacagtcact

SEQ ID NO: 4978484 - DNA, 16 bp, Homo sapiens
ctcaaaacttaacata

SEQ ID NO: 4978485 - DNA, 20 bp, Homo sapiens
ctcaaaagagaaaaacaaaa

SEQ ID NO: 4978486 - DNA, 14 bp, Homo sapiens
ctcaaaagcattta

SEQ ID NO: 4978487 - DNA, 13 bp, Homo sapiens
ctcaaaatatttg

SEQ ID NO: 4978488 - DNA, 14 bp, Homo sapiens
ctcaaaatgtgtaa

SEQ ID NO: 4978489 - DNA, 17 bp, Homo sapiens
ctcaaacaacactggtg

SEQ ID NO: 4978490 - DNA, 12 bp, Homo sapiens
ctcaaactatga

SEQ ID NO: 4978491 - DNA, 14 bp, Homo sapiens
ctcaaagttttgaa

SEQ ID NO: 4978492 - DNA, 15 bp, Homo sapiens
ctcaaagttttgaaa

SEQ ID NO: 4978493 - DNA, 16 bp, Homo sapiens
ctcaaatgttctaagt

SEQ ID NO: 4978494 - DNA, 19 bp, Homo sapiens
ctcaaatgttctaagtttc

SEQ ID NO: 4978495 - DNA, 24 bp, Homo sapiens
ctcaaatgttctaagtttctaaga

SEQ ID NO: 4978496 - DNA, 17 bp, Homo sapiens
ctcaaattgtcagcaat

SEQ ID NO: 4978497 - DNA, 19 bp, Homo sapiens
ctcaacaaagcacagtgtt

SEQ ID NO: 4978498 - DNA, 12 bp, Homo sapiens
ctcaacaataaa

SEQ ID NO: 4978499 - DNA, 15 bp, Homo sapiens
ctcaacctcctgggc

SEQ ID NO: 4978500 - DNA, 14 bp, Homo sapiens
ctcaacctcctgtg

SEQ ID NO: 4978501 - DNA, 12 bp, Homo sapiens
ctcaacctcttc

SEQ ID NO: 4978502 - DNA, 18 bp, Homo sapiens
ctcaacctcttctggctc

SEQ ID NO: 4978503 - DNA, 20 bp, Homo sapiens
ctcaacctcttctggctcaa

SEQ ID NO: 4978504 - DNA, 15 bp, Homo sapiens
ctcaacgtattgttt

SEQ ID NO: 4978505 - DNA, 16 bp, Homo sapiens
ctcaactttctgttgg

SEQ ID NO: 4978506 - DNA, 17 bp, Homo sapiens
ctcaagagggcactggt

SEQ ID NO: 4978507 - DNA, 21 bp, Homo sapiens
ctcaagagggcactggtggcc

SEQ ID NO: 4978508 - DNA, 12 bp, Homo sapiens
ctcaagcactga

SEQ ID NO: 4978509 - DNA, 14 bp, Homo sapiens
ctcaagcactgata

SEQ ID NO: 4978510 - DNA, 21 bp, Homo sapiens
ctcaaggaatctttaagcaga

SEQ ID NO: 4978511 - DNA, 21 bp, Homo sapiens
ctcaagggctagcatccctga

SEQ ID NO: 4978512 - DNA, 18 bp, Homo sapiens
ctcaagtgattctcctgc

SEQ ID NO: 4978513 - DNA, 18 bp, Homo sapiens
cagacacgccttcccctc

SEQ ID NO: 4978514 - DNA, 21 bp, Homo sapiens
cagacactgaccatccactct

SEQ ID NO: 4978515 - DNA, 13 bp, Homo sapiens
cagacagaagtct

SEQ ID NO: 4978516 - DNA, 15 bp, Homo sapiens
cagacagacacacac

SEQ ID NO: 4978517 - DNA, 16 bp, Homo sapiens
cagacagacacacaca

SEQ ID NO: 4978518 - DNA, 11 bp, Homo sapiens
cagacaggcaa

SEQ ID NO: 4978519 - DNA, 13 bp, Homo sapiens
cagacaggcaagc

SEQ ID NO: 4978520 - DNA, 22 bp, Homo sapiens
cagacaggcaagcacctcctgc

SEQ ID NO: 4978521 - DNA, 12 bp, Homo sapiens
cagacataaagc

SEQ ID NO: 4978522 - DNA, 17 bp, Homo sapiens
cagacatacgaaacaca

SEQ ID NO: 4978523 - DNA, 19 bp, Homo sapiens
cagacatacgaaacacaaa

SEQ ID NO: 4978524 - DNA, 17 bp, Homo sapiens
cagacatctctgcaccc

SEQ ID NO: 4978525 - DNA, 22 bp, Homo sapiens
cagaccaccccgcctgccctca

SEQ ID NO: 4978526 - DNA, 15 bp, Homo sapiens
cagacccctggcttt

SEQ ID NO: 4978527 - DNA, 18 bp, Homo sapiens
cagacccctggcttttca

SEQ ID NO: 4978528 - DNA, 23 bp, Homo sapiens
cagacccctggcttttcactgct

SEQ ID NO: 4978529 - DNA, 21 bp, Homo sapiens
cagacctgctttttgaaatga

SEQ ID NO: 4978530 - DNA, 23 bp, Homo sapiens
cagacctgctttttgaaatgaaa

SEQ ID NO: 4978531 - DNA, 16 bp, Homo sapiens
cagactactattttct

SEQ ID NO: 4978532 - DNA, 23 bp, Homo sapiens
cagactctacagaggccatgggc

SEQ ID NO: 4978533 - DNA, 19 bp, Homo sapiens
cagactctcagcccagaag

SEQ ID NO: 4978534 - DNA, 21 bp, Homo sapiens
cagactctcagcccagaagaa

SEQ ID NO: 4978535 - DNA, 22 bp, Homo sapiens
cagactctttcgatacccagga

SEQ ID NO: 4978536 - DNA, 15 bp, Homo sapiens
cagactgcaggttgg

SEQ ID NO: 4978537 - DNA, 22 bp, Homo sapiens
cagactgctagtgttctgtcta

SEQ ID NO: 4978538 - DNA, 14 bp, Homo sapiens
cagactggaagcac

SEQ ID NO: 4978539 - DNA, 20 bp, Homo sapiens
cagactggaagcacagcttc

SEQ ID NO: 4978540 - DNA, 16 bp, Homo sapiens
cagacttttgtacatc

SEQ ID NO: 4978541 - DNA, 22 bp, Homo sapiens
cagatggcccggatgctgcttc

SEQ ID NO: 4978542 - DNA, 23 bp, Homo sapiens
cagatgtcccttgatgcacagag

SEQ ID NO: 4978543 - DNA, 18 bp, Homo sapiens
cagatgtttccagacttc

SEQ ID NO: 4978544 - DNA, 14 bp, Homo sapiens
cagattcagtcttg

SEQ ID NO: 4978545 - DNA, 14 bp, Homo sapiens
cagattcccagagc

SEQ ID NO: 4978546 - DNA, 18 bp, Homo sapiens
cagattcccagagcaaaa

SEQ ID NO: 4978547 - DNA, 21 bp, Homo sapiens
cagattcccagagcaaaataa

SEQ ID NO: 4978548 - DNA, 20 bp, Homo sapiens
cagattgcaacaggctgggc

SEQ ID NO: 4978549 - DNA, 21 bp, Homo sapiens
cagattgcaacaggctgggct

SEQ ID NO: 4978550 - DNA, 14 bp, Homo sapiens
cagattgttatcta

SEQ ID NO: 4978551 - DNA, 16 bp, Homo sapiens
cagattttaattgtca

SEQ ID NO: 4978552 - DNA, 13 bp, Homo sapiens
cagattttgataa

SEQ ID NO: 4978553 - DNA, 20 bp, Homo sapiens
cagattttggggttgtgttg

SEQ ID NO: 4978554 - DNA, 18 bp, Homo sapiens
cagatttttcggaggccc

SEQ ID NO: 4978555 - DNA, 23 bp, Homo sapiens
cagattttttgaaccatccactt

SEQ ID NO: 4978556 - DNA, 15 bp, Homo sapiens
cagcaaaaatataaa

SEQ ID NO: 4978557 - DNA, 11 bp, Homo sapiens
cagcaaaccat

SEQ ID NO: 4978558 - DNA, 24 bp, Homo sapiens
cagcaaaccatttttaaagtagaa

SEQ ID NO: 4978559 - DNA, 21 bp, Homo sapiens
cagcaaagaggactcgcttgt

SEQ ID NO: 4978560 - DNA, 14 bp, Homo sapiens
cagcaacacagcct

SEQ ID NO: 4978561 - DNA, 19 bp, Homo sapiens
cagcaacacagcctgggcc

SEQ ID NO: 4978562 - DNA, 15 bp, Homo sapiens
cagcaagaatattgt

SEQ ID NO: 4978563 - DNA, 19 bp, Homo sapiens
cagcaaggccctgctgccc

SEQ ID NO: 4978564 - DNA, 17 bp, Homo sapiens
cagcaagtgagagctgg

SEQ ID NO: 4978565 - DNA, 19 bp, Homo sapiens
cagcaagtgagagctgggt

SEQ ID NO: 4978566 - DNA, 19 bp, Homo sapiens
cagcaatatattaccagca

SEQ ID NO: 4978567 - DNA, 22 bp, Homo sapiens
cagcaatatattaccagcaaga

SEQ ID NO: 4978568 - DNA, 19 bp, Homo sapiens
cagcaatgacatctcaggg

SEQ ID NO: 4978569 - DNA, 14 bp, Homo sapiens
cagcacatattttc

SEQ ID NO: 4978570 - DNA, 17 bp, Homo sapiens
cagcacatgctggccag

SEQ ID NO: 4978571 - DNA, 22 bp, Homo sapiens
cagcaccaccctagtcccttcc

SEQ ID NO: 4978572 - DNA, 17 bp, Homo sapiens
cagcacctcagcctgca

SEQ ID NO: 4978573 - DNA, 15 bp, Homo sapiens
cagcactactgggtg

SEQ ID NO: 4978574 - DNA, 19 bp, Homo sapiens
cagcactactgggtgtcat

SEQ ID NO: 4978575 - DNA, 11 bp, Homo sapiens
cagcactgaaa

SEQ ID NO: 4978576 - DNA, 12 bp, Homo sapiens
cagcactgaaaa

SEQ ID NO: 4978577 - DNA, 14 bp, Homo sapiens
cagcactgaaaata

SEQ ID NO: 4978578 - DNA, 13 bp, Homo sapiens
cagcacttattta

SEQ ID NO: 4978579 - DNA, 14 bp, Homo sapiens
cagcacttgtctca

SEQ ID NO: 4978580 - DNA, 20 bp, Homo sapiens
cagcacttgtctcattttaa

SEQ ID NO: 4978581 - DNA, 13 bp, Homo sapiens
cagcagaaggatt

SEQ ID NO: 4978582 - DNA, 14 bp, Homo sapiens
cagcagcagcaggt

SEQ ID NO: 4978583 - DNA, 16 bp, Homo sapiens
cagcagcagcaggtga

SEQ ID NO: 4978584 - DNA, 13 bp, Homo sapiens
cagcagcattttt

SEQ ID NO: 4978585 - DNA, 12 bp, Homo sapiens
cagcagcctgct

SEQ ID NO: 4978586 - DNA, 12 bp, Homo sapiens
cagcagcttcac

SEQ ID NO: 4978587 - DNA, 22 bp, Homo sapiens
cagcaggtcctccatcccaaca

SEQ ID NO: 4978588 - DNA, 18 bp, Homo sapiens
cagcaggtgattggacca

SEQ ID NO: 4978589 - DNA, 19 bp, Homo sapiens
cagcagtcctttgtaaaca

SEQ ID NO: 4978590 - DNA, 16 bp, Homo sapiens
cagcagtgcagccggg

SEQ ID NO: 4978591 - DNA, 12 bp, Homo sapiens
cagcagtgttcc

SEQ ID NO: 4978592 - DNA, 23 bp, Homo sapiens
cagcagtgttccccatctgggtc

SEQ ID NO: 4978593 - DNA, 17 bp, Homo sapiens
cagcatcctggcacccg

SEQ ID NO: 4978594 - DNA, 19 bp, Homo sapiens
cagcatcctggcacccggc

SEQ ID NO: 4978595 - DNA, 20 bp, Homo sapiens
cagcatcctggcacccggcc

SEQ ID NO: 4978596 - DNA, 15 bp, Homo sapiens
cagccacacccaggc

SEQ ID NO: 4978597 - DNA, 14 bp, Homo sapiens
cagccacggccagg

SEQ ID NO: 4978598 - DNA, 16 bp, Homo sapiens
cagccacggccaggcc

SEQ ID NO: 4978599 - DNA, 18 bp, Homo sapiens
cagccacggccaggccag

SEQ ID NO: 4978600 - DNA, 23 bp, Homo sapiens
cagccacggccaggccagaggga

SEQ ID NO: 4978601 - DNA, 18 bp, Homo sapiens
cagccagtgagatgaggg

SEQ ID NO: 4978602 - DNA, 21 bp, Homo sapiens
cagccatacttatctctctgt

SEQ ID NO: 4978603 - DNA, 16 bp, Homo sapiens
cagccatcaaaatgct

SEQ ID NO: 4978604 - DNA, 21 bp, Homo sapiens
cagccatgcccgcattagctc

SEQ ID NO: 4978605 - DNA, 13 bp, Homo sapiens
cagcccagagact

SEQ ID NO: 4978606 - DNA, 14 bp, Homo sapiens
cagcccagagactt

SEQ ID NO: 4978607 - DNA, 17 bp, Homo sapiens
cagcccagagactttgt

SEQ ID NO: 4978608 - DNA, 23 bp, Homo sapiens
cagcccagcttggccctttcctt

SEQ ID NO: 4978609 - DNA, 23 bp, Homo sapiens
cagcccaggccggggtggagcat

SEQ ID NO: 4978610 - DNA, 16 bp, Homo sapiens
cagcccatctcggagc

SEQ ID NO: 4978611 - DNA, 17 bp, Homo sapiens
cagcccatctcggagca

SEQ ID NO: 4978612 - DNA, 19 bp, Homo sapiens
cagcccatgcccacctgcc

SEQ ID NO: 4978613 - DNA, 21 bp, Homo sapiens
cagcccatgcccacctgccca

SEQ ID NO: 4978614 - DNA, 18 bp, Homo sapiens
cagcccatggccctgtgc

SEQ ID NO: 4978615 - DNA, 14 bp, Homo sapiens
cagccccacccagg

SEQ ID NO: 4978616 - DNA, 18 bp, Homo sapiens
cagccccactgccagcag

SEQ ID NO: 4978617 - DNA, 14 bp, Homo sapiens
cagccccagtgccc

SEQ ID NO: 4978618 - DNA, 16 bp, Homo sapiens
cagccccagtgcccac

SEQ ID NO: 4978619 - DNA, 13 bp, Homo sapiens
cagccccattctg

SEQ ID NO: 4978620 - DNA, 16 bp, Homo sapiens
cagccccattctgcct

SEQ ID NO: 4978621 - DNA, 17 bp, Homo sapiens
cagccccattctgcctg

SEQ ID NO: 4978622 - DNA, 17 bp, Homo sapiens
cagccccgagctgtccc

SEQ ID NO: 4978623 - DNA, 17 bp, Homo sapiens
cagccccggccctgggc

SEQ ID NO: 4978624 - DNA, 12 bp, Homo sapiens
cagcccctagaa

SEQ ID NO: 4978625 - DNA, 19 bp, Homo sapiens
cacggctcactgcagcctc

SEQ ID NO: 4978626 - DNA, 18 bp, Homo sapiens
cacgggacggaagtgctt

SEQ ID NO: 4978627 - DNA, 15 bp, Homo sapiens
cacggtagtgcctga

SEQ ID NO: 4978628 - DNA, 22 bp, Homo sapiens
cacggtatttatagagagagac

SEQ ID NO: 4978629 - DNA, 15 bp, Homo sapiens
cacgtacaaaatcca

SEQ ID NO: 4978630 - DNA, 19 bp, Homo sapiens
cacgtacacacacatacac

SEQ ID NO: 4978631 - DNA, 23 bp, Homo sapiens
cacgtggttggggccctgccctg

SEQ ID NO: 4978632 - DNA, 18 bp, Homo sapiens
cacgttccacagttgcca

SEQ ID NO: 4978633 - DNA, 15 bp, Homo sapiens
cactaaaattttagg

SEQ ID NO: 4978634 - DNA, 12 bp, Homo sapiens
cactaaagcagt

SEQ ID NO: 4978635 - DNA, 17 bp, Homo sapiens
cactaaagccagcctga

SEQ ID NO: 4978636 - DNA, 20 bp, Homo sapiens
cactaaagccagcctgacct

SEQ ID NO: 4978637 - DNA, 15 bp, Homo sapiens
cactaaatcagagac

SEQ ID NO: 4978638 - DNA, 20 bp, Homo sapiens
cactaacgttgagcccctgg

SEQ ID NO: 4978639 - DNA, 14 bp, Homo sapiens
cactaactcaccag

SEQ ID NO: 4978640 - DNA, 18 bp, Homo sapiens
cactaactcaccagcccc

SEQ ID NO: 4978641 - DNA, 21 bp, Homo sapiens
cactacatgcagcccatgccc

SEQ ID NO: 4978642 - DNA, 23 bp, Homo sapiens
cactacatgcagcccatgcccac

SEQ ID NO: 4978643 - DNA, 20 bp, Homo sapiens
cactacatgtggtttataga

SEQ ID NO: 4978644 - DNA, 15 bp, Homo sapiens
cactacattcattta

SEQ ID NO: 4978645 - DNA, 13 bp, Homo sapiens
cactactgggtgt

SEQ ID NO: 4978646 - DNA, 14 bp, Homo sapiens
cactactgggtgtc

SEQ ID NO: 4978647 - DNA, 21 bp, Homo sapiens
cactactgggtgtcatttcat

SEQ ID NO: 4978648 - DNA, 20 bp, Homo sapiens
cactagaaaagctgatcata

SEQ ID NO: 4978649 - DNA, 20 bp, Homo sapiens
cactagcctttggctctgga

SEQ ID NO: 4978650 - DNA, 19 bp, Homo sapiens
cactaggcacccagctgcc

SEQ ID NO: 4978651 - DNA, 17 bp, Homo sapiens
cactagtaagtaattat

SEQ ID NO: 4978652 - DNA, 13 bp, Homo sapiens
cactatccatgca

SEQ ID NO: 4978653 - DNA, 16 bp, Homo sapiens
cactatgttgcccagg

SEQ ID NO: 4978654 - DNA, 16 bp, Homo sapiens
cactcaagcactgata

SEQ ID NO: 4978655 - DNA, 13 bp, Homo sapiens
cactcaagcttgg

SEQ ID NO: 4978656 - DNA, 13 bp, Homo sapiens
cactcacatgaca

SEQ ID NO: 4978657 - DNA, 15 bp, Homo sapiens
attgtacatatttgt

SEQ ID NO: 4978658 - DNA, 18 bp, Homo sapiens
attgtactcaatggattt

SEQ ID NO: 4978659 - DNA, 22 bp, Homo sapiens
attgtactcaatggatttgatg

SEQ ID NO: 4978660 - DNA, 15 bp, Homo sapiens
attgtatgatgtgtt

SEQ ID NO: 4978661 - DNA, 22 bp, Homo sapiens
attgtcgaaaagagtcttccaa

SEQ ID NO: 4978662 - DNA, 20 bp, Homo sapiens
attgtcttttgtcatgtggc

SEQ ID NO: 4978663 - DNA, 14 bp, Homo sapiens
attgtgaactcatt

SEQ ID NO: 4978664 - DNA, 15 bp, Homo sapiens
attgtgcaaatggaa

SEQ ID NO: 4978665 - DNA, 17 bp, Homo sapiens
attgtgccaatatgtat

SEQ ID NO: 4978666 - DNA, 11 bp, Homo sapiens
attgtgctgcc

SEQ ID NO: 4978667 - DNA, 15 bp, Homo sapiens
attgtgcttcacagt

SEQ ID NO: 4978668 - DNA, 12 bp, Homo sapiens
attgtgcttctc

SEQ ID NO: 4978669 - DNA, 17 bp, Homo sapiens
attgtgcttctccccag

SEQ ID NO: 4978670 - DNA, 20 bp, Homo sapiens
attgtgcttctccccagaat

SEQ ID NO: 4978671 - DNA, 21 bp, Homo sapiens
attgtgggacttattacaatt

SEQ ID NO: 4978672 - DNA, 21 bp, Homo sapiens
attgtggtaggccttttaaca

SEQ ID NO: 4978673 - DNA, 22 bp, Homo sapiens
attgtggtaggccttttaacat

SEQ ID NO: 4978674 - DNA, 18 bp, Homo sapiens
attgtggtgtgagcttca

SEQ ID NO: 4978675 - DNA, 18 bp, Homo sapiens
attgttaatttcagtcct

SEQ ID NO: 4978676 - DNA, 17 bp, Homo sapiens
attgttactcttacgaa

SEQ ID NO: 4978677 - DNA, 18 bp, Homo sapiens
attgttagcttccttaag

SEQ ID NO: 4978678 - DNA, 15 bp, Homo sapiens
attgttgaaattttg

SEQ ID NO: 4978679 - DNA, 15 bp, Homo sapiens
attgttgtataattt

SEQ ID NO: 4978680 - DNA, 20 bp, Homo sapiens
attgttgtttctttctagtg

SEQ ID NO: 4978681 - DNA, 21 bp, Homo sapiens
attgtttggggatgagaaagg

SEQ ID NO: 4978682 - DNA, 17 bp, Homo sapiens
attgttttaatctgaaa

SEQ ID NO: 4978683 - DNA, 18 bp, Homo sapiens
attgttttaatctgaaat

SEQ ID NO: 4978684 - DNA, 19 bp, Homo sapiens
attgttttagagactatgg

SEQ ID NO: 4978685 - DNA, 10 bp, Homo sapiens
attgttttca

SEQ ID NO: 4978686 - DNA, 18 bp, Homo sapiens
attgttttctatttatgc

SEQ ID NO: 4978687 - DNA, 21 bp, Homo sapiens
attgttttctatttatgcctt

SEQ ID NO: 4978688 - DNA, 17 bp, Homo sapiens
attgttttgaatattac

SEQ ID NO: 4978689 - DNA, 13 bp, Homo sapiens
atttaaaaaataa

SEQ ID NO: 4978690 - DNA, 15 bp, Homo sapiens
atttaaaaaataact

SEQ ID NO: 4978691 - DNA, 15 bp, Homo sapiens
atttaaaaactggaa

SEQ ID NO: 4978692 - DNA, 17 bp, Homo sapiens
atttaaaattgctatgt

SEQ ID NO: 4978693 - DNA, 15 bp, Homo sapiens
atttaaacacacaga

SEQ ID NO: 4978694 - DNA, 14 bp, Homo sapiens
atttaaacagcagt

SEQ ID NO: 4978695 - DNA, 15 bp, Homo sapiens
atttaaacagcagtg

SEQ ID NO: 4978696 - DNA, 20 bp, Homo sapiens
atttaaacagcagtgttccc

SEQ ID NO: 4978697 - DNA, 12 bp, Homo sapiens
atttaaagcatt

SEQ ID NO: 4978698 - DNA, 16 bp, Homo sapiens
atttaaagcattgctt

SEQ ID NO: 4978699 - DNA, 15 bp, Homo sapiens
atttaaagcctcctc

SEQ ID NO: 4978700 - DNA, 13 bp, Homo sapiens
atttaaatataat

SEQ ID NO: 4978701 - DNA, 22 bp, Homo sapiens
atttaaatataattctgtaaat

SEQ ID NO: 4978702 - DNA, 16 bp, Homo sapiens
atttaaatgtgtacaa

SEQ ID NO: 4978703 - DNA, 19 bp, Homo sapiens
atttaaattttacccttta

SEQ ID NO: 4978704 - DNA, 13 bp, Homo sapiens
atttaacatgcaa

SEQ ID NO: 4978705 - DNA, 22 bp, Homo sapiens
atttaacatgcaacccgaaggt

SEQ ID NO: 4978706 - DNA, 16 bp, Homo sapiens
atttaacattatttat

SEQ ID NO: 4978707 - DNA, 21 bp, Homo sapiens
atttaactacccttaattact

SEQ ID NO: 4978708 - DNA, 22 bp, Homo sapiens
atttaactacccttaattactt

SEQ ID NO: 4978709 - DNA, 13 bp, Homo sapiens
atttaagcaaata

SEQ ID NO: 4978710 - DNA, 22 bp, Homo sapiens
atttaagcaaatacttagcaaa

SEQ ID NO: 4978711 - DNA, 15 bp, Homo sapiens
atttaagcacaaact

SEQ ID NO: 4978712 - DNA, 18 bp, Homo sapiens
atttaagcacaaacttta

SEQ ID NO: 4978713 - DNA, 16 bp, Homo sapiens
caccccggcaggccct

SEQ ID NO: 4978714 - DNA, 19 bp, Homo sapiens
caccccggcaggccctgca

SEQ ID NO: 4978715 - DNA, 18 bp, Homo sapiens
caccccggccccctgccc

SEQ ID NO: 4978716 - DNA, 15 bp, Homo sapiens
caccccgggctctct

SEQ ID NO: 4978717 - DNA, 14 bp, Homo sapiens
cacccctaaagaga

SEQ ID NO: 4978718 - DNA, 15 bp, Homo sapiens
cacccctaaagagat

SEQ ID NO: 4978719 - DNA, 17 bp, Homo sapiens
cacccctacccctggct

SEQ ID NO: 4978720 - DNA, 20 bp, Homo sapiens
cacccctgtcctcactgctc

SEQ ID NO: 4978721 - DNA, 21 bp, Homo sapiens
cacccctgtcctcactgctcc

SEQ ID NO: 4978722 - DNA, 23 bp, Homo sapiens
cacccctgtcctcactgctccct

SEQ ID NO: 4978723 - DNA, 21 bp, Homo sapiens
cacccggcccctgctggttca

SEQ ID NO: 4978724 - DNA, 18 bp, Homo sapiens
cacccgtgagcgcctgtg

SEQ ID NO: 4978725 - DNA, 23 bp, Homo sapiens
cacccgtgagcgcctgtgcacac

SEQ ID NO: 4978726 - DNA, 16 bp, Homo sapiens
caccctagtcccttcc

SEQ ID NO: 4978727 - DNA, 19 bp, Homo sapiens
caccctcactctgccaggg

SEQ ID NO: 4978728 - DNA, 22 bp, Homo sapiens
caccctcactctgccagggcag

SEQ ID NO: 4978729 - DNA, 14 bp, Homo sapiens
caccctccctggag

SEQ ID NO: 4978730 - DNA, 13 bp, Homo sapiens
caccctctggccg

SEQ ID NO: 4978731 - DNA, 20 bp, Homo sapiens
caccctgaggtcagggagtg

SEQ ID NO: 4978732 - DNA, 13 bp, Homo sapiens
caccctgcaaggc

SEQ ID NO: 4978733 - DNA, 16 bp, Homo sapiens
caccctggggagaaag

SEQ ID NO: 4978734 - DNA, 15 bp, Homo sapiens
caccctggggcctgg

SEQ ID NO: 4978735 - DNA, 19 bp, Homo sapiens
caccctggggcctggacct

SEQ ID NO: 4978736 - DNA, 21 bp, Homo sapiens
caccctggggcctggacctgc

SEQ ID NO: 4978737 - DNA, 22 bp, Homo sapiens
caccctggggcctggacctgcc

SEQ ID NO: 4978738 - DNA, 17 bp, Homo sapiens
caccctgtactgttctg

SEQ ID NO: 4978739 - DNA, 23 bp, Homo sapiens
caccctgtactgttctgtgtctt

SEQ ID NO: 4978740 - DNA, 17 bp, Homo sapiens
cacccttaacccaagga

SEQ ID NO: 4978741 - DNA, 18 bp, Homo sapiens
cacccttaacccaaggag

SEQ ID NO: 4978742 - DNA, 20 bp, Homo sapiens
cacccttaacccaaggagca

SEQ ID NO: 4978743 - DNA, 19 bp, Homo sapiens
cacccttagaaaatgtgtc

SEQ ID NO: 4978744 - DNA, 13 bp, Homo sapiens
cacccttcccctc

SEQ ID NO: 4978745 - DNA, 14 bp, Homo sapiens
cacccttcccctcc

SEQ ID NO: 4978746 - DNA, 14 bp, Homo sapiens
caagtgagagctgg

SEQ ID NO: 4978747 - DNA, 16 bp, Homo sapiens
caagtgcctgctttta

SEQ ID NO: 4978748 - DNA, 12 bp, Homo sapiens
caagtggacctt

SEQ ID NO: 4978749 - DNA, 22 bp, Homo sapiens
caagtggaccttaggccttcct

SEQ ID NO: 4978750 - DNA, 20 bp, Homo sapiens
caagtgggatctgtcacacc

SEQ ID NO: 4978751 - DNA, 14 bp, Homo sapiens
caagtgtgaacaaa

SEQ ID NO: 4978752 - DNA, 14 bp, Homo sapiens
caagttaagagaaa

SEQ ID NO: 4978753 - DNA, 20 bp, Homo sapiens
caataaaatcttgaaaatgc

SEQ ID NO: 4978754 - DNA, 18 bp, Homo sapiens
caataaacgcattatcag

SEQ ID NO: 4978755 - DNA, 14 bp, Homo sapiens
caataaatgtctgt

SEQ ID NO: 4978756 - DNA, 16 bp, Homo sapiens
caataaatgtctgttg

SEQ ID NO: 4978757 - DNA, 13 bp, Homo sapiens
caataacttctga

SEQ ID NO: 4978758 - DNA, 16 bp, Homo sapiens
caataattcatattct

SEQ ID NO: 4978759 - DNA, 19 bp, Homo sapiens
caatacaaacaatctctta

SEQ ID NO: 4978760 - DNA, 19 bp, Homo sapiens
caatagcaacgtagcttct

SEQ ID NO: 4978761 - DNA, 15 bp, Homo sapiens
caataggctgttccc

SEQ ID NO: 4978762 - DNA, 16 bp, Homo sapiens
caatagtttgcataga

SEQ ID NO: 4978763 - DNA, 22 bp, Homo sapiens
caatataaaaggcaaatgtgta

SEQ ID NO: 4978764 - DNA, 17 bp, Homo sapiens
caatatataaaaatata

SEQ ID NO: 4978765 - DNA, 15 bp, Homo sapiens
caatatctaatatat

SEQ ID NO: 4978766 - DNA, 16 bp, Homo sapiens
caatatctaatatata

SEQ ID NO: 4978767 - DNA, 21 bp, Homo sapiens
caatatgtaaatagtgcagaa

SEQ ID NO: 4978768 - DNA, 15 bp, Homo sapiens
caatattaaatctgc

SEQ ID NO: 4978769 - DNA, 15 bp, Homo sapiens
caatatttgaatttt

SEQ ID NO: 4978770 - DNA, 17 bp, Homo sapiens
caatcaaataagtattt

SEQ ID NO: 4978771 - DNA, 23 bp, Homo sapiens
caatcaaataagtatttataata

SEQ ID NO: 4978772 - DNA, 14 bp, Homo sapiens
caatcagcactgaa

SEQ ID NO: 4978773 - DNA, 20 bp, Homo sapiens
caatcatctgtgtgaaaatg

SEQ ID NO: 4978774 - DNA, 17 bp, Homo sapiens
caatcatgaaatatgca

SEQ ID NO: 4978775 - DNA, 17 bp, Homo sapiens
caatcattgttttgaat

SEQ ID NO: 4978776 - DNA, 17 bp, Homo sapiens
caatcatttctcactgt

SEQ ID NO: 4978777 - DNA, 22 bp, Homo sapiens
caatcccaccaaccctcagagc

SEQ ID NO: 4978778 - DNA, 19 bp, Homo sapiens
caatcctggctctgtggct

SEQ ID NO: 4978779 - DNA, 14 bp, Homo sapiens
caatctcaaggaat

SEQ ID NO: 4978780 - DNA, 18 bp, Homo sapiens
caatctcttaaattgggt

SEQ ID NO: 4978781 - DNA, 20 bp, Homo sapiens
caatgaaaagtcgttttcca

SEQ ID NO: 4978782 - DNA, 16 bp, Homo sapiens
caatgacatctcaggg

SEQ ID NO: 4978783 - DNA, 19 bp, Homo sapiens
caatgacatctcaggggcc

SEQ ID NO: 4978784 - DNA, 21 bp, Homo sapiens
caatgagactctagggtccag

SEQ ID NO: 4978785 - DNA, 21 bp, Homo sapiens
caatgatgaatgagaatctac

SEQ ID NO: 4978786 - DNA, 13 bp, Homo sapiens
caatgatggcaat

SEQ ID NO: 4978787 - DNA, 21 bp, Homo sapiens
caatgatggcaattttgtaac

SEQ ID NO: 4978788 - DNA, 21 bp, Homo sapiens
cacattagattttattttact

SEQ ID NO: 4978789 - DNA, 23 bp, Homo sapiens
cacattcagggctattttttccc

SEQ ID NO: 4978790 - DNA, 22 bp, Homo sapiens
cacattgagctgatataaattc

SEQ ID NO: 4978791 - DNA, 15 bp, Homo sapiens
cacattgcattctat

SEQ ID NO: 4978792 - DNA, 17 bp, Homo sapiens
cacattgttgttttttt

SEQ ID NO: 4978793 - DNA, 21 bp, Homo sapiens
cacattgttgtttttttaata

SEQ ID NO: 4978794 - DNA, 13 bp, Homo sapiens
cacatttaaggat

SEQ ID NO: 4978795 - DNA, 13 bp, Homo sapiens
cacatttctaaaa

SEQ ID NO: 4978796 - DNA, 22 bp, Homo sapiens
cacatttggttctaagaaaccc

SEQ ID NO: 4978797 - DNA, 11 bp, Homo sapiens
cacatttgtac

SEQ ID NO: 4978798 - DNA, 15 bp, Homo sapiens
caccaaagatgcagc

SEQ ID NO: 4978799 - DNA, 17 bp, Homo sapiens
caccaaagatgcagccg

SEQ ID NO: 4978800 - DNA, 13 bp, Homo sapiens
caccaaagctgcc

SEQ ID NO: 4978801 - DNA, 18 bp, Homo sapiens
caccaaagctgcccactg

SEQ ID NO: 4978802 - DNA, 13 bp, Homo sapiens
caccaaagttcta

SEQ ID NO: 4978803 - DNA, 13 bp, Homo sapiens
caccaaccctcag

SEQ ID NO: 4978804 - DNA, 15 bp, Homo sapiens
caccaaccgacaggc

SEQ ID NO: 4978805 - DNA, 12 bp, Homo sapiens
caccaagcccag

SEQ ID NO: 4978806 - DNA, 14 bp, Homo sapiens
caccacacccagcc

SEQ ID NO: 4978807 - DNA, 14 bp, Homo sapiens
caccacagacacac

SEQ ID NO: 4978808 - DNA, 21 bp, Homo sapiens
caccaccaaatgccaagaaaa

SEQ ID NO: 4978809 - DNA, 13 bp, Homo sapiens
caccacctctgtg

SEQ ID NO: 4978810 - DNA, 14 bp, Homo sapiens
caccacctctgtgg

SEQ ID NO: 4978811 - DNA, 22 bp, Homo sapiens
caccacggcgttgtacctgtag

SEQ ID NO: 4978812 - DNA, 17 bp, Homo sapiens
caccacggtagtgcctg

SEQ ID NO: 4978813 - DNA, 13 bp, Homo sapiens
caccactccattc

SEQ ID NO: 4978814 - DNA, 14 bp, Homo sapiens
caccactccattcc

SEQ ID NO: 4978815 - DNA, 15 bp, Homo sapiens
caccactccattccc

SEQ ID NO: 4978816 - DNA, 16 bp, Homo sapiens
caccactccattccca

SEQ ID NO: 4978817 - DNA, 20 bp, Homo sapiens
caccagagaccgtcctcacc

SEQ ID NO: 4978818 - DNA, 12 bp, Homo sapiens
caccagagcaga

SEQ ID NO: 4978819 - DNA, 17 bp, Homo sapiens
caccagagcagatgcag

SEQ ID NO: 4978820 - DNA, 20 bp, Homo sapiens
caccagagcagatgcagaga

SEQ ID NO: 4978821 - DNA, 15 bp, Homo sapiens
caccagagcccacct

SEQ ID NO: 4978822 - DNA, 18 bp, Homo sapiens
caccagagcccaccttgg

SEQ ID NO: 4978823 - DNA, 15 bp, Homo sapiens
caccagcatcacctg

SEQ ID NO: 4978824 - DNA, 20 bp, Homo sapiens
caccagcatcacctgcctgt

SEQ ID NO: 4978825 - DNA, 12 bp, Homo sapiens
caccagccagcg

SEQ ID NO: 4978826 - DNA, 20 bp, Homo sapiens
caccagccccactgccagca

SEQ ID NO: 4978827 - DNA, 22 bp, Homo sapiens
caccagccccactgccagcagc

SEQ ID NO: 4978828 - DNA, 13 bp, Homo sapiens
caccagccccagt

SEQ ID NO: 4978829 - DNA, 17 bp, Homo sapiens
caccagccccagtgccc

SEQ ID NO: 4978830 - DNA, 21 bp, Homo sapiens
caccagcccttagcagggaaa

SEQ ID NO: 4978831 - DNA, 19 bp, Homo sapiens
caccaggagaaccactaca

SEQ ID NO: 4978832 - DNA, 13 bp, Homo sapiens
caccagtgtcccc

SEQ ID NO: 4978833 - DNA, 16 bp, Homo sapiens
caccagtgtcccctcc

SEQ ID NO: 4978834 - DNA, 23 bp, Homo sapiens
caccagtgtggggttctgctggg

SEQ ID NO: 4978835 - DNA, 18 bp, Homo sapiens
caccatcatgtctggcta

SEQ ID NO: 4978836 - DNA, 14 bp, Homo sapiens
caccatgcttccag

SEQ ID NO: 4978837 - DNA, 20 bp, Homo sapiens
cacccaccatcatgtctggc

SEQ ID NO: 4978838 - DNA, 13 bp, Homo sapiens
cacccacctcagc

SEQ ID NO: 4978839 - DNA, 17 bp, Homo sapiens
cacccacctcagcctcc

SEQ ID NO: 4978840 - DNA, 16 bp, Homo sapiens
cacccagcccacttct

SEQ ID NO: 4978841 - DNA, 17 bp, Homo sapiens
cacccagcccacttctg

SEQ ID NO: 4978842 - DNA, 13 bp, Homo sapiens
cacccagcctcag

SEQ ID NO: 4978843 - DNA, 16 bp, Homo sapiens
cacccaggagccccga

SEQ ID NO: 4978844 - DNA, 20 bp, Homo sapiens
cacccaggagccccgaggcc

SEQ ID NO: 4978845 - DNA, 11 bp, Homo sapiens
cacccaggagg

SEQ ID NO: 4978846 - DNA, 20 bp, Homo sapiens
cacccaggctggagtgcagt

SEQ ID NO: 4978847 - DNA, 19 bp, Homo sapiens
cacccatgggctctgacag

SEQ ID NO: 4978848 - DNA, 20 bp, Homo sapiens
cacccatgggctctgacaga

SEQ ID NO: 4978849 - DNA, 21 bp, Homo sapiens
caccccaagtagtctgctcac

SEQ ID NO: 4978850 - DNA, 12 bp, Homo sapiens
caccccacactt

SEQ ID NO: 4978851 - DNA, 14 bp, Homo sapiens
caccccacccttcc

SEQ ID NO: 4978852 - DNA, 12 bp, Homo sapiens
caccccacctgc

SEQ ID NO: 4978853 - DNA, 14 bp, Homo sapiens
caccccacctgcag

SEQ ID NO: 4978854 - DNA, 15 bp, Homo sapiens
caccccatcccacac

SEQ ID NO: 4978855 - DNA, 12 bp, Homo sapiens
caccccatgcca

SEQ ID NO: 4978856 - DNA, 11 bp, Homo sapiens
cacccccaccc

SEQ ID NO: 4978857 - DNA, 14 bp, Homo sapiens
cacccccaccccca

SEQ ID NO: 4978858 - DNA, 12 bp, Homo sapiens
cacccccagctc

SEQ ID NO: 4978859 - DNA, 13 bp, Homo sapiens
cacccccttctct

SEQ ID NO: 4978860 - DNA, 12 bp, Homo sapiens
caccccctttcc

SEQ ID NO: 4978861 - DNA, 16 bp, Homo sapiens
caccccgcctgccctc

SEQ ID NO: 4978862 - DNA, 15 bp, Homo sapiens
caccccggcaggccc

SEQ ID NO: 4978863 - DNA, 15 bp, Homo sapiens
caaataaaaatattg

SEQ ID NO: 4978864 - DNA, 17 bp, Homo sapiens
caaataacttcagtcct

SEQ ID NO: 4978865 - DNA, 18 bp, Homo sapiens
caaataagtatttataat

SEQ ID NO: 4978866 - DNA, 19 bp, Homo sapiens
caaatacttagcaaaaagt

SEQ ID NO: 4978867 - DNA, 22 bp, Homo sapiens
caaatacttagcaaaaagtggg

SEQ ID NO: 4978868 - DNA, 20 bp, Homo sapiens
caaatagtttataaatgtga

SEQ ID NO: 4978869 - DNA, 15 bp, Homo sapiens
caaatataagatttt

SEQ ID NO: 4978870 - DNA, 11 bp, Homo sapiens
caaatatattg

SEQ ID NO: 4978871 - DNA, 22 bp, Homo sapiens
caaatatcttgtgttgtccttt

SEQ ID NO: 4978872 - DNA, 22 bp, Homo sapiens
caaatatgagtacaaatgcctt

SEQ ID NO: 4978873 - DNA, 15 bp, Homo sapiens
caaatattcagaata

SEQ ID NO: 4978874 - DNA, 18 bp, Homo sapiens
caaatattgttgacaact

SEQ ID NO: 4978875 - DNA, 22 bp, Homo sapiens
caaatattgttgacaactgtga

SEQ ID NO: 4978876 - DNA, 12 bp, Homo sapiens
caaatatttatt

SEQ ID NO: 4978877 - DNA, 20 bp, Homo sapiens
caaatatttattttctttct

SEQ ID NO: 4978878 - DNA, 21 bp, Homo sapiens
caaatcaacagaagcatttgt

SEQ ID NO: 4978879 - DNA, 17 bp, Homo sapiens
caaatccgctctcttcc

SEQ ID NO: 4978880 - DNA, 20 bp, Homo sapiens
caaatccgctctcttcctgc

SEQ ID NO: 4978881 - DNA, 22 bp, Homo sapiens
caaatccgctctcttcctgccc

SEQ ID NO: 4978882 - DNA, 18 bp, Homo sapiens
caaatccttccaaaaatt

SEQ ID NO: 4978883 - DNA, 21 bp, Homo sapiens
caaatctcaatgaagccagct

SEQ ID NO: 4978884 - DNA, 14 bp, Homo sapiens
caaatctgaagatt

SEQ ID NO: 4978885 - DNA, 18 bp, Homo sapiens
caaatctgtgtatattat

SEQ ID NO: 4978886 - DNA, 20 bp, Homo sapiens
caaatgacatgcactgaccc

SEQ ID NO: 4978887 - DNA, 16 bp, Homo sapiens
caaatgcatgaacaag

SEQ ID NO: 4978888 - DNA, 17 bp, Homo sapiens
caaatgcatgaacaagt

SEQ ID NO: 4978889 - DNA, 18 bp, Homo sapiens
caaatgccttaaaatgga

SEQ ID NO: 4978890 - DNA, 22 bp, Homo sapiens
caaatggcgtctggaagtccaa

SEQ ID NO: 4978891 - DNA, 15 bp, Homo sapiens
caaatggtaggcatt

SEQ ID NO: 4978892 - DNA, 12 bp, Homo sapiens
caaatgttctaa

SEQ ID NO: 4978893 - DNA, 15 bp, Homo sapiens
caaatgttctaagtt

SEQ ID NO: 4978894 - DNA, 22 bp, Homo sapiens
caaatgttctaagtttctaaga

SEQ ID NO: 4978895 - DNA, 22 bp, Homo sapiens
caaattaaaaagattctttttc

SEQ ID NO: 4978896 - DNA, 23 bp, Homo sapiens
caaattaaaaagattctttttct

SEQ ID NO: 4978897 - DNA, 19 bp, Homo sapiens
caaattataaaaagccact

SEQ ID NO: 4978898 - DNA, 12 bp, Homo sapiens
caaattatttgt

SEQ ID NO: 4978899 - DNA, 17 bp, Homo sapiens
caaattatttgtgtaat

SEQ ID NO: 4978900 - DNA, 19 bp, Homo sapiens
caaattgtgcttctcccca

SEQ ID NO: 4978901 - DNA, 16 bp, Homo sapiens
caaatttatcaaagca

SEQ ID NO: 4978902 - DNA, 15 bp, Homo sapiens
caacaagagtttatt

SEQ ID NO: 4978903 - DNA, 21 bp, Homo sapiens
caacaagatttccttgtgcaa

SEQ ID NO: 4978904 - DNA, 16 bp, Homo sapiens
caacacaataacacta

SEQ ID NO: 4978905 - DNA, 16 bp, Homo sapiens
caacacacctggtgaa

SEQ ID NO: 4978906 - DNA, 16 bp, Homo sapiens
caacacagaggaattt

SEQ ID NO: 4978907 - DNA, 23 bp, Homo sapiens
attttaatggattgttaatttca

SEQ ID NO: 4978908 - DNA, 14 bp, Homo sapiens
attttaatgtgatg

SEQ ID NO: 4978909 - DNA, 13 bp, Homo sapiens
attttaattgtca

SEQ ID NO: 4978910 - DNA, 15 bp, Homo sapiens
attttaattgtcatg

SEQ ID NO: 4978911 - DNA, 14 bp, Homo sapiens
attttacacagaaa

SEQ ID NO: 4978912 - DNA, 17 bp, Homo sapiens
attttacacagaaacac

SEQ ID NO: 4978913 - DNA, 22 bp, Homo sapiens
attttactccataaacagactg

SEQ ID NO: 4978914 - DNA, 21 bp, Homo sapiens
attttagaaacccctctgtag

SEQ ID NO: 4978915 - DNA, 21 bp, Homo sapiens
attttaggagctaaggctcta

SEQ ID NO: 4978916 - DNA, 16 bp, Homo sapiens
attttagtattcattc

SEQ ID NO: 4978917 - DNA, 19 bp, Homo sapiens
attttagtattcattctgc

SEQ ID NO: 4978918 - DNA, 16 bp, Homo sapiens
attttagtccaaataa

SEQ ID NO: 4978919 - DNA, 22 bp, Homo sapiens
attttcaaagctttttccagag

SEQ ID NO: 4978920 - DNA, 22 bp, Homo sapiens
attttcaagaaactgaggaatt

SEQ ID NO: 4978921 - DNA, 21 bp, Homo sapiens
attttcaagcagcatcttctg

SEQ ID NO: 4978922 - DNA, 13 bp, Homo sapiens
attttcactgtag

SEQ ID NO: 4978923 - DNA, 18 bp, Homo sapiens
attttcagtaatgttatt

SEQ ID NO: 4978924 - DNA, 19 bp, Homo sapiens
attttcataacttattgct

SEQ ID NO: 4978925 - DNA, 21 bp, Homo sapiens
attttcataacttattgctga

SEQ ID NO: 4978926 - DNA, 22 bp, Homo sapiens
attttcataacttattgctgat

SEQ ID NO: 4978927 - DNA, 22 bp, Homo sapiens
attttccccccactctccccac

SEQ ID NO: 4978928 - DNA, 16 bp, Homo sapiens
attttcctacaggcag

SEQ ID NO: 4978929 - DNA, 16 bp, Homo sapiens
attttcgtatgaaaat

SEQ ID NO: 4978930 - DNA, 18 bp, Homo sapiens
attttctaagcaatttct

SEQ ID NO: 4978931 - DNA, 17 bp, Homo sapiens
attttctataacagata

SEQ ID NO: 4978932 - DNA, 14 bp, Homo sapiens
attttctatgtact

SEQ ID NO: 4978933 - DNA, 22 bp, Homo sapiens
attttctatgtactagtactgt

SEQ ID NO: 4978934 - DNA, 20 bp, Homo sapiens
attttctcaaaagcatttat

SEQ ID NO: 4978935 - DNA, 18 bp, Homo sapiens
attttctggaatacatga

SEQ ID NO: 4978936 - DNA, 19 bp, Homo sapiens
attttctggttctaacatt

SEQ ID NO: 4978937 - DNA, 12 bp, Homo sapiens
attttctgtcag

SEQ ID NO: 4978938 - DNA, 20 bp, Homo sapiens
attttctgtcagatgagaac

SEQ ID NO: 4978939 - DNA, 18 bp, Homo sapiens
attttcttttgaattgtt

SEQ ID NO: 4978940 - DNA, 20 bp, Homo sapiens
attttcttttgaattgtttt

SEQ ID NO: 4978941 - DNA, 18 bp, Homo sapiens
attttgaaaagcttctta

SEQ ID NO: 4978942 - DNA, 20 bp, Homo sapiens
attttgaaaagcttcttaat

SEQ ID NO: 4978943 - DNA, 17 bp, Homo sapiens
attttgaagtttacatt

SEQ ID NO: 4978944 - DNA, 19 bp, Homo sapiens
attttgaagtttacatttt

SEQ ID NO: 4978945 - DNA, 22 bp, Homo sapiens
attttgaataccattaaaactg

SEQ ID NO: 4978946 - DNA, 17 bp, Homo sapiens
attttgaggtaaagata

SEQ ID NO: 4978947 - DNA, 18 bp, Homo sapiens
attttgaggtaaagatat

SEQ ID NO: 4978948 - DNA, 13 bp, Homo sapiens
attttgataataa

SEQ ID NO: 4978949 - DNA, 16 bp, Homo sapiens
attttgataataatat

SEQ ID NO: 4978950 - DNA, 16 bp, Homo sapiens
attttgatgcagcatt

SEQ ID NO: 4978951 - DNA, 17 bp, Homo sapiens
attttgatgcagcattt

SEQ ID NO: 4978952 - DNA, 22 bp, Homo sapiens
attttgatgcagcatttgataa

SEQ ID NO: 4978953 - DNA, 21 bp, Homo sapiens
attttgcctcttttctctgtg

SEQ ID NO: 4978954 - DNA, 22 bp, Homo sapiens
attttgggacaattgttttaat

SEQ ID NO: 4978955 - DNA, 11 bp, Homo sapiens
attttggggtc

SEQ ID NO: 4978956 - DNA, 17 bp, Homo sapiens
caaaccccaccctagtt

SEQ ID NO: 4978957 - DNA, 23 bp, Homo sapiens
caaaccccctccttacgctttgt

SEQ ID NO: 4978958 - DNA, 18 bp, Homo sapiens
caaaccccgaccacctgc

SEQ ID NO: 4978959 - DNA, 15 bp, Homo sapiens
caaacctaccaaaat

SEQ ID NO: 4978960 - DNA, 17 bp, Homo sapiens
caaacgcctagattgct

SEQ ID NO: 4978961 - DNA, 14 bp, Homo sapiens
caaacgcctcccct

SEQ ID NO: 4978962 - DNA, 20 bp, Homo sapiens
caaactacagacctgctttt

SEQ ID NO: 4978963 - DNA, 20 bp, Homo sapiens
caaactggagtctggagtgg

SEQ ID NO: 4978964 - DNA, 16 bp, Homo sapiens
caaactggggcctcca

SEQ ID NO: 4978965 - DNA, 12 bp, Homo sapiens
caaactgtaaat

SEQ ID NO: 4978966 - DNA, 14 bp, Homo sapiens
caaactgtaaataa

SEQ ID NO: 4978967 - DNA, 14 bp, Homo sapiens
caaactgtgaagca

SEQ ID NO: 4978968 - DNA, 14 bp, Homo sapiens
caaacttactattt

SEQ ID NO: 4978969 - DNA, 19 bp, Homo sapiens
caaagaaagaaagtttaga

SEQ ID NO: 4978970 - DNA, 13 bp, Homo sapiens
caaagaaatgaac

SEQ ID NO: 4978971 - DNA, 19 bp, Homo sapiens
caaagaaatgaacattcca

SEQ ID NO: 4978972 - DNA, 20 bp, Homo sapiens
caaagaggactcgcttgtaa

SEQ ID NO: 4978973 - DNA, 21 bp, Homo sapiens
caaagaggactcgcttgtaaa

SEQ ID NO: 4978974 - DNA, 21 bp, Homo sapiens
caaagaggctgcccctctcac

SEQ ID NO: 4978975 - DNA, 13 bp, Homo sapiens
caaagaggtattt

SEQ ID NO: 4978976 - DNA, 24 bp, Homo sapiens
caaagagttctggaaaagaactgt

SEQ ID NO: 4978977 - DNA, 14 bp, Homo sapiens
caaagatcaaaata

SEQ ID NO: 4978978 - DNA, 15 bp, Homo sapiens
caaagatcaaaataa

SEQ ID NO: 4978979 - DNA, 15 bp, Homo sapiens
caaagatgcagccgc

SEQ ID NO: 4978980 - DNA, 16 bp, Homo sapiens
caaagatggctcagag

SEQ ID NO: 4978981 - DNA, 17 bp, Homo sapiens
caaagatggctcagagg

SEQ ID NO: 4978982 - DNA, 14 bp, Homo sapiens
caaagcacagtgtt

SEQ ID NO: 4978983 - DNA, 16 bp, Homo sapiens
caaagcacagtttgaa

SEQ ID NO: 4978984 - DNA, 19 bp, Homo sapiens
caaagcatagatgttttgg

SEQ ID NO: 4978985 - DNA, 21 bp, Homo sapiens
caaagccaaagctaggcctgg

SEQ ID NO: 4978986 - DNA, 22 bp, Homo sapiens
caaagccaaagctaggcctggc

SEQ ID NO: 4978987 - DNA, 22 bp, Homo sapiens
caaagccagggtctctccctca

SEQ ID NO: 4978988 - DNA, 17 bp, Homo sapiens
caaagctaggcctggcc

SEQ ID NO: 4978989 - DNA, 19 bp, Homo sapiens
caaagctaggcctggccag

SEQ ID NO: 4978990 - DNA, 18 bp, Homo sapiens
caaagctcaaataaaaat

SEQ ID NO: 4978991 - DNA, 19 bp, Homo sapiens
caaagctgatgacaacttc

SEQ ID NO: 4978992 - DNA, 16 bp, Homo sapiens
caaagctggctcacct

SEQ ID NO: 4978993 - DNA, 12 bp, Homo sapiens
caaagctgttaa

SEQ ID NO: 4978994 - DNA, 13 bp, Homo sapiens
caaagctgttaaa

SEQ ID NO: 4978995 - DNA, 20 bp, Homo sapiens
caaaggacattatgtgtgca

SEQ ID NO: 4978996 - DNA, 14 bp, Homo sapiens
caaaggcaagttaa

SEQ ID NO: 4978997 - DNA, 13 bp, Homo sapiens
caaaggcccccta

SEQ ID NO: 4978998 - DNA, 15 bp, Homo sapiens
caaagggaaatatca

SEQ ID NO: 4978999 - DNA, 18 bp, Homo sapiens
caaaggggacaggcctca

SEQ ID NO: 4979000 - DNA, 23 bp, Homo sapiens
caaaggggatcataaagttagaa

SEQ ID NO: 4979001 - DNA, 18 bp, Homo sapiens
caaaggtctttttaaacc

SEQ ID NO: 4979002 - DNA, 20 bp, Homo sapiens
caaaggtctttttaaaccag

SEQ ID NO: 4979003 - DNA, 12 bp, Homo sapiens
caaaggttctag

SEQ ID NO: 4979004 - DNA, 19 bp, Homo sapiens
caaaggttctaggtttcaa

SEQ ID NO: 4979005 - DNA, 11 bp, Homo sapiens
caaaggttttc

SEQ ID NO: 4979006 - DNA, 20 bp, Homo sapiens
caaagtacaatgtgtttttc

SEQ ID NO: 4979007 - DNA, 19 bp, Homo sapiens
caaagtcctttttttccat

SEQ ID NO: 4979008 - DNA, 14 bp, Homo sapiens
caaagtctctaatt

SEQ ID NO: 4979009 - DNA, 16 bp, Homo sapiens
caaagtctttggggtc

SEQ ID NO: 4979010 - DNA, 16 bp, Homo sapiens
caaagtgccactcatt

SEQ ID NO: 4979011 - DNA, 22 bp, Homo sapiens
caaagtgccactcattcctgta

SEQ ID NO: 4979012 - DNA, 13 bp, Homo sapiens
caaagtgctggga

SEQ ID NO: 4979013 - DNA, 13 bp, Homo sapiens
caaagttatccag

SEQ ID NO: 4979014 - DNA, 20 bp, Homo sapiens
caaagttccctacttcctgt

SEQ ID NO: 4979015 - DNA, 21 bp, Homo sapiens
caaagttccctacttcctgtg

SEQ ID NO: 4979016 - DNA, 21 bp, Homo sapiens
caaagttctaataatttctaa

SEQ ID NO: 4979017 - DNA, 22 bp, Homo sapiens
caaagtttcctaatcagaaatt

SEQ ID NO: 4979018 - DNA, 17 bp, Homo sapiens
caaagttttgaaaagct

SEQ ID NO: 4979019 - DNA, 18 bp, Homo sapiens
caaagttttgaaaagcta

SEQ ID NO: 4979020 - DNA, 14 bp, Homo sapiens
actatttaaactta

SEQ ID NO: 4979021 - DNA, 20 bp, Homo sapiens
actatttaaagcctcctcat

SEQ ID NO: 4979022 - DNA, 22 bp, Homo sapiens
actatttctacacagtgggaac

SEQ ID NO: 4979023 - DNA, 22 bp, Homo sapiens
actatttctgggtcttttgcta

SEQ ID NO: 4979024 - DNA, 23 bp, Homo sapiens
actatttctgggtcttttgctac

SEQ ID NO: 4979025 - DNA, 18 bp, Homo sapiens
actatttgtctttcagga

SEQ ID NO: 4979026 - DNA, 19 bp, Homo sapiens
actcaaaatatttgtacat

SEQ ID NO: 4979027 - DNA, 16 bp, Homo sapiens
actcaatgcactgaca

SEQ ID NO: 4979028 - DNA, 22 bp, Homo sapiens
actcacaagtgctcatctgttg

SEQ ID NO: 4979029 - DNA, 23 bp, Homo sapiens
actcacaggttggaagagaatca

SEQ ID NO: 4979030 - DNA, 19 bp, Homo sapiens
actcacatttattctgctc

SEQ ID NO: 4979031 - DNA, 21 bp, Homo sapiens
actcacatttattctgctcac

SEQ ID NO: 4979032 - DNA, 21 bp, Homo sapiens
actcaccagccccactgccag

SEQ ID NO: 4979033 - DNA, 19 bp, Homo sapiens
actcaccccggcagacgcc

SEQ ID NO: 4979034 - DNA, 12 bp, Homo sapiens
actcactgaagc

SEQ ID NO: 4979035 - DNA, 14 bp, Homo sapiens
actcactgaagcct

SEQ ID NO: 4979036 - DNA, 15 bp, Homo sapiens
actcactgaagcctg

SEQ ID NO: 4979037 - DNA, 18 bp, Homo sapiens
actcactgaagcctgcgt

SEQ ID NO: 4979038 - DNA, 16 bp, Homo sapiens
actcagaagacactga

SEQ ID NO: 4979039 - DNA, 18 bp, Homo sapiens
actcagaagacactgatg

SEQ ID NO: 4979040 - DNA, 16 bp, Homo sapiens
actcagcccctaggag

SEQ ID NO: 4979041 - DNA, 16 bp, Homo sapiens
actcagcctgctgccc

SEQ ID NO: 4979042 - DNA, 18 bp, Homo sapiens
actcagcctgctgcccag

SEQ ID NO: 4979043 - DNA, 22 bp, Homo sapiens
actcagcctgctgcccaggctg

SEQ ID NO: 4979044 - DNA, 17 bp, Homo sapiens
actcaggaggctgaggc

SEQ ID NO: 4979045 - DNA, 15 bp, Homo sapiens
actcagggacagagc

SEQ ID NO: 4979046 - DNA, 17 bp, Homo sapiens
atgtgtggtggcctcag

SEQ ID NO: 4979047 - DNA, 19 bp, Homo sapiens
atgtgtggtggcctcagct

SEQ ID NO: 4979048 - DNA, 20 bp, Homo sapiens
atgtgtgtatatatgtgtat

SEQ ID NO: 4979049 - DNA, 14 bp, Homo sapiens
atgtgttgtgatag

SEQ ID NO: 4979050 - DNA, 15 bp, Homo sapiens
atgtgtttactttaa

SEQ ID NO: 4979051 - DNA, 15 bp, Homo sapiens
atgtgtttttctcca

SEQ ID NO: 4979052 - DNA, 15 bp, Homo sapiens
atgttaaatttgtaa

SEQ ID NO: 4979053 - DNA, 23 bp, Homo sapiens
atgttaaatttgtaagtttcagg

SEQ ID NO: 4979054 - DNA, 13 bp, Homo sapiens
atgttaaggaaac

SEQ ID NO: 4979055 - DNA, 17 bp, Homo sapiens
atgttaaggaaactctt

SEQ ID NO: 4979056 - DNA, 19 bp, Homo sapiens
atgttaaggaaactcttat

SEQ ID NO: 4979057 - DNA, 23 bp, Homo sapiens
atgttaaggaaactcttatctca

SEQ ID NO: 4979058 - DNA, 21 bp, Homo sapiens
atgttactattttctacaatt

SEQ ID NO: 4979059 - DNA, 22 bp, Homo sapiens
atgttagtcattgttatttata

SEQ ID NO: 4979060 - DNA, 13 bp, Homo sapiens
atgttatatattt

SEQ ID NO: 4979061 - DNA, 17 bp, Homo sapiens
atgttatatattttttg

SEQ ID NO: 4979062 - DNA, 20 bp, Homo sapiens
atgttatcttctcaagttct

SEQ ID NO: 4979063 - DNA, 21 bp, Homo sapiens
atgttatcttctcaagttcta

SEQ ID NO: 4979064 - DNA, 18 bp, Homo sapiens
atgttatgactatgtaaa

SEQ ID NO: 4979065 - DNA, 17 bp, Homo sapiens
atgttatttctgcaaac

SEQ ID NO: 4979066 - DNA, 19 bp, Homo sapiens
atgttattttcttctaagt

SEQ ID NO: 4979067 - DNA, 19 bp, Homo sapiens
atgttcacgcaacttgaaa

SEQ ID NO: 4979068 - DNA, 13 bp, Homo sapiens
atgttctaaggct

SEQ ID NO: 4979069 - DNA, 14 bp, Homo sapiens
atgttctaaggctc

SEQ ID NO: 4979070 - DNA, 15 bp, Homo sapiens
atgttctaaggctct

SEQ ID NO: 4979071 - DNA, 18 bp, Homo sapiens
atgttctaaggctctgag

SEQ ID NO: 4979072 - DNA, 22 bp, Homo sapiens
atgttctaaggctctgagagtc

SEQ ID NO: 4979073 - DNA, 13 bp, Homo sapiens
atgttctaagttt

SEQ ID NO: 4979074 - DNA, 19 bp, Homo sapiens
atgttctaagtttctaaga

SEQ ID NO: 4979075 - DNA, 13 bp, Homo sapiens
atgttctctgagg

SEQ ID NO: 4979076 - DNA, 18 bp, Homo sapiens
atgttctctgaggacact

SEQ ID NO: 4979077 - DNA, 14 bp, Homo sapiens
atgttctgccccca

SEQ ID NO: 4979078 - DNA, 14 bp, Homo sapiens
atgttctgggacac

SEQ ID NO: 4979079 - DNA, 21 bp, Homo sapiens
atgttctgtgcctgtaaacat

SEQ ID NO: 4979080 - DNA, 19 bp, Homo sapiens
atgttcttgcagtcatcag

SEQ ID NO: 4979081 - DNA, 15 bp, Homo sapiens
atgttgaatactttt

SEQ ID NO: 4979082 - DNA, 16 bp, Homo sapiens
atgttgatttttactg

SEQ ID NO: 4979083 - DNA, 23 bp, Homo sapiens
atgttgatttttactgtgtttta

SEQ ID NO: 4979084 - DNA, 14 bp, Homo sapiens
atgttgcccaggca

SEQ ID NO: 4979085 - DNA, 19 bp, Homo sapiens
atgttggacacctttaggt

SEQ ID NO: 4979086 - DNA, 13 bp, Homo sapiens
atgttggccaggc

SEQ ID NO: 4979087 - DNA, 14 bp, Homo sapiens
atgttggccaggct

SEQ ID NO: 4979088 - DNA, 16 bp, Homo sapiens
atgttggccaggctgg

SEQ ID NO: 4979089 - DNA, 21 bp, Homo sapiens
atgttggccaggctggtctaa

SEQ ID NO: 4979090 - DNA, 14 bp, Homo sapiens
atgttggtgttcca

SEQ ID NO: 4979091 - DNA, 16 bp, Homo sapiens
atgttgtaatgctgca

SEQ ID NO: 4979092 - DNA, 18 bp, Homo sapiens
atgttgtaatgctgcact

SEQ ID NO: 4979093 - DNA, 11 bp, Homo sapiens
atgttgtacaa

SEQ ID NO: 4979094 - DNA, 16 bp, Homo sapiens
atgttgttatgctatt

SEQ ID NO: 4979095 - DNA, 17 bp, Homo sapiens
atgtttaatctgttatg

SEQ ID NO: 4979096 - DNA, 22 bp, Homo sapiens
atgtttacaggtggacacacaa

SEQ ID NO: 4979097 - DNA, 21 bp, Homo sapiens
atgtttagatagggctgggca

SEQ ID NO: 4979098 - DNA, 18 bp, Homo sapiens
atgtttatgaaaataaat

SEQ ID NO: 4979099 - DNA, 19 bp, Homo sapiens
atgtttattcttctagagt

SEQ ID NO: 4979100 - DNA, 13 bp, Homo sapiens
atgtttccagcag

SEQ ID NO: 4979101 - DNA, 14 bp, Homo sapiens
atgtttcttaacta

SEQ ID NO: 4979102 - DNA, 22 bp, Homo sapiens
atgtttgaaatgaggtctgttt

SEQ ID NO: 4979103 - DNA, 17 bp, Homo sapiens
atgtttgaatatggaca

SEQ ID NO: 4979104 - DNA, 18 bp, Homo sapiens
atgtttgaggagcatgtt

SEQ ID NO: 4979105 - DNA, 13 bp, Homo sapiens
atgtttgcagggg

SEQ ID NO: 4979106 - DNA, 14 bp, Homo sapiens
atgtttgcctctgc

SEQ ID NO: 4979107 - DNA, 17 bp, Homo sapiens
atgtttgcctctgcctc

SEQ ID NO: 4979108 - DNA, 21 bp, Homo sapiens
atgtttggtgcatagaactgg

SEQ ID NO: 4979109 - DNA, 14 bp, Homo sapiens
atgtttgtggcctc

SEQ ID NO: 4979110 - DNA, 20 bp, Homo sapiens
atgttttaccgtaataatta

SEQ ID NO: 4979111 - DNA, 18 bp, Homo sapiens
atgttttattatttctat

SEQ ID NO: 4979112 - DNA, 20 bp, Homo sapiens
atgttttgtatacaaatata

SEQ ID NO: 4979113 - DNA, 19 bp, Homo sapiens
atgttttgtgactatatag

SEQ ID NO: 4979114 - DNA, 18 bp, Homo sapiens
atgtttttaaaagtttca

SEQ ID NO: 4979115 - DNA, 23 bp, Homo sapiens
atgtttttaaaagtttcaatgtg

SEQ ID NO: 4979116 - DNA, 12 bp, Homo sapiens
atgtttttatac

SEQ ID NO: 4979117 - DNA, 15 bp, Homo sapiens
atgtttttatacaaa

SEQ ID NO: 4979118 - DNA, 21 bp, Homo sapiens
atgtttttctgccagggagct

SEQ ID NO: 4979119 - DNA, 14 bp, Homo sapiens
attaaaaaaaaaga

SEQ ID NO: 4979120 - DNA, 16 bp, Homo sapiens
attaaaaagattcttt

SEQ ID NO: 4979121 - DNA, 14 bp, Homo sapiens
attaaaaatatgga

SEQ ID NO: 4979122 - DNA, 13 bp, Homo sapiens
attaaaacattgg

SEQ ID NO: 4979123 - DNA, 21 bp, Homo sapiens
attaaaacttcttaaatatct

SEQ ID NO: 4979124 - DNA, 22 bp, Homo sapiens
attaaaacttcttaaatatctt

SEQ ID NO: 4979125 - DNA, 12 bp, Homo sapiens
attaaacagatg

SEQ ID NO: 4979126 - DNA, 14 bp, Homo sapiens
attaaacagatgat

SEQ ID NO: 4979127 - DNA, 19 bp, Homo sapiens
attaaacagatgatgagaa

SEQ ID NO: 4979128 - DNA, 15 bp, Homo sapiens
attaaacataaaaca

SEQ ID NO: 4979129 - DNA, 16 bp, Homo sapiens
attaaacataaaacaa

SEQ ID NO: 4979130 - DNA, 18 bp, Homo sapiens
attaaagtgctaaggttc

SEQ ID NO: 4979131 - DNA, 19 bp, Homo sapiens
attaaagtgctaaggttct

SEQ ID NO: 4979132 - DNA, 23 bp, Homo sapiens
attaaagtgctaaggttctaagg

SEQ ID NO: 4979133 - DNA, 17 bp, Homo sapiens
attaaataagattctaa

SEQ ID NO: 4979134 - DNA, 22 bp, Homo sapiens
attaaatatagattagaaaaat

SEQ ID NO: 4979135 - DNA, 11 bp, Homo sapiens
attaaatctgt

SEQ ID NO: 4979136 - DNA, 22 bp, Homo sapiens
attaaatgaatattttgataat

SEQ ID NO: 4979137 - DNA, 11 bp, Homo sapiens
attaaatgttt

SEQ ID NO: 4979138 - DNA, 17 bp, Homo sapiens
attaaattcacaaactt

SEQ ID NO: 4979139 - DNA, 12 bp, Homo sapiens
attaacttattt

SEQ ID NO: 4979140 - DNA, 14 bp, Homo sapiens
attaacttatttag

SEQ ID NO: 4979141 - DNA, 19 bp, Homo sapiens
attaagaaggcaaaaatgt

SEQ ID NO: 4979142 - DNA, 16 bp, Homo sapiens
attaagatacaaatta

SEQ ID NO: 4979143 - DNA, 18 bp, Homo sapiens
attaagtaatcaataaag

SEQ ID NO: 4979144 - DNA, 16 bp, Homo sapiens
attaataaaaaatgga

SEQ ID NO: 4979145 - DNA, 19 bp, Homo sapiens
attaatagcttttattgta

SEQ ID NO: 4979146 - DNA, 14 bp, Homo sapiens
attaatcatctata

SEQ ID NO: 4979147 - DNA, 20 bp, Homo sapiens
attaatgccattatccctga

SEQ ID NO: 4979148 - DNA, 23 bp, Homo sapiens
attaatgtacttgtttctctgtt

SEQ ID NO: 4979149 - DNA, 18 bp, Homo sapiens
attaatgtttctatctga

SEQ ID NO: 4979150 - DNA, 16 bp, Homo sapiens
attaattaaacattgt

SEQ ID NO: 4979151 - DNA, 17 bp, Homo sapiens
attaatttgattaacaa

SEQ ID NO: 4979152 - DNA, 15 bp, Homo sapiens
attaatttgcatctg

SEQ ID NO: 4979153 - DNA, 13 bp, Homo sapiens
attaattttactc

SEQ ID NO: 4979154 - DNA, 16 bp, Homo sapiens
attaattttttttcat

SEQ ID NO: 4979155 - DNA, 10 bp, Homo sapiens
attacaaata

SEQ ID NO: 4979156 - DNA, 17 bp, Homo sapiens
attctctgtgtctaaga

SEQ ID NO: 4979157 - DNA, 15 bp, Homo sapiens
attctcttgtataag

SEQ ID NO: 4979158 - DNA, 18 bp, Homo sapiens
attctcttgtataagatc

SEQ ID NO: 4979159 - DNA, 20 bp, Homo sapiens
attctcttgtataagatcct

SEQ ID NO: 4979160 - DNA, 22 bp, Homo sapiens
attctcttgtataagatcctag

SEQ ID NO: 4979161 - DNA, 17 bp, Homo sapiens
attctcttttatctgtt

SEQ ID NO: 4979162 - DNA, 15 bp, Homo sapiens
attctgaagcaacat

SEQ ID NO: 4979163 - DNA, 14 bp, Homo sapiens
attctgagaaaaca

SEQ ID NO: 4979164 - DNA, 19 bp, Homo sapiens
attctgagacatgtgtcaa

SEQ ID NO: 4979165 - DNA, 23 bp, Homo sapiens
attctgcagtaaatcttttacaa

SEQ ID NO: 4979166 - DNA, 19 bp, Homo sapiens
attctgcattgctagataa

SEQ ID NO: 4979167 - DNA, 19 bp, Homo sapiens
attctgcccaaaaatatgg

SEQ ID NO: 4979168 - DNA, 18 bp, Homo sapiens
attctgctcacatatctg

SEQ ID NO: 4979169 - DNA, 15 bp, Homo sapiens
attctggagatactg

SEQ ID NO: 4979170 - DNA, 17 bp, Homo sapiens
attctgtggaacaagcc

SEQ ID NO: 4979171 - DNA, 12 bp, Homo sapiens
attctgttaaaa

SEQ ID NO: 4979172 - DNA, 19 bp, Homo sapiens
attctgttggccagtgtga

SEQ ID NO: 4979173 - DNA, 19 bp, Homo sapiens
attcttacactgcctgtat

SEQ ID NO: 4979174 - DNA, 20 bp, Homo sapiens
attcttcagcgtaaaatggt

SEQ ID NO: 4979175 - DNA, 20 bp, Homo sapiens
attcttcagttggttgtgtc

SEQ ID NO: 4979176 - DNA, 23 bp, Homo sapiens
attcttcagttggttgtgtcttt

SEQ ID NO: 4979177 - DNA, 19 bp, Homo sapiens
attcttcctagttttctcc

SEQ ID NO: 4979178 - DNA, 10 bp, Homo sapiens
attcttcctt

SEQ ID NO: 4979179 - DNA, 12 bp, Homo sapiens
attcttctgctt

SEQ ID NO: 4979180 - DNA, 14 bp, Homo sapiens
attcttctgcttca

SEQ ID NO: 4979181 - DNA, 20 bp, Homo sapiens
attcttctgcttcagcctcc

SEQ ID NO: 4979182 - DNA, 15 bp, Homo sapiens
attcttctgtgttta

SEQ ID NO: 4979183 - DNA, 15 bp, Homo sapiens
attcttgaaggaaaa

SEQ ID NO: 4979184 - DNA, 18 bp, Homo sapiens
attcttgttttctttctt

SEQ ID NO: 4979185 - DNA, 14 bp, Homo sapiens
attcttttaacttc

SEQ ID NO: 4979186 - DNA, 17 bp, Homo sapiens
attcttttaacttcttt

SEQ ID NO: 4979187 - DNA, 15 bp, Homo sapiens
attgaaaatcttgtg

SEQ ID NO: 4979188 - DNA, 14 bp, Homo sapiens
attgaaaatgaatg

SEQ ID NO: 4979189 - DNA, 17 bp, Homo sapiens
attgaacacaaactgta

SEQ ID NO: 4979190 - DNA, 19 bp, Homo sapiens
attgaacacaaactgtaaa

SEQ ID NO: 4979191 - DNA, 14 bp, Homo sapiens
attgaagacaattt

SEQ ID NO: 4979192 - DNA, 23 bp, Homo sapiens
attgaagagagatatatctgaaa

SEQ ID NO: 4979193 - DNA, 15 bp, Homo sapiens
attgaatattgtgtt

SEQ ID NO: 4979194 - DNA, 16 bp, Homo sapiens
attgaatgtttccaac

SEQ ID NO: 4979195 - DNA, 18 bp, Homo sapiens
attgacaaatctgtgtat

SEQ ID NO: 4979196 - DNA, 14 bp, Homo sapiens
attgacacagaaaa

SEQ ID NO: 4979197 - DNA, 17 bp, Homo sapiens
attgacacagaaaatgt

SEQ ID NO: 4979198 - DNA, 13 bp, Homo sapiens
attgacagaagct

SEQ ID NO: 4979199 - DNA, 15 bp, Homo sapiens
attgaccatctgctt

SEQ ID NO: 4979200 - DNA, 17 bp, Homo sapiens
attgaccgcgactaatt

SEQ ID NO: 4979201 - DNA, 20 bp, Homo sapiens
attgaccgcgactaatttca

SEQ ID NO: 4979202 - DNA, 12 bp, Homo sapiens
attgacctgctc

SEQ ID NO: 4979203 - DNA, 15 bp, Homo sapiens
attgacggtttttta

SEQ ID NO: 4979204 - DNA, 22 bp, Homo sapiens
attgactattttcgttcattac

SEQ ID NO: 4979205 - DNA, 14 bp, Homo sapiens
attgacttcaatga

SEQ ID NO: 4979206 - DNA, 20 bp, Homo sapiens
attgagaaaaatatatacta

SEQ ID NO: 4979207 - DNA, 13 bp, Homo sapiens
attgagaaggaga

SEQ ID NO: 4979208 - DNA, 17 bp, Homo sapiens
attgagaaggagagaaa

SEQ ID NO: 4979209 - DNA, 16 bp, Homo sapiens
attgagagttttgtct

SEQ ID NO: 4979210 - DNA, 19 bp, Homo sapiens
attgagctgatataaattc

SEQ ID NO: 4979211 - DNA, 12 bp, Homo sapiens
attgaggaagag

SEQ ID NO: 4979212 - DNA, 20 bp, Homo sapiens
attgagtttgtaggtaaaat

SEQ ID NO: 4979213 - DNA, 19 bp, Homo sapiens
attgatcattttcccccca

SEQ ID NO: 4979214 - DNA, 16 bp, Homo sapiens
ccattaatcatttccc

SEQ ID NO: 4979215 - DNA, 14 bp, Homo sapiens
ccattatccctgaa

SEQ ID NO: 4979216 - DNA, 18 bp, Homo sapiens
ccattattttctgtcaga

SEQ ID NO: 4979217 - DNA, 17 bp, Homo sapiens
ccattctattttagaat

SEQ ID NO: 4979218 - DNA, 15 bp, Homo sapiens
ccattctcatctgca

SEQ ID NO: 4979219 - DNA, 20 bp, Homo sapiens
ccattgcatcacctctgtaa

SEQ ID NO: 4979220 - DNA, 14 bp, Homo sapiens
ccattggtccaaga

SEQ ID NO: 4979221 - DNA, 13 bp, Homo sapiens
ccattggtgttgt

SEQ ID NO: 4979222 - DNA, 16 bp, Homo sapiens
ccatttatatatgaaa

SEQ ID NO: 4979223 - DNA, 13 bp, Homo sapiens
ccatttcctgaga

SEQ ID NO: 4979224 - DNA, 19 bp, Homo sapiens
ccatttgatacccctgggg

SEQ ID NO: 4979225 - DNA, 21 bp, Homo sapiens
ccatttgatacccctggggaa

SEQ ID NO: 4979226 - DNA, 17 bp, Homo sapiens
ccatttgatttttctaa

SEQ ID NO: 4979227 - DNA, 16 bp, Homo sapiens
ccatttgctttttcac

SEQ ID NO: 4979228 - DNA, 23 bp, Homo sapiens
ccattttcttattgcgctgctac

SEQ ID NO: 4979229 - DNA, 20 bp, Homo sapiens
ccattttggggtacccactg

SEQ ID NO: 4979230 - DNA, 13 bp, Homo sapiens
ccattttgtgaat

SEQ ID NO: 4979231 - DNA, 20 bp, Homo sapiens
cccaaacaaatatgcaaaag

SEQ ID NO: 4979232 - DNA, 15 bp, Homo sapiens
cccaaagtgctggga

SEQ ID NO: 4979233 - DNA, 16 bp, Homo sapiens
cccaaatctcttccac

SEQ ID NO: 4979234 - DNA, 17 bp, Homo sapiens
cccaacaaaccatccag

SEQ ID NO: 4979235 - DNA, 17 bp, Homo sapiens
cccaaccagtgccaagg

SEQ ID NO: 4979236 - DNA, 13 bp, Homo sapiens
cccaacccccacc

SEQ ID NO: 4979237 - DNA, 20 bp, Homo sapiens
cccaaccctatctcctgaca

SEQ ID NO: 4979238 - DNA, 13 bp, Homo sapiens
cccaacctgctct

SEQ ID NO: 4979239 - DNA, 21 bp, Homo sapiens
cccaacctgctctcctcttgc

SEQ ID NO: 4979240 - DNA, 14 bp, Homo sapiens
cccaacctgctgaa

SEQ ID NO: 4979241 - DNA, 20 bp, Homo sapiens
cccaacggccctgcagccag

SEQ ID NO: 4979242 - DNA, 16 bp, Homo sapiens
cccaactctgagccca

SEQ ID NO: 4979243 - DNA, 20 bp, Homo sapiens
cccaagaatagatgctgact

SEQ ID NO: 4979244 - DNA, 20 bp, Homo sapiens
cccaagacttcattgtccct

SEQ ID NO: 4979245 - DNA, 16 bp, Homo sapiens
cccaagccaaaaacct

SEQ ID NO: 4979246 - DNA, 16 bp, Homo sapiens
cccaagcccaggccac

SEQ ID NO: 4979247 - DNA, 12 bp, Homo sapiens
cccaagctcctc

SEQ ID NO: 4979248 - DNA, 14 bp, Homo sapiens
cccaagctctgctc

SEQ ID NO: 4979249 - DNA, 14 bp, Homo sapiens
cccaagcttagaac

SEQ ID NO: 4979250 - DNA, 14 bp, Homo sapiens
cccaaggaaagccc

SEQ ID NO: 4979251 - DNA, 15 bp, Homo sapiens
cccaaggagcacagg

SEQ ID NO: 4979252 - DNA, 22 bp, Homo sapiens
cccaaggagcacaggtcccacc

SEQ ID NO: 4979253 - DNA, 19 bp, Homo sapiens
cccaagtagtctgctcaca

SEQ ID NO: 4979254 - DNA, 18 bp, Homo sapiens
cccaagtggtgaatgaca

SEQ ID NO: 4979255 - DNA, 24 bp, Homo sapiens
cccaagtggtttccacatgctctg

SEQ ID NO: 4979256 - DNA, 23 bp, Homo sapiens
cccaagtttccatagcaacagga

SEQ ID NO: 4979257 - DNA, 16 bp, Homo sapiens
cccaatcagcactgaa

SEQ ID NO: 4979258 - DNA, 21 bp, Homo sapiens
cccaatccctttattaccccc

SEQ ID NO: 4979259 - DNA, 14 bp, Homo sapiens
cccaatctccatct

SEQ ID NO: 4979260 - DNA, 16 bp, Homo sapiens
cccaatgcacatccat

SEQ ID NO: 4979261 - DNA, 14 bp, Homo sapiens
cccaattggaggaa

SEQ ID NO: 4979262 - DNA, 11 bp, Homo sapiens
cccaatttccc

SEQ ID NO: 4979263 - DNA, 12 bp, Homo sapiens
cccacaccctgg

SEQ ID NO: 4979264 - DNA, 20 bp, Homo sapiens
cccacaggaagcctgcagtc

SEQ ID NO: 4979265 - DNA, 16 bp, Homo sapiens
cccacaggaggcaagc

SEQ ID NO: 4979266 - DNA, 19 bp, Homo sapiens
cccacatgtgacacatatg

SEQ ID NO: 4979267 - DNA, 15 bp, Homo sapiens
cccacccacatgtga

SEQ ID NO: 4979268 - DNA, 14 bp, Homo sapiens
cccaccccacactt

SEQ ID NO: 4979269 - DNA, 13 bp, Homo sapiens
cccacccctccct

SEQ ID NO: 4979270 - DNA, 12 bp, Homo sapiens
cccaccctgctg

SEQ ID NO: 4979271 - DNA, 14 bp, Homo sapiens
cccaccctgctgcc

SEQ ID NO: 4979272 - DNA, 23 bp, Homo sapiens
cccaccgggctgggagctctgca

SEQ ID NO: 4979273 - DNA, 16 bp, Homo sapiens
cccacctatgtgccaa

SEQ ID NO: 4979274 - DNA, 13 bp, Homo sapiens
cccacctcacccc

SEQ ID NO: 4979275 - DNA, 12 bp, Homo sapiens
cccacctcagcc

SEQ ID NO: 4979276 - DNA, 15 bp, Homo sapiens
cccacctcagcctcc

SEQ ID NO: 4979277 - DNA, 14 bp, Homo sapiens
cccacctccagccc

SEQ ID NO: 4979278 - DNA, 10 bp, Homo sapiens
cccacctccc

SEQ ID NO: 4979279 - DNA, 14 bp, Homo sapiens
cccacctccccacg

SEQ ID NO: 4979280 - DNA, 17 bp, Homo sapiens
cccacctccccacgccc

SEQ ID NO: 4979281 - DNA, 20 bp, Homo sapiens
cccacctctgtgacctcagg

SEQ ID NO: 4979282 - DNA, 12 bp, Homo sapiens
cccacctgcagg

SEQ ID NO: 4979283 - DNA, 20 bp, Homo sapiens
cccacctgcagggctgccct

SEQ ID NO: 4979284 - DNA, 13 bp, Homo sapiens
cccacctgcccat

SEQ ID NO: 4979285 - DNA, 22 bp, Homo sapiens
cccaccttggctcaagtcctct

SEQ ID NO: 4979286 - DNA, 19 bp, Homo sapiens
cccacgattttctccagct

SEQ ID NO: 4979287 - DNA, 21 bp, Homo sapiens
cccacgattttctccagctca

SEQ ID NO: 4979288 - DNA, 16 bp, Homo sapiens
cccacgccgggaacca

SEQ ID NO: 4979289 - DNA, 14 bp, Homo sapiens
cccacgccttatcc

SEQ ID NO: 4979290 - DNA, 18 bp, Homo sapiens
cccactatccttcgtgaa

SEQ ID NO: 4979291 - DNA, 11 bp, Homo sapiens
cccactctccc

SEQ ID NO: 4979292 - DNA, 14 bp, Homo sapiens
cccactctccccac

SEQ ID NO: 4979293 - DNA, 15 bp, Homo sapiens
cccactctccccaca

SEQ ID NO: 4979294 - DNA, 22 bp, Homo sapiens
cccactgatgctgttctcttct

SEQ ID NO: 4979295 - DNA, 13 bp, Homo sapiens
cccactgccagca

SEQ ID NO: 4979296 - DNA, 15 bp, Homo sapiens
cccactgccagcagc

SEQ ID NO: 4979297 - DNA, 21 bp, Homo sapiens
cccactgccagcagcagcagg

SEQ ID NO: 4979298 - DNA, 23 bp, Homo sapiens
cccactgtttctcttgagctggc

SEQ ID NO: 4979299 - DNA, 19 bp, Homo sapiens
cccagaacttccctgattg

SEQ ID NO: 4979300 - DNA, 19 bp, Homo sapiens
cccagacagacatctctgc

SEQ ID NO: 4979301 - DNA, 18 bp, Homo sapiens
cccagactactattttct

SEQ ID NO: 4979302 - DNA, 13 bp, Homo sapiens
cccagagaacagc

SEQ ID NO: 4979303 - DNA, 11 bp, Homo sapiens
cccagagactt

SEQ ID NO: 4979304 - DNA, 23 bp, Homo sapiens
cccagagctgtttatggcctcag

SEQ ID NO: 4979305 - DNA, 15 bp, Homo sapiens
cccagaggctgagtt

SEQ ID NO: 4979306 - DNA, 18 bp, Homo sapiens
cccagaggtaacagaaca

SEQ ID NO: 4979307 - DNA, 15 bp, Homo sapiens
cccagaggtccagcc

SEQ ID NO: 4979308 - DNA, 15 bp, Homo sapiens
cccagagtcatctga

SEQ ID NO: 4979309 - DNA, 16 bp, Homo sapiens
cccagcaagtgagagc

SEQ ID NO: 4979310 - DNA, 18 bp, Homo sapiens
cccagcaagtgagagctg

SEQ ID NO: 4979311 - DNA, 23 bp, Homo sapiens
cccagcaagtgagagctgggtgt

SEQ ID NO: 4979312 - DNA, 18 bp, Homo sapiens
cccagcacctcagcctgc

SEQ ID NO: 4979313 - DNA, 16 bp, Homo sapiens
cccagcacctgcctcc

SEQ ID NO: 4979314 - DNA, 12 bp, Homo sapiens
cccagcactttg

SEQ ID NO: 4979315 - DNA, 17 bp, Homo sapiens
cccagcatcactcccca

SEQ ID NO: 4979316 - DNA, 17 bp, Homo sapiens
cccagcccacttctgcc

SEQ ID NO: 4979317 - DNA, 19 bp, Homo sapiens
cccagcccacttctgccat

SEQ ID NO: 4979318 - DNA, 14 bp, Homo sapiens
ccagtattcttgtc

SEQ ID NO: 4979319 - DNA, 16 bp, Homo sapiens
ccagtcaagaagaaaa

SEQ ID NO: 4979320 - DNA, 15 bp, Homo sapiens
ccagtccccagccct

SEQ ID NO: 4979321 - DNA, 14 bp, Homo sapiens
ccagtccccctatc

SEQ ID NO: 4979322 - DNA, 18 bp, Homo sapiens
ccagtcctgcctggccag

SEQ ID NO: 4979323 - DNA, 16 bp, Homo sapiens
ccagtctctcttaaag

SEQ ID NO: 4979324 - DNA, 17 bp, Homo sapiens
ccagtctctcttaaagt

SEQ ID NO: 4979325 - DNA, 18 bp, Homo sapiens
ccagtctggaatgcagtg

SEQ ID NO: 4979326 - DNA, 19 bp, Homo sapiens
ccagtctttaaaggcccag

SEQ ID NO: 4979327 - DNA, 23 bp, Homo sapiens
ccagtctttaaaggcccagcccc

SEQ ID NO: 4979328 - DNA, 18 bp, Homo sapiens
ccagtgacctgctgggta

SEQ ID NO: 4979329 - DNA, 23 bp, Homo sapiens
ccagtgagggacgtcagacttgg

SEQ ID NO: 4979330 - DNA, 19 bp, Homo sapiens
ccagtgagtctctggggca

SEQ ID NO: 4979331 - DNA, 13 bp, Homo sapiens
ccagtgccaagga

SEQ ID NO: 4979332 - DNA, 14 bp, Homo sapiens
ccagtgccaaggac

SEQ ID NO: 4979333 - DNA, 16 bp, Homo sapiens
ccagtggaggtttgtc

SEQ ID NO: 4979334 - DNA, 15 bp, Homo sapiens
ccagtggggcctgtg

SEQ ID NO: 4979335 - DNA, 14 bp, Homo sapiens
ccagtggtgccttg

SEQ ID NO: 4979336 - DNA, 16 bp, Homo sapiens
ccagtgtaatccccca

SEQ ID NO: 4979337 - DNA, 12 bp, Homo sapiens
ccagtgtacata

SEQ ID NO: 4979338 - DNA, 16 bp, Homo sapiens
ccagtgtcccctccac

SEQ ID NO: 4979339 - DNA, 22 bp, Homo sapiens
ccagtgtcccctccactgtcac

SEQ ID NO: 4979340 - DNA, 23 bp, Homo sapiens
ccagtgtgacaaggattgctact

SEQ ID NO: 4979341 - DNA, 22 bp, Homo sapiens
ccagtgtggggttctgctggga

SEQ ID NO: 4979342 - DNA, 18 bp, Homo sapiens
ccagtgttctatgaacaa

SEQ ID NO: 4979343 - DNA, 19 bp, Homo sapiens
ccagtgttgcctaagtatt

SEQ ID NO: 4979344 - DNA, 13 bp, Homo sapiens
ccagttaaggacc

SEQ ID NO: 4979345 - DNA, 19 bp, Homo sapiens
ccagttcaatctcccgctg

SEQ ID NO: 4979346 - DNA, 14 bp, Homo sapiens
ccagttcaggagtc

SEQ ID NO: 4979347 - DNA, 18 bp, Homo sapiens
ccagttgaataaaagtgc

SEQ ID NO: 4979348 - DNA, 20 bp, Homo sapiens
ccataattttttttttcctt

SEQ ID NO: 4979349 - DNA, 13 bp, Homo sapiens
ccatactcagcct

SEQ ID NO: 4979350 - DNA, 17 bp, Homo sapiens
ccatacttatctctctg

SEQ ID NO: 4979351 - DNA, 13 bp, Homo sapiens
ccatagagtttaa

SEQ ID NO: 4979352 - DNA, 21 bp, Homo sapiens
ccatagatcttctgaaatgaa

SEQ ID NO: 4979353 - DNA, 14 bp, Homo sapiens
ccatagcaacagga

SEQ ID NO: 4979354 - DNA, 21 bp, Homo sapiens
ccatatataacagatacattt

SEQ ID NO: 4979355 - DNA, 14 bp, Homo sapiens
ccatatcttgcgaa

SEQ ID NO: 4979356 - DNA, 21 bp, Homo sapiens
ccatatcttgcgaatccaagc

SEQ ID NO: 4979357 - DNA, 23 bp, Homo sapiens
ccatatcttgcgaatccaagctc

SEQ ID NO: 4979358 - DNA, 22 bp, Homo sapiens
ccatatgccttggggaggacaa

SEQ ID NO: 4979359 - DNA, 18 bp, Homo sapiens
ccatattctgttggccag

SEQ ID NO: 4979360 - DNA, 11 bp, Homo sapiens
ccatattttca

SEQ ID NO: 4979361 - DNA, 16 bp, Homo sapiens
ccatcacaatacagat

SEQ ID NO: 4979362 - DNA, 16 bp, Homo sapiens
ccatcaccctcttcct

SEQ ID NO: 4979363 - DNA, 22 bp, Homo sapiens
ccatcatgcccggtcccacccc

SEQ ID NO: 4979364 - DNA, 19 bp, Homo sapiens
ccatccaccgctgctccac

SEQ ID NO: 4979365 - DNA, 16 bp, Homo sapiens
ccatccactctaccct

SEQ ID NO: 4979366 - DNA, 19 bp, Homo sapiens
ccatccactctaccctccc

SEQ ID NO: 4979367 - DNA, 22 bp, Homo sapiens
ccatccactctaccctcccacc

SEQ ID NO: 4979368 - DNA, 20 bp, Homo sapiens
ccatcccaaccagtgccaag

SEQ ID NO: 4979369 - DNA, 22 bp, Homo sapiens
ccatcccaaccagtgccaagga

SEQ ID NO: 4979370 - DNA, 14 bp, Homo sapiens
ccatcccacaccct

SEQ ID NO: 4979371 - DNA, 21 bp, Homo sapiens
ccatcccaggacaccacaccc

SEQ ID NO: 4979372 - DNA, 22 bp, Homo sapiens
ccatcccaggacaccacaccca

SEQ ID NO: 4979373 - DNA, 23 bp, Homo sapiens
ccatcccaggacaccacacccag

SEQ ID NO: 4979374 - DNA, 14 bp, Homo sapiens
ccatccctgcctgg

SEQ ID NO: 4979375 - DNA, 13 bp, Homo sapiens
ccatccctgtgag

SEQ ID NO: 4979376 - DNA, 23 bp, Homo sapiens
ccatccggtttgccatgttgcca

SEQ ID NO: 4979377 - DNA, 15 bp, Homo sapiens
ccatcctaaaagcca

SEQ ID NO: 4979378 - DNA, 15 bp, Homo sapiens
ccatctaagctgcag

SEQ ID NO: 4979379 - DNA, 16 bp, Homo sapiens
ccatctaagctgcagc

SEQ ID NO: 4979380 - DNA, 17 bp, Homo sapiens
ccatctaagctgcagct

SEQ ID NO: 4979381 - DNA, 20 bp, Homo sapiens
ccatctaagctgcagcttcc

SEQ ID NO: 4979382 - DNA, 21 bp, Homo sapiens
ccatctaagctgcagcttcct

SEQ ID NO: 4979383 - DNA, 17 bp, Homo sapiens
ccatctagtacttgaaa

SEQ ID NO: 4979384 - DNA, 15 bp, Homo sapiens
ccatctcccaccctg

SEQ ID NO: 4979385 - DNA, 22 bp, Homo sapiens
ccatctcctataatctgtcaaa

SEQ ID NO: 4979386 - DNA, 18 bp, Homo sapiens
ccatctggcctggcctgg

SEQ ID NO: 4979387 - DNA, 17 bp, Homo sapiens
ccatctgggtccttgca

SEQ ID NO: 4979388 - DNA, 22 bp, Homo sapiens
ccatctgggtccttgcacccct

SEQ ID NO: 4979389 - DNA, 15 bp, Homo sapiens
ccatcttagtttgga

SEQ ID NO: 4979390 - DNA, 16 bp, Homo sapiens
ccatgaacagaaaaca

SEQ ID NO: 4979391 - DNA, 15 bp, Homo sapiens
ccatgaagacaggat

SEQ ID NO: 4979392 - DNA, 20 bp, Homo sapiens
ccatgacaggcctgaagata

SEQ ID NO: 4979393 - DNA, 14 bp, Homo sapiens
ccatgaccatactg

SEQ ID NO: 4979394 - DNA, 15 bp, Homo sapiens
ccatgagaccctggt

SEQ ID NO: 4979395 - DNA, 20 bp, Homo sapiens
ccatgagaccctggtgcctg

SEQ ID NO: 4979396 - DNA, 23 bp, Homo sapiens
ccatgattctatttatatgtaca

SEQ ID NO: 4979397 - DNA, 13 bp, Homo sapiens
ccatgcaccaaac

SEQ ID NO: 4979398 - DNA, 14 bp, Homo sapiens
ccatgcaggccctt

SEQ ID NO: 4979399 - DNA, 13 bp, Homo sapiens
ccatgcccacctg

SEQ ID NO: 4979400 - DNA, 15 bp, Homo sapiens
ccatgcccacctgcc

SEQ ID NO: 4979401 - DNA, 16 bp, Homo sapiens
ccatgcccacctgccc

SEQ ID NO: 4979402 - DNA, 17 bp, Homo sapiens
ccatgcccacctgccca

SEQ ID NO: 4979403 - DNA, 15 bp, Homo sapiens
ccatgctcctcactg

SEQ ID NO: 4979404 - DNA, 17 bp, Homo sapiens
ccatgctcctcactgcc

SEQ ID NO: 4979405 - DNA, 19 bp, Homo sapiens
ccatggacactccagtgcc

SEQ ID NO: 4979406 - DNA, 23 bp, Homo sapiens
ccatgggatacaacctccctctt

SEQ ID NO: 4979407 - DNA, 24 bp, Homo sapiens
ccatgggatacaacctccctcttg

SEQ ID NO: 4979408 - DNA, 15 bp, Homo sapiens
ccatgggcctcctgt

SEQ ID NO: 4979409 - DNA, 13 bp, Homo sapiens
ccatgggcttcac

SEQ ID NO: 4979410 - DNA, 19 bp, Homo sapiens
ccatgggcttcactgtata

SEQ ID NO: 4979411 - DNA, 20 bp, Homo sapiens
ccatggttaagagtccaaga

SEQ ID NO: 4979412 - DNA, 20 bp, Homo sapiens
ccatgtaaataccagactgc

SEQ ID NO: 4979413 - DNA, 14 bp, Homo sapiens
ccatgtagccccct

SEQ ID NO: 4979414 - DNA, 14 bp, Homo sapiens
ccatgtccaaagag

SEQ ID NO: 4979415 - DNA, 19 bp, Homo sapiens
ccatgtccaaagaggctgc

SEQ ID NO: 4979416 - DNA, 16 bp, Homo sapiens
ccatgtcgcctctgca

SEQ ID NO: 4979417 - DNA, 19 bp, Homo sapiens
ccatgtcgcctctgcattc

SEQ ID NO: 4979418 - DNA, 17 bp, Homo sapiens
ccatgttctgcccccag

SEQ ID NO: 4979419 - DNA, 21 bp, Homo sapiens
ccatgttctgcccccagccca

SEQ ID NO: 4979420 - DNA, 16 bp, Homo sapiens
ccatgttgtaatgctg

SEQ ID NO: 4979421 - DNA, 17 bp, Homo sapiens
ccatgttgtaatgctgc

SEQ ID NO: 4979422 - DNA, 13 bp, Homo sapiens
ccatgtttgtaaa

SEQ ID NO: 4979423 - DNA, 14 bp, Homo sapiens
ccatgtttgtaaaa

SEQ ID NO: 4979424 - DNA, 15 bp, Homo sapiens
ccatgtttgtaaaac

SEQ ID NO: 4979425 - DNA, 14 bp, Homo sapiens
ccattaaaactgct

SEQ ID NO: 4979426 - DNA, 15 bp, Homo sapiens
ccattaaagtctgaa

SEQ ID NO: 4979427 - DNA, 15 bp, Homo sapiens
ccattaaatgaatat

SEQ ID NO: 4979428 - DNA, 17 bp, Homo sapiens
ccattaaatgaatattt

SEQ ID NO: 4979429 - DNA, 20 bp, Homo sapiens
ccacaaagcacagtttgaac

SEQ ID NO: 4979430 - DNA, 15 bp, Homo sapiens
ccacaactgacacag

SEQ ID NO: 4979431 - DNA, 23 bp, Homo sapiens
cattgacgattccttctctgaac

SEQ ID NO: 4979432 - DNA, 22 bp, Homo sapiens
cattgactggtttacaggccct

SEQ ID NO: 4979433 - DNA, 20 bp, Homo sapiens
cattgactttcagtaaacat

SEQ ID NO: 4979434 - DNA, 22 bp, Homo sapiens
cattgactttcagtaaacataa

SEQ ID NO: 4979435 - DNA, 19 bp, Homo sapiens
cattgagctgatataaatt

SEQ ID NO: 4979436 - DNA, 16 bp, Homo sapiens
cattgaggaagagtct

SEQ ID NO: 4979437 - DNA, 17 bp, Homo sapiens
cattgatcataaactga

SEQ ID NO: 4979438 - DNA, 15 bp, Homo sapiens
cattgattcagcctg

SEQ ID NO: 4979439 - DNA, 16 bp, Homo sapiens
cattgcattctattgc

SEQ ID NO: 4979440 - DNA, 18 bp, Homo sapiens
cattgcattctattgcct

SEQ ID NO: 4979441 - DNA, 20 bp, Homo sapiens
cattgcattctattgccttc

SEQ ID NO: 4979442 - DNA, 13 bp, Homo sapiens
cattgccaccagg

SEQ ID NO: 4979443 - DNA, 20 bp, Homo sapiens
cattgccaccaggagaacca

SEQ ID NO: 4979444 - DNA, 11 bp, Homo sapiens
cattgcctggc

SEQ ID NO: 4979445 - DNA, 19 bp, Homo sapiens
cattgctccctaagactgt

SEQ ID NO: 4979446 - DNA, 18 bp, Homo sapiens
cattgctgagcctctgct

SEQ ID NO: 4979447 - DNA, 17 bp, Homo sapiens
cattgctgttatgtctg

SEQ ID NO: 4979448 - DNA, 22 bp, Homo sapiens
cattgcttgtgccacaccctcc

SEQ ID NO: 4979449 - DNA, 18 bp, Homo sapiens
cattgcttttattttgaa

SEQ ID NO: 4979450 - DNA, 21 bp, Homo sapiens
cattggggttccgcactttcc

SEQ ID NO: 4979451 - DNA, 13 bp, Homo sapiens
cattggtccaaga

SEQ ID NO: 4979452 - DNA, 14 bp, Homo sapiens
cattggtccaagat

SEQ ID NO: 4979453 - DNA, 18 bp, Homo sapiens
cattgtaaacaaactctt

SEQ ID NO: 4979454 - DNA, 23 bp, Homo sapiens
cattgtaaacaaactcttgaaga

SEQ ID NO: 4979455 - DNA, 19 bp, Homo sapiens
cattgtaaatagtatttga

SEQ ID NO: 4979456 - DNA, 17 bp, Homo sapiens
cattgtagagcttctgg

SEQ ID NO: 4979457 - DNA, 18 bp, Homo sapiens
cattgtccctcttcactc

SEQ ID NO: 4979458 - DNA, 21 bp, Homo sapiens
cattgtggtgtgagcttcaga

SEQ ID NO: 4979459 - DNA, 16 bp, Homo sapiens
cattgttatttataca

SEQ ID NO: 4979460 - DNA, 13 bp, Homo sapiens
cattgttgagcta

SEQ ID NO: 4979461 - DNA, 16 bp, Homo sapiens
cattgttgctccctgt

SEQ ID NO: 4979462 - DNA, 17 bp, Homo sapiens
cattgttgctccctgtg

SEQ ID NO: 4979463 - DNA, 18 bp, Homo sapiens
cattgttggccaaagcca

SEQ ID NO: 4979464 - DNA, 22 bp, Homo sapiens
cattgttttgaatattactcct

SEQ ID NO: 4979465 - DNA, 12 bp, Homo sapiens
catttaaaaaaa

SEQ ID NO: 4979466 - DNA, 17 bp, Homo sapiens
catttaaagcattgctg

SEQ ID NO: 4979467 - DNA, 12 bp, Homo sapiens
catttaagtttc

SEQ ID NO: 4979468 - DNA, 15 bp, Homo sapiens
catttactaaacata

SEQ ID NO: 4979469 - DNA, 12 bp, Homo sapiens
catttagaaaat

SEQ ID NO: 4979470 - DNA, 17 bp, Homo sapiens
catttataattgcatct

SEQ ID NO: 4979471 - DNA, 14 bp, Homo sapiens
catttatatatgaa

SEQ ID NO: 4979472 - DNA, 13 bp, Homo sapiens
catttatatgtac

SEQ ID NO: 4979473 - DNA, 12 bp, Homo sapiens
catttatcattc

SEQ ID NO: 4979474 - DNA, 18 bp, Homo sapiens
catttatccacaggaaag

SEQ ID NO: 4979475 - DNA, 16 bp, Homo sapiens
catttatgaagcaagc

SEQ ID NO: 4979476 - DNA, 23 bp, Homo sapiens
catttatgagtaactattattat

SEQ ID NO: 4979477 - DNA, 16 bp, Homo sapiens
catttatgatttaata

SEQ ID NO: 4979478 - DNA, 18 bp, Homo sapiens
catttatgatttaataaa

SEQ ID NO: 4979479 - DNA, 16 bp, Homo sapiens
catttattctgctcac

SEQ ID NO: 4979480 - DNA, 17 bp, Homo sapiens
catttattttttacatt

SEQ ID NO: 4979481 - DNA, 19 bp, Homo sapiens
catttattttttacattat

SEQ ID NO: 4979482 - DNA, 18 bp, Homo sapiens
catttcaaatgtgctgtc

SEQ ID NO: 4979483 - DNA, 21 bp, Homo sapiens
catttcatcattgtttctgca

SEQ ID NO: 4979484 - DNA, 19 bp, Homo sapiens
catttcattccattgccta

SEQ ID NO: 4979485 - DNA, 12 bp, Homo sapiens
catttcattgta

SEQ ID NO: 4979486 - DNA, 20 bp, Homo sapiens
catttcattgtatgatgtgt

SEQ ID NO: 4979487 - DNA, 23 bp, Homo sapiens
catttcattgtatgatgtgttgt

SEQ ID NO: 4979488 - DNA, 21 bp, Homo sapiens
catttccaacaccacagacac

SEQ ID NO: 4979489 - DNA, 22 bp, Homo sapiens
catttctaaaagaatattcaga

SEQ ID NO: 4979490 - DNA, 12 bp, Homo sapiens
catttctaaaat

SEQ ID NO: 4979491 - DNA, 22 bp, Homo sapiens
catttcttcagtcagaaaactt

SEQ ID NO: 4979492 - DNA, 23 bp, Homo sapiens
catttcttcagtcagaaaacttt

SEQ ID NO: 4979493 - DNA, 13 bp, Homo sapiens
catttcttttctg

SEQ ID NO: 4979494 - DNA, 20 bp, Homo sapiens
catttcttttctttttacat

SEQ ID NO: 4979495 - DNA, 21 bp, Homo sapiens
catttcttttctttttacata

SEQ ID NO: 4979496 - DNA, 23 bp, Homo sapiens
catttgataatgataaaacacct

SEQ ID NO: 4979497 - DNA, 11 bp, Homo sapiens
catttgatacc

SEQ ID NO: 4979498 - DNA, 22 bp, Homo sapiens
catttgccttgcagaactgcca

SEQ ID NO: 4979499 - DNA, 15 bp, Homo sapiens
catttggaatacttt

SEQ ID NO: 4979500 - DNA, 17 bp, Homo sapiens
catttggaatacttttt

SEQ ID NO: 4979501 - DNA, 21 bp, Homo sapiens
catttggagacacaactattt

SEQ ID NO: 4979502 - DNA, 21 bp, Homo sapiens
catttggttcattaattctat

SEQ ID NO: 4979503 - DNA, 19 bp, Homo sapiens
catttggttctaagaaacc

SEQ ID NO: 4979504 - DNA, 11 bp, Homo sapiens
catttgtaaaa

SEQ ID NO: 4979505 - DNA, 14 bp, Homo sapiens
catttgtgaaatga

SEQ ID NO: 4979506 - DNA, 16 bp, Homo sapiens
catttgtgaaatgatg

SEQ ID NO: 4979507 - DNA, 16 bp, Homo sapiens
catttgtgccagagga

SEQ ID NO: 4979508 - DNA, 20 bp, Homo sapiens
catttgttgtgatgtctttt

SEQ ID NO: 4979509 - DNA, 16 bp, Homo sapiens
cattttaaataaaaga

SEQ ID NO: 4979510 - DNA, 17 bp, Homo sapiens
cattttaaataaaagaa

SEQ ID NO: 4979511 - DNA, 18 bp, Homo sapiens
cattttaaataaaagaaa

SEQ ID NO: 4979512 - DNA, 16 bp, Homo sapiens
cattttcaccccaccc

SEQ ID NO: 4979513 - DNA, 17 bp, Homo sapiens
cattttcaccccaccct

SEQ ID NO: 4979514 - DNA, 17 bp, Homo sapiens
cattttccccccactct

SEQ ID NO: 4979515 - DNA, 20 bp, Homo sapiens
cattttcttattgcgctgct

SEQ ID NO: 4979516 - DNA, 21 bp, Homo sapiens
cattttggggtacccactgct

SEQ ID NO: 4979517 - DNA, 12 bp, Homo sapiens
cattttgtgaat

SEQ ID NO: 4979518 - DNA, 21 bp, Homo sapiens
cattttgtgaatggattggat

SEQ ID NO: 4979519 - DNA, 13 bp, Homo sapiens
cattttgttctta

SEQ ID NO: 4979520 - DNA, 18 bp, Homo sapiens
cattttgttcttacacat

SEQ ID NO: 4979521 - DNA, 13 bp, Homo sapiens
cattttgttgtaa

SEQ ID NO: 4979522 - DNA, 15 bp, Homo sapiens
cattttgttgtaaaa

SEQ ID NO: 4979523 - DNA, 18 bp, Homo sapiens
cattttgttgtaaaaaga

SEQ ID NO: 4979524 - DNA, 20 bp, Homo sapiens
catttttagtagagacaggg

SEQ ID NO: 4979525 - DNA, 15 bp, Homo sapiens
catttttatttatga

SEQ ID NO: 4979526 - DNA, 16 bp, Homo sapiens
catttttatttatgaa

SEQ ID NO: 4979527 - DNA, 18 bp, Homo sapiens
cattttttaaggaaacaa

SEQ ID NO: 4979528 - DNA, 18 bp, Homo sapiens
cattttttgggcagcaat

SEQ ID NO: 4979529 - DNA, 20 bp, Homo sapiens
catttttttaatttattatt

SEQ ID NO: 4979530 - DNA, 17 bp, Homo sapiens
cattttttttttaaatc

SEQ ID NO: 4979531 - DNA, 19 bp, Homo sapiens
ccaaaaagattttcagaaa

SEQ ID NO: 4979532 - DNA, 22 bp, Homo sapiens
ccaaaaaggttgctgtttcaca

SEQ ID NO: 4979533 - DNA, 23 bp, Homo sapiens
ccaaaaaggttgctgtttcacaa

SEQ ID NO: 4979534 - DNA, 14 bp, Homo sapiens
ccaaaaattattat

SEQ ID NO: 4979535 - DNA, 15 bp, Homo sapiens
ccaaaacccatgtgg

SEQ ID NO: 4979536 - DNA, 14 bp, Homo sapiens
catggtcacacact

SEQ ID NO: 4979537 - DNA, 16 bp, Homo sapiens
catggtcacacactga

SEQ ID NO: 4979538 - DNA, 14 bp, Homo sapiens
catggtccctgcct

SEQ ID NO: 4979539 - DNA, 22 bp, Homo sapiens
catggtggacccagcgggcagg

SEQ ID NO: 4979540 - DNA, 14 bp, Homo sapiens
catggtgtaataag

SEQ ID NO: 4979541 - DNA, 21 bp, Homo sapiens
catgtaaagaaatgtcttaat

SEQ ID NO: 4979542 - DNA, 18 bp, Homo sapiens
catgtaaataccagactg

SEQ ID NO: 4979543 - DNA, 21 bp, Homo sapiens
catgtaaataccagactgcag

SEQ ID NO: 4979544 - DNA, 23 bp, Homo sapiens
catgtaaataccagactgcaggt

SEQ ID NO: 4979545 - DNA, 17 bp, Homo sapiens
catgtacctcccctgcc

SEQ ID NO: 4979546 - DNA, 13 bp, Homo sapiens
catgtagagaaaa

SEQ ID NO: 4979547 - DNA, 16 bp, Homo sapiens
catgtagagaaaagca

SEQ ID NO: 4979548 - DNA, 22 bp, Homo sapiens
catgtagccccctggcctctgt

SEQ ID NO: 4979549 - DNA, 15 bp, Homo sapiens
catgtagctgagttt

SEQ ID NO: 4979550 - DNA, 14 bp, Homo sapiens
catgtataaatgtg

SEQ ID NO: 4979551 - DNA, 18 bp, Homo sapiens
catgtatgtcttggacac

SEQ ID NO: 4979552 - DNA, 15 bp, Homo sapiens
catgtatttatctct

SEQ ID NO: 4979553 - DNA, 20 bp, Homo sapiens
catgtatttatctctattta

SEQ ID NO: 4979554 - DNA, 13 bp, Homo sapiens
catgtccaaagag

SEQ ID NO: 4979555 - DNA, 17 bp, Homo sapiens
catgtccaaagaggctg

SEQ ID NO: 4979556 - DNA, 19 bp, Homo sapiens
catgtccaaagaggctgcc

SEQ ID NO: 4979557 - DNA, 22 bp, Homo sapiens
catgtccctaccgagtctcttc

SEQ ID NO: 4979558 - DNA, 14 bp, Homo sapiens
catgtcgcctctgc

SEQ ID NO: 4979559 - DNA, 22 bp, Homo sapiens
catgtcgctagccagtgctcca

SEQ ID NO: 4979560 - DNA, 23 bp, Homo sapiens
catgtcttgtacatgtgtagcct

SEQ ID NO: 4979561 - DNA, 21 bp, Homo sapiens
catgtctttctccaaagttat

SEQ ID NO: 4979562 - DNA, 12 bp, Homo sapiens
catgtgaaacct

SEQ ID NO: 4979563 - DNA, 14 bp, Homo sapiens
catgtgaaaccttt

SEQ ID NO: 4979564 - DNA, 18 bp, Homo sapiens
catgtgaaacctttttta

SEQ ID NO: 4979565 - DNA, 15 bp, Homo sapiens
catgtgacacatatg

SEQ ID NO: 4979566 - DNA, 16 bp, Homo sapiens
catgtgacacatatgc

SEQ ID NO: 4979567 - DNA, 18 bp, Homo sapiens
catgtgccctcctgaggg

SEQ ID NO: 4979568 - DNA, 16 bp, Homo sapiens
catgtgcctctttgtc

SEQ ID NO: 4979569 - DNA, 20 bp, Homo sapiens
catgtggtttggttcctctc

SEQ ID NO: 4979570 - DNA, 23 bp, Homo sapiens
catgtggtttggttcctctctgg

SEQ ID NO: 4979571 - DNA, 14 bp, Homo sapiens
catgtgtgtataag

SEQ ID NO: 4979572 - DNA, 18 bp, Homo sapiens
catgtgtgtatatatgtg

SEQ ID NO: 4979573 - DNA, 19 bp, Homo sapiens
catgtgtgtatatatgtgt

SEQ ID NO: 4979574 - DNA, 20 bp, Homo sapiens
catgtgttttaattccaata

SEQ ID NO: 4979575 - DNA, 13 bp, Homo sapiens
catgttatatatt

SEQ ID NO: 4979576 - DNA, 20 bp, Homo sapiens
catgttatatattttttgta

SEQ ID NO: 4979577 - DNA, 22 bp, Homo sapiens
catgttatatattttttgtagg

SEQ ID NO: 4979578 - DNA, 15 bp, Homo sapiens
catgttctctgagga

SEQ ID NO: 4979579 - DNA, 12 bp, Homo sapiens
catgttggccag

SEQ ID NO: 4979580 - DNA, 16 bp, Homo sapiens
catgttggccaggctg

SEQ ID NO: 4979581 - DNA, 18 bp, Homo sapiens
catgttggccaggctggt

SEQ ID NO: 4979582 - DNA, 22 bp, Homo sapiens
catgttggtcaaaagctggatt

SEQ ID NO: 4979583 - DNA, 18 bp, Homo sapiens
catgttgttaaaattatg

SEQ ID NO: 4979584 - DNA, 14 bp, Homo sapiens
catgtttgcttcat

SEQ ID NO: 4979585 - DNA, 20 bp, Homo sapiens
catgtttggtgcatagaact

SEQ ID NO: 4979586 - DNA, 22 bp, Homo sapiens
catgtttggtgcatagaactgg

SEQ ID NO: 4979587 - DNA, 13 bp, Homo sapiens
catgtttgtaaaa

SEQ ID NO: 4979588 - DNA, 17 bp, Homo sapiens
catgttttgtatacaaa

SEQ ID NO: 4979589 - DNA, 17 bp, Homo sapiens
catgttttgtgactata

SEQ ID NO: 4979590 - DNA, 23 bp, Homo sapiens
catgtttttgttttctttgaatg

SEQ ID NO: 4979591 - DNA, 13 bp, Homo sapiens
cattaaaaaatga

SEQ ID NO: 4979592 - DNA, 13 bp, Homo sapiens
cattaaaaatgga

SEQ ID NO: 4979593 - DNA, 14 bp, Homo sapiens
cattaaaaatggaa

SEQ ID NO: 4979594 - DNA, 13 bp, Homo sapiens
cattaaacctgtc

SEQ ID NO: 4979595 - DNA, 23 bp, Homo sapiens
cattaaacctgtctccactgtgc

SEQ ID NO: 4979596 - DNA, 15 bp, Homo sapiens
cattaaatgaatatt

SEQ ID NO: 4979597 - DNA, 13 bp, Homo sapiens
cattaaattcaca

SEQ ID NO: 4979598 - DNA, 18 bp, Homo sapiens
cattaaattcacaaactt

SEQ ID NO: 4979599 - DNA, 23 bp, Homo sapiens
cattaatcaatcatctgtgtgaa

SEQ ID NO: 4979600 - DNA, 12 bp, Homo sapiens
cattaatgtttc

SEQ ID NO: 4979601 - DNA, 12 bp, Homo sapiens
cattaccactca

SEQ ID NO: 4979602 - DNA, 16 bp, Homo sapiens
cattaccactcaggca

SEQ ID NO: 4979603 - DNA, 13 bp, Homo sapiens
cattacccttccc

SEQ ID NO: 4979604 - DNA, 17 bp, Homo sapiens
cattaccttactgtgga

SEQ ID NO: 4979605 - DNA, 18 bp, Homo sapiens
cattaccttttaccagct

SEQ ID NO: 4979606 - DNA, 16 bp, Homo sapiens
cattagactcctcctc

SEQ ID NO: 4979607 - DNA, 20 bp, Homo sapiens
cattagcacagattttaatt

SEQ ID NO: 4979608 - DNA, 18 bp, Homo sapiens
cattagcagtttgctttg

SEQ ID NO: 4979609 - DNA, 21 bp, Homo sapiens
cattaggaattaagttatctt

SEQ ID NO: 4979610 - DNA, 14 bp, Homo sapiens
cattagtaaatgtc

SEQ ID NO: 4979611 - DNA, 23 bp, Homo sapiens
cattagtaaatgtctttgtaagt

SEQ ID NO: 4979612 - DNA, 14 bp, Homo sapiens
cattatccctgaat

SEQ ID NO: 4979613 - DNA, 19 bp, Homo sapiens
cattatgtccactgtgtat

SEQ ID NO: 4979614 - DNA, 20 bp, Homo sapiens
cattatgtccactgtgtata

SEQ ID NO: 4979615 - DNA, 12 bp, Homo sapiens
cattatgtgtgc

SEQ ID NO: 4979616 - DNA, 22 bp, Homo sapiens
cattatgtgtgcatgtgtgtat

SEQ ID NO: 4979617 - DNA, 13 bp, Homo sapiens
cattattcattta

SEQ ID NO: 4979618 - DNA, 15 bp, Homo sapiens
cattattctctttta

SEQ ID NO: 4979619 - DNA, 14 bp, Homo sapiens
cattattgcttatt

SEQ ID NO: 4979620 - DNA, 14 bp, Homo sapiens
cattatttatatgg

SEQ ID NO: 4979621 - DNA, 13 bp, Homo sapiens
cattatttctagt

SEQ ID NO: 4979622 - DNA, 21 bp, Homo sapiens
cattcaatattgacatttgta

SEQ ID NO: 4979623 - DNA, 12 bp, Homo sapiens
cattcagagagc

SEQ ID NO: 4979624 - DNA, 16 bp, Homo sapiens
cattccaacagtgagt

SEQ ID NO: 4979625 - DNA, 14 bp, Homo sapiens
cattccaagactct

SEQ ID NO: 4979626 - DNA, 18 bp, Homo sapiens
cattccaagactctagag

SEQ ID NO: 4979627 - DNA, 13 bp, Homo sapiens
cattccccatggg

SEQ ID NO: 4979628 - DNA, 14 bp, Homo sapiens
cattccttctttga

SEQ ID NO: 4979629 - DNA, 23 bp, Homo sapiens
cattccttctttgataatgttaa

SEQ ID NO: 4979630 - DNA, 13 bp, Homo sapiens
cattctattgcct

SEQ ID NO: 4979631 - DNA, 20 bp, Homo sapiens
cattctattgccttctttga

SEQ ID NO: 4979632 - DNA, 23 bp, Homo sapiens
cattctcataattcctacagcac

SEQ ID NO: 4979633 - DNA, 20 bp, Homo sapiens
cattctcatctgcacccttc

SEQ ID NO: 4979634 - DNA, 22 bp, Homo sapiens
cattctccccagtgtatgtctt

SEQ ID NO: 4979635 - DNA, 15 bp, Homo sapiens
cattctcctgcctgt

SEQ ID NO: 4979636 - DNA, 20 bp, Homo sapiens
cattctgatttggaaaaaga

SEQ ID NO: 4979637 - DNA, 21 bp, Homo sapiens
cattctgcattgctagataaa

SEQ ID NO: 4979638 - DNA, 18 bp, Homo sapiens
cattctgcctgcccaggc

SEQ ID NO: 4979639 - DNA, 16 bp, Homo sapiens
cattctgtgatcattt

SEQ ID NO: 4979640 - DNA, 23 bp, Homo sapiens
catatcttaaagaaacagctttc

SEQ ID NO: 4979641 - DNA, 13 bp, Homo sapiens
catatgaaatcct

SEQ ID NO: 4979642 - DNA, 15 bp, Homo sapiens
catatgacttgatct

SEQ ID NO: 4979643 - DNA, 13 bp, Homo sapiens
catatgatctgtt

SEQ ID NO: 4979644 - DNA, 20 bp, Homo sapiens
catatgatttcactagaaaa

SEQ ID NO: 4979645 - DNA, 16 bp, Homo sapiens
catatgcaccttgtgt

SEQ ID NO: 4979646 - DNA, 23 bp, Homo sapiens
catatgcaccttgtgtctgtaca

SEQ ID NO: 4979647 - DNA, 18 bp, Homo sapiens
catatgggttagatgttg

SEQ ID NO: 4979648 - DNA, 13 bp, Homo sapiens
catatgtaaacat

SEQ ID NO: 4979649 - DNA, 15 bp, Homo sapiens
catatgtaaacataa

SEQ ID NO: 4979650 - DNA, 16 bp, Homo sapiens
catatgtacataaatt

SEQ ID NO: 4979651 - DNA, 17 bp, Homo sapiens
catatgtagactatata

SEQ ID NO: 4979652 - DNA, 20 bp, Homo sapiens
catatgtagactatatacat

SEQ ID NO: 4979653 - DNA, 23 bp, Homo sapiens
catatgtagactatatacatgtg

SEQ ID NO: 4979654 - DNA, 21 bp, Homo sapiens
catatgtcactagaatggata

SEQ ID NO: 4979655 - DNA, 15 bp, Homo sapiens
catatgtgatctgtc

SEQ ID NO: 4979656 - DNA, 16 bp, Homo sapiens
catatgtgatctgtct

SEQ ID NO: 4979657 - DNA, 13 bp, Homo sapiens
catattctgtctg

SEQ ID NO: 4979658 - DNA, 16 bp, Homo sapiens
catattggaaaaatca

SEQ ID NO: 4979659 - DNA, 14 bp, Homo sapiens
catattggtattca

SEQ ID NO: 4979660 - DNA, 21 bp, Homo sapiens
catattgtgcttcacagtaga

SEQ ID NO: 4979661 - DNA, 13 bp, Homo sapiens
catatttactacc

SEQ ID NO: 4979662 - DNA, 15 bp, Homo sapiens
catatttgagactag

SEQ ID NO: 4979663 - DNA, 12 bp, Homo sapiens
catatttggaag

SEQ ID NO: 4979664 - DNA, 13 bp, Homo sapiens
catattttgtata

SEQ ID NO: 4979665 - DNA, 18 bp, Homo sapiens
catcaaaaactttggagt

SEQ ID NO: 4979666 - DNA, 13 bp, Homo sapiens
catcaaaatgctt

SEQ ID NO: 4979667 - DNA, 21 bp, Homo sapiens
catcaagaggtgggagggccc

SEQ ID NO: 4979668 - DNA, 19 bp, Homo sapiens
catcaatcaaataagtatt

SEQ ID NO: 4979669 - DNA, 12 bp, Homo sapiens
catcacagcagc

SEQ ID NO: 4979670 - DNA, 22 bp, Homo sapiens
catcacaggacacggggcagtg

SEQ ID NO: 4979671 - DNA, 19 bp, Homo sapiens
catcacagggttgggccca

SEQ ID NO: 4979672 - DNA, 14 bp, Homo sapiens
catcaccctcttcc

SEQ ID NO: 4979673 - DNA, 19 bp, Homo sapiens
catcacttgtacaaaataa

SEQ ID NO: 4979674 - DNA, 19 bp, Homo sapiens
catcagatggaaatatttt

SEQ ID NO: 4979675 - DNA, 11 bp, Homo sapiens
catcagcaaac

SEQ ID NO: 4979676 - DNA, 14 bp, Homo sapiens
catcagggacagga

SEQ ID NO: 4979677 - DNA, 18 bp, Homo sapiens
catcagggacaggatgac

SEQ ID NO: 4979678 - DNA, 11 bp, Homo sapiens
catcagggcct

SEQ ID NO: 4979679 - DNA, 13 bp, Homo sapiens
catcagggcctgg

SEQ ID NO: 4979680 - DNA, 18 bp, Homo sapiens
catcagggcctggggcct

SEQ ID NO: 4979681 - DNA, 21 bp, Homo sapiens
catcagggcctggggcctgag

SEQ ID NO: 4979682 - DNA, 22 bp, Homo sapiens
catcagggcctggggcctgaga

SEQ ID NO: 4979683 - DNA, 19 bp, Homo sapiens
catcagggggaagaagcag

SEQ ID NO: 4979684 - DNA, 16 bp, Homo sapiens
catcatgaattttaca

SEQ ID NO: 4979685 - DNA, 10 bp, Homo sapiens
catcatgtca

SEQ ID NO: 4979686 - DNA, 15 bp, Homo sapiens
catcatgtctggcta

SEQ ID NO: 4979687 - DNA, 10 bp, Homo sapiens
catcattaga

SEQ ID NO: 4979688 - DNA, 16 bp, Homo sapiens
catccaaccttcccaa

SEQ ID NO: 4979689 - DNA, 15 bp, Homo sapiens
catccaactccagca

SEQ ID NO: 4979690 - DNA, 12 bp, Homo sapiens
catccaccccat

SEQ ID NO: 4979691 - DNA, 19 bp, Homo sapiens
catccactctaccctccca

SEQ ID NO: 4979692 - DNA, 12 bp, Homo sapiens
catccataaatc

SEQ ID NO: 4979693 - DNA, 17 bp, Homo sapiens
catccataaatccagtt

SEQ ID NO: 4979694 - DNA, 20 bp, Homo sapiens
catccatgtcctatgtgtga

SEQ ID NO: 4979695 - DNA, 22 bp, Homo sapiens
catcccaaccagtgccaaggac

SEQ ID NO: 4979696 - DNA, 14 bp, Homo sapiens
catcccacaccctg

SEQ ID NO: 4979697 - DNA, 19 bp, Homo sapiens
catcccaggacaccacacc

SEQ ID NO: 4979698 - DNA, 19 bp, Homo sapiens
catcccatctaagctgcag

SEQ ID NO: 4979699 - DNA, 21 bp, Homo sapiens
catccccaggggtcccagcca

SEQ ID NO: 4979700 - DNA, 14 bp, Homo sapiens
catcccccaaagtt

SEQ ID NO: 4979701 - DNA, 14 bp, Homo sapiens
catcccctcccatc

SEQ ID NO: 4979702 - DNA, 14 bp, Homo sapiens
catccctccccagt

SEQ ID NO: 4979703 - DNA, 24 bp, Homo sapiens
catccctgagcaggaaagtttacc

SEQ ID NO: 4979704 - DNA, 17 bp, Homo sapiens
catccctgaggagccag

SEQ ID NO: 4979705 - DNA, 13 bp, Homo sapiens
catccctgcctgg

SEQ ID NO: 4979706 - DNA, 15 bp, Homo sapiens
catccctgcctggtc

SEQ ID NO: 4979707 - DNA, 12 bp, Homo sapiens
catccctgtgag

SEQ ID NO: 4979708 - DNA, 13 bp, Homo sapiens
catccctgtgagg

SEQ ID NO: 4979709 - DNA, 16 bp, Homo sapiens
catccgccttttgtat

SEQ ID NO: 4979710 - DNA, 19 bp, Homo sapiens
catcctaaaagccacccca

SEQ ID NO: 4979711 - DNA, 20 bp, Homo sapiens
catcctaagaaatatgtgag

SEQ ID NO: 4979712 - DNA, 14 bp, Homo sapiens
catcctaccctttt

SEQ ID NO: 4979713 - DNA, 16 bp, Homo sapiens
catcctccgtccagcc

SEQ ID NO: 4979714 - DNA, 21 bp, Homo sapiens
catcctcctggaaccttgctg

SEQ ID NO: 4979715 - DNA, 23 bp, Homo sapiens
catcctcctggaaccttgctgtc

SEQ ID NO: 4979716 - DNA, 17 bp, Homo sapiens
catcctgactctgcccc

SEQ ID NO: 4979717 - DNA, 14 bp, Homo sapiens
catcctgagccccg

SEQ ID NO: 4979718 - DNA, 16 bp, Homo sapiens
catcctgagccccgcc

SEQ ID NO: 4979719 - DNA, 21 bp, Homo sapiens
catcctgagccccgccctctt

SEQ ID NO: 4979720 - DNA, 13 bp, Homo sapiens
catcctgccagcc

SEQ ID NO: 4979721 - DNA, 21 bp, Homo sapiens
catcctgccagccccacacag

SEQ ID NO: 4979722 - DNA, 22 bp, Homo sapiens
catcctgccagccccacacagc

SEQ ID NO: 4979723 - DNA, 16 bp, Homo sapiens
catcctgccttcatgg

SEQ ID NO: 4979724 - DNA, 12 bp, Homo sapiens
catcctggctgc

SEQ ID NO: 4979725 - DNA, 15 bp, Homo sapiens
catcctggctgcggc

SEQ ID NO: 4979726 - DNA, 21 bp, Homo sapiens
catccttggtctttgtatctt

SEQ ID NO: 4979727 - DNA, 17 bp, Homo sapiens
catcctttgcagggcag

SEQ ID NO: 4979728 - DNA, 14 bp, Homo sapiens
catctaagctgcag

SEQ ID NO: 4979729 - DNA, 17 bp, Homo sapiens
catctaagctgcagctt

SEQ ID NO: 4979730 - DNA, 23 bp, Homo sapiens
catctaagctgcagcttcctgtc

SEQ ID NO: 4979731 - DNA, 18 bp, Homo sapiens
catctaggtaatttttac

SEQ ID NO: 4979732 - DNA, 18 bp, Homo sapiens
catctagtacttgaaaaa

SEQ ID NO: 4979733 - DNA, 13 bp, Homo sapiens
catctattttgat

SEQ ID NO: 4979734 - DNA, 19 bp, Homo sapiens
catctcactggatgcaaag

SEQ ID NO: 4979735 - DNA, 19 bp, Homo sapiens
catctcaggggccagagga

SEQ ID NO: 4979736 - DNA, 22 bp, Homo sapiens
catctcattcaaaccccaccct

SEQ ID NO: 4979737 - DNA, 16 bp, Homo sapiens
catctcccaccctgta

SEQ ID NO: 4979738 - DNA, 20 bp, Homo sapiens
catctcctataatctgtcaa

SEQ ID NO: 4979739 - DNA, 13 bp, Homo sapiens
catctctccccaa

SEQ ID NO: 4979740 - DNA, 20 bp, Homo sapiens
cagcctccaagctccatctc

SEQ ID NO: 4979741 - DNA, 14 bp, Homo sapiens
cagcctccagcctg

SEQ ID NO: 4979742 - DNA, 16 bp, Homo sapiens
cagcctcccaccccca

SEQ ID NO: 4979743 - DNA, 20 bp, Homo sapiens
cagcctcccgaatagctggg

SEQ ID NO: 4979744 - DNA, 21 bp, Homo sapiens
cagcctcccgagtagctggga

SEQ ID NO: 4979745 - DNA, 23 bp, Homo sapiens
cagcctcgttggaagaggaacag

SEQ ID NO: 4979746 - DNA, 16 bp, Homo sapiens
cagcctctgacccctc

SEQ ID NO: 4979747 - DNA, 19 bp, Homo sapiens
cagcctctgacccctcctc

SEQ ID NO: 4979748 - DNA, 22 bp, Homo sapiens
cagcctctgacccctcctcact

SEQ ID NO: 4979749 - DNA, 23 bp, Homo sapiens
cagcctctgacccctcctcactg

SEQ ID NO: 4979750 - DNA, 11 bp, Homo sapiens
cagcctcttaa

SEQ ID NO: 4979751 - DNA, 19 bp, Homo sapiens
cagcctcttaaagctgcct

SEQ ID NO: 4979752 - DNA, 20 bp, Homo sapiens
cagcctcttaaagctgcctg

SEQ ID NO: 4979753 - DNA, 21 bp, Homo sapiens
cagcctcttaaagctgcctgt

SEQ ID NO: 4979754 - DNA, 20 bp, Homo sapiens
cagcctgagcaactcttgat

SEQ ID NO: 4979755 - DNA, 21 bp, Homo sapiens
cagcctgagcaactcttgatt

SEQ ID NO: 4979756 - DNA, 23 bp, Homo sapiens
cagcctgcccaagcccaggccac

SEQ ID NO: 4979757 - DNA, 19 bp, Homo sapiens
cagcctgctaattccccag

SEQ ID NO: 4979758 - DNA, 15 bp, Homo sapiens
cagcctgctgcccag

SEQ ID NO: 4979759 - DNA, 10 bp, Homo sapiens
cagcctggca

SEQ ID NO: 4979760 - DNA, 13 bp, Homo sapiens
cagcctggcacag

SEQ ID NO: 4979761 - DNA, 20 bp, Homo sapiens
cagcctggcacagggcagtg

SEQ ID NO: 4979762 - DNA, 11 bp, Homo sapiens
cagcctgggac

SEQ ID NO: 4979763 - DNA, 18 bp, Homo sapiens
cagcctgggcagccaggc

SEQ ID NO: 4979764 - DNA, 12 bp, Homo sapiens
cagcctgggccc

SEQ ID NO: 4979765 - DNA, 16 bp, Homo sapiens
cagcctgggccccagc

SEQ ID NO: 4979766 - DNA, 17 bp, Homo sapiens
cagcctggggcctggca

SEQ ID NO: 4979767 - DNA, 19 bp, Homo sapiens
cagcctggggcctggcagg

SEQ ID NO: 4979768 - DNA, 23 bp, Homo sapiens
cagcctggtccatgcagggggct

SEQ ID NO: 4979769 - DNA, 22 bp, Homo sapiens
cagcctgtcccatggacactcc

SEQ ID NO: 4979770 - DNA, 15 bp, Homo sapiens
cagcctgtggcatct

SEQ ID NO: 4979771 - DNA, 18 bp, Homo sapiens
cagcctttggccttggct

SEQ ID NO: 4979772 - DNA, 16 bp, Homo sapiens
cagcgaccgccccctc

SEQ ID NO: 4979773 - DNA, 18 bp, Homo sapiens
cagcgaccttcctcatcc

SEQ ID NO: 4979774 - DNA, 16 bp, Homo sapiens
cagcgagccctggtgg

SEQ ID NO: 4979775 - DNA, 21 bp, Homo sapiens
cagcgagccctggtggcagtg

SEQ ID NO: 4979776 - DNA, 13 bp, Homo sapiens
cagcgggcaggtt

SEQ ID NO: 4979777 - DNA, 15 bp, Homo sapiens
cagcggggacagctc

SEQ ID NO: 4979778 - DNA, 16 bp, Homo sapiens
cagcgtaaaatggtga

SEQ ID NO: 4979779 - DNA, 17 bp, Homo sapiens
cagcgtaaaatggtgaa

SEQ ID NO: 4979780 - DNA, 18 bp, Homo sapiens
cagcgtccctagcagtga

SEQ ID NO: 4979781 - DNA, 23 bp, Homo sapiens
cagctaagggaagacatttcttt

SEQ ID NO: 4979782 - DNA, 19 bp, Homo sapiens
cagctaatcagcattctca

SEQ ID NO: 4979783 - DNA, 15 bp, Homo sapiens
cagctaatgggacac

SEQ ID NO: 4979784 - DNA, 17 bp, Homo sapiens
cagctaccctgtgtata

SEQ ID NO: 4979785 - DNA, 16 bp, Homo sapiens
cagctactgatttttg

SEQ ID NO: 4979786 - DNA, 17 bp, Homo sapiens
cagctacttaagagaaa

SEQ ID NO: 4979787 - DNA, 20 bp, Homo sapiens
cagctacttaagagaaatgg

SEQ ID NO: 4979788 - DNA, 21 bp, Homo sapiens
cagctacttcctcctccccac

SEQ ID NO: 4979789 - DNA, 17 bp, Homo sapiens
cagctacttggtttgtg

SEQ ID NO: 4979790 - DNA, 18 bp, Homo sapiens
cagctagaaaacattttt

SEQ ID NO: 4979791 - DNA, 17 bp, Homo sapiens
cagctatgggagcccca

SEQ ID NO: 4979792 - DNA, 20 bp, Homo sapiens
cagctatgggagccccaggg

SEQ ID NO: 4979793 - DNA, 13 bp, Homo sapiens
cagctcaccagcc

SEQ ID NO: 4979794 - DNA, 15 bp, Homo sapiens
cagctcaccagcccc

SEQ ID NO: 4979795 - DNA, 22 bp, Homo sapiens
cagctcaccagccccagtgccc

SEQ ID NO: 4979796 - DNA, 13 bp, Homo sapiens
cagctcagaaccc

SEQ ID NO: 4979797 - DNA, 15 bp, Homo sapiens
cagctcagaacccag

SEQ ID NO: 4979798 - DNA, 13 bp, Homo sapiens
cagctcagcgcca

SEQ ID NO: 4979799 - DNA, 17 bp, Homo sapiens
cagctcagcgccagcct

SEQ ID NO: 4979800 - DNA, 18 bp, Homo sapiens
cagctcagcgccagcctg

SEQ ID NO: 4979801 - DNA, 18 bp, Homo sapiens
cagctcagtcccatcaga

SEQ ID NO: 4979802 - DNA, 14 bp, Homo sapiens
cagctccagctcac

SEQ ID NO: 4979803 - DNA, 14 bp, Homo sapiens
cagctccattttct

SEQ ID NO: 4979804 - DNA, 12 bp, Homo sapiens
cagctccccaag

SEQ ID NO: 4979805 - DNA, 14 bp, Homo sapiens
cagctccctgccaa

SEQ ID NO: 4979806 - DNA, 21 bp, Homo sapiens
cagctccttctgtcctactct

SEQ ID NO: 4979807 - DNA, 14 bp, Homo sapiens
cagctcgatccaaa

SEQ ID NO: 4979808 - DNA, 21 bp, Homo sapiens
cagctctgtgttgccatgtgt

SEQ ID NO: 4979809 - DNA, 18 bp, Homo sapiens
cagctcttctccaggctg

SEQ ID NO: 4979810 - DNA, 19 bp, Homo sapiens
cagctcttctccaggctgt

SEQ ID NO: 4979811 - DNA, 23 bp, Homo sapiens
cagctcttctccaggctgtatcc

SEQ ID NO: 4979812 - DNA, 18 bp, Homo sapiens
cagctgagttatgatgta

SEQ ID NO: 4979813 - DNA, 16 bp, Homo sapiens
cagctgatacttcatt

SEQ ID NO: 4979814 - DNA, 21 bp, Homo sapiens
cagctgatacttcatttaaaa

SEQ ID NO: 4979815 - DNA, 18 bp, Homo sapiens
cagctgatgttggaagag

SEQ ID NO: 4979816 - DNA, 16 bp, Homo sapiens
cagctgcaccagagca

SEQ ID NO: 4979817 - DNA, 16 bp, Homo sapiens
cagctgcagctgggct

SEQ ID NO: 4979818 - DNA, 15 bp, Homo sapiens
cagctgcaggaatca

SEQ ID NO: 4979819 - DNA, 14 bp, Homo sapiens
cagctgcctcactt

SEQ ID NO: 4979820 - DNA, 21 bp, Homo sapiens
cagctgcggtccacccaggag

SEQ ID NO: 4979821 - DNA, 22 bp, Homo sapiens
cagctgcggtccacccaggagc

SEQ ID NO: 4979822 - DNA, 23 bp, Homo sapiens
cagctgcggtccacccaggagcc

SEQ ID NO: 4979823 - DNA, 24 bp, Homo sapiens
cagctggacagaggggactctggg

SEQ ID NO: 4979824 - DNA, 23 bp, Homo sapiens
cagctggactctgcatcccagca

SEQ ID NO: 4979825 - DNA, 15 bp, Homo sapiens
cagctggcctggaca

SEQ ID NO: 4979826 - DNA, 18 bp, Homo sapiens
cagctgtaacacagctga

SEQ ID NO: 4979827 - DNA, 21 bp, Homo sapiens
ccctagagcctgcctggagcg

SEQ ID NO: 4979828 - DNA, 13 bp, Homo sapiens
ccctagatagttt

SEQ ID NO: 4979829 - DNA, 13 bp, Homo sapiens
ccctagcccagga

SEQ ID NO: 4979830 - DNA, 12 bp, Homo sapiens
ccctaggttccc

SEQ ID NO: 4979831 - DNA, 15 bp, Homo sapiens
ccctaggttccctgt

SEQ ID NO: 4979832 - DNA, 19 bp, Homo sapiens
ccctaggttccctgttctt

SEQ ID NO: 4979833 - DNA, 16 bp, Homo sapiens
ccctagtcccttcccc

SEQ ID NO: 4979834 - DNA, 22 bp, Homo sapiens
ccctagtcccttcccctccctg

SEQ ID NO: 4979835 - DNA, 21 bp, Homo sapiens
ccctagttccctctgctcagc

SEQ ID NO: 4979836 - DNA, 23 bp, Homo sapiens
ccctatatgtagtataaagaaaa

SEQ ID NO: 4979837 - DNA, 19 bp, Homo sapiens
ccctatccttggcaccaaa

SEQ ID NO: 4979838 - DNA, 14 bp, Homo sapiens
ccctatctcctgac

SEQ ID NO: 4979839 - DNA, 17 bp, Homo sapiens
ccctcacacatccagac

SEQ ID NO: 4979840 - DNA, 13 bp, Homo sapiens
ccctcacagcctc

SEQ ID NO: 4979841 - DNA, 16 bp, Homo sapiens
ccctcacagcctctga

SEQ ID NO: 4979842 - DNA, 18 bp, Homo sapiens
ccctcacagcctctgacc

SEQ ID NO: 4979843 - DNA, 17 bp, Homo sapiens
ccctcactctgccaggg

SEQ ID NO: 4979844 - DNA, 21 bp, Homo sapiens
ccctcactctgccagggcagt

SEQ ID NO: 4979845 - DNA, 9 bp, Homo sapiens
ccctcagaa

SEQ ID NO: 4979846 - DNA, 22 bp, Homo sapiens
ccctcaggggaaaactgttacc

SEQ ID NO: 4979847 - DNA, 23 bp, Homo sapiens
ccctcatcttgaagggcccagga

SEQ ID NO: 4979848 - DNA, 21 bp, Homo sapiens
ccctcatggcccctctgacct

SEQ ID NO: 4979849 - DNA, 18 bp, Homo sapiens
ccctccagaaccaccccg

SEQ ID NO: 4979850 - DNA, 12 bp, Homo sapiens
ccctccagcctt

SEQ ID NO: 4979851 - DNA, 12 bp, Homo sapiens
ccctcccacccc

SEQ ID NO: 4979852 - DNA, 13 bp, Homo sapiens
ccctcccacctct

SEQ ID NO: 4979853 - DNA, 14 bp, Homo sapiens
ccctcccacctctg

SEQ ID NO: 4979854 - DNA, 19 bp, Homo sapiens
ccctcccacctctgtgacc

SEQ ID NO: 4979855 - DNA, 16 bp, Homo sapiens
ccctccccatcccatg

SEQ ID NO: 4979856 - DNA, 14 bp, Homo sapiens
ccctccccatggag

SEQ ID NO: 4979857 - DNA, 16 bp, Homo sapiens
ccctccccgcaccccc

SEQ ID NO: 4979858 - DNA, 12 bp, Homo sapiens
ccctcccctccc

SEQ ID NO: 4979859 - DNA, 16 bp, Homo sapiens
ccctcccctcccctgc

SEQ ID NO: 4979860 - DNA, 14 bp, Homo sapiens
ccctcccctgctgc

SEQ ID NO: 4979861 - DNA, 14 bp, Homo sapiens
ccctccctgcccct

SEQ ID NO: 4979862 - DNA, 16 bp, Homo sapiens
ccctccctggctccca

SEQ ID NO: 4979863 - DNA, 21 bp, Homo sapiens
ccctccgaccacttccagggg

SEQ ID NO: 4979864 - DNA, 18 bp, Homo sapiens
ccctcctcacctctggac

SEQ ID NO: 4979865 - DNA, 16 bp, Homo sapiens
ccctcctcactggcca

SEQ ID NO: 4979866 - DNA, 18 bp, Homo sapiens
ccctcctctagctgtggg

SEQ ID NO: 4979867 - DNA, 22 bp, Homo sapiens
ccctcctgagggaggacctggg

SEQ ID NO: 4979868 - DNA, 23 bp, Homo sapiens
ccctcctgtgctgggggaatgag

SEQ ID NO: 4979869 - DNA, 12 bp, Homo sapiens
ccctccttcaga

SEQ ID NO: 4979870 - DNA, 21 bp, Homo sapiens
ccctcgaagcgcgccactcgc

SEQ ID NO: 4979871 - DNA, 23 bp, Homo sapiens
ccctcgcctgtggagctcagccc

SEQ ID NO: 4979872 - DNA, 18 bp, Homo sapiens
ccctcgtggtccccaaca

SEQ ID NO: 4979873 - DNA, 23 bp, Homo sapiens
ccctcgtggtccccaacagcgac

SEQ ID NO: 4979874 - DNA, 12 bp, Homo sapiens
ccctctgccacc

SEQ ID NO: 4979875 - DNA, 19 bp, Homo sapiens
ccctctgccaccagagacc

SEQ ID NO: 4979876 - DNA, 14 bp, Homo sapiens
ccctctgctcagcc

SEQ ID NO: 4979877 - DNA, 22 bp, Homo sapiens
ccctctggaggggtgtggctcc

SEQ ID NO: 4979878 - DNA, 21 bp, Homo sapiens
ccctctgggaacctcccagag

SEQ ID NO: 4979879 - DNA, 12 bp, Homo sapiens
ccctcttcctga

SEQ ID NO: 4979880 - DNA, 22 bp, Homo sapiens
ccctcttgttttgtttgtctct

SEQ ID NO: 4979881 - DNA, 14 bp, Homo sapiens
ccctctttctcttt

SEQ ID NO: 4979882 - DNA, 19 bp, Homo sapiens
ccctctttctctttcttcc

SEQ ID NO: 4979883 - DNA, 21 bp, Homo sapiens
ccctctttctctttcttcctt

SEQ ID NO: 4979884 - DNA, 17 bp, Homo sapiens
ccctctttggctcccct

SEQ ID NO: 4979885 - DNA, 20 bp, Homo sapiens
ccctctttggctcccctgta

SEQ ID NO: 4979886 - DNA, 21 bp, Homo sapiens
ccctctttggctcccctgtac

SEQ ID NO: 4979887 - DNA, 23 bp, Homo sapiens
ccctgaaaatgtttttctgccag

SEQ ID NO: 4979888 - DNA, 21 bp, Homo sapiens
ccctgaaacacgaaacttgtt

SEQ ID NO: 4979889 - DNA, 14 bp, Homo sapiens
ccctgaacaagaat

SEQ ID NO: 4979890 - DNA, 14 bp, Homo sapiens
ccctgaagccagcc

SEQ ID NO: 4979891 - DNA, 17 bp, Homo sapiens
ccctgaagccagccttc

SEQ ID NO: 4979892 - DNA, 18 bp, Homo sapiens
ccctgaagccagccttct

SEQ ID NO: 4979893 - DNA, 16 bp, Homo sapiens
ccctgagatcccctga

SEQ ID NO: 4979894 - DNA, 19 bp, Homo sapiens
ccctgagatcccctgagcc

SEQ ID NO: 4979895 - DNA, 20 bp, Homo sapiens
ccctgagatcccctgagccc

SEQ ID NO: 4979896 - DNA, 21 bp, Homo sapiens
ccctgattgacctgctccgct

SEQ ID NO: 4979897 - DNA, 16 bp, Homo sapiens
ccctgatttcttgctt

SEQ ID NO: 4979898 - DNA, 23 bp, Homo sapiens
ccctgcaaaatttgatgccagga

SEQ ID NO: 4979899 - DNA, 21 bp, Homo sapiens
ccctgcaaggcccacaggagg

SEQ ID NO: 4979900 - DNA, 23 bp, Homo sapiens
ccctgcaatgtatcccttctcac

SEQ ID NO: 4979901 - DNA, 22 bp, Homo sapiens
ccctgcactaaagccagcctga

SEQ ID NO: 4979902 - DNA, 19 bp, Homo sapiens
ccctgcacttgcagactct

SEQ ID NO: 4979903 - DNA, 22 bp, Homo sapiens
ccctgcacttgcagactctaca

SEQ ID NO: 4979904 - DNA, 20 bp, Homo sapiens
ccctgcagatgccaccctag

SEQ ID NO: 4979905 - DNA, 12 bp, Homo sapiens
ccctgccaccct

SEQ ID NO: 4979906 - DNA, 14 bp, Homo sapiens
ccctgccaccctgg

SEQ ID NO: 4979907 - DNA, 14 bp, Homo sapiens
ccctgccacctccc

SEQ ID NO: 4979908 - DNA, 16 bp, Homo sapiens
ccctgccagaggggaa

SEQ ID NO: 4979909 - DNA, 22 bp, Homo sapiens
ccctgcccaggccggccagcct

SEQ ID NO: 4979910 - DNA, 19 bp, Homo sapiens
ccctgccccccagcctctg

SEQ ID NO: 4979911 - DNA, 21 bp, Homo sapiens
ccctgccccccagcctctggc

SEQ ID NO: 4979912 - DNA, 17 bp, Homo sapiens
ccctgcccctcccttca

SEQ ID NO: 4979913 - DNA, 13 bp, Homo sapiens
ccgcacaccctca

SEQ ID NO: 4979914 - DNA, 15 bp, Homo sapiens
ccgcacagcagcctg

SEQ ID NO: 4979915 - DNA, 21 bp, Homo sapiens
ccgcacagcagcctgcttccc

SEQ ID NO: 4979916 - DNA, 14 bp, Homo sapiens
ccgcacagctcagg

SEQ ID NO: 4979917 - DNA, 13 bp, Homo sapiens
ccgcaccccccaa

SEQ ID NO: 4979918 - DNA, 18 bp, Homo sapiens
ccgcagacctccccagcc

SEQ ID NO: 4979919 - DNA, 19 bp, Homo sapiens
ccgcagacctccccagccc

SEQ ID NO: 4979920 - DNA, 20 bp, Homo sapiens
ccgcagacctccccagcccc

SEQ ID NO: 4979921 - DNA, 20 bp, Homo sapiens
ccgccaatgcacggcctcgc

SEQ ID NO: 4979922 - DNA, 16 bp, Homo sapiens
ccgccacacagaccac

SEQ ID NO: 4979923 - DNA, 23 bp, Homo sapiens
ccgcccacaggaagcctgcagtc

SEQ ID NO: 4979924 - DNA, 14 bp, Homo sapiens
ccgcccatgcactg

SEQ ID NO: 4979925 - DNA, 13 bp, Homo sapiens
ccgcccccagcct

SEQ ID NO: 4979926 - DNA, 14 bp, Homo sapiens
ccgccccctcctga

SEQ ID NO: 4979927 - DNA, 13 bp, Homo sapiens
ccgcccctgcagc

SEQ ID NO: 4979928 - DNA, 16 bp, Homo sapiens
ccgcccctgcagcacg

SEQ ID NO: 4979929 - DNA, 17 bp, Homo sapiens
ccgcccctgcagcacgg

SEQ ID NO: 4979930 - DNA, 14 bp, Homo sapiens
ccgccctcttcctg

SEQ ID NO: 4979931 - DNA, 14 bp, Homo sapiens
ccgcctcccagcct

SEQ ID NO: 4979932 - DNA, 23 bp, Homo sapiens
ccgcctgtctctttaagggcatg

SEQ ID NO: 4979933 - DNA, 12 bp, Homo sapiens
ccgccttccttg

SEQ ID NO: 4979934 - DNA, 17 bp, Homo sapiens
ccgcgggttccgcaggc

SEQ ID NO: 4979935 - DNA, 16 bp, Homo sapiens
ccgcgtttagaccaag

SEQ ID NO: 4979936 - DNA, 20 bp, Homo sapiens
ccgctagagcagcccaaatt

SEQ ID NO: 4979937 - DNA, 20 bp, Homo sapiens
ccgctcacctagagccagac

SEQ ID NO: 4979938 - DNA, 21 bp, Homo sapiens
ccgctcagccctccctgcccc

SEQ ID NO: 4979939 - DNA, 22 bp, Homo sapiens
ccgctcagccctccctgcccct

SEQ ID NO: 4979940 - DNA, 20 bp, Homo sapiens
ccgctctacatcttctgcct

SEQ ID NO: 4979941 - DNA, 13 bp, Homo sapiens
cctactgttctaa

SEQ ID NO: 4979942 - DNA, 16 bp, Homo sapiens
cctactgttctaaagc

SEQ ID NO: 4979943 - DNA, 16 bp, Homo sapiens
cctacttcttttgctc

SEQ ID NO: 4979944 - DNA, 22 bp, Homo sapiens
cctacttcttttgctcttagct

SEQ ID NO: 4979945 - DNA, 18 bp, Homo sapiens
cctagaaacccaagctcc

SEQ ID NO: 4979946 - DNA, 18 bp, Homo sapiens
cctagagaacgcagccct

SEQ ID NO: 4979947 - DNA, 15 bp, Homo sapiens
cctagagccagacca

SEQ ID NO: 4979948 - DNA, 14 bp, Homo sapiens
cctagagcctgcct

SEQ ID NO: 4979949 - DNA, 19 bp, Homo sapiens
cctagagcctgcctggagc

SEQ ID NO: 4979950 - DNA, 15 bp, Homo sapiens
cctagcaagctggcc

SEQ ID NO: 4979951 - DNA, 13 bp, Homo sapiens
cctagcccaccct

SEQ ID NO: 4979952 - DNA, 16 bp, Homo sapiens
cctagcccaccctgct

SEQ ID NO: 4979953 - DNA, 20 bp, Homo sapiens
cctagcccagcgctctgcct

SEQ ID NO: 4979954 - DNA, 19 bp, Homo sapiens
cctagcccaggagagagaa

SEQ ID NO: 4979955 - DNA, 20 bp, Homo sapiens
cctagccctctcacatttat

SEQ ID NO: 4979956 - DNA, 17 bp, Homo sapiens
cctagcctgtttcttcc

SEQ ID NO: 4979957 - DNA, 22 bp, Homo sapiens
cctagctttatatatggacatg

SEQ ID NO: 4979958 - DNA, 17 bp, Homo sapiens
cctaggaccactcagcc

SEQ ID NO: 4979959 - DNA, 18 bp, Homo sapiens
cctaggaccactcagccc

SEQ ID NO: 4979960 - DNA, 19 bp, Homo sapiens
cctaggaccactcagcccc

SEQ ID NO: 4979961 - DNA, 21 bp, Homo sapiens
cctaggaccactcagccccta

SEQ ID NO: 4979962 - DNA, 23 bp, Homo sapiens
cctaggaccactcagcccctagg

SEQ ID NO: 4979963 - DNA, 14 bp, Homo sapiens
cctaggattctaaa

SEQ ID NO: 4979964 - DNA, 13 bp, Homo sapiens
cctaggtgacaga

SEQ ID NO: 4979965 - DNA, 18 bp, Homo sapiens
cctaggtgacagagtgag

SEQ ID NO: 4979966 - DNA, 20 bp, Homo sapiens
cctaggttccctgttcttcc

SEQ ID NO: 4979967 - DNA, 13 bp, Homo sapiens
cctagtactgccc

SEQ ID NO: 4979968 - DNA, 16 bp, Homo sapiens
cctagtccagtgacct

SEQ ID NO: 4979969 - DNA, 22 bp, Homo sapiens
cctagttccctctgctcagcca

SEQ ID NO: 4979970 - DNA, 14 bp, Homo sapiens
cctagtttccctga

SEQ ID NO: 4979971 - DNA, 13 bp, Homo sapiens
cctagtttcctct

SEQ ID NO: 4979972 - DNA, 17 bp, Homo sapiens
cctagtttcctctcctt

SEQ ID NO: 4979973 - DNA, 15 bp, Homo sapiens
cctagtttgacctca

SEQ ID NO: 4979974 - DNA, 14 bp, Homo sapiens
cctataacttgatg

SEQ ID NO: 4979975 - DNA, 19 bp, Homo sapiens
cctataacttgatgcatgt

SEQ ID NO: 4979976 - DNA, 14 bp, Homo sapiens
cctataatctgtca

SEQ ID NO: 4979977 - DNA, 23 bp, Homo sapiens
cctataatctgtcaaaacactgt

SEQ ID NO: 4979978 - DNA, 14 bp, Homo sapiens
cctataatgtgtgt

SEQ ID NO: 4979979 - DNA, 17 bp, Homo sapiens
cctataatgtgtgtatg

SEQ ID NO: 4979980 - DNA, 17 bp, Homo sapiens
cctatcacctatttcca

SEQ ID NO: 4979981 - DNA, 17 bp, Homo sapiens
cctatccttggcaccaa

SEQ ID NO: 4979982 - DNA, 16 bp, Homo sapiens
cctatctcctgacaga

SEQ ID NO: 4979983 - DNA, 21 bp, Homo sapiens
cctatgagcatcctgagcccc

SEQ ID NO: 4979984 - DNA, 14 bp, Homo sapiens
cctatgcacatatg

SEQ ID NO: 4979985 - DNA, 14 bp, Homo sapiens
cctatgtatttgca

SEQ ID NO: 4979986 - DNA, 22 bp, Homo sapiens
cctattgcaaaggttccaactg

SEQ ID NO: 4979987 - DNA, 16 bp, Homo sapiens
cctatttacctgcagg

SEQ ID NO: 4979988 - DNA, 17 bp, Homo sapiens
cctatttgccatgggct

SEQ ID NO: 4979989 - DNA, 14 bp, Homo sapiens
cctatttttgtaaa

SEQ ID NO: 4979990 - DNA, 13 bp, Homo sapiens
cctatttttgtag

SEQ ID NO: 4979991 - DNA, 16 bp, Homo sapiens
cctcaaaggcccgctc

SEQ ID NO: 4979992 - DNA, 15 bp, Homo sapiens
cctcaacctcctggg

SEQ ID NO: 4979993 - DNA, 20 bp, Homo sapiens
cctcaacctcctgtggaacc

SEQ ID NO: 4979994 - DNA, 12 bp, Homo sapiens
cctcacagcctc

SEQ ID NO: 4979995 - DNA, 18 bp, Homo sapiens
cctcacagcctctgaccc

SEQ ID NO: 4979996 - DNA, 21 bp, Homo sapiens
cctcacagcctctgacccctc

SEQ ID NO: 4979997 - DNA, 22 bp, Homo sapiens
cctcacagcctctgacccctcc

SEQ ID NO: 4979998 - DNA, 19 bp, Homo sapiens
cctcacagtcccactgtgc

SEQ ID NO: 4979999 - DNA, 13 bp, Homo sapiens
cctcacagtgacc

SEQ ID NO: 4980000 - DNA, 22 bp, Homo sapiens
cctcacccctgtcctcactgct

SEQ ID NO: 4980001 - DNA, 11 bp, Homo sapiens
cctcaccctgc

SEQ ID NO: 4980002 - DNA, 13 bp, Homo sapiens
cctcacctctacc

SEQ ID NO: 4980003 - DNA, 13 bp, Homo sapiens
cctcacctctgga

SEQ ID NO: 4980004 - DNA, 15 bp, Homo sapiens
cctcactctgccagg

SEQ ID NO: 4980005 - DNA, 18 bp, Homo sapiens
cctcactctgccagggca

SEQ ID NO: 4980006 - DNA, 19 bp, Homo sapiens
cctcactctgccagggcag

SEQ ID NO: 4980007 - DNA, 22 bp, Homo sapiens
cctcactctgccagggcagtgc

SEQ ID NO: 4980008 - DNA, 20 bp, Homo sapiens
cctcactgcccgcacaccct

SEQ ID NO: 4980009 - DNA, 12 bp, Homo sapiens
cctcactggcca

SEQ ID NO: 4980010 - DNA, 16 bp, Homo sapiens
cctcactgttgaattt

SEQ ID NO: 4980011 - DNA, 16 bp, Homo sapiens
cctcagagccacccct

SEQ ID NO: 4980012 - DNA, 16 bp, Homo sapiens
cctcagatgtcccttg

SEQ ID NO: 4980013 - DNA, 23 bp, Homo sapiens
cctcagatgtcccttgatgcaca

SEQ ID NO: 4980014 - DNA, 16 bp, Homo sapiens
cctcagccacacccag

SEQ ID NO: 4980015 - DNA, 19 bp, Homo sapiens
cctcagccacacccaggca

SEQ ID NO: 4980016 - DNA, 19 bp, Homo sapiens
cctcagcctcccaaagtgc

SEQ ID NO: 4980017 - DNA, 22 bp, Homo sapiens
cctcagcctcccaagtagctgg

SEQ ID NO: 4980018 - DNA, 22 bp, Homo sapiens
cctcagcctcccgaatagctgg

SEQ ID NO: 4980019 - DNA, 13 bp, Homo sapiens
cctcagctgcctc

SEQ ID NO: 4980020 - DNA, 15 bp, Homo sapiens
cctcaggcactagcc

SEQ ID NO: 4980021 - DNA, 19 bp, Homo sapiens
cctcaggcactagcctttg

SEQ ID NO: 4980022 - DNA, 13 bp, Homo sapiens
cctcaggcaggaa

SEQ ID NO: 4980023 - DNA, 17 bp, Homo sapiens
cctcagggagcagggaa

SEQ ID NO: 4980024 - DNA, 19 bp, Homo sapiens
cctcagggagcagggaagg

SEQ ID NO: 4980025 - DNA, 20 bp, Homo sapiens
cctcagggagcagggaaggc

SEQ ID NO: 4980026 - DNA, 21 bp, Homo sapiens
cctcaggggaaaactgttacc

SEQ ID NO: 4980027 - DNA, 19 bp, Homo sapiens
cctcaggtgatccacccac

SEQ ID NO: 4980028 - DNA, 24 bp, Homo sapiens
cctcaggtgttttttatgaagtgc

SEQ ID NO: 4980029 - DNA, 11 bp, Homo sapiens
cctcagtcctc

SEQ ID NO: 4980030 - DNA, 24 bp, Homo sapiens
cctcagtcctcccctcacagcctc

SEQ ID NO: 4980031 - DNA, 20 bp, Homo sapiens
cctcagttcccttggcctca

SEQ ID NO: 4980032 - DNA, 12 bp, Homo sapiens
cctcatatttaa

SEQ ID NO: 4980033 - DNA, 22 bp, Homo sapiens
cctcatccaccccatccctccc

SEQ ID NO: 4980034 - DNA, 16 bp, Homo sapiens
cctcatctatgaggaa

SEQ ID NO: 4980035 - DNA, 15 bp, Homo sapiens
cctcatggcccctct

SEQ ID NO: 4980036 - DNA, 16 bp, Homo sapiens
cctcatggcccctctg

SEQ ID NO: 4980037 - DNA, 18 bp, Homo sapiens
cctcatggcccctctgac

SEQ ID NO: 4980038 - DNA, 21 bp, Homo sapiens
cctcatgtacataccctggcc

SEQ ID NO: 4980039 - DNA, 13 bp, Homo sapiens
cctcatgtttatg

SEQ ID NO: 4980040 - DNA, 14 bp, Homo sapiens
cctccacagcgagg

SEQ ID NO: 4980041 - DNA, 15 bp, Homo sapiens
cctccacagcgaggg

SEQ ID NO: 4980042 - DNA, 12 bp, Homo sapiens
cctccactgtca

SEQ ID NO: 4980043 - DNA, 22 bp, Homo sapiens
cctccagaactcactggggcct

SEQ ID NO: 4980044 - DNA, 12 bp, Homo sapiens
cctccagaagcc

SEQ ID NO: 4980045 - DNA, 17 bp, Homo sapiens
cctccagaagcctctgg

SEQ ID NO: 4980046 - DNA, 20 bp, Homo sapiens
cctccagaagcctctggcta

SEQ ID NO: 4980047 - DNA, 21 bp, Homo sapiens
cctccagaagcctctggctag

SEQ ID NO: 4980048 - DNA, 22 bp, Homo sapiens
cctccagaagcctctggctaga

SEQ ID NO: 4980049 - DNA, 12 bp, Homo sapiens
cctccagcccgg

SEQ ID NO: 4980050 - DNA, 15 bp, Homo sapiens
cctccagcccgggag

SEQ ID NO: 4980051 - DNA, 23 bp, Homo sapiens
cctctgccagaagatcccctcag

SEQ ID NO: 4980052 - DNA, 11 bp, Homo sapiens
cctctgcctga

SEQ ID NO: 4980053 - DNA, 19 bp, Homo sapiens
cctctgcctgtctccccca

SEQ ID NO: 4980054 - DNA, 16 bp, Homo sapiens
cctctgcggaccccag

SEQ ID NO: 4980055 - DNA, 17 bp, Homo sapiens
cctctgcggaccccagc

SEQ ID NO: 4980056 - DNA, 18 bp, Homo sapiens
cctctgcggaccccagct

SEQ ID NO: 4980057 - DNA, 13 bp, Homo sapiens
cctctgctcagcc

SEQ ID NO: 4980058 - DNA, 15 bp, Homo sapiens
cctctgctcagccaa

SEQ ID NO: 4980059 - DNA, 16 bp, Homo sapiens
cctctggactggctag

SEQ ID NO: 4980060 - DNA, 18 bp, Homo sapiens
cctctggactggctagag

SEQ ID NO: 4980061 - DNA, 17 bp, Homo sapiens
cctctggagccctaacc

SEQ ID NO: 4980062 - DNA, 23 bp, Homo sapiens
cctctggcattagaattatttaa

SEQ ID NO: 4980063 - DNA, 17 bp, Homo sapiens
cctctggccgcctaggc

SEQ ID NO: 4980064 - DNA, 13 bp, Homo sapiens
cctctggctagag

SEQ ID NO: 4980065 - DNA, 23 bp, Homo sapiens
cctctggctagaggccagcccca

SEQ ID NO: 4980066 - DNA, 24 bp, Homo sapiens
cctctggctagaggccagccccac

SEQ ID NO: 4980067 - DNA, 23 bp, Homo sapiens
cctctgggaaatgagaaggcagc

SEQ ID NO: 4980068 - DNA, 14 bp, Homo sapiens
cctctgggaacctc

SEQ ID NO: 4980069 - DNA, 15 bp, Homo sapiens
cctctgggaacctcc

SEQ ID NO: 4980070 - DNA, 21 bp, Homo sapiens
cctctgggaacctcccagagg

SEQ ID NO: 4980071 - DNA, 17 bp, Homo sapiens
cctctggggctctaggg

SEQ ID NO: 4980072 - DNA, 17 bp, Homo sapiens
cctctgtccaggcactg

SEQ ID NO: 4980073 - DNA, 22 bp, Homo sapiens
cctctgtctcatcctcctggaa

SEQ ID NO: 4980074 - DNA, 23 bp, Homo sapiens
cctctgtctcatcctcctggaac

SEQ ID NO: 4980075 - DNA, 14 bp, Homo sapiens
cctctgtctgccct

SEQ ID NO: 4980076 - DNA, 17 bp, Homo sapiens
cctctgtgacctcaggc

SEQ ID NO: 4980077 - DNA, 14 bp, Homo sapiens
cctctgtgccttct

SEQ ID NO: 4980078 - DNA, 13 bp, Homo sapiens
cctctgtgtcctt

SEQ ID NO: 4980079 - DNA, 19 bp, Homo sapiens
cctctgtgtccttccctgc

SEQ ID NO: 4980080 - DNA, 19 bp, Homo sapiens
cctcttaaagctgcctgta

SEQ ID NO: 4980081 - DNA, 20 bp, Homo sapiens
cctcttaaagctgcctgtag

SEQ ID NO: 4980082 - DNA, 22 bp, Homo sapiens
cctcttaaagctgcctgtagtt

SEQ ID NO: 4980083 - DNA, 16 bp, Homo sapiens
cctcttactaatgtaa

SEQ ID NO: 4980084 - DNA, 20 bp, Homo sapiens
cctcttcaccccggcaggcc

SEQ ID NO: 4980085 - DNA, 11 bp, Homo sapiens
cctcttcccca

SEQ ID NO: 4980086 - DNA, 17 bp, Homo sapiens
aaaaactatgttcagaa

SEQ ID NO: 4980087 - DNA, 16 bp, Homo sapiens
aaaactatgttcagaa

SEQ ID NO: 4980088 - DNA, 19 bp, Homo sapiens
aaaattgtttccaaagtgc

SEQ ID NO: 4980089 - DNA, 12 bp, Homo sapiens
aaagagaaaaac

SEQ ID NO: 4980090 - DNA, 13 bp, Homo sapiens
aaagtgcatgtca

SEQ ID NO: 4980091 - DNA, 20 bp, Homo sapiens
aaccacggtcacacctcact

SEQ ID NO: 4980092 - DNA, 12 bp, Homo sapiens
aacttcatctgc

SEQ ID NO: 4980093 - DNA, 13 bp, Homo sapiens
aacttcatctgcc

SEQ ID NO: 4980094 - DNA, 15 bp, Homo sapiens
aaggcattgcacaga

SEQ ID NO: 4980095 - DNA, 12 bp, Homo sapiens
aagtagaaaaat

SEQ ID NO: 4980096 - DNA, 20 bp, Homo sapiens
aagtagaaaaattgtttcca

SEQ ID NO: 4980097 - DNA, 15 bp, Homo sapiens
aagtgcatgtcacat

SEQ ID NO: 4980098 - DNA, 19 bp, Homo sapiens
aagtgcatgtcacatgcca

SEQ ID NO: 4980099 - DNA, 14 bp, Homo sapiens
aatgacttccatat

SEQ ID NO: 4980100 - DNA, 20 bp, Homo sapiens
acaaccacggtcacacctca

SEQ ID NO: 4980101 - DNA, 22 bp, Homo sapiens
acaaccacggtcacacctcact

SEQ ID NO: 4980102 - DNA, 12 bp, Homo sapiens
acacctcactgt

SEQ ID NO: 4980103 - DNA, 17 bp, Homo sapiens
acacctcactgtcatct

SEQ ID NO: 4980104 - DNA, 22 bp, Homo sapiens
acacctcactgtcatctgccag

SEQ ID NO: 4980105 - DNA, 13 bp, Homo sapiens
acagaaattgcat

SEQ ID NO: 4980106 - DNA, 21 bp, Homo sapiens
accacggtcacacctcactgt

SEQ ID NO: 4980107 - DNA, 14 bp, Homo sapiens
acctcactgtcatc

SEQ ID NO: 4980108 - DNA, 17 bp, Homo sapiens
acctcactgtcatctgc

SEQ ID NO: 4980109 - DNA, 19 bp, Homo sapiens
acctcactgtcatctgcca

SEQ ID NO: 4980110 - DNA, 21 bp, Homo sapiens
acctcactgtcatctgccagg

SEQ ID NO: 4980111 - DNA, 13 bp, Homo sapiens
acctccatgtcat

SEQ ID NO: 4980112 - DNA, 15 bp, Homo sapiens
acggtcacacctcac

SEQ ID NO: 4980113 - DNA, 20 bp, Homo sapiens
acggtcacacctcactgtca

SEQ ID NO: 4980114 - DNA, 15 bp, Homo sapiens
actgtcatctgccag

SEQ ID NO: 4980115 - DNA, 16 bp, Homo sapiens
actgtcatctgccagg

SEQ ID NO: 4980116 - DNA, 16 bp, Homo sapiens
agaaaaattgtttcca

SEQ ID NO: 4980117 - DNA, 19 bp, Homo sapiens
agaaaaattgtttccaaag

SEQ ID NO: 4980118 - DNA, 20 bp, Homo sapiens
agataaaatctactccaaat

SEQ ID NO: 4980119 - DNA, 17 bp, Homo sapiens
agcaacaaatatgtcaa

SEQ ID NO: 4980120 - DNA, 16 bp, Homo sapiens
aggagtaacttgcaag

SEQ ID NO: 4980121 - DNA, 23 bp, Homo sapiens
aggatgagccacagaaattgcat

SEQ ID NO: 4980122 - DNA, 20 bp, Homo sapiens
agtagaaaaattgtttccaa

SEQ ID NO: 4980123 - DNA, 12 bp, Homo sapiens
agtgcatgtcac

SEQ ID NO: 4980124 - DNA, 18 bp, Homo sapiens
ataaaatctactccaaat

SEQ ID NO: 4980125 - DNA, 21 bp, Homo sapiens
atataccaatgacttccatat

SEQ ID NO: 4980126 - DNA, 20 bp, Homo sapiens
atattttaaaagagaaaaac

SEQ ID NO: 4980127 - DNA, 20 bp, Homo sapiens
atgccttttttttttttaag

SEQ ID NO: 4980128 - DNA, 16 bp, Homo sapiens
atgtcacatgccacaa

SEQ ID NO: 4980129 - DNA, 20 bp, Homo sapiens
atgttcagaacttcatctgc

SEQ ID NO: 4980130 - DNA, 12 bp, Homo sapiens
attcattgtttg

SEQ ID NO: 4980131 - DNA, 17 bp, Homo sapiens
attcattgtttgtttta

SEQ ID NO: 4980132 - DNA, 21 bp, Homo sapiens
attcctttttatttgtttgca

SEQ ID NO: 4980133 - DNA, 13 bp, Homo sapiens
attgtttccaaag

SEQ ID NO: 4980134 - DNA, 22 bp, Homo sapiens
attgtttccaaagtgcatgtca

SEQ ID NO: 4980135 - DNA, 23 bp, Homo sapiens
attgtttccaaagtgcatgtcac

SEQ ID NO: 4980136 - DNA, 13 bp, Homo sapiens
attgtttgtttta

SEQ ID NO: 4980137 - DNA, 15 bp, Homo sapiens
atttactttgcattt

SEQ ID NO: 4980138 - DNA, 14 bp, Homo sapiens
atttgtttgcaata

SEQ ID NO: 4980139 - DNA, 17 bp, Homo sapiens
caaaaactttcatgcct

SEQ ID NO: 4980140 - DNA, 15 bp, Homo sapiens
caaagcagataaaat

SEQ ID NO: 4980141 - DNA, 21 bp, Homo sapiens
caaagtgcatgtcacatgcca

SEQ ID NO: 4980142 - DNA, 16 bp, Homo sapiens
cacacctcactgtcat

SEQ ID NO: 4980143 - DNA, 13 bp, Homo sapiens
cacctcactgtca

SEQ ID NO: 4980144 - DNA, 16 bp, Homo sapiens
cacctcactgtcatct

SEQ ID NO: 4980145 - DNA, 16 bp, Homo sapiens
cacctccatgtcatcc

SEQ ID NO: 4980146 - DNA, 14 bp, Homo sapiens
cactctttccagat

SEQ ID NO: 4980147 - DNA, 15 bp, Homo sapiens
cactgtcatctgcca

SEQ ID NO: 4980148 - DNA, 18 bp, Homo sapiens
cagaacttcatctgccac

SEQ ID NO: 4980149 - DNA, 21 bp, Homo sapiens
cagataaaatctactccaaat

SEQ ID NO: 4980150 - DNA, 13 bp, Homo sapiens
cagattttttgta

SEQ ID NO: 4980151 - DNA, 22 bp, Homo sapiens
caggcagcccaaaagtttattg

SEQ ID NO: 4980152 - DNA, 17 bp, Homo sapiens
cagttttttcacctcca

SEQ ID NO: 4980153 - DNA, 23 bp, Homo sapiens
cagttttttcacctccatgtcat

SEQ ID NO: 4980154 - DNA, 21 bp, Homo sapiens
catattttaaaagagaaaaac

SEQ ID NO: 4980155 - DNA, 14 bp, Homo sapiens
catgtcacatgcca

SEQ ID NO: 4980156 - DNA, 21 bp, Homo sapiens
catgtcacatgccacaaccac

SEQ ID NO: 4980157 - DNA, 14 bp, Homo sapiens
catgtgcaaagtga

SEQ ID NO: 4980158 - DNA, 12 bp, Homo sapiens
cattttgtttca

SEQ ID NO: 4980159 - DNA, 24 bp, Homo sapiens
ccagtgtttttcttcatgtgcaaa

SEQ ID NO: 4980160 - DNA, 11 bp, Homo sapiens
ccatgtcatcc

SEQ ID NO: 4980161 - DNA, 15 bp, Homo sapiens
cctcactgtcatctg

SEQ ID NO: 4980162 - DNA, 16 bp, Homo sapiens
cctcactgtcatctgc

SEQ ID NO: 4980163 - DNA, 12 bp, Homo sapiens
cctccatgtcat

SEQ ID NO: 4980164 - DNA, 13 bp, Homo sapiens
ctacactggataa

SEQ ID NO: 4980165 - DNA, 13 bp, Homo sapiens
ctcactgtcatct

SEQ ID NO: 4980166 - DNA, 19 bp, Homo sapiens
ctcactgtcatctgccagg

SEQ ID NO: 4980167 - DNA, 13 bp, Homo sapiens
ctccatgtcatcc

SEQ ID NO: 4980168 - DNA, 14 bp, Homo sapiens
ctccatgtcatccg

SEQ ID NO: 4980169 - DNA, 14 bp, Homo sapiens
ctgtcatctgccag

SEQ ID NO: 4980170 - DNA, 13 bp, Homo sapiens
cttcatctgccac

SEQ ID NO: 4980171 - DNA, 17 bp, Homo sapiens
cttcatgtgcaaagtga

SEQ ID NO: 4980172 - DNA, 17 bp, Homo sapiens
ctttgcattttgtttca

SEQ ID NO: 4980173 - DNA, 14 bp, Homo sapiens
gaaaaattgtttcc

SEQ ID NO: 4980174 - DNA, 19 bp, Homo sapiens
gaaaaattgtttccaaagt

SEQ ID NO: 4980175 - DNA, 21 bp, Homo sapiens
gaacagcgtttttaacaagat

SEQ ID NO: 4980176 - DNA, 17 bp, Homo sapiens
gacatagcacgaatctg

SEQ ID NO: 4980177 - DNA, 20 bp, Homo sapiens
gataaaatctactccaaatt

SEQ ID NO: 4980178 - DNA, 17 bp, Homo sapiens
tcacacctcactgtcat

SEQ ID NO: 4980179 - DNA, 19 bp, Homo sapiens
tcacacctcactgtcatct

SEQ ID NO: 4980180 - DNA, 16 bp, Homo sapiens
tcaccagtgtttttct

SEQ ID NO: 4980181 - DNA, 15 bp, Homo sapiens
tcacctccatgtcat

SEQ ID NO: 4980182 - DNA, 15 bp, Homo sapiens
tcactctttccagat

SEQ ID NO: 4980183 - DNA, 16 bp, Homo sapiens
tcactgtcatctgcca

SEQ ID NO: 4980184 - DNA, 19 bp, Homo sapiens
tcagaacttcatctgccac

SEQ ID NO: 4980185 - DNA, 12 bp, Homo sapiens
tccatgtcatcc

SEQ ID NO: 4980186 - DNA, 12 bp, Homo sapiens
tctactccaaat

SEQ ID NO: 4980187 - DNA, 15 bp, Homo sapiens
tgagctgcactgacc

SEQ ID NO: 4980188 - DNA, 19 bp, Homo sapiens
tgcaaaaactttcatgcct

SEQ ID NO: 4980189 - DNA, 16 bp, Homo sapiens
tgcattttgtttcact

SEQ ID NO: 4980190 - DNA, 17 bp, Homo sapiens
tgccacaaccacggtca

SEQ ID NO: 4980191 - DNA, 10 bp, Homo sapiens
tgtttgcaat

SEQ ID NO: 4980192 - DNA, 17 bp, Homo sapiens
ttaacaagatttcagct

SEQ ID NO: 4980193 - DNA, 21 bp, Homo sapiens
ttaagtagaaaaattgtttcc

SEQ ID NO: 4980194 - DNA, 20 bp, Homo sapiens
ttactttgcattttgtttca

SEQ ID NO: 4980195 - DNA, 15 bp, Homo sapiens
ttcaccagtgttttt

SEQ ID NO: 4980196 - DNA, 18 bp, Homo sapiens
ttcacctccatgtcatcc

SEQ ID NO: 4980197 - DNA, 18 bp, Homo sapiens
ttcacgaacagcgttttt

SEQ ID NO: 4980198 - DNA, 16 bp, Homo sapiens
ttcactctttccagat

SEQ ID NO: 4980199 - DNA, 19 bp, Homo sapiens
ttcagaacttcatctgcca

SEQ ID NO: 4980200 - DNA, 12 bp, Homo sapiens
ttcatctgccac

SEQ ID NO: 4980201 - DNA, 14 bp, Homo sapiens
ttcatgcctttttt

SEQ ID NO: 4980202 - DNA, 20 bp, Homo sapiens
ttcctttttatttgtttgca

SEQ ID NO: 4980203 - DNA, 12 bp, Homo sapiens
ttgtttccaaag

SEQ ID NO: 4980204 - DNA, 13 bp, Homo sapiens
tttaagtagaaaa

SEQ ID NO: 4980205 - DNA, 17 bp, Homo sapiens
tttcacctccatgtcat

SEQ ID NO: 4980206 - DNA, 17 bp, Homo sapiens
tttcactctttccagat

SEQ ID NO: 4980207 - DNA, 21 bp, Homo sapiens
tttcagaagaaaggcattgca

SEQ ID NO: 4980208 - DNA, 14 bp, Homo sapiens
tttccaaagtgcat

SEQ ID NO: 4980209 - DNA, 18 bp, Homo sapiens
tttgtagtgattcattgt

SEQ ID NO: 4980210 - DNA, 19 bp, Homo sapiens
tttgtttcactctttccag

SEQ ID NO: 4980211 - DNA, 22 bp, Homo sapiens
ttttcagaagaaaggcattgca

SEQ ID NO: 4980212 - DNA, 16 bp, Homo sapiens
ttttcttcatgtgcaa

SEQ ID NO: 4980213 - DNA, 17 bp, Homo sapiens
ttttgtttcactctttc

SEQ ID NO: 4980214 - DNA, 22 bp, Homo sapiens
ttttgtttcactctttccagat

SEQ ID NO: 4980215 - DNA, 16 bp, Homo sapiens
tttttaagtagaaaaa

SEQ ID NO: 4980216 - DNA, 18 bp, Homo sapiens
tttttatttgtttgcaat

SEQ ID NO: 4980217 - DNA, 17 bp, Homo sapiens
ttcacctccatgtcatc

SEQ ID NO: 4980218 - DNA, 18 bp, Homo sapiens
ttcagaacttcatctgcc

SEQ ID NO: 4980219 - DNA, 15 bp, Homo sapiens
ttcagaagaaaggca

SEQ ID NO: 4980220 - DNA, 16 bp, Homo sapiens
ttcattgtttgtttta

SEQ ID NO: 4980221 - DNA, 20 bp, Homo sapiens
ttccaaagtgcatgtcacat

SEQ ID NO: 4980222 - DNA, 23 bp, Homo sapiens
ttctaaggagtaacttgcaagtt

SEQ ID NO: 4980223 - DNA, 23 bp, Homo sapiens
ttgcaccttatagttcatagcaa

SEQ ID NO: 4980224 - DNA, 23 bp, Homo sapiens
tttatgttgcaggaaaccctttt

SEQ ID NO: 4980225 - DNA, 13 bp, Homo sapiens
tttcacctccatg

SEQ ID NO: 4980226 - DNA, 18 bp, Homo sapiens
tttcacctccatgtcatc

SEQ ID NO: 4980227 - DNA, 19 bp, Homo sapiens
tttcacctccatgtcatcc

SEQ ID NO: 4980228 - DNA, 12 bp, Homo sapiens
tttccaaagtgc

SEQ ID NO: 4980229 - DNA, 21 bp, Homo sapiens
tttccaaagtgcatgtcacat

SEQ ID NO: 4980230 - DNA, 16 bp, Homo sapiens
ttttaagtagaaaaat

SEQ ID NO: 4980231 - DNA, 17 bp, Homo sapiens
ttttcacctccatgtca

SEQ ID NO: 4980232 - DNA, 18 bp, Homo sapiens
gattcattgtttgtttta

SEQ ID NO: 4980233 - DNA, 16 bp, Homo sapiens
ggaggatgagccacag

SEQ ID NO: 4980234 - DNA, 23 bp, Homo sapiens
ggtcacacctcactgtcatctgc

SEQ ID NO: 4980235 - DNA, 20 bp, Homo sapiens
gtattatatttaaaaaaaac

SEQ ID NO: 4980236 - DNA, 17 bp, Homo sapiens
gtcacacctcactgtca

SEQ ID NO: 4980237 - DNA, 23 bp, Homo sapiens
gtcacacctcactgtcatctgcc

SEQ ID NO: 4980238 - DNA, 14 bp, Homo sapiens
gtcacatgccacaa

SEQ ID NO: 4980239 - DNA, 12 bp, Homo sapiens
gtcatctgccag

SEQ ID NO: 4980240 - DNA, 15 bp, Homo sapiens
gtgattcattgtttg

SEQ ID NO: 4980241 - DNA, 20 bp, Homo sapiens
gtgcaaaaactttcatgcct

SEQ ID NO: 4980242 - DNA, 11 bp, Homo sapiens
gtgcaaagtga

SEQ ID NO: 4980243 - DNA, 18 bp, Homo sapiens
gttcagaacttcatctgc

SEQ ID NO: 4980244 - DNA, 20 bp, Homo sapiens
gttcagaacttcatctgcca

SEQ ID NO: 4980245 - DNA, 21 bp, Homo sapiens
gttcagaacttcatctgccac

SEQ ID NO: 4980246 - DNA, 16 bp, Homo sapiens
gtttcactctttccag

SEQ ID NO: 4980247 - DNA, 14 bp, Homo sapiens
gtttccaaagtgca

SEQ ID NO: 4980248 - DNA, 20 bp, Homo sapiens
taagtagaaaaattgtttcc

SEQ ID NO: 4980249 - DNA, 18 bp, Homo sapiens
taccaatgacttccatat

SEQ ID NO: 4980250 - DNA, 20 bp, Homo sapiens
tattatatttaaaaaaaact

SEQ ID NO: 4980251 - DNA, 20 bp, Homo sapiens
tcacacctcactgtcatctg

SEQ ID NO: 4980252 - DNA, 22 bp, Homo sapiens
tcacacctcactgtcatctgcc

SEQ ID NO: 4980253 - DNA, 14 bp, Homo sapiens
tcactgtcatctgc

SEQ ID NO: 4980254 - DNA, 15 bp, Homo sapiens
tcactgtcatctgcc

SEQ ID NO: 4980255 - DNA, 17 bp, Homo sapiens
tcactgtcatctgccag

SEQ ID NO: 4980256 - DNA, 17 bp, Homo sapiens
tcagaacttcatctgcc

SEQ ID NO: 4980257 - DNA, 17 bp, Homo sapiens
tcatccgagcaaggtgg

SEQ ID NO: 4980258 - DNA, 15 bp, Homo sapiens
tcatgtgcaaagtga

SEQ ID NO: 4980259 - DNA, 22 bp, Homo sapiens
tcatgtgcaaagtgactatttg

SEQ ID NO: 4980260 - DNA, 18 bp, Homo sapiens
tcttcatgtgcaaagtga

SEQ ID NO: 4980261 - DNA, 21 bp, Homo sapiens
tgatttgtagtgattcattgt

SEQ ID NO: 4980262 - DNA, 20 bp, Homo sapiens
tgcaagttttcagtacaaat

SEQ ID NO: 4980263 - DNA, 22 bp, Homo sapiens
tgcattttgtttcactctttcc

SEQ ID NO: 4980264 - DNA, 21 bp, Homo sapiens
tgccacaaccacggtcacacc

SEQ ID NO: 4980265 - DNA, 16 bp, Homo sapiens
tgtagtgattcattgt

SEQ ID NO: 4980266 - DNA, 14 bp, Homo sapiens
tgtcaagaacagga

SEQ ID NO: 4980267 - DNA, 12 bp, Homo sapiens
tgtgcaaagtga

SEQ ID NO: 4980268 - DNA, 19 bp, Homo sapiens
tgttcagaacttcatctgc

SEQ ID NO: 4980269 - DNA, 22 bp, Homo sapiens
tgttcagaacttcatctgccac

SEQ ID NO: 4980270 - DNA, 24 bp, Homo sapiens
tgttcagaacttcatctgccactg

SEQ ID NO: 4980271 - DNA, 16 bp, Homo sapiens
tgttgaacaaaactga

SEQ ID NO: 4980272 - DNA, 19 bp, Homo sapiens
tgttgcaggaaaccctttt

SEQ ID NO: 4980273 - DNA, 14 bp, Homo sapiens
tgtttcactctttc

SEQ ID NO: 4980274 - DNA, 23 bp, Homo sapiens
ttaagtagaaaaattgtttccaa

SEQ ID NO: 4980275 - DNA, 16 bp, Homo sapiens
ttcacctccatgtcat

SEQ ID NO: 4980276 - DNA, 12 bp, Homo sapiens
aaaaattgtttc

SEQ ID NO: 4980277 - DNA, 13 bp, Homo sapiens
aaaaattgtttcc

SEQ ID NO: 4980278 - DNA, 16 bp, Homo sapiens
aaaaattgtttccaaa

SEQ ID NO: 4980279 - DNA, 15 bp, Homo sapiens
aaaactttcatgcct

SEQ ID NO: 4980280 - DNA, 13 bp, Homo sapiens
aaaattgtttcca

SEQ ID NO: 4980281 - DNA, 15 bp, Homo sapiens
aaattgtttccaaag

SEQ ID NO: 4980282 - DNA, 22 bp, Homo sapiens
aaattgtttccaaagtgcatgt

SEQ ID NO: 4980283 - DNA, 19 bp, Homo sapiens
aaccacggtcacacctcac

SEQ ID NO: 4980284 - DNA, 23 bp, Homo sapiens
aactatgttcagaacttcatctg

SEQ ID NO: 4980285 - DNA, 14 bp, Homo sapiens
aacttcatctgcca

SEQ ID NO: 4980286 - DNA, 17 bp, Homo sapiens
aagaacaggacatagca

SEQ ID NO: 4980287 - DNA, 19 bp, Homo sapiens
aaggcattgcacagagtga

SEQ ID NO: 4980288 - DNA, 22 bp, Homo sapiens
aagtgcatgtcacatgccacaa

SEQ ID NO: 4980289 - DNA, 12 bp, Homo sapiens
aattgtttccaa

SEQ ID NO: 4980290 - DNA, 13 bp, Homo sapiens
aattgtttccaaa

SEQ ID NO: 4980291 - DNA, 19 bp, Homo sapiens
acacctcactgtcatctgc

SEQ ID NO: 4980292 - DNA, 22 bp, Homo sapiens
accagttttttcacctccatgt

SEQ ID NO: 4980293 - DNA, 12 bp, Homo sapiens
acctcactgtca

SEQ ID NO: 4980294 - DNA, 23 bp, Homo sapiens
actatgttcagaacttcatctgc

SEQ ID NO: 4980295 - DNA, 13 bp, Homo sapiens
actgacctctaca

SEQ ID NO: 4980296 - DNA, 14 bp, Homo sapiens
actgtcatctgcca

SEQ ID NO: 4980297 - DNA, 13 bp, Homo sapiens
acttcatctgcca

SEQ ID NO: 4980298 - DNA, 21 bp, Homo sapiens
acttcatctgccactggttat

SEQ ID NO: 4980299 - DNA, 15 bp, Homo sapiens
agaaaaattgtttcc

SEQ ID NO: 4980300 - DNA, 17 bp, Homo sapiens
agaaaaattgtttccaa

SEQ ID NO: 4980301 - DNA, 18 bp, Homo sapiens
agaaaaattgtttccaaa

SEQ ID NO: 4980302 - DNA, 22 bp, Homo sapiens
agaaaaattgtttccaaagtgc

SEQ ID NO: 4980303 - DNA, 14 bp, Homo sapiens
agaacttcatctgc

SEQ ID NO: 4980304 - DNA, 15 bp, Homo sapiens
agaacttcatctgcc

SEQ ID NO: 4980305 - DNA, 16 bp, Homo sapiens
agaacttcatctgcca

SEQ ID NO: 4980306 - DNA, 18 bp, Homo sapiens
agtagaaaaattgtttcc

SEQ ID NO: 4980307 - DNA, 19 bp, Homo sapiens
agtagaaaaattgtttcca

SEQ ID NO: 4980308 - DNA, 14 bp, Homo sapiens
agtgcatgtcacat

SEQ ID NO: 4980309 - DNA, 13 bp, Homo sapiens
agttttttcacct

SEQ ID NO: 4980310 - DNA, 19 bp, Homo sapiens
atcgtaaccagttttttca

SEQ ID NO: 4980311 - DNA, 23 bp, Homo sapiens
atctactccaaattattttcaag

SEQ ID NO: 4980312 - DNA, 19 bp, Homo sapiens
atgtaaaacagattttttg

SEQ ID NO: 4980313 - DNA, 13 bp, Homo sapiens
atgtgcaaagtga

SEQ ID NO: 4980314 - DNA, 16 bp, Homo sapiens
atgttcagaacttcat

SEQ ID NO: 4980315 - DNA, 21 bp, Homo sapiens
atgttcagaacttcatctgcc

SEQ ID NO: 4980316 - DNA, 23 bp, Homo sapiens
atgttcagaacttcatctgccac

SEQ ID NO: 4980317 - DNA, 17 bp, Homo sapiens
attgtttccaaagtgca

SEQ ID NO: 4980318 - DNA, 15 bp, Homo sapiens
attttacttgcacct

SEQ ID NO: 4980319 - DNA, 11 bp, Homo sapiens
attttgtttca

SEQ ID NO: 4980320 - DNA, 14 bp, Homo sapiens
caaagtgcatgtca

SEQ ID NO: 4980321 - DNA, 16 bp, Homo sapiens
caaagtgcatgtcaca

SEQ ID NO: 4980322 - DNA, 19 bp, Homo sapiens
caaatctgtgctacactgg

SEQ ID NO: 4980323 - DNA, 14 bp, Homo sapiens
caatattttcagaa

SEQ ID NO: 4980324 - DNA, 15 bp, Homo sapiens
cacctcactgtcatc

SEQ ID NO: 4980325 - DNA, 17 bp, Homo sapiens
cacctcactgtcatctg

SEQ ID NO: 4980326 - DNA, 18 bp, Homo sapiens
cacctcactgtcatctgc

SEQ ID NO: 4980327 - DNA, 19 bp, Homo sapiens
cacctcactgtcatctgcc

SEQ ID NO: 4980328 - DNA, 14 bp, Homo sapiens
cacctccatgtcat

SEQ ID NO: 4980329 - DNA, 15 bp, Homo sapiens
cacctccatgtcatc

SEQ ID NO: 4980330 - DNA, 17 bp, Homo sapiens
cacctccatgtcatccg

SEQ ID NO: 4980331 - DNA, 16 bp, Homo sapiens
cagaacttcatctgcc

SEQ ID NO: 4980332 - DNA, 22 bp, Homo sapiens
cagaagaaaggcattgcacaga

SEQ ID NO: 4980333 - DNA, 14 bp, Homo sapiens
caggaaaccctttt

SEQ ID NO: 4980334 - DNA, 15 bp, Homo sapiens
cattgcacagagtga

SEQ ID NO: 4980335 - DNA, 17 bp, Homo sapiens
cattttgtttcactctt

SEQ ID NO: 4980336 - DNA, 21 bp, Homo sapiens
ccacggtcacacctcactgtc

SEQ ID NO: 4980337 - DNA, 22 bp, Homo sapiens
ccatattttaaaagagaaaaac

SEQ ID NO: 4980338 - DNA, 13 bp, Homo sapiens
ccgagcaaggtgg

SEQ ID NO: 4980339 - DNA, 17 bp, Homo sapiens
cctcactgtcatctgcc

SEQ ID NO: 4980340 - DNA, 19 bp, Homo sapiens
cctcactgtcatctgccag

SEQ ID NO: 4980341 - DNA, 14 bp, Homo sapiens
cctccatgtcatcc

SEQ ID NO: 4980342 - DNA, 22 bp, Homo sapiens
ccttttttttttttaagtagaa

SEQ ID NO: 4980343 - DNA, 19 bp, Homo sapiens
cggtcacacctcactgtca

SEQ ID NO: 4980344 - DNA, 22 bp, Homo sapiens
cggtcacacctcactgtcatct

SEQ ID NO: 4980345 - DNA, 23 bp, Homo sapiens
cgtaaccagttttttcacctcca

SEQ ID NO: 4980346 - DNA, 13 bp, Homo sapiens
ctgtcatctgcca

SEQ ID NO: 4980347 - DNA, 16 bp, Homo sapiens
cttcatctgccactgg

SEQ ID NO: 4980348 - DNA, 21 bp, Homo sapiens
gaaaaattgtttccaaagtgc

SEQ ID NO: 4980349 - DNA, 16 bp, Homo sapiens
gaaaggcattgcacag

SEQ ID NO: 4980350 - DNA, 16 bp, Homo sapiens
gaacttcatctgccac

SEQ ID NO: 4980351 - DNA, 19 bp, Homo sapiens
gaacttcatctgccactgg

SEQ ID NO: 4980352 - DNA, 23 bp, Homo sapiens
gacatagcacgaatctgttacca

SEQ ID NO: 4980353 - DNA, 15 bp, Homo sapiens
gcatgtcacatgcca

SEQ ID NO: 4980354 - DNA, 16 bp, Homo sapiens
gcattgcacagagtga

SEQ ID NO: 4980355 - DNA, 23 bp, Homo sapiens
ggaatatcgtaaccagttttttc

SEQ ID NO: 4980356 - DNA, 15 bp, Homo sapiens
ggaggaggatgagcc

SEQ ID NO: 4980357 - DNA, 16 bp, Homo sapiens
ggtcacacctcactgt

SEQ ID NO: 4980358 - DNA, 18 bp, Homo sapiens
ggtcacacctcactgtca

SEQ ID NO: 4980359 - DNA, 21 bp, Homo sapiens
ggtcacacctcactgtcatct

SEQ ID NO: 4980360 - DNA, 22 bp, Homo sapiens
ggttcagtgagctgcactgacc

SEQ ID NO: 4980361 - DNA, 22 bp, Homo sapiens
gtacaaatctgtgctacactgg

SEQ ID NO: 4980362 - DNA, 16 bp, Homo sapiens
gtagaaaaattgtttc

SEQ ID NO: 4980363 - DNA, 18 bp, Homo sapiens
gtagtgattcattgtttg

SEQ ID NO: 4980364 - DNA, 22 bp, Homo sapiens
gtcacacctcactgtcatctgc

SEQ ID NO: 4980365 - DNA, 12 bp, Homo sapiens
gtgattcattgt

SEQ ID NO: 4980366 - DNA, 17 bp, Homo sapiens
gtgcatgtcacatgcca

SEQ ID NO: 4980367 - DNA, 15 bp, Homo sapiens
gtttcactctttcca

SEQ ID NO: 4980368 - DNA, 21 bp, Homo sapiens
gtttcactctttccagataag

SEQ ID NO: 4980369 - DNA, 13 bp, Homo sapiens
gtttccaaagtgc

SEQ ID NO: 4980370 - DNA, 15 bp, Homo sapiens
gtttccaaagtgcat

SEQ ID NO: 4980371 - DNA, 15 bp, Homo sapiens
taaaatctactccaa

SEQ ID NO: 4980372 - DNA, 13 bp, Homo sapiens
taacttgcaagtt

SEQ ID NO: 4980373 - DNA, 23 bp, Homo sapiens
taagtagaaaaattgtttccaaa

SEQ ID NO: 4980374 - DNA, 15 bp, Homo sapiens
taattcagctcttga

SEQ ID NO: 4980375 - DNA, 15 bp, Homo sapiens
tacactggataaaaa

SEQ ID NO: 4980376 - DNA, 19 bp, Homo sapiens
tactttgcattttgtttca

SEQ ID NO: 4980377 - DNA, 15 bp, Homo sapiens
tagaaaaattgtttc

SEQ ID NO: 4980378 - DNA, 16 bp, Homo sapiens
aaaaactttcatgcct

SEQ ID NO: 4980379 - DNA, 20 bp, Homo sapiens
aaaaattgtttccaaagtgc

SEQ ID NO: 4980380 - DNA, 13 bp, Homo sapiens
aaaagagaaaaac

SEQ ID NO: 4980381 - DNA, 14 bp, Homo sapiens
aaagcagataaaat

SEQ ID NO: 4980382 - DNA, 14 bp, Homo sapiens
aaagtgcatgtcac

SEQ ID NO: 4980383 - DNA, 15 bp, Homo sapiens
aaagtgcatgtcaca

SEQ ID NO: 4980384 - DNA, 20 bp, Homo sapiens
aaagtgcatgtcacatgcca

SEQ ID NO: 4980385 - DNA, 19 bp, Homo sapiens
aaattgcataattttctaa

SEQ ID NO: 4980386 - DNA, 15 bp, Homo sapiens
tgcatgtcacatgcc

SEQ ID NO: 4980387 - DNA, 14 bp, Homo sapiens
tgcattttgtttca

SEQ ID NO: 4980388 - DNA, 14 bp, Homo sapiens
tgctcttctttaga

SEQ ID NO: 4980389 - DNA, 20 bp, Homo sapiens
tgttcagaacttcatctgcc

SEQ ID NO: 4980390 - DNA, 14 bp, Homo sapiens
tgtttccaaagtgc

SEQ ID NO: 4980391 - DNA, 20 bp, Homo sapiens
tgtttccaaagtgcatgtca

SEQ ID NO: 4980392 - DNA, 15 bp, Homo sapiens
ttaaaagagaaaaac

SEQ ID NO: 4980393 - DNA, 13 bp, Homo sapiens
ttatttgtttgca

SEQ ID NO: 4980394 - DNA, 14 bp, Homo sapiens
ttcactctttccag

SEQ ID NO: 4980395 - DNA, 20 bp, Homo sapiens
ttcagaacttcatctgccac

SEQ ID NO: 4980396 - DNA, 16 bp, Homo sapiens
ttcatgtgcaaagtga

SEQ ID NO: 4980397 - DNA, 12 bp, Homo sapiens
ttcttcatgtgc

SEQ ID NO: 4980398 - DNA, 13 bp, Homo sapiens
ttgcacagagtga

SEQ ID NO: 4980399 - DNA, 22 bp, Homo sapiens
ttgtttccaaagtgcatgtcac

SEQ ID NO: 4980400 - DNA, 15 bp, Homo sapiens
tttaaaagagaaaaa

SEQ ID NO: 4980401 - DNA, 15 bp, Homo sapiens
tttaagtagaaaaat

SEQ ID NO: 4980402 - DNA, 15 bp, Homo sapiens
tttccaaagtgcatg

SEQ ID NO: 4980403 - DNA, 14 bp, Homo sapiens
tttctaatttcaag

SEQ ID NO: 4980404 - DNA, 23 bp, Homo sapiens
ttttaagtagaaaaattgtttcc

SEQ ID NO: 4980405 - DNA, 19 bp, Homo sapiens
tttttcacctccatgtcat

SEQ ID NO: 4980406 - DNA, 18 bp, Homo sapiens
tagaaaaattgtttccaa

SEQ ID NO: 4980407 - DNA, 21 bp, Homo sapiens
tagaaaaattgtttccaaagt

SEQ ID NO: 4980408 - DNA, 23 bp, Homo sapiens
tagaaaaattgtttccaaagtgc

SEQ ID NO: 4980409 - DNA, 22 bp, Homo sapiens
tatataccaatgacttccatat

SEQ ID NO: 4980410 - DNA, 15 bp, Homo sapiens
aaccacggtcacacc

SEQ ID NO: 4980411 - DNA, 19 bp, Homo sapiens
aaccagttttttcacctcc

SEQ ID NO: 4980412 - DNA, 15 bp, Homo sapiens
aacttcatctgccac

SEQ ID NO: 4980413 - DNA, 18 bp, Homo sapiens
aagcagagttgctcttca

SEQ ID NO: 4980414 - DNA, 19 bp, Homo sapiens
aattgcataattttctaat

SEQ ID NO: 4980415 - DNA, 16 bp, Homo sapiens
aatttcaagtcttcct

SEQ ID NO: 4980416 - DNA, 18 bp, Homo sapiens
aattttacttgcacctta

SEQ ID NO: 4980417 - DNA, 15 bp, Homo sapiens
acacctcactgtcat

SEQ ID NO: 4980418 - DNA, 18 bp, Homo sapiens
acacctcactgtcatctg

SEQ ID NO: 4980419 - DNA, 20 bp, Homo sapiens
acacctcactgtcatctgcc

SEQ ID NO: 4980420 - DNA, 14 bp, Homo sapiens
acagcgtttttaac

SEQ ID NO: 4980421 - DNA, 23 bp, Homo sapiens
accaatgacttccatattttaaa

SEQ ID NO: 4980422 - DNA, 15 bp, Homo sapiens
acctcactgtcatct

SEQ ID NO: 4980423 - DNA, 18 bp, Homo sapiens
acctcactgtcatctgcc

SEQ ID NO: 4980424 - DNA, 20 bp, Homo sapiens
acctcactgtcatctgccag

SEQ ID NO: 4980425 - DNA, 14 bp, Homo sapiens
acctccatgtcatc

SEQ ID NO: 4980426 - DNA, 15 bp, Homo sapiens
acctccatgtcatcc

SEQ ID NO: 4980427 - DNA, 16 bp, Homo sapiens
acctccatgtcatccg

SEQ ID NO: 4980428 - DNA, 22 bp, Homo sapiens
acggtcacacctcactgtcatc

SEQ ID NO: 4980429 - DNA, 19 bp, Homo sapiens
actgaccttgactactcag

SEQ ID NO: 4980430 - DNA, 12 bp, Homo sapiens
actgtcatctgc

SEQ ID NO: 4980431 - DNA, 14 bp, Homo sapiens
acttcatctgccac

SEQ ID NO: 4980432 - DNA, 24 bp, Homo sapiens
agaaaaattgtttccaaagtgcat

SEQ ID NO: 4980433 - DNA, 13 bp, Homo sapiens
agaagaaaggcat

SEQ ID NO: 4980434 - DNA, 10 bp, Homo sapiens
agagaaaaac

SEQ ID NO: 4980435 - DNA, 18 bp, Homo sapiens
aggaggatgagccacaga

SEQ ID NO: 4980436 - DNA, 13 bp, Homo sapiens
aggcattgcacag

SEQ ID NO: 4980437 - DNA, 14 bp, Homo sapiens
aggcattgcacaga

SEQ ID NO: 4980438 - DNA, 15 bp, Homo sapiens
agtgagctgcactga

SEQ ID NO: 4980439 - DNA, 16 bp, Homo sapiens
agtgattcattgtttg

SEQ ID NO: 4980440 - DNA, 21 bp, Homo sapiens
agtgcaaaaactttcatgcct

SEQ ID NO: 4980441 - DNA, 19 bp, Homo sapiens
agtgcatgtcacatgccac

SEQ ID NO: 4980442 - DNA, 22 bp, Homo sapiens
agttttttcacctccatgtcat

SEQ ID NO: 4980443 - DNA, 20 bp, Homo sapiens
ataagcagagttgctcttca

SEQ ID NO: 4980444 - DNA, 18 bp, Homo sapiens
atataccaatgacttcca

SEQ ID NO: 4980445 - DNA, 12 bp, Homo sapiens
atgagccacaga

SEQ ID NO: 4980446 - DNA, 21 bp, Homo sapiens
atgccacaaccacggtcacac

SEQ ID NO: 4980447 - DNA, 23 bp, Homo sapiens
atgtcaagaacaggacatagcac

SEQ ID NO: 4980448 - DNA, 16 bp, Homo sapiens
attgtttccaaagtgc

SEQ ID NO: 4980449 - DNA, 20 bp, Homo sapiens
attgtttccaaagtgcatgt

SEQ ID NO: 4980450 - DNA, 19 bp, Homo sapiens
attttgtttcactctttcc

SEQ ID NO: 4980451 - DNA, 13 bp, Homo sapiens
caaatatgtcaag

SEQ ID NO: 4980452 - DNA, 23 bp, Homo sapiens
caaccacggtcacacctcactgt

SEQ ID NO: 4980453 - DNA, 22 bp, Homo sapiens
caagaacaggacatagcacgaa

SEQ ID NO: 4980454 - DNA, 20 bp, Homo sapiens
cacacctcactgtcatctgc

SEQ ID NO: 4980455 - DNA, 21 bp, Homo sapiens
cacacctcactgtcatctgcc

SEQ ID NO: 4980456 - DNA, 11 bp, Homo sapiens
cacctcactgt

SEQ ID NO: 4980457 - DNA, 20 bp, Homo sapiens
cacctcactgtcatctgcca

SEQ ID NO: 4980458 - DNA, 16 bp, Homo sapiens
cacggtcacacctcac

SEQ ID NO: 4980459 - DNA, 13 bp, Homo sapiens
cactgtcatctgc

SEQ ID NO: 4980460 - DNA, 16 bp, Homo sapiens
cactgtcatctgccag

SEQ ID NO: 4980461 - DNA, 23 bp, Homo sapiens
cagaaattgcataattttctaat

SEQ ID NO: 4980462 - DNA, 17 bp, Homo sapiens
cagaacttcatctgcca

SEQ ID NO: 4980463 - DNA, 13 bp, Homo sapiens
cagaagaaaggca

SEQ ID NO: 4980464 - DNA, 15 bp, Homo sapiens
catgtcacatgccac

SEQ ID NO: 4980465 - DNA, 21 bp, Homo sapiens
catgtcatccgagcaaggtgg

SEQ ID NO: 4980466 - DNA, 14 bp, Homo sapiens
cattcaaaaacccc

SEQ ID NO: 4980467 - DNA, 20 bp, Homo sapiens
ccaaagtgcatgtcacatgc

SEQ ID NO: 4980468 - DNA, 21 bp, Homo sapiens
ccaaagtgcatgtcacatgcc

SEQ ID NO: 4980469 - DNA, 22 bp, Homo sapiens
ccagtgtttttcttcatgtgca

SEQ ID NO: 4980470 - DNA, 22 bp, Homo sapiens
ccatgtcatccgagcaaggtgg

SEQ ID NO: 4980471 - DNA, 20 bp, Homo sapiens
cctcactgtcatctgccagg

SEQ ID NO: 4980472 - DNA, 21 bp, Homo sapiens
ctatgttcagaacttcatctg

SEQ ID NO: 4980473 - DNA, 22 bp, Homo sapiens
ctatgttcagaacttcatctgc

SEQ ID NO: 4980474 - DNA, 23 bp, Homo sapiens
ctatgttcagaacttcatctgcc

SEQ ID NO: 4980475 - DNA, 14 bp, Homo sapiens
ctcactgtcatctg

SEQ ID NO: 4980476 - DNA, 15 bp, Homo sapiens
ctcactgtcatctgc

SEQ ID NO: 4980477 - DNA, 17 bp, Homo sapiens
ctcactgtcatctgcca

SEQ ID NO: 4980478 - DNA, 12 bp, Homo sapiens
ctgtcatctgcc

SEQ ID NO: 4980479 - DNA, 12 bp, Homo sapiens
cttcatctgcca

SEQ ID NO: 4980480 - DNA, 19 bp, Homo sapiens
cttcatgtgcaaagtgact

SEQ ID NO: 4980481 - DNA, 23 bp, Homo sapiens
cttgcaccttatagttcatagca

SEQ ID NO: 4980482 - DNA, 18 bp, Homo sapiens
gaaaaattgtttccaaag

SEQ ID NO: 4980483 - DNA, 23 bp, Homo sapiens
gaaaaattgtttccaaagtgcat

SEQ ID NO: 4980484 - DNA, 13 bp, Homo sapiens
gaacttcatctgc

SEQ ID NO: 4980485 - DNA, 14 bp, Homo sapiens
gaacttcatctgcc

SEQ ID NO: 4980486 - DNA, 12 bp, Homo sapiens
gaagaaaggcat

SEQ ID NO: 4980487 - DNA, 23 bp, Homo sapiens
gaatatcgtaaccagttttttca

SEQ ID NO: 4980488 - DNA, 16 bp, Homo sapiens
gcaacaaatatgtcaa

SEQ ID NO: 4980489 - DNA, 19 bp, Homo sapiens
gcattttgtttcactcttt

SEQ ID NO: 4980490 - DNA, 23 bp, Homo sapiens
gcattttgtttcactctttccag

SEQ ID NO: 4980491 - DNA, 17 bp, Homo sapiens
ggaatatcgtaaccagt

SEQ ID NO: 4980492 - DNA, 10 bp, Homo sapiens
gtagaaaaat

SEQ ID NO: 4980493 - DNA, 20 bp, Homo sapiens
gtcacacctcactgtcatct

SEQ ID NO: 4980494 - DNA, 21 bp, Homo sapiens
gtcacacctcactgtcatctg

SEQ ID NO: 4980495 - DNA, 11 bp, Homo sapiens
gtcatctgcca

SEQ ID NO: 4980496 - DNA, 15 bp, Homo sapiens
gtggttcagtgagct

SEQ ID NO: 4980497 - DNA, 15 bp, Homo sapiens
gttatttttttctaa

SEQ ID NO: 4980498 - DNA, 19 bp, Homo sapiens
gttcagaacttcatctgcc

SEQ ID NO: 4980499 - DNA, 16 bp, Homo sapiens
gttcagtgagctgcac

SEQ ID NO: 4980500 - DNA, 20 bp, Homo sapiens
gtttccaaagtgcatgtcac

SEQ ID NO: 4980501 - DNA, 14 bp, Homo sapiens
taaaagagaaaaac

SEQ ID NO: 4980502 - DNA, 18 bp, Homo sapiens
taaccagttttttcacct

SEQ ID NO: 4980503 - DNA, 20 bp, Homo sapiens
taaccagttttttcacctcc

SEQ ID NO: 4980504 - DNA, 13 bp, Homo sapiens
taagtagaaaaat

SEQ ID NO: 4980505 - DNA, 21 bp, Homo sapiens
taagtagaaaaattgtttcca

SEQ ID NO: 4980506 - DNA, 23 bp, Homo sapiens
tatataccaatgacttccatatt

SEQ ID NO: 4980507 - DNA, 21 bp, Homo sapiens
tatgttcagaacttcatctgc

SEQ ID NO: 4980508 - DNA, 23 bp, Homo sapiens
tatgttcagaacttcatctgcca

SEQ ID NO: 4980509 - DNA, 18 bp, Homo sapiens
tattttaaaagagaaaaa

SEQ ID NO: 4980510 - DNA, 16 bp, Homo sapiens
tcacacctcactgtca

SEQ ID NO: 4980511 - DNA, 17 bp, Homo sapiens
tcacctccatgtcatcc

SEQ ID NO: 4980512 - DNA, 16 bp, Homo sapiens
tcagaacttcatctgc

SEQ ID NO: 4980513 - DNA, 12 bp, Homo sapiens
tcatctgccagg

SEQ ID NO: 4980514 - DNA, 20 bp, Homo sapiens
tccaaagtgcatgtcacatg

SEQ ID NO: 4980515 - DNA, 23 bp, Homo sapiens
tccaaagtgcatgtcacatgcca

SEQ ID NO: 4980516 - DNA, 15 bp, Homo sapiens
aaaaattgtttccaa

SEQ ID NO: 4980517 - DNA, 14 bp, Homo sapiens
aaaattgtttccaa

SEQ ID NO: 4980518 - DNA, 14 bp, Homo sapiens
aaacagattttttg

SEQ ID NO: 4980519 - DNA, 22 bp, Homo sapiens
aaaggcattgcacagagtgaac

SEQ ID NO: 4980520 - DNA, 21 bp, Homo sapiens
aaagtgcatgtcacatgccac

SEQ ID NO: 4980521 - DNA, 13 bp, Homo sapiens
aaattattttcaa

SEQ ID NO: 4980522 - DNA, 14 bp, Homo sapiens
aaattgtttccaaa

SEQ ID NO: 4980523 - DNA, 18 bp, Homo sapiens
aaattgtttccaaagtgc

SEQ ID NO: 4980524 - DNA, 19 bp, Homo sapiens
aacaaaactgaccttgact

SEQ ID NO: 4980525 - DNA, 21 bp, Homo sapiens
aaccagttttttcacctccat

SEQ ID NO: 4980526 - DNA, 23 bp, Homo sapiens
aagaaaggcattgcacagagtga

SEQ ID NO: 4980527 - DNA, 11 bp, Homo sapiens
aagagaaaaac

SEQ ID NO: 4980528 - DNA, 9 bp, Homo sapiens
aagtagaaa

SEQ ID NO: 4980529 - DNA, 19 bp, Homo sapiens
aagtagaaaaattgtttcc

SEQ ID NO: 4980530 - DNA, 23 bp, Homo sapiens
aagtagaaaaattgtttccaaag

SEQ ID NO: 4980531 - DNA, 17 bp, Homo sapiens
aagtgactatttgttct

SEQ ID NO: 4980532 - DNA, 13 bp, Homo sapiens
aagtgcatgtcac

SEQ ID NO: 4980533 - DNA, 18 bp, Homo sapiens
aagtgcatgtcacatgcc

SEQ ID NO: 4980534 - DNA, 14 bp, Homo sapiens
aatctactccaaat

SEQ ID NO: 4980535 - DNA, 17 bp, Homo sapiens
aattgtttccaaagtgc

SEQ ID NO: 4980536 - DNA, 18 bp, Homo sapiens
aattgtttccaaagtgca

SEQ ID NO: 4980537 - DNA, 14 bp, Homo sapiens
acacctcactgtca

SEQ ID NO: 4980538 - DNA, 21 bp, Homo sapiens
acacctcactgtcatctgcca

SEQ ID NO: 4980539 - DNA, 14 bp, Homo sapiens
accacggtcacacc

SEQ ID NO: 4980540 - DNA, 24 bp, Homo sapiens
accacggtcacacctcactgtcat

SEQ ID NO: 4980541 - DNA, 12 bp, Homo sapiens
accagttttttc

SEQ ID NO: 4980542 - DNA, 12 bp, Homo sapiens
acctccatgtca

SEQ ID NO: 4980543 - DNA, 21 bp, Homo sapiens
acggtcacacctcactgtcat

SEQ ID NO: 4980544 - DNA, 23 bp, Homo sapiens
acggtcacacctcactgtcatct

SEQ ID NO: 4980545 - DNA, 13 bp, Homo sapiens
actgtcatctgcc

SEQ ID NO: 4980546 - DNA, 12 bp, Homo sapiens
acttcatctgcc

SEQ ID NO: 4980547 - DNA, 16 bp, Homo sapiens
acttcatctgccactg

SEQ ID NO: 4980548 - DNA, 18 bp, Homo sapiens
actttgcattttgtttca

SEQ ID NO: 4980549 - DNA, 14 bp, Homo sapiens
agaaaaattgtttc

SEQ ID NO: 4980550 - DNA, 17 bp, Homo sapiens
agaacttcatctgccac

SEQ ID NO: 4980551 - DNA, 18 bp, Homo sapiens
agagtgtgactcatcagg

SEQ ID NO: 4980552 - DNA, 18 bp, Homo sapiens
agcaaggtggacatcttc

SEQ ID NO: 4980553 - DNA, 11 bp, Homo sapiens
agtagaaaaat

SEQ ID NO: 4980554 - DNA, 18 bp, Homo sapiens
agtgcatgtcacatgcca

SEQ ID NO: 4980555 - DNA, 21 bp, Homo sapiens
agtgcatgtcacatgccacaa

SEQ ID NO: 4980556 - DNA, 19 bp, Homo sapiens
ataccaatgacttccatat

SEQ ID NO: 4980557 - DNA, 9 bp, Homo sapiens
atgtcatcc

SEQ ID NO: 4980558 - DNA, 22 bp, Homo sapiens
atgttcagaacttcatctgcca

SEQ ID NO: 4980559 - DNA, 14 bp, Homo sapiens
attgcacagagtga

SEQ ID NO: 4980560 - DNA, 12 bp, Homo sapiens
attgtttccaaa

SEQ ID NO: 4980561 - DNA, 22 bp, Homo sapiens
atttactttgcattttgtttca

SEQ ID NO: 4980562 - DNA, 17 bp, Homo sapiens
attttgtttcactcttt

SEQ ID NO: 4980563 - DNA, 15 bp, Homo sapiens
caaagtgcatgtcac

SEQ ID NO: 4980564 - DNA, 19 bp, Homo sapiens
caatattttcagaagaaag

SEQ ID NO: 4980565 - DNA, 15 bp, Homo sapiens
caatgacttccatat

SEQ ID NO: 4980566 - DNA, 18 bp, Homo sapiens
cacacctcactgtcatct

SEQ ID NO: 4980567 - DNA, 22 bp, Homo sapiens
cacacctcactgtcatctgcca

SEQ ID NO: 4980568 - DNA, 23 bp, Homo sapiens
cacacctcactgtcatctgccag

SEQ ID NO: 4980569 - DNA, 14 bp, Homo sapiens
cacctcactgtcat

SEQ ID NO: 4980570 - DNA, 13 bp, Homo sapiens
cacctccatgtca

SEQ ID NO: 4980571 - DNA, 22 bp, Homo sapiens
cacggtcacacctcactgtcat

SEQ ID NO: 4980572 - DNA, 14 bp, Homo sapiens
cactggataaaaat

SEQ ID NO: 4980573 - DNA, 14 bp, Homo sapiens
cactgtcatctgcc

SEQ ID NO: 4980574 - DNA, 14 bp, Homo sapiens
cagaaattgcataa

SEQ ID NO: 4980575 - DNA, 15 bp, Homo sapiens
cagaacttcatctgc

SEQ ID NO: 4980576 - DNA, 22 bp, Homo sapiens
cagtgcaaaaactttcatgcct

SEQ ID NO: 4980577 - DNA, 20 bp, Homo sapiens
cataattttctaatttcaag

SEQ ID NO: 4980578 - DNA, 22 bp, Homo sapiens
catagcacgaatctgttaccag

SEQ ID NO: 4980579 - DNA, 12 bp, Homo sapiens
catgtcacatgc

SEQ ID NO: 4980580 - DNA, 16 bp, Homo sapiens
catgtcacatgccaca

SEQ ID NO: 4980581 - DNA, 19 bp, Homo sapiens
cattttgtttcactctttc

SEQ ID NO: 4980582 - DNA, 16 bp, Homo sapiens
ccaaagtgcatgtcac

SEQ ID NO: 4980583 - DNA, 22 bp, Homo sapiens
ccaaagtgcatgtcacatgcca

SEQ ID NO: 4980584 - DNA, 18 bp, Homo sapiens
ccacaaccacggtcacac

SEQ ID NO: 4980585 - DNA, 18 bp, Homo sapiens
ccagtaggaggaggatga

SEQ ID NO: 4980586 - DNA, 23 bp, Homo sapiens
ccagtgtttttcttcatgtgcaa

SEQ ID NO: 4980587 - DNA, 14 bp, Homo sapiens
cctcactgtcatct

SEQ ID NO: 4980588 - DNA, 18 bp, Homo sapiens
cctcactgtcatctgcca

SEQ ID NO: 4980589 - DNA, 14 bp, Homo sapiens
cggtcacacctcac

SEQ ID NO: 4980590 - DNA, 17 bp, Homo sapiens
ctacactggataaaaat

SEQ ID NO: 4980591 - DNA, 16 bp, Homo sapiens
ctcactgtcatctgcc

SEQ ID NO: 4980592 - DNA, 18 bp, Homo sapiens
ctcactgtcatctgccag

SEQ ID NO: 4980593 - DNA, 17 bp, Homo sapiens
ctttttatttgtttgca

SEQ ID NO: 4980594 - DNA, 20 bp, Homo sapiens
gaaattgcataattttctaa

SEQ ID NO: 4980595 - DNA, 14 bp, Homo sapiens
gaacagcgttttta

SEQ ID NO: 4980596 - DNA, 15 bp, Homo sapiens
gaacttcatctgcca

SEQ ID NO: 4980597 - DNA, 23 bp, Homo sapiens
gaggtattatatttaaaaaaaac

SEQ ID NO: 4980598 - DNA, 19 bp, Homo sapiens
gataaaatctactccaaat

SEQ ID NO: 4980599 - DNA, 16 bp, Homo sapiens
gcaaggtggacatctt

SEQ ID NO: 4980600 - DNA, 19 bp, Homo sapiens
gcaggaaaccctttttgta

SEQ ID NO: 4980601 - DNA, 17 bp, Homo sapiens
gcatgtcacatgccaca

SEQ ID NO: 4980602 - DNA, 18 bp, Homo sapiens
gcatgtcacatgccacaa

SEQ ID NO: 4980603 - DNA, 13 bp, Homo sapiens
gcattttgtttca

SEQ ID NO: 4980604 - DNA, 21 bp, Homo sapiens
gtaaccagttttttcacctcc

SEQ ID NO: 4980605 - DNA, 14 bp, Homo sapiens
gtcacacctcactg

SEQ ID NO: 4980606 - DNA, 13 bp, Homo sapiens
gtgcaaagtgact

SEQ ID NO: 4980607 - DNA, 11 bp, Homo sapiens
gtgcatgtcac

SEQ ID NO: 4980608 - DNA, 13 bp, Homo sapiens
gtgcatgtcacat

SEQ ID NO: 4980609 - DNA, 23 bp, Homo sapiens
gttttttcacctccatgtcatcc

SEQ ID NO: 4980610 - DNA, 17 bp, Homo sapiens
taaaatctactccaaat

SEQ ID NO: 4980611 - DNA, 18 bp, Homo sapiens
taacttgcaagttttcag

SEQ ID NO: 4980612 - DNA, 12 bp, Homo sapiens
tactttgcattt

SEQ ID NO: 4980613 - DNA, 17 bp, Homo sapiens
tagaaaaattgtttcca

SEQ ID NO: 4980614 - DNA, 19 bp, Homo sapiens
tagaaaaattgtttccaaa

SEQ ID NO: 4980615 - DNA, 20 bp, Homo sapiens
tagaaaaattgtttccaaag

SEQ ID NO: 4980616 - DNA, 20 bp, Homo sapiens
tataccaatgacttccatat

SEQ ID NO: 4980617 - DNA, 14 bp, Homo sapiens
tatttgtttgcaat

SEQ ID NO: 4980618 - DNA, 14 bp, Homo sapiens
tattttcagaagaa

SEQ ID NO: 4980619 - DNA, 23 bp, Homo sapiens
tcacacctcactgtcatctgcca

SEQ ID NO: 4980620 - DNA, 12 bp, Homo sapiens
tcacctccatgt

SEQ ID NO: 4980621 - DNA, 12 bp, Homo sapiens
tcactgtcatct

SEQ ID NO: 4980622 - DNA, 18 bp, Homo sapiens
tcagaacttcatctgcca

SEQ ID NO: 4980623 - DNA, 17 bp, Homo sapiens
tccaaagtgcatgtcac

SEQ ID NO: 4980624 - DNA, 23 bp, Homo sapiens
tccatattttaaaagagaaaaac

SEQ ID NO: 4980625 - DNA, 16 bp, Homo sapiens
tcttcatgtgcaaagt

SEQ ID NO: 4980626 - DNA, 16 bp, Homo sapiens
tgcatgtcacatgcca

SEQ ID NO: 4980627 - DNA, 12 bp, Homo sapiens
tgtcatctgcca

SEQ ID NO: 4980628 - DNA, 13 bp, Homo sapiens
tgtcatctgccag

SEQ ID NO: 4980629 - DNA, 21 bp, Homo sapiens
tgttcagaacttcatctgcca

SEQ ID NO: 4980630 - DNA, 21 bp, Homo sapiens
tgtttccaaagtgcatgtcac

SEQ ID NO: 4980631 - DNA, 23 bp, Homo sapiens
tgtttccaaagtgcatgtcacat

SEQ ID NO: 4980632 - DNA, 15 bp, Homo sapiens
ttcacctccatgtca

SEQ ID NO: 4980633 - DNA, 17 bp, Homo sapiens
ttcagaacttcatctgc

SEQ ID NO: 4980634 - DNA, 11 bp, Homo sapiens
ttccaaagtgc

SEQ ID NO: 4980635 - DNA, 12 bp, Homo sapiens
ttccaaagtgca

SEQ ID NO: 4980636 - DNA, 16 bp, Homo sapiens
ttccaaagtgcatgtc

SEQ ID NO: 4980637 - DNA, 17 bp, Homo sapiens
ttccaaagtgcatgtca

SEQ ID NO: 4980638 - DNA, 19 bp, Homo sapiens
ttccaaagtgcatgtcaca

SEQ ID NO: 4980639 - DNA, 15 bp, Homo sapiens
ttgcattttgtttca

SEQ ID NO: 4980640 - DNA, 16 bp, Homo sapiens
tttaaaagagaaaaac

SEQ ID NO: 4980641 - DNA, 17 bp, Homo sapiens
tttaacaagatttcagc

SEQ ID NO: 4980642 - DNA, 17 bp, Homo sapiens
tttccaaagtgcatgtc

SEQ ID NO: 4980643 - DNA, 18 bp, Homo sapiens
tttccaaagtgcatgtca

SEQ ID NO: 4980644 - DNA, 20 bp, Homo sapiens
tttcttcatgtgcaaagtga

SEQ ID NO: 4980645 - DNA, 20 bp, Homo sapiens
ttttcacctccatgtcatcc

SEQ ID NO: 4980646 - DNA, 15 bp, Homo sapiens
ctgctcatccaaagt

SEQ ID NO: 4980647 - DNA, 21 bp, Homo sapiens
ctggcagtaacctagtgaatt

SEQ ID NO: 4980648 - DNA, 19 bp, Homo sapiens
ctggtggtaccattattat

SEQ ID NO: 4980649 - DNA, 23 bp, Homo sapiens
cttgtgtatattttaatgaatat

SEQ ID NO: 4980650 - DNA, 19 bp, Homo sapiens
gaaaatacctattttatat

SEQ ID NO: 4980651 - DNA, 21 bp, Homo sapiens
gaaaatacctattttatatga

SEQ ID NO: 4980652 - DNA, 16 bp, Homo sapiens
gaaataatagggaaaa

SEQ ID NO: 4980653 - DNA, 18 bp, Homo sapiens
gaagtgcttgatatgtaa

SEQ ID NO: 4980654 - DNA, 10 bp, Homo sapiens
gaagtggaag

SEQ ID NO: 4980655 - DNA, 15 bp, Homo sapiens
gaattactgtatata

SEQ ID NO: 4980656 - DNA, 16 bp, Homo sapiens
gaatttctaaatgttg

SEQ ID NO: 4980657 - DNA, 14 bp, Homo sapiens
gacctaggcaagtt

SEQ ID NO: 4980658 - DNA, 16 bp, Homo sapiens
gactggcagtaaccta

SEQ ID NO: 4980659 - DNA, 21 bp, Homo sapiens
gataattttatttataaacta

SEQ ID NO: 4980660 - DNA, 22 bp, Homo sapiens
gataattttatttataaactag

SEQ ID NO: 4980661 - DNA, 15 bp, Homo sapiens
gatactctcagattt

SEQ ID NO: 4980662 - DNA, 18 bp, Homo sapiens
gatgatttggtcagattg

SEQ ID NO: 4980663 - DNA, 14 bp, Homo sapiens
gatgggggaaaaaa

SEQ ID NO: 4980664 - DNA, 19 bp, Homo sapiens
ctagtgaatttctgaaaga

SEQ ID NO: 4980665 - DNA, 20 bp, Homo sapiens
ctcattataaaatgggaaga

SEQ ID NO: 4980666 - DNA, 12 bp, Homo sapiens
ctcgagtgaatt

SEQ ID NO: 4980667 - DNA, 13 bp, Homo sapiens
ctctttaaaatat

SEQ ID NO: 4980668 - DNA, 19 bp, Homo sapiens
ctggagttcagcagtgatg

SEQ ID NO: 4980669 - DNA, 15 bp, Homo sapiens
ctgtgcattagatat

SEQ ID NO: 4980670 - DNA, 23 bp, Homo sapiens
cttcagagtcctcattataaaat

SEQ ID NO: 4980671 - DNA, 16 bp, Homo sapiens
gaaacttagaggaaaa

SEQ ID NO: 4980672 - DNA, 17 bp, Homo sapiens
gaatattgatgttaaca

SEQ ID NO: 4980673 - DNA, 18 bp, Homo sapiens
gaattactgtatataaac

SEQ ID NO: 4980674 - DNA, 22 bp, Homo sapiens
gaatttgacctaggcaagtttg

SEQ ID NO: 4980675 - DNA, 16 bp, Homo sapiens
gacactacatatctaa

SEQ ID NO: 4980676 - DNA, 15 bp, Homo sapiens
gacatctcaggattt

SEQ ID NO: 4980677 - DNA, 22 bp, Homo sapiens
gaggaaggaaaaggaggaaatt

SEQ ID NO: 4980678 - DNA, 19 bp, Homo sapiens
gagtatacctcctatatgt

SEQ ID NO: 4980679 - DNA, 21 bp, Homo sapiens
gatcaaaacatgcttgaataa

SEQ ID NO: 4980680 - DNA, 19 bp, Homo sapiens
gcaactacagaagtggaag

SEQ ID NO: 4980681 - DNA, 19 bp, Homo sapiens
gcagacctacctgcagtgg

SEQ ID NO: 4980682 - DNA, 16 bp, Homo sapiens
gccagaggaaggaaaa

SEQ ID NO: 4980683 - DNA, 18 bp, Homo sapiens
gctaaacaagtaagaaaa

SEQ ID NO: 4980684 - DNA, 18 bp, Homo sapiens
gctggagttcagcagtga

SEQ ID NO: 4980685 - DNA, 16 bp, Homo sapiens
gctgtttgcgtgaatg

SEQ ID NO: 4980686 - DNA, 22 bp, Homo sapiens
gtaaaatcccatctgctagaag

SEQ ID NO: 4980687 - DNA, 14 bp, Homo sapiens
gtgaatttctaaat

SEQ ID NO: 4980688 - DNA, 19 bp, Homo sapiens
gtttctgaagtacttaaac

SEQ ID NO: 4980689 - DNA, 19 bp, Homo sapiens
taaaactcagaatataaca

SEQ ID NO: 4980690 - DNA, 21 bp, Homo sapiens
taaaatatttgtctttaaaca

SEQ ID NO: 4980691 - DNA, 15 bp, Homo sapiens
taaactaggtaaaat

SEQ ID NO: 4980692 - DNA, 20 bp, Homo sapiens
taaactccttaacttcaggg

SEQ ID NO: 4980693 - DNA, 15 bp, Homo sapiens
taacaagaggggaaa

SEQ ID NO: 4980694 - DNA, 18 bp, Homo sapiens
taagggggaaaactgttc

SEQ ID NO: 4980695 - DNA, 17 bp, Homo sapiens
taattttatttataaac

SEQ ID NO: 4980696 - DNA, 18 bp, Homo sapiens
taattttatttataaact

SEQ ID NO: 4980697 - DNA, 12 bp, Homo sapiens
tagaggaaaagg

SEQ ID NO: 4980698 - DNA, 15 bp, Homo sapiens
tagatcctgagatga

SEQ ID NO: 4980699 - DNA, 22 bp, Homo sapiens
taggagagggggcgatatagag

SEQ ID NO: 4980700 - DNA, 14 bp, Homo sapiens
tataaaatgggaag

SEQ ID NO: 4980701 - DNA, 17 bp, Homo sapiens
tataaaatgggaagact

SEQ ID NO: 4980702 - DNA, 20 bp, Homo sapiens
tcagaatataacatgtaaaa

SEQ ID NO: 4980703 - DNA, 18 bp, Homo sapiens
tcatttagtgctaaacaa

SEQ ID NO: 4980704 - DNA, 19 bp, Homo sapiens
tccttgacctctataaact

SEQ ID NO: 4980705 - DNA, 18 bp, Homo sapiens
tctaaatgttggaatgtt

SEQ ID NO: 4980706 - DNA, 17 bp, Homo sapiens
tctaatttgcattgtgt

SEQ ID NO: 4980707 - DNA, 13 bp, Homo sapiens
tctgaagtactta

SEQ ID NO: 4980708 - DNA, 23 bp, Homo sapiens
tctttaaacagcaactacagaag

SEQ ID NO: 4980709 - DNA, 17 bp, Homo sapiens
tgaagaaattgtggggg

SEQ ID NO: 4980710 - DNA, 15 bp, Homo sapiens
tgaatattgatgtta

SEQ ID NO: 4980711 - DNA, 19 bp, Homo sapiens
tgaatattgatgttaacaa

SEQ ID NO: 4980712 - DNA, 20 bp, Homo sapiens
tgaattactgtatataaact

SEQ ID NO: 4980713 - DNA, 15 bp, Homo sapiens
tgacctctataaact

SEQ ID NO: 4980714 - DNA, 16 bp, Homo sapiens
tgagatgatttggtca

SEQ ID NO: 4980715 - DNA, 12 bp, Homo sapiens
tgatacttccaa

SEQ ID NO: 4980716 - DNA, 23 bp, Homo sapiens
tgctaaacaagtaagaaaaataa

SEQ ID NO: 4980717 - DNA, 16 bp, Homo sapiens
tggaatgaagaaattg

SEQ ID NO: 4980718 - DNA, 14 bp, Homo sapiens
tgtcagaaacatga

SEQ ID NO: 4980719 - DNA, 16 bp, Homo sapiens
tgtcagaaacatgaaa

SEQ ID NO: 4980720 - DNA, 16 bp, Homo sapiens
tgtcgtaggtaaacta

SEQ ID NO: 4980721 - DNA, 21 bp, Homo sapiens
tgtgccagaggaaggaaaagg

SEQ ID NO: 4980722 - DNA, 17 bp, Homo sapiens
tgtgtcagaaacatgaa

SEQ ID NO: 4980723 - DNA, 21 bp, Homo sapiens
tgtgtcagaaacatgaaatgc

SEQ ID NO: 4980724 - DNA, 22 bp, Homo sapiens
tgtttaaaactcagaatataac

SEQ ID NO: 4980725 - DNA, 20 bp, Homo sapiens
ttagagtatacctcctatat

SEQ ID NO: 4980726 - DNA, 16 bp, Homo sapiens
ttatgggatgtaaaca

SEQ ID NO: 4980727 - DNA, 17 bp, Homo sapiens
ttatgggatgtaaacaa

SEQ ID NO: 4980728 - DNA, 14 bp, Homo sapiens
ttcccactccttca

SEQ ID NO: 4980729 - DNA, 19 bp, Homo sapiens
ttctctttaaaatatttgt

SEQ ID NO: 4980730 - DNA, 13 bp, Homo sapiens
ttctgaagtactt

SEQ ID NO: 4980731 - DNA, 18 bp, Homo sapiens
ttgcatgaattactgtat

SEQ ID NO: 4980732 - DNA, 20 bp, Homo sapiens
ttgtgtcagaaacatgaaat

SEQ ID NO: 4980733 - DNA, 23 bp, Homo sapiens
ttgtttaaaactcagaatataac

SEQ ID NO: 4980734 - DNA, 23 bp, Homo sapiens
tttaaaactcagaatataacatg

SEQ ID NO: 4980735 - DNA, 19 bp, Homo sapiens
tttataaactaggtaaaat

SEQ ID NO: 4980736 - DNA, 22 bp, Homo sapiens
tttatcatgtcgtaggtaaact

SEQ ID NO: 4980737 - DNA, 20 bp, Homo sapiens
tttcatttagtgctaaacaa

SEQ ID NO: 4980738 - DNA, 21 bp, Homo sapiens
tttctaaatgttggaatgtta

SEQ ID NO: 4980739 - DNA, 18 bp, Homo sapiens
tttgcattgtgtcagaaa

SEQ ID NO: 4980740 - DNA, 15 bp, Homo sapiens
tttgtctttaaacag

SEQ ID NO: 4980741 - DNA, 17 bp, Homo sapiens
ttttatatgatggggga

SEQ ID NO: 4980742 - DNA, 16 bp, Homo sapiens
ttttatttataaacta

SEQ ID NO: 4980743 - DNA, 14 bp, Homo sapiens
aaaactcagaatat

SEQ ID NO: 4980744 - DNA, 13 bp, Homo sapiens
aaaaggaggaaat

SEQ ID NO: 4980745 - DNA, 22 bp, Homo sapiens
aaaagtaatctttaaactggct

SEQ ID NO: 4980746 - DNA, 20 bp, Homo sapiens
aaaatacctattttatatga

SEQ ID NO: 4980747 - DNA, 15 bp, Homo sapiens
aaaatgggaagactg

SEQ ID NO: 4980748 - DNA, 19 bp, Homo sapiens
aaaatgggaagactgagct

SEQ ID NO: 4980749 - DNA, 16 bp, Homo sapiens
aaagctttggacaagt

SEQ ID NO: 4980750 - DNA, 18 bp, Homo sapiens
aaataagctcgagtgaat

SEQ ID NO: 4980751 - DNA, 17 bp, Homo sapiens
aacaagaggggaaaaca

SEQ ID NO: 4980752 - DNA, 16 bp, Homo sapiens
aacaagtaagaaaaat

SEQ ID NO: 4980753 - DNA, 21 bp, Homo sapiens
aacctggtattttaagagaaa

SEQ ID NO: 4980754 - DNA, 16 bp, Homo sapiens
aactcagaatataaca

SEQ ID NO: 4980755 - DNA, 14 bp, Homo sapiens
aacttagaggaaaa

SEQ ID NO: 4980756 - DNA, 16 bp, Homo sapiens
aacttagaggaaaagg

SEQ ID NO: 4980757 - DNA, 15 bp, Homo sapiens
aacttccacaagagt

SEQ ID NO: 4980758 - DNA, 15 bp, Homo sapiens
aacttttaaagaaaa

SEQ ID NO: 4980759 - DNA, 14 bp, Homo sapiens
aagaaaaatatgat

SEQ ID NO: 4980760 - DNA, 20 bp, Homo sapiens
aaggtagatcctgagatgat

SEQ ID NO: 4980761 - DNA, 18 bp, Homo sapiens
aagtaatctttaaactgg

SEQ ID NO: 4980762 - DNA, 13 bp, Homo sapiens
aagtacttaaact

SEQ ID NO: 4980763 - DNA, 20 bp, Homo sapiens
aagtacttaaacttccacaa

SEQ ID NO: 4980764 - DNA, 14 bp, Homo sapiens
aataatagggaaaa

SEQ ID NO: 4980765 - DNA, 18 bp, Homo sapiens
aataatagggaaaatacc

SEQ ID NO: 4980766 - DNA, 21 bp, Homo sapiens
aatattgatgttaacaagagg

SEQ ID NO: 4980767 - DNA, 16 bp, Homo sapiens
aatgcttccaagcatg

SEQ ID NO: 4980768 - DNA, 19 bp, Homo sapiens
aatttctgaaagatgagta

SEQ ID NO: 4980769 - DNA, 20 bp, Homo sapiens
acaaaacacaggttttttca

SEQ ID NO: 4980770 - DNA, 13 bp, Homo sapiens
acaagagtgaatt

SEQ ID NO: 4980771 - DNA, 12 bp, Homo sapiens
acagatgatact

SEQ ID NO: 4980772 - DNA, 14 bp, Homo sapiens
accttcctcctccc

SEQ ID NO: 4980773 - DNA, 17 bp, Homo sapiens
actcagaatataacatg

SEQ ID NO: 4980774 - DNA, 23 bp, Homo sapiens
actgttctctttaaaatatttgt

SEQ ID NO: 4980775 - DNA, 20 bp, Homo sapiens
acttccacttgtgtatattt

SEQ ID NO: 4980776 - DNA, 14 bp, Homo sapiens
acttgcatgaatta

SEQ ID NO: 4980777 - DNA, 21 bp, Homo sapiens
acttgcatgaattactgtata

SEQ ID NO: 4980778 - DNA, 12 bp, Homo sapiens
acttgtgtatat

SEQ ID NO: 4980779 - DNA, 23 bp, Homo sapiens
acttgtgtatattttaatgaata

SEQ ID NO: 4980780 - DNA, 21 bp, Homo sapiens
actttttgcaccttattttct

SEQ ID NO: 4980781 - DNA, 12 bp, Homo sapiens
agaaacttagag

SEQ ID NO: 4980782 - DNA, 22 bp, Homo sapiens
agaagtggaagtgcttgatatg

SEQ ID NO: 4980783 - DNA, 14 bp, Homo sapiens
agaatataacatgt

SEQ ID NO: 4980784 - DNA, 14 bp, Homo sapiens
agattgggataagg

SEQ ID NO: 4980785 - DNA, 19 bp, Homo sapiens
agcaatctgcattttaaca

SEQ ID NO: 4980786 - DNA, 20 bp, Homo sapiens
agcttagagtatacctccta

SEQ ID NO: 4980787 - DNA, 18 bp, Homo sapiens
aggatttcaccagaagtt

SEQ ID NO: 4980788 - DNA, 20 bp, Homo sapiens
aggcacaaaattttgtttaa

SEQ ID NO: 4980789 - DNA, 19 bp, Homo sapiens
agtgataattttatttata

SEQ ID NO: 4980790 - DNA, 14 bp, Homo sapiens
ataaactaggtaaa

SEQ ID NO: 4980791 - DNA, 18 bp, Homo sapiens
ataaactccttaacttca

SEQ ID NO: 4980792 - DNA, 16 bp, Homo sapiens
atattgatgttaacaa

SEQ ID NO: 4980793 - DNA, 21 bp, Homo sapiens
atcatgtcgtaggtaaactaa

SEQ ID NO: 4980794 - DNA, 20 bp, Homo sapiens
atccaaagttgccacagatg

SEQ ID NO: 4980795 - DNA, 15 bp, Homo sapiens
atcccatctgctaga

SEQ ID NO: 4980796 - DNA, 18 bp, Homo sapiens
atctttaaactggctggc

SEQ ID NO: 4980797 - DNA, 20 bp, Homo sapiens
atgatactctcagattttaa

SEQ ID NO: 4980798 - DNA, 16 bp, Homo sapiens
atgatcaaaacatgct

SEQ ID NO: 4980799 - DNA, 20 bp, Homo sapiens
atgcttttagttttaaaagt

SEQ ID NO: 4980800 - DNA, 22 bp, Homo sapiens
atgttaacaagaggggaaaaca

SEQ ID NO: 4980801 - DNA, 23 bp, Homo sapiens
atgttatgggatgtaaacaatgt

SEQ ID NO: 4980802 - DNA, 22 bp, Homo sapiens
attagatattaggggggaaagt

SEQ ID NO: 4980803 - DNA, 16 bp, Homo sapiens
atttagtgctaaacaa

SEQ ID NO: 4980804 - DNA, 18 bp, Homo sapiens
atttcaccagaagttaca

SEQ ID NO: 4980805 - DNA, 13 bp, Homo sapiens
atttgcattgtgt

SEQ ID NO: 4980806 - DNA, 11 bp, Homo sapiens
attttaacaag

SEQ ID NO: 4980807 - DNA, 14 bp, Homo sapiens
attttaagagaaaa

SEQ ID NO: 4980808 - DNA, 19 bp, Homo sapiens
attttaatgaatattgatg

SEQ ID NO: 4980809 - DNA, 23 bp, Homo sapiens
caaattagcaggtgcaccttctg

SEQ ID NO: 4980810 - DNA, 20 bp, Homo sapiens
caagaatttgacttggaaaa

SEQ ID NO: 4980811 - DNA, 21 bp, Homo sapiens
caagtccttgacctctataaa

SEQ ID NO: 4980812 - DNA, 16 bp, Homo sapiens
caagtgataattttat

SEQ ID NO: 4980813 - DNA, 23 bp, Homo sapiens
caagtgataattttatttataaa

SEQ ID NO: 4980814 - DNA, 14 bp, Homo sapiens
cacaagagtgaatt

SEQ ID NO: 4980815 - DNA, 12 bp, Homo sapiens
cagaaacatgaa

SEQ ID NO: 4980816 - DNA, 19 bp, Homo sapiens
cagacactacatatctaaa

SEQ ID NO: 4980817 - DNA, 17 bp, Homo sapiens
cagagtcctcattataa

SEQ ID NO: 4980818 - DNA, 16 bp, Homo sapiens
cagagtttacattcta

SEQ ID NO: 4980819 - DNA, 22 bp, Homo sapiens
caggatttcaccagaagttaca

SEQ ID NO: 4980820 - DNA, 22 bp, Homo sapiens
cagtgatgcttttagttttaaa

SEQ ID NO: 4980821 - DNA, 20 bp, Homo sapiens
catgaattactgtatataaa

SEQ ID NO: 4980822 - DNA, 13 bp, Homo sapiens
cattctaatttgc

SEQ ID NO: 4980823 - DNA, 15 bp, Homo sapiens
cctataatacaaata

SEQ ID NO: 4980824 - DNA, 22 bp, Homo sapiens
cgagtgaatttctaaatgttgg

SEQ ID NO: 4980825 - DNA, 12 bp, Homo sapiens
cgtaggtaaact

SEQ ID NO: 4980826 - DNA, 14 bp, Homo sapiens
ctacagaagtggaa

SEQ ID NO: 4980827 - DNA, 16 bp, Homo sapiens
ctacctgcagtgggaa

SEQ ID NO: 4980828 - DNA, 19 bp, Homo sapiens
ctctgttcctgagccccca

SEQ ID NO: 4980829 - DNA, 21 bp, Homo sapiens
ctgcaggtcagtttggaatga

SEQ ID NO: 4980830 - DNA, 18 bp, Homo sapiens
ctggacttcctataatac

SEQ ID NO: 4980831 - DNA, 17 bp, Homo sapiens
ctggctggcccagagtt

SEQ ID NO: 4980832 - DNA, 14 bp, Homo sapiens
ctgtttaatttaca

SEQ ID NO: 4980833 - DNA, 14 bp, Homo sapiens
cttagaggaaaagg

SEQ ID NO: 4980834 - DNA, 15 bp, Homo sapiens
cttagaggaaaaggg

SEQ ID NO: 4980835 - DNA, 16 bp, Homo sapiens
cttccaagcatgacaa

SEQ ID NO: 4980836 - DNA, 12 bp, Homo sapiens
cttcctataata

SEQ ID NO: 4980837 - DNA, 15 bp, Homo sapiens
cttgacctctataaa

SEQ ID NO: 4980838 - DNA, 14 bp, Homo sapiens
cttgatatgtaagt

SEQ ID NO: 4980839 - DNA, 22 bp, Homo sapiens
gaaaactgttctctttaaaata

SEQ ID NO: 4980840 - DNA, 17 bp, Homo sapiens
gaatataacatgtaaaa

SEQ ID NO: 4980841 - DNA, 20 bp, Homo sapiens
gacaacttttaaagaaaaat

SEQ ID NO: 4980842 - DNA, 19 bp, Homo sapiens
gacctacctgcagtgggaa

SEQ ID NO: 4980843 - DNA, 16 bp, Homo sapiens
gagcccccacattctc

SEQ ID NO: 4980844 - DNA, 17 bp, Homo sapiens
gagtgaatttgacctag

SEQ ID NO: 4980845 - DNA, 13 bp, Homo sapiens
gatgtaaacaatg

SEQ ID NO: 4980846 - DNA, 20 bp, Homo sapiens
gcattgtgtcagaaacatga

SEQ ID NO: 4980847 - DNA, 13 bp, Homo sapiens
gtaagtacttcca

SEQ ID NO: 4980848 - DNA, 16 bp, Homo sapiens
gtaatctttaaactgg

SEQ ID NO: 4980849 - DNA, 18 bp, Homo sapiens
gtcactaggatgcagatg

SEQ ID NO: 4980850 - DNA, 13 bp, Homo sapiens
gtcatctgtttaa

SEQ ID NO: 4980851 - DNA, 16 bp, Homo sapiens
gtgaatttctaaatgt

SEQ ID NO: 4980852 - DNA, 17 bp, Homo sapiens
gttatgggatgtaaaca

SEQ ID NO: 4980853 - DNA, 15 bp, Homo sapiens
gttctctttaaaata

SEQ ID NO: 4980854 - DNA, 15 bp, Homo sapiens
gtttctgaagtactt

SEQ ID NO: 4980855 - DNA, 19 bp, Homo sapiens
taaacaagtaagaaaaata

SEQ ID NO: 4980856 - DNA, 18 bp, Homo sapiens
taaacagcaactacagaa

SEQ ID NO: 4980857 - DNA, 12 bp, Homo sapiens
taacatgtaaaa

SEQ ID NO: 4980858 - DNA, 22 bp, Homo sapiens
taagtacttccacttgtgtata

SEQ ID NO: 4980859 - DNA, 15 bp, Homo sapiens
taatctttaaactgg

SEQ ID NO: 4980860 - DNA, 15 bp, Homo sapiens
taatgatcaaaacat

SEQ ID NO: 4980861 - DNA, 17 bp, Homo sapiens
taatgatcaaaacatgc

SEQ ID NO: 4980862 - DNA, 22 bp, Homo sapiens
tacattctaatttgcattgtgt

SEQ ID NO: 4980863 - DNA, 15 bp, Homo sapiens
tactgtatataaact

SEQ ID NO: 4980864 - DNA, 16 bp, Homo sapiens
taggcaagtttgttca

SEQ ID NO: 4980865 - DNA, 18 bp, Homo sapiens
tagtgaatttctgaaaga

SEQ ID NO: 4980866 - DNA, 13 bp, Homo sapiens
tataaacttcaga

SEQ ID NO: 4980867 - DNA, 14 bp, Homo sapiens
tataacatgtaaaa

SEQ ID NO: 4980868 - DNA, 15 bp, Homo sapiens
tatgggatgtaaaca

SEQ ID NO: 4980869 - DNA, 23 bp, Homo sapiens
tattgatgttaacaagaggggaa

SEQ ID NO: 4980870 - DNA, 17 bp, Homo sapiens
tatttgtctttaaacag

SEQ ID NO: 4980871 - DNA, 15 bp, Homo sapiens
tattttaatgaatat

SEQ ID NO: 4980872 - DNA, 19 bp, Homo sapiens
tcagaaacatgaaatgctt

SEQ ID NO: 4980873 - DNA, 19 bp, Homo sapiens
tcagaatataacatgtaaa

SEQ ID NO: 4980874 - DNA, 20 bp, Homo sapiens
tcctataatacaaatacaca

SEQ ID NO: 4980875 - DNA, 20 bp, Homo sapiens
tcctcattataaaatgggaa

SEQ ID NO: 4980876 - DNA, 22 bp, Homo sapiens
tctcaggatttcaccagaagtt

SEQ ID NO: 4980877 - DNA, 15 bp, Homo sapiens
tctgcattttaacaa

SEQ ID NO: 4980878 - DNA, 18 bp, Homo sapiens
tgacaacttttaaagaaa

SEQ ID NO: 4980879 - DNA, 23 bp, Homo sapiens
tgataattttatttataaactag

SEQ ID NO: 4980880 - DNA, 15 bp, Homo sapiens
tgatctggacttcct

SEQ ID NO: 4980881 - DNA, 23 bp, Homo sapiens
tgcattgtgtcagaaacatgaaa

SEQ ID NO: 4980882 - DNA, 18 bp, Homo sapiens
tggtattttaagagaaaa

SEQ ID NO: 4980883 - DNA, 16 bp, Homo sapiens
tgttctctttaaaata

SEQ ID NO: 4980884 - DNA, 21 bp, Homo sapiens
tgtttaaaactcagaatataa

SEQ ID NO: 4980885 - DNA, 21 bp, Homo sapiens
ttaaaactcagaatataacat

SEQ ID NO: 4980886 - DNA, 21 bp, Homo sapiens
ttaaaatatttgtctttaaac

SEQ ID NO: 4980887 - DNA, 15 bp, Homo sapiens
ttaagggggaaaact

SEQ ID NO: 4980888 - DNA, 21 bp, Homo sapiens
ttaatgaatattgatgttaac

SEQ ID NO: 4980889 - DNA, 18 bp, Homo sapiens
ttatgggatgtaaacaat

SEQ ID NO: 4980890 - DNA, 14 bp, Homo sapiens
ttcaccagaagtta

SEQ ID NO: 4980891 - DNA, 15 bp, Homo sapiens
ttccaagcatgacaa

SEQ ID NO: 4980892 - DNA, 22 bp, Homo sapiens
ttgcatgaattactgtatataa

SEQ ID NO: 4980893 - DNA, 20 bp, Homo sapiens
tttaaaactcagaatataac

SEQ ID NO: 4980894 - DNA, 14 bp, Homo sapiens
tttaaaatatttgt

SEQ ID NO: 4980895 - DNA, 22 bp, Homo sapiens
tttagttttaaaagtctatgat

SEQ ID NO: 4980896 - DNA, 23 bp, Homo sapiens
tttatcatgtcgtaggtaaacta

SEQ ID NO: 4980897 - DNA, 15 bp, Homo sapiens
tttggaatgaagaaa

SEQ ID NO: 4980898 - DNA, 19 bp, Homo sapiens
ttttaagagaaaactgcag

SEQ ID NO: 4980899 - DNA, 15 bp, Homo sapiens
ttttaagggggaaaa

SEQ ID NO: 4980900 - DNA, 21 bp, Homo sapiens
ttttaatgaatattgatgtta

SEQ ID NO: 4980901 - DNA, 17 bp, Homo sapiens
ttttatttataaactag

SEQ ID NO: 4980902 - DNA, 17 bp, Homo sapiens
ttttgtttaaaactcag

SEQ ID NO: 4980903 - DNA, 22 bp, Homo sapiens
tttttatcatgtcgtaggtaaa

SEQ ID NO: 4980904 - DNA, 17 bp, Homo sapiens
aaaatgggaagactgag

SEQ ID NO: 4980905 - DNA, 13 bp, Homo sapiens
aaacaatgtaaag

SEQ ID NO: 4980906 - DNA, 21 bp, Homo sapiens
aaacatgcttgaataactgag

SEQ ID NO: 4980907 - DNA, 19 bp, Homo sapiens
aaactcagaatataacatg

SEQ ID NO: 4980908 - DNA, 15 bp, Homo sapiens
aaacttagaggaaaa

SEQ ID NO: 4980909 - DNA, 17 bp, Homo sapiens
aaacttagaggaaaagg

SEQ ID NO: 4980910 - DNA, 16 bp, Homo sapiens
aaagtaatctttaaac

SEQ ID NO: 4980911 - DNA, 12 bp, Homo sapiens
aaatatgatact

SEQ ID NO: 4980912 - DNA, 19 bp, Homo sapiens
aaatatttgtctttaaaca

SEQ ID NO: 4980913 - DNA, 17 bp, Homo sapiens
aaatgttggaatgttat

SEQ ID NO: 4980914 - DNA, 18 bp, Homo sapiens
aaatgttggaatgttatg

SEQ ID NO: 4980915 - DNA, 17 bp, Homo sapiens
aacaagtaagaaaaata

SEQ ID NO: 4980916 - DNA, 14 bp, Homo sapiens
aacaatgtaaagta

SEQ ID NO: 4980917 - DNA, 13 bp, Homo sapiens
aacagcaactaca

SEQ ID NO: 4980918 - DNA, 14 bp, Homo sapiens
aacttttaaagaaa

SEQ ID NO: 4980919 - DNA, 14 bp, Homo sapiens
aagaggggaaaaca

SEQ ID NO: 4980920 - DNA, 18 bp, Homo sapiens
aagcaccccagtcactag

SEQ ID NO: 4980921 - DNA, 17 bp, Homo sapiens
aaggcacaaaattttgt

SEQ ID NO: 4980922 - DNA, 21 bp, Homo sapiens
aagggcacagacactacatat

SEQ ID NO: 4980923 - DNA, 20 bp, Homo sapiens
aagtccttgacctctataaa

SEQ ID NO: 4980924 - DNA, 14 bp, Homo sapiens
aatgatcaaaacat

SEQ ID NO: 4980925 - DNA, 15 bp, Homo sapiens
aatgatcaaaacatg

SEQ ID NO: 4980926 - DNA, 14 bp, Homo sapiens
aatgttggaatgtt

SEQ ID NO: 4980927 - DNA, 14 bp, Homo sapiens
aattactgtatata

SEQ ID NO: 4980928 - DNA, 16 bp, Homo sapiens
acaacttttaaagaaa

SEQ ID NO: 4980929 - DNA, 13 bp, Homo sapiens
acaagtaagaaaa

SEQ ID NO: 4980930 - DNA, 20 bp, Homo sapiens
acagacactacatatctaaa

SEQ ID NO: 4980931 - DNA, 18 bp, Homo sapiens
acagatgatacttccaag

SEQ ID NO: 4980932 - DNA, 22 bp, Homo sapiens
acattctctaggagaaacttag

SEQ ID NO: 4980933 - DNA, 21 bp, Homo sapiens
actaacctggtattttaagag

SEQ ID NO: 4980934 - DNA, 22 bp, Homo sapiens
actcagaatataacatgtaaaa

SEQ ID NO: 4980935 - DNA, 21 bp, Homo sapiens
actggcagtaacctagtgaat

SEQ ID NO: 4980936 - DNA, 15 bp, Homo sapiens
acttagaggaaaagg

SEQ ID NO: 4980937 - DNA, 20 bp, Homo sapiens
acttccaagtgataatttta

SEQ ID NO: 4980938 - DNA, 22 bp, Homo sapiens
acttccacaagagtgaatttga

SEQ ID NO: 4980939 - DNA, 13 bp, Homo sapiens
acttgtgtatatt

SEQ ID NO: 4980940 - DNA, 15 bp, Homo sapiens
acttttaaagaaaaa

SEQ ID NO: 4980941 - DNA, 18 bp, Homo sapiens
acttttaaagaaaaatat

SEQ ID NO: 4980942 - DNA, 22 bp, Homo sapiens
acttttaaagaaaaatatgata

SEQ ID NO: 4980943 - DNA, 23 bp, Homo sapiens
agaaaaataagctcgagtgaatt

SEQ ID NO: 4980944 - DNA, 11 bp, Homo sapiens
agaaacatgaa

SEQ ID NO: 4980945 - DNA, 17 bp, Homo sapiens
agaaacttagaggaaaa

SEQ ID NO: 4980946 - DNA, 16 bp, Homo sapiens
agacactacatatcta

SEQ ID NO: 4980947 - DNA, 22 bp, Homo sapiens
agatattaggggggaaagtcat

SEQ ID NO: 4980948 - DNA, 24 bp, Homo sapiens
agatgatacttccaagtgataatt

SEQ ID NO: 4980949 - DNA, 20 bp, Homo sapiens
agcaatctgcattttaacaa

SEQ ID NO: 4980950 - DNA, 19 bp, Homo sapiens
agcatgacaacttttaaag

SEQ ID NO: 4980951 - DNA, 21 bp, Homo sapiens
agggaaataatagggaaaata

SEQ ID NO: 4980952 - DNA, 15 bp, Homo sapiens
agtaatctttaaact

SEQ ID NO: 4980953 - DNA, 19 bp, Homo sapiens
agtcactaggatgcagatg

SEQ ID NO: 4980954 - DNA, 14 bp, Homo sapiens
agtcatctgtttaa

SEQ ID NO: 4980955 - DNA, 14 bp, Homo sapiens
agtcctcattataa

SEQ ID NO: 4980956 - DNA, 18 bp, Homo sapiens
agtgaatttctaaatgtt

SEQ ID NO: 4980957 - DNA, 22 bp, Homo sapiens
agtgctaaacaagtaagaaaaa

SEQ ID NO: 4980958 - DNA, 19 bp, Homo sapiens
agtgcttgatatgtaagta

SEQ ID NO: 4980959 - DNA, 14 bp, Homo sapiens
agtttacattctaa

SEQ ID NO: 4980960 - DNA, 17 bp, Homo sapiens
ataagctcgagtgaatt

SEQ ID NO: 4980961 - DNA, 21 bp, Homo sapiens
ataattttatttataaactag

SEQ ID NO: 4980962 - DNA, 15 bp, Homo sapiens
atacacaatcctcca

SEQ ID NO: 4980963 - DNA, 14 bp, Homo sapiens
atagagaataaggc

SEQ ID NO: 4980964 - DNA, 17 bp, Homo sapiens
atatgatgggggaaaaa

SEQ ID NO: 4980965 - DNA, 17 bp, Homo sapiens
atattaggggggaaagt

SEQ ID NO: 4980966 - DNA, 19 bp, Homo sapiens
atattaggggggaaagtca

SEQ ID NO: 4980967 - DNA, 12 bp, Homo sapiens
atcaaaacatgc

SEQ ID NO: 4980968 - DNA, 18 bp, Homo sapiens
atcctgtgccagaggaag

SEQ ID NO: 4980969 - DNA, 23 bp, Homo sapiens
atcctgtgccagaggaaggaaaa

SEQ ID NO: 4980970 - DNA, 20 bp, Homo sapiens
atctaaagctttggacaagt

SEQ ID NO: 4980971 - DNA, 21 bp, Homo sapiens
atgaatattgatgttaacaag

SEQ ID NO: 4980972 - DNA, 18 bp, Homo sapiens
atgaattactgtatataa

SEQ ID NO: 4980973 - DNA, 19 bp, Homo sapiens
atgacaacttttaaagaaa

SEQ ID NO: 4980974 - DNA, 22 bp, Homo sapiens
atgacaacttttaaagaaaaat

SEQ ID NO: 4980975 - DNA, 16 bp, Homo sapiens
atgtaaagtaagacat

SEQ ID NO: 4980976 - DNA, 17 bp, Homo sapiens
atgttatgggatgtaaa

SEQ ID NO: 4980977 - DNA, 18 bp, Homo sapiens
atgttatgggatgtaaac

SEQ ID NO: 4980978 - DNA, 19 bp, Homo sapiens
atgttatgggatgtaaaca

SEQ ID NO: 4980979 - DNA, 16 bp, Homo sapiens
attgatgttaacaaga

SEQ ID NO: 4980980 - DNA, 18 bp, Homo sapiens
attgtgtcagaaacatga

SEQ ID NO: 4980981 - DNA, 15 bp, Homo sapiens
atttgtctttaaaca

SEQ ID NO: 4980982 - DNA, 18 bp, Homo sapiens
caagtaagaaaaataagc

SEQ ID NO: 4980983 - DNA, 18 bp, Homo sapiens
caagtccttgacctctat

SEQ ID NO: 4980984 - DNA, 20 bp, Homo sapiens
caagtccttgacctctataa

SEQ ID NO: 4980985 - DNA, 16 bp, Homo sapiens
cactttgagaaacacc

SEQ ID NO: 4980986 - DNA, 20 bp, Homo sapiens
cagaatataacatgtaaaat

SEQ ID NO: 4980987 - DNA, 21 bp, Homo sapiens
cagcaatctgcattttaacaa

SEQ ID NO: 4980988 - DNA, 17 bp, Homo sapiens
cagtaacctagtgaatt

SEQ ID NO: 4980989 - DNA, 14 bp, Homo sapiens
catccaaagttgcc

SEQ ID NO: 4980990 - DNA, 19 bp, Homo sapiens
catctgtttaatttacaca

SEQ ID NO: 4980991 - DNA, 18 bp, Homo sapiens
ccagaggaaggaaaagga

SEQ ID NO: 4980992 - DNA, 13 bp, Homo sapiens
cggtccaaagtta

SEQ ID NO: 4980993 - DNA, 20 bp, Homo sapiens
ctacagaagtggaagtgctt

SEQ ID NO: 4980994 - DNA, 16 bp, Homo sapiens
ctatatgtccatttaa

SEQ ID NO: 4980995 - DNA, 22 bp, Homo sapiens
ctcgagtgaatttctaaatgtt

SEQ ID NO: 4980996 - DNA, 19 bp, Homo sapiens
ctctccagcggtccaaagt

SEQ ID NO: 4980997 - DNA, 20 bp, Homo sapiens
ctgaagtacttaaacttcca

SEQ ID NO: 4980998 - DNA, 21 bp, Homo sapiens
ctgcattttaacaagcacccc

SEQ ID NO: 4980999 - DNA, 20 bp, Homo sapiens
gatgttaacaagaggggaaa

SEQ ID NO: 4981000 - DNA, 21 bp, Homo sapiens
gcatgaattactgtatataaa

SEQ ID NO: 4981001 - DNA, 17 bp, Homo sapiens
ggaagtgcttgatatgt

SEQ ID NO: 4981002 - DNA, 21 bp, Homo sapiens
ggcacagacactacatatcta

SEQ ID NO: 4981003 - DNA, 20 bp, Homo sapiens
ggcccagagtttacattcta

SEQ ID NO: 4981004 - DNA, 16 bp, Homo sapiens
ggtagggaaataatag

SEQ ID NO: 4981005 - DNA, 13 bp, Homo sapiens
gtaatctttaaac

SEQ ID NO: 4981006 - DNA, 17 bp, Homo sapiens
gtatattttaatgaata

SEQ ID NO: 4981007 - DNA, 19 bp, Homo sapiens
gtatattttaatgaatatt

SEQ ID NO: 4981008 - DNA, 15 bp, Homo sapiens
gtcctcattataaaa

SEQ ID NO: 4981009 - DNA, 22 bp, Homo sapiens
gtgataattttatttataaact

SEQ ID NO: 4981010 - DNA, 17 bp, Homo sapiens
taaaactcagaatataa

SEQ ID NO: 4981011 - DNA, 22 bp, Homo sapiens
taaaactcagaatataacatgt

SEQ ID NO: 4981012 - DNA, 18 bp, Homo sapiens
taaacaagtaagaaaaat

SEQ ID NO: 4981013 - DNA, 16 bp, Homo sapiens
taaacaatgtaaagta

SEQ ID NO: 4981014 - DNA, 17 bp, Homo sapiens
taaatgttggaatgtta

SEQ ID NO: 4981015 - DNA, 22 bp, Homo sapiens
taatttacacacttgcatgaat

SEQ ID NO: 4981016 - DNA, 23 bp, Homo sapiens
tagaccacggctgccccttccac

SEQ ID NO: 4981017 - DNA, 17 bp, Homo sapiens
taggtaaactaacctgg

SEQ ID NO: 4981018 - DNA, 17 bp, Homo sapiens
tataaactaggtaaaat

SEQ ID NO: 4981019 - DNA, 13 bp, Homo sapiens
tataacatgtaaa

SEQ ID NO: 4981020 - DNA, 19 bp, Homo sapiens
tatcatgtcgtaggtaaac

SEQ ID NO: 4981021 - DNA, 14 bp, Homo sapiens
tatgggatgtaaac

SEQ ID NO: 4981022 - DNA, 19 bp, Homo sapiens
tatgggatgtaaacaatgt

SEQ ID NO: 4981023 - DNA, 23 bp, Homo sapiens
tatgggatgtaaacaatgtaaag

SEQ ID NO: 4981024 - DNA, 16 bp, Homo sapiens
tcatgtcgtaggtaaa

SEQ ID NO: 4981025 - DNA, 15 bp, Homo sapiens
tcatttagtgctaaa

SEQ ID NO: 4981026 - DNA, 16 bp, Homo sapiens
tcctcattataaaatg

SEQ ID NO: 4981027 - DNA, 23 bp, Homo sapiens
tctaggagaaacttagaggaaaa

SEQ ID NO: 4981028 - DNA, 19 bp, Homo sapiens
tctcagattttaaggggga

SEQ ID NO: 4981029 - DNA, 16 bp, Homo sapiens
tctttaaaatatttgt

SEQ ID NO: 4981030 - DNA, 11 bp, Homo sapiens
tctttaaacag

SEQ ID NO: 4981031 - DNA, 20 bp, Homo sapiens
tgaagtacttaaacttccac

SEQ ID NO: 4981032 - DNA, 13 bp, Homo sapiens
tgaatttctaaat

SEQ ID NO: 4981033 - DNA, 19 bp, Homo sapiens
tgacctaggcaagtttgtt

SEQ ID NO: 4981034 - DNA, 20 bp, Homo sapiens
tgatatgtaagtacttccac

SEQ ID NO: 4981035 - DNA, 12 bp, Homo sapiens
tgatgttaacaa

SEQ ID NO: 4981036 - DNA, 20 bp, Homo sapiens
tgcatgaattactgtatata

SEQ ID NO: 4981037 - DNA, 21 bp, Homo sapiens
tgctaaacaagtaagaaaaat

SEQ ID NO: 4981038 - DNA, 21 bp, Homo sapiens
tgcttgatatgtaagtacttc

SEQ ID NO: 4981039 - DNA, 15 bp, Homo sapiens
tgtgtcagaaacatg

SEQ ID NO: 4981040 - DNA, 21 bp, Homo sapiens
tgttaacaagaggggaaaaca

SEQ ID NO: 4981041 - DNA, 20 bp, Homo sapiens
tgttatgggatgtaaacaat

SEQ ID NO: 4981042 - DNA, 22 bp, Homo sapiens
ttaaaatatttgtctttaaaca

SEQ ID NO: 4981043 - DNA, 13 bp, Homo sapiens
ttaaagaaaaata

SEQ ID NO: 4981044 - DNA, 19 bp, Homo sapiens
ttaacaagaggggaaaaca

SEQ ID NO: 4981045 - DNA, 19 bp, Homo sapiens
ttaagggggaaaactgttc

SEQ ID NO: 4981046 - DNA, 14 bp, Homo sapiens
ttactgtatataaa

SEQ ID NO: 4981047 - DNA, 15 bp, Homo sapiens
ttagtgctaaacaag

SEQ ID NO: 4981048 - DNA, 21 bp, Homo sapiens
ttataaaatgggaagactgag

SEQ ID NO: 4981049 - DNA, 15 bp, Homo sapiens
ttatgggatgtaaac

SEQ ID NO: 4981050 - DNA, 12 bp, Homo sapiens
ttatttataaac

SEQ ID NO: 4981051 - DNA, 14 bp, Homo sapiens
ttctctttaaaata

SEQ ID NO: 4981052 - DNA, 16 bp, Homo sapiens
ttgacctctataaact

SEQ ID NO: 4981053 - DNA, 23 bp, Homo sapiens
ttgatgttaacaagaggggaaaa

SEQ ID NO: 4981054 - DNA, 15 bp, Homo sapiens
ttgctctaatgatca

SEQ ID NO: 4981055 - DNA, 11 bp, Homo sapiens
ttggaatgtta

SEQ ID NO: 4981056 - DNA, 14 bp, Homo sapiens
ttgtctttaaacag

SEQ ID NO: 4981057 - DNA, 19 bp, Homo sapiens
tttacacacttgcatgaat

SEQ ID NO: 4981058 - DNA, 15 bp, Homo sapiens
tttatttataaacta

SEQ ID NO: 4981059 - DNA, 15 bp, Homo sapiens
tttcaccagaagtta

SEQ ID NO: 4981060 - DNA, 23 bp, Homo sapiens
tttctgaaagatgagtaatttct

SEQ ID NO: 4981061 - DNA, 19 bp, Homo sapiens
tttctgaagtacttaaact

SEQ ID NO: 4981062 - DNA, 14 bp, Homo sapiens
tttgacttggaaaa

SEQ ID NO: 4981063 - DNA, 12 bp, Homo sapiens
tttgcattgtgt

SEQ ID NO: 4981064 - DNA, 19 bp, Homo sapiens
ttttaaagaaaaatatgat

SEQ ID NO: 4981065 - DNA, 20 bp, Homo sapiens
ttttatatgatgggggaaaa

SEQ ID NO: 4981066 - DNA, 23 bp, Homo sapiens
aaaaggtagatcctgagatgatt

SEQ ID NO: 4981067 - DNA, 19 bp, Homo sapiens
aaaatatttgtctttaaac

SEQ ID NO: 4981068 - DNA, 15 bp, Homo sapiens
aaactaggtaaaatt

SEQ ID NO: 4981069 - DNA, 20 bp, Homo sapiens
aaactgttctctttaaaata

SEQ ID NO: 4981070 - DNA, 20 bp, Homo sapiens
aaacttccacaagagtgaat

SEQ ID NO: 4981071 - DNA, 13 bp, Homo sapiens
aaagtaagacatc

SEQ ID NO: 4981072 - DNA, 22 bp, Homo sapiens
aaatatgatactctcagatttt

SEQ ID NO: 4981073 - DNA, 20 bp, Homo sapiens
aaatatttgtctttaaacag

SEQ ID NO: 4981074 - DNA, 14 bp, Homo sapiens
aacaagtaagaaaa

SEQ ID NO: 4981075 - DNA, 18 bp, Homo sapiens
aactaacctggtatttta

SEQ ID NO: 4981076 - DNA, 19 bp, Homo sapiens
aactgttctctttaaaata

SEQ ID NO: 4981077 - DNA, 21 bp, Homo sapiens
aagcatgacaacttttaaaga

SEQ ID NO: 4981078 - DNA, 15 bp, Homo sapiens
aataatagggaaaat

SEQ ID NO: 4981079 - DNA, 22 bp, Homo sapiens
aatagggaaaatacctatttta

SEQ ID NO: 4981080 - DNA, 12 bp, Homo sapiens
aatataacatgt

SEQ ID NO: 4981081 - DNA, 18 bp, Homo sapiens
aatctgcattttaacaag

SEQ ID NO: 4981082 - DNA, 22 bp, Homo sapiens
aatgttatgggatgtaaacaat

SEQ ID NO: 4981083 - DNA, 20 bp, Homo sapiens
aatttgcattgtgtcagaaa

SEQ ID NO: 4981084 - DNA, 18 bp, Homo sapiens
acaacagttctcttctag

SEQ ID NO: 4981085 - DNA, 17 bp, Homo sapiens
acaacttttaaagaaaa

SEQ ID NO: 4981086 - DNA, 20 bp, Homo sapiens
acaacttttaaagaaaaata

SEQ ID NO: 4981087 - DNA, 12 bp, Homo sapiens
acaatgtaaagt

SEQ ID NO: 4981088 - DNA, 15 bp, Homo sapiens
acagacactacatat

SEQ ID NO: 4981089 - DNA, 18 bp, Homo sapiens
acatgaaatgcttccaag

SEQ ID NO: 4981090 - DNA, 14 bp, Homo sapiens
acatgcttgaataa

SEQ ID NO: 4981091 - DNA, 16 bp, Homo sapiens
acatgcttgaataact

SEQ ID NO: 4981092 - DNA, 13 bp, Homo sapiens
actaggtaaaatt

SEQ ID NO: 4981093 - DNA, 20 bp, Homo sapiens
actcagaatataacatgtaa

SEQ ID NO: 4981094 - DNA, 23 bp, Homo sapiens
actcagaatataacatgtaaaat

SEQ ID NO: 4981095 - DNA, 16 bp, Homo sapiens
actgagcttagagtat

SEQ ID NO: 4981096 - DNA, 20 bp, Homo sapiens
acttcagagtcctcattata

SEQ ID NO: 4981097 - DNA, 19 bp, Homo sapiens
acttccaagtgataatttt

SEQ ID NO: 4981098 - DNA, 20 bp, Homo sapiens
acttgcatgaattactgtat

SEQ ID NO: 4981099 - DNA, 22 bp, Homo sapiens
acttgcatgaattactgtatat

SEQ ID NO: 4981100 - DNA, 20 bp, Homo sapiens
agaaacaccacccatttcta

SEQ ID NO: 4981101 - DNA, 17 bp, Homo sapiens
agaataaggcacaaaat

SEQ ID NO: 4981102 - DNA, 15 bp, Homo sapiens
agaggaaggaaaagg

SEQ ID NO: 4981103 - DNA, 17 bp, Homo sapiens
agagtcctcattataaa

SEQ ID NO: 4981104 - DNA, 14 bp, Homo sapiens
agatgatttggtca

SEQ ID NO: 4981105 - DNA, 17 bp, Homo sapiens
agcatgacaacttttaa

SEQ ID NO: 4981106 - DNA, 20 bp, Homo sapiens
agcatgacaacttttaaaga

SEQ ID NO: 4981107 - DNA, 23 bp, Homo sapiens
agtgataattttatttataaact

SEQ ID NO: 4981108 - DNA, 22 bp, Homo sapiens
agtgatgcttttagttttaaaa

SEQ ID NO: 4981109 - DNA, 15 bp, Homo sapiens
agtttggaatgaaga

SEQ ID NO: 4981110 - DNA, 14 bp, Homo sapiens
agttttaaaagtct

SEQ ID NO: 4981111 - DNA, 20 bp, Homo sapiens
ataaactccttaacttcagg

SEQ ID NO: 4981112 - DNA, 13 bp, Homo sapiens
ataaacttcagag

SEQ ID NO: 4981113 - DNA, 13 bp, Homo sapiens
ataacatgtaaaa

SEQ ID NO: 4981114 - DNA, 15 bp, Homo sapiens
ataacatgtaaaatc

SEQ ID NO: 4981115 - DNA, 14 bp, Homo sapiens
ataatagggaaaat

SEQ ID NO: 4981116 - DNA, 15 bp, Homo sapiens
atataacatgtaaaa

SEQ ID NO: 4981117 - DNA, 14 bp, Homo sapiens
atatagagaataag

SEQ ID NO: 4981118 - DNA, 22 bp, Homo sapiens
atatctaaagctttggacaagt

SEQ ID NO: 4981119 - DNA, 14 bp, Homo sapiens
atatgtaagtactt

SEQ ID NO: 4981120 - DNA, 15 bp, Homo sapiens
atatgtaagtacttc

SEQ ID NO: 4981121 - DNA, 17 bp, Homo sapiens
atatttgtctttaaaca

SEQ ID NO: 4981122 - DNA, 15 bp, Homo sapiens
atattttaatgaata

SEQ ID NO: 4981123 - DNA, 17 bp, Homo sapiens
atcatgtcgtaggtaaa

SEQ ID NO: 4981124 - DNA, 21 bp, Homo sapiens
aaaacatgcttgaataactga

SEQ ID NO: 4981125 - DNA, 17 bp, Homo sapiens
aaaagtaatctttaaac

SEQ ID NO: 4981126 - DNA, 13 bp, Homo sapiens
aaaatatgatact

SEQ ID NO: 4981127 - DNA, 19 bp, Homo sapiens
aaacatgcttgaataactg

SEQ ID NO: 4981128 - DNA, 23 bp, Homo sapiens
aaacatgcttgaataactgagct

SEQ ID NO: 4981129 - DNA, 21 bp, Homo sapiens
aaactggctggcccagagttt

SEQ ID NO: 4981130 - DNA, 13 bp, Homo sapiens
aaacttagaggaa

SEQ ID NO: 4981131 - DNA, 15 bp, Homo sapiens
aaagatgagtaattt

SEQ ID NO: 4981132 - DNA, 21 bp, Homo sapiens
aaagttcccactccttcagga

SEQ ID NO: 4981133 - DNA, 14 bp, Homo sapiens
aaataatagggaaa

SEQ ID NO: 4981134 - DNA, 13 bp, Homo sapiens
aacatgtaaaatc

SEQ ID NO: 4981135 - DNA, 16 bp, Homo sapiens
aagtaatctttaaact

SEQ ID NO: 4981136 - DNA, 23 bp, Homo sapiens
aagtacttccacttgtgtatatt

SEQ ID NO: 4981137 - DNA, 21 bp, Homo sapiens
aagtcatctgtttaatttaca

SEQ ID NO: 4981138 - DNA, 21 bp, Homo sapiens
aatgttatgggatgtaaacaa

SEQ ID NO: 4981139 - DNA, 18 bp, Homo sapiens
aattactgtatataaact

SEQ ID NO: 4981140 - DNA, 20 bp, Homo sapiens
aattactgtatataaactcc

SEQ ID NO: 4981141 - DNA, 17 bp, Homo sapiens
aattttatttataaact

SEQ ID NO: 4981142 - DNA, 13 bp, Homo sapiens
acaaaattttgtt

SEQ ID NO: 4981143 - DNA, 15 bp, Homo sapiens
acaaaattttgttta

SEQ ID NO: 4981144 - DNA, 23 bp, Homo sapiens
acaaaattttgtttaaaactcag

SEQ ID NO: 4981145 - DNA, 15 bp, Homo sapiens
acaagtaagaaaaat

SEQ ID NO: 4981146 - DNA, 16 bp, Homo sapiens
accaaattagcaggtg

SEQ ID NO: 4981147 - DNA, 13 bp, Homo sapiens
acctcctggtggt

SEQ ID NO: 4981148 - DNA, 15 bp, Homo sapiens
accttctgtggctgt

SEQ ID NO: 4981149 - DNA, 15 bp, Homo sapiens
actacagaagtggaa

SEQ ID NO: 4981150 - DNA, 14 bp, Homo sapiens
actgtatataaact

SEQ ID NO: 4981151 - DNA, 22 bp, Homo sapiens
actgttctctttaaaatatttg

SEQ ID NO: 4981152 - DNA, 22 bp, Homo sapiens
acttgtgtatattttaatgaat

SEQ ID NO: 4981153 - DNA, 12 bp, Homo sapiens
agaaaaatatga

SEQ ID NO: 4981154 - DNA, 18 bp, Homo sapiens
agaaacatgaaatgcttc

SEQ ID NO: 4981155 - DNA, 22 bp, Homo sapiens
agacatctcaggatttcaccag

SEQ ID NO: 4981156 - DNA, 19 bp, Homo sapiens
agatattaggggggaaagt

SEQ ID NO: 4981157 - DNA, 16 bp, Homo sapiens
agcaatctgcatttta

SEQ ID NO: 4981158 - DNA, 21 bp, Homo sapiens
agcaatctgcattttaacaag

SEQ ID NO: 4981159 - DNA, 17 bp, Homo sapiens
agcagacctacctgcag

SEQ ID NO: 4981160 - DNA, 15 bp, Homo sapiens
agcatgacaactttt

SEQ ID NO: 4981161 - DNA, 21 bp, Homo sapiens
agcatgacaacttttaaagaa

SEQ ID NO: 4981162 - DNA, 18 bp, Homo sapiens
agcctgactttctctcca

SEQ ID NO: 4981163 - DNA, 15 bp, Homo sapiens
aggcaagtttgttca

SEQ ID NO: 4981164 - DNA, 16 bp, Homo sapiens
agtaacctagtgaatt

SEQ ID NO: 4981165 - DNA, 21 bp, Homo sapiens
agtggaagtgcttgatatgta

SEQ ID NO: 4981166 - DNA, 16 bp, Homo sapiens
ataactgagcttagag

SEQ ID NO: 4981167 - DNA, 12 bp, Homo sapiens
ataatagggaaa

SEQ ID NO: 4981168 - DNA, 15 bp, Homo sapiens
atattgatgttaaca

SEQ ID NO: 4981169 - DNA, 19 bp, Homo sapiens
atctggacttcctataata

SEQ ID NO: 4981170 - DNA, 13 bp, Homo sapiens
atgaatattgatg

SEQ ID NO: 4981171 - DNA, 21 bp, Homo sapiens
atgaattactgtatataaact

SEQ ID NO: 4981172 - DNA, 14 bp, Homo sapiens
atgatgggggaaaa

SEQ ID NO: 4981173 - DNA, 14 bp, Homo sapiens
atgctgctcatcca

SEQ ID NO: 4981174 - DNA, 18 bp, Homo sapiens
atgtaaacaatgtaaagt

SEQ ID NO: 4981175 - DNA, 20 bp, Homo sapiens
atgttatgggatgtaaacaa

SEQ ID NO: 4981176 - DNA, 20 bp, Homo sapiens
attactgtatataaactcct

SEQ ID NO: 4981177 - DNA, 19 bp, Homo sapiens
attagcaggtgcaccttct

SEQ ID NO: 4981178 - DNA, 22 bp, Homo sapiens
attgtgtcagaaacatgaaatg

SEQ ID NO: 4981179 - DNA, 12 bp, Homo sapiens
atttataaacta

SEQ ID NO: 4981180 - DNA, 18 bp, Homo sapiens
atttataaactaggtaaa

SEQ ID NO: 4981181 - DNA, 15 bp, Homo sapiens
attttaatgaatatt

SEQ ID NO: 4981182 - DNA, 19 bp, Homo sapiens
caaagttcccactccttca

SEQ ID NO: 4981183 - DNA, 13 bp, Homo sapiens
caagaggggaaaa

SEQ ID NO: 4981184 - DNA, 17 bp, Homo sapiens
caatctgcattttaaca

SEQ ID NO: 4981185 - DNA, 21 bp, Homo sapiens
cacaatcctccaagaatttga

SEQ ID NO: 4981186 - DNA, 20 bp, Homo sapiens
cacaggttttttcaatttat

SEQ ID NO: 4981187 - DNA, 17 bp, Homo sapiens
cactacatatctaaagc

SEQ ID NO: 4981188 - DNA, 15 bp, Homo sapiens
cagaatataacatgt

SEQ ID NO: 4981189 - DNA, 17 bp, Homo sapiens
cagagtttacattctaa

SEQ ID NO: 4981190 - DNA, 23 bp, Homo sapiens
cagagtttacattctaatttgca

SEQ ID NO: 4981191 - DNA, 19 bp, Homo sapiens
cagcatcccagccagggtt

SEQ ID NO: 4981192 - DNA, 18 bp, Homo sapiens
cagcggtccaaagttatc

SEQ ID NO: 4981193 - DNA, 13 bp, Homo sapiens
catgacaactttt

SEQ ID NO: 4981194 - DNA, 22 bp, Homo sapiens
cattagatattaggggggaaag

SEQ ID NO: 4981195 - DNA, 14 bp, Homo sapiens
cattctaatttgca

SEQ ID NO: 4981196 - DNA, 22 bp, Homo sapiens
cattgtgtcagaaacatgaaat

SEQ ID NO: 4981197 - DNA, 17 bp, Homo sapiens
ccagaggaaggaaaagg

SEQ ID NO: 4981198 - DNA, 21 bp, Homo sapiens
cctataatacaaatacacaat

SEQ ID NO: 4981199 - DNA, 12 bp, Homo sapiens
cctgactttctc

SEQ ID NO: 4981200 - DNA, 14 bp, Homo sapiens
cgagtgaatttcta

SEQ ID NO: 4981201 - DNA, 16 bp, Homo sapiens
ctaaatgttggaatgt

SEQ ID NO: 4981202 - DNA, 15 bp, Homo sapiens
ctaggtaaaatttgt

SEQ ID NO: 4981203 - DNA, 13 bp, Homo sapiens
atgatcaaaacat

SEQ ID NO: 4981204 - DNA, 18 bp, Homo sapiens
atgatctggacttcctat

SEQ ID NO: 4981205 - DNA, 16 bp, Homo sapiens
atgtcgtaggtaaact

SEQ ID NO: 4981206 - DNA, 21 bp, Homo sapiens
atgttatgggatgtaaacaat

SEQ ID NO: 4981207 - DNA, 20 bp, Homo sapiens
attgtgtcagaaacatgaaa

SEQ ID NO: 4981208 - DNA, 19 bp, Homo sapiens
atttagtgctaaacaagta

SEQ ID NO: 4981209 - DNA, 21 bp, Homo sapiens
atttctactttttgcacctta

SEQ ID NO: 4981210 - DNA, 16 bp, Homo sapiens
attttaagggggaaaa

SEQ ID NO: 4981211 - DNA, 18 bp, Homo sapiens
attttaagggggaaaact

SEQ ID NO: 4981212 - DNA, 13 bp, Homo sapiens
attttatatgatg

SEQ ID NO: 4981213 - DNA, 20 bp, Homo sapiens
attttttttatcatgtcgta

SEQ ID NO: 4981214 - DNA, 22 bp, Homo sapiens
caaagttgccacagatgatact

SEQ ID NO: 4981215 - DNA, 19 bp, Homo sapiens
caagcatgacaacttttaa

SEQ ID NO: 4981216 - DNA, 13 bp, Homo sapiens
caccagaagttac

SEQ ID NO: 4981217 - DNA, 16 bp, Homo sapiens
cagattgggataaggc

SEQ ID NO: 4981218 - DNA, 19 bp, Homo sapiens
cagattttaagggggaaaa

SEQ ID NO: 4981219 - DNA, 22 bp, Homo sapiens
cagattttaagggggaaaactg

SEQ ID NO: 4981220 - DNA, 12 bp, Homo sapiens
cagcaatctgca

SEQ ID NO: 4981221 - DNA, 16 bp, Homo sapiens
caggtagggaaataat

SEQ ID NO: 4981222 - DNA, 13 bp, Homo sapiens
catccaaagttcc

SEQ ID NO: 4981223 - DNA, 18 bp, Homo sapiens
catgaattactgtatata

SEQ ID NO: 4981224 - DNA, 19 bp, Homo sapiens
catgacaacttttaaagaa

SEQ ID NO: 4981225 - DNA, 23 bp, Homo sapiens
catgacaacttttaaagaaaaat

SEQ ID NO: 4981226 - DNA, 17 bp, Homo sapiens
cattgtgtcagaaacat

SEQ ID NO: 4981227 - DNA, 17 bp, Homo sapiens
catttagtgctaaacaa

SEQ ID NO: 4981228 - DNA, 15 bp, Homo sapiens
cctcatccaaagttc

SEQ ID NO: 4981229 - DNA, 13 bp, Homo sapiens
cctcattataaaa

SEQ ID NO: 4981230 - DNA, 18 bp, Homo sapiens
cggcagcatcccagccag

SEQ ID NO: 4981231 - DNA, 14 bp, Homo sapiens
ctaaagctttggac

SEQ ID NO: 4981232 - DNA, 19 bp, Homo sapiens
ctaatgatcaaaacatgct

SEQ ID NO: 4981233 - DNA, 23 bp, Homo sapiens
ctattttatatgatgggggaaaa

SEQ ID NO: 4981234 - DNA, 17 bp, Homo sapiens
ctgctcatccaaagttg

SEQ ID NO: 4981235 - DNA, 22 bp, Homo sapiens
ctggtattttaagagaaaactg

SEQ ID NO: 4981236 - DNA, 22 bp, Homo sapiens
ctgtgccagaggaaggaaaagg

SEQ ID NO: 4981237 - DNA, 18 bp, Homo sapiens
cttccacaagagtgaatt

SEQ ID NO: 4981238 - DNA, 22 bp, Homo sapiens
ctttaaaatatttgtctttaaa

SEQ ID NO: 4981239 - DNA, 20 bp, Homo sapiens
ctttacccctcatccaaagt

SEQ ID NO: 4981240 - DNA, 20 bp, Homo sapiens
cttttaaagaaaaatatgat

SEQ ID NO: 4981241 - DNA, 22 bp, Homo sapiens
cttttaaagaaaaatatgatac

SEQ ID NO: 4981242 - DNA, 15 bp, Homo sapiens
gaatataacatgtaa

SEQ ID NO: 4981243 - DNA, 22 bp, Homo sapiens
gaatgttatgggatgtaaacaa

SEQ ID NO: 4981244 - DNA, 18 bp, Homo sapiens
gacctttcttttcttaga

SEQ ID NO: 4981245 - DNA, 18 bp, Homo sapiens
gcaactacagaagtggaa

SEQ ID NO: 4981246 - DNA, 13 bp, Homo sapiens
gctgtttgcgtga

SEQ ID NO: 4981247 - DNA, 13 bp, Homo sapiens
gtaagacatctca

SEQ ID NO: 4981248 - DNA, 15 bp, Homo sapiens
gtagatcctgagatg

SEQ ID NO: 4981249 - DNA, 15 bp, Homo sapiens
gtatacctcctatat

SEQ ID NO: 4981250 - DNA, 21 bp, Homo sapiens
gtattttaagagaaaactgca

SEQ ID NO: 4981251 - DNA, 14 bp, Homo sapiens
gtcagtttggaatg

SEQ ID NO: 4981252 - DNA, 19 bp, Homo sapiens
gtgaatttctgaaagatga

SEQ ID NO: 4981253 - DNA, 22 bp, Homo sapiens
gtttaaaactcagaatataaca

SEQ ID NO: 4981254 - DNA, 14 bp, Homo sapiens
gtttaatttacaca

SEQ ID NO: 4981255 - DNA, 12 bp, Homo sapiens
taaaactcagaa

SEQ ID NO: 4981256 - DNA, 13 bp, Homo sapiens
taaaactcagaat

SEQ ID NO: 4981257 - DNA, 14 bp, Homo sapiens
taaaatttgttgtt

SEQ ID NO: 4981258 - DNA, 15 bp, Homo sapiens
taaacaagtaagaaa

SEQ ID NO: 4981259 - DNA, 16 bp, Homo sapiens
taaagaaaaatatgat

SEQ ID NO: 4981260 - DNA, 22 bp, Homo sapiens
taaagctttggacaagtccttg

SEQ ID NO: 4981261 - DNA, 13 bp, Homo sapiens
taacatgtaaaat

SEQ ID NO: 4981262 - DNA, 17 bp, Homo sapiens
tacctattttatatgat

SEQ ID NO: 4981263 - DNA, 16 bp, Homo sapiens
tagggaaataataggg

SEQ ID NO: 4981264 - DNA, 15 bp, Homo sapiens
tatgatgggggaaaa

SEQ ID NO: 4981265 - DNA, 15 bp, Homo sapiens
tattgatgttaacaa

SEQ ID NO: 4981266 - DNA, 16 bp, Homo sapiens
tattgatgttaacaag

SEQ ID NO: 4981267 - DNA, 19 bp, Homo sapiens
tatttataaactaggtaaa

SEQ ID NO: 4981268 - DNA, 22 bp, Homo sapiens
tcaatttctctgctctcttgga

SEQ ID NO: 4981269 - DNA, 19 bp, Homo sapiens
tcagagtcctcattataaa

SEQ ID NO: 4981270 - DNA, 21 bp, Homo sapiens
tcaggatttcaccagaagtta

SEQ ID NO: 4981271 - DNA, 12 bp, Homo sapiens
tcattataaaat

SEQ ID NO: 4981272 - DNA, 14 bp, Homo sapiens
tcctccaagaattt

SEQ ID NO: 4981273 - DNA, 16 bp, Homo sapiens
tcgagtgaatttctaa

SEQ ID NO: 4981274 - DNA, 18 bp, Homo sapiens
tctaaagctttggacaag

SEQ ID NO: 4981275 - DNA, 18 bp, Homo sapiens
tctaatgatcaaaacatg

SEQ ID NO: 4981276 - DNA, 20 bp, Homo sapiens
tcttgtttctgaagtactta

SEQ ID NO: 4981277 - DNA, 16 bp, Homo sapiens
tgaattactgtatata

SEQ ID NO: 4981278 - DNA, 19 bp, Homo sapiens
tgatacttccaagtgataa

SEQ ID NO: 4981279 - DNA, 22 bp, Homo sapiens
tgatttggtcagattgggataa

SEQ ID NO: 4981280 - DNA, 18 bp, Homo sapiens
tgctaaacaagtaagaaa

SEQ ID NO: 4981281 - DNA, 21 bp, Homo sapiens
tgctctaatgatcaaaacatg

SEQ ID NO: 4981282 - DNA, 22 bp, Homo sapiens
tgctgtgcattagatattaggg

SEQ ID NO: 4981283 - DNA, 15 bp, Homo sapiens
tgggggaaaaaaagt

SEQ ID NO: 4981284 - DNA, 19 bp, Homo sapiens
tgtaaacaatgtaaagtaa

SEQ ID NO: 4981285 - DNA, 16 bp, Homo sapiens
tgtaaagtaagacatc

SEQ ID NO: 4981286 - DNA, 17 bp, Homo sapiens
tgtatattttaatgaat

SEQ ID NO: 4981287 - DNA, 18 bp, Homo sapiens
tgtgtatattttaatgaa

SEQ ID NO: 4981288 - DNA, 22 bp, Homo sapiens
ttaatgaatattgatgttaaca

SEQ ID NO: 4981289 - DNA, 16 bp, Homo sapiens
ttactgtatataaact

SEQ ID NO: 4981290 - DNA, 13 bp, Homo sapiens
ttagaggaaaagg

SEQ ID NO: 4981291 - DNA, 15 bp, Homo sapiens
ttaggggggaaagtc

SEQ ID NO: 4981292 - DNA, 23 bp, Homo sapiens
ttcagagtcctcattataaaatg

SEQ ID NO: 4981293 - DNA, 12 bp, Homo sapiens
ttctcttctagg

SEQ ID NO: 4981294 - DNA, 17 bp, Homo sapiens
ttgatatgtaagtactt

SEQ ID NO: 4981295 - DNA, 13 bp, Homo sapiens
ttgatgttaacaa

SEQ ID NO: 4981296 - DNA, 22 bp, Homo sapiens
ttgccacagatgatacttccaa

SEQ ID NO: 4981297 - DNA, 20 bp, Homo sapiens
tttaaaatatttgtctttaa

SEQ ID NO: 4981298 - DNA, 14 bp, Homo sapiens
tttaagggggaaaa

SEQ ID NO: 4981299 - DNA, 14 bp, Homo sapiens
tttgtctttaaaca

SEQ ID NO: 4981300 - DNA, 16 bp, Homo sapiens
aaagggaactgaacat

SEQ ID NO: 4981301 - DNA, 16 bp, Homo sapiens
aaagtggtatagaaat

SEQ ID NO: 4981302 - DNA, 20 bp, Homo sapiens
aaagtggtatagaaatgctg

SEQ ID NO: 4981303 - DNA, 20 bp, Homo sapiens
aacttttttttaagttacac

SEQ ID NO: 4981304 - DNA, 23 bp, Homo sapiens
aagacgtgattttgctgtagaag

SEQ ID NO: 4981305 - DNA, 23 bp, Homo sapiens
aagatggcacttataaccaaagc

SEQ ID NO: 4981306 - DNA, 13 bp, Homo sapiens
aagctagaaatga

SEQ ID NO: 4981307 - DNA, 17 bp, Homo sapiens
aagtggtatagaaatgc

SEQ ID NO: 4981308 - DNA, 15 bp, Homo sapiens
aagttcttagttgct

SEQ ID NO: 4981309 - DNA, 14 bp, Homo sapiens
aagtttaattgact

SEQ ID NO: 4981310 - DNA, 15 bp, Homo sapiens
aatcacgtaaagcta

SEQ ID NO: 4981311 - DNA, 21 bp, Homo sapiens
aatcacgtaaagctagaaatg

SEQ ID NO: 4981312 - DNA, 20 bp, Homo sapiens
aatgatccccagctgtttat

SEQ ID NO: 4981313 - DNA, 22 bp, Homo sapiens
aatgatccccagctgtttatgc

SEQ ID NO: 4981314 - DNA, 15 bp, Homo sapiens
acagtcttgtattaa

SEQ ID NO: 4981315 - DNA, 13 bp, Homo sapiens
atattgatgtgtg

SEQ ID NO: 4981316 - DNA, 13 bp, Homo sapiens
atattgtacagtt

SEQ ID NO: 4981317 - DNA, 17 bp, Homo sapiens
atgtaaaagactttttt

SEQ ID NO: 4981318 - DNA, 15 bp, Homo sapiens
atgtctcgtggtagg

SEQ ID NO: 4981319 - DNA, 21 bp, Homo sapiens
atgttaaacttacttagtgtt

SEQ ID NO: 4981320 - DNA, 19 bp, Homo sapiens
attccagagcgtgtagtga

SEQ ID NO: 4981321 - DNA, 14 bp, Homo sapiens
atttttgtcttgtg

SEQ ID NO: 4981322 - DNA, 17 bp, Homo sapiens
caaagcccaaagtggta

SEQ ID NO: 4981323 - DNA, 14 bp, Homo sapiens
caatattgtacagt

SEQ ID NO: 4981324 - DNA, 17 bp, Homo sapiens
caggacctgtggccaag

SEQ ID NO: 4981325 - DNA, 22 bp, Homo sapiens
ccaaagtggtatagaaatgctg

SEQ ID NO: 4981326 - DNA, 20 bp, Homo sapiens
cccaaagtggtatagaaatg

SEQ ID NO: 4981327 - DNA, 21 bp, Homo sapiens
cccaaagtggtatagaaatgc

SEQ ID NO: 4981328 - DNA, 16 bp, Homo sapiens
cctacagtgtacagtc

SEQ ID NO: 4981329 - DNA, 20 bp, Homo sapiens
cctacagtgtacagtcttgt

SEQ ID NO: 4981330 - DNA, 18 bp, Homo sapiens
cgtgattttgctgtagaa

SEQ ID NO: 4981331 - DNA, 20 bp, Homo sapiens
cgtggaacgtttttcctgtt

SEQ ID NO: 4981332 - DNA, 13 bp, Homo sapiens
ctacagtgtacag

SEQ ID NO: 4981333 - DNA, 14 bp, Homo sapiens
ctacagtgtacagt

SEQ ID NO: 4981334 - DNA, 15 bp, Homo sapiens
ctacagtgtacagtc

SEQ ID NO: 4981335 - DNA, 20 bp, Homo sapiens
ctacagtgtacagtcttgta

SEQ ID NO: 4981336 - DNA, 16 bp, Homo sapiens
ctcgtggtaggactgt

SEQ ID NO: 4981337 - DNA, 15 bp, Homo sapiens
ctgaacattccagag

SEQ ID NO: 4981338 - DNA, 14 bp, Homo sapiens
ctggtttttcagtt

SEQ ID NO: 4981339 - DNA, 20 bp, Homo sapiens
ctgtatgtctcgtggtagga

SEQ ID NO: 4981340 - DNA, 16 bp, Homo sapiens
ctgtggccaagttctt

SEQ ID NO: 4981341 - DNA, 23 bp, Homo sapiens
cttgttggatttttgtcttgtgt

SEQ ID NO: 4981342 - DNA, 15 bp, Homo sapiens
ctttagtttttgtga

SEQ ID NO: 4981343 - DNA, 18 bp, Homo sapiens
gaaaagggaactgaacat

SEQ ID NO: 4981344 - DNA, 23 bp, Homo sapiens
gaaatgctggtttttcagttttc

SEQ ID NO: 4981345 - DNA, 19 bp, Homo sapiens
gaccaatattgtacagttt

SEQ ID NO: 4981346 - DNA, 21 bp, Homo sapiens
gaccaatattgtacagttttt

SEQ ID NO: 4981347 - DNA, 19 bp, Homo sapiens
gacctgtggccaagttctt

SEQ ID NO: 4981348 - DNA, 21 bp, Homo sapiens
gactgaccaatattgtacagt

SEQ ID NO: 4981349 - DNA, 18 bp, Homo sapiens
gatgtaaaagactttttt

SEQ ID NO: 4981350 - DNA, 15 bp, Homo sapiens
gatttttgtcttgtg

SEQ ID NO: 4981351 - DNA, 18 bp, Homo sapiens
gcacctacagtgtacagt

SEQ ID NO: 4981352 - DNA, 19 bp, Homo sapiens
gcccaaagtggtatagaaa

SEQ ID NO: 4981353 - DNA, 11 bp, Homo sapiens
gctagaaatga

SEQ ID NO: 4981354 - DNA, 14 bp, Homo sapiens
gcttgttggatttt

SEQ ID NO: 4981355 - DNA, 17 bp, Homo sapiens
ggaactgaacattccag

SEQ ID NO: 4981356 - DNA, 16 bp, Homo sapiens
gtaaagctagaaatga

SEQ ID NO: 4981357 - DNA, 16 bp, Homo sapiens
gtacagtcttgtatta

SEQ ID NO: 4981358 - DNA, 15 bp, Homo sapiens
gtaggactgtagaaa

SEQ ID NO: 4981359 - DNA, 14 bp, Homo sapiens
gtatagaaatgctg

SEQ ID NO: 4981360 - DNA, 23 bp, Homo sapiens
gtatagaaatgctggtttttcag

SEQ ID NO: 4981361 - DNA, 23 bp, Homo sapiens
gtctaggcaggacctgtggccaa

SEQ ID NO: 4981362 - DNA, 19 bp, Homo sapiens
gtgaagtttaattgactta

SEQ ID NO: 4981363 - DNA, 13 bp, Homo sapiens
gtgtttctttagt

SEQ ID NO: 4981364 - DNA, 16 bp, Homo sapiens
gtgtttctttagtttt

SEQ ID NO: 4981365 - DNA, 14 bp, Homo sapiens
gttggatttttgtc

SEQ ID NO: 4981366 - DNA, 16 bp, Homo sapiens
gtttctttagtttttg

SEQ ID NO: 4981367 - DNA, 12 bp, Homo sapiens
gtttttcagttt

SEQ ID NO: 4981368 - DNA, 19 bp, Homo sapiens
gtttttcctgttcttaaga

SEQ ID NO: 4981369 - DNA, 13 bp, Homo sapiens
taaaagacttttt

SEQ ID NO: 4981370 - DNA, 20 bp, Homo sapiens
taaaagtacatgttaaactt

SEQ ID NO: 4981371 - DNA, 15 bp, Homo sapiens
taaagctagaaatga

SEQ ID NO: 4981372 - DNA, 13 bp, Homo sapiens
taaataacttttt

SEQ ID NO: 4981373 - DNA, 21 bp, Homo sapiens
taagttacacatttttcagat

SEQ ID NO: 4981374 - DNA, 19 bp, Homo sapiens
tacacatttttcagatata

SEQ ID NO: 4981375 - DNA, 13 bp, Homo sapiens
tacagtgtacagt

SEQ ID NO: 4981376 - DNA, 16 bp, Homo sapiens
tacagtgtacagtctt

SEQ ID NO: 4981377 - DNA, 14 bp, Homo sapiens
taggcaggacctgt

SEQ ID NO: 4981378 - DNA, 17 bp, Homo sapiens
tataaattttttttgtt

SEQ ID NO: 4981379 - DNA, 21 bp, Homo sapiens
tatgtctcgtggtaggactgt

SEQ ID NO: 4981380 - DNA, 15 bp, Homo sapiens
tattaagttgttaat

SEQ ID NO: 4981381 - DNA, 12 bp, Homo sapiens
tattgtacagtt

SEQ ID NO: 4981382 - DNA, 13 bp, Homo sapiens
tattgtacagttt

SEQ ID NO: 4981383 - DNA, 15 bp, Homo sapiens
tattgtacagttttt

SEQ ID NO: 4981384 - DNA, 13 bp, Homo sapiens
tatttatataaat

SEQ ID NO: 4981385 - DNA, 19 bp, Homo sapiens
tcacgtaaagctagaaatg

SEQ ID NO: 4981386 - DNA, 18 bp, Homo sapiens
tcagatataaaagactga

SEQ ID NO: 4981387 - DNA, 22 bp, Homo sapiens
tcccgtggaacgtttttcctgt

SEQ ID NO: 4981388 - DNA, 19 bp, Homo sapiens
tcctgttcttaagacgtga

SEQ ID NO: 4981389 - DNA, 20 bp, Homo sapiens
tcgtggtaggactgtagaaa

SEQ ID NO: 4981390 - DNA, 16 bp, Homo sapiens
tcttgtattaagttgt

SEQ ID NO: 4981391 - DNA, 22 bp, Homo sapiens
tcttgtattaagttgttaataa

SEQ ID NO: 4981392 - DNA, 19 bp, Homo sapiens
tgaccaatattgtacagtt

SEQ ID NO: 4981393 - DNA, 21 bp, Homo sapiens
tgaccaatattgtacagtttt

SEQ ID NO: 4981394 - DNA, 17 bp, Homo sapiens
tgacttatttatataaa

SEQ ID NO: 4981395 - DNA, 20 bp, Homo sapiens
tgacttatttatataaattt

SEQ ID NO: 4981396 - DNA, 21 bp, Homo sapiens
tgacttatttatataaatttt

SEQ ID NO: 4981397 - DNA, 16 bp, Homo sapiens
tgattttgctgtagaa

SEQ ID NO: 4981398 - DNA, 18 bp, Homo sapiens
tgctggtttttcagtttt

SEQ ID NO: 4981399 - DNA, 14 bp, Homo sapiens
tgcttgttggattt

SEQ ID NO: 4981400 - DNA, 17 bp, Homo sapiens
tggtaggactgtagaaa

SEQ ID NO: 4981401 - DNA, 18 bp, Homo sapiens
tggtaggactgtagaaaa

SEQ ID NO: 4981402 - DNA, 16 bp, Homo sapiens
tggtatagaaatgctg

SEQ ID NO: 4981403 - DNA, 12 bp, Homo sapiens
tgtacagtcttg

SEQ ID NO: 4981404 - DNA, 12 bp, Homo sapiens
tgtacagttttt

SEQ ID NO: 4981405 - DNA, 18 bp, Homo sapiens
tgtagaaaagggaactga

SEQ ID NO: 4981406 - DNA, 13 bp, Homo sapiens
tgttaataaaagt

SEQ ID NO: 4981407 - DNA, 18 bp, Homo sapiens
tgttaataaaagtacatg

SEQ ID NO: 4981408 - DNA, 16 bp, Homo sapiens
tgttcttaagacgtga

SEQ ID NO: 4981409 - DNA, 21 bp, Homo sapiens
ttaattgacttatttatataa

SEQ ID NO: 4981410 - DNA, 15 bp, Homo sapiens
ttagttgctgtatgt

SEQ ID NO: 4981411 - DNA, 21 bp, Homo sapiens
ttagtttttgtgaagtttaat

SEQ ID NO: 4981412 - DNA, 14 bp, Homo sapiens
ttcagatataaaag

SEQ ID NO: 4981413 - DNA, 15 bp, Homo sapiens
ttcagatataaaaga

SEQ ID NO: 4981414 - DNA, 22 bp, Homo sapiens
ttcagatataaaagactgacca

SEQ ID NO: 4981415 - DNA, 14 bp, Homo sapiens
ttgttaataaaagt

SEQ ID NO: 4981416 - DNA, 14 bp, Homo sapiens
tttcagatataaaa

SEQ ID NO: 4981417 - DNA, 13 bp, Homo sapiens
tttgctgtagaag

SEQ ID NO: 4981418 - DNA, 21 bp, Homo sapiens
tttgtcttgtgtttctttagt

SEQ ID NO: 4981419 - DNA, 12 bp, Homo sapiens
ttttcagttttc

SEQ ID NO: 4981420 - DNA, 21 bp, Homo sapiens
ttttgtgaagtttaattgact

SEQ ID NO: 4981421 - DNA, 18 bp, Homo sapiens
tttttaagttacacattt

SEQ ID NO: 4981422 - DNA, 13 bp, Homo sapiens
ttttttgtttcat

SEQ ID NO: 4981423 - DNA, 14 bp, Homo sapiens
aaagctagaaatga

SEQ ID NO: 4981424 - DNA, 23 bp, Homo sapiens
aaatgatccccagctgtttatgc

SEQ ID NO: 4981425 - DNA, 22 bp, Homo sapiens
aaatgctggtttttcagttttc

SEQ ID NO: 4981426 - DNA, 17 bp, Homo sapiens
aacgtttttcctgttct

SEQ ID NO: 4981427 - DNA, 15 bp, Homo sapiens
aactgaacattccag

SEQ ID NO: 4981428 - DNA, 14 bp, Homo sapiens
aacttacttagtgt

SEQ ID NO: 4981429 - DNA, 14 bp, Homo sapiens
aagttacacatttt

SEQ ID NO: 4981430 - DNA, 15 bp, Homo sapiens
aagttgttaataaaa

SEQ ID NO: 4981431 - DNA, 12 bp, Homo sapiens
aataactttttt

SEQ ID NO: 4981432 - DNA, 15 bp, Homo sapiens
aatattgtacagttt

SEQ ID NO: 4981433 - DNA, 20 bp, Homo sapiens
aatcacgtaaagctagaaat

SEQ ID NO: 4981434 - DNA, 19 bp, Homo sapiens
aatgatccccagctgttta

SEQ ID NO: 4981435 - DNA, 14 bp, Homo sapiens
aattgacttattta

SEQ ID NO: 4981436 - DNA, 22 bp, Homo sapiens
acagtcttgtattaagttgtta

SEQ ID NO: 4981437 - DNA, 12 bp, Homo sapiens
acagtgtacagt

SEQ ID NO: 4981438 - DNA, 15 bp, Homo sapiens
acagtttttattgct

SEQ ID NO: 4981439 - DNA, 17 bp, Homo sapiens
acatgttaaacttactt

SEQ ID NO: 4981440 - DNA, 14 bp, Homo sapiens
accaatattgtaca

SEQ ID NO: 4981441 - DNA, 19 bp, Homo sapiens
accaatattgtacagtttt

SEQ ID NO: 4981442 - DNA, 18 bp, Homo sapiens
acctgtggccaagttctt

SEQ ID NO: 4981443 - DNA, 19 bp, Homo sapiens
acctgtggccaagttctta

SEQ ID NO: 4981444 - DNA, 17 bp, Homo sapiens
acgtaaagctagaaatg

SEQ ID NO: 4981445 - DNA, 19 bp, Homo sapiens
acgtgattttgctgtagaa

SEQ ID NO: 4981446 - DNA, 13 bp, Homo sapiens
actgaacattcca

SEQ ID NO: 4981447 - DNA, 20 bp, Homo sapiens
actgaccaatattgtacagt

SEQ ID NO: 4981448 - DNA, 21 bp, Homo sapiens
actgaccaatattgtacagtt

SEQ ID NO: 4981449 - DNA, 15 bp, Homo sapiens
acttttttttaagtt

SEQ ID NO: 4981450 - DNA, 17 bp, Homo sapiens
agacgtgattttgctgt

SEQ ID NO: 4981451 - DNA, 19 bp, Homo sapiens
agcacctacagtgtacagt

SEQ ID NO: 4981452 - DNA, 21 bp, Homo sapiens
aggacctgtggccaagttctt

SEQ ID NO: 4981453 - DNA, 14 bp, Homo sapiens
agtggtatagaaat

SEQ ID NO: 4981454 - DNA, 18 bp, Homo sapiens
agtggtatagaaatgctg

SEQ ID NO: 4981455 - DNA, 16 bp, Homo sapiens
atttttcagatataaa

SEQ ID NO: 4981456 - DNA, 18 bp, Homo sapiens
caaagtggtatagaaatg

SEQ ID NO: 4981457 - DNA, 18 bp, Homo sapiens
caatattgtacagttttt

SEQ ID NO: 4981458 - DNA, 14 bp, Homo sapiens
cacatttttcagat

SEQ ID NO: 4981459 - DNA, 18 bp, Homo sapiens
cacatttttcagatataa

SEQ ID NO: 4981460 - DNA, 23 bp, Homo sapiens
cacctacagtgtacagtcttgta

SEQ ID NO: 4981461 - DNA, 15 bp, Homo sapiens
cagcacctacagtgt

SEQ ID NO: 4981462 - DNA, 17 bp, Homo sapiens
caggagtgggttgattt

SEQ ID NO: 4981463 - DNA, 12 bp, Homo sapiens
cagtgtacagtc

SEQ ID NO: 4981464 - DNA, 17 bp, Homo sapiens
cagtgtacagtcttgta

SEQ ID NO: 4981465 - DNA, 14 bp, Homo sapiens
ccaatattgtacag

SEQ ID NO: 4981466 - DNA, 15 bp, Homo sapiens
cctacagtgtacagt

SEQ ID NO: 4981467 - DNA, 15 bp, Homo sapiens
cgtggaacgtttttc

SEQ ID NO: 4981468 - DNA, 16 bp, Homo sapiens
ctacagtgtacagtct

SEQ ID NO: 4981469 - DNA, 16 bp, Homo sapiens
ctaggcaggacctgtg

SEQ ID NO: 4981470 - DNA, 15 bp, Homo sapiens
ctcgtggtaggactg

SEQ ID NO: 4981471 - DNA, 21 bp, Homo sapiens
ctctccattcccgtggaacgt

SEQ ID NO: 4981472 - DNA, 15 bp, Homo sapiens
ctggtttttcagttt

SEQ ID NO: 4981473 - DNA, 16 bp, Homo sapiens
ctggtttttcagtttt

SEQ ID NO: 4981474 - DNA, 18 bp, Homo sapiens
ctgttcttaagacgtgat

SEQ ID NO: 4981475 - DNA, 13 bp, Homo sapiens
cttgtattaagtt

SEQ ID NO: 4981476 - DNA, 17 bp, Homo sapiens
gaccaatattgtacagt

SEQ ID NO: 4981477 - DNA, 16 bp, Homo sapiens
gacttatttatataaa

SEQ ID NO: 4981478 - DNA, 15 bp, Homo sapiens
gagtgggttgatttc

SEQ ID NO: 4981479 - DNA, 16 bp, Homo sapiens
gataaataactttttt

SEQ ID NO: 4981480 - DNA, 19 bp, Homo sapiens
gcacctacagtgtacagtc

SEQ ID NO: 4981481 - DNA, 14 bp, Homo sapiens
ggatttttgtcttg

SEQ ID NO: 4981482 - DNA, 14 bp, Homo sapiens
gtacagtcttgtat

SEQ ID NO: 4981483 - DNA, 13 bp, Homo sapiens
gtacagtttttat

SEQ ID NO: 4981484 - DNA, 15 bp, Homo sapiens
gtatagaaatgctgg

SEQ ID NO: 4981485 - DNA, 22 bp, Homo sapiens
gtattaagttgttaataaaagt

SEQ ID NO: 4981486 - DNA, 20 bp, Homo sapiens
gtcttgtgtttctttagttt

SEQ ID NO: 4981487 - DNA, 22 bp, Homo sapiens
gtggaacgtttttcctgttctt

SEQ ID NO: 4981488 - DNA, 14 bp, Homo sapiens
gtggccaagttctt

SEQ ID NO: 4981489 - DNA, 14 bp, Homo sapiens
gtggtatagaaatg

SEQ ID NO: 4981490 - DNA, 13 bp, Homo sapiens
gtgtacagtcttg

SEQ ID NO: 4981491 - DNA, 17 bp, Homo sapiens
gttacacatttttcaga

SEQ ID NO: 4981492 - DNA, 15 bp, Homo sapiens
gttgttaataaaagt

SEQ ID NO: 4981493 - DNA, 14 bp, Homo sapiens
gtttttcagttttc

SEQ ID NO: 4981494 - DNA, 14 bp, Homo sapiens
taaagctagaaatg

SEQ ID NO: 4981495 - DNA, 19 bp, Homo sapiens
taaattttttttgtttcat

SEQ ID NO: 4981496 - DNA, 15 bp, Homo sapiens
tacacatttttcaga

SEQ ID NO: 4981497 - DNA, 12 bp, Homo sapiens
tacagtcttgta

SEQ ID NO: 4981498 - DNA, 22 bp, Homo sapiens
tacagtgtacagtcttgtatta

SEQ ID NO: 4981499 - DNA, 21 bp, Homo sapiens
tagtgaatcacgtaaagctag

SEQ ID NO: 4981500 - DNA, 14 bp, Homo sapiens
tataaaagactgac

SEQ ID NO: 4981501 - DNA, 18 bp, Homo sapiens
tatacgataaataacttt

SEQ ID NO: 4981502 - DNA, 11 bp, Homo sapiens
tatagaaatgc

SEQ ID NO: 4981503 - DNA, 14 bp, Homo sapiens
tattgtacagtttt

SEQ ID NO: 4981504 - DNA, 20 bp, Homo sapiens
tcagatataaaagactgacc

SEQ ID NO: 4981505 - DNA, 20 bp, Homo sapiens
tcagcacctacagtgtacag

SEQ ID NO: 4981506 - DNA, 21 bp, Homo sapiens
tcagcacctacagtgtacagt

SEQ ID NO: 4981507 - DNA, 22 bp, Homo sapiens
tcagcacctacagtgtacagtc

SEQ ID NO: 4981508 - DNA, 15 bp, Homo sapiens
tcgtggtaggactgt

SEQ ID NO: 4981509 - DNA, 15 bp, Homo sapiens
tctttagtttttgtg

SEQ ID NO: 4981510 - DNA, 13 bp, Homo sapiens
tgaacattccaga

SEQ ID NO: 4981511 - DNA, 21 bp, Homo sapiens
tgatttcagcacctacagtgt

SEQ ID NO: 4981512 - DNA, 17 bp, Homo sapiens
tgattttgctgtagaag

SEQ ID NO: 4981513 - DNA, 19 bp, Homo sapiens
tgattttgctgtagaagat

SEQ ID NO: 4981514 - DNA, 15 bp, Homo sapiens
tgctggtttttcagt

SEQ ID NO: 4981515 - DNA, 16 bp, Homo sapiens
tgctggtttttcagtt

SEQ ID NO: 4981516 - DNA, 17 bp, Homo sapiens
tggatttttgtcttgtg

SEQ ID NO: 4981517 - DNA, 14 bp, Homo sapiens
tggtatagaaatgc

SEQ ID NO: 4981518 - DNA, 16 bp, Homo sapiens
tggtttttcagttttc

SEQ ID NO: 4981519 - DNA, 15 bp, Homo sapiens
tgtacagtcttgtat

SEQ ID NO: 4981520 - DNA, 22 bp, Homo sapiens
tgtagtgaatcacgtaaagcta

SEQ ID NO: 4981521 - DNA, 18 bp, Homo sapiens
tgtatgtctcgtggtagg

SEQ ID NO: 4981522 - DNA, 21 bp, Homo sapiens
tgtattaagttgttaataaaa

SEQ ID NO: 4981523 - DNA, 18 bp, Homo sapiens
tgtctcgtggtaggactg

SEQ ID NO: 4981524 - DNA, 19 bp, Homo sapiens
tgtctcgtggtaggactgt

SEQ ID NO: 4981525 - DNA, 21 bp, Homo sapiens
tgtctcgtggtaggactgtag

SEQ ID NO: 4981526 - DNA, 18 bp, Homo sapiens
tgtggccaagttcttagt

SEQ ID NO: 4981527 - DNA, 19 bp, Homo sapiens
tgttaataaaagtacatgt

SEQ ID NO: 4981528 - DNA, 20 bp, Homo sapiens
tgtttcatattgatgtgtgt

SEQ ID NO: 4981529 - DNA, 17 bp, Homo sapiens
ttacacatttttcagat

SEQ ID NO: 4981530 - DNA, 18 bp, Homo sapiens
ttagtttttgtgaagttt

SEQ ID NO: 4981531 - DNA, 22 bp, Homo sapiens
ttcagcacctacagtgtacagt

SEQ ID NO: 4981532 - DNA, 12 bp, Homo sapiens
ttcagttttcag

SEQ ID NO: 4981533 - DNA, 21 bp, Homo sapiens
ttcttaagacgtgattttgct

SEQ ID NO: 4981534 - DNA, 23 bp, Homo sapiens
ttcttaagacgtgattttgctgt

SEQ ID NO: 4981535 - DNA, 15 bp, Homo sapiens
ttcttagttgctgta

SEQ ID NO: 4981536 - DNA, 23 bp, Homo sapiens
ttcttagttgctgtatgtctcgt

SEQ ID NO: 4981537 - DNA, 16 bp, Homo sapiens
ttgatgtgtgtctagg

SEQ ID NO: 4981538 - DNA, 18 bp, Homo sapiens
ttggatttttgtcttgtg

SEQ ID NO: 4981539 - DNA, 12 bp, Homo sapiens
ttgtacagtttt

SEQ ID NO: 4981540 - DNA, 16 bp, Homo sapiens
ttgtacagtttttatt

SEQ ID NO: 4981541 - DNA, 18 bp, Homo sapiens
tttaagttacacattttt

SEQ ID NO: 4981542 - DNA, 18 bp, Homo sapiens
tttcagatataaaagact

SEQ ID NO: 4981543 - DNA, 19 bp, Homo sapiens
ttttcagatataaaagact

SEQ ID NO: 4981544 - DNA, 22 bp, Homo sapiens
ttttcagatataaaagactgac

SEQ ID NO: 4981545 - DNA, 14 bp, Homo sapiens
ttttgctgtagaag

SEQ ID NO: 4981546 - DNA, 12 bp, Homo sapiens
ttttgtttcata

SEQ ID NO: 4981547 - DNA, 12 bp, Homo sapiens
tttttcagtttt

SEQ ID NO: 4981548 - DNA, 12 bp, Homo sapiens
ttttttgtttca

SEQ ID NO: 4981549 - DNA, 13 bp, Homo sapiens
acagtgtacagtc

SEQ ID NO: 4981550 - DNA, 17 bp, Homo sapiens
acagtgtacagtcttgt

SEQ ID NO: 4981551 - DNA, 16 bp, Homo sapiens
acctacagtgtacagt

SEQ ID NO: 4981552 - DNA, 18 bp, Homo sapiens
acgtaaagctagaaatga

SEQ ID NO: 4981553 - DNA, 23 bp, Homo sapiens
actgtagaaaagggaactgaaca

SEQ ID NO: 4981554 - DNA, 15 bp, Homo sapiens
acttatttatataaa

SEQ ID NO: 4981555 - DNA, 19 bp, Homo sapiens
agaagatggcacttataac

SEQ ID NO: 4981556 - DNA, 22 bp, Homo sapiens
agactgaccaatattgtacagt

SEQ ID NO: 4981557 - DNA, 14 bp, Homo sapiens
agcacctacagtgt

SEQ ID NO: 4981558 - DNA, 12 bp, Homo sapiens
agctagaaatga

SEQ ID NO: 4981559 - DNA, 16 bp, Homo sapiens
aggacctgtggccaag

SEQ ID NO: 4981560 - DNA, 16 bp, Homo sapiens
agtcttgtattaagtt

SEQ ID NO: 4981561 - DNA, 15 bp, Homo sapiens
agtggtatagaaatg

SEQ ID NO: 4981562 - DNA, 17 bp, Homo sapiens
agtgtacagtcttgtat

SEQ ID NO: 4981563 - DNA, 13 bp, Homo sapiens
agttacacatttt

SEQ ID NO: 4981564 - DNA, 16 bp, Homo sapiens
agttacacatttttca

SEQ ID NO: 4981565 - DNA, 14 bp, Homo sapiens
agtttaattgactt

SEQ ID NO: 4981566 - DNA, 15 bp, Homo sapiens
ataaaagtacatgtt

SEQ ID NO: 4981567 - DNA, 19 bp, Homo sapiens
ataaattttttttgtttca

SEQ ID NO: 4981568 - DNA, 22 bp, Homo sapiens
ataaattttttttgtttcatat

SEQ ID NO: 4981569 - DNA, 18 bp, Homo sapiens
ataacttttttttaagtt

SEQ ID NO: 4981570 - DNA, 19 bp, Homo sapiens
atagaaatgctggtttttc

SEQ ID NO: 4981571 - DNA, 22 bp, Homo sapiens
atagaaatgctggtttttcagt

SEQ ID NO: 4981572 - DNA, 22 bp, Homo sapiens
atataaattttttttgtttcat

SEQ ID NO: 4981573 - DNA, 12 bp, Homo sapiens
atattgtacagt

SEQ ID NO: 4981574 - DNA, 14 bp, Homo sapiens
atattgtacagttt

SEQ ID NO: 4981575 - DNA, 21 bp, Homo sapiens
atcacgtaaagctagaaatga

SEQ ID NO: 4981576 - DNA, 19 bp, Homo sapiens
attaagttgttaataaaag

SEQ ID NO: 4981577 - DNA, 13 bp, Homo sapiens
attgtacagtttt

SEQ ID NO: 4981578 - DNA, 15 bp, Homo sapiens
atttatataaatttt

SEQ ID NO: 4981579 - DNA, 15 bp, Homo sapiens
attttttttgtttca

SEQ ID NO: 4981580 - DNA, 19 bp, Homo sapiens
caaagcccaaagtggtata

SEQ ID NO: 4981581 - DNA, 16 bp, Homo sapiens
caatattgtacagttt

SEQ ID NO: 4981582 - DNA, 17 bp, Homo sapiens
caatattgtacagtttt

SEQ ID NO: 4981583 - DNA, 16 bp, Homo sapiens
cacctacagtgtacag

SEQ ID NO: 4981584 - DNA, 22 bp, Homo sapiens
cagatataaaagactgaccaat

SEQ ID NO: 4981585 - DNA, 20 bp, Homo sapiens
cagcacctacagtgtacagt

SEQ ID NO: 4981586 - DNA, 18 bp, Homo sapiens
cagtgtacagtcttgtat

SEQ ID NO: 4981587 - DNA, 15 bp, Homo sapiens
cagtttttattgctt

SEQ ID NO: 4981588 - DNA, 15 bp, Homo sapiens
ccaatattgtacagt

SEQ ID NO: 4981589 - DNA, 18 bp, Homo sapiens
ccaatattgtacagtttt

SEQ ID NO: 4981590 - DNA, 11 bp, Homo sapiens
cccagctgttt

SEQ ID NO: 4981591 - DNA, 20 bp, Homo sapiens
cctgtggccaagttcttagt

SEQ ID NO: 4981592 - DNA, 17 bp, Homo sapiens
cgtaaagctagaaatga

SEQ ID NO: 4981593 - DNA, 17 bp, Homo sapiens
ctcgtggtaggactgta

SEQ ID NO: 4981594 - DNA, 21 bp, Homo sapiens
ctcgtggtaggactgtagaaa

SEQ ID NO: 4981595 - DNA, 15 bp, Homo sapiens
ctgaccaatattgta

SEQ ID NO: 4981596 - DNA, 18 bp, Homo sapiens
ctgaccaatattgtacag

SEQ ID NO: 4981597 - DNA, 19 bp, Homo sapiens
ctgaccaatattgtacagt

SEQ ID NO: 4981598 - DNA, 21 bp, Homo sapiens
ctgaccaatattgtacagttt

SEQ ID NO: 4981599 - DNA, 19 bp, Homo sapiens
ctgtagaaaagggaactga

SEQ ID NO: 4981600 - DNA, 18 bp, Homo sapiens
ctgtggccaagttcttag

SEQ ID NO: 4981601 - DNA, 17 bp, Homo sapiens
cttgtattaagttgtta

SEQ ID NO: 4981602 - DNA, 23 bp, Homo sapiens
cttgtattaagttgttaataaaa

SEQ ID NO: 4981603 - DNA, 14 bp, Homo sapiens
cttttttttaagtt

SEQ ID NO: 4981604 - DNA, 18 bp, Homo sapiens
gaagtttaattgacttat

SEQ ID NO: 4981605 - DNA, 16 bp, Homo sapiens
gacgtgattttgctgt

SEQ ID NO: 4981606 - DNA, 17 bp, Homo sapiens
gacgtgattttgctgta

SEQ ID NO: 4981607 - DNA, 22 bp, Homo sapiens
gactgaccaatattgtacagtt

SEQ ID NO: 4981608 - DNA, 11 bp, Homo sapiens
gactgtagaaa

SEQ ID NO: 4981609 - DNA, 21 bp, Homo sapiens
gataaataacttttttttaag

SEQ ID NO: 4981610 - DNA, 14 bp, Homo sapiens
gatccccagctgtt

SEQ ID NO: 4981611 - DNA, 14 bp, Homo sapiens
gctggtttttcagt

SEQ ID NO: 4981612 - DNA, 15 bp, Homo sapiens
gctggtttttcagtt

SEQ ID NO: 4981613 - DNA, 16 bp, Homo sapiens
ggatttttgtcttgtg

SEQ ID NO: 4981614 - DNA, 12 bp, Homo sapiens
ggccaagttctt

SEQ ID NO: 4981615 - DNA, 15 bp, Homo sapiens
gtaaaagactttttt

SEQ ID NO: 4981616 - DNA, 13 bp, Homo sapiens
gtacagtcttgta

SEQ ID NO: 4981617 - DNA, 12 bp, Homo sapiens
gtacagttttta

SEQ ID NO: 4981618 - DNA, 20 bp, Homo sapiens
gtagaaaagggaactgaaca

SEQ ID NO: 4981619 - DNA, 22 bp, Homo sapiens
gtatagaaatgctggtttttca

SEQ ID NO: 4981620 - DNA, 13 bp, Homo sapiens
gtctcgtggtagg

SEQ ID NO: 4981621 - DNA, 19 bp, Homo sapiens
gtctcgtggtaggactgta

SEQ ID NO: 4981622 - DNA, 19 bp, Homo sapiens
gtgtctaggcaggacctgt

SEQ ID NO: 4981623 - DNA, 16 bp, Homo sapiens
gttacacatttttcag

SEQ ID NO: 4981624 - DNA, 16 bp, Homo sapiens
gttcttaagacgtgat

SEQ ID NO: 4981625 - DNA, 21 bp, Homo sapiens
tacacatttttcagatataaa

SEQ ID NO: 4981626 - DNA, 13 bp, Homo sapiens
tacagtcttgtat

SEQ ID NO: 4981627 - DNA, 15 bp, Homo sapiens
tacagtgtacagtct

SEQ ID NO: 4981628 - DNA, 15 bp, Homo sapiens
taggcaggacctgtg

SEQ ID NO: 4981629 - DNA, 10 bp, Homo sapiens
tagtttttgt

SEQ ID NO: 4981630 - DNA, 23 bp, Homo sapiens
tatataaattttttttgtttcat

SEQ ID NO: 4981631 - DNA, 11 bp, Homo sapiens
tattgtacagt

SEQ ID NO: 4981632 - DNA, 17 bp, Homo sapiens
tattgtacagtttttat

SEQ ID NO: 4981633 - DNA, 18 bp, Homo sapiens
tcacgtaaagctagaaat

SEQ ID NO: 4981634 - DNA, 20 bp, Homo sapiens
tcacgtaaagctagaaatga

SEQ ID NO: 4981635 - DNA, 14 bp, Homo sapiens
tcagatataaaaga

SEQ ID NO: 4981636 - DNA, 17 bp, Homo sapiens
tcagatataaaagactg

SEQ ID NO: 4981637 - DNA, 16 bp, Homo sapiens
tcagttttcaggagtg

SEQ ID NO: 4981638 - DNA, 14 bp, Homo sapiens
tccccagctgttta

SEQ ID NO: 4981639 - DNA, 15 bp, Homo sapiens
tccccagctgtttat

SEQ ID NO: 4981640 - DNA, 16 bp, Homo sapiens
tcccgtggaacgtttt

SEQ ID NO: 4981641 - DNA, 14 bp, Homo sapiens
tcgtggtaggactg

SEQ ID NO: 4981642 - DNA, 19 bp, Homo sapiens
tctcgtggtaggactgtag

SEQ ID NO: 4981643 - DNA, 21 bp, Homo sapiens
tctcgtggtaggactgtagaa

SEQ ID NO: 4981644 - DNA, 14 bp, Homo sapiens
tctctccattcccg

SEQ ID NO: 4981645 - DNA, 17 bp, Homo sapiens
tgaatcacgtaaagcta

SEQ ID NO: 4981646 - DNA, 23 bp, Homo sapiens
tgaatcacgtaaagctagaaatg

SEQ ID NO: 4981647 - DNA, 14 bp, Homo sapiens
tgattttgctgtag

SEQ ID NO: 4981648 - DNA, 12 bp, Homo sapiens
tgctggtttttc

SEQ ID NO: 4981649 - DNA, 13 bp, Homo sapiens
tggtatagaaatg

SEQ ID NO: 4981650 - DNA, 21 bp, Homo sapiens
tgtacagtcttgtattaagtt

SEQ ID NO: 4981651 - DNA, 20 bp, Homo sapiens
tgtagaaaagggaactgaac

SEQ ID NO: 4981652 - DNA, 21 bp, Homo sapiens
tgtagaaaagggaactgaaca

SEQ ID NO: 4981653 - DNA, 23 bp, Homo sapiens
tgtagaaaagggaactgaacatt

SEQ ID NO: 4981654 - DNA, 17 bp, Homo sapiens
tgtctaggcaggacctg

SEQ ID NO: 4981655 - DNA, 20 bp, Homo sapiens
tgtctcgtggtaggactgta

SEQ ID NO: 4981656 - DNA, 22 bp, Homo sapiens
tgtgtgtctaggcaggacctgt

SEQ ID NO: 4981657 - DNA, 17 bp, Homo sapiens
tgttggatttttgtctt

SEQ ID NO: 4981658 - DNA, 22 bp, Homo sapiens
ttaagttacacatttttcagat

SEQ ID NO: 4981659 - DNA, 16 bp, Homo sapiens
ttaataaaagtacatg

SEQ ID NO: 4981660 - DNA, 13 bp, Homo sapiens
ttagttgctgtat

SEQ ID NO: 4981661 - DNA, 14 bp, Homo sapiens
ttatgcatagataa

SEQ ID NO: 4981662 - DNA, 12 bp, Homo sapiens
ttcagatataaa

SEQ ID NO: 4981663 - DNA, 23 bp, Homo sapiens
ttcagcacctacagtgtacagtc

SEQ ID NO: 4981664 - DNA, 14 bp, Homo sapiens
ttcttagttgctgt

SEQ ID NO: 4981665 - DNA, 13 bp, Homo sapiens
ttgtacagttttt

SEQ ID NO: 4981666 - DNA, 15 bp, Homo sapiens
tttcagttttcagga

SEQ ID NO: 4981667 - DNA, 13 bp, Homo sapiens
tttgtttcatatt

SEQ ID NO: 4981668 - DNA, 21 bp, Homo sapiens
ttttaagttacacatttttca

SEQ ID NO: 4981669 - DNA, 22 bp, Homo sapiens
ttttaagttacacatttttcag

SEQ ID NO: 4981670 - DNA, 21 bp, Homo sapiens
ttttcagatataaaagactga

SEQ ID NO: 4981671 - DNA, 13 bp, Homo sapiens
ttttgctgtagaa

SEQ ID NO: 4981672 - DNA, 13 bp, Homo sapiens
ttttgtcttgtgt

SEQ ID NO: 4981673 - DNA, 19 bp, Homo sapiens
ttttgtttcatattgatgt

SEQ ID NO: 4981674 - DNA, 15 bp, Homo sapiens
tttttcagttttcag

SEQ ID NO: 4981675 - DNA, 13 bp, Homo sapiens
atagaaatgctgg

SEQ ID NO: 4981676 - DNA, 19 bp, Homo sapiens
aaagactgaccaatattgt

SEQ ID NO: 4981677 - DNA, 21 bp, Homo sapiens
aaagggaactgaacattccag

SEQ ID NO: 4981678 - DNA, 16 bp, Homo sapiens
aaagtacatgttaaac

SEQ ID NO: 4981679 - DNA, 17 bp, Homo sapiens
aaagtggtatagaaatg

SEQ ID NO: 4981680 - DNA, 17 bp, Homo sapiens
aaattttttttgtttca

SEQ ID NO: 4981681 - DNA, 13 bp, Homo sapiens
aagtggtatagaa

SEQ ID NO: 4981682 - DNA, 22 bp, Homo sapiens
aagttcttagttgctgtatgtc

SEQ ID NO: 4981683 - DNA, 13 bp, Homo sapiens
aatattgtacagt

SEQ ID NO: 4981684 - DNA, 23 bp, Homo sapiens
aatattgtacagtttttattgct

SEQ ID NO: 4981685 - DNA, 16 bp, Homo sapiens
aatctctccattcccg

SEQ ID NO: 4981686 - DNA, 18 bp, Homo sapiens
aatgctggtttttcagtt

SEQ ID NO: 4981687 - DNA, 21 bp, Homo sapiens
aattgacttatttatataaat

SEQ ID NO: 4981688 - DNA, 14 bp, Homo sapiens
acacatttttcaga

SEQ ID NO: 4981689 - DNA, 14 bp, Homo sapiens
acagtcttgtatta

SEQ ID NO: 4981690 - DNA, 21 bp, Homo sapiens
acatttttcagatataaaaga

SEQ ID NO: 4981691 - DNA, 15 bp, Homo sapiens
accaatattgtacag

SEQ ID NO: 4981692 - DNA, 16 bp, Homo sapiens
accaatattgtacagt

SEQ ID NO: 4981693 - DNA, 18 bp, Homo sapiens
accaatattgtacagttt

SEQ ID NO: 4981694 - DNA, 17 bp, Homo sapiens
acctacagtgtacagtc

SEQ ID NO: 4981695 - DNA, 20 bp, Homo sapiens
acctacagtgtacagtcttg

SEQ ID NO: 4981696 - DNA, 17 bp, Homo sapiens
acctgtggccaagttct

SEQ ID NO: 4981697 - DNA, 16 bp, Homo sapiens
actgaacattccagag

SEQ ID NO: 4981698 - DNA, 22 bp, Homo sapiens
actgaccaatattgtacagttt

SEQ ID NO: 4981699 - DNA, 20 bp, Homo sapiens
agaaaagggaactgaacatt

SEQ ID NO: 4981700 - DNA, 12 bp, Homo sapiens
agactgaccaat

SEQ ID NO: 4981701 - DNA, 21 bp, Homo sapiens
agactgaccaatattgtacag

SEQ ID NO: 4981702 - DNA, 21 bp, Homo sapiens
agcacctacagtgtacagtct

SEQ ID NO: 4981703 - DNA, 18 bp, Homo sapiens
agtcttgtattaagttgt

SEQ ID NO: 4981704 - DNA, 13 bp, Homo sapiens
agtgtacagtctt

SEQ ID NO: 4981705 - DNA, 15 bp, Homo sapiens
agtgtacagtcttgt

SEQ ID NO: 4981706 - DNA, 16 bp, Homo sapiens
agtgtacagtcttgta

SEQ ID NO: 4981707 - DNA, 19 bp, Homo sapiens
agttacacatttttcagat

SEQ ID NO: 4981708 - DNA, 21 bp, Homo sapiens
agttcttagttgctgtatgtc

SEQ ID NO: 4981709 - DNA, 23 bp, Homo sapiens
agttgttaataaaagtacatgtt

SEQ ID NO: 4981710 - DNA, 20 bp, Homo sapiens
agtttttattgcttgttgga

SEQ ID NO: 4981711 - DNA, 18 bp, Homo sapiens
ataatctctccattcccg

SEQ ID NO: 4981712 - DNA, 16 bp, Homo sapiens
agttcttagttgctgt

SEQ ID NO: 4981713 - DNA, 20 bp, Homo sapiens
agttcttagttgctgtatgt

SEQ ID NO: 4981714 - DNA, 16 bp, Homo sapiens
agttgttaataaaagt

SEQ ID NO: 4981715 - DNA, 15 bp, Homo sapiens
agtttaattgactta

SEQ ID NO: 4981716 - DNA, 15 bp, Homo sapiens
agtttttattgcttg

SEQ ID NO: 4981717 - DNA, 12 bp, Homo sapiens
ataaataacttt

SEQ ID NO: 4981718 - DNA, 20 bp, Homo sapiens
ataaccaaagcccaaagtgg

SEQ ID NO: 4981719 - DNA, 17 bp, Homo sapiens
atataaattttttttgt

SEQ ID NO: 4981720 - DNA, 14 bp, Homo sapiens
atcacgtaaagcta

SEQ ID NO: 4981721 - DNA, 16 bp, Homo sapiens
atgtctcgtggtagga

SEQ ID NO: 4981722 - DNA, 19 bp, Homo sapiens
atgtctcgtggtaggactg

SEQ ID NO: 4981723 - DNA, 14 bp, Homo sapiens
attaagttgttaat

SEQ ID NO: 4981724 - DNA, 20 bp, Homo sapiens
attaagttgttaataaaagt

SEQ ID NO: 4981725 - DNA, 16 bp, Homo sapiens
attgcttgttggattt

SEQ ID NO: 4981726 - DNA, 14 bp, Homo sapiens
attgtacagttttt

SEQ ID NO: 4981727 - DNA, 15 bp, Homo sapiens
attgtacagttttta

SEQ ID NO: 4981728 - DNA, 21 bp, Homo sapiens
attgtacagtttttattgctt

SEQ ID NO: 4981729 - DNA, 18 bp, Homo sapiens
aaaagggaactgaacatt

SEQ ID NO: 4981730 - DNA, 15 bp, Homo sapiens
aaagcccaaagtggt

SEQ ID NO: 4981731 - DNA, 18 bp, Homo sapiens
aaagcccaaagtggtata

SEQ ID NO: 4981732 - DNA, 13 bp, Homo sapiens
aaagctagaaatg

SEQ ID NO: 4981733 - DNA, 18 bp, Homo sapiens
aaattttttttgtttcat

SEQ ID NO: 4981734 - DNA, 14 bp, Homo sapiens
aacttttttttaag

SEQ ID NO: 4981735 - DNA, 16 bp, Homo sapiens
aagacgtgattttgct

SEQ ID NO: 4981736 - DNA, 22 bp, Homo sapiens
aagacgtgattttgctgtagaa

SEQ ID NO: 4981737 - DNA, 17 bp, Homo sapiens
aagttacacatttttca

SEQ ID NO: 4981738 - DNA, 14 bp, Homo sapiens
aatattgtacagtt

SEQ ID NO: 4981739 - DNA, 17 bp, Homo sapiens
aatattgtacagttttt

SEQ ID NO: 4981740 - DNA, 16 bp, Homo sapiens
aatgatccccagctgt

SEQ ID NO: 4981741 - DNA, 20 bp, Homo sapiens
acagatgtaaaagacttttt

SEQ ID NO: 4981742 - DNA, 18 bp, Homo sapiens
acagtcttgtattaagtt

SEQ ID NO: 4981743 - DNA, 15 bp, Homo sapiens
acagtgtacagtctt

SEQ ID NO: 4981744 - DNA, 18 bp, Homo sapiens
acagtgtacagtcttgta

SEQ ID NO: 4981745 - DNA, 17 bp, Homo sapiens
accaatattgtacagtt

SEQ ID NO: 4981746 - DNA, 15 bp, Homo sapiens
acctacagtgtacag

SEQ ID NO: 4981747 - DNA, 18 bp, Homo sapiens
acctacagtgtacagtct

SEQ ID NO: 4981748 - DNA, 20 bp, Homo sapiens
agaaatgctggtttttcagt

SEQ ID NO: 4981749 - DNA, 21 bp, Homo sapiens
agaaatgctggtttttcagtt

SEQ ID NO: 4981750 - DNA, 15 bp, Homo sapiens
agatataaaagactg

SEQ ID NO: 4981751 - DNA, 15 bp, Homo sapiens
agcacctacagtgta

SEQ ID NO: 4981752 - DNA, 22 bp, Homo sapiens
agcacctacagtgtacagtctt

SEQ ID NO: 4981753 - DNA, 20 bp, Homo sapiens
agcccaaagtggtatagaaa

SEQ ID NO: 4981754 - DNA, 23 bp, Homo sapiens
agcccaaagtggtatagaaatgc

SEQ ID NO: 4981755 - DNA, 11 bp, Homo sapiens
agctagaaatg

SEQ ID NO: 4981756 - DNA, 13 bp, Homo sapiens
agctgtttatgca

SEQ ID NO: 4981757 - DNA, 18 bp, Homo sapiens
aggagtgggttgatttca

SEQ ID NO: 4981758 - DNA, 14 bp, Homo sapiens
agtacatgttaaac

SEQ ID NO: 4981759 - DNA, 22 bp, Homo sapiens
agtcttgtattaagttgttaat

SEQ ID NO: 4981760 - DNA, 16 bp, Homo sapiens
agtggtatagaaatgc

SEQ ID NO: 4981761 - DNA, 18 bp, Homo sapiens
agtttaattgacttattt

SEQ ID NO: 4981762 - DNA, 21 bp, Homo sapiens
ataaaagtacatgttaaactt

SEQ ID NO: 4981763 - DNA, 14 bp, Homo sapiens
ataaataacttttt

SEQ ID NO: 4981764 - DNA, 13 bp, Homo sapiens
atacgataaataa

SEQ ID NO: 4981765 - DNA, 16 bp, Homo sapiens
atataaaagactgacc

SEQ ID NO: 4981766 - DNA, 13 bp, Homo sapiens
atgctggtttttc

SEQ ID NO: 4981767 - DNA, 13 bp, Homo sapiens
attaagttgttaa

SEQ ID NO: 4981768 - DNA, 20 bp, Homo sapiens
attttgctgtagaagatggc

SEQ ID NO: 4981769 - DNA, 19 bp, Homo sapiens
caaagtggtatagaaatgc

SEQ ID NO: 4981770 - DNA, 15 bp, Homo sapiens
caatattgtacagtt

SEQ ID NO: 4981771 - DNA, 13 bp, Homo sapiens
cacctacagtgta

SEQ ID NO: 4981772 - DNA, 17 bp, Homo sapiens
cacctacagtgtacagt

SEQ ID NO: 4981773 - DNA, 20 bp, Homo sapiens
cacctacagtgtacagtctt

SEQ ID NO: 4981774 - DNA, 21 bp, Homo sapiens
cagctgtttatgcatagataa

SEQ ID NO: 4981775 - DNA, 17 bp, Homo sapiens
cagtcttgtattaagtt

SEQ ID NO: 4981776 - DNA, 15 bp, Homo sapiens
cagtgtacagtcttg

SEQ ID NO: 4981777 - DNA, 18 bp, Homo sapiens
catttttcagatataaaa

SEQ ID NO: 4981778 - DNA, 20 bp, Homo sapiens
catttttcagatataaaaga

SEQ ID NO: 4981779 - DNA, 19 bp, Homo sapiens
ccaaagtggtatagaaatg

SEQ ID NO: 4981780 - DNA, 16 bp, Homo sapiens
ccaatattgtacagtt

SEQ ID NO: 4981781 - DNA, 16 bp, Homo sapiens
cgtaaagctagaaatg

SEQ ID NO: 4981782 - DNA, 17 bp, Homo sapiens
ctacagtgtacagtctt

SEQ ID NO: 4981783 - DNA, 23 bp, Homo sapiens
ctagaaatgatccccagctgttt

SEQ ID NO: 4981784 - DNA, 15 bp, Homo sapiens
ctaggcaggacctgt

SEQ ID NO: 4981785 - DNA, 24 bp, Homo sapiens
ctccattcccgtggaacgtttttc

SEQ ID NO: 4981786 - DNA, 20 bp, Homo sapiens
ctgaccaatattgtacagtt

SEQ ID NO: 4981787 - DNA, 14 bp, Homo sapiens
cttacttagtgtta

SEQ ID NO: 4981788 - DNA, 22 bp, Homo sapiens
cttgtattaagttgttaataaa

SEQ ID NO: 4981789 - DNA, 21 bp, Homo sapiens
cttgtgtttctttagtttttg

SEQ ID NO: 4981790 - DNA, 21 bp, Homo sapiens
cttgttggatttttgtcttgt

SEQ ID NO: 4981791 - DNA, 13 bp, Homo sapiens
ctttagtttttgt

SEQ ID NO: 4981792 - DNA, 12 bp, Homo sapiens
gaacgtttttcc

SEQ ID NO: 4981793 - DNA, 15 bp, Homo sapiens
gaacgtttttcctgt

SEQ ID NO: 4981794 - DNA, 18 bp, Homo sapiens
gaccaatattgtacagtt

SEQ ID NO: 4981795 - DNA, 18 bp, Homo sapiens
gatataaaagactgacca

SEQ ID NO: 4981796 - DNA, 21 bp, Homo sapiens
gatggcacttataaccaaagc

SEQ ID NO: 4981797 - DNA, 16 bp, Homo sapiens
gattttgctgtagaag

SEQ ID NO: 4981798 - DNA, 21 bp, Homo sapiens
gcacctacagtgtacagtctt

SEQ ID NO: 4981799 - DNA, 12 bp, Homo sapiens
gccaagttctta

SEQ ID NO: 4981800 - DNA, 13 bp, Homo sapiens
ggtatagaaatgc

SEQ ID NO: 4981801 - DNA, 15 bp, Homo sapiens
gtaaagctagaaatg

SEQ ID NO: 4981802 - DNA, 12 bp, Homo sapiens
gtagaagatggc

SEQ ID NO: 4981803 - DNA, 16 bp, Homo sapiens
gtgaatcacgtaaagc

SEQ ID NO: 4981804 - DNA, 18 bp, Homo sapiens
gtgaatcacgtaaagcta

SEQ ID NO: 4981805 - DNA, 16 bp, Homo sapiens
gtgattttgctgtaga

SEQ ID NO: 4981806 - DNA, 16 bp, Homo sapiens
gtgtacagtcttgtat

SEQ ID NO: 4981807 - DNA, 22 bp, Homo sapiens
gtgtacagtcttgtattaagtt

SEQ ID NO: 4981808 - DNA, 19 bp, Homo sapiens
gttaaacttacttagtgtt

SEQ ID NO: 4981809 - DNA, 12 bp, Homo sapiens
gttaataaaagt

SEQ ID NO: 4981810 - DNA, 19 bp, Homo sapiens
gttcttagttgctgtatgt

SEQ ID NO: 4981811 - DNA, 23 bp, Homo sapiens
gttgatttcagcacctacagtgt

SEQ ID NO: 4981812 - DNA, 20 bp, Homo sapiens
gttggatttttgtcttgtgt

SEQ ID NO: 4981813 - DNA, 24 bp, Homo sapiens
gttttcaggagtgggttgatttca

SEQ ID NO: 4981814 - DNA, 17 bp, Homo sapiens
taataaaagtacatgtt

SEQ ID NO: 4981815 - DNA, 17 bp, Homo sapiens
tacacatttttcagata

SEQ ID NO: 4981816 - DNA, 18 bp, Homo sapiens
tagaagatggcacttata

SEQ ID NO: 4981817 - DNA, 13 bp, Homo sapiens
taggactgtagaa

SEQ ID NO: 4981818 - DNA, 14 bp, Homo sapiens
taggactgtagaaa

SEQ ID NO: 4981819 - DNA, 21 bp, Homo sapiens
tataaattttttttgtttcat

SEQ ID NO: 4981820 - DNA, 19 bp, Homo sapiens
tattgcttgttggattttt

SEQ ID NO: 4981821 - DNA, 23 bp, Homo sapiens
tcccgtggaacgtttttcctgtt

SEQ ID NO: 4981822 - DNA, 18 bp, Homo sapiens
tcttgtattaagttgtta

SEQ ID NO: 4981823 - DNA, 12 bp, Homo sapiens
tcttgtgtttct

SEQ ID NO: 4981824 - DNA, 14 bp, Homo sapiens
tgaacattccagag

SEQ ID NO: 4981825 - DNA, 17 bp, Homo sapiens
tgaccaatattgtacag

SEQ ID NO: 4981826 - DNA, 18 bp, Homo sapiens
tgaccaatattgtacagt

SEQ ID NO: 4981827 - DNA, 20 bp, Homo sapiens
tgatttcagcacctacagtg

SEQ ID NO: 4981828 - DNA, 21 bp, Homo sapiens
tggaacgtttttcctgttctt

SEQ ID NO: 4981829 - DNA, 16 bp, Homo sapiens
tggccaagttcttagt

SEQ ID NO: 4981830 - DNA, 22 bp, Homo sapiens
tggtatagaaatgctggttttt

SEQ ID NO: 4981831 - DNA, 14 bp, Homo sapiens
tgtacagtcttgta

SEQ ID NO: 4981832 - DNA, 17 bp, Homo sapiens
tgtacagtcttgtatta

SEQ ID NO: 4981833 - DNA, 19 bp, Homo sapiens
tgtagaaaagggaactgaa

SEQ ID NO: 4981834 - DNA, 19 bp, Homo sapiens
tgtctaggcaggacctgtg

SEQ ID NO: 4981835 - DNA, 15 bp, Homo sapiens
tgtcttgtgtttctt

SEQ ID NO: 4981836 - DNA, 18 bp, Homo sapiens
tgtcttgtgtttctttag

SEQ ID NO: 4981837 - DNA, 19 bp, Homo sapiens
tgtgtctaggcaggacctg

SEQ ID NO: 4981838 - DNA, 20 bp, Homo sapiens
tgtgtctaggcaggacctgt

SEQ ID NO: 4981839 - DNA, 20 bp, Homo sapiens
tgttggatttttgtcttgtg

SEQ ID NO: 4981840 - DNA, 15 bp, Homo sapiens
ttacacatttttcag

SEQ ID NO: 4981841 - DNA, 23 bp, Homo sapiens
ttacacatttttcagatataaaa

SEQ ID NO: 4981842 - DNA, 19 bp, Homo sapiens
ttcagatataaaagactga

SEQ ID NO: 4981843 - DNA, 23 bp, Homo sapiens
ttcccgtggaacgtttttcctgt

SEQ ID NO: 4981844 - DNA, 20 bp, Homo sapiens
ttcctgttcttaagacgtga

SEQ ID NO: 4981845 - DNA, 20 bp, Homo sapiens
ttgctgtagaagatggcact

SEQ ID NO: 4981846 - DNA, 19 bp, Homo sapiens
ttgtgtttctttagttttt

SEQ ID NO: 4981847 - DNA, 19 bp, Homo sapiens
ttgttaataaaagtacatg

SEQ ID NO: 4981848 - DNA, 21 bp, Homo sapiens
ttgttaataaaagtacatgtt

SEQ ID NO: 4981849 - DNA, 13 bp, Homo sapiens
tttattgcttgtt

SEQ ID NO: 4981850 - DNA, 16 bp, Homo sapiens
tttcagatataaaaga

SEQ ID NO: 4981851 - DNA, 23 bp, Homo sapiens
tttcagcacctacagtgtacagt

SEQ ID NO: 4981852 - DNA, 21 bp, Homo sapiens
tttctttagtttttgtgaagt

SEQ ID NO: 4981853 - DNA, 21 bp, Homo sapiens
tttgctgtagaagatggcact

SEQ ID NO: 4981854 - DNA, 15 bp, Homo sapiens
ttttcagatataaaa

SEQ ID NO: 4981855 - DNA, 17 bp, Homo sapiens
ttttcagatataaaaga

SEQ ID NO: 4981856 - DNA, 14 bp, Homo sapiens
ttttcagttttcag

SEQ ID NO: 4981857 - DNA, 14 bp, Homo sapiens
gtgtgtaatttaaa

SEQ ID NO: 4981858 - DNA, 13 bp, Homo sapiens
gtgtgtgtatgtg

SEQ ID NO: 4981859 - DNA, 17 bp, Homo sapiens
gtgtgtgttgtgtgtgg

SEQ ID NO: 4981860 - DNA, 15 bp, Homo sapiens
gtgttgtgtgtggga

SEQ ID NO: 4981861 - DNA, 16 bp, Homo sapiens
gtgtttatgtgtgtgt

SEQ ID NO: 4981862 - DNA, 17 bp, Homo sapiens
gttatgggatgtaaaca

SEQ ID NO: 4981863 - DNA, 19 bp, Homo sapiens
gttcaagccattctgcctc

SEQ ID NO: 4981864 - DNA, 21 bp, Homo sapiens
gttcaagccattctgcctcag

SEQ ID NO: 4981865 - DNA, 18 bp, Homo sapiens
gttcactcttggagcctg

SEQ ID NO: 4981866 - DNA, 15 bp, Homo sapiens
gttctctttaaaata

SEQ ID NO: 4981867 - DNA, 14 bp, Homo sapiens
gttgggagaatgtc

SEQ ID NO: 4981868 - DNA, 12 bp, Homo sapiens
gttgtgtgtggg

SEQ ID NO: 4981869 - DNA, 22 bp, Homo sapiens
gttgtgtgtgggagtgtgtaat

SEQ ID NO: 4981870 - DNA, 22 bp, Homo sapiens
gtttaaaactcagaatataaca

SEQ ID NO: 4981871 - DNA, 17 bp, Homo sapiens
gtttacatatctgtccc

SEQ ID NO: 4981872 - DNA, 16 bp, Homo sapiens
gtttatgtgtgtgtgt

SEQ ID NO: 4981873 - DNA, 22 bp, Homo sapiens
taaaactcagaatataacatgt

SEQ ID NO: 4981874 - DNA, 17 bp, Homo sapiens
taaaagataaatattat

SEQ ID NO: 4981875 - DNA, 16 bp, Homo sapiens
taaaattgtgatgtgt

SEQ ID NO: 4981876 - DNA, 18 bp, Homo sapiens
taaacaagtaagaaaaat

SEQ ID NO: 4981877 - DNA, 13 bp, Homo sapiens
taaatttatgtga

SEQ ID NO: 4981878 - DNA, 15 bp, Homo sapiens
taacaagaggggaaa

SEQ ID NO: 4981879 - DNA, 12 bp, Homo sapiens
taacatgtaaaa

SEQ ID NO: 4981880 - DNA, 13 bp, Homo sapiens
taacatgtaaaat

SEQ ID NO: 4981881 - DNA, 20 bp, Homo sapiens
taacctcgggtgatccaccc

SEQ ID NO: 4981882 - DNA, 22 bp, Homo sapiens
taacttaaaagaacatgtatat

SEQ ID NO: 4981883 - DNA, 15 bp, Homo sapiens
taagaatatttgaat

SEQ ID NO: 4981884 - DNA, 18 bp, Homo sapiens
taagaatatttgaatgta

SEQ ID NO: 4981885 - DNA, 15 bp, Homo sapiens
taatgaaacttggat

SEQ ID NO: 4981886 - DNA, 17 bp, Homo sapiens
taatgatcaaaacatgc

SEQ ID NO: 4981887 - DNA, 14 bp, Homo sapiens
taatgtctttgagc

SEQ ID NO: 4981888 - DNA, 19 bp, Homo sapiens
taattctttgacctgttgg

SEQ ID NO: 4981889 - DNA, 19 bp, Homo sapiens
taatttaaaattgtgatgt

SEQ ID NO: 4981890 - DNA, 22 bp, Homo sapiens
taatttacacacttgcatgaat

SEQ ID NO: 4981891 - DNA, 17 bp, Homo sapiens
taattttatttataaac

SEQ ID NO: 4981892 - DNA, 22 bp, Homo sapiens
tacattctaatttgcattgtgt

SEQ ID NO: 4981893 - DNA, 15 bp, Homo sapiens
tactagctgtgcaac

SEQ ID NO: 4981894 - DNA, 15 bp, Homo sapiens
tactgttataattat

SEQ ID NO: 4981895 - DNA, 22 bp, Homo sapiens
tactgttataattattccttct

SEQ ID NO: 4981896 - DNA, 15 bp, Homo sapiens
tactttctctctcct

SEQ ID NO: 4981897 - DNA, 18 bp, Homo sapiens
tagccaccgcctcctaca

SEQ ID NO: 4981898 - DNA, 18 bp, Homo sapiens
taggaactgctgggcttg

SEQ ID NO: 4981899 - DNA, 19 bp, Homo sapiens
taggattacaggcatgagc

SEQ ID NO: 4981900 - DNA, 16 bp, Homo sapiens
tagggaaataataggg

SEQ ID NO: 4981901 - DNA, 22 bp, Homo sapiens
tataaacatgcttgcattatat

SEQ ID NO: 4981902 - DNA, 14 bp, Homo sapiens
tatcagcacgtgtg

SEQ ID NO: 4981903 - DNA, 16 bp, Homo sapiens
tatccgaactactgtt

SEQ ID NO: 4981904 - DNA, 12 bp, Homo sapiens
tatgcttcatac

SEQ ID NO: 4981905 - DNA, 13 bp, Homo sapiens
tatgcttcataca

SEQ ID NO: 4981906 - DNA, 14 bp, Homo sapiens
tatgcttcatacag

SEQ ID NO: 4981907 - DNA, 23 bp, Homo sapiens
tatgggatgtaaacaatgtaaag

SEQ ID NO: 4981908 - DNA, 21 bp, Homo sapiens
tatggtaggaactgctgggct

SEQ ID NO: 4981909 - DNA, 12 bp, Homo sapiens
tatgtggaagtg

SEQ ID NO: 4981910 - DNA, 19 bp, Homo sapiens
tatgtgggggtctgtgtgt

SEQ ID NO: 4981911 - DNA, 22 bp, Homo sapiens
tattagtaggttttttttattt

SEQ ID NO: 4981912 - DNA, 15 bp, Homo sapiens
tattgatgttaacaa

SEQ ID NO: 4981913 - DNA, 23 bp, Homo sapiens
tattgatgttaacaagaggggaa

SEQ ID NO: 4981914 - DNA, 22 bp, Homo sapiens
tatttgaatgtatgcttcatac

SEQ ID NO: 4981915 - DNA, 15 bp, Homo sapiens
tcaaaaaacttgtaa

SEQ ID NO: 4981916 - DNA, 17 bp, Homo sapiens
tcaagccattctgcctc

SEQ ID NO: 4981917 - DNA, 18 bp, Homo sapiens
tcaagccattctgcctca

SEQ ID NO: 4981918 - DNA, 16 bp, Homo sapiens
tcacctccatccccct

SEQ ID NO: 4981919 - DNA, 14 bp, Homo sapiens
tcactcttggagcc

SEQ ID NO: 4981920 - DNA, 18 bp, Homo sapiens
tcactcttggagcctgca

SEQ ID NO: 4981921 - DNA, 18 bp, Homo sapiens
tcactgcaacctctgcct

SEQ ID NO: 4981922 - DNA, 21 bp, Homo sapiens
tcactgcaacctctgcctccc

SEQ ID NO: 4981923 - DNA, 17 bp, Homo sapiens
tcagatttgccttattg

SEQ ID NO: 4981924 - DNA, 22 bp, Homo sapiens
tcagcccaaaccaccagaagcc

SEQ ID NO: 4981925 - DNA, 14 bp, Homo sapiens
tcaggcccaaagcc

SEQ ID NO: 4981926 - DNA, 14 bp, Homo sapiens
tcagtatgtggaag

SEQ ID NO: 4981927 - DNA, 22 bp, Homo sapiens
tcagtctttaatctgagaggcc

SEQ ID NO: 4981928 - DNA, 14 bp, Homo sapiens
tcagttctcttcac

SEQ ID NO: 4981929 - DNA, 16 bp, Homo sapiens
tcataaatttatggtt

SEQ ID NO: 4981930 - DNA, 22 bp, Homo sapiens
tcatgatagaaggctatgggga

SEQ ID NO: 4981931 - DNA, 15 bp, Homo sapiens
tcattgcactgatct

SEQ ID NO: 4981932 - DNA, 19 bp, Homo sapiens
tcatttcactaagctcctc

SEQ ID NO: 4981933 - DNA, 20 bp, Homo sapiens
tcatttcactaagctcctcc

SEQ ID NO: 4981934 - DNA, 17 bp, Homo sapiens
tccaaagccaatgtgaa

SEQ ID NO: 4981935 - DNA, 20 bp, Homo sapiens
tccaaagttcttatctctag

SEQ ID NO: 4981936 - DNA, 16 bp, Homo sapiens
tccaagctttgggttg

SEQ ID NO: 4981937 - DNA, 22 bp, Homo sapiens
tccaatcccatctattctctgc

SEQ ID NO: 4981938 - DNA, 18 bp, Homo sapiens
tccactcctcctagccac

SEQ ID NO: 4981939 - DNA, 17 bp, Homo sapiens
tccacttccccacactt

SEQ ID NO: 4981940 - DNA, 14 bp, Homo sapiens
tccagcaccacact

SEQ ID NO: 4981941 - DNA, 20 bp, Homo sapiens
tccagccctgagttcctagc

SEQ ID NO: 4981942 - DNA, 16 bp, Homo sapiens
tccaggccagggggcc

SEQ ID NO: 4981943 - DNA, 20 bp, Homo sapiens
tcccaaagtgctgggattac

SEQ ID NO: 4981944 - DNA, 21 bp, Homo sapiens
tcccaaagtgctgggattaca

SEQ ID NO: 4981945 - DNA, 20 bp, Homo sapiens
tcccaaagtgttaggattac

SEQ ID NO: 4981946 - DNA, 21 bp, Homo sapiens
tcccaaagtgttaggattaca

SEQ ID NO: 4981947 - DNA, 19 bp, Homo sapiens
tcccatctattctctgcct

SEQ ID NO: 4981948 - DNA, 23 bp, Homo sapiens
tccctctactgggagcctaccca

SEQ ID NO: 4981949 - DNA, 22 bp, Homo sapiens
tccctgaggcaggtccccagac

SEQ ID NO: 4981950 - DNA, 17 bp, Homo sapiens
tccgcctgcctctgcct

SEQ ID NO: 4981951 - DNA, 20 bp, Homo sapiens
tcctaataatcattggattc

SEQ ID NO: 4981952 - DNA, 18 bp, Homo sapiens
tcctaccttggtcctgcc

SEQ ID NO: 4981953 - DNA, 21 bp, Homo sapiens
tcctagccaccgcctcctaca

SEQ ID NO: 4981954 - DNA, 16 bp, Homo sapiens
tcctcattataaaatg

SEQ ID NO: 4981955 - DNA, 14 bp, Homo sapiens
tcctccaagaattt

SEQ ID NO: 4981956 - DNA, 19 bp, Homo sapiens
tcctgtccctcatccatag

SEQ ID NO: 4981957 - DNA, 16 bp, Homo sapiens
tccttctcctcttgta

SEQ ID NO: 4981958 - DNA, 21 bp, Homo sapiens
tcctttactttctctctcctc

SEQ ID NO: 4981959 - DNA, 12 bp, Homo sapiens
tcgacacagagt

SEQ ID NO: 4981960 - DNA, 17 bp, Homo sapiens
tctaatttgcattgtgt

SEQ ID NO: 4981961 - DNA, 15 bp, Homo sapiens
tctattctctgcctt

SEQ ID NO: 4981962 - DNA, 21 bp, Homo sapiens
tctcactctgtcacccaggct

SEQ ID NO: 4981963 - DNA, 17 bp, Homo sapiens
tctccaacaagttgcct

SEQ ID NO: 4981964 - DNA, 15 bp, Homo sapiens
tctcgatatcctgat

SEQ ID NO: 4981965 - DNA, 16 bp, Homo sapiens
tctctgcctttactat

SEQ ID NO: 4981966 - DNA, 15 bp, Homo sapiens
tctgcattttaacaa

SEQ ID NO: 4981967 - DNA, 15 bp, Homo sapiens
tctggctgcagagca

SEQ ID NO: 4981968 - DNA, 16 bp, Homo sapiens
tctgggccccaggcac

SEQ ID NO: 4981969 - DNA, 14 bp, Homo sapiens
tctgtctgccctca

SEQ ID NO: 4981970 - DNA, 17 bp, Homo sapiens
tctgtgaacttccctac

SEQ ID NO: 4981971 - DNA, 16 bp, Homo sapiens
tctgtgtgtttatgtg

SEQ ID NO: 4981972 - DNA, 14 bp, Homo sapiens
tcttactctactgc

SEQ ID NO: 4981973 - DNA, 13 bp, Homo sapiens
ttattttaaaaga

SEQ ID NO: 4981974 - DNA, 18 bp, Homo sapiens
ttcaagccattctgcctc

SEQ ID NO: 4981975 - DNA, 14 bp, Homo sapiens
ttcaccagaagtta

SEQ ID NO: 4981976 - DNA, 14 bp, Homo sapiens
ttcactaagctcct

SEQ ID NO: 4981977 - DNA, 13 bp, Homo sapiens
ttcagcttgggga

SEQ ID NO: 4981978 - DNA, 21 bp, Homo sapiens
ttccactcctcctagccaccc

SEQ ID NO: 4981979 - DNA, 14 bp, Homo sapiens
ttcccactccttca

SEQ ID NO: 4981980 - DNA, 16 bp, Homo sapiens
ttcctaccttggtcct

SEQ ID NO: 4981981 - DNA, 14 bp, Homo sapiens
ttcctagccaccgc

SEQ ID NO: 4981982 - DNA, 15 bp, Homo sapiens
ttcctagccaccgcc

SEQ ID NO: 4981983 - DNA, 14 bp, Homo sapiens
ttcctttgatctcg

SEQ ID NO: 4981984 - DNA, 12 bp, Homo sapiens
ttctcctttaaa

SEQ ID NO: 4981985 - DNA, 19 bp, Homo sapiens
ttctctttaaaatatttgt

SEQ ID NO: 4981986 - DNA, 19 bp, Homo sapiens
ttctgagagctgtgcatca

SEQ ID NO: 4981987 - DNA, 16 bp, Homo sapiens
ttcttatctctagctc

SEQ ID NO: 4981988 - DNA, 21 bp, Homo sapiens
ttctttcctaccttggtcctg

SEQ ID NO: 4981989 - DNA, 16 bp, Homo sapiens
ttgaactgagcttgga

SEQ ID NO: 4981990 - DNA, 18 bp, Homo sapiens
ttgaatgtatgcttcata

SEQ ID NO: 4981991 - DNA, 17 bp, Homo sapiens
ttgatatgtaagtactt

SEQ ID NO: 4981992 - DNA, 23 bp, Homo sapiens
ttgatgttaacaagaggggaaaa

SEQ ID NO: 4981993 - DNA, 20 bp, Homo sapiens
ttgctatgagctggggatgt

SEQ ID NO: 4981994 - DNA, 14 bp, Homo sapiens
ttgggacccctggt

SEQ ID NO: 4981995 - DNA, 23 bp, Homo sapiens
ttggggacaggggcaggaggaag

SEQ ID NO: 4981996 - DNA, 20 bp, Homo sapiens
ttgggtggggggcttcatac

SEQ ID NO: 4981997 - DNA, 22 bp, Homo sapiens
ttgggtggggggcttcatacac

SEQ ID NO: 4981998 - DNA, 12 bp, Homo sapiens
ttgtgatgtgtc

SEQ ID NO: 4981999 - DNA, 15 bp, Homo sapiens
ttgtttagaagaagt

SEQ ID NO: 4982000 - DNA, 20 bp, Homo sapiens
tttaaaagataaatattata

SEQ ID NO: 4982001 - DNA, 18 bp, Homo sapiens
tttaaaagatgcaatgta

SEQ ID NO: 4982002 - DNA, 14 bp, Homo sapiens
tttaaaatatttgt

SEQ ID NO: 4982003 - DNA, 12 bp, Homo sapiens
tttactttctct

SEQ ID NO: 4982004 - DNA, 23 bp, Homo sapiens
tttatgcaactaactgtttacat

SEQ ID NO: 4982005 - DNA, 11 bp, Homo sapiens
tttatgtgtgt

SEQ ID NO: 4982006 - DNA, 22 bp, Homo sapiens
tttgaatgtatgcttcatacag

SEQ ID NO: 4982007 - DNA, 14 bp, Homo sapiens
tttgacttggaaaa

SEQ ID NO: 4982008 - DNA, 21 bp, Homo sapiens
tttgagacagggtctcactct

SEQ ID NO: 4982009 - DNA, 16 bp, Homo sapiens
tttgccatgttgccca

SEQ ID NO: 4982010 - DNA, 19 bp, Homo sapiens
tttgctatgagctggggat

SEQ ID NO: 4982011 - DNA, 18 bp, Homo sapiens
tttggcaaactctccacc

SEQ ID NO: 4982012 - DNA, 20 bp, Homo sapiens
tttgtcaaggctgactactc

SEQ ID NO: 4982013 - DNA, 14 bp, Homo sapiens
tttgtctttaaaca

SEQ ID NO: 4982014 - DNA, 15 bp, Homo sapiens
tttgtctttaaacag

SEQ ID NO: 4982015 - DNA, 11 bp, Homo sapiens
tttgtggggag

SEQ ID NO: 4982016 - DNA, 20 bp, Homo sapiens
ttttatatgatgggggaaaa

SEQ ID NO: 4982017 - DNA, 20 bp, Homo sapiens
cacctccatccccctctgtc

SEQ ID NO: 4982018 - DNA, 12 bp, Homo sapiens
caccttggcctc

SEQ ID NO: 4982019 - DNA, 18 bp, Homo sapiens
cactctgtcacccaggct

SEQ ID NO: 4982020 - DNA, 16 bp, Homo sapiens
cactcttggagcctgc

SEQ ID NO: 4982021 - DNA, 17 bp, Homo sapiens
cactcttggagcctgca

SEQ ID NO: 4982022 - DNA, 23 bp, Homo sapiens
cactcttggagcctgcagagctg

SEQ ID NO: 4982023 - DNA, 15 bp, Homo sapiens
cactgcaacctctgc

SEQ ID NO: 4982024 - DNA, 12 bp, Homo sapiens
cagaagcccaga

SEQ ID NO: 4982025 - DNA, 15 bp, Homo sapiens
cagaatgaggctgct

SEQ ID NO: 4982026 - DNA, 17 bp, Homo sapiens
cagagcagtgggcctgg

SEQ ID NO: 4982027 - DNA, 20 bp, Homo sapiens
cagagcagtgggcctggcca

SEQ ID NO: 4982028 - DNA, 21 bp, Homo sapiens
cagagctggattcaattcctg

SEQ ID NO: 4982029 - DNA, 17 bp, Homo sapiens
cagagtcctcattataa

SEQ ID NO: 4982030 - DNA, 23 bp, Homo sapiens
cagagtttacattctaatttgca

SEQ ID NO: 4982031 - DNA, 16 bp, Homo sapiens
cagattgggataaggc

SEQ ID NO: 4982032 - DNA, 21 bp, Homo sapiens
cagcaatctgcattttaacaa

SEQ ID NO: 4982033 - DNA, 21 bp, Homo sapiens
cagcccaaaccaccagaagcc

SEQ ID NO: 4982034 - DNA, 19 bp, Homo sapiens
cagcctcccaagtagctgg

SEQ ID NO: 4982035 - DNA, 17 bp, Homo sapiens
cagcctgccactcaggc

SEQ ID NO: 4982036 - DNA, 18 bp, Homo sapiens
cagcggtccaaagttatc

SEQ ID NO: 4982037 - DNA, 16 bp, Homo sapiens
cagctcactgcaacct

SEQ ID NO: 4982038 - DNA, 12 bp, Homo sapiens
caggacccctga

SEQ ID NO: 4982039 - DNA, 14 bp, Homo sapiens
caggacccctgagt

SEQ ID NO: 4982040 - DNA, 15 bp, Homo sapiens
caggaggtggtctgg

SEQ ID NO: 4982041 - DNA, 16 bp, Homo sapiens
caggctgcagtgcaat

SEQ ID NO: 4982042 - DNA, 19 bp, Homo sapiens
cagggataataacagcacc

SEQ ID NO: 4982043 - DNA, 18 bp, Homo sapiens
cagggctgaggcctctca

SEQ ID NO: 4982044 - DNA, 22 bp, Homo sapiens
cagggggccagtccctgaggca

SEQ ID NO: 4982045 - DNA, 21 bp, Homo sapiens
cagggttttgccatgttgccc

SEQ ID NO: 4982046 - DNA, 16 bp, Homo sapiens
caggtagggaaataat

SEQ ID NO: 4982047 - DNA, 15 bp, Homo sapiens
caggtttgggacccc

SEQ ID NO: 4982048 - DNA, 18 bp, Homo sapiens
caggtttgggacccctgg

SEQ ID NO: 4982049 - DNA, 14 bp, Homo sapiens
cagttcagcttggg

SEQ ID NO: 4982050 - DNA, 18 bp, Homo sapiens
cataatcacaacccttca

SEQ ID NO: 4982051 - DNA, 16 bp, Homo sapiens
catacagggatggtgt

SEQ ID NO: 4982052 - DNA, 18 bp, Homo sapiens
catatctgtcccctgcta

SEQ ID NO: 4982053 - DNA, 23 bp, Homo sapiens
catcagttcctttgatctcgctg

SEQ ID NO: 4982054 - DNA, 19 bp, Homo sapiens
catccatggggctgattgt

SEQ ID NO: 4982055 - DNA, 15 bp, Homo sapiens
catccccctctgtct

SEQ ID NO: 4982056 - DNA, 16 bp, Homo sapiens
catctattctctgcct

SEQ ID NO: 4982057 - DNA, 17 bp, Homo sapiens
catctattctctgcctt

SEQ ID NO: 4982058 - DNA, 13 bp, Homo sapiens
catgacaactttt

SEQ ID NO: 4982059 - DNA, 19 bp, Homo sapiens
catgacaacttttaaagaa

SEQ ID NO: 4982060 - DNA, 19 bp, Homo sapiens
catgagttggctgggaata

SEQ ID NO: 4982061 - DNA, 13 bp, Homo sapiens
cattccagaggaa

SEQ ID NO: 4982062 - DNA, 14 bp, Homo sapiens
cattccagaggaag

SEQ ID NO: 4982063 - DNA, 15 bp, Homo sapiens
cattggattctgaga

SEQ ID NO: 4982064 - DNA, 19 bp, Homo sapiens
cattgtccctgaagagaag

SEQ ID NO: 4982065 - DNA, 13 bp, Homo sapiens
catttactcttga

SEQ ID NO: 4982066 - DNA, 19 bp, Homo sapiens
catttcactaagctcctcc

SEQ ID NO: 4982067 - DNA, 12 bp, Homo sapiens
ccaagaggctgc

SEQ ID NO: 4982068 - DNA, 13 bp, Homo sapiens
ccaagaggctgca

SEQ ID NO: 4982069 - DNA, 15 bp, Homo sapiens
ccaagaggctgcagc

SEQ ID NO: 4982070 - DNA, 16 bp, Homo sapiens
ccaagaggctgcagcc

SEQ ID NO: 4982071 - DNA, 18 bp, Homo sapiens
ccaagtctctgggcccca

SEQ ID NO: 4982072 - DNA, 22 bp, Homo sapiens
ccaccaagcctggtcagcccaa

SEQ ID NO: 4982073 - DNA, 14 bp, Homo sapiens
ccaccagaagccca

SEQ ID NO: 4982074 - DNA, 16 bp, Homo sapiens
ccaccagaagcccaga

SEQ ID NO: 4982075 - DNA, 15 bp, Homo sapiens
ccaccctccactctc

SEQ ID NO: 4982076 - DNA, 17 bp, Homo sapiens
ccaccgcctcctacagc

SEQ ID NO: 4982077 - DNA, 12 bp, Homo sapiens
ccaccttggcct

SEQ ID NO: 4982078 - DNA, 16 bp, Homo sapiens
ccacttccccacactt

SEQ ID NO: 4982079 - DNA, 12 bp, Homo sapiens
ccagaagcccag

SEQ ID NO: 4982080 - DNA, 13 bp, Homo sapiens
ccagaagcccaga

SEQ ID NO: 4982081 - DNA, 12 bp, Homo sapiens
ccagaccccctg

SEQ ID NO: 4982082 - DNA, 18 bp, Homo sapiens
ccagaccccctggagact

SEQ ID NO: 4982083 - DNA, 17 bp, Homo sapiens
ccagacctcacctccat

SEQ ID NO: 4982084 - DNA, 18 bp, Homo sapiens
ccagactggagtgcagtg

SEQ ID NO: 4982085 - DNA, 15 bp, Homo sapiens
ccagtccctgaggca

SEQ ID NO: 4982086 - DNA, 12 bp, Homo sapiens
ccattctgcctc

SEQ ID NO: 4982087 - DNA, 19 bp, Homo sapiens
cccaaaacaccgggttcca

SEQ ID NO: 4982088 - DNA, 21 bp, Homo sapiens
cccacaggaggtggtctggga

SEQ ID NO: 4982089 - DNA, 15 bp, Homo sapiens
cccaccttggcctcc

SEQ ID NO: 4982090 - DNA, 15 bp, Homo sapiens
cccactgcgcacagc

SEQ ID NO: 4982091 - DNA, 16 bp, Homo sapiens
cccatctattctctgc

SEQ ID NO: 4982092 - DNA, 22 bp, Homo sapiens
ccccacaacacaagcaccccag

SEQ ID NO: 4982093 - DNA, 23 bp, Homo sapiens
ccccacaggaggtggtctgggac

SEQ ID NO: 4982094 - DNA, 21 bp, Homo sapiens
ccccagactccaccaagcctg

SEQ ID NO: 4982095 - DNA, 12 bp, Homo sapiens
ccccctctgtct

SEQ ID NO: 4982096 - DNA, 11 bp, Homo sapiens
cccctggcttg

SEQ ID NO: 4982097 - DNA, 17 bp, Homo sapiens
ccctaccctacccccac

SEQ ID NO: 4982098 - DNA, 23 bp, Homo sapiens
ccctcccaacagagctgggctac

SEQ ID NO: 4982099 - DNA, 20 bp, Homo sapiens
ccctctactgggagcctacc

SEQ ID NO: 4982100 - DNA, 16 bp, Homo sapiens
ccctctgtctgccctc

SEQ ID NO: 4982101 - DNA, 17 bp, Homo sapiens
ccctgaggcaggtcccc

SEQ ID NO: 4982102 - DNA, 21 bp, Homo sapiens
ccctgaggcaggtccccagac

SEQ ID NO: 4982103 - DNA, 13 bp, Homo sapiens
ccctgccagaccc

SEQ ID NO: 4982104 - DNA, 16 bp, Homo sapiens
ccgcctgcctctgcct

SEQ ID NO: 4982105 - DNA, 22 bp, Homo sapiens
ccgcctgcctctgcctcccaaa

SEQ ID NO: 4982106 - DNA, 22 bp, Homo sapiens
ccgggtcatctgtacctctgcc

SEQ ID NO: 4982107 - DNA, 15 bp, Homo sapiens
cctaataaagagact

SEQ ID NO: 4982108 - DNA, 14 bp, Homo sapiens
cctacccccacaac

SEQ ID NO: 4982109 - DNA, 13 bp, Homo sapiens
cctcattataaaa

SEQ ID NO: 4982110 - DNA, 17 bp, Homo sapiens
cctccacttccccacac

SEQ ID NO: 4982111 - DNA, 18 bp, Homo sapiens
cctccatccccctctgtc

SEQ ID NO: 4982112 - DNA, 14 bp, Homo sapiens
cctctactgggagc

SEQ ID NO: 4982113 - DNA, 15 bp, Homo sapiens
cctcttccaggcccc

SEQ ID NO: 4982114 - DNA, 13 bp, Homo sapiens
cctcttgtagcca

SEQ ID NO: 4982115 - DNA, 19 bp, Homo sapiens
cctgaggaagagggactgt

SEQ ID NO: 4982116 - DNA, 22 bp, Homo sapiens
cctgagtaaaaaagctgtgtgc

SEQ ID NO: 4982117 - DNA, 20 bp, Homo sapiens
cctgagttcctagccaccgc

SEQ ID NO: 4982118 - DNA, 17 bp, Homo sapiens
cctgcaccgccccttct

SEQ ID NO: 4982119 - DNA, 17 bp, Homo sapiens
cctgcagagctgcgggc

SEQ ID NO: 4982120 - DNA, 14 bp, Homo sapiens
cctgccagaccccc

SEQ ID NO: 4982121 - DNA, 18 bp, Homo sapiens
cctgccatcatgtttaca

SEQ ID NO: 4982122 - DNA, 14 bp, Homo sapiens
cctgcctctttgag

SEQ ID NO: 4982123 - DNA, 15 bp, Homo sapiens
cctgctgcctaataa

SEQ ID NO: 4982124 - DNA, 17 bp, Homo sapiens
ccttagttttttcatct

SEQ ID NO: 4982125 - DNA, 22 bp, Homo sapiens
ccttcacatttactagctgtgc

SEQ ID NO: 4982126 - DNA, 17 bp, Homo sapiens
ccttccaagagcctgag

SEQ ID NO: 4982127 - DNA, 20 bp, Homo sapiens
ccttctccaacaagttgcct

SEQ ID NO: 4982128 - DNA, 12 bp, Homo sapiens
ccttctcctctt

SEQ ID NO: 4982129 - DNA, 15 bp, Homo sapiens
ccttctcctcttgta

SEQ ID NO: 4982130 - DNA, 21 bp, Homo sapiens
ccttgaaaacaagcctccact

SEQ ID NO: 4982131 - DNA, 23 bp, Homo sapiens
ccttgacaaagtcaagccacatg

SEQ ID NO: 4982132 - DNA, 16 bp, Homo sapiens
cgagacttctctgtga

SEQ ID NO: 4982133 - DNA, 22 bp, Homo sapiens
cgagtgaatttctaaatgttgg

SEQ ID NO: 4982134 - DNA, 20 bp, Homo sapiens
cgatctcggctcactgcaac

SEQ ID NO: 4982135 - DNA, 19 bp, Homo sapiens
cgattcttgtgcctcggcc

SEQ ID NO: 4982136 - DNA, 15 bp, Homo sapiens
cggctggacttggag

SEQ ID NO: 4982137 - DNA, 22 bp, Homo sapiens
cgggtcatctgtacctctgcct

SEQ ID NO: 4982138 - DNA, 13 bp, Homo sapiens
cggtccaaagtta

SEQ ID NO: 4982139 - DNA, 12 bp, Homo sapiens
cgtaggtaaact

SEQ ID NO: 4982140 - DNA, 16 bp, Homo sapiens
ctaaatgttggaatgt

SEQ ID NO: 4982141 - DNA, 22 bp, Homo sapiens
ctaattctttgacctgttggga

SEQ ID NO: 4982142 - DNA, 13 bp, Homo sapiens
ctaatttttttct

SEQ ID NO: 4982143 - DNA, 15 bp, Homo sapiens
ctacactttgctagt

SEQ ID NO: 4982144 - DNA, 20 bp, Homo sapiens
ctacagaagtggaagtgctt

SEQ ID NO: 4982145 - DNA, 16 bp, Homo sapiens
ctacctgcagtgggaa

SEQ ID NO: 4982146 - DNA, 20 bp, Homo sapiens
ctaccttggtcctgcctctt

SEQ ID NO: 4982147 - DNA, 22 bp, Homo sapiens
ctactctggaggtttgtttaga

SEQ ID NO: 4982148 - DNA, 15 bp, Homo sapiens
ctactgggagcctac

SEQ ID NO: 4982149 - DNA, 18 bp, Homo sapiens
ctactgggagcctaccca

SEQ ID NO: 4982150 - DNA, 13 bp, Homo sapiens
ctagcatttcttc

SEQ ID NO: 4982151 - DNA, 19 bp, Homo sapiens
ctagtagctgggattacag

SEQ ID NO: 4982152 - DNA, 15 bp, Homo sapiens
ctagtagttaagaga

SEQ ID NO: 4982153 - DNA, 17 bp, Homo sapiens
ctatctgtttacagtgt

SEQ ID NO: 4982154 - DNA, 21 bp, Homo sapiens
ctatggggatagatgtgtgga

SEQ ID NO: 4982155 - DNA, 13 bp, Homo sapiens
ctattctctgcct

SEQ ID NO: 4982156 - DNA, 23 bp, Homo sapiens
ctcacctccatccccctctgtct

SEQ ID NO: 4982157 - DNA, 19 bp, Homo sapiens
ctcactcccagttccctgg

SEQ ID NO: 4982158 - DNA, 22 bp, Homo sapiens
ctcactcccagttccctggaca

SEQ ID NO: 4982159 - DNA, 20 bp, Homo sapiens
ctcactgcaacctctgcctc

SEQ ID NO: 4982160 - DNA, 22 bp, Homo sapiens
ctcactgctaagaatatttgaa

SEQ ID NO: 4982161 - DNA, 16 bp, Homo sapiens
ctcagctcactgcaac

SEQ ID NO: 4982162 - DNA, 17 bp, Homo sapiens
ctcattccagaggaagg

SEQ ID NO: 4982163 - DNA, 22 bp, Homo sapiens
ctcatttcactaagctcctcct

SEQ ID NO: 4982164 - DNA, 15 bp, Homo sapiens
ctccaatcccatcta

SEQ ID NO: 4982165 - DNA, 18 bp, Homo sapiens
ctccatccccctctgtct

SEQ ID NO: 4982166 - DNA, 20 bp, Homo sapiens
ctccatccccctctgtctgc

SEQ ID NO: 4982167 - DNA, 22 bp, Homo sapiens
ctcccaaagtgctgggattaca

SEQ ID NO: 4982168 - DNA, 22 bp, Homo sapiens
ctcccaaagtgttaggattaca

SEQ ID NO: 4982169 - DNA, 23 bp, Homo sapiens
ctcccagttccctggacagagct

SEQ ID NO: 4982170 - DNA, 17 bp, Homo sapiens
ctcctgctgcctaataa

SEQ ID NO: 4982171 - DNA, 23 bp, Homo sapiens
ctcctttaaattctttcctacct

SEQ ID NO: 4982172 - DNA, 21 bp, Homo sapiens
ctcggcctccctagtagctgg

SEQ ID NO: 4982173 - DNA, 19 bp, Homo sapiens
ctcgtgatccgcctgcctc

SEQ ID NO: 4982174 - DNA, 21 bp, Homo sapiens
ctctactgggagcctacccac

SEQ ID NO: 4982175 - DNA, 13 bp, Homo sapiens
ctctgtctgccct

SEQ ID NO: 4982176 - DNA, 14 bp, Homo sapiens
ctctgtctgccctc

SEQ ID NO: 4982177 - DNA, 15 bp, Homo sapiens
ctcttggagcctgca

SEQ ID NO: 4982178 - DNA, 23 bp, Homo sapiens
ctcttgtagccagaattctggac

SEQ ID NO: 4982179 - DNA, 12 bp, Homo sapiens
ctgagaggccac

SEQ ID NO: 4982180 - DNA, 18 bp, Homo sapiens
ctgagatctctgcaggaa

SEQ ID NO: 4982181 - DNA, 12 bp, Homo sapiens
ctgagcaggtgt

SEQ ID NO: 4982182 - DNA, 20 bp, Homo sapiens
ctgagcttggaagcttctgg

SEQ ID NO: 4982183 - DNA, 21 bp, Homo sapiens
ctgaggtgggagatgtggaaa

SEQ ID NO: 4982184 - DNA, 21 bp, Homo sapiens
ctgagtaaaaaagctgtgtgc

SEQ ID NO: 4982185 - DNA, 15 bp, Homo sapiens
ctgagttcctagcca

SEQ ID NO: 4982186 - DNA, 20 bp, Homo sapiens
ctgatccagccctgagttcc

SEQ ID NO: 4982187 - DNA, 21 bp, Homo sapiens
ctgatcttactctactgctgc

SEQ ID NO: 4982188 - DNA, 13 bp, Homo sapiens
ctgattgtattta

SEQ ID NO: 4982189 - DNA, 13 bp, Homo sapiens
ctgcaacctccac

SEQ ID NO: 4982190 - DNA, 21 bp, Homo sapiens
ctgcagagctgcgggctgggt

SEQ ID NO: 4982191 - DNA, 22 bp, Homo sapiens
ctgcagccaggccactggcccc

SEQ ID NO: 4982192 - DNA, 16 bp, Homo sapiens
ctgccactcaggccca

SEQ ID NO: 4982193 - DNA, 23 bp, Homo sapiens
ctgccactcaggcccaaagcctc

SEQ ID NO: 4982194 - DNA, 11 bp, Homo sapiens
ctgcctaataa

SEQ ID NO: 4982195 - DNA, 13 bp, Homo sapiens
ctgcctcagcctc

SEQ ID NO: 4982196 - DNA, 13 bp, Homo sapiens
ctgcctctgcctc

SEQ ID NO: 4982197 - DNA, 23 bp, Homo sapiens
ctgcctggtcctcacactcaccc

SEQ ID NO: 4982198 - DNA, 22 bp, Homo sapiens
ctgcgggctgggtgtggtctcc

SEQ ID NO: 4982199 - DNA, 17 bp, Homo sapiens
ctgctgcctaataaaga

SEQ ID NO: 4982200 - DNA, 17 bp, Homo sapiens
ctgctttccaaagccaa

SEQ ID NO: 4982201 - DNA, 18 bp, Homo sapiens
ctggacttcctataatac

SEQ ID NO: 4982202 - DNA, 12 bp, Homo sapiens
ctggaggtttgt

SEQ ID NO: 4982203 - DNA, 18 bp, Homo sapiens
ctggcccctgagatctct

SEQ ID NO: 4982204 - DNA, 23 bp, Homo sapiens
ctggccctatgcttccggcctcc

SEQ ID NO: 4982205 - DNA, 18 bp, Homo sapiens
ctgggaataagtgccagg

SEQ ID NO: 4982206 - DNA, 17 bp, Homo sapiens
ctggggatgtctctcat

SEQ ID NO: 4982207 - DNA, 16 bp, Homo sapiens
ctggggattgggcccc

SEQ ID NO: 4982208 - DNA, 18 bp, Homo sapiens
ctggggattgggcccctg

SEQ ID NO: 4982209 - DNA, 22 bp, Homo sapiens
ctggggattgggcccctgccag

SEQ ID NO: 4982210 - DNA, 20 bp, Homo sapiens
ctggtggttcactcttggag

SEQ ID NO: 4982211 - DNA, 21 bp, Homo sapiens
ctgtcacccaggctgcagtgc

SEQ ID NO: 4982212 - DNA, 19 bp, Homo sapiens
ctgtgaggggctctctcat

SEQ ID NO: 4982213 - DNA, 18 bp, Homo sapiens
ctgtgtgtgtgtatgtgg

SEQ ID NO: 4982214 - DNA, 21 bp, Homo sapiens
ctgtgtgtgtgtatgtggggg

SEQ ID NO: 4982215 - DNA, 20 bp, Homo sapiens
ctgtgtgtttatgtgtgtgt

SEQ ID NO: 4982216 - DNA, 14 bp, Homo sapiens
cttaatgtctttga

SEQ ID NO: 4982217 - DNA, 17 bp, Homo sapiens
cttcaaagcttttgtaa

SEQ ID NO: 4982218 - DNA, 23 bp, Homo sapiens
cttcagagtcctcattataaaat

SEQ ID NO: 4982219 - DNA, 12 bp, Homo sapiens
cttcatacaggg

SEQ ID NO: 4982220 - DNA, 22 bp, Homo sapiens
cttcatacagggatggtgttca

SEQ ID NO: 4982221 - DNA, 12 bp, Homo sapiens
cttctctgtgaa

SEQ ID NO: 4982222 - DNA, 20 bp, Homo sapiens
cttctggtgaccttccaaga

SEQ ID NO: 4982223 - DNA, 19 bp, Homo sapiens
cttgaactgagcttggaag

SEQ ID NO: 4982224 - DNA, 20 bp, Homo sapiens
cttgctgccctgtgctcctc

SEQ ID NO: 4982225 - DNA, 17 bp, Homo sapiens
cttggagcctgcagagc

SEQ ID NO: 4982226 - DNA, 18 bp, Homo sapiens
cttggagcctgcagagct

SEQ ID NO: 4982227 - DNA, 20 bp, Homo sapiens
cttggagcctgcagagctgc

SEQ ID NO: 4982228 - DNA, 20 bp, Homo sapiens
ctttccaaagccaatgtgaa

SEQ ID NO: 4982229 - DNA, 23 bp, Homo sapiens
ctttccaaagccaatgtgaacag

SEQ ID NO: 4982230 - DNA, 18 bp, Homo sapiens
ctttccactcctcctagc

SEQ ID NO: 4982231 - DNA, 21 bp, Homo sapiens
ctttccactcctcctagccac

SEQ ID NO: 4982232 - DNA, 23 bp, Homo sapiens
ctttgatgtcaaacgccttgaaa

SEQ ID NO: 4982233 - DNA, 20 bp, Homo sapiens
ctttgggttggagctgttcc

SEQ ID NO: 4982234 - DNA, 16 bp, Homo sapiens
cttttctttctaccaa

SEQ ID NO: 4982235 - DNA, 19 bp, Homo sapiens
gaaaatacctattttatat

SEQ ID NO: 4982236 - DNA, 18 bp, Homo sapiens
gaacccctggctccaggc

SEQ ID NO: 4982237 - DNA, 22 bp, Homo sapiens
gaacccctggctccaggccagg

SEQ ID NO: 4982238 - DNA, 17 bp, Homo sapiens
gaactgctgggcttggc

SEQ ID NO: 4982239 - DNA, 10 bp, Homo sapiens
gaagcccaga

SEQ ID NO: 4982240 - DNA, 18 bp, Homo sapiens
gaagtgtgggtctgtgtg

SEQ ID NO: 4982241 - DNA, 19 bp, Homo sapiens
gaagtgtgggtctgtgtgt

SEQ ID NO: 4982242 - DNA, 21 bp, Homo sapiens
gaagtgtgggtctgtgtgtgt

SEQ ID NO: 4982243 - DNA, 17 bp, Homo sapiens
gaatattgatgttaaca

SEQ ID NO: 4982244 - DNA, 17 bp, Homo sapiens
gaatatttgaatgtatg

SEQ ID NO: 4982245 - DNA, 18 bp, Homo sapiens
gaatgtatgcttcataca

SEQ ID NO: 4982246 - DNA, 19 bp, Homo sapiens
gaatgtcagtatgtggaag

SEQ ID NO: 4982247 - DNA, 16 bp, Homo sapiens
gaattattttaaaaga

SEQ ID NO: 4982248 - DNA, 22 bp, Homo sapiens
gaatttgacctaggcaagtttg

SEQ ID NO: 4982249 - DNA, 21 bp, Homo sapiens
gaattttaaaagatgcaatgt

SEQ ID NO: 4982250 - DNA, 15 bp, Homo sapiens
gacaaagtcaagcca

SEQ ID NO: 4982251 - DNA, 16 bp, Homo sapiens
gacactacatatctaa

SEQ ID NO: 4982252 - DNA, 18 bp, Homo sapiens
gacaggggcaggaggaag

SEQ ID NO: 4982253 - DNA, 15 bp, Homo sapiens
gtatgcttcatacag

SEQ ID NO: 4982254 - DNA, 21 bp, Homo sapiens
gtatgcttcatacagggatgg

SEQ ID NO: 4982255 - DNA, 21 bp, Homo sapiens
gtattttaagagaaaactgca

SEQ ID NO: 4982256 - DNA, 22 bp, Homo sapiens
gtcagcccaaaccaccagaagc

SEQ ID NO: 4982257 - DNA, 21 bp, Homo sapiens
gtcagtatgtggaagtgtggg

SEQ ID NO: 4982258 - DNA, 13 bp, Homo sapiens
gtcagttgtatca

SEQ ID NO: 4982259 - DNA, 20 bp, Homo sapiens
gtcccagaatgcctcctgca

SEQ ID NO: 4982260 - DNA, 18 bp, Homo sapiens
gtccctgaggcaggtccc

SEQ ID NO: 4982261 - DNA, 15 bp, Homo sapiens
gtcctcattataaaa

SEQ ID NO: 4982262 - DNA, 19 bp, Homo sapiens
gtccttcaagattccattt

SEQ ID NO: 4982263 - DNA, 12 bp, Homo sapiens
gtccttctcctc

SEQ ID NO: 4982264 - DNA, 14 bp, Homo sapiens
gtctggctgcagag

SEQ ID NO: 4982265 - DNA, 16 bp, Homo sapiens
gtctgtgtgtgtgtat

SEQ ID NO: 4982266 - DNA, 20 bp, Homo sapiens
gtctgtgtgtgtgtatgtgg

SEQ ID NO: 4982267 - DNA, 11 bp, Homo sapiens
gtctgtgtgtt

SEQ ID NO: 4982268 - DNA, 22 bp, Homo sapiens
gtctttccactcctcctagcca

SEQ ID NO: 4982269 - DNA, 14 bp, Homo sapiens
gtgaatttctaaat

SEQ ID NO: 4982270 - DNA, 19 bp, Homo sapiens
gtgcctcggcctccctagt

SEQ ID NO: 4982271 - DNA, 14 bp, Homo sapiens
gtggaagagggctg

SEQ ID NO: 4982272 - DNA, 17 bp, Homo sapiens
gtggaagagggctgcaa

SEQ ID NO: 4982273 - DNA, 19 bp, Homo sapiens
gtggaagtgtgggtctgtg

SEQ ID NO: 4982274 - DNA, 20 bp, Homo sapiens
gtggaagtgtgggtctgtgt

SEQ ID NO: 4982275 - DNA, 19 bp, Homo sapiens
gtggaattattttaaaaga

SEQ ID NO: 4982276 - DNA, 17 bp, Homo sapiens
gtggctggatctgtgag

SEQ ID NO: 4982277 - DNA, 13 bp, Homo sapiens
gtgggcctggcca

SEQ ID NO: 4982278 - DNA, 15 bp, Homo sapiens
gtggggggcttcata

SEQ ID NO: 4982279 - DNA, 14 bp, Homo sapiens
gtgggggtctgtgt

SEQ ID NO: 4982280 - DNA, 19 bp, Homo sapiens
gtggggtaggttgggagaa

SEQ ID NO: 4982281 - DNA, 17 bp, Homo sapiens
gtggtgtccttctcctc

SEQ ID NO: 4982282 - DNA, 18 bp, Homo sapiens
gtggtgtccttctcctct

SEQ ID NO: 4982283 - DNA, 23 bp, Homo sapiens
gtggttcactcttggagcctgca

SEQ ID NO: 4982284 - DNA, 22 bp, Homo sapiens
gtgtaatttaaaattgtgatgt

SEQ ID NO: 4982285 - DNA, 14 bp, Homo sapiens
gtgtccttctcctc

SEQ ID NO: 4982286 - DNA, 15 bp, Homo sapiens
gtgtgtatgtggggg

SEQ ID NO: 4982287 - DNA, 12 bp, Homo sapiens
gtgtgttgtgtg

SEQ ID NO: 4982288 - DNA, 15 bp, Homo sapiens
gtgtgtttatgtgtg

SEQ ID NO: 4982289 - DNA, 20 bp, Homo sapiens
gttcactcttggagcctgca

SEQ ID NO: 4982290 - DNA, 24 bp, Homo sapiens
gttcactcttggagcctgcagagc

SEQ ID NO: 4982291 - DNA, 12 bp, Homo sapiens
gttcagcttggg

SEQ ID NO: 4982292 - DNA, 16 bp, Homo sapiens
gttcctagccaccgcc

SEQ ID NO: 4982293 - DNA, 14 bp, Homo sapiens
gttgtgtgtgggag

SEQ ID NO: 4982294 - DNA, 13 bp, Homo sapiens
gtttatgtgtgtg

SEQ ID NO: 4982295 - DNA, 22 bp, Homo sapiens
gtttgggacccctggtggttca

SEQ ID NO: 4982296 - DNA, 15 bp, Homo sapiens
taaaaaagctgtgtg

SEQ ID NO: 4982297 - DNA, 12 bp, Homo sapiens
taaaagaattgt

SEQ ID NO: 4982298 - DNA, 16 bp, Homo sapiens
taaaagatgcaatgta

SEQ ID NO: 4982299 - DNA, 15 bp, Homo sapiens
taaaattgtgatgtg

SEQ ID NO: 4982300 - DNA, 15 bp, Homo sapiens
taaacaagtaagaaa

SEQ ID NO: 4982301 - DNA, 18 bp, Homo sapiens
taaacagcaactacagaa

SEQ ID NO: 4982302 - DNA, 15 bp, Homo sapiens
taaactaggtaaaat

SEQ ID NO: 4982303 - DNA, 20 bp, Homo sapiens
taaactctcgagacttctct

SEQ ID NO: 4982304 - DNA, 22 bp, Homo sapiens
taaagctttggacaagtccttg

SEQ ID NO: 4982305 - DNA, 21 bp, Homo sapiens
taacctcgggtgatccaccca

SEQ ID NO: 4982306 - DNA, 13 bp, Homo sapiens
taagatctcagtg

SEQ ID NO: 4982307 - DNA, 23 bp, Homo sapiens
taataatcattggattctgagag

SEQ ID NO: 4982308 - DNA, 21 bp, Homo sapiens
taatcatcagttcctttgatc

SEQ ID NO: 4982309 - DNA, 20 bp, Homo sapiens
taatttaaaattgtgatgtg

SEQ ID NO: 4982310 - DNA, 18 bp, Homo sapiens
taattttatttataaact

SEQ ID NO: 4982311 - DNA, 13 bp, Homo sapiens
tacagcactgtga

SEQ ID NO: 4982312 - DNA, 14 bp, Homo sapiens
tacatatctgtccc

SEQ ID NO: 4982313 - DNA, 22 bp, Homo sapiens
tacatatctgtcccctgctact

SEQ ID NO: 4982314 - DNA, 17 bp, Homo sapiens
tacctattttatatgat

SEQ ID NO: 4982315 - DNA, 13 bp, Homo sapiens
tacctcttggctg

SEQ ID NO: 4982316 - DNA, 18 bp, Homo sapiens
taccttggtcctgcctct

SEQ ID NO: 4982317 - DNA, 21 bp, Homo sapiens
tagacatttgctatgagctgg

SEQ ID NO: 4982318 - DNA, 24 bp, Homo sapiens
tagaggggaaaagagatgatgaaa

SEQ ID NO: 4982319 - DNA, 15 bp, Homo sapiens
tagatcctgagatga

SEQ ID NO: 4982320 - DNA, 11 bp, Homo sapiens
tagatgtgtgg

SEQ ID NO: 4982321 - DNA, 18 bp, Homo sapiens
tagccacccaccacactg

SEQ ID NO: 4982322 - DNA, 15 bp, Homo sapiens
taggaactgctgggc

SEQ ID NO: 4982323 - DNA, 16 bp, Homo sapiens
taggcaagtttgttca

SEQ ID NO: 4982324 - DNA, 17 bp, Homo sapiens
taggtaaactaacctgg

SEQ ID NO: 4982325 - DNA, 15 bp, Homo sapiens
tagtaaatgattcat

SEQ ID NO: 4982326 - DNA, 15 bp, Homo sapiens
tagtaggccttcaat

SEQ ID NO: 4982327 - DNA, 13 bp, Homo sapiens
tataaacttcaga

SEQ ID NO: 4982328 - DNA, 13 bp, Homo sapiens
tataacatgtaaa

SEQ ID NO: 4982329 - DNA, 14 bp, Homo sapiens
tataacatgtaaaa

SEQ ID NO: 4982330 - DNA, 18 bp, Homo sapiens
tatatgttgaccattcca

SEQ ID NO: 4982331 - DNA, 20 bp, Homo sapiens
tatatttgtaaatttatgtg

SEQ ID NO: 4982332 - DNA, 17 bp, Homo sapiens
tatctgtttacagtgtt

SEQ ID NO: 4982333 - DNA, 23 bp, Homo sapiens
tatgagctggggatgtctctcat

SEQ ID NO: 4982334 - DNA, 16 bp, Homo sapiens
tatgcttcatacaggg

SEQ ID NO: 4982335 - DNA, 19 bp, Homo sapiens
tatgggatgtaaacaatgt

SEQ ID NO: 4982336 - DNA, 17 bp, Homo sapiens
tatggggatagatgtgt

SEQ ID NO: 4982337 - DNA, 19 bp, Homo sapiens
tatggggatagatgtgtgg

SEQ ID NO: 4982338 - DNA, 20 bp, Homo sapiens
tatggggatagatgtgtgga

SEQ ID NO: 4982339 - DNA, 16 bp, Homo sapiens
tatgtggaagtgtggg

SEQ ID NO: 4982340 - DNA, 11 bp, Homo sapiens
tatgtgtgtgt

SEQ ID NO: 4982341 - DNA, 14 bp, Homo sapiens
tatgtgtgtgtgtt

SEQ ID NO: 4982342 - DNA, 22 bp, Homo sapiens
tatgtgtgtgtgttgtgtgtgg

SEQ ID NO: 4982343 - DNA, 15 bp, Homo sapiens
tattacagtccttca

SEQ ID NO: 4982344 - DNA, 12 bp, Homo sapiens
tattcccatgag

SEQ ID NO: 4982345 - DNA, 22 bp, Homo sapiens
tatttccctgaaggaaccaaag

SEQ ID NO: 4982346 - DNA, 16 bp, Homo sapiens
tatttgtaaatttatg

SEQ ID NO: 4982347 - DNA, 22 bp, Homo sapiens
tatttgtaaatttatgtgatgg

SEQ ID NO: 4982348 - DNA, 14 bp, Homo sapiens
tcaaaaaacttgta

SEQ ID NO: 4982349 - DNA, 20 bp, Homo sapiens
tcaaagcttttgtaaaataa

SEQ ID NO: 4982350 - DNA, 16 bp, Homo sapiens
tcaataaattttttct

SEQ ID NO: 4982351 - DNA, 13 bp, Homo sapiens
tcacccaggctgc

SEQ ID NO: 4982352 - DNA, 20 bp, Homo sapiens
tcactgcaacctccacctcc

SEQ ID NO: 4982353 - DNA, 17 bp, Homo sapiens
tcactgcaacctctgcc

SEQ ID NO: 4982354 - DNA, 20 bp, Homo sapiens
tcagaatataacatgtaaaa

SEQ ID NO: 4982355 - DNA, 22 bp, Homo sapiens
tcagatttgccttattggcagc

SEQ ID NO: 4982356 - DNA, 9 bp, Homo sapiens
cttcataca

SEQ ID NO: 4982357 - DNA, 15 bp, Homo sapiens
cttccaagagcctga

SEQ ID NO: 4982358 - DNA, 18 bp, Homo sapiens
cttccacaagagtgaatt

SEQ ID NO: 4982359 - DNA, 17 bp, Homo sapiens
cttctacctcttggctg

SEQ ID NO: 4982360 - DNA, 18 bp, Homo sapiens
cttctcctcttgtagcca

SEQ ID NO: 4982361 - DNA, 21 bp, Homo sapiens
cttctggtgaccttccaagag

SEQ ID NO: 4982362 - DNA, 14 bp, Homo sapiens
cttgaaccttcaaa

SEQ ID NO: 4982363 - DNA, 19 bp, Homo sapiens
cttgacaaagtcaagccac

SEQ ID NO: 4982364 - DNA, 16 bp, Homo sapiens
cttgctctgttgccag

SEQ ID NO: 4982365 - DNA, 13 bp, Homo sapiens
cttggagcctgca

SEQ ID NO: 4982366 - DNA, 15 bp, Homo sapiens
cttggagcctgcaga

SEQ ID NO: 4982367 - DNA, 16 bp, Homo sapiens
cttggagcctgcagag

SEQ ID NO: 4982368 - DNA, 15 bp, Homo sapiens
cttggtgtcgtttcc

SEQ ID NO: 4982369 - DNA, 19 bp, Homo sapiens
cttggttccagcctgccac

SEQ ID NO: 4982370 - DNA, 20 bp, Homo sapiens
cttggttccagcctgccact

SEQ ID NO: 4982371 - DNA, 23 bp, Homo sapiens
cttgtgtatattttaatgaatat

SEQ ID NO: 4982372 - DNA, 20 bp, Homo sapiens
ctttacccctcatccaaagt

SEQ ID NO: 4982373 - DNA, 14 bp, Homo sapiens
ctttgacctgttgg

SEQ ID NO: 4982374 - DNA, 22 bp, Homo sapiens
ctttgaggtggaagagggctgc

SEQ ID NO: 4982375 - DNA, 19 bp, Homo sapiens
ctttggctatgagggcctt

SEQ ID NO: 4982376 - DNA, 18 bp, Homo sapiens
cttttcccccagcaccta

SEQ ID NO: 4982377 - DNA, 23 bp, Homo sapiens
cttttgtaaaataaaaccaccaa

SEQ ID NO: 4982378 - DNA, 11 bp, Homo sapiens
gaaacttggat

SEQ ID NO: 4982379 - DNA, 21 bp, Homo sapiens
gaacagcggctggacttggag

SEQ ID NO: 4982380 - DNA, 15 bp, Homo sapiens
gaacatgatttattt

SEQ ID NO: 4982381 - DNA, 23 bp, Homo sapiens
gaaccaaagcgaattttaaaaga

SEQ ID NO: 4982382 - DNA, 15 bp, Homo sapiens
gaactgagcttggaa

SEQ ID NO: 4982383 - DNA, 17 bp, Homo sapiens
gaagagaagggcagggc

SEQ ID NO: 4982384 - DNA, 15 bp, Homo sapiens
gaaggctatggggat

SEQ ID NO: 4982385 - DNA, 10 bp, Homo sapiens
gaagtggaag

SEQ ID NO: 4982386 - DNA, 17 bp, Homo sapiens
gaagtgtgggtctgtgt

SEQ ID NO: 4982387 - DNA, 21 bp, Homo sapiens
gaatgtatgcttcatacaggg

SEQ ID NO: 4982388 - DNA, 15 bp, Homo sapiens
gaattactgtatata

SEQ ID NO: 4982389 - DNA, 18 bp, Homo sapiens
gaattactgtatataaac

SEQ ID NO: 4982390 - DNA, 13 bp, Homo sapiens
gaattattttaaa

SEQ ID NO: 4982391 - DNA, 18 bp, Homo sapiens
gaattattttaaaagata

SEQ ID NO: 4982392 - DNA, 16 bp, Homo sapiens
gaatttctaaatgttg

SEQ ID NO: 4982393 - DNA, 12 bp, Homo sapiens
gaattttaaaag

SEQ ID NO: 4982394 - DNA, 15 bp, Homo sapiens
gaattttaaaagatg

SEQ ID NO: 4982395 - DNA, 19 bp, Homo sapiens
gacaggtttgggacccctg

SEQ ID NO: 4982396 - DNA, 15 bp, Homo sapiens
gacagtatttgtggg

SEQ ID NO: 4982397 - DNA, 15 bp, Homo sapiens
gacatctcaggattt

SEQ ID NO: 4982398 - DNA, 23 bp, Homo sapiens
gaccattccaaagttcttatctc

SEQ ID NO: 4982399 - DNA, 16 bp, Homo sapiens
gaccttccaagagcct

SEQ ID NO: 4982400 - DNA, 17 bp, Homo sapiens
gaccttccaagagcctg

SEQ ID NO: 4982401 - DNA, 15 bp, Homo sapiens
gactatggagctgag

SEQ ID NO: 4982402 - DNA, 14 bp, Homo sapiens
gacttctctgtgaa

SEQ ID NO: 4982403 - DNA, 20 bp, Homo sapiens
gagatgatgaaaatatttaa

SEQ ID NO: 4982404 - DNA, 17 bp, Homo sapiens
gagcagtgggcctggcc

SEQ ID NO: 4982405 - DNA, 15 bp, Homo sapiens
gagcctacccacccc

SEQ ID NO: 4982406 - DNA, 14 bp, Homo sapiens
gagccttgctctgt

SEQ ID NO: 4982407 - DNA, 22 bp, Homo sapiens
gaggacagtatttgtggggagg

SEQ ID NO: 4982408 - DNA, 15 bp, Homo sapiens
gaggatgtctgggcc

SEQ ID NO: 4982409 - DNA, 12 bp, Homo sapiens
gaggcaggtccc

SEQ ID NO: 4982410 - DNA, 20 bp, Homo sapiens
gaggggtggtgtccttctcc

SEQ ID NO: 4982411 - DNA, 17 bp, Homo sapiens
gaggtggaagagggctg

SEQ ID NO: 4982412 - DNA, 18 bp, Homo sapiens
gaggtggaattattttaa

SEQ ID NO: 4982413 - DNA, 14 bp, Homo sapiens
gagtccctgccatc

SEQ ID NO: 4982414 - DNA, 18 bp, Homo sapiens
gagtgaggatgtctgggc

SEQ ID NO: 4982415 - DNA, 21 bp, Homo sapiens
gagtgtgtaatttaaaattgt

SEQ ID NO: 4982416 - DNA, 13 bp, Homo sapiens
gagttcctagcca

SEQ ID NO: 4982417 - DNA, 13 bp, Homo sapiens
gagttggctggga

SEQ ID NO: 4982418 - DNA, 21 bp, Homo sapiens
gataattttatttataaacta

SEQ ID NO: 4982419 - DNA, 15 bp, Homo sapiens
gatatcctgatctcg

SEQ ID NO: 4982420 - DNA, 21 bp, Homo sapiens
gatcaaaacatgcttgaataa

SEQ ID NO: 4982421 - DNA, 20 bp, Homo sapiens
gatccacccaccttggcctc

SEQ ID NO: 4982422 - DNA, 18 bp, Homo sapiens
gatccgcctgcctctgcc

SEQ ID NO: 4982423 - DNA, 12 bp, Homo sapiens
gatctctgcagg

SEQ ID NO: 4982424 - DNA, 23 bp, Homo sapiens
gatctctgcaggaaatggctgtg

SEQ ID NO: 4982425 - DNA, 15 bp, Homo sapiens
gatcttactctactg

SEQ ID NO: 4982426 - DNA, 13 bp, Homo sapiens
gatggaatgatgg

SEQ ID NO: 4982427 - DNA, 20 bp, Homo sapiens
gatggcaaagaaggagagca

SEQ ID NO: 4982428 - DNA, 24 bp, Homo sapiens
gatggtgttcaaaaaacttgtaaa

SEQ ID NO: 4982429 - DNA, 21 bp, Homo sapiens
gattacaggtgtgacccactg

SEQ ID NO: 4982430 - DNA, 13 bp, Homo sapiens
gattctgagagct

SEQ ID NO: 4982431 - DNA, 21 bp, Homo sapiens
gattcttgtgcctcggcctcc

SEQ ID NO: 4982432 - DNA, 23 bp, Homo sapiens
gatttgctcagtgtctggctgca

SEQ ID NO: 4982433 - DNA, 20 bp, Homo sapiens
gcaacctctgcctcccgggt

SEQ ID NO: 4982434 - DNA, 20 bp, Homo sapiens
gcaatggcgcgatctcagct

SEQ ID NO: 4982435 - DNA, 20 bp, Homo sapiens
gcacaccaccacacacagct

SEQ ID NO: 4982436 - DNA, 21 bp, Homo sapiens
gcaccccctggcttgaacctt

SEQ ID NO: 4982437 - DNA, 19 bp, Homo sapiens
gcagacctacctgcagtgg

SEQ ID NO: 4982438 - DNA, 17 bp, Homo sapiens
gcagagctgcgggctgg

SEQ ID NO: 4982439 - DNA, 19 bp, Homo sapiens
gcagattttgcccttgaca

SEQ ID NO: 4982440 - DNA, 18 bp, Homo sapiens
gcaggaaatggctgtgga

SEQ ID NO: 4982441 - DNA, 21 bp, Homo sapiens
gcagtgcaatggcgcgatctc

SEQ ID NO: 4982442 - DNA, 21 bp, Homo sapiens
gcatgaattactgtatataaa

SEQ ID NO: 4982443 - DNA, 18 bp, Homo sapiens
gcatggagatagccccac

SEQ ID NO: 4982444 - DNA, 16 bp, Homo sapiens
gccaccgcctcctaca

SEQ ID NO: 4982445 - DNA, 15 bp, Homo sapiens
gccacgattgcagga

SEQ ID NO: 4982446 - DNA, 17 bp, Homo sapiens
gccagaccccctggaga

SEQ ID NO: 4982447 - DNA, 16 bp, Homo sapiens
gccagactggagtgca

SEQ ID NO: 4982448 - DNA, 14 bp, Homo sapiens
gccaggatggaatg

SEQ ID NO: 4982449 - DNA, 16 bp, Homo sapiens
gccagtccctgaggca

SEQ ID NO: 4982450 - DNA, 22 bp, Homo sapiens
gccagtccctgaggcaggtccc

SEQ ID NO: 4982451 - DNA, 23 bp, Homo sapiens
gccagtggctggatctgtgaggg

SEQ ID NO: 4982452 - DNA, 22 bp, Homo sapiens
gcccaaaccaccagaagcccag

SEQ ID NO: 4982453 - DNA, 18 bp, Homo sapiens
aactgtttacatatctgt

SEQ ID NO: 4982454 - DNA, 14 bp, Homo sapiens
aacttttaaagaaa

SEQ ID NO: 4982455 - DNA, 18 bp, Homo sapiens
aagatctcagtggttaag

SEQ ID NO: 4982456 - DNA, 18 bp, Homo sapiens
aagccaagaggctgcagc

SEQ ID NO: 4982457 - DNA, 22 bp, Homo sapiens
aagccaagaggctgcagccagg

SEQ ID NO: 4982458 - DNA, 15 bp, Homo sapiens
aagcctggtcagccc

SEQ ID NO: 4982459 - DNA, 17 bp, Homo sapiens
aagcctggtcagcccaa

SEQ ID NO: 4982460 - DNA, 23 bp, Homo sapiens
aaggaaccaaagcgaattttaaa

SEQ ID NO: 4982461 - DNA, 17 bp, Homo sapiens
aaggcacaaaattttgt

SEQ ID NO: 4982462 - DNA, 21 bp, Homo sapiens
aaggggtaggattactaggtg

SEQ ID NO: 4982463 - DNA, 18 bp, Homo sapiens
aagtaatctttaaactgg

SEQ ID NO: 4982464 - DNA, 20 bp, Homo sapiens
aagtacttaaacttccacaa

SEQ ID NO: 4982465 - DNA, 18 bp, Homo sapiens
aagtgtgggtctgtgtgt

SEQ ID NO: 4982466 - DNA, 15 bp, Homo sapiens
aataatagggaaaat

SEQ ID NO: 4982467 - DNA, 18 bp, Homo sapiens
aataatagggaaaatacc

SEQ ID NO: 4982468 - DNA, 22 bp, Homo sapiens
aatagggaaaatacctatttta

SEQ ID NO: 4982469 - DNA, 12 bp, Homo sapiens
aatataacatgt

SEQ ID NO: 4982470 - DNA, 21 bp, Homo sapiens
aatattgatgttaacaagagg

SEQ ID NO: 4982471 - DNA, 21 bp, Homo sapiens
aatcccatctattctctgcct

SEQ ID NO: 4982472 - DNA, 22 bp, Homo sapiens
aatcccatctattctctgcctt

SEQ ID NO: 4982473 - DNA, 15 bp, Homo sapiens
aatctatgattccag

SEQ ID NO: 4982474 - DNA, 14 bp, Homo sapiens
aatgaaacttggat

SEQ ID NO: 4982475 - DNA, 22 bp, Homo sapiens
aatgacaggtttgggacccctg

SEQ ID NO: 4982476 - DNA, 14 bp, Homo sapiens
aatgatcaaaacat

SEQ ID NO: 4982477 - DNA, 16 bp, Homo sapiens
aatgcttccaagcatg

SEQ ID NO: 4982478 - DNA, 13 bp, Homo sapiens
aatgtcagtatgt

SEQ ID NO: 4982479 - DNA, 16 bp, Homo sapiens
aatgtcagtatgtgga

SEQ ID NO: 4982480 - DNA, 22 bp, Homo sapiens
aatgtcagtatgtggaagtgtg

SEQ ID NO: 4982481 - DNA, 19 bp, Homo sapiens
aatgtgaacagcggctgga

SEQ ID NO: 4982482 - DNA, 15 bp, Homo sapiens
aattattttaaaaga

SEQ ID NO: 4982483 - DNA, 14 bp, Homo sapiens
aattgtgatgtgtc

SEQ ID NO: 4982484 - DNA, 15 bp, Homo sapiens
aattgtgatgtgtcc

SEQ ID NO: 4982485 - DNA, 17 bp, Homo sapiens
aattttatttataaact

SEQ ID NO: 4982486 - DNA, 18 bp, Homo sapiens
acaagcaccccagacctc

SEQ ID NO: 4982487 - DNA, 13 bp, Homo sapiens
acagcccacctgg

SEQ ID NO: 4982488 - DNA, 21 bp, Homo sapiens
acagcggctggacttggaggt

SEQ ID NO: 4982489 - DNA, 15 bp, Homo sapiens
acaggcgcacaccac

SEQ ID NO: 4982490 - DNA, 19 bp, Homo sapiens
acaggcgcacaccaccaca

SEQ ID NO: 4982491 - DNA, 11 bp, Homo sapiens
acagtgttccg

SEQ ID NO: 4982492 - DNA, 14 bp, Homo sapiens
acatgcttgaataa

SEQ ID NO: 4982493 - DNA, 19 bp, Homo sapiens
acatttactagctgtgcaa

SEQ ID NO: 4982494 - DNA, 20 bp, Homo sapiens
acatttactagctgtgcaac

SEQ ID NO: 4982495 - DNA, 16 bp, Homo sapiens
accaaattagcaggtg

SEQ ID NO: 4982496 - DNA, 20 bp, Homo sapiens
accaagcctggtcagcccaa

SEQ ID NO: 4982497 - DNA, 13 bp, Homo sapiens
accaccagaagcc

SEQ ID NO: 4982498 - DNA, 15 bp, Homo sapiens
accaccagaagccca

SEQ ID NO: 4982499 - DNA, 16 bp, Homo sapiens
accaccagaagcccag

SEQ ID NO: 4982500 - DNA, 17 bp, Homo sapiens
accaccagaagcccaga

SEQ ID NO: 4982501 - DNA, 13 bp, Homo sapiens
accagaagcccag

SEQ ID NO: 4982502 - DNA, 15 bp, Homo sapiens
acccaccttggcctc

SEQ ID NO: 4982503 - DNA, 15 bp, Homo sapiens
acccaggctgcagtg

SEQ ID NO: 4982504 - DNA, 20 bp, Homo sapiens
accccccctcctgctgccta

SEQ ID NO: 4982505 - DNA, 16 bp, Homo sapiens
acccctggtggttcac

SEQ ID NO: 4982506 - DNA, 11 bp, Homo sapiens
accctttctcc

SEQ ID NO: 4982507 - DNA, 13 bp, Homo sapiens
acctcacctccat

SEQ ID NO: 4982508 - DNA, 13 bp, Homo sapiens
acctcctggtggt

SEQ ID NO: 4982509 - DNA, 20 bp, Homo sapiens
acctgcaccgccccttctcc

SEQ ID NO: 4982510 - DNA, 15 bp, Homo sapiens
accttccaagagcct

SEQ ID NO: 4982511 - DNA, 15 bp, Homo sapiens
accttggcctcccaa

SEQ ID NO: 4982512 - DNA, 20 bp, Homo sapiens
actaactgtttacatatctg

SEQ ID NO: 4982513 - DNA, 19 bp, Homo sapiens
actacactttgctagtgaa

SEQ ID NO: 4982514 - DNA, 19 bp, Homo sapiens
actactgttataattattc

SEQ ID NO: 4982515 - DNA, 11 bp, Homo sapiens
actagctgtgc

SEQ ID NO: 4982516 - DNA, 22 bp, Homo sapiens
actcagaatataacatgtaaaa

SEQ ID NO: 4982517 - DNA, 21 bp, Homo sapiens
actcagccctcattggctctt

SEQ ID NO: 4982518 - DNA, 16 bp, Homo sapiens
actcaggcccaaagcc

SEQ ID NO: 4982519 - DNA, 14 bp, Homo sapiens
actcctcctagcca

SEQ ID NO: 4982520 - DNA, 21 bp, Homo sapiens
actctggaggtttgtttagaa

SEQ ID NO: 4982521 - DNA, 16 bp, Homo sapiens
actgagcttagagtat

SEQ ID NO: 4982522 - DNA, 16 bp, Homo sapiens
actgagcttggaagct

SEQ ID NO: 4982523 - DNA, 16 bp, Homo sapiens
actgatccagccctga

SEQ ID NO: 4982524 - DNA, 14 bp, Homo sapiens
actgcaacctctgc

SEQ ID NO: 4982525 - DNA, 14 bp, Homo sapiens
actgtatataaact

SEQ ID NO: 4982526 - DNA, 21 bp, Homo sapiens
actgttataattattccttct

SEQ ID NO: 4982527 - DNA, 22 bp, Homo sapiens
actgttctctttaaaatatttg

SEQ ID NO: 4982528 - DNA, 19 bp, Homo sapiens
actgtttacatatctgtcc

SEQ ID NO: 4982529 - DNA, 19 bp, Homo sapiens
acttccaagtgataatttt

SEQ ID NO: 4982530 - DNA, 20 bp, Homo sapiens
acttccacttgtgtatattt

SEQ ID NO: 4982531 - DNA, 22 bp, Homo sapiens
acttgcatgaattactgtatat

SEQ ID NO: 4982532 - DNA, 13 bp, Homo sapiens
acttgtgtatatt

SEQ ID NO: 4982533 - DNA, 22 bp, Homo sapiens
acttgtgtatattttaatgaat

SEQ ID NO: 4982534 - DNA, 22 bp, Homo sapiens
acttttaaagaaaaatatgata

SEQ ID NO: 4982535 - DNA, 21 bp, Homo sapiens
actttttgcaccttattttct

SEQ ID NO: 4982536 - DNA, 23 bp, Homo sapiens
agaaaaataagctcgagtgaatt

SEQ ID NO: 4982537 - DNA, 20 bp, Homo sapiens
agaaacaccacccatttcta

SEQ ID NO: 4982538 - DNA, 12 bp, Homo sapiens
agaaacttagag

SEQ ID NO: 4982539 - DNA, 13 bp, Homo sapiens
agaatgaggctgc

SEQ ID NO: 4982540 - DNA, 21 bp, Homo sapiens
agacagggtctcactctgtca

SEQ ID NO: 4982541 - DNA, 22 bp, Homo sapiens
agacatctcaggatttcaccag

SEQ ID NO: 4982542 - DNA, 18 bp, Homo sapiens
agacggagccttgctctg

SEQ ID NO: 4982543 - DNA, 12 bp, Homo sapiens
agactccaccaa

SEQ ID NO: 4982544 - DNA, 14 bp, Homo sapiens
agacttatcaacat

SEQ ID NO: 4982545 - DNA, 20 bp, Homo sapiens
agaggacagtatttgtgggg

SEQ ID NO: 4982546 - DNA, 16 bp, Homo sapiens
agaggctgcagccagg

SEQ ID NO: 4982547 - DNA, 18 bp, Homo sapiens
agaggggaaaagagatga

SEQ ID NO: 4982548 - DNA, 14 bp, Homo sapiens
agataaatattata

SEQ ID NO: 4982549 - DNA, 24 bp, Homo sapiens
agatgatacttccaagtgataatt

SEQ ID NO: 4982550 - DNA, 22 bp, Homo sapiens
agatgtggaaaagccaagaggc

SEQ ID NO: 4982551 - DNA, 20 bp, Homo sapiens
agcaccccatagagttgtga

SEQ ID NO: 4982552 - DNA, 17 bp, Homo sapiens
agcagacctacctgcag

SEQ ID NO: 4982553 - DNA, 18 bp, Homo sapiens
agcagtgggcctggccag

SEQ ID NO: 4982554 - DNA, 13 bp, Homo sapiens
agcatctcccagt

SEQ ID NO: 4982555 - DNA, 20 bp, Homo sapiens
agcatttcttccaattatta

SEQ ID NO: 4982556 - DNA, 20 bp, Homo sapiens
agcccaaaccaccagaagcc

SEQ ID NO: 4982557 - DNA, 14 bp, Homo sapiens
agccctgagttcct

SEQ ID NO: 4982558 - DNA, 20 bp, Homo sapiens
agccctgagttcctagccac

SEQ ID NO: 4982559 - DNA, 23 bp, Homo sapiens
agccctgagttcctagccaccgc

SEQ ID NO: 4982560 - DNA, 18 bp, Homo sapiens
agcctccacttccccaca

SEQ ID NO: 4982561 - DNA, 13 bp, Homo sapiens
agcctgcagagct

SEQ ID NO: 4982562 - DNA, 13 bp, Homo sapiens
ccattggtgttga

SEQ ID NO: 4982563 - DNA, 12 bp, Homo sapiens
cccagttccctg

SEQ ID NO: 4982564 - DNA, 22 bp, Homo sapiens
cccccacaacacaagcacccca

SEQ ID NO: 4982565 - DNA, 18 bp, Homo sapiens
ccctactacactttgcta

SEQ ID NO: 4982566 - DNA, 19 bp, Homo sapiens
ccctcattggctcttgaac

SEQ ID NO: 4982567 - DNA, 18 bp, Homo sapiens
ccctgagatctctgcagg

SEQ ID NO: 4982568 - DNA, 20 bp, Homo sapiens
ccctgaggcaggtccccaga

SEQ ID NO: 4982569 - DNA, 21 bp, Homo sapiens
ccctgccagaccccctggaga

SEQ ID NO: 4982570 - DNA, 20 bp, Homo sapiens
ccctgccatcatgtttacag

SEQ ID NO: 4982571 - DNA, 16 bp, Homo sapiens
ccctggctccaggcca

SEQ ID NO: 4982572 - DNA, 23 bp, Homo sapiens
ccctggcttgaaccttcaaagct

SEQ ID NO: 4982573 - DNA, 24 bp, Homo sapiens
ccctgtgccttggtgtgctgtatc

SEQ ID NO: 4982574 - DNA, 14 bp, Homo sapiens
ccgcctgcctctgc

SEQ ID NO: 4982575 - DNA, 15 bp, Homo sapiens
ccgggttccagcacc

SEQ ID NO: 4982576 - DNA, 13 bp, Homo sapiens
cctaataaagaga

SEQ ID NO: 4982577 - DNA, 16 bp, Homo sapiens
cctaccctacccccac

SEQ ID NO: 4982578 - DNA, 21 bp, Homo sapiens
cctactacactttgctagtga

SEQ ID NO: 4982579 - DNA, 13 bp, Homo sapiens
cctagtagctggg

SEQ ID NO: 4982580 - DNA, 14 bp, Homo sapiens
cctcacactcaccc

SEQ ID NO: 4982581 - DNA, 15 bp, Homo sapiens
cctcatccaaagttc

SEQ ID NO: 4982582 - DNA, 23 bp, Homo sapiens
cctccacttccccacacttccca

SEQ ID NO: 4982583 - DNA, 18 bp, Homo sapiens
cctcccaagtagctggga

SEQ ID NO: 4982584 - DNA, 15 bp, Homo sapiens
cctcctagccaccca

SEQ ID NO: 4982585 - DNA, 11 bp, Homo sapiens
cctcctgctgc

SEQ ID NO: 4982586 - DNA, 23 bp, Homo sapiens
cctcctgctgcctaataaagaga

SEQ ID NO: 4982587 - DNA, 15 bp, Homo sapiens
cctcttggctgcctt

SEQ ID NO: 4982588 - DNA, 12 bp, Homo sapiens
cctgcagagctg

SEQ ID NO: 4982589 - DNA, 22 bp, Homo sapiens
cctgccactcaggcccaaagcc

SEQ ID NO: 4982590 - DNA, 23 bp, Homo sapiens
cctgccactcaggcccaaagcct

SEQ ID NO: 4982591 - DNA, 20 bp, Homo sapiens
cctgccatcatgtttacaga

SEQ ID NO: 4982592 - DNA, 16 bp, Homo sapiens
cctgcctctgcctccc

SEQ ID NO: 4982593 - DNA, 22 bp, Homo sapiens
cctgctgcctaataaagagact

SEQ ID NO: 4982594 - DNA, 19 bp, Homo sapiens
cctggagactaaccccacc

SEQ ID NO: 4982595 - DNA, 15 bp, Homo sapiens
cctggctccaggcca

SEQ ID NO: 4982596 - DNA, 17 bp, Homo sapiens
cctggctccaggccagg

SEQ ID NO: 4982597 - DNA, 13 bp, Homo sapiens
cctggtggttcac

SEQ ID NO: 4982598 - DNA, 15 bp, Homo sapiens
ccttccaagagcctg

SEQ ID NO: 4982599 - DNA, 16 bp, Homo sapiens
ccttccaagagcctga

SEQ ID NO: 4982600 - DNA, 21 bp, Homo sapiens
ccttgacaaagtcaagccaca

SEQ ID NO: 4982601 - DNA, 16 bp, Homo sapiens
cgaattttaaaagatg

SEQ ID NO: 4982602 - DNA, 17 bp, Homo sapiens
cgatctcggctcactgc

SEQ ID NO: 4982603 - DNA, 21 bp, Homo sapiens
cgattgcaggagtccctgcca

SEQ ID NO: 4982604 - DNA, 23 bp, Homo sapiens
cgattgcaggagtccctgccatc

SEQ ID NO: 4982605 - DNA, 19 bp, Homo sapiens
cggcctccctagtagctgg

SEQ ID NO: 4982606 - DNA, 20 bp, Homo sapiens
cggctcactgcaacctctgc

SEQ ID NO: 4982607 - DNA, 21 bp, Homo sapiens
cgggttcaagccattctgcct

SEQ ID NO: 4982608 - DNA, 18 bp, Homo sapiens
cgtgatccgcctgcctct

SEQ ID NO: 4982609 - DNA, 13 bp, Homo sapiens
cgtgctacctgca

SEQ ID NO: 4982610 - DNA, 21 bp, Homo sapiens
ctaaactctcgagacttctct

SEQ ID NO: 4982611 - DNA, 14 bp, Homo sapiens
ctaaagctttggac

SEQ ID NO: 4982612 - DNA, 11 bp, Homo sapiens
ctaataaagag

SEQ ID NO: 4982613 - DNA, 21 bp, Homo sapiens
ctaattctttgacctgttggg

SEQ ID NO: 4982614 - DNA, 14 bp, Homo sapiens
ctacagaagtggaa

SEQ ID NO: 4982615 - DNA, 21 bp, Homo sapiens
ctaccccccctcctgctgcct

SEQ ID NO: 4982616 - DNA, 13 bp, Homo sapiens
ctactacagcact

SEQ ID NO: 4982617 - DNA, 14 bp, Homo sapiens
ctactgggagccta

SEQ ID NO: 4982618 - DNA, 20 bp, Homo sapiens
ctactgttataattattcct

SEQ ID NO: 4982619 - DNA, 19 bp, Homo sapiens
ctagatctagaatcagagc

SEQ ID NO: 4982620 - DNA, 21 bp, Homo sapiens
ctagatctagaatcagagctg

SEQ ID NO: 4982621 - DNA, 23 bp, Homo sapiens
ctagctcagacatctactacagc

SEQ ID NO: 4982622 - DNA, 19 bp, Homo sapiens
ctagtgaatttctgaaaga

SEQ ID NO: 4982623 - DNA, 16 bp, Homo sapiens
ctatatgtccatttaa

SEQ ID NO: 4982624 - DNA, 15 bp, Homo sapiens
ctatgagggccttga

SEQ ID NO: 4982625 - DNA, 17 bp, Homo sapiens
ctatgagggccttgagt

SEQ ID NO: 4982626 - DNA, 19 bp, Homo sapiens
ctatggggatagatgtgtg

SEQ ID NO: 4982627 - DNA, 14 bp, Homo sapiens
ctattgtagagcca

SEQ ID NO: 4982628 - DNA, 16 bp, Homo sapiens
ctcactgcaacctcca

SEQ ID NO: 4982629 - DNA, 17 bp, Homo sapiens
ctcactgcaacctccac

SEQ ID NO: 4982630 - DNA, 16 bp, Homo sapiens
ctcagttctcttcact

SEQ ID NO: 4982631 - DNA, 23 bp, Homo sapiens
ctcatgatagaaggctatgggga

SEQ ID NO: 4982632 - DNA, 20 bp, Homo sapiens
ctcattataaaatgggaaga

SEQ ID NO: 4982633 - DNA, 23 bp, Homo sapiens
ctccaagcccagttcagcttggg

SEQ ID NO: 4982634 - DNA, 16 bp, Homo sapiens
ctccatccccctctgt

SEQ ID NO: 4982635 - DNA, 17 bp, Homo sapiens
ctccatccccctctgtc

SEQ ID NO: 4982636 - DNA, 14 bp, Homo sapiens
ctcccaacagagct

SEQ ID NO: 4982637 - DNA, 20 bp, Homo sapiens
ctccctctactgggagccta

SEQ ID NO: 4982638 - DNA, 12 bp, Homo sapiens
ctcctacagccc

SEQ ID NO: 4982639 - DNA, 14 bp, Homo sapiens
ctcctcttccaggc

SEQ ID NO: 4982640 - DNA, 11 bp, Homo sapiens
ctcctcttgta

SEQ ID NO: 4982641 - DNA, 19 bp, Homo sapiens
ctcctttaaattctttcct

SEQ ID NO: 4982642 - DNA, 13 bp, Homo sapiens
ctctactgctgct

SEQ ID NO: 4982643 - DNA, 16 bp, Homo sapiens
ctctagctcagacatc

SEQ ID NO: 4982644 - DNA, 16 bp, Homo sapiens
ctcttgaactgagctt

SEQ ID NO: 4982645 - DNA, 19 bp, Homo sapiens
ctcttgaactgagcttgga

SEQ ID NO: 4982646 - DNA, 14 bp, Homo sapiens
ctcttggagcctgc

SEQ ID NO: 4982647 - DNA, 22 bp, Homo sapiens
ctcttggagcctgcagagctgc

SEQ ID NO: 4982648 - DNA, 13 bp, Homo sapiens
ctctttgatgtca

SEQ ID NO: 4982649 - DNA, 21 bp, Homo sapiens
ctgaagagaagggcagggctg

SEQ ID NO: 4982650 - DNA, 17 bp, Homo sapiens
ctgagatctctgcagga

SEQ ID NO: 4982651 - DNA, 14 bp, Homo sapiens
ctgagcttggaagc

SEQ ID NO: 4982652 - DNA, 21 bp, Homo sapiens
ctgagcttggaagcttctggt

SEQ ID NO: 4982653 - DNA, 18 bp, Homo sapiens
ctgaggaagagggactgt

SEQ ID NO: 4982654 - DNA, 14 bp, Homo sapiens
ctgaggcaggtccc

SEQ ID NO: 4982655 - DNA, 18 bp, Homo sapiens
ctgaggcaggtccccaga

SEQ ID NO: 4982656 - DNA, 16 bp, Homo sapiens
ctgagttcctagccac

SEQ ID NO: 4982657 - DNA, 17 bp, Homo sapiens
ctgagttcctagccacc

SEQ ID NO: 4982658 - DNA, 18 bp, Homo sapiens
ctgagttcctagccaccg

SEQ ID NO: 4982659 - DNA, 19 bp, Homo sapiens
ctgcaacctccacctccgg

SEQ ID NO: 4982660 - DNA, 16 bp, Homo sapiens
ctgcaacctctgcctc

SEQ ID NO: 4982661 - DNA, 20 bp, Homo sapiens
ctgcaacctctgcctcccgg

SEQ ID NO: 4982662 - DNA, 18 bp, Homo sapiens
ctgcagagcagtgggcct

SEQ ID NO: 4982663 - DNA, 21 bp, Homo sapiens
ctgcagagcagtgggcctggc

SEQ ID NO: 4982664 - DNA, 23 bp, Homo sapiens
ctgcagagcagtgggcctggcca

SEQ ID NO: 4982665 - DNA, 12 bp, Homo sapiens
ctgcagagctgc

SEQ ID NO: 4982666 - DNA, 23 bp, Homo sapiens
ctgcagagctgcgggctgggtgt

SEQ ID NO: 4982667 - DNA, 23 bp, Homo sapiens
ctgcagccaggccactggcccct

SEQ ID NO: 4982668 - DNA, 17 bp, Homo sapiens
ctgcaggaaatggctgt

SEQ ID NO: 4982669 - DNA, 16 bp, Homo sapiens
ctgcctaataaagaga

SEQ ID NO: 4982670 - DNA, 15 bp, Homo sapiens
ctgctctgtgcccac

SEQ ID NO: 4982671 - DNA, 22 bp, Homo sapiens
ctgctgcctaataaagagactg

SEQ ID NO: 4982672 - DNA, 14 bp, Homo sapiens
ctggagtgcagtgg

SEQ ID NO: 4982673 - DNA, 21 bp, Homo sapiens
ctggcagtaacctagtgaatt

SEQ ID NO: 4982674 - DNA, 22 bp, Homo sapiens
ctggcccctgagatctctgcag

SEQ ID NO: 4982675 - DNA, 23 bp, Homo sapiens
ctggcccctgagatctctgcagg

SEQ ID NO: 4982676 - DNA, 13 bp, Homo sapiens
ctggccctgtgcc

SEQ ID NO: 4982677 - DNA, 16 bp, Homo sapiens
ctgggagcctacccac

SEQ ID NO: 4982678 - DNA, 23 bp, Homo sapiens
ctgggccccaggcaccccctggc

SEQ ID NO: 4982679 - DNA, 22 bp, Homo sapiens
ctggggatgtctctcatgacca

SEQ ID NO: 4982680 - DNA, 22 bp, Homo sapiens
ctggtgaccttccaagagcctg

SEQ ID NO: 4982681 - DNA, 15 bp, Homo sapiens
ctgtgcattagatat

SEQ ID NO: 4982682 - DNA, 22 bp, Homo sapiens
ctgtgccagaggaaggaaaagg

SEQ ID NO: 4982683 - DNA, 17 bp, Homo sapiens
ctgtgcccaccctccac

SEQ ID NO: 4982684 - DNA, 23 bp, Homo sapiens
ctgtgcccaccctccactctcct

SEQ ID NO: 4982685 - DNA, 16 bp, Homo sapiens
ctgtgccttttgccat

SEQ ID NO: 4982686 - DNA, 14 bp, Homo sapiens
ctgtgtgtgtgtat

SEQ ID NO: 4982687 - DNA, 16 bp, Homo sapiens
ctgtgtgtttatgtgt

SEQ ID NO: 4982688 - DNA, 17 bp, Homo sapiens
ctgtgtgtttatgtgtg

SEQ ID NO: 4982689 - DNA, 18 bp, Homo sapiens
ctgtgtgtttatgtgtgt

SEQ ID NO: 4982690 - DNA, 15 bp, Homo sapiens
ctgtttacagtgttc

SEQ ID NO: 4982691 - DNA, 16 bp, Homo sapiens
cttagttttttcatct

SEQ ID NO: 4982692 - DNA, 18 bp, Homo sapiens
cttattggcagctctact

SEQ ID NO: 4982693 - DNA, 22 bp, Homo sapiens
cttcaaagcttttgtaaaataa

SEQ ID NO: 4982694 - DNA, 17 bp, Homo sapiens
cttcaattagttcccct

SEQ ID NO: 4982695 - DNA, 21 bp, Homo sapiens
aaaacatgcttgaataactga

SEQ ID NO: 4982696 - DNA, 16 bp, Homo sapiens
aaaagagatgatgaaa

SEQ ID NO: 4982697 - DNA, 22 bp, Homo sapiens
aaaagtaatctttaaactggct

SEQ ID NO: 4982698 - DNA, 13 bp, Homo sapiens
aaacaatgtaaag

SEQ ID NO: 4982699 - DNA, 17 bp, Homo sapiens
aaacaccgggttccagc

SEQ ID NO: 4982700 - DNA, 15 bp, Homo sapiens
aaaccaccagaagcc

SEQ ID NO: 4982701 - DNA, 18 bp, Homo sapiens
aaaccaccagaagcccag

SEQ ID NO: 4982702 - DNA, 15 bp, Homo sapiens
aaacttagaggaaaa

SEQ ID NO: 4982703 - DNA, 20 bp, Homo sapiens
aaagagatgatgaaaatatt

SEQ ID NO: 4982704 - DNA, 14 bp, Homo sapiens
aaagataaatatta

SEQ ID NO: 4982705 - DNA, 14 bp, Homo sapiens
aaagatgcaatgta

SEQ ID NO: 4982706 - DNA, 15 bp, Homo sapiens
aaagccaagaggctg

SEQ ID NO: 4982707 - DNA, 14 bp, Homo sapiens
aaagcgaattttaa

SEQ ID NO: 4982708 - DNA, 13 bp, Homo sapiens
aaagtaagacatc

SEQ ID NO: 4982709 - DNA, 13 bp, Homo sapiens
aaataaaggaacc

SEQ ID NO: 4982710 - DNA, 18 bp, Homo sapiens
aaatgttggaatgttatg

SEQ ID NO: 4982711 - DNA, 19 bp, Homo sapiens
aaattctttcctaccttgg

SEQ ID NO: 4982712 - DNA, 12 bp, Homo sapiens
aaatttatgtga

SEQ ID NO: 4982713 - DNA, 16 bp, Homo sapiens
aacaagtaagaaaaat

SEQ ID NO: 4982714 - DNA, 20 bp, Homo sapiens
aacagcggctggacttggag

SEQ ID NO: 4982715 - DNA, 13 bp, Homo sapiens
aaccaccaaagtc

SEQ ID NO: 4982716 - DNA, 17 bp, Homo sapiens
aaccaccagaagcccag

SEQ ID NO: 4982717 - DNA, 19 bp, Homo sapiens
aaccaccagaagcccagaa

SEQ ID NO: 4982718 - DNA, 19 bp, Homo sapiens
aacctctgcctcccgggtt

SEQ ID NO: 4982719 - DNA, 22 bp, Homo sapiens
aacgccttgaaaacaagcctcc

SEQ ID NO: 4982720 - DNA, 18 bp, Homo sapiens
aactaacctggtatttta

SEQ ID NO: 4982721 - DNA, 16 bp, Homo sapiens
aactcagaatataaca

SEQ ID NO: 4982722 - DNA, 19 bp, Homo sapiens
aactgttctctttaaaata

SEQ ID NO: 4982723 - DNA, 21 bp, Homo sapiens
aacttaatgtctttgagcctt

SEQ ID NO: 4982724 - DNA, 14 bp, Homo sapiens
aacttagaggaaaa

SEQ ID NO: 4982725 - DNA, 14 bp, Homo sapiens
aagaaaaatatgat

SEQ ID NO: 4982726 - DNA, 20 bp, Homo sapiens
aagaattgtctttctgtctc

SEQ ID NO: 4982727 - DNA, 18 bp, Homo sapiens
aagagaagggcagggctg

SEQ ID NO: 4982728 - DNA, 14 bp, Homo sapiens
aagaggctgcagcc

SEQ ID NO: 4982729 - DNA, 15 bp, Homo sapiens
aagatgcaatgtaga

SEQ ID NO: 4982730 - DNA, 14 bp, Homo sapiens
aagccattctgcct

SEQ ID NO: 4982731 - DNA, 16 bp, Homo sapiens
aagccattctgcctca

SEQ ID NO: 4982732 - DNA, 22 bp, Homo sapiens
aagccattctgcctcagcctcc

SEQ ID NO: 4982733 - DNA, 18 bp, Homo sapiens
aagcctggtcagcccaaa

SEQ ID NO: 4982734 - DNA, 22 bp, Homo sapiens
aaggaaccaaagcgaattttaa

SEQ ID NO: 4982735 - DNA, 22 bp, Homo sapiens
aaggccctatctgtttacagtg

SEQ ID NO: 4982736 - DNA, 21 bp, Homo sapiens
aagggcacagacactacatat

SEQ ID NO: 4982737 - DNA, 21 bp, Homo sapiens
aagtcactggccagtggctgg

SEQ ID NO: 4982738 - DNA, 20 bp, Homo sapiens
aagtgtgggtctgtgtgtgt

SEQ ID NO: 4982739 - DNA, 17 bp, Homo sapiens
aataagtgccaggatgg

SEQ ID NO: 4982740 - DNA, 14 bp, Homo sapiens
aataatagggaaaa

SEQ ID NO: 4982741 - DNA, 13 bp, Homo sapiens
aataatcattgga

SEQ ID NO: 4982742 - DNA, 21 bp, Homo sapiens
aatatttgaatgtatgcttca

SEQ ID NO: 4982743 - DNA, 20 bp, Homo sapiens
aatcccatctattctctgcc

SEQ ID NO: 4982744 - DNA, 18 bp, Homo sapiens
aatctatgattccaggtg

SEQ ID NO: 4982745 - DNA, 15 bp, Homo sapiens
aatgatcaaaacatg

SEQ ID NO: 4982746 - DNA, 12 bp, Homo sapiens
aatgtagagggg

SEQ ID NO: 4982747 - DNA, 15 bp, Homo sapiens
aatgtatgcttcata

SEQ ID NO: 4982748 - DNA, 17 bp, Homo sapiens
aatgtatgcttcataca

SEQ ID NO: 4982749 - DNA, 18 bp, Homo sapiens
aatgtatgcttcatacag

SEQ ID NO: 4982750 - DNA, 19 bp, Homo sapiens
aattattccttcttactct

SEQ ID NO: 4982751 - DNA, 12 bp, Homo sapiens
aattattttaaa

SEQ ID NO: 4982752 - DNA, 19 bp, Homo sapiens
aatttctgaaagatgagta

SEQ ID NO: 4982753 - DNA, 20 bp, Homo sapiens
aatttgcattgtgtcagaaa

SEQ ID NO: 4982754 - DNA, 20 bp, Homo sapiens
acaaaacacaggttttttca

SEQ ID NO: 4982755 - DNA, 17 bp, Homo sapiens
acaacttttaaagaaaa

SEQ ID NO: 4982756 - DNA, 13 bp, Homo sapiens
acaagagtgaatt

SEQ ID NO: 4982757 - DNA, 14 bp, Homo sapiens
acaagcaccccaga

SEQ ID NO: 4982758 - DNA, 20 bp, Homo sapiens
acacgtaatgaaacttggat

SEQ ID NO: 4982759 - DNA, 16 bp, Homo sapiens
acactcacccaacaat

SEQ ID NO: 4982760 - DNA, 20 bp, Homo sapiens
acacttcccatttactcttg

SEQ ID NO: 4982761 - DNA, 21 bp, Homo sapiens
acagacactcccacttggcat

SEQ ID NO: 4982762 - DNA, 23 bp, Homo sapiens
acagaggacagtatttgtgggga

SEQ ID NO: 4982763 - DNA, 18 bp, Homo sapiens
acagatgatacttccaag

SEQ ID NO: 4982764 - DNA, 12 bp, Homo sapiens
acagcaccccat

SEQ ID NO: 4982765 - DNA, 18 bp, Homo sapiens
acagggtctcactctgtc

SEQ ID NO: 4982766 - DNA, 15 bp, Homo sapiens
acaggtttgggaccc

SEQ ID NO: 4982767 - DNA, 22 bp, Homo sapiens
acattctctaggagaaacttag

SEQ ID NO: 4982768 - DNA, 22 bp, Homo sapiens
accacacgtaatgaaacttgga

SEQ ID NO: 4982769 - DNA, 17 bp, Homo sapiens
accaccacacacagcta

SEQ ID NO: 4982770 - DNA, 18 bp, Homo sapiens
accattccaaagttctta

SEQ ID NO: 4982771 - DNA, 22 bp, Homo sapiens
accattccaaagttcttatctc

SEQ ID NO: 4982772 - DNA, 19 bp, Homo sapiens
acccaggctgcagtgcaat

SEQ ID NO: 4982773 - DNA, 16 bp, Homo sapiens
acccccaggacccctg

SEQ ID NO: 4982774 - DNA, 19 bp, Homo sapiens
acccctggctccaggccag

SEQ ID NO: 4982775 - DNA, 15 bp, Homo sapiens
accctccactctcct

SEQ ID NO: 4982776 - DNA, 23 bp, Homo sapiens
accctccctctactgggagccta

SEQ ID NO: 4982777 - DNA, 23 bp, Homo sapiens
acctccatccccctctgtctgcc

SEQ ID NO: 4982778 - DNA, 18 bp, Homo sapiens
acgtaatgaaacttggat

SEQ ID NO: 4982779 - DNA, 15 bp, Homo sapiens
actacagaagtggaa

SEQ ID NO: 4982780 - DNA, 22 bp, Homo sapiens
actagatctagaatcagagctg

SEQ ID NO: 4982781 - DNA, 20 bp, Homo sapiens
actatatgttgaccattcca

SEQ ID NO: 4982782 - DNA, 23 bp, Homo sapiens
actcagaatataacatgtaaaat

SEQ ID NO: 4982783 - DNA, 17 bp, Homo sapiens
actcagccctcattggc

SEQ ID NO: 4982784 - DNA, 13 bp, Homo sapiens
actcagtctttaa

SEQ ID NO: 4982785 - DNA, 16 bp, Homo sapiens
actcctcctagccacc

SEQ ID NO: 4982786 - DNA, 15 bp, Homo sapiens
actctcgagacttct

SEQ ID NO: 4982787 - DNA, 14 bp, Homo sapiens
actcttggagcctg

SEQ ID NO: 4982788 - DNA, 16 bp, Homo sapiens
actcttggagcctgca

SEQ ID NO: 4982789 - DNA, 22 bp, Homo sapiens
actcttggagcctgcagagctg

SEQ ID NO: 4982790 - DNA, 12 bp, Homo sapiens
actgagcttgga

SEQ ID NO: 4982791 - DNA, 17 bp, Homo sapiens
actgatccagccctgag

SEQ ID NO: 4982792 - DNA, 13 bp, Homo sapiens
actgatcttactc

SEQ ID NO: 4982793 - DNA, 19 bp, Homo sapiens
actgcaacctccacctccg

SEQ ID NO: 4982794 - DNA, 12 bp, Homo sapiens
actgcaacctct

SEQ ID NO: 4982795 - DNA, 16 bp, Homo sapiens
actgctaagaatattt

SEQ ID NO: 4982796 - DNA, 16 bp, Homo sapiens
actgttccctgaggtg

SEQ ID NO: 4982797 - DNA, 15 bp, Homo sapiens
acttagaggaaaagg

SEQ ID NO: 4982798 - DNA, 20 bp, Homo sapiens
acttcagagtcctcattata

SEQ ID NO: 4982799 - DNA, 14 bp, Homo sapiens
acttctcctttaaa

SEQ ID NO: 4982800 - DNA, 13 bp, Homo sapiens
acttctctgtgaa

SEQ ID NO: 4982801 - DNA, 20 bp, Homo sapiens
acttgcatgaattactgtat

SEQ ID NO: 4982802 - DNA, 23 bp, Homo sapiens
acttgtgtatattttaatgaata

SEQ ID NO: 4982803 - DNA, 14 bp, Homo sapiens
actttctctctcct

SEQ ID NO: 4982804 - DNA, 18 bp, Homo sapiens
acttttaaagaaaaatat

SEQ ID NO: 4982805 - DNA, 18 bp, Homo sapiens
agaaacatgaaatgcttc

SEQ ID NO: 4982806 - DNA, 22 bp, Homo sapiens
agaacccctggctccaggccag

SEQ ID NO: 4982807 - DNA, 11 bp, Homo sapiens
agaagcccaga

SEQ ID NO: 4982808 - DNA, 12 bp, Homo sapiens
agaatgaggctg

SEQ ID NO: 4982809 - DNA, 14 bp, Homo sapiens
agaatgaggctgct

SEQ ID NO: 4982810 - DNA, 13 bp, Homo sapiens
agaccccctggag

SEQ ID NO: 4982811 - DNA, 14 bp, Homo sapiens
agaccccctggaga

SEQ ID NO: 4982812 - DNA, 16 bp, Homo sapiens
agacttctctgtgaac

SEQ ID NO: 4982813 - DNA, 16 bp, Homo sapiens
agagcagtgggcctgg

SEQ ID NO: 4982814 - DNA, 10 bp, Homo sapiens
agagctgggc

SEQ ID NO: 4982815 - DNA, 17 bp, Homo sapiens
agagggatgcatggaga

SEQ ID NO: 4982816 - DNA, 22 bp, Homo sapiens
agaggtgtgcaagagagggatg

SEQ ID NO: 4982817 - DNA, 23 bp, Homo sapiens
agaggtgtgcaagagagggatgc

SEQ ID NO: 4982818 - DNA, 17 bp, Homo sapiens
agagtcctcattataaa

SEQ ID NO: 4982819 - DNA, 22 bp, Homo sapiens
agatattaggggggaaagtcat

SEQ ID NO: 4982820 - DNA, 17 bp, Homo sapiens
agatgtggaaaagccaa

SEQ ID NO: 4982821 - DNA, 14 bp, Homo sapiens
agattgggataagg

SEQ ID NO: 4982822 - DNA, 16 bp, Homo sapiens
agcaatctgcatttta

SEQ ID NO: 4982823 - DNA, 21 bp, Homo sapiens
agcaatctgcattttaacaag

SEQ ID NO: 4982824 - DNA, 10 bp, Homo sapiens
agcaccccag

SEQ ID NO: 4982825 - DNA, 23 bp, Homo sapiens
agcactgtgatgctttatgcaac

SEQ ID NO: 4982826 - DNA, 19 bp, Homo sapiens
agcatgacaacttttaaag

SEQ ID NO: 4982827 - DNA, 21 bp, Homo sapiens
agcatgacaacttttaaagaa

SEQ ID NO: 4982828 - DNA, 14 bp, Homo sapiens
agccaagaggctgc

SEQ ID NO: 4982829 - DNA, 14 bp, Homo sapiens
agccattctgcctc

SEQ ID NO: 4982830 - DNA, 15 bp, Homo sapiens
agccattctgcctca

SEQ ID NO: 4982831 - DNA, 17 bp, Homo sapiens
agcccaaaccaccagaa

SEQ ID NO: 4982832 - DNA, 22 bp, Homo sapiens
agcccaaaccaccagaagccca

SEQ ID NO: 4982833 - DNA, 18 bp, Homo sapiens
agcccagttcagcttggg

SEQ ID NO: 4982834 - DNA, 18 bp, Homo sapiens
agccctgagttcctagcc

SEQ ID NO: 4982835 - DNA, 16 bp, Homo sapiens
agcctggtcagcccaa

SEQ ID NO: 4982836 - DNA, 15 bp, Homo sapiens
agccttgctctgttg

SEQ ID NO: 4982837 - DNA, 19 bp, Homo sapiens
agctaattctttgacctgt

SEQ ID NO: 4982838 - DNA, 17 bp, Homo sapiens
agctaattttcatattt

SEQ ID NO: 4982839 - DNA, 14 bp, Homo sapiens
agctgagcaggtgt

SEQ ID NO: 4982840 - DNA, 15 bp, Homo sapiens
agctgcgggctgggt

SEQ ID NO: 4982841 - DNA, 15 bp, Homo sapiens
agctggggatgtctc

SEQ ID NO: 4982842 - DNA, 20 bp, Homo sapiens
agcttagagtatacctccta

SEQ ID NO: 4982843 - DNA, 22 bp, Homo sapiens
agcttctggtgaccttccaaga

SEQ ID NO: 4982844 - DNA, 21 bp, Homo sapiens
agctttggctatgagggcctt

SEQ ID NO: 4982845 - DNA, 20 bp, Homo sapiens
aggaaatggctgtggagtgt

SEQ ID NO: 4982846 - DNA, 22 bp, Homo sapiens
aggagggttgggcgtgctacct

SEQ ID NO: 4982847 - DNA, 21 bp, Homo sapiens
aggagtccctgccatcatgtt

SEQ ID NO: 4982848 - DNA, 13 bp, Homo sapiens
aggatgtctgggc

SEQ ID NO: 4982849 - DNA, 17 bp, Homo sapiens
aggcaccccctggcttg

SEQ ID NO: 4982850 - DNA, 12 bp, Homo sapiens
aggcaggtcccc

SEQ ID NO: 4982851 - DNA, 15 bp, Homo sapiens
aggcaggtccccaga

SEQ ID NO: 4982852 - DNA, 16 bp, Homo sapiens
aggcctgactctcagc

SEQ ID NO: 4982853 - DNA, 21 bp, Homo sapiens
aggctatggggatagatgtgt

SEQ ID NO: 4982854 - DNA, 22 bp, Homo sapiens
aggctatggggatagatgtgtg

SEQ ID NO: 4982855 - DNA, 18 bp, Homo sapiens
aggctgcagccaggccac

SEQ ID NO: 4982856 - DNA, 17 bp, Homo sapiens
aggctgctttccaaagc

SEQ ID NO: 4982857 - DNA, 18 bp, Homo sapiens
aggctgctttccaaagcc

SEQ ID NO: 4982858 - DNA, 14 bp, Homo sapiens
agggatggtgttca

SEQ ID NO: 4982859 - DNA, 13 bp, Homo sapiens
aggggcaggagga

SEQ ID NO: 4982860 - DNA, 18 bp, Homo sapiens
aggggcaggaggaagggg

SEQ ID NO: 4982861 - DNA, 21 bp, Homo sapiens
agggtcttggttccagcctgc

SEQ ID NO: 4982862 - DNA, 17 bp, Homo sapiens
aggtccccagctttggc

SEQ ID NO: 4982863 - DNA, 18 bp, Homo sapiens
aggtccccagctttggct

SEQ ID NO: 4982864 - DNA, 16 bp, Homo sapiens
aggtggaagagggctg

SEQ ID NO: 4982865 - DNA, 16 bp, Homo sapiens
aggtttgggacccctg

SEQ ID NO: 4982866 - DNA, 21 bp, Homo sapiens
aggtttgggacccctggtggt

SEQ ID NO: 4982867 - DNA, 15 bp, Homo sapiens
agtatgtggaagtgt

SEQ ID NO: 4982868 - DNA, 17 bp, Homo sapiens
agtatgtggaagtgtgg

SEQ ID NO: 4982869 - DNA, 14 bp, Homo sapiens
agtatttgtgggga

SEQ ID NO: 4982870 - DNA, 19 bp, Homo sapiens
agtcactaggatgcagatg

SEQ ID NO: 4982871 - DNA, 20 bp, Homo sapiens
agtccttcaagattccattt

SEQ ID NO: 4982872 - DNA, 14 bp, Homo sapiens
agtctccaatccca

SEQ ID NO: 4982873 - DNA, 21 bp, Homo sapiens
agtggaagtgcttgatatgta

SEQ ID NO: 4982874 - DNA, 16 bp, Homo sapiens
agtgtgggtctgtgtg

SEQ ID NO: 4982875 - DNA, 13 bp, Homo sapiens
agttcagcttggg

SEQ ID NO: 4982876 - DNA, 18 bp, Homo sapiens
agttcataaatttatggt

SEQ ID NO: 4982877 - DNA, 20 bp, Homo sapiens
agttctcttcactcaaggat

SEQ ID NO: 4982878 - DNA, 23 bp, Homo sapiens
agttgtatcagcacgtgtggcct

SEQ ID NO: 4982879 - DNA, 16 bp, Homo sapiens
agtttggcaaactctc

SEQ ID NO: 4982880 - DNA, 15 bp, Homo sapiens
ataacagcaccccat

SEQ ID NO: 4982881 - DNA, 15 bp, Homo sapiens
ataacatgtaaaatc

SEQ ID NO: 4982882 - DNA, 17 bp, Homo sapiens
ataataacagcacccca

SEQ ID NO: 4982883 - DNA, 15 bp, Homo sapiens
atacacaatcctcca

SEQ ID NO: 4982884 - DNA, 22 bp, Homo sapiens
atatctaaagctttggacaagt

SEQ ID NO: 4982885 - DNA, 19 bp, Homo sapiens
atattaggggggaaagtca

SEQ ID NO: 4982886 - DNA, 15 bp, Homo sapiens
atattgatgttaaca

SEQ ID NO: 4982887 - DNA, 16 bp, Homo sapiens
atattgatgttaacaa

SEQ ID NO: 4982888 - DNA, 22 bp, Homo sapiens
atatttaaaggccctatctgtt

SEQ ID NO: 4982889 - DNA, 19 bp, Homo sapiens
atatttccctgaaggaacc

SEQ ID NO: 4982890 - DNA, 14 bp, Homo sapiens
atcagcctgtgcca

SEQ ID NO: 4982891 - DNA, 16 bp, Homo sapiens
atcagtgtctttccac

SEQ ID NO: 4982892 - DNA, 21 bp, Homo sapiens
atcatgtcgtaggtaaactaa

SEQ ID NO: 4982893 - DNA, 18 bp, Homo sapiens
atcatgtttacagaggac

SEQ ID NO: 4982894 - DNA, 20 bp, Homo sapiens
atcattatcagcctgtgcca

SEQ ID NO: 4982895 - DNA, 21 bp, Homo sapiens
atcattggattctgagagctg

SEQ ID NO: 4982896 - DNA, 16 bp, Homo sapiens
atccccctctgtctgc

SEQ ID NO: 4982897 - DNA, 20 bp, Homo sapiens
atccccctctgtctgccctc

SEQ ID NO: 4982898 - DNA, 16 bp, Homo sapiens
atctactacagcactg

SEQ ID NO: 4982899 - DNA, 13 bp, Homo sapiens
atctattctctgc

SEQ ID NO: 4982900 - DNA, 21 bp, Homo sapiens
atctcgtgatccgcctgcctc

SEQ ID NO: 4982901 - DNA, 19 bp, Homo sapiens
atctggacttcctataata

SEQ ID NO: 4982902 - DNA, 16 bp, Homo sapiens
atctgtacctctgcct

SEQ ID NO: 4982903 - DNA, 13 bp, Homo sapiens
atctgtcccctgc

SEQ ID NO: 4982904 - DNA, 14 bp, Homo sapiens
atctgtcccctgct

SEQ ID NO: 4982905 - DNA, 21 bp, Homo sapiens
atctgtgaggggctctctcat

SEQ ID NO: 4982906 - DNA, 22 bp, Homo sapiens
atctgtgaggggctctctcatg

SEQ ID NO: 4982907 - DNA, 12 bp, Homo sapiens
atctgtttacag

SEQ ID NO: 4982908 - DNA, 15 bp, Homo sapiens
atctgtttacagtgt

SEQ ID NO: 4982909 - DNA, 12 bp, Homo sapiens
atgaaaatattt

SEQ ID NO: 4982910 - DNA, 13 bp, Homo sapiens
atgaaacttggat

SEQ ID NO: 4982911 - DNA, 21 bp, Homo sapiens
atgaatattgatgttaacaag

SEQ ID NO: 4982912 - DNA, 18 bp, Homo sapiens
atgaattactgtatataa

SEQ ID NO: 4982913 - DNA, 19 bp, Homo sapiens
atgatgaaaatatttaaag

SEQ ID NO: 4982914 - DNA, 15 bp, Homo sapiens
atgattccaggtggc

SEQ ID NO: 4982915 - DNA, 14 bp, Homo sapiens
atgctgctcatcca

SEQ ID NO: 4982916 - DNA, 16 bp, Homo sapiens
atgcttcatacaggga

SEQ ID NO: 4982917 - DNA, 23 bp, Homo sapiens
atgcttcatacagggatggtgtt

SEQ ID NO: 4982918 - DNA, 20 bp, Homo sapiens
atgcttttagttttaaaagt

SEQ ID NO: 4982919 - DNA, 23 bp, Homo sapiens
atggtgacttttgaaaagaggtg

SEQ ID NO: 4982920 - DNA, 18 bp, Homo sapiens
atgtaaacaatgtaaagt

SEQ ID NO: 4982921 - DNA, 16 bp, Homo sapiens
atgtaaagtaagacat

SEQ ID NO: 4982922 - DNA, 17 bp, Homo sapiens
atgtatataaacatgct

SEQ ID NO: 4982923 - DNA, 16 bp, Homo sapiens
atgtatgcttcataca

SEQ ID NO: 4982924 - DNA, 16 bp, Homo sapiens
atgtcgtaggtaaact

SEQ ID NO: 4982925 - DNA, 16 bp, Homo sapiens
atgtgaacagcggctg

SEQ ID NO: 4982926 - DNA, 10 bp, Homo sapiens
atgtgtgtgt

SEQ ID NO: 4982927 - DNA, 17 bp, Homo sapiens
atgttatgggatgtaaa

SEQ ID NO: 4982928 - DNA, 18 bp, Homo sapiens
atgttatgggatgtaaac

SEQ ID NO: 4982929 - DNA, 19 bp, Homo sapiens
atgttatgggatgtaaaca

SEQ ID NO: 4982930 - DNA, 23 bp, Homo sapiens
atgttatgggatgtaaacaatgt

SEQ ID NO: 4982931 - DNA, 17 bp, Homo sapiens
atgtttacagaggacag

SEQ ID NO: 4982932 - DNA, 19 bp, Homo sapiens
atgtttacagaggacagta

SEQ ID NO: 4982933 - DNA, 17 bp, Homo sapiens
attacaggcgcacacca

SEQ ID NO: 4982934 - DNA, 20 bp, Homo sapiens
attactgtatataaactcct

SEQ ID NO: 4982935 - DNA, 22 bp, Homo sapiens
attagatattaggggggaaagt

SEQ ID NO: 4982936 - DNA, 14 bp, Homo sapiens
attattttaaaaga

SEQ ID NO: 4982937 - DNA, 17 bp, Homo sapiens
attcatggcctggggga

SEQ ID NO: 4982938 - DNA, 16 bp, Homo sapiens
attcctgtccttcaca

SEQ ID NO: 4982939 - DNA, 14 bp, Homo sapiens
attctttcctacct

SEQ ID NO: 4982940 - DNA, 23 bp, Homo sapiens
attgcaggagtccctgccatcat

SEQ ID NO: 4982941 - DNA, 15 bp, Homo sapiens
attgggcccctgcca

SEQ ID NO: 4982942 - DNA, 15 bp, Homo sapiens
attgtgatgtgtcct

SEQ ID NO: 4982943 - DNA, 22 bp, Homo sapiens
attgtgtcagaaacatgaaatg

SEQ ID NO: 4982944 - DNA, 20 bp, Homo sapiens
atttaaaggccctatctgtt

SEQ ID NO: 4982945 - DNA, 16 bp, Homo sapiens
atttactagctgtgca

SEQ ID NO: 4982946 - DNA, 17 bp, Homo sapiens
atttccctgaaggaacc

SEQ ID NO: 4982947 - DNA, 17 bp, Homo sapiens
atttgaatgtatgcttc

SEQ ID NO: 4982948 - DNA, 20 bp, Homo sapiens
atttgaatgtatgcttcata

SEQ ID NO: 4982949 - DNA, 19 bp, Homo sapiens
atttgtaaatttatgtgat

SEQ ID NO: 4982950 - DNA, 20 bp, Homo sapiens
attttaaaagataaatatta

SEQ ID NO: 4982951 - DNA, 19 bp, Homo sapiens
attttaatgaatattgatg

SEQ ID NO: 4982952 - DNA, 16 bp, Homo sapiens
caaaccaccagaagcc

SEQ ID NO: 4982953 - DNA, 14 bp, Homo sapiens
caaagcgaatttta

SEQ ID NO: 4982954 - DNA, 17 bp, Homo sapiens
caaagcttttgtaaaat

SEQ ID NO: 4982955 - DNA, 19 bp, Homo sapiens
caaagtgttaggattacag

SEQ ID NO: 4982956 - DNA, 20 bp, Homo sapiens
caaatccttgtgggaaaaga

SEQ ID NO: 4982957 - DNA, 22 bp, Homo sapiens
caaatgagggtcttggttccag

SEQ ID NO: 4982958 - DNA, 23 bp, Homo sapiens
caaattagcaggtgcaccttctg

SEQ ID NO: 4982959 - DNA, 13 bp, Homo sapiens
caacccaagtctc

SEQ ID NO: 4982960 - DNA, 20 bp, Homo sapiens
caagaatttgacttggaaaa

SEQ ID NO: 4982961 - DNA, 16 bp, Homo sapiens
caagaggctgcagcca

SEQ ID NO: 4982962 - DNA, 17 bp, Homo sapiens
caagattccatttctta

SEQ ID NO: 4982963 - DNA, 12 bp, Homo sapiens
caagcaccccag

SEQ ID NO: 4982964 - DNA, 20 bp, Homo sapiens
caagcccagttcagcttggg

SEQ ID NO: 4982965 - DNA, 12 bp, Homo sapiens
caagcctggtca

SEQ ID NO: 4982966 - DNA, 17 bp, Homo sapiens
caagccttggctctacc

SEQ ID NO: 4982967 - DNA, 18 bp, Homo sapiens
caagcgattcttgtgcct

SEQ ID NO: 4982968 - DNA, 20 bp, Homo sapiens
caagcgattcttgtgcctcg

SEQ ID NO: 4982969 - DNA, 16 bp, Homo sapiens
caagtgataattttat

SEQ ID NO: 4982970 - DNA, 19 bp, Homo sapiens
caatgtagaggggaaaaga

SEQ ID NO: 4982971 - DNA, 23 bp, Homo sapiens
caattagttcccctactacactt

SEQ ID NO: 4982972 - DNA, 19 bp, Homo sapiens
cacaagcaccccagacctc

SEQ ID NO: 4982973 - DNA, 15 bp, Homo sapiens
cacatgagataatat

SEQ ID NO: 4982974 - DNA, 14 bp, Homo sapiens
cacatttactagct

SEQ ID NO: 4982975 - DNA, 19 bp, Homo sapiens
caccaagcctggtcagccc

SEQ ID NO: 4982976 - DNA, 22 bp, Homo sapiens
caccaagcctggtcagcccaaa

SEQ ID NO: 4982977 - DNA, 13 bp, Homo sapiens
caccagaagccca

SEQ ID NO: 4982978 - DNA, 17 bp, Homo sapiens
caccagaagcccagaat

SEQ ID NO: 4982979 - DNA, 17 bp, Homo sapiens
caccgcctcctacagcc

SEQ ID NO: 4982980 - DNA, 16 bp, Homo sapiens
cacctcaaatcttcta

SEQ ID NO: 4982981 - DNA, 19 bp, Homo sapiens
cacctccgggttcaagcga

SEQ ID NO: 4982982 - DNA, 11 bp, Homo sapiens
caccttggcct

SEQ ID NO: 4982983 - DNA, 13 bp, Homo sapiens
caccttggcctcc

SEQ ID NO: 4982984 - DNA, 18 bp, Homo sapiens
cactcctcctagccaccc

SEQ ID NO: 4982985 - DNA, 14 bp, Homo sapiens
cactcttggagcct

SEQ ID NO: 4982986 - DNA, 23 bp, Homo sapiens
cactgcaacctccacctccgggt

SEQ ID NO: 4982987 - DNA, 18 bp, Homo sapiens
cactgctaagaatatttg

SEQ ID NO: 4982988 - DNA, 17 bp, Homo sapiens
cacttcccatttactct

SEQ ID NO: 4982989 - DNA, 21 bp, Homo sapiens
cacttcccatttactcttgag

SEQ ID NO: 4982990 - DNA, 12 bp, Homo sapiens
cagaaacatgaa

SEQ ID NO: 4982991 - DNA, 11 bp, Homo sapiens
cagaagcccag

SEQ ID NO: 4982992 - DNA, 15 bp, Homo sapiens
cagaatataacatgt

SEQ ID NO: 4982993 - DNA, 20 bp, Homo sapiens
cagaatataacatgtaaaat

SEQ ID NO: 4982994 - DNA, 15 bp, Homo sapiens
cagaccccctggaga

SEQ ID NO: 4982995 - DNA, 15 bp, Homo sapiens
cagacctcacctcca

SEQ ID NO: 4982996 - DNA, 16 bp, Homo sapiens
cagactggagtgcagt

SEQ ID NO: 4982997 - DNA, 21 bp, Homo sapiens
cagagcagtgggcctggccag

SEQ ID NO: 4982998 - DNA, 22 bp, Homo sapiens
cagaggacagtatttgtgggga

SEQ ID NO: 4982999 - DNA, 17 bp, Homo sapiens
cagagtttacattctaa

SEQ ID NO: 4983000 - DNA, 22 bp, Homo sapiens
cagcacctagagtagtgcttgg

SEQ ID NO: 4983001 - DNA, 21 bp, Homo sapiens
cagcaggtccccagctttggc

SEQ ID NO: 4983002 - DNA, 16 bp, Homo sapiens
cagcccacctggcttt

SEQ ID NO: 4983003 - DNA, 16 bp, Homo sapiens
cagcctgccactcagg

SEQ ID NO: 4983004 - DNA, 16 bp, Homo sapiens
cagcggctggacttgg

SEQ ID NO: 4983005 - DNA, 12 bp, Homo sapiens
cagctcactgca

SEQ ID NO: 4983006 - DNA, 18 bp, Homo sapiens
caggcaccccctggcttg

SEQ ID NO: 4983007 - DNA, 21 bp, Homo sapiens
caggccagggggccagtccct

SEQ ID NO: 4983008 - DNA, 15 bp, Homo sapiens
caggcctgactctca

SEQ ID NO: 4983009 - DNA, 14 bp, Homo sapiens
caggcgtctgccac

SEQ ID NO: 4983010 - DNA, 16 bp, Homo sapiens
caggcgtctgccacca

SEQ ID NO: 4983011 - DNA, 16 bp, Homo sapiens
caggctggtcttgaac

SEQ ID NO: 4983012 - DNA, 23 bp, Homo sapiens
cagggataataacagcaccccat

SEQ ID NO: 4983013 - DNA, 16 bp, Homo sapiens
cagggctgaggcctct

SEQ ID NO: 4983014 - DNA, 14 bp, Homo sapiens
caggggcaggagga

SEQ ID NO: 4983015 - DNA, 12 bp, Homo sapiens
caggtccccaga

SEQ ID NO: 4983016 - DNA, 13 bp, Homo sapiens
caggtccccagac

SEQ ID NO: 4983017 - DNA, 12 bp, Homo sapiens
caggtgttcttc

SEQ ID NO: 4983018 - DNA, 20 bp, Homo sapiens
cagtccctgaggcaggtccc

SEQ ID NO: 4983019 - DNA, 23 bp, Homo sapiens
cagtccctgaggcaggtccccag

SEQ ID NO: 4983020 - DNA, 22 bp, Homo sapiens
cagtgatgcttttagttttaaa

SEQ ID NO: 4983021 - DNA, 16 bp, Homo sapiens
cagtggctggatctgt

SEQ ID NO: 4983022 - DNA, 21 bp, Homo sapiens
cagtgggcctggccagcaggt

SEQ ID NO: 4983023 - DNA, 11 bp, Homo sapiens
cagtggttaag

SEQ ID NO: 4983024 - DNA, 17 bp, Homo sapiens
cagtgtctggctgcaga

SEQ ID NO: 4983025 - DNA, 19 bp, Homo sapiens
cagtgtctggctgcagagc

SEQ ID NO: 4983026 - DNA, 18 bp, Homo sapiens
cagtgttccgtggttaaa

SEQ ID NO: 4983027 - DNA, 21 bp, Homo sapiens
cagttcctttgatctcgctgt

SEQ ID NO: 4983028 - DNA, 16 bp, Homo sapiens
cagttctcttcactca

SEQ ID NO: 4983029 - DNA, 19 bp, Homo sapiens
catacagggatggtgttca

SEQ ID NO: 4983030 - DNA, 21 bp, Homo sapiens
catcatgtttacagaggacag

SEQ ID NO: 4983031 - DNA, 14 bp, Homo sapiens
catccaaagttgcc

SEQ ID NO: 4983032 - DNA, 20 bp, Homo sapiens
catccccctctgtctgccct

SEQ ID NO: 4983033 - DNA, 20 bp, Homo sapiens
catgaattactgtatataaa

SEQ ID NO: 4983034 - DNA, 18 bp, Homo sapiens
catgatttatttgtcctt

SEQ ID NO: 4983035 - DNA, 21 bp, Homo sapiens
cattacctcagtgagaagcca

SEQ ID NO: 4983036 - DNA, 19 bp, Homo sapiens
cattccaaagttcttatct

SEQ ID NO: 4983037 - DNA, 21 bp, Homo sapiens
cattccaaagttcttatctct

SEQ ID NO: 4983038 - DNA, 14 bp, Homo sapiens
cattctaatttgca

SEQ ID NO: 4983039 - DNA, 20 bp, Homo sapiens
cattggattctgagagctgt

SEQ ID NO: 4983040 - DNA, 22 bp, Homo sapiens
cattggctcttgaactgagctt

SEQ ID NO: 4983041 - DNA, 20 bp, Homo sapiens
catttactcttgagactact

SEQ ID NO: 4983042 - DNA, 14 bp, Homo sapiens
ccaaagccaatgtg

SEQ ID NO: 4983043 - DNA, 12 bp, Homo sapiens
ccaagagcctga

SEQ ID NO: 4983044 - DNA, 16 bp, Homo sapiens
ccaagagcctgagagt

SEQ ID NO: 4983045 - DNA, 14 bp, Homo sapiens
ccaagaggctgcag

SEQ ID NO: 4983046 - DNA, 19 bp, Homo sapiens
ccaagcctggtcagcccaa

SEQ ID NO: 4983047 - DNA, 20 bp, Homo sapiens
ccaagcctggtcagcccaaa

SEQ ID NO: 4983048 - DNA, 19 bp, Homo sapiens
ccaagccttggctctaccc

SEQ ID NO: 4983049 - DNA, 16 bp, Homo sapiens
ccacaccctcactgct

SEQ ID NO: 4983050 - DNA, 22 bp, Homo sapiens
ccacacgtaatgaaacttggat

SEQ ID NO: 4983051 - DNA, 22 bp, Homo sapiens
ccacactgatccagccctgagt

SEQ ID NO: 4983052 - DNA, 14 bp, Homo sapiens
ccaccaaagtcctg

SEQ ID NO: 4983053 - DNA, 21 bp, Homo sapiens
ccaccaagcctggtcagccca

SEQ ID NO: 4983054 - DNA, 11 bp, Homo sapiens
ccaccagaagc

SEQ ID NO: 4983055 - DNA, 12 bp, Homo sapiens
ccaccagaagcc

SEQ ID NO: 4983056 - DNA, 18 bp, Homo sapiens
ccaccttggcctcccaaa

SEQ ID NO: 4983057 - DNA, 20 bp, Homo sapiens
ccacgttggccaggatggtc

SEQ ID NO: 4983058 - DNA, 14 bp, Homo sapiens
ccagaagcccagaa

SEQ ID NO: 4983059 - DNA, 15 bp, Homo sapiens
ccagaatgaggctgc

SEQ ID NO: 4983060 - DNA, 18 bp, Homo sapiens
ccagccctgagttcctag

SEQ ID NO: 4983061 - DNA, 10 bp, Homo sapiens
ccagcctgcc

SEQ ID NO: 4983062 - DNA, 20 bp, Homo sapiens
ccaggcaaagtgcacctcaa

SEQ ID NO: 4983063 - DNA, 19 bp, Homo sapiens
ccaggccagggggccagtc

SEQ ID NO: 4983064 - DNA, 13 bp, Homo sapiens
ccaggctgcagtg

SEQ ID NO: 4983065 - DNA, 15 bp, Homo sapiens
ccagttcagcttggg

SEQ ID NO: 4983066 - DNA, 15 bp, Homo sapiens
ccatccccctctgtc

SEQ ID NO: 4983067 - DNA, 21 bp, Homo sapiens
cccaaaacaccgggttccagc

SEQ ID NO: 4983068 - DNA, 22 bp, Homo sapiens
cccaaaccaccagaagcccaga

SEQ ID NO: 4983069 - DNA, 21 bp, Homo sapiens
cccacaacacaagcaccccag

SEQ ID NO: 4983070 - DNA, 16 bp, Homo sapiens
cccagaatgaggctgc

SEQ ID NO: 4983071 - DNA, 17 bp, Homo sapiens
cccagaatgaggctgct

SEQ ID NO: 4983072 - DNA, 18 bp, Homo sapiens
cccagaatgcctcctgca

SEQ ID NO: 4983073 - DNA, 10 bp, Homo sapiens
cccagacctc

SEQ ID NO: 4983074 - DNA, 21 bp, Homo sapiens
cccagctatggttctctcgca

SEQ ID NO: 4983075 - DNA, 16 bp, Homo sapiens
cccaggacccctgagt

SEQ ID NO: 4983076 - DNA, 20 bp, Homo sapiens
cccaggcaccccctggcttg

SEQ ID NO: 4983077 - DNA, 14 bp, Homo sapiens
cccaggctgcagtg

SEQ ID NO: 4983078 - DNA, 20 bp, Homo sapiens
ccccagactccaccaagcct

SEQ ID NO: 4983079 - DNA, 13 bp, Homo sapiens
cccctccacctgc

SEQ ID NO: 4983080 - DNA, 20 bp, Homo sapiens
cccctggctccaggccaggg

SEQ ID NO: 4983081 - DNA, 12 bp, Homo sapiens
cccctggtggtt

SEQ ID NO: 4983082 - DNA, 23 bp, Homo sapiens
ccctccctctactgggagcctac

SEQ ID NO: 4983083 - DNA, 21 bp, Homo sapiens
ccctcctgctgcctaataaag

SEQ ID NO: 4983084 - DNA, 17 bp, Homo sapiens
ccctctactgggagcct

SEQ ID NO: 4983085 - DNA, 13 bp, Homo sapiens
ccctggtggttca

SEQ ID NO: 4983086 - DNA, 13 bp, Homo sapiens
ccgcctgcctctg

SEQ ID NO: 4983087 - DNA, 12 bp, Homo sapiens
ccgggttccagc

SEQ ID NO: 4983088 - DNA, 15 bp, Homo sapiens
cctacagcccacctg

SEQ ID NO: 4983089 - DNA, 16 bp, Homo sapiens
cctaccttggtcctgc

SEQ ID NO: 4983090 - DNA, 16 bp, Homo sapiens
cctagccacccaccac

SEQ ID NO: 4983091 - DNA, 19 bp, Homo sapiens
cctagtagctgggattaca

SEQ ID NO: 4983092 - DNA, 15 bp, Homo sapiens
cctataatacaaata

SEQ ID NO: 4983093 - DNA, 22 bp, Homo sapiens
cctatctgtttacagtgttccg

SEQ ID NO: 4983094 - DNA, 12 bp, Homo sapiens
cctccagaggag

SEQ ID NO: 4983095 - DNA, 18 bp, Homo sapiens
cctcccaaagtgctggga

SEQ ID NO: 4983096 - DNA, 15 bp, Homo sapiens
cctcccaacagagct

SEQ ID NO: 4983097 - DNA, 15 bp, Homo sapiens
cctcggcctccctag

SEQ ID NO: 4983098 - DNA, 18 bp, Homo sapiens
cctctcattccagaggaa

SEQ ID NO: 4983099 - DNA, 13 bp, Homo sapiens
cctctgcctccca

SEQ ID NO: 4983100 - DNA, 14 bp, Homo sapiens
cctgactctcagca

SEQ ID NO: 4983101 - DNA, 12 bp, Homo sapiens
cctgactttctc

SEQ ID NO: 4983102 - DNA, 15 bp, Homo sapiens
cctgaggcaggtccc

SEQ ID NO: 4983103 - DNA, 14 bp, Homo sapiens
cctgagttcctagc

SEQ ID NO: 4983104 - DNA, 21 bp, Homo sapiens
cctgagttcctagccaccgcc

SEQ ID NO: 4983105 - DNA, 13 bp, Homo sapiens
cctgcagagctgc

SEQ ID NO: 4983106 - DNA, 14 bp, Homo sapiens
cctgcagagctgcg

SEQ ID NO: 4983107 - DNA, 14 bp, Homo sapiens
cctgcctctgcctc

SEQ ID NO: 4983108 - DNA, 18 bp, Homo sapiens
cctgcctggtcctcacac

SEQ ID NO: 4983109 - DNA, 15 bp, Homo sapiens
cctggcttgaacctt

SEQ ID NO: 4983110 - DNA, 12 bp, Homo sapiens
cctggtcagccc

SEQ ID NO: 4983111 - DNA, 14 bp, Homo sapiens
cctggtcagcccaa

SEQ ID NO: 4983112 - DNA, 12 bp, Homo sapiens
cctggtggttca

SEQ ID NO: 4983113 - DNA, 22 bp, Homo sapiens
cctggtggttcactcttggagc

SEQ ID NO: 4983114 - DNA, 15 bp, Homo sapiens
ccttcaagattccat

SEQ ID NO: 4983115 - DNA, 15 bp, Homo sapiens
ccttggtcctgcctc

SEQ ID NO: 4983116 - DNA, 13 bp, Homo sapiens
ccttttcccccag

SEQ ID NO: 4983117 - DNA, 14 bp, Homo sapiens
cgagtgaatttcta

SEQ ID NO: 4983118 - DNA, 17 bp, Homo sapiens
cgatctcagctcactgc

SEQ ID NO: 4983119 - DNA, 20 bp, Homo sapiens
cgatctcagctcactgcaac

SEQ ID NO: 4983120 - DNA, 16 bp, Homo sapiens
cgattcttgtgcctcg

SEQ ID NO: 4983121 - DNA, 18 bp, Homo sapiens
cgattcttgtgcctcggc

SEQ ID NO: 4983122 - DNA, 13 bp, Homo sapiens
cgcctgcctctgc

SEQ ID NO: 4983123 - DNA, 15 bp, Homo sapiens
cgggtcatctgtacc

SEQ ID NO: 4983124 - DNA, 16 bp, Homo sapiens
cgtgatccgcctgcct

SEQ ID NO: 4983125 - DNA, 19 bp, Homo sapiens
cgtgatccgcctgcctctg

SEQ ID NO: 4983126 - DNA, 23 bp, Homo sapiens
ctaaactctcgagacttctctgt

SEQ ID NO: 4983127 - DNA, 18 bp, Homo sapiens
ctaataatcattggattc

SEQ ID NO: 4983128 - DNA, 17 bp, Homo sapiens
ctacactttgctagtga

SEQ ID NO: 4983129 - DNA, 18 bp, Homo sapiens
ctaccccccctcctgctg

SEQ ID NO: 4983130 - DNA, 16 bp, Homo sapiens
ctacttcaattagttc

SEQ ID NO: 4983131 - DNA, 13 bp, Homo sapiens
ctagagtagtgct

SEQ ID NO: 4983132 - DNA, 18 bp, Homo sapiens
ctagccaccgcctcctac

SEQ ID NO: 4983133 - DNA, 15 bp, Homo sapiens
ctaggtaaaatttgt

SEQ ID NO: 4983134 - DNA, 13 bp, Homo sapiens
ctatgagggcctt

SEQ ID NO: 4983135 - DNA, 12 bp, Homo sapiens
ctattctctgcc

SEQ ID NO: 4983136 - DNA, 16 bp, Homo sapiens
ctattctctgccttta

SEQ ID NO: 4983137 - DNA, 13 bp, Homo sapiens
ctcacctccatcc

SEQ ID NO: 4983138 - DNA, 14 bp, Homo sapiens
ctcactgcaacctc

SEQ ID NO: 4983139 - DNA, 19 bp, Homo sapiens
ctcactgcaacctccacct

SEQ ID NO: 4983140 - DNA, 19 bp, Homo sapiens
ctcactgcaacctctgcct

SEQ ID NO: 4983141 - DNA, 20 bp, Homo sapiens
ctcactgctaagaatatttg

SEQ ID NO: 4983142 - DNA, 21 bp, Homo sapiens
ctcactgctaagaatatttga

SEQ ID NO: 4983143 - DNA, 21 bp, Homo sapiens
ctcagcctcccaagtagctgg

SEQ ID NO: 4983144 - DNA, 23 bp, Homo sapiens
ctcaggccgaaggaggagtcagg

SEQ ID NO: 4983145 - DNA, 20 bp, Homo sapiens
ctcagtgtctggctgcagag

SEQ ID NO: 4983146 - DNA, 22 bp, Homo sapiens
ctcagtgtctggctgcagagca

SEQ ID NO: 4983147 - DNA, 21 bp, Homo sapiens
ctccaatgctgttatccctgc

SEQ ID NO: 4983148 - DNA, 21 bp, Homo sapiens
ctccactctcctcttccaggc

SEQ ID NO: 4983149 - DNA, 17 bp, Homo sapiens
ctccattggtgttgaca

SEQ ID NO: 4983150 - DNA, 22 bp, Homo sapiens
ctccctagtagctgggattaca

SEQ ID NO: 4983151 - DNA, 13 bp, Homo sapiens
ctccctctactgg

SEQ ID NO: 4983152 - DNA, 19 bp, Homo sapiens
ctccctctactgggagcct

SEQ ID NO: 4983153 - DNA, 12 bp, Homo sapiens
ctcctcctagcc

SEQ ID NO: 4983154 - DNA, 15 bp, Homo sapiens
ctcctcttgtagcca

SEQ ID NO: 4983155 - DNA, 18 bp, Homo sapiens
ctcctgctgcctaataaa

SEQ ID NO: 4983156 - DNA, 16 bp, Homo sapiens
ctcctttactttctct

SEQ ID NO: 4983157 - DNA, 22 bp, Homo sapiens
ctcgagtgaatttctaaatgtt

SEQ ID NO: 4983158 - DNA, 18 bp, Homo sapiens
ctctactgggagcctacc

SEQ ID NO: 4983159 - DNA, 23 bp, Homo sapiens
ctctagctcagacatctactaca

SEQ ID NO: 4983160 - DNA, 20 bp, Homo sapiens
ctctcttgattaagatctca

SEQ ID NO: 4983161 - DNA, 20 bp, Homo sapiens
ctctgcaggaaatggctgtg

SEQ ID NO: 4983162 - DNA, 21 bp, Homo sapiens
ctctgtcacccaggctgcagt

SEQ ID NO: 4983163 - DNA, 15 bp, Homo sapiens
ctctgtctgccctca

SEQ ID NO: 4983164 - DNA, 22 bp, Homo sapiens
ctctgtgcccaccctccactct

SEQ ID NO: 4983165 - DNA, 16 bp, Homo sapiens
ctctgttgccagactg

SEQ ID NO: 4983166 - DNA, 17 bp, Homo sapiens
ctcttgaactgagcttg

SEQ ID NO: 4983167 - DNA, 20 bp, Homo sapiens
ctgaagtacttaaacttcca

SEQ ID NO: 4983168 - DNA, 16 bp, Homo sapiens
ctgagatctctgcagg

SEQ ID NO: 4983169 - DNA, 12 bp, Homo sapiens
ctgagcttggaa

SEQ ID NO: 4983170 - DNA, 23 bp, Homo sapiens
ctgaggaagagggactgttcttt

SEQ ID NO: 4983171 - DNA, 23 bp, Homo sapiens
ctgatcttactctactgctgctg

SEQ ID NO: 4983172 - DNA, 18 bp, Homo sapiens
ctgcaacctccacctccg

SEQ ID NO: 4983173 - DNA, 15 bp, Homo sapiens
ctgcaacctctgcct

SEQ ID NO: 4983174 - DNA, 19 bp, Homo sapiens
ctgccagaccccctggaga

SEQ ID NO: 4983175 - DNA, 15 bp, Homo sapiens
ctgcctaataaagag

SEQ ID NO: 4983176 - DNA, 18 bp, Homo sapiens
ctgcctaataaagagact

SEQ ID NO: 4983177 - DNA, 16 bp, Homo sapiens
ctgcctggtcctcaca

SEQ ID NO: 4983178 - DNA, 19 bp, Homo sapiens
ctgcctggtcctcacactc

SEQ ID NO: 4983179 - DNA, 14 bp, Homo sapiens
ctgctgcctaataa

SEQ ID NO: 4983180 - DNA, 11 bp, Homo sapiens
ctgctgggctt

SEQ ID NO: 4983181 - DNA, 15 bp, Homo sapiens
ctgctttccaaagcc

SEQ ID NO: 4983182 - DNA, 13 bp, Homo sapiens
ctggacttggagg

SEQ ID NO: 4983183 - DNA, 14 bp, Homo sapiens
ctggatctgtgagg

SEQ ID NO: 4983184 - DNA, 21 bp, Homo sapiens
ctggccagtggctggatctgt

SEQ ID NO: 4983185 - DNA, 23 bp, Homo sapiens
ctggctgcagagcagtgggcctg

SEQ ID NO: 4983186 - DNA, 17 bp, Homo sapiens
ctggctggcccagagtt

SEQ ID NO: 4983187 - DNA, 18 bp, Homo sapiens
ctgggctaccccccctcc

SEQ ID NO: 4983188 - DNA, 22 bp, Homo sapiens
ctggtattttaagagaaaactg

SEQ ID NO: 4983189 - DNA, 13 bp, Homo sapiens
ctggtcagcccaa

SEQ ID NO: 4983190 - DNA, 23 bp, Homo sapiens
ctggtgaccttccaagagcctga

SEQ ID NO: 4983191 - DNA, 19 bp, Homo sapiens
ctggtggtaccattattat

SEQ ID NO: 4983192 - DNA, 23 bp, Homo sapiens
ctggtggttcactcttggagcct

SEQ ID NO: 4983193 - DNA, 14 bp, Homo sapiens
ctgtacctctgcct

SEQ ID NO: 4983194 - DNA, 14 bp, Homo sapiens
ctgtcccctgctac

SEQ ID NO: 4983195 - DNA, 15 bp, Homo sapiens
ctgtgtgtgtgtatg

SEQ ID NO: 4983196 - DNA, 16 bp, Homo sapiens
ctgtgtgtgtgtatgt

SEQ ID NO: 4983197 - DNA, 20 bp, Homo sapiens
ctgtgtgtgtgtatgtgggg

SEQ ID NO: 4983198 - DNA, 19 bp, Homo sapiens
ctgttatccctgcctggtc

SEQ ID NO: 4983199 - DNA, 13 bp, Homo sapiens
ctgttgccagact

SEQ ID NO: 4983200 - DNA, 13 bp, Homo sapiens
ctgtttacagtgt

SEQ ID NO: 4983201 - DNA, 19 bp, Homo sapiens
ctgtttacatatctgtccc

SEQ ID NO: 4983202 - DNA, 21 bp, Homo sapiens
cttactctactgctgctgaca

SEQ ID NO: 4983203 - DNA, 15 bp, Homo sapiens
cttaggccagcacca

SEQ ID NO: 4983204 - DNA, 17 bp, Homo sapiens
cttatctctagctcaga

SEQ ID NO: 4983205 - DNA, 22 bp, Homo sapiens
cttatctctagctcagacatct

SEQ ID NO: 4983206 - DNA, 18 bp, Homo sapiens
cttcaattagttccccta

SEQ ID NO: 4983207 - DNA, 10 bp, Homo sapiens
cttcatacac

SEQ ID NO: 4983208 - DNA, 14 bp, Homo sapiens
cttccaagagcctg

SEQ ID NO: 4983209 - DNA, 16 bp, Homo sapiens
cttccaagcatgacaa

SEQ ID NO: 4983210 - DNA, 19 bp, Homo sapiens
cttctccaacaagttgcct

SEQ ID NO: 4983211 - DNA, 21 bp, Homo sapiens
cttctccaacaagttgcctcc

SEQ ID NO: 4983212 - DNA, 17 bp, Homo sapiens
cttgaactgagcttgga

SEQ ID NO: 4983213 - DNA, 16 bp, Homo sapiens
cttgacaaagtcaagc

SEQ ID NO: 4983214 - DNA, 22 bp, Homo sapiens
cttgacaaagtcaagccacatg

SEQ ID NO: 4983215 - DNA, 20 bp, Homo sapiens
cttgattaagatctcagtgg

SEQ ID NO: 4983216 - DNA, 15 bp, Homo sapiens
cttggaagcttctgg

SEQ ID NO: 4983217 - DNA, 13 bp, Homo sapiens
cttggtcctgcct

SEQ ID NO: 4983218 - DNA, 16 bp, Homo sapiens
cttggtcctgcctctt

SEQ ID NO: 4983219 - DNA, 10 bp, Homo sapiens
cttgtagcca

SEQ ID NO: 4983220 - DNA, 22 bp, Homo sapiens
ctttaaaatatttgtctttaaa

SEQ ID NO: 4983221 - DNA, 23 bp, Homo sapiens
ctttcctaccttggtcctgcctc

SEQ ID NO: 4983222 - DNA, 14 bp, Homo sapiens
ctttgaggtggaag

SEQ ID NO: 4983223 - DNA, 20 bp, Homo sapiens
cttttaaagaaaaatatgat

SEQ ID NO: 4983224 - DNA, 14 bp, Homo sapiens
cttttgtcccagaa

SEQ ID NO: 4983225 - DNA, 22 bp, Homo sapiens
gaaaagaaatctatgattccag

SEQ ID NO: 4983226 - DNA, 16 bp, Homo sapiens
gaaacttagaggaaaa

SEQ ID NO: 4983227 - DNA, 20 bp, Homo sapiens
gaaatctatgattccaggtg

SEQ ID NO: 4983228 - DNA, 11 bp, Homo sapiens
gaaccaaagcg

SEQ ID NO: 4983229 - DNA, 13 bp, Homo sapiens
gaactattagagc

SEQ ID NO: 4983230 - DNA, 22 bp, Homo sapiens
gaactgagcttggaagcttctg

SEQ ID NO: 4983231 - DNA, 12 bp, Homo sapiens
gaagagggctgc

SEQ ID NO: 4983232 - DNA, 23 bp, Homo sapiens
gaaggaaccaaagcgaattttaa

SEQ ID NO: 4983233 - DNA, 19 bp, Homo sapiens
gaagggcagggctgaggcc

SEQ ID NO: 4983234 - DNA, 22 bp, Homo sapiens
gaaggggtaggattactaggtg

SEQ ID NO: 4983235 - DNA, 24 bp, Homo sapiens
gaagtgtgggtctgtgtgtgtgta

SEQ ID NO: 4983236 - DNA, 13 bp, Homo sapiens
gaatgtcagtatg

SEQ ID NO: 4983237 - DNA, 16 bp, Homo sapiens
gaatgtcagtatgtgg

SEQ ID NO: 4983238 - DNA, 22 bp, Homo sapiens
gaatgttatgggatgtaaacaa

SEQ ID NO: 4983239 - DNA, 20 bp, Homo sapiens
gaattgggtggggggcttca

SEQ ID NO: 4983240 - DNA, 22 bp, Homo sapiens
gaattgggtggggggcttcata

SEQ ID NO: 4983241 - DNA, 20 bp, Homo sapiens
gacaacttttaaagaaaaat

SEQ ID NO: 4983242 - DNA, 22 bp, Homo sapiens
gacaggtttgggacccctggtg

SEQ ID NO: 4983243 - DNA, 18 bp, Homo sapiens
gaccattccaaagttctt

SEQ ID NO: 4983244 - DNA, 22 bp, Homo sapiens
gacccactgcgcacagccccag

SEQ ID NO: 4983245 - DNA, 18 bp, Homo sapiens
gacctcacctccatcccc

SEQ ID NO: 4983246 - DNA, 18 bp, Homo sapiens
gaccttccaagagcctga

SEQ ID NO: 4983247 - DNA, 18 bp, Homo sapiens
gactaaccccaccacacc

SEQ ID NO: 4983248 - DNA, 23 bp, Homo sapiens
gagactaaccccaccacaccctc

SEQ ID NO: 4983249 - DNA, 12 bp, Homo sapiens
gagacttctctg

SEQ ID NO: 4983250 - DNA, 18 bp, Homo sapiens
gagatgatgaaaatattt

SEQ ID NO: 4983251 - DNA, 18 bp, Homo sapiens
gagcagtgggcctggcca

SEQ ID NO: 4983252 - DNA, 16 bp, Homo sapiens
gagcccccacattctc

SEQ ID NO: 4983253 - DNA, 15 bp, Homo sapiens
gagcctgcagagctg

SEQ ID NO: 4983254 - DNA, 18 bp, Homo sapiens
gaggctgcagccaggcca

SEQ ID NO: 4983255 - DNA, 23 bp, Homo sapiens
gagggtcttggttccagcctgcc

SEQ ID NO: 4983256 - DNA, 13 bp, Homo sapiens
gagtgtgtaattt

SEQ ID NO: 4983257 - DNA, 14 bp, Homo sapiens
gatagatgtgtgga

SEQ ID NO: 4983258 - DNA, 19 bp, Homo sapiens
gatccgcctgcctctgcct

SEQ ID NO: 4983259 - DNA, 22 bp, Homo sapiens
gatctcgtgatccgcctgcctc

SEQ ID NO: 4983260 - DNA, 17 bp, Homo sapiens
gatcttactctactgct

SEQ ID NO: 4983261 - DNA, 14 bp, Homo sapiens
gatgaaaatattta

SEQ ID NO: 4983262 - DNA, 17 bp, Homo sapiens
gatgaaaatatttaaag

SEQ ID NO: 4983263 - DNA, 17 bp, Homo sapiens
gatgcaatgtagagggg

SEQ ID NO: 4983264 - DNA, 13 bp, Homo sapiens
gatgcatggagat

SEQ ID NO: 4983265 - DNA, 20 bp, Homo sapiens
gatgcatggagatagcccca

SEQ ID NO: 4983266 - DNA, 14 bp, Homo sapiens
gatgggggaaaaaa

SEQ ID NO: 4983267 - DNA, 13 bp, Homo sapiens
gatgtaaacaatg

SEQ ID NO: 4983268 - DNA, 21 bp, Homo sapiens
gatgtgtcctgataagctgag

SEQ ID NO: 4983269 - DNA, 22 bp, Homo sapiens
gattcatatatccgaactactg

SEQ ID NO: 4983270 - DNA, 17 bp, Homo sapiens
gattccaggtggcatca

SEQ ID NO: 4983271 - DNA, 14 bp, Homo sapiens
gattctgagagctg

SEQ ID NO: 4983272 - DNA, 15 bp, Homo sapiens
gattgggcccctgcc

SEQ ID NO: 4983273 - DNA, 20 bp, Homo sapiens
gcaaatccttgtgggaaaag

SEQ ID NO: 4983274 - DNA, 15 bp, Homo sapiens
gcaccacactcagcc

SEQ ID NO: 4983275 - DNA, 18 bp, Homo sapiens
gcaccccctggcttgaac

SEQ ID NO: 4983276 - DNA, 20 bp, Homo sapiens
gcagccaggccactggcccc

SEQ ID NO: 4983277 - DNA, 11 bp, Homo sapiens
gcaggaggaag

SEQ ID NO: 4983278 - DNA, 14 bp, Homo sapiens
gcaggtccccagac

SEQ ID NO: 4983279 - DNA, 16 bp, Homo sapiens
gcagtggcacgatctc

SEQ ID NO: 4983280 - DNA, 15 bp, Homo sapiens
gcagtgggcctggcc

SEQ ID NO: 4983281 - DNA, 17 bp, Homo sapiens
gcagtgggcctggccag

SEQ ID NO: 4983282 - DNA, 12 bp, Homo sapiens
gccaagaggctg

SEQ ID NO: 4983283 - DNA, 14 bp, Homo sapiens
gccaagaggctgca

SEQ ID NO: 4983284 - DNA, 17 bp, Homo sapiens
gccaagaggctgcagcc

SEQ ID NO: 4983285 - DNA, 17 bp, Homo sapiens
gccaccatgcctaattt

SEQ ID NO: 4983286 - DNA, 19 bp, Homo sapiens
gccaccgcctcctacagcc

SEQ ID NO: 4983287 - DNA, 22 bp, Homo sapiens
gccactcaggcccaaagcctcg

SEQ ID NO: 4983288 - DNA, 19 bp, Homo sapiens
gccaggccactggcccctg

SEQ ID NO: 4983289 - DNA, 17 bp, Homo sapiens
gccatcatgtttacaga

SEQ ID NO: 4983290 - DNA, 13 bp, Homo sapiens
gccattctgcctc

SEQ ID NO: 4983291 - DNA, 20 bp, Homo sapiens
gcccctgagatctctgcagg

SEQ ID NO: 4983292 - DNA, 11 bp, Homo sapiens
gccctatctgt

SEQ ID NO: 4983293 - DNA, 19 bp, Homo sapiens
gcctaatttttttctattt

SEQ ID NO: 4983294 - DNA, 19 bp, Homo sapiens
gcctccagaggaggggtgg

SEQ ID NO: 4983295 - DNA, 17 bp, Homo sapiens
gcctcgacacagagtgg

SEQ ID NO: 4983296 - DNA, 19 bp, Homo sapiens
gcctctcattccagaggaa

SEQ ID NO: 4983297 - DNA, 12 bp, Homo sapiens
gcctgcagagct

SEQ ID NO: 4983298 - DNA, 23 bp, Homo sapiens
gcctggccagcaggtccccagct

SEQ ID NO: 4983299 - DNA, 13 bp, Homo sapiens
gcctggtcagccc

SEQ ID NO: 4983300 - DNA, 22 bp, Homo sapiens
gcgcacaccaccacacacagct

SEQ ID NO: 4983301 - DNA, 16 bp, Homo sapiens
gcgcacagccccagct

SEQ ID NO: 4983302 - DNA, 21 bp, Homo sapiens
gcgcacagccccagctaattt

SEQ ID NO: 4983303 - DNA, 14 bp, Homo sapiens
gcgtgctacctgca

SEQ ID NO: 4983304 - DNA, 17 bp, Homo sapiens
gctatgagctggggatg

SEQ ID NO: 4983305 - DNA, 17 bp, Homo sapiens
gctcactgcaacctcca

SEQ ID NO: 4983306 - DNA, 22 bp, Homo sapiens
gctcactgcaacctctgcctcc

SEQ ID NO: 4983307 - DNA, 17 bp, Homo sapiens
gctccaggccagggggc

SEQ ID NO: 4983308 - DNA, 15 bp, Homo sapiens
gctctccaagcccag

SEQ ID NO: 4983309 - DNA, 15 bp, Homo sapiens
gctgcagccaggcca

SEQ ID NO: 4983310 - DNA, 18 bp, Homo sapiens
gctggagttcagcagtga

SEQ ID NO: 4983311 - DNA, 14 bp, Homo sapiens
gctggggatgtctc

SEQ ID NO: 4983312 - DNA, 13 bp, Homo sapiens
gctgtttgcgtga

SEQ ID NO: 4983313 - DNA, 11 bp, Homo sapiens
gcttcatacac

SEQ ID NO: 4983314 - DNA, 22 bp, Homo sapiens
gcttcatacagggatggtgttc

SEQ ID NO: 4983315 - DNA, 13 bp, Homo sapiens
gcttggtgcatga

SEQ ID NO: 4983316 - DNA, 17 bp, Homo sapiens
gcttttctttctaccaa

SEQ ID NO: 4983317 - DNA, 16 bp, Homo sapiens
gcttttgtaaaataaa

SEQ ID NO: 4983318 - DNA, 20 bp, Homo sapiens
ggaaaagccaagaggctgca

SEQ ID NO: 4983319 - DNA, 21 bp, Homo sapiens
ggaagtgtgggtctgtgtgtg

SEQ ID NO: 4983320 - DNA, 22 bp, Homo sapiens
ggaagtgtgggtctgtgtgtgt

SEQ ID NO: 4983321 - DNA, 19 bp, Homo sapiens
ggacatagtaaatgattca

SEQ ID NO: 4983322 - DNA, 16 bp, Homo sapiens
ggacttggaggtagct

SEQ ID NO: 4983323 - DNA, 12 bp, Homo sapiens
ggagtgcagtgg

SEQ ID NO: 4983324 - DNA, 22 bp, Homo sapiens
ggagtgtgtaatttaaaattgt

SEQ ID NO: 4983325 - DNA, 14 bp, Homo sapiens
ggatagatgtgtgg

SEQ ID NO: 4983326 - DNA, 16 bp, Homo sapiens
ggatgcatggagatag

SEQ ID NO: 4983327 - DNA, 15 bp, Homo sapiens
ggatggtgttcaaaa

SEQ ID NO: 4983328 - DNA, 21 bp, Homo sapiens
ggcacagacactacatatcta

SEQ ID NO: 4983329 - DNA, 12 bp, Homo sapiens
ggcagctcagct

SEQ ID NO: 4983330 - DNA, 18 bp, Homo sapiens
ggccagcaccatctcttt

SEQ ID NO: 4983331 - DNA, 17 bp, Homo sapiens
ggccagtccctgaggca

SEQ ID NO: 4983332 - DNA, 20 bp, Homo sapiens
ggcccctgccagaccccctg

SEQ ID NO: 4983333 - DNA, 14 bp, Homo sapiens
ggctccaggccagg

SEQ ID NO: 4983334 - DNA, 13 bp, Homo sapiens
ggctggacttgga

SEQ ID NO: 4983335 - DNA, 17 bp, Homo sapiens
ggctggatctgtgaggg

SEQ ID NO: 4983336 - DNA, 12 bp, Homo sapiens
ggcttcatacac

SEQ ID NO: 4983337 - DNA, 19 bp, Homo sapiens
gggagaatgtcagtatgtg

SEQ ID NO: 4983338 - DNA, 11 bp, Homo sapiens
gggagtgtgta

SEQ ID NO: 4983339 - DNA, 13 bp, Homo sapiens
gggatagatgtgt

SEQ ID NO: 4983340 - DNA, 18 bp, Homo sapiens
gggccagtccctgaggca

SEQ ID NO: 4983341 - DNA, 21 bp, Homo sapiens
gggccagtccctgaggcaggt

SEQ ID NO: 4983342 - DNA, 13 bp, Homo sapiens
ggggatagatgtg

SEQ ID NO: 4983343 - DNA, 22 bp, Homo sapiens
gggggcttcatacacatgagat

SEQ ID NO: 4983344 - DNA, 18 bp, Homo sapiens
gggtcattcatggcctgg

SEQ ID NO: 4983345 - DNA, 17 bp, Homo sapiens
gggtggggggcttcata

SEQ ID NO: 4983346 - DNA, 18 bp, Homo sapiens
ggtaggaactgctgggct

SEQ ID NO: 4983347 - DNA, 13 bp, Homo sapiens
ggtcctgcctctt

SEQ ID NO: 4983348 - DNA, 20 bp, Homo sapiens
ggtctgtgtgtgtgtatgtg

SEQ ID NO: 4983349 - DNA, 20 bp, Homo sapiens
ggtgcccagaatgaggctgc

SEQ ID NO: 4983350 - DNA, 23 bp, Homo sapiens
ggtggttcactcttggagcctgc

SEQ ID NO: 4983351 - DNA, 15 bp, Homo sapiens
ggttccagcctgcca

SEQ ID NO: 4983352 - DNA, 16 bp, Homo sapiens
ggttccagcctgccac

SEQ ID NO: 4983353 - DNA, 19 bp, Homo sapiens
ggttgggagaatgtcagta

SEQ ID NO: 4983354 - DNA, 19 bp, Homo sapiens
ggttgggcgtgctacctgc

SEQ ID NO: 4983355 - DNA, 14 bp, Homo sapiens
ggtttgggacccct

SEQ ID NO: 4983356 - DNA, 19 bp, Homo sapiens
gtaaagcacagtccctagg

SEQ ID NO: 4983357 - DNA, 13 bp, Homo sapiens
gtaagtacttcca

SEQ ID NO: 4983358 - DNA, 16 bp, Homo sapiens
gtaatctttaaactgg

SEQ ID NO: 4983359 - DNA, 15 bp, Homo sapiens
gtagatcctgagatg

SEQ ID NO: 4983360 - DNA, 21 bp, Homo sapiens
gtagctgggagtacaggcgtc

SEQ ID NO: 4983361 - DNA, 18 bp, Homo sapiens
gtagctgggattacaggc

SEQ ID NO: 4983362 - DNA, 17 bp, Homo sapiens
gtaggttttttttattt

SEQ ID NO: 4983363 - DNA, 18 bp, Homo sapiens
gtagtgcttggtgcatga

SEQ ID NO: 4983364 - DNA, 15 bp, Homo sapiens
gtatacctcctatat

SEQ ID NO: 4983365 - DNA, 14 bp, Homo sapiens
gtatgcttcataca

SEQ ID NO: 4983366 - DNA, 21 bp, Homo sapiens
gtatgtggaagtgtgggtctg

SEQ ID NO: 4983367 - DNA, 17 bp, Homo sapiens
gtcagtatgtggaagtg

SEQ ID NO: 4983368 - DNA, 22 bp, Homo sapiens
gtccctgaggcaggtccccaga

SEQ ID NO: 4983369 - DNA, 22 bp, Homo sapiens
gtccttcaagattccatttctt

SEQ ID NO: 4983370 - DNA, 16 bp, Homo sapiens
gtctcactctgtcacc

SEQ ID NO: 4983371 - DNA, 17 bp, Homo sapiens
gtctctgggccccaggc

SEQ ID NO: 4983372 - DNA, 13 bp, Homo sapiens
gtctggctgcaga

SEQ ID NO: 4983373 - DNA, 14 bp, Homo sapiens
gtgaacttccctac

SEQ ID NO: 4983374 - DNA, 19 bp, Homo sapiens
gtgaatttctgaaagatga

SEQ ID NO: 4983375 - DNA, 21 bp, Homo sapiens
gtgaccttccaagagcctgag

SEQ ID NO: 4983376 - DNA, 15 bp, Homo sapiens
gtgaggatgtctggg

SEQ ID NO: 4983377 - DNA, 21 bp, Homo sapiens
gtgaggtggaattattttaaa

SEQ ID NO: 4983378 - DNA, 15 bp, Homo sapiens
gtgatccgcctgcct

SEQ ID NO: 4983379 - DNA, 10 bp, Homo sapiens
gtgatgtgtc

SEQ ID NO: 4983380 - DNA, 12 bp, Homo sapiens
gtgcaagagagg

SEQ ID NO: 4983381 - DNA, 22 bp, Homo sapiens
gtgcacctcaaatcttctaatt

SEQ ID NO: 4983382 - DNA, 14 bp, Homo sapiens
gtgccttttgccat

SEQ ID NO: 4983383 - DNA, 23 bp, Homo sapiens
gtgctattgtagagccagaggtc

SEQ ID NO: 4983384 - DNA, 15 bp, Homo sapiens
gtgctctccaagccc

SEQ ID NO: 4983385 - DNA, 23 bp, Homo sapiens
gtggaaaagccaagaggctgcag

SEQ ID NO: 4983386 - DNA, 15 bp, Homo sapiens
gtggaattattttaa

SEQ ID NO: 4983387 - DNA, 22 bp, Homo sapiens
gtggttcactcttggagcctgc

SEQ ID NO: 4983388 - DNA, 23 bp, Homo sapiens
gtgtccttctcctcttgtagcca

SEQ ID NO: 4983389 - DNA, 14 bp, Homo sapiens
gtgtctggctgcag

SEQ ID NO: 4983390 - DNA, 17 bp, Homo sapiens
gtgtgggagtgtgtaat

SEQ ID NO: 4983391 - DNA, 14 bp, Homo sapiens
gtgtgggtctgtgt

SEQ ID NO: 4983392 - DNA, 12 bp, Homo sapiens
gtgtgtatgtgg

SEQ ID NO: 4983393 - DNA, 13 bp, Homo sapiens
gtgtgtatgtggg

SEQ ID NO: 4983394 - DNA, 14 bp, Homo sapiens
gtgtgtgtatgtgg

SEQ ID NO: 4983395 - DNA, 17 bp, Homo sapiens
gtgtgttgtgtgtggga

SEQ ID NO: 4983396 - DNA, 14 bp, Homo sapiens
gtgtgtttatgtgt

SEQ ID NO: 4983397 - DNA, 12 bp, Homo sapiens
gtgtttatgtgt

SEQ ID NO: 4983398 - DNA, 17 bp, Homo sapiens
gttaaactcgctcactg

SEQ ID NO: 4983399 - DNA, 17 bp, Homo sapiens
gttcactcttggagcct

SEQ ID NO: 4983400 - DNA, 19 bp, Homo sapiens
gttcactcttggagcctgc

SEQ ID NO: 4983401 - DNA, 14 bp, Homo sapiens
gttccagcaccaca

SEQ ID NO: 4983402 - DNA, 13 bp, Homo sapiens
gttccagcctgcc

SEQ ID NO: 4983403 - DNA, 17 bp, Homo sapiens
gttccctggacagagct

SEQ ID NO: 4983404 - DNA, 15 bp, Homo sapiens
gttcttatctctagc

SEQ ID NO: 4983405 - DNA, 21 bp, Homo sapiens
gttgggagaatgtcagtatgt

SEQ ID NO: 4983406 - DNA, 16 bp, Homo sapiens
gttgggcgtgctacct

SEQ ID NO: 4983407 - DNA, 13 bp, Homo sapiens
gttgtgtgtggga

SEQ ID NO: 4983408 - DNA, 13 bp, Homo sapiens
gtttacagtgttc

SEQ ID NO: 4983409 - DNA, 18 bp, Homo sapiens
gtttccctcccaacagag

SEQ ID NO: 4983410 - DNA, 16 bp, Homo sapiens
gttttcttaacttaaa

SEQ ID NO: 4983411 - DNA, 14 bp, Homo sapiens
taaaaccaccaaag

SEQ ID NO: 4983412 - DNA, 17 bp, Homo sapiens
taaaactcagaatataa

SEQ ID NO: 4983413 - DNA, 19 bp, Homo sapiens
taaaactcagaatataaca

SEQ ID NO: 4983414 - DNA, 14 bp, Homo sapiens
taacagcaccccat

SEQ ID NO: 4983415 - DNA, 15 bp, Homo sapiens
taacagcaccccata

SEQ ID NO: 4983416 - DNA, 13 bp, Homo sapiens
taagaatatttga

SEQ ID NO: 4983417 - DNA, 14 bp, Homo sapiens
taagaatatttgaa

SEQ ID NO: 4983418 - DNA, 22 bp, Homo sapiens
taagtgccaggatggaatgatg

SEQ ID NO: 4983419 - DNA, 14 bp, Homo sapiens
taatgaaacttgga

SEQ ID NO: 4983420 - DNA, 15 bp, Homo sapiens
taatgatcaaaacat

SEQ ID NO: 4983421 - DNA, 14 bp, Homo sapiens
taattattccttct

SEQ ID NO: 4983422 - DNA, 15 bp, Homo sapiens
taatttaaaattgtg

SEQ ID NO: 4983423 - DNA, 18 bp, Homo sapiens
tacagaggacagtatttg

SEQ ID NO: 4983424 - DNA, 17 bp, Homo sapiens
tacagcccacctggctt

SEQ ID NO: 4983425 - DNA, 18 bp, Homo sapiens
tacaggcgtctgccacca

SEQ ID NO: 4983426 - DNA, 17 bp, Homo sapiens
tacagggatggtgttca

SEQ ID NO: 4983427 - DNA, 16 bp, Homo sapiens
taccttggtcctgcct

SEQ ID NO: 4983428 - DNA, 17 bp, Homo sapiens
taccttggtcctgcctc

SEQ ID NO: 4983429 - DNA, 12 bp, Homo sapiens
tactagctgtgc

SEQ ID NO: 4983430 - DNA, 14 bp, Homo sapiens
tactagctgtgcaa

SEQ ID NO: 4983431 - DNA, 14 bp, Homo sapiens
tactgctgctgaca

SEQ ID NO: 4983432 - DNA, 15 bp, Homo sapiens
tactgtatataaact

SEQ ID NO: 4983433 - DNA, 19 bp, Homo sapiens
tagccaccgcctcctacag

SEQ ID NO: 4983434 - DNA, 21 bp, Homo sapiens
taggcttcattgcactgatct

SEQ ID NO: 4983435 - DNA, 17 bp, Homo sapiens
tataaaatgggaagact

SEQ ID NO: 4983436 - DNA, 17 bp, Homo sapiens
tataaactaggtaaaat

SEQ ID NO: 4983437 - DNA, 11 bp, Homo sapiens
tatatatttcc

SEQ ID NO: 4983438 - DNA, 21 bp, Homo sapiens
tatatttccctgaaggaacca

SEQ ID NO: 4983439 - DNA, 19 bp, Homo sapiens
tatcatgtcgtaggtaaac

SEQ ID NO: 4983440 - DNA, 17 bp, Homo sapiens
tatctgtcccctgctac

SEQ ID NO: 4983441 - DNA, 17 bp, Homo sapiens
tatgcttcatacaggga

SEQ ID NO: 4983442 - DNA, 15 bp, Homo sapiens
tatgggatgtaaaca

SEQ ID NO: 4983443 - DNA, 23 bp, Homo sapiens
tatgtgtgtgtgttgtgtgtggg

SEQ ID NO: 4983444 - DNA, 12 bp, Homo sapiens
tattctctgcct

SEQ ID NO: 4983445 - DNA, 16 bp, Homo sapiens
tattgatgttaacaag

SEQ ID NO: 4983446 - DNA, 19 bp, Homo sapiens
tatttataaactaggtaaa

SEQ ID NO: 4983447 - DNA, 17 bp, Homo sapiens
tatttgtctttaaacag

SEQ ID NO: 4983448 - DNA, 21 bp, Homo sapiens
tattttaaaagataaatatta

SEQ ID NO: 4983449 - DNA, 19 bp, Homo sapiens
tcaaagcttttgtaaaata

SEQ ID NO: 4983450 - DNA, 16 bp, Homo sapiens
tcaagccattctgcct

SEQ ID NO: 4983451 - DNA, 23 bp, Homo sapiens
tcacagcaagtcactggccagtg

SEQ ID NO: 4983452 - DNA, 14 bp, Homo sapiens
tcacctccatcccc

SEQ ID NO: 4983453 - DNA, 15 bp, Homo sapiens
tcactaagctcctcc

SEQ ID NO: 4983454 - DNA, 13 bp, Homo sapiens
tcactcttggagc

SEQ ID NO: 4983455 - DNA, 16 bp, Homo sapiens
tcactcttggagcctg

SEQ ID NO: 4983456 - DNA, 20 bp, Homo sapiens
tcactgcaacctctgcctcc

SEQ ID NO: 4983457 - DNA, 19 bp, Homo sapiens
tcagagtcctcattataaa

SEQ ID NO: 4983458 - DNA, 21 bp, Homo sapiens
tcagcccaaaccaccagaagc

SEQ ID NO: 4983459 - DNA, 20 bp, Homo sapiens
tcagcctcccaagtagctgg

SEQ ID NO: 4983460 - DNA, 21 bp, Homo sapiens
tcaggatttcaccagaagtta

SEQ ID NO: 4983461 - DNA, 15 bp, Homo sapiens
tcaggccgaaggagg

SEQ ID NO: 4983462 - DNA, 16 bp, Homo sapiens
tcagtatgtggaagtg

SEQ ID NO: 4983463 - DNA, 17 bp, Homo sapiens
tcagttctcttcactca

SEQ ID NO: 4983464 - DNA, 17 bp, Homo sapiens
tcatgtttacagaggac

SEQ ID NO: 4983465 - DNA, 18 bp, Homo sapiens
tcatttagtgctaaacaa

SEQ ID NO: 4983466 - DNA, 21 bp, Homo sapiens
tcatttcactaagctcctcct

SEQ ID NO: 4983467 - DNA, 22 bp, Homo sapiens
tccaagcccagttcagcttggg

SEQ ID NO: 4983468 - DNA, 23 bp, Homo sapiens
tccaccaagcctggtcagcccaa

SEQ ID NO: 4983469 - DNA, 21 bp, Homo sapiens
tccacccaccttggcctccca

SEQ ID NO: 4983470 - DNA, 15 bp, Homo sapiens
tccacctccgggttc

SEQ ID NO: 4983471 - DNA, 18 bp, Homo sapiens
tccactggggattgggcc

SEQ ID NO: 4983472 - DNA, 22 bp, Homo sapiens
tccagccctgagttcctagcca

SEQ ID NO: 4983473 - DNA, 18 bp, Homo sapiens
tccaggccagggggccag

SEQ ID NO: 4983474 - DNA, 17 bp, Homo sapiens
tccatccccctctgtct

SEQ ID NO: 4983475 - DNA, 19 bp, Homo sapiens
tccatccccctctgtctgc

SEQ ID NO: 4983476 - DNA, 17 bp, Homo sapiens
tcccaacagagctgggc

SEQ ID NO: 4983477 - DNA, 17 bp, Homo sapiens
tcccatttactcttgag

SEQ ID NO: 4983478 - DNA, 15 bp, Homo sapiens
tcccctactacactt

SEQ ID NO: 4983479 - DNA, 20 bp, Homo sapiens
tccctagtagctgggattac

SEQ ID NO: 4983480 - DNA, 22 bp, Homo sapiens
tccctctactgggagcctaccc

SEQ ID NO: 4983481 - DNA, 23 bp, Homo sapiens
tccctgcctggtcctcacactca

SEQ ID NO: 4983482 - DNA, 13 bp, Homo sapiens
tccgcctgcctct

SEQ ID NO: 4983483 - DNA, 14 bp, Homo sapiens
tccgcctgcctctg

SEQ ID NO: 4983484 - DNA, 15 bp, Homo sapiens
tcctgctgcctaata

SEQ ID NO: 4983485 - DNA, 20 bp, Homo sapiens
tcctgctgcctaataaagag

SEQ ID NO: 4983486 - DNA, 21 bp, Homo sapiens
tcctgctgcctaataaagaga

SEQ ID NO: 4983487 - DNA, 22 bp, Homo sapiens
tccttcaagattccatttctta

SEQ ID NO: 4983488 - DNA, 10 bp, Homo sapiens
tccttctcct

SEQ ID NO: 4983489 - DNA, 20 bp, Homo sapiens
tccttctcctcttgtagcca

SEQ ID NO: 4983490 - DNA, 21 bp, Homo sapiens
tccttcttactctcctcttct

SEQ ID NO: 4983491 - DNA, 16 bp, Homo sapiens
tcgagtgaatttctaa

SEQ ID NO: 4983492 - DNA, 19 bp, Homo sapiens
tctaattccaagatccaat

SEQ ID NO: 4983493 - DNA, 15 bp, Homo sapiens
tctacctcttggctg

SEQ ID NO: 4983494 - DNA, 16 bp, Homo sapiens
tctagaatcagagctg

SEQ ID NO: 4983495 - DNA, 23 bp, Homo sapiens
tctaggagaaacttagaggaaaa

SEQ ID NO: 4983496 - DNA, 13 bp, Homo sapiens
tctattctctgcc

SEQ ID NO: 4983497 - DNA, 14 bp, Homo sapiens
tctattctctgcct

SEQ ID NO: 4983498 - DNA, 15 bp, Homo sapiens
tctatttttaggaga

SEQ ID NO: 4983499 - DNA, 16 bp, Homo sapiens
tctcattccagaggaa

SEQ ID NO: 4983500 - DNA, 17 bp, Homo sapiens
tctcctctttgatgtca

SEQ ID NO: 4983501 - DNA, 19 bp, Homo sapiens
tctcgagacttctctgtga

SEQ ID NO: 4983502 - DNA, 19 bp, Homo sapiens
tctcgtgatccgcctgcct

SEQ ID NO: 4983503 - DNA, 20 bp, Homo sapiens
tctcgtgatccgcctgcctc

SEQ ID NO: 4983504 - DNA, 16 bp, Homo sapiens
tctctctcctctttga

SEQ ID NO: 4983505 - DNA, 13 bp, Homo sapiens
tctgaagtactta

SEQ ID NO: 4983506 - DNA, 12 bp, Homo sapiens
tctgagagctgt

SEQ ID NO: 4983507 - DNA, 11 bp, Homo sapiens
tctgtgtgtgt

SEQ ID NO: 4983508 - DNA, 20 bp, Homo sapiens
tctgtgtgtttatgtgtgtg

SEQ ID NO: 4983509 - DNA, 14 bp, Homo sapiens
tctgtttacagtgt

SEQ ID NO: 4983510 - DNA, 13 bp, Homo sapiens
tcttactctcctc

SEQ ID NO: 4983511 - DNA, 22 bp, Homo sapiens
tcttcattacctcagtgagaag

SEQ ID NO: 4983512 - DNA, 13 bp, Homo sapiens
tcttctagcattt

SEQ ID NO: 4983513 - DNA, 16 bp, Homo sapiens
tcttctagcatttctt

SEQ ID NO: 4983514 - DNA, 17 bp, Homo sapiens
tcttgaactgagcttgg

SEQ ID NO: 4983515 - DNA, 15 bp, Homo sapiens
tcttggagcctgcag

SEQ ID NO: 4983516 - DNA, 18 bp, Homo sapiens
tcttggagcctgcagagc

SEQ ID NO: 4983517 - DNA, 17 bp, Homo sapiens
tcttggttccagcctgc

SEQ ID NO: 4983518 - DNA, 18 bp, Homo sapiens
tcttggttccagcctgcc

SEQ ID NO: 4983519 - DNA, 19 bp, Homo sapiens
tcttggttccagcctgcca

SEQ ID NO: 4983520 - DNA, 17 bp, Homo sapiens
tcttgtgcctcggcctc

SEQ ID NO: 4983521 - DNA, 21 bp, Homo sapiens
tctttccactcctcctagcca

SEQ ID NO: 4983522 - DNA, 22 bp, Homo sapiens
tctttccactcctcctagccac

SEQ ID NO: 4983523 - DNA, 22 bp, Homo sapiens
tctttcctaccttggtcctgcc

SEQ ID NO: 4983524 - DNA, 18 bp, Homo sapiens
tgaaaacaagcctccact

SEQ ID NO: 4983525 - DNA, 11 bp, Homo sapiens
tgaaaatattt

SEQ ID NO: 4983526 - DNA, 23 bp, Homo sapiens
tgaatgtatgcttcatacaggga

SEQ ID NO: 4983527 - DNA, 16 bp, Homo sapiens
tgaattactgtatata

SEQ ID NO: 4983528 - DNA, 15 bp, Homo sapiens
tgacctctataaact

SEQ ID NO: 4983529 - DNA, 20 bp, Homo sapiens
tgaccttccaagagcctgag

SEQ ID NO: 4983530 - DNA, 23 bp, Homo sapiens
tgagacagggtctcactctgtca

SEQ ID NO: 4983531 - DNA, 16 bp, Homo sapiens
tgaggcaggtccccag

SEQ ID NO: 4983532 - DNA, 20 bp, Homo sapiens
tgaggctgctttccaaagcc

SEQ ID NO: 4983533 - DNA, 14 bp, Homo sapiens
tgagttggctggga

SEQ ID NO: 4983534 - DNA, 16 bp, Homo sapiens
tgagttggctgggaat

SEQ ID NO: 4983535 - DNA, 15 bp, Homo sapiens
tgatccagccctgag

SEQ ID NO: 4983536 - DNA, 15 bp, Homo sapiens
tgatccgcctgcctc

SEQ ID NO: 4983537 - DNA, 15 bp, Homo sapiens
tgatctggacttcct

SEQ ID NO: 4983538 - DNA, 12 bp, Homo sapiens
tgatgttaacaa

SEQ ID NO: 4983539 - DNA, 21 bp, Homo sapiens
tgcaacctctgcctcccgggt

SEQ ID NO: 4983540 - DNA, 22 bp, Homo sapiens
tgcaacctctgcctcccgggtt

SEQ ID NO: 4983541 - DNA, 22 bp, Homo sapiens
tgcactgatcttactctactgc

SEQ ID NO: 4983542 - DNA, 20 bp, Homo sapiens
tgcatgaattactgtatata

SEQ ID NO: 4983543 - DNA, 21 bp, Homo sapiens
tgcattatatttgtaaattta

SEQ ID NO: 4983544 - DNA, 17 bp, Homo sapiens
tgccagaccccctggag

SEQ ID NO: 4983545 - DNA, 17 bp, Homo sapiens
tgccagactggagtgca

SEQ ID NO: 4983546 - DNA, 22 bp, Homo sapiens
tgccatcatgtttacagaggac

SEQ ID NO: 4983547 - DNA, 23 bp, Homo sapiens
tgcccaggcaaagtgcacctcaa

SEQ ID NO: 4983548 - DNA, 20 bp, Homo sapiens
tgcccaggctggtcttgaac

SEQ ID NO: 4983549 - DNA, 16 bp, Homo sapiens
tgccttggtgtgctgt

SEQ ID NO: 4983550 - DNA, 19 bp, Homo sapiens
tgccttgtgaaggaattat

SEQ ID NO: 4983551 - DNA, 21 bp, Homo sapiens
tgctaagaatatttgaatgta

SEQ ID NO: 4983552 - DNA, 18 bp, Homo sapiens
tgctattgtagagccaga

SEQ ID NO: 4983553 - DNA, 22 bp, Homo sapiens
tgctattgtagagccagaggtc

SEQ ID NO: 4983554 - DNA, 21 bp, Homo sapiens
tgctctaatgatcaaaacatg

SEQ ID NO: 4983555 - DNA, 13 bp, Homo sapiens
tgctgcctaataa

SEQ ID NO: 4983556 - DNA, 15 bp, Homo sapiens
tgctgtagacatttg

SEQ ID NO: 4983557 - DNA, 23 bp, Homo sapiens
tgctgtatccatccatggggctg

SEQ ID NO: 4983558 - DNA, 15 bp, Homo sapiens
tgcttcatacaggga

SEQ ID NO: 4983559 - DNA, 16 bp, Homo sapiens
tggaaaagccaagagg

SEQ ID NO: 4983560 - DNA, 13 bp, Homo sapiens
tggaagtgtgggt

SEQ ID NO: 4983561 - DNA, 14 bp, Homo sapiens
tggaagtgtgggtc

SEQ ID NO: 4983562 - DNA, 20 bp, Homo sapiens
tggaagtgtgggtctgtgtg

SEQ ID NO: 4983563 - DNA, 16 bp, Homo sapiens
tggaatgaagaaattg

SEQ ID NO: 4983564 - DNA, 19 bp, Homo sapiens
tggaattattttaaaagat

SEQ ID NO: 4983565 - DNA, 22 bp, Homo sapiens
tggacctttcctgaggaagagg

SEQ ID NO: 4983566 - DNA, 16 bp, Homo sapiens
tggactgttccctgag

SEQ ID NO: 4983567 - DNA, 17 bp, Homo sapiens
tggattcaattcctgtc

SEQ ID NO: 4983568 - DNA, 16 bp, Homo sapiens
tggattctgagagctg

SEQ ID NO: 4983569 - DNA, 19 bp, Homo sapiens
tggcaaactctccaccaca

SEQ ID NO: 4983570 - DNA, 15 bp, Homo sapiens
tggccagtggctgga

SEQ ID NO: 4983571 - DNA, 16 bp, Homo sapiens
tggccagtggctggat

SEQ ID NO: 4983572 - DNA, 21 bp, Homo sapiens
tggcctgttcttctatgggtt

SEQ ID NO: 4983573 - DNA, 19 bp, Homo sapiens
tggcgcgatctcagctcac

SEQ ID NO: 4983574 - DNA, 23 bp, Homo sapiens
tgggaataagtgccaggatggaa

SEQ ID NO: 4983575 - DNA, 22 bp, Homo sapiens
tgggagtacaggcgtctgccac

SEQ ID NO: 4983576 - DNA, 21 bp, Homo sapiens
tgggagtgaggatgtctgggc

SEQ ID NO: 4983577 - DNA, 13 bp, Homo sapiens
tgggagtgtgtaa

SEQ ID NO: 4983578 - DNA, 15 bp, Homo sapiens
tgggccccaggcacc

SEQ ID NO: 4983579 - DNA, 23 bp, Homo sapiens
tgggctaccccccctcctgctgc

SEQ ID NO: 4983580 - DNA, 20 bp, Homo sapiens
tggggacaggggcaggagga

SEQ ID NO: 4983581 - DNA, 14 bp, Homo sapiens
tggggagggatttg

SEQ ID NO: 4983582 - DNA, 16 bp, Homo sapiens
tggggatagatgtgtg

SEQ ID NO: 4983583 - DNA, 20 bp, Homo sapiens
tggggatagatgtgtggaca

SEQ ID NO: 4983584 - DNA, 15 bp, Homo sapiens
tgggggaaaaaaagt

SEQ ID NO: 4983585 - DNA, 15 bp, Homo sapiens
tgggggtctgtgtgt

SEQ ID NO: 4983586 - DNA, 15 bp, Homo sapiens
tggggtaggttggga

SEQ ID NO: 4983587 - DNA, 18 bp, Homo sapiens
tgggtggggggcttcata

SEQ ID NO: 4983588 - DNA, 12 bp, Homo sapiens
tggtcagcccaa

SEQ ID NO: 4983589 - DNA, 16 bp, Homo sapiens
tggtctgggactctct

SEQ ID NO: 4983590 - DNA, 17 bp, Homo sapiens
tggtgtccttctcctct

SEQ ID NO: 4983591 - DNA, 16 bp, Homo sapiens
tggttccagcctgcca

SEQ ID NO: 4983592 - DNA, 17 bp, Homo sapiens
tgtaaatttatgtgatg

SEQ ID NO: 4983593 - DNA, 22 bp, Homo sapiens
tgtaatttaaaattgtgatgtg

SEQ ID NO: 4983594 - DNA, 22 bp, Homo sapiens
tgtatccatccatggggctgat

SEQ ID NO: 4983595 - DNA, 20 bp, Homo sapiens
tgtatgtgggggtctgtgtg

SEQ ID NO: 4983596 - DNA, 15 bp, Homo sapiens
tgtccttctcctctt

SEQ ID NO: 4983597 - DNA, 16 bp, Homo sapiens
tgtcgtaggtaaacta

SEQ ID NO: 4983598 - DNA, 21 bp, Homo sapiens
tgtgccagaggaaggaaaagg

SEQ ID NO: 4983599 - DNA, 14 bp, Homo sapiens
tgtgcccaccctcc

SEQ ID NO: 4983600 - DNA, 17 bp, Homo sapiens
tgtgccttggtgtgctg

SEQ ID NO: 4983601 - DNA, 21 bp, Homo sapiens
tgtggaaaagccaagaggctg

SEQ ID NO: 4983602 - DNA, 15 bp, Homo sapiens
tgtggaagtgtgggt

SEQ ID NO: 4983603 - DNA, 13 bp, Homo sapiens
tgtggtctccact

SEQ ID NO: 4983604 - DNA, 22 bp, Homo sapiens
tgtgtaatttaaaattgtgatg

SEQ ID NO: 4983605 - DNA, 11 bp, Homo sapiens
tgtgtatgtgg

SEQ ID NO: 4983606 - DNA, 12 bp, Homo sapiens
tgtgtatgtggg

SEQ ID NO: 4983607 - DNA, 13 bp, Homo sapiens
tgtgtatgtgggg

SEQ ID NO: 4983608 - DNA, 15 bp, Homo sapiens
tgtgtgggagtgtgt

SEQ ID NO: 4983609 - DNA, 16 bp, Homo sapiens
tgtgtgggagtgtgta

SEQ ID NO: 4983610 - DNA, 20 bp, Homo sapiens
tgtgtgtgggagtgtgtaat

SEQ ID NO: 4983611 - DNA, 18 bp, Homo sapiens
tgtgtgttgtgtgtggga

SEQ ID NO: 4983612 - DNA, 14 bp, Homo sapiens
tgtgttgtgtgtgg

SEQ ID NO: 4983613 - DNA, 15 bp, Homo sapiens
tgtgtttatgtgtgt

SEQ ID NO: 4983614 - DNA, 20 bp, Homo sapiens
tgttatgggatgtaaacaat

SEQ ID NO: 4983615 - DNA, 21 bp, Homo sapiens
tgttccgtggttaaactcgct

SEQ ID NO: 4983616 - DNA, 16 bp, Homo sapiens
tgttgtgtgtgggagt

SEQ ID NO: 4983617 - DNA, 22 bp, Homo sapiens
tgtttaaaactcagaatataac

SEQ ID NO: 4983618 - DNA, 23 bp, Homo sapiens
tgtttacatatctgtcccctgct

SEQ ID NO: 4983619 - DNA, 16 bp, Homo sapiens
tgtttagaagaagtgt

SEQ ID NO: 4983620 - DNA, 19 bp, Homo sapiens
tgtttagaagaagtgtgtc

SEQ ID NO: 4983621 - DNA, 21 bp, Homo sapiens
ttaaaagatgcaatgtagagg

SEQ ID NO: 4983622 - DNA, 18 bp, Homo sapiens
ttaaaattgtgatgtgtc

SEQ ID NO: 4983623 - DNA, 21 bp, Homo sapiens
ttaatgaatattgatgttaac

SEQ ID NO: 4983624 - DNA, 22 bp, Homo sapiens
ttaatgaatattgatgttaaca

SEQ ID NO: 4983625 - DNA, 15 bp, Homo sapiens
ttacagaggacagta

SEQ ID NO: 4983626 - DNA, 13 bp, Homo sapiens
ttacagtgttccg

SEQ ID NO: 4983627 - DNA, 14 bp, Homo sapiens
ttactagctgtgca

SEQ ID NO: 4983628 - DNA, 16 bp, Homo sapiens
ttactttctctctcct

SEQ ID NO: 4983629 - DNA, 14 bp, Homo sapiens
ttagaagaagtgtg

SEQ ID NO: 4983630 - DNA, 16 bp, Homo sapiens
ttagcctttgtcccag

SEQ ID NO: 4983631 - DNA, 15 bp, Homo sapiens
ttaggggggaaagtc

SEQ ID NO: 4983632 - DNA, 21 bp, Homo sapiens
ttataaaatgggaagactgag

SEQ ID NO: 4983633 - DNA, 15 bp, Homo sapiens
ttatgggatgtaaac

SEQ ID NO: 4983634 - DNA, 17 bp, Homo sapiens
ttatgggatgtaaacaa

SEQ ID NO: 4983635 - DNA, 14 bp, Homo sapiens
ttatgtgtgtgtgt

SEQ ID NO: 4983636 - DNA, 18 bp, Homo sapiens
ttcactcttggagcctgc

SEQ ID NO: 4983637 - DNA, 16 bp, Homo sapiens
ttcagatttgccttat

SEQ ID NO: 4983638 - DNA, 21 bp, Homo sapiens
ttcatacagggatggtgttca

SEQ ID NO: 4983639 - DNA, 13 bp, Homo sapiens
ttccaagagcctg

SEQ ID NO: 4983640 - DNA, 22 bp, Homo sapiens
ttccaagagcctgagagtgagg

SEQ ID NO: 4983641 - DNA, 15 bp, Homo sapiens
ttccaagcatgacaa

SEQ ID NO: 4983642 - DNA, 18 bp, Homo sapiens
ttccctaccctaccccca

SEQ ID NO: 4983643 - DNA, 22 bp, Homo sapiens
ttccctcccaacagagctgggc

SEQ ID NO: 4983644 - DNA, 12 bp, Homo sapiens
ttccctgaggtg

SEQ ID NO: 4983645 - DNA, 18 bp, Homo sapiens
ttctcctttaaattcttt

SEQ ID NO: 4983646 - DNA, 13 bp, Homo sapiens
ttctcttcactca

SEQ ID NO: 4983647 - DNA, 12 bp, Homo sapiens
ttctcttctagg

SEQ ID NO: 4983648 - DNA, 14 bp, Homo sapiens
ttctctttaaaata

SEQ ID NO: 4983649 - DNA, 12 bp, Homo sapiens
ttcttgtgcctc

SEQ ID NO: 4983650 - DNA, 17 bp, Homo sapiens
ttcttgtgcctcggcct

SEQ ID NO: 4983651 - DNA, 13 bp, Homo sapiens
ttctttcctacct

SEQ ID NO: 4983652 - DNA, 13 bp, Homo sapiens
ttgaaaagaggtg

SEQ ID NO: 4983653 - DNA, 14 bp, Homo sapiens
ttgaaaagaggtgt

SEQ ID NO: 4983654 - DNA, 13 bp, Homo sapiens
ttgaactcctaac

SEQ ID NO: 4983655 - DNA, 20 bp, Homo sapiens
ttgacaaagtcaagccacat

SEQ ID NO: 4983656 - DNA, 13 bp, Homo sapiens
ttgatgttaacaa

SEQ ID NO: 4983657 - DNA, 18 bp, Homo sapiens
ttgcatgaattactgtat

SEQ ID NO: 4983658 - DNA, 22 bp, Homo sapiens
ttgcatgaattactgtatataa

SEQ ID NO: 4983659 - DNA, 15 bp, Homo sapiens
ttgctctaatgatca

SEQ ID NO: 4983660 - DNA, 11 bp, Homo sapiens
ttggaatgtta

SEQ ID NO: 4983661 - DNA, 18 bp, Homo sapiens
ttggagcctgcagagctg

SEQ ID NO: 4983662 - DNA, 17 bp, Homo sapiens
ttggattctgagagctg

SEQ ID NO: 4983663 - DNA, 16 bp, Homo sapiens
ttgggacccctggtgg

SEQ ID NO: 4983664 - DNA, 17 bp, Homo sapiens
ttgggtggggggcttca

SEQ ID NO: 4983665 - DNA, 18 bp, Homo sapiens
ttgtaaataaaggaacca

SEQ ID NO: 4983666 - DNA, 18 bp, Homo sapiens
ttgtccctgaagagaagg

SEQ ID NO: 4983667 - DNA, 15 bp, Homo sapiens
ttgtgcctcggcctc

SEQ ID NO: 4983668 - DNA, 20 bp, Homo sapiens
ttgtgtcagaaacatgaaat

SEQ ID NO: 4983669 - DNA, 20 bp, Homo sapiens
tttaaaactcagaatataac

SEQ ID NO: 4983670 - DNA, 17 bp, Homo sapiens
tttaaaggccctatctg

SEQ ID NO: 4983671 - DNA, 14 bp, Homo sapiens
tttaagggggaaaa

SEQ ID NO: 4983672 - DNA, 19 bp, Homo sapiens
tttacacacttgcatgaat

SEQ ID NO: 4983673 - DNA, 20 bp, Homo sapiens
tttacagaggacagtatttg

SEQ ID NO: 4983674 - DNA, 21 bp, Homo sapiens
tttactttctctctcctcttt

SEQ ID NO: 4983675 - DNA, 22 bp, Homo sapiens
tttagttttaaaagtctatgat

SEQ ID NO: 4983676 - DNA, 22 bp, Homo sapiens
tttatcatgtcgtaggtaaact

SEQ ID NO: 4983677 - DNA, 20 bp, Homo sapiens
tttcatttagtgctaaacaa

SEQ ID NO: 4983678 - DNA, 18 bp, Homo sapiens
tttccactcctcctagcc

SEQ ID NO: 4983679 - DNA, 19 bp, Homo sapiens
tttccactcctcctagcca

SEQ ID NO: 4983680 - DNA, 21 bp, Homo sapiens
tttctaaatgttggaatgtta

SEQ ID NO: 4983681 - DNA, 21 bp, Homo sapiens
tttgagccttagttttttcat

SEQ ID NO: 4983682 - DNA, 12 bp, Homo sapiens
tttgcattgtgt

SEQ ID NO: 4983683 - DNA, 18 bp, Homo sapiens
tttgcattgtgtcagaaa

SEQ ID NO: 4983684 - DNA, 23 bp, Homo sapiens
tttggcaaactctccaccacacg

SEQ ID NO: 4983685 - DNA, 17 bp, Homo sapiens
tttgtaaaataaaacca

SEQ ID NO: 4983686 - DNA, 20 bp, Homo sapiens
ttttaaaagatgcaatgtag

SEQ ID NO: 4983687 - DNA, 15 bp, Homo sapiens
ttttaagggggaaaa

SEQ ID NO: 4983688 - DNA, 21 bp, Homo sapiens
ttttaatgaatattgatgtta

SEQ ID NO: 4983689 - DNA, 16 bp, Homo sapiens
ttttatttataaacta

SEQ ID NO: 4983690 - DNA, 17 bp, Homo sapiens
ttttatttataaactag

SEQ ID NO: 4983691 - DNA, 21 bp, Homo sapiens
ttttatttttctcatgatgag

SEQ ID NO: 4983692 - DNA, 13 bp, Homo sapiens
ttttcccccagca

SEQ ID NO: 4983693 - DNA, 22 bp, Homo sapiens
tcttactctactgctgctgaca

SEQ ID NO: 4983694 - DNA, 14 bp, Homo sapiens
tcttatctctagct

SEQ ID NO: 4983695 - DNA, 13 bp, Homo sapiens
tcttccaattatt

SEQ ID NO: 4983696 - DNA, 12 bp, Homo sapiens
tcttggagcctg

SEQ ID NO: 4983697 - DNA, 19 bp, Homo sapiens
tcttggagcctgcagagct

SEQ ID NO: 4983698 - DNA, 13 bp, Homo sapiens
tcttggttccagc

SEQ ID NO: 4983699 - DNA, 20 bp, Homo sapiens
tcttgtttctgaagtactta

SEQ ID NO: 4983700 - DNA, 11 bp, Homo sapiens
tctttaaacag

SEQ ID NO: 4983701 - DNA, 23 bp, Homo sapiens
tctttaaacagcaactacagaag

SEQ ID NO: 4983702 - DNA, 16 bp, Homo sapiens
tgaaaacaagcctcca

SEQ ID NO: 4983703 - DNA, 13 bp, Homo sapiens
tgaaaatatttaa

SEQ ID NO: 4983704 - DNA, 14 bp, Homo sapiens
tgaaaatatttaaa

SEQ ID NO: 4983705 - DNA, 22 bp, Homo sapiens
tgaacagcggctggacttggag

SEQ ID NO: 4983706 - DNA, 15 bp, Homo sapiens
tgaaccttcaaagct

SEQ ID NO: 4983707 - DNA, 16 bp, Homo sapiens
tgaactgagcttggaa

SEQ ID NO: 4983708 - DNA, 22 bp, Homo sapiens
tgaagagaagggcagggctgag

SEQ ID NO: 4983709 - DNA, 16 bp, Homo sapiens
tgaaggaaccaaagcg

SEQ ID NO: 4983710 - DNA, 20 bp, Homo sapiens
tgaagtacttaaacttccac

SEQ ID NO: 4983711 - DNA, 15 bp, Homo sapiens
tgaatattgatgtta

SEQ ID NO: 4983712 - DNA, 14 bp, Homo sapiens
tgaatgtatgcttc

SEQ ID NO: 4983713 - DNA, 19 bp, Homo sapiens
tgaatgtatgcttcataca

SEQ ID NO: 4983714 - DNA, 20 bp, Homo sapiens
tgaatgtatgcttcatacag

SEQ ID NO: 4983715 - DNA, 15 bp, Homo sapiens
tgacaggtttgggac

SEQ ID NO: 4983716 - DNA, 23 bp, Homo sapiens
tgacccactgcgcacagccccag

SEQ ID NO: 4983717 - DNA, 19 bp, Homo sapiens
tgacctaggcaagtttgtt

SEQ ID NO: 4983718 - DNA, 17 bp, Homo sapiens
aaaagtaatctttaaac

SEQ ID NO: 4983719 - DNA, 22 bp, Homo sapiens
aaaataaaaccaccaaagtcct

SEQ ID NO: 4983720 - DNA, 14 bp, Homo sapiens
aaaatatttaaagg

SEQ ID NO: 4983721 - DNA, 19 bp, Homo sapiens
aaaatatttgtctttaaac

SEQ ID NO: 4983722 - DNA, 15 bp, Homo sapiens
aaaatgggaagactg

SEQ ID NO: 4983723 - DNA, 19 bp, Homo sapiens
aaaatgggaagactgagct

SEQ ID NO: 4983724 - DNA, 15 bp, Homo sapiens
agcctgcagagctgc

SEQ ID NO: 4983725 - DNA, 15 bp, Homo sapiens
agcctggtcagccca

SEQ ID NO: 4983726 - DNA, 22 bp, Homo sapiens
agccttagttttttcatctgta

SEQ ID NO: 4983727 - DNA, 13 bp, Homo sapiens
agcgaattttaaa

SEQ ID NO: 4983728 - DNA, 17 bp, Homo sapiens
agcggctggacttggag

SEQ ID NO: 4983729 - DNA, 21 bp, Homo sapiens
agcggctggacttggaggtag

SEQ ID NO: 4983730 - DNA, 14 bp, Homo sapiens
agctcagacatcta

SEQ ID NO: 4983731 - DNA, 17 bp, Homo sapiens
agctgggagtacaggcg

SEQ ID NO: 4983732 - DNA, 17 bp, Homo sapiens
agctgggattacaggcg

SEQ ID NO: 4983733 - DNA, 20 bp, Homo sapiens
agctttggctatgagggcct

SEQ ID NO: 4983734 - DNA, 20 bp, Homo sapiens
agctttgggttggagctgtt

SEQ ID NO: 4983735 - DNA, 13 bp, Homo sapiens
aggaaccaaagcg

SEQ ID NO: 4983736 - DNA, 15 bp, Homo sapiens
aggaaccaaagcgaa

SEQ ID NO: 4983737 - DNA, 16 bp, Homo sapiens
aggaactgctgggctt

SEQ ID NO: 4983738 - DNA, 15 bp, Homo sapiens
aggcaagtttgttca

SEQ ID NO: 4983739 - DNA, 13 bp, Homo sapiens
aggcaggtcccca

SEQ ID NO: 4983740 - DNA, 14 bp, Homo sapiens
aggcaggtccccag

SEQ ID NO: 4983741 - DNA, 16 bp, Homo sapiens
aggcaggtccccagac

SEQ ID NO: 4983742 - DNA, 12 bp, Homo sapiens
aggcccaaagcc

SEQ ID NO: 4983743 - DNA, 15 bp, Homo sapiens
aggcccaaagcctcg

SEQ ID NO: 4983744 - DNA, 19 bp, Homo sapiens
aggctatggggatagatgt

SEQ ID NO: 4983745 - DNA, 12 bp, Homo sapiens
aggctgcagtgc

SEQ ID NO: 4983746 - DNA, 13 bp, Homo sapiens
aggctgctttcca

SEQ ID NO: 4983747 - DNA, 15 bp, Homo sapiens
aggctgctttccaaa

SEQ ID NO: 4983748 - DNA, 19 bp, Homo sapiens
aggctgctttccaaagcca

SEQ ID NO: 4983749 - DNA, 21 bp, Homo sapiens
agggaaataatagggaaaata

SEQ ID NO: 4983750 - DNA, 16 bp, Homo sapiens
agggatggtgttcaaa

SEQ ID NO: 4983751 - DNA, 22 bp, Homo sapiens
agggatttggggctcagagtgg

SEQ ID NO: 4983752 - DNA, 12 bp, Homo sapiens
aggggcaggagg

SEQ ID NO: 4983753 - DNA, 21 bp, Homo sapiens
aggggtggtgtccttctcctc

SEQ ID NO: 4983754 - DNA, 11 bp, Homo sapiens
aggtccccaga

SEQ ID NO: 4983755 - DNA, 18 bp, Homo sapiens
aggtgcccagaatgaggc

SEQ ID NO: 4983756 - DNA, 22 bp, Homo sapiens
aggtgcccagaatgaggctgct

SEQ ID NO: 4983757 - DNA, 17 bp, Homo sapiens
aggtggaattattttaa

SEQ ID NO: 4983758 - DNA, 14 bp, Homo sapiens
aggtgtgcaagaga

SEQ ID NO: 4983759 - DNA, 23 bp, Homo sapiens
aggttgggagaatgtcagtatgt

SEQ ID NO: 4983760 - DNA, 23 bp, Homo sapiens
aggtttgtttagaagaagtgtgt

SEQ ID NO: 4983761 - DNA, 21 bp, Homo sapiens
agtagctgggagtacaggcgt

SEQ ID NO: 4983762 - DNA, 19 bp, Homo sapiens
agtatgtggaagtgtgggt

SEQ ID NO: 4983763 - DNA, 19 bp, Homo sapiens
agtccctgaggcaggtccc

SEQ ID NO: 4983764 - DNA, 14 bp, Homo sapiens
agtcctcattataa

SEQ ID NO: 4983765 - DNA, 19 bp, Homo sapiens
agtgataattttatttata

SEQ ID NO: 4983766 - DNA, 21 bp, Homo sapiens
agtgcacctcaaatcttctaa

SEQ ID NO: 4983767 - DNA, 24 bp, Homo sapiens
agtgcagtggcacgatctcggctc

SEQ ID NO: 4983768 - DNA, 20 bp, Homo sapiens
agtgctgggattacaggtgt

SEQ ID NO: 4983769 - DNA, 16 bp, Homo sapiens
agtggctggatctgtg

SEQ ID NO: 4983770 - DNA, 16 bp, Homo sapiens
agtggggtaggttggg

SEQ ID NO: 4983771 - DNA, 13 bp, Homo sapiens
agtgtctggctgc

SEQ ID NO: 4983772 - DNA, 16 bp, Homo sapiens
agtgtctttccactcc

SEQ ID NO: 4983773 - DNA, 16 bp, Homo sapiens
agtgtggcagtttggc

SEQ ID NO: 4983774 - DNA, 17 bp, Homo sapiens
agtgtggcagtttggca

SEQ ID NO: 4983775 - DNA, 21 bp, Homo sapiens
agtgttccgtggttaaactcg

SEQ ID NO: 4983776 - DNA, 14 bp, Homo sapiens
ataaactaggtaaa

SEQ ID NO: 4983777 - DNA, 18 bp, Homo sapiens
ataaactccttaacttca

SEQ ID NO: 4983778 - DNA, 20 bp, Homo sapiens
ataaactccttaacttcagg

SEQ ID NO: 4983779 - DNA, 13 bp, Homo sapiens
ataaacttcagag

SEQ ID NO: 4983780 - DNA, 18 bp, Homo sapiens
ataataacagcaccccat

SEQ ID NO: 4983781 - DNA, 14 bp, Homo sapiens
ataatagggaaaat

SEQ ID NO: 4983782 - DNA, 18 bp, Homo sapiens
ataatcacaacccttcag

SEQ ID NO: 4983783 - DNA, 11 bp, Homo sapiens
atagatgtgtg

SEQ ID NO: 4983784 - DNA, 15 bp, Homo sapiens
atatatatatatatt

SEQ ID NO: 4983785 - DNA, 17 bp, Homo sapiens
atatgatgggggaaaaa

SEQ ID NO: 4983786 - DNA, 17 bp, Homo sapiens
atatgcagattttgccc

SEQ ID NO: 4983787 - DNA, 15 bp, Homo sapiens
atatgtaagtacttc

SEQ ID NO: 4983788 - DNA, 17 bp, Homo sapiens
atattaggggggaaagt

SEQ ID NO: 4983789 - DNA, 17 bp, Homo sapiens
atatttgtctttaaaca

SEQ ID NO: 4983790 - DNA, 23 bp, Homo sapiens
atcatgtttacagaggacagtat

SEQ ID NO: 4983791 - DNA, 22 bp, Homo sapiens
atcattggattctgagagctgt

SEQ ID NO: 4983792 - DNA, 20 bp, Homo sapiens
atccaaagttgccacagatg

SEQ ID NO: 4983793 - DNA, 18 bp, Homo sapiens
atccacccaccttggcct

SEQ ID NO: 4983794 - DNA, 20 bp, Homo sapiens
atccatggggctgattgtat

SEQ ID NO: 4983795 - DNA, 20 bp, Homo sapiens
atcccatctattctctgcct

SEQ ID NO: 4983796 - DNA, 15 bp, Homo sapiens
atcccatctgctaga

SEQ ID NO: 4983797 - DNA, 14 bp, Homo sapiens
atccccctctgtct

SEQ ID NO: 4983798 - DNA, 23 bp, Homo sapiens
atccccctctgtctgccctcaca

SEQ ID NO: 4983799 - DNA, 15 bp, Homo sapiens
atccgcctgcctctg

SEQ ID NO: 4983800 - DNA, 18 bp, Homo sapiens
atccgcctgcctctgcct

SEQ ID NO: 4983801 - DNA, 23 bp, Homo sapiens
atcctgtgccagaggaaggaaaa

SEQ ID NO: 4983802 - DNA, 16 bp, Homo sapiens
atctcagctcactgca

SEQ ID NO: 4983803 - DNA, 21 bp, Homo sapiens
atctcgctgtaagatttgtca

SEQ ID NO: 4983804 - DNA, 15 bp, Homo sapiens
atctcggctcactgc

SEQ ID NO: 4983805 - DNA, 22 bp, Homo sapiens
atctctgcaggaaatggctgtg

SEQ ID NO: 4983806 - DNA, 17 bp, Homo sapiens
atctgtttacagtgttc

SEQ ID NO: 4983807 - DNA, 18 bp, Homo sapiens
atcttactctactgctgc

SEQ ID NO: 4983808 - DNA, 13 bp, Homo sapiens
atgaaaatattta

SEQ ID NO: 4983809 - DNA, 14 bp, Homo sapiens
atgaaaatatttaa

SEQ ID NO: 4983810 - DNA, 19 bp, Homo sapiens
atgacaacttttaaagaaa

SEQ ID NO: 4983811 - DNA, 20 bp, Homo sapiens
atgagggtcttggttccagc

SEQ ID NO: 4983812 - DNA, 18 bp, Homo sapiens
atgagttggctgggaata

SEQ ID NO: 4983813 - DNA, 16 bp, Homo sapiens
atgatcaaaacatgct

SEQ ID NO: 4983814 - DNA, 18 bp, Homo sapiens
atgatctggacttcctat

SEQ ID NO: 4983815 - DNA, 15 bp, Homo sapiens
atgatgaaaatattt

SEQ ID NO: 4983816 - DNA, 16 bp, Homo sapiens
atgatgggtcagttgt

SEQ ID NO: 4983817 - DNA, 19 bp, Homo sapiens
atgcttcatacagggatgg

SEQ ID NO: 4983818 - DNA, 17 bp, Homo sapiens
atggcctccagaggagg

SEQ ID NO: 4983819 - DNA, 16 bp, Homo sapiens
atggcctgggggatgt

SEQ ID NO: 4983820 - DNA, 22 bp, Homo sapiens
atggtctcgatatcctgatctc

SEQ ID NO: 4983821 - DNA, 14 bp, Homo sapiens
atgtatgcttcata

SEQ ID NO: 4983822 - DNA, 15 bp, Homo sapiens
atgtatgcttcatac

SEQ ID NO: 4983823 - DNA, 20 bp, Homo sapiens
atgtatgcttcatacaggga

SEQ ID NO: 4983824 - DNA, 23 bp, Homo sapiens
atgtggaaaagccaagaggctgc

SEQ ID NO: 4983825 - DNA, 16 bp, Homo sapiens
atgtggaagtgtgggt

SEQ ID NO: 4983826 - DNA, 22 bp, Homo sapiens
atgtggaagtgtgggtctgtgt

SEQ ID NO: 4983827 - DNA, 17 bp, Homo sapiens
atgtgggggtctgtgtg

SEQ ID NO: 4983828 - DNA, 18 bp, Homo sapiens
atgtgtgtgtgttgtgtg

SEQ ID NO: 4983829 - DNA, 22 bp, Homo sapiens
atgtgtgtgtgttgtgtgtggg

SEQ ID NO: 4983830 - DNA, 15 bp, Homo sapiens
atgttgaccattcca

SEQ ID NO: 4983831 - DNA, 20 bp, Homo sapiens
attaggcttcattgcactga

SEQ ID NO: 4983832 - DNA, 21 bp, Homo sapiens
attattccttcttactctcct

SEQ ID NO: 4983833 - DNA, 23 bp, Homo sapiens
attattccttcttactctcctct

SEQ ID NO: 4983834 - DNA, 13 bp, Homo sapiens
attattttaaaag

SEQ ID NO: 4983835 - DNA, 12 bp, Homo sapiens
attccagaggaa

SEQ ID NO: 4983836 - DNA, 22 bp, Homo sapiens
attccttcttactctcctcttc

SEQ ID NO: 4983837 - DNA, 19 bp, Homo sapiens
attggattctgagagctgt

SEQ ID NO: 4983838 - DNA, 21 bp, Homo sapiens
attggctcttgaactgagctt

SEQ ID NO: 4983839 - DNA, 16 bp, Homo sapiens
attgggcccctgccag

SEQ ID NO: 4983840 - DNA, 21 bp, Homo sapiens
ctgcattttaacaagcacccc

SEQ ID NO: 4983841 - DNA, 17 bp, Homo sapiens
ctgccagaccccctgga

SEQ ID NO: 4983842 - DNA, 22 bp, Homo sapiens
ctgccatcatgtttacagagga

SEQ ID NO: 4983843 - DNA, 23 bp, Homo sapiens
ctgccatcatgtttacagaggac

SEQ ID NO: 4983844 - DNA, 14 bp, Homo sapiens
ctgcctaataaaga

SEQ ID NO: 4983845 - DNA, 14 bp, Homo sapiens
ctgcctctttgagt

SEQ ID NO: 4983846 - DNA, 17 bp, Homo sapiens
ctgcctggtcctcacac

SEQ ID NO: 4983847 - DNA, 16 bp, Homo sapiens
ctgcgcacagccccag

SEQ ID NO: 4983848 - DNA, 15 bp, Homo sapiens
ctgctcatccaaagt

SEQ ID NO: 4983849 - DNA, 17 bp, Homo sapiens
ctgctcatccaaagttg

SEQ ID NO: 4983850 - DNA, 13 bp, Homo sapiens
ctgctgctgacat

SEQ ID NO: 4983851 - DNA, 17 bp, Homo sapiens
ctggagactaaccccac

SEQ ID NO: 4983852 - DNA, 19 bp, Homo sapiens
ctggagttcagcagtgatg

SEQ ID NO: 4983853 - DNA, 20 bp, Homo sapiens
ctggattcaattcctgtcct

SEQ ID NO: 4983854 - DNA, 21 bp, Homo sapiens
ctggattcaattcctgtcctt

SEQ ID NO: 4983855 - DNA, 16 bp, Homo sapiens
ctggctccaggccagg

SEQ ID NO: 4983856 - DNA, 14 bp, Homo sapiens
ctggcttgaacctt

SEQ ID NO: 4983857 - DNA, 19 bp, Homo sapiens
ctgggagcctacccacccc

SEQ ID NO: 4983858 - DNA, 22 bp, Homo sapiens
ctgggagcctacccacccccag

SEQ ID NO: 4983859 - DNA, 15 bp, Homo sapiens
ctgggccccaggcac

SEQ ID NO: 4983860 - DNA, 16 bp, Homo sapiens
ctggggatgtctctca

SEQ ID NO: 4983861 - DNA, 12 bp, Homo sapiens
ctggtcagccca

SEQ ID NO: 4983862 - DNA, 12 bp, Homo sapiens
ctggtggttcac

SEQ ID NO: 4983863 - DNA, 21 bp, Homo sapiens
ctggtggttcactcttggagc

SEQ ID NO: 4983864 - DNA, 14 bp, Homo sapiens
ctgtcacccaggct

SEQ ID NO: 4983865 - DNA, 16 bp, Homo sapiens
ctgtcacccaggctgc

SEQ ID NO: 4983866 - DNA, 22 bp, Homo sapiens
ctgtcacccaggctgcagtgca

SEQ ID NO: 4983867 - DNA, 14 bp, Homo sapiens
ctgttataattatt

SEQ ID NO: 4983868 - DNA, 14 bp, Homo sapiens
ctgttgccagactg

SEQ ID NO: 4983869 - DNA, 21 bp, Homo sapiens
ctgttgccagactggagtgca

SEQ ID NO: 4983870 - DNA, 14 bp, Homo sapiens
ctgtttaatttaca

SEQ ID NO: 4983871 - DNA, 16 bp, Homo sapiens
cttaatgtctttgagc

SEQ ID NO: 4983872 - DNA, 14 bp, Homo sapiens
cttagaggaaaagg

SEQ ID NO: 4983873 - DNA, 15 bp, Homo sapiens
cttagaggaaaaggg

SEQ ID NO: 4983874 - DNA, 17 bp, Homo sapiens
cttcaagattccatttc

SEQ ID NO: 4983875 - DNA, 18 bp, Homo sapiens
cttcaataaattttttct

SEQ ID NO: 4983876 - DNA, 13 bp, Homo sapiens
cttcatacaggga

SEQ ID NO: 4983877 - DNA, 21 bp, Homo sapiens
cttccaattattacagtcctt

SEQ ID NO: 4983878 - DNA, 12 bp, Homo sapiens
cttcctataata

SEQ ID NO: 4983879 - DNA, 11 bp, Homo sapiens
cttctcctctt

SEQ ID NO: 4983880 - DNA, 18 bp, Homo sapiens
cttctggtgaccttccaa

SEQ ID NO: 4983881 - DNA, 15 bp, Homo sapiens
cttgacctctataaa

SEQ ID NO: 4983882 - DNA, 14 bp, Homo sapiens
cttgatatgtaagt

SEQ ID NO: 4983883 - DNA, 19 bp, Homo sapiens
cttggagcctgcagagctg

SEQ ID NO: 4983884 - DNA, 17 bp, Homo sapiens
cttggaggtagctttga

SEQ ID NO: 4983885 - DNA, 20 bp, Homo sapiens
cttggggacaggggcaggag

SEQ ID NO: 4983886 - DNA, 17 bp, Homo sapiens
cttggttccagcctgcc

SEQ ID NO: 4983887 - DNA, 16 bp, Homo sapiens
ctttgaggtggaagag

SEQ ID NO: 4983888 - DNA, 17 bp, Homo sapiens
ctttgaggtggaagagg

SEQ ID NO: 4983889 - DNA, 21 bp, Homo sapiens
ctttgatgtcaaacgccttga

SEQ ID NO: 4983890 - DNA, 22 bp, Homo sapiens
cttttaaagaaaaatatgatac

SEQ ID NO: 4983891 - DNA, 22 bp, Homo sapiens
gaaaactgttctctttaaaata

SEQ ID NO: 4983892 - DNA, 21 bp, Homo sapiens
gaaaatacctattttatatga

SEQ ID NO: 4983893 - DNA, 13 bp, Homo sapiens
gaaaatatttaaa

SEQ ID NO: 4983894 - DNA, 16 bp, Homo sapiens
gaaataatagggaaaa

SEQ ID NO: 4983895 - DNA, 18 bp, Homo sapiens
gaaatctatgattccagg

SEQ ID NO: 4983896 - DNA, 20 bp, Homo sapiens
gaaccaaagcgaattttaaa

SEQ ID NO: 4983897 - DNA, 14 bp, Homo sapiens
gaactgagcttgga

SEQ ID NO: 4983898 - DNA, 16 bp, Homo sapiens
gaactgagcttggaag

SEQ ID NO: 4983899 - DNA, 21 bp, Homo sapiens
gaactgagcttggaagcttct

SEQ ID NO: 4983900 - DNA, 20 bp, Homo sapiens
gaactgctgggcttggcagc

SEQ ID NO: 4983901 - DNA, 13 bp, Homo sapiens
gaagaagtgtgtc

SEQ ID NO: 4983902 - DNA, 12 bp, Homo sapiens
gaagcccagaat

SEQ ID NO: 4983903 - DNA, 22 bp, Homo sapiens
gaagcttctggtgaccttccaa

SEQ ID NO: 4983904 - DNA, 18 bp, Homo sapiens
gaagtgcttgatatgtaa

SEQ ID NO: 4983905 - DNA, 20 bp, Homo sapiens
gaataagtgccaggatggaa

SEQ ID NO: 4983906 - DNA, 15 bp, Homo sapiens
gaatataacatgtaa

SEQ ID NO: 4983907 - DNA, 17 bp, Homo sapiens
gaatataacatgtaaaa

SEQ ID NO: 4983908 - DNA, 16 bp, Homo sapiens
gaatgtatgcttcata

SEQ ID NO: 4983909 - DNA, 18 bp, Homo sapiens
gaatgtcagtatgtggaa

SEQ ID NO: 4983910 - DNA, 19 bp, Homo sapiens
gaattctggacaacccaag

SEQ ID NO: 4983911 - DNA, 23 bp, Homo sapiens
gaattgggtggggggcttcatac

SEQ ID NO: 4983912 - DNA, 23 bp, Homo sapiens
gaattttaaaagatgcaatgtag

SEQ ID NO: 4983913 - DNA, 20 bp, Homo sapiens
gacaggggcaggaggaaggg

SEQ ID NO: 4983914 - DNA, 16 bp, Homo sapiens
gaccctttctccacag

SEQ ID NO: 4983915 - DNA, 14 bp, Homo sapiens
gacctcacctccat

SEQ ID NO: 4983916 - DNA, 17 bp, Homo sapiens
gacctttcctgaggaag

SEQ ID NO: 4983917 - DNA, 16 bp, Homo sapiens
gactggagtgcagtgg

SEQ ID NO: 4983918 - DNA, 18 bp, Homo sapiens
gacttttgaaaagaggtg

SEQ ID NO: 4983919 - DNA, 15 bp, Homo sapiens
gagagtgaggtggaa

SEQ ID NO: 4983920 - DNA, 17 bp, Homo sapiens
gagcctacccaccccca

SEQ ID NO: 4983921 - DNA, 21 bp, Homo sapiens
gagccttagttttttcatctg

SEQ ID NO: 4983922 - DNA, 15 bp, Homo sapiens
gagccttgctctgtt

SEQ ID NO: 4983923 - DNA, 22 bp, Homo sapiens
gaggaaggaaaaggaggaaatt

SEQ ID NO: 4983924 - DNA, 22 bp, Homo sapiens
gaggcctctcattccagaggaa

SEQ ID NO: 4983925 - DNA, 19 bp, Homo sapiens
gaggctgcagccaggccac

SEQ ID NO: 4983926 - DNA, 23 bp, Homo sapiens
gagggttgggcgtgctacctgca

SEQ ID NO: 4983927 - DNA, 21 bp, Homo sapiens
gaggtagctttgaggtggaag

SEQ ID NO: 4983928 - DNA, 20 bp, Homo sapiens
gaggtggaagagggctgcaa

SEQ ID NO: 4983929 - DNA, 22 bp, Homo sapiens
gaggtttgtttagaagaagtgt

SEQ ID NO: 4983930 - DNA, 19 bp, Homo sapiens
gagtatacctcctatatgt

SEQ ID NO: 4983931 - DNA, 17 bp, Homo sapiens
gagtgaatttgacctag

SEQ ID NO: 4983932 - DNA, 19 bp, Homo sapiens
gagtggactgttccctgag

SEQ ID NO: 4983933 - DNA, 15 bp, Homo sapiens
gataaatattatatt

SEQ ID NO: 4983934 - DNA, 22 bp, Homo sapiens
gataattttatttataaactag

SEQ ID NO: 4983935 - DNA, 13 bp, Homo sapiens
gatagatgtgtgg

SEQ ID NO: 4983936 - DNA, 21 bp, Homo sapiens
gatccacccaccttggcctcc

SEQ ID NO: 4983937 - DNA, 23 bp, Homo sapiens
gatctcagtggttaagattccta

SEQ ID NO: 4983938 - DNA, 19 bp, Homo sapiens
gatcttactctactgctgc

SEQ ID NO: 4983939 - DNA, 15 bp, Homo sapiens
gatgaaaatatttaa

SEQ ID NO: 4983940 - DNA, 16 bp, Homo sapiens
gatgaaaatatttaaa

SEQ ID NO: 4983941 - DNA, 18 bp, Homo sapiens
gatgatttggtcagattg

SEQ ID NO: 4983942 - DNA, 21 bp, Homo sapiens
gatgggtcagttgtatcagca

SEQ ID NO: 4983943 - DNA, 23 bp, Homo sapiens
gatggtctcgatatcctgatctc

SEQ ID NO: 4983944 - DNA, 23 bp, Homo sapiens
gatgtggaaaagccaagaggctg

SEQ ID NO: 4983945 - DNA, 20 bp, Homo sapiens
gatgttaacaagaggggaaa

SEQ ID NO: 4983946 - DNA, 23 bp, Homo sapiens
gattgcaggagtccctgccatca

SEQ ID NO: 4983947 - DNA, 17 bp, Homo sapiens
gattgggcccctgccag

SEQ ID NO: 4983948 - DNA, 20 bp, Homo sapiens
gatttggggctcagagtggg

SEQ ID NO: 4983949 - DNA, 19 bp, Homo sapiens
gcaacctccacctccgggt

SEQ ID NO: 4983950 - DNA, 18 bp, Homo sapiens
gcaactacagaagtggaa

SEQ ID NO: 4983951 - DNA, 15 bp, Homo sapiens
gcaccccctggcttg

SEQ ID NO: 4983952 - DNA, 21 bp, Homo sapiens
gcagagcagtgggcctggcca

SEQ ID NO: 4983953 - DNA, 19 bp, Homo sapiens
gcagagctgcgggctgggt

SEQ ID NO: 4983954 - DNA, 13 bp, Homo sapiens
gcaggtccccaga

SEQ ID NO: 4983955 - DNA, 18 bp, Homo sapiens
gcattatatttgtaaatt

SEQ ID NO: 4983956 - DNA, 20 bp, Homo sapiens
gcattgtgtcagaaacatga

SEQ ID NO: 4983957 - DNA, 13 bp, Homo sapiens
gccaagaggctgc

SEQ ID NO: 4983958 - DNA, 21 bp, Homo sapiens
gccatcatgtttacagaggac

SEQ ID NO: 4983959 - DNA, 16 bp, Homo sapiens
gcctacccacccccag

SEQ ID NO: 4983960 - DNA, 15 bp, Homo sapiens
gcctcagcctcccaa

SEQ ID NO: 4983961 - DNA, 20 bp, Homo sapiens
gcctctcattccagaggaag

SEQ ID NO: 4983962 - DNA, 15 bp, Homo sapiens
gcctctgcctcccaa

SEQ ID NO: 4983963 - DNA, 20 bp, Homo sapiens
gcctgcagagctgcgggctg

SEQ ID NO: 4983964 - DNA, 15 bp, Homo sapiens
gcctggtcagcccaa

SEQ ID NO: 4983965 - DNA, 17 bp, Homo sapiens
gcctggtcctcacactc

SEQ ID NO: 4983966 - DNA, 14 bp, Homo sapiens
gcgaattttaaaag

SEQ ID NO: 4983967 - DNA, 16 bp, Homo sapiens
gcgaattttaaaagat

SEQ ID NO: 4983968 - DNA, 22 bp, Homo sapiens
gctaattctttgacctgttggg

SEQ ID NO: 4983969 - DNA, 22 bp, Homo sapiens
gctaccccccctcctgctgcct

SEQ ID NO: 4983970 - DNA, 19 bp, Homo sapiens
gctatggggatagatgtgt

SEQ ID NO: 4983971 - DNA, 18 bp, Homo sapiens
gctcactgcaacctccac

SEQ ID NO: 4983972 - DNA, 14 bp, Homo sapiens
gctgattgtattta

SEQ ID NO: 4983973 - DNA, 20 bp, Homo sapiens
gctgcagagcagtgggcctg

SEQ ID NO: 4983974 - DNA, 19 bp, Homo sapiens
gctgcctaataaagagact

SEQ ID NO: 4983975 - DNA, 22 bp, Homo sapiens
gctgggctaccccccctcctgc

SEQ ID NO: 4983976 - DNA, 16 bp, Homo sapiens
gctgtgtgctctccaa

SEQ ID NO: 4983977 - DNA, 19 bp, Homo sapiens
gcttctggtgaccttccaa

SEQ ID NO: 4983978 - DNA, 22 bp, Homo sapiens
ggaaccaaagcgaattttaaaa

SEQ ID NO: 4983979 - DNA, 15 bp, Homo sapiens
ggaactgctgggctt

SEQ ID NO: 4983980 - DNA, 23 bp, Homo sapiens
ggaagggacaccaagccttggct

SEQ ID NO: 4983981 - DNA, 16 bp, Homo sapiens
ggaattattttaaaag

SEQ ID NO: 4983982 - DNA, 17 bp, Homo sapiens
ggaattattttaaaaga

SEQ ID NO: 4983983 - DNA, 17 bp, Homo sapiens
ggacaggggcaggagga

SEQ ID NO: 4983984 - DNA, 17 bp, Homo sapiens
ggagcctgcagagctgc

SEQ ID NO: 4983985 - DNA, 12 bp, Homo sapiens
ggagggatttgg

SEQ ID NO: 4983986 - DNA, 11 bp, Homo sapiens
ggagtgtgtaa

SEQ ID NO: 4983987 - DNA, 13 bp, Homo sapiens
ggatagatgtgtg

SEQ ID NO: 4983988 - DNA, 15 bp, Homo sapiens
ggattcaattcctgt

SEQ ID NO: 4983989 - DNA, 17 bp, Homo sapiens
ggattgagataatctaa

SEQ ID NO: 4983990 - DNA, 17 bp, Homo sapiens
ggcccctgagatctctg

SEQ ID NO: 4983991 - DNA, 12 bp, Homo sapiens
ggccctgtgcct

SEQ ID NO: 4983992 - DNA, 16 bp, Homo sapiens
ggcctgactctcagca

SEQ ID NO: 4983993 - DNA, 21 bp, Homo sapiens
ggctatggggatagatgtgtg

SEQ ID NO: 4983994 - DNA, 18 bp, Homo sapiens
ggctccaggccagggggc

SEQ ID NO: 4983995 - DNA, 22 bp, Homo sapiens
ggctcctcactcccagttccct

SEQ ID NO: 4983996 - DNA, 18 bp, Homo sapiens
ggctcttgaactgagctt

SEQ ID NO: 4983997 - DNA, 19 bp, Homo sapiens
ggctcttgaactgagcttg

SEQ ID NO: 4983998 - DNA, 20 bp, Homo sapiens
ggctcttgaactgagcttgg

SEQ ID NO: 4983999 - DNA, 16 bp, Homo sapiens
ggctgcagccaggcca

SEQ ID NO: 4984000 - DNA, 15 bp, Homo sapiens
ggctgctttccaaag

SEQ ID NO: 4984001 - DNA, 9 bp, Homo sapiens
ggcttcata

SEQ ID NO: 4984002 - DNA, 11 bp, Homo sapiens
ggcttcataca

SEQ ID NO: 4984003 - DNA, 12 bp, Homo sapiens
ggcttgaacctt

SEQ ID NO: 4984004 - DNA, 17 bp, Homo sapiens
gggacaggggcaggagg

SEQ ID NO: 4984005 - DNA, 16 bp, Homo sapiens
gggatggtgttcaaaa

SEQ ID NO: 4984006 - DNA, 14 bp, Homo sapiens
gggatgtctctcat

SEQ ID NO: 4984007 - DNA, 15 bp, Homo sapiens
gggcacataacttaa

SEQ ID NO: 4984008 - DNA, 23 bp, Homo sapiens
gggctaccccccctcctgctgcc

SEQ ID NO: 4984009 - DNA, 19 bp, Homo sapiens
gggcttcatacacatgaga

SEQ ID NO: 4984010 - DNA, 15 bp, Homo sapiens
ggggaaaagagatga

SEQ ID NO: 4984011 - DNA, 16 bp, Homo sapiens
ggtaggaactgctggg

SEQ ID NO: 4984012 - DNA, 17 bp, Homo sapiens
ggtctgtgtgtgtgtat

SEQ ID NO: 4984013 - DNA, 20 bp, Homo sapiens
ggtcttggttccagcctgcc

SEQ ID NO: 4984014 - DNA, 16 bp, Homo sapiens
ggtggggggcttcata

SEQ ID NO: 4984015 - DNA, 18 bp, Homo sapiens
ggtggggggcttcataca

SEQ ID NO: 4984016 - DNA, 14 bp, Homo sapiens
ggtgtccttctcct

SEQ ID NO: 4984017 - DNA, 17 bp, Homo sapiens
ggtgtccttctcctctt

SEQ ID NO: 4984018 - DNA, 14 bp, Homo sapiens
ggttccagcctgcc

SEQ ID NO: 4984019 - DNA, 22 bp, Homo sapiens
ggtttgtttagaagaagtgtgt

SEQ ID NO: 4984020 - DNA, 22 bp, Homo sapiens
gtaaaatcccatctgctagaag

SEQ ID NO: 4984021 - DNA, 17 bp, Homo sapiens
gtaaatttatgtgatgg

SEQ ID NO: 4984022 - DNA, 13 bp, Homo sapiens
gtaagacatctca

SEQ ID NO: 4984023 - DNA, 16 bp, Homo sapiens
gtaatgaaacttggat

SEQ ID NO: 4984024 - DNA, 23 bp, Homo sapiens
gtaatttaaaattgtgatgtgtc

SEQ ID NO: 4984025 - DNA, 21 bp, Homo sapiens
gtagctgggattacaggcgca

SEQ ID NO: 4984026 - DNA, 16 bp, Homo sapiens
gtaggaactgctgggc

SEQ ID NO: 4984027 - DNA, 13 bp, Homo sapiens
gtaggattactag

SEQ ID NO: 4984028 - DNA, 15 bp, Homo sapiens
gtatgtggaagtgtg

SEQ ID NO: 4984029 - DNA, 18 bp, Homo sapiens
gtatgtggaagtgtgggt

SEQ ID NO: 4984030 - DNA, 19 bp, Homo sapiens
gtatgtgggggtctgtgtg

SEQ ID NO: 4984031 - DNA, 20 bp, Homo sapiens
gtatgtgggggtctgtgtgt

SEQ ID NO: 4984032 - DNA, 20 bp, Homo sapiens
gtcacccaggctgcagtgca

SEQ ID NO: 4984033 - DNA, 13 bp, Homo sapiens
gtcatctgtttaa

SEQ ID NO: 4984034 - DNA, 22 bp, Homo sapiens
gtccccagactccaccaagcct

SEQ ID NO: 4984035 - DNA, 13 bp, Homo sapiens
gtcctcacactca

SEQ ID NO: 4984036 - DNA, 11 bp, Homo sapiens
gtcctgcctct

SEQ ID NO: 4984037 - DNA, 16 bp, Homo sapiens
gtccttcaagattcca

SEQ ID NO: 4984038 - DNA, 21 bp, Homo sapiens
gtccttctcctcttgtagcca

SEQ ID NO: 4984039 - DNA, 11 bp, Homo sapiens
gtctgtgtgtg

SEQ ID NO: 4984040 - DNA, 12 bp, Homo sapiens
gtctgtgtgtgt

SEQ ID NO: 4984041 - DNA, 16 bp, Homo sapiens
gtcttggttccagcct

SEQ ID NO: 4984042 - DNA, 17 bp, Homo sapiens
gtcttggttccagcctg

SEQ ID NO: 4984043 - DNA, 16 bp, Homo sapiens
gtgaatttctaaatgt

SEQ ID NO: 4984044 - DNA, 20 bp, Homo sapiens
gtgaccttccaagagcctga

SEQ ID NO: 4984045 - DNA, 22 bp, Homo sapiens
gtgataattttatttataaact

SEQ ID NO: 4984046 - DNA, 23 bp, Homo sapiens
gtgatccacccaccttggcctcc

SEQ ID NO: 4984047 - DNA, 14 bp, Homo sapiens
gtgatccgcctgcc

SEQ ID NO: 4984048 - DNA, 16 bp, Homo sapiens
gtgatccgcctgcctc

SEQ ID NO: 4984049 - DNA, 22 bp, Homo sapiens
gtgatccgcctgcctctgcctc

SEQ ID NO: 4984050 - DNA, 16 bp, Homo sapiens
gtgcctcggcctccct

SEQ ID NO: 4984051 - DNA, 15 bp, Homo sapiens
gtggaagtgtgggtc

SEQ ID NO: 4984052 - DNA, 21 bp, Homo sapiens
gtggaagtgtgggtctgtgtg

SEQ ID NO: 4984053 - DNA, 22 bp, Homo sapiens
gtggaagtgtgggtctgtgtgt

SEQ ID NO: 4984054 - DNA, 16 bp, Homo sapiens
gtggaattattttaaa

SEQ ID NO: 4984055 - DNA, 15 bp, Homo sapiens
gtggcagtttggcaa

SEQ ID NO: 4984056 - DNA, 16 bp, Homo sapiens
gtgggggtctgtgtgt

SEQ ID NO: 4984057 - DNA, 18 bp, Homo sapiens
gtggtctccactggggat

SEQ ID NO: 4984058 - DNA, 20 bp, Homo sapiens
gtggttcactcttggagcct

SEQ ID NO: 4984059 - DNA, 21 bp, Homo sapiens
gtggttcactcttggagcctg

SEQ ID NO: 4984060 - DNA, 16 bp, Homo sapiens
gtgtccttctcctctt

SEQ ID NO: 4984061 - DNA, 22 bp, Homo sapiens
gtgtccttctcctcttgtagcc

SEQ ID NO: 4984062 - DNA, 17 bp, Homo sapiens
gtgtctttccactcctc

SEQ ID NO: 4984063 - DNA, 20 bp, Homo sapiens
gtgtgtcacccttaggccag

SEQ ID NO: 4984064 - DNA, 16 bp, Homo sapiens
gtgtgtgggagtgtgt

SEQ ID NO: 4984065 - DNA, 14 bp, Homo sapiens
gtgtgttgtgtgtg

SEQ ID NO: 4984066 - DNA, 16 bp, Homo sapiens
gtgtgtttatgtgtgt

SEQ ID NO: 4984067 - DNA, 14 bp, Homo sapiens
gttaagattcctaa

SEQ ID NO: 4984068 - DNA, 17 bp, Homo sapiens
gttcaagccattctgcc

SEQ ID NO: 4984069 - DNA, 14 bp, Homo sapiens
gttccagcctgcca

SEQ ID NO: 4984070 - DNA, 15 bp, Homo sapiens
gttccagcctgccac

SEQ ID NO: 4984071 - DNA, 18 bp, Homo sapiens
gttgtatcagcacgtgtg

SEQ ID NO: 4984072 - DNA, 16 bp, Homo sapiens
gttgtgtgtgggagtg

SEQ ID NO: 4984073 - DNA, 18 bp, Homo sapiens
ttctccaacaagttgcct

SEQ ID NO: 4984074 - DNA, 21 bp, Homo sapiens
ttctcctttaaattctttcct

SEQ ID NO: 4984075 - DNA, 13 bp, Homo sapiens
ttctgaagtactt

SEQ ID NO: 4984076 - DNA, 21 bp, Homo sapiens
ttgaaaagaggtgtgcaagag

SEQ ID NO: 4984077 - DNA, 22 bp, Homo sapiens
ttgattaagatctcagtggtta

SEQ ID NO: 4984078 - DNA, 22 bp, Homo sapiens
ttggagctgttccattgggtcc

SEQ ID NO: 4984079 - DNA, 15 bp, Homo sapiens
ttggattctgagagc

SEQ ID NO: 4984080 - DNA, 20 bp, Homo sapiens
ttggcaaactctccaccaca

SEQ ID NO: 4984081 - DNA, 16 bp, Homo sapiens
ttggcagctctactct

SEQ ID NO: 4984082 - DNA, 21 bp, Homo sapiens
ttgggtggggggcttcataca

SEQ ID NO: 4984083 - DNA, 21 bp, Homo sapiens
ttgtaaaataaaaccaccaaa

SEQ ID NO: 4984084 - DNA, 19 bp, Homo sapiens
ttgtaaatttatgtgatgg

SEQ ID NO: 4984085 - DNA, 13 bp, Homo sapiens
ttgtgtgtgggag

SEQ ID NO: 4984086 - DNA, 23 bp, Homo sapiens
tttaaaactcagaatataacatg

SEQ ID NO: 4984087 - DNA, 20 bp, Homo sapiens
tttaaaatatttgtctttaa

SEQ ID NO: 4984088 - DNA, 16 bp, Homo sapiens
tttaaaattgtgatgt

SEQ ID NO: 4984089 - DNA, 23 bp, Homo sapiens
tttatcatgtcgtaggtaaacta

SEQ ID NO: 4984090 - DNA, 13 bp, Homo sapiens
tttatgtgtgtgt

SEQ ID NO: 4984091 - DNA, 15 bp, Homo sapiens
tttcaccagaagtta

SEQ ID NO: 4984092 - DNA, 13 bp, Homo sapiens
tttcactaagctc

SEQ ID NO: 4984093 - DNA, 22 bp, Homo sapiens
tttccctcccaacagagctggg

SEQ ID NO: 4984094 - DNA, 19 bp, Homo sapiens
tttctgaagtacttaaact

SEQ ID NO: 4984095 - DNA, 23 bp, Homo sapiens
tttgacctgttgggagtgaggat

SEQ ID NO: 4984096 - DNA, 19 bp, Homo sapiens
ttttaaagaaaaatatgat

SEQ ID NO: 4984097 - DNA, 17 bp, Homo sapiens
ttttatatgatggggga

SEQ ID NO: 4984098 - DNA, 17 bp, Homo sapiens
ttttgtttaaaactcag

SEQ ID NO: 4984099 - DNA, 14 bp, Homo sapiens
aaaactcagaatat

SEQ ID NO: 4984100 - DNA, 19 bp, Homo sapiens
aaaagagatgatgaaaata

SEQ ID NO: 4984101 - DNA, 14 bp, Homo sapiens
aaaagataaatatt

SEQ ID NO: 4984102 - DNA, 18 bp, Homo sapiens
aaaagccaagaggctgca

SEQ ID NO: 4984103 - DNA, 16 bp, Homo sapiens
aaaattgtgatgtgtc

SEQ ID NO: 4984104 - DNA, 19 bp, Homo sapiens
aaacatgcttgaataactg

SEQ ID NO: 4984105 - DNA, 23 bp, Homo sapiens
aaacatgcttgaataactgagct

SEQ ID NO: 4984106 - DNA, 14 bp, Homo sapiens
aaaccaccagaagc

SEQ ID NO: 4984107 - DNA, 19 bp, Homo sapiens
aaacttgtaaataaaggaa

SEQ ID NO: 4984108 - DNA, 19 bp, Homo sapiens
aaagagatgatgaaaatat

SEQ ID NO: 4984109 - DNA, 22 bp, Homo sapiens
aaagagatgatgaaaatattta

SEQ ID NO: 4984110 - DNA, 13 bp, Homo sapiens
aaagaggtgtgca

SEQ ID NO: 4984111 - DNA, 13 bp, Homo sapiens
aaagataaatatt

SEQ ID NO: 4984112 - DNA, 15 bp, Homo sapiens
aaagccaatgtgaac

SEQ ID NO: 4984113 - DNA, 16 bp, Homo sapiens
aaagtaatctttaaac

SEQ ID NO: 4984114 - DNA, 12 bp, Homo sapiens
aaatatgatact

SEQ ID NO: 4984115 - DNA, 22 bp, Homo sapiens
aaatatgatactctcagatttt

SEQ ID NO: 4984116 - DNA, 19 bp, Homo sapiens
aaatatttgtctttaaaca

SEQ ID NO: 4984117 - DNA, 20 bp, Homo sapiens
aaatatttgtctttaaacag

SEQ ID NO: 4984118 - DNA, 16 bp, Homo sapiens
aaatctatgattccag

SEQ ID NO: 4984119 - DNA, 14 bp, Homo sapiens
aacaagtaagaaaa

SEQ ID NO: 4984120 - DNA, 17 bp, Homo sapiens
aacaagtaagaaaaata

SEQ ID NO: 4984121 - DNA, 16 bp, Homo sapiens
aacctccacctccggg

SEQ ID NO: 4984122 - DNA, 16 bp, Homo sapiens
agcgaattttaaaaga

SEQ ID NO: 4984123 - DNA, 14 bp, Homo sapiens
agctgcctgtgcct

SEQ ID NO: 4984124 - DNA, 17 bp, Homo sapiens
agctggattcaattcct

SEQ ID NO: 4984125 - DNA, 18 bp, Homo sapiens
agctgtgtgctctccaag

SEQ ID NO: 4984126 - DNA, 21 bp, Homo sapiens
agcttctggtgaccttccaag

SEQ ID NO: 4984127 - DNA, 22 bp, Homo sapiens
agctttgaggtggaagagggct

SEQ ID NO: 4984128 - DNA, 12 bp, Homo sapiens
aggacagtattt

SEQ ID NO: 4984129 - DNA, 19 bp, Homo sapiens
aggacagtatttgtgggga

SEQ ID NO: 4984130 - DNA, 20 bp, Homo sapiens
aggcacaaaattttgtttaa

SEQ ID NO: 4984131 - DNA, 23 bp, Homo sapiens
aggcaccccctggcttgaacctt

SEQ ID NO: 4984132 - DNA, 19 bp, Homo sapiens
aggccagggggccagtccc

SEQ ID NO: 4984133 - DNA, 22 bp, Homo sapiens
aggccctatctgtttacagtgt

SEQ ID NO: 4984134 - DNA, 18 bp, Homo sapiens
aggctcatttcactaagc

SEQ ID NO: 4984135 - DNA, 21 bp, Homo sapiens
aggctgctttccaaagccaat

SEQ ID NO: 4984136 - DNA, 19 bp, Homo sapiens
aggcttcattgcactgatc

SEQ ID NO: 4984137 - DNA, 23 bp, Homo sapiens
aggtagctttgaggtggaagagg

SEQ ID NO: 4984138 - DNA, 16 bp, Homo sapiens
agtaacctagtgaatt

SEQ ID NO: 4984139 - DNA, 15 bp, Homo sapiens
agtaatctttaaact

SEQ ID NO: 4984140 - DNA, 19 bp, Homo sapiens
agtagtgcttggtgcatga

SEQ ID NO: 4984141 - DNA, 14 bp, Homo sapiens
agtcatctgtttaa

SEQ ID NO: 4984142 - DNA, 22 bp, Homo sapiens
agtccctgaggcaggtccccag

SEQ ID NO: 4984143 - DNA, 23 bp, Homo sapiens
agtgataattttatttataaact

SEQ ID NO: 4984144 - DNA, 18 bp, Homo sapiens
agtgccaggatggaatga

SEQ ID NO: 4984145 - DNA, 22 bp, Homo sapiens
agtgctaaacaagtaagaaaaa

SEQ ID NO: 4984146 - DNA, 19 bp, Homo sapiens
agtgcttgatatgtaagta

SEQ ID NO: 4984147 - DNA, 21 bp, Homo sapiens
agtggactgttccctgaggtg

SEQ ID NO: 4984148 - DNA, 12 bp, Homo sapiens
agtgtctggctg

SEQ ID NO: 4984149 - DNA, 19 bp, Homo sapiens
agtgtgggtctgtgtgtgt

SEQ ID NO: 4984150 - DNA, 9 bp, Homo sapiens
agtgtgtaa

SEQ ID NO: 4984151 - DNA, 19 bp, Homo sapiens
agttcctttgatctcgctg

SEQ ID NO: 4984152 - DNA, 13 bp, Homo sapiens
ataacatgtaaaa

SEQ ID NO: 4984153 - DNA, 16 bp, Homo sapiens
ataactgagcttagag

SEQ ID NO: 4984154 - DNA, 14 bp, Homo sapiens
atagagaataaggc

SEQ ID NO: 4984155 - DNA, 15 bp, Homo sapiens
atataacatgtaaaa

SEQ ID NO: 4984156 - DNA, 14 bp, Homo sapiens
atatagagaataag

SEQ ID NO: 4984157 - DNA, 9 bp, Homo sapiens
atatatttc

SEQ ID NO: 4984158 - DNA, 21 bp, Homo sapiens
atatttccctgaaggaaccaa

SEQ ID NO: 4984159 - DNA, 21 bp, Homo sapiens
atatttgaatgtatgcttcat

SEQ ID NO: 4984160 - DNA, 15 bp, Homo sapiens
atattttaatgaata

SEQ ID NO: 4984161 - DNA, 12 bp, Homo sapiens
atcagagctgga

SEQ ID NO: 4984162 - DNA, 19 bp, Homo sapiens
atcagttcctttgatctcg

SEQ ID NO: 4984163 - DNA, 22 bp, Homo sapiens
atcagttcctttgatctcgctg

SEQ ID NO: 4984164 - DNA, 17 bp, Homo sapiens
atcatgtcgtaggtaaa

SEQ ID NO: 4984165 - DNA, 17 bp, Homo sapiens
atccaataggatctcgt

SEQ ID NO: 4984166 - DNA, 19 bp, Homo sapiens
atccatagcacctccacat

SEQ ID NO: 4984167 - DNA, 16 bp, Homo sapiens
atccgcctgcctctgc

SEQ ID NO: 4984168 - DNA, 18 bp, Homo sapiens
atcctgtgccagaggaag

SEQ ID NO: 4984169 - DNA, 20 bp, Homo sapiens
atctaaagctttggacaagt

SEQ ID NO: 4984170 - DNA, 23 bp, Homo sapiens
atctcagtggttaagattcctaa

SEQ ID NO: 4984171 - DNA, 20 bp, Homo sapiens
atctgagaggccacagtgca

SEQ ID NO: 4984172 - DNA, 13 bp, Homo sapiens
atgaatattgatg

SEQ ID NO: 4984173 - DNA, 20 bp, Homo sapiens
atgatactctcagattttaa

SEQ ID NO: 4984174 - DNA, 19 bp, Homo sapiens
atgatttatttgtcctttt

SEQ ID NO: 4984175 - DNA, 10 bp, Homo sapiens
atgcttcata

SEQ ID NO: 4984176 - DNA, 11 bp, Homo sapiens
atgcttcatac

SEQ ID NO: 4984177 - DNA, 12 bp, Homo sapiens
atgcttcataca

SEQ ID NO: 4984178 - DNA, 15 bp, Homo sapiens
atgcttcatacaggg

SEQ ID NO: 4984179 - DNA, 20 bp, Homo sapiens
atggggatagatgtgtggac

SEQ ID NO: 4984180 - DNA, 19 bp, Homo sapiens
atggtgttcaaaaaacttg

SEQ ID NO: 4984181 - DNA, 16 bp, Homo sapiens
atggttctcaggcctg

SEQ ID NO: 4984182 - DNA, 17 bp, Homo sapiens
atgtatgcttcatacag

SEQ ID NO: 4984183 - DNA, 13 bp, Homo sapiens
atgtcagtatgtg

SEQ ID NO: 4984184 - DNA, 16 bp, Homo sapiens
atgtcagtatgtggaa

SEQ ID NO: 4984185 - DNA, 13 bp, Homo sapiens
atgtggaagtgtg

SEQ ID NO: 4984186 - DNA, 23 bp, Homo sapiens
atgtgtgtgtgttgtgtgtggga

SEQ ID NO: 4984187 - DNA, 22 bp, Homo sapiens
atgttaacaagaggggaaaaca

SEQ ID NO: 4984188 - DNA, 20 bp, Homo sapiens
atgttatgggatgtaaacaa

SEQ ID NO: 4984189 - DNA, 21 bp, Homo sapiens
atgttatgggatgtaaacaat

SEQ ID NO: 4984190 - DNA, 15 bp, Homo sapiens
atgtttacagaggac

SEQ ID NO: 4984191 - DNA, 16 bp, Homo sapiens
attaagatctcagtgg

SEQ ID NO: 4984192 - DNA, 19 bp, Homo sapiens
attagcaggtgcaccttct

SEQ ID NO: 4984193 - DNA, 18 bp, Homo sapiens
attagttcccctactaca

SEQ ID NO: 4984194 - DNA, 14 bp, Homo sapiens
attccaaagttctt

SEQ ID NO: 4984195 - DNA, 22 bp, Homo sapiens
attccatttcttaacagtctcc

SEQ ID NO: 4984196 - DNA, 12 bp, Homo sapiens
attctctgcctt

SEQ ID NO: 4984197 - DNA, 13 bp, Homo sapiens
attctgagagctg

SEQ ID NO: 4984198 - DNA, 21 bp, Homo sapiens
attcttgtgcctcggcctccc

SEQ ID NO: 4984199 - DNA, 19 bp, Homo sapiens
attctttgacctgttggga

SEQ ID NO: 4984200 - DNA, 16 bp, Homo sapiens
attgatgttaacaaga

SEQ ID NO: 4984201 - DNA, 19 bp, Homo sapiens
attgcactgatcttactct

SEQ ID NO: 4984202 - DNA, 21 bp, Homo sapiens
attgggtggggggcttcatac

SEQ ID NO: 4984203 - DNA, 18 bp, Homo sapiens
attgtagagccagaggtc

SEQ ID NO: 4984204 - DNA, 14 bp, Homo sapiens
attgtgagctcctt

SEQ ID NO: 4984205 - DNA, 14 bp, Homo sapiens
attgtgatgtgtcc

SEQ ID NO: 4984206 - DNA, 18 bp, Homo sapiens
atttaaaggccctatctg

SEQ ID NO: 4984207 - DNA, 12 bp, Homo sapiens
atttataaacta

SEQ ID NO: 4984208 - DNA, 19 bp, Homo sapiens
atttcactaagctcctcct

SEQ ID NO: 4984209 - DNA, 21 bp, Homo sapiens
atttctactttttgcacctta

SEQ ID NO: 4984210 - DNA, 16 bp, Homo sapiens
atttgctatgagctgg

SEQ ID NO: 4984211 - DNA, 15 bp, Homo sapiens
attttgcccttgaca

SEQ ID NO: 4984212 - DNA, 12 bp, Homo sapiens
atttttctcatg

SEQ ID NO: 4984213 - DNA, 16 bp, Homo sapiens
caaaaattctcagttc

SEQ ID NO: 4984214 - DNA, 22 bp, Homo sapiens
caaaccaccagaagcccagaat

SEQ ID NO: 4984215 - DNA, 19 bp, Homo sapiens
caaagtgctgggattacag

SEQ ID NO: 4984216 - DNA, 19 bp, Homo sapiens
caaagttcccactccttca

SEQ ID NO: 4984217 - DNA, 14 bp, Homo sapiens
caaatcttctaatt

SEQ ID NO: 4984218 - DNA, 14 bp, Homo sapiens
caacaagttgcctc

SEQ ID NO: 4984219 - DNA, 17 bp, Homo sapiens
caacacaagcaccccag

SEQ ID NO: 4984220 - DNA, 19 bp, Homo sapiens
caacctccacctccgggtt

SEQ ID NO: 4984221 - DNA, 14 bp, Homo sapiens
caacctctgcctcc

SEQ ID NO: 4984222 - DNA, 11 bp, Homo sapiens
caagagcctga

SEQ ID NO: 4984223 - DNA, 13 bp, Homo sapiens
caagagcctgaga

SEQ ID NO: 4984224 - DNA, 23 bp, Homo sapiens
caagagcctgagagtgaggtgga

SEQ ID NO: 4984225 - DNA, 14 bp, Homo sapiens
caagaggctgcagc

SEQ ID NO: 4984226 - DNA, 15 bp, Homo sapiens
caagccattctgcct

SEQ ID NO: 4984227 - DNA, 16 bp, Homo sapiens
caagccattctgcctc

SEQ ID NO: 4984228 - DNA, 17 bp, Homo sapiens
caagccattctgcctca

SEQ ID NO: 4984229 - DNA, 21 bp, Homo sapiens
caagccattctgcctcagcct

SEQ ID NO: 4984230 - DNA, 17 bp, Homo sapiens
caagcctggtcagccca

SEQ ID NO: 4984231 - DNA, 20 bp, Homo sapiens
caagtccttgacctctataa

SEQ ID NO: 4984232 - DNA, 16 bp, Homo sapiens
caatcccatctattct

SEQ ID NO: 4984233 - DNA, 17 bp, Homo sapiens
caatctgcattttaaca

SEQ ID NO: 4984234 - DNA, 19 bp, Homo sapiens
caatggcgcgatctcagct

SEQ ID NO: 4984235 - DNA, 18 bp, Homo sapiens
caattcctgtccttcaca

SEQ ID NO: 4984236 - DNA, 14 bp, Homo sapiens
cacaagagtgaatt

SEQ ID NO: 4984237 - DNA, 18 bp, Homo sapiens
cacaagcaccccagacct

SEQ ID NO: 4984238 - DNA, 19 bp, Homo sapiens
cacagagcatggcctccag

SEQ ID NO: 4984239 - DNA, 16 bp, Homo sapiens
cacatgagataatatg

SEQ ID NO: 4984240 - DNA, 15 bp, Homo sapiens
cacctagagtagtgc

SEQ ID NO: 4984241 - DNA, 13 bp, Homo sapiens
aacctctgcctcc

SEQ ID NO: 4984242 - DNA, 13 bp, Homo sapiens
aaccttcaaagct

SEQ ID NO: 4984243 - DNA, 21 bp, Homo sapiens
aactctcgagacttctctgtg

SEQ ID NO: 4984244 - DNA, 17 bp, Homo sapiens
aactgagcttggaagct

SEQ ID NO: 4984245 - DNA, 16 bp, Homo sapiens
aacttagaggaaaagg

SEQ ID NO: 4984246 - DNA, 15 bp, Homo sapiens
aacttttaaagaaaa

SEQ ID NO: 4984247 - DNA, 11 bp, Homo sapiens
aagaatatttg

SEQ ID NO: 4984248 - DNA, 15 bp, Homo sapiens
aagaatatttgaatg

SEQ ID NO: 4984249 - DNA, 20 bp, Homo sapiens
aagagatgatgaaaatattt

SEQ ID NO: 4984250 - DNA, 16 bp, Homo sapiens
aagaggtgtgcaagag

SEQ ID NO: 4984251 - DNA, 18 bp, Homo sapiens
aagaggtgtgcaagagag

SEQ ID NO: 4984252 - DNA, 15 bp, Homo sapiens
aagcctcgacacaga

SEQ ID NO: 4984253 - DNA, 21 bp, Homo sapiens
aagctgtgtgctctccaagcc

SEQ ID NO: 4984254 - DNA, 16 bp, Homo sapiens
aagtaatctttaaact

SEQ ID NO: 4984255 - DNA, 23 bp, Homo sapiens
aagtacttccacttgtgtatatt

SEQ ID NO: 4984256 - DNA, 21 bp, Homo sapiens
aagtcatctgtttaatttaca

SEQ ID NO: 4984257 - DNA, 22 bp, Homo sapiens
aagtgcacctcaaatcttctaa

SEQ ID NO: 4984258 - DNA, 10 bp, Homo sapiens
aagtgtgggt

SEQ ID NO: 4984259 - DNA, 18 bp, Homo sapiens
aataaactggcagctcag

SEQ ID NO: 4984260 - DNA, 14 bp, Homo sapiens
aatatttgaatgta

SEQ ID NO: 4984261 - DNA, 23 bp, Homo sapiens
aatatttgaatgtatgcttcata

SEQ ID NO: 4984262 - DNA, 21 bp, Homo sapiens
aatgtatgcttcatacaggga

SEQ ID NO: 4984263 - DNA, 15 bp, Homo sapiens
aatgtcagtatgtgg

SEQ ID NO: 4984264 - DNA, 14 bp, Homo sapiens
aatgttggaatgtt

SEQ ID NO: 4984265 - DNA, 18 bp, Homo sapiens
aattactgtatataaact

SEQ ID NO: 4984266 - DNA, 18 bp, Homo sapiens
aattattacagtccttca

SEQ ID NO: 4984267 - DNA, 21 bp, Homo sapiens
aattcctgtccttcacattta

SEQ ID NO: 4984268 - DNA, 22 bp, Homo sapiens
aattctttcctaccttggtcct

SEQ ID NO: 4984269 - DNA, 18 bp, Homo sapiens
aattctttgacctgttgg

SEQ ID NO: 4984270 - DNA, 23 bp, Homo sapiens
aattgggtggggggcttcataca

SEQ ID NO: 4984271 - DNA, 11 bp, Homo sapiens
aattgtgatgt

SEQ ID NO: 4984272 - DNA, 19 bp, Homo sapiens
acaaaaattctcagttctc

SEQ ID NO: 4984273 - DNA, 18 bp, Homo sapiens
acaacacaagcaccccag

SEQ ID NO: 4984274 - DNA, 18 bp, Homo sapiens
acaacagttctcttctag

SEQ ID NO: 4984275 - DNA, 16 bp, Homo sapiens
acaacttttaaagaaa

SEQ ID NO: 4984276 - DNA, 13 bp, Homo sapiens
acaagtaagaaaa

SEQ ID NO: 4984277 - DNA, 16 bp, Homo sapiens
acaattaggcttcatt

SEQ ID NO: 4984278 - DNA, 15 bp, Homo sapiens
acactgatccagccc

SEQ ID NO: 4984279 - DNA, 22 bp, Homo sapiens
acagagtggactgttccctgag

SEQ ID NO: 4984280 - DNA, 12 bp, Homo sapiens
acagatgatact

SEQ ID NO: 4984281 - DNA, 19 bp, Homo sapiens
acagcggctggacttggag

SEQ ID NO: 4984282 - DNA, 22 bp, Homo sapiens
acagcggctggacttggaggta

SEQ ID NO: 4984283 - DNA, 15 bp, Homo sapiens
acaggggcaggagga

SEQ ID NO: 4984284 - DNA, 18 bp, Homo sapiens
acaggtttgggacccctg

SEQ ID NO: 4984285 - DNA, 21 bp, Homo sapiens
acatatctgtcccctgctact

SEQ ID NO: 4984286 - DNA, 16 bp, Homo sapiens
acatgcttgaataact

SEQ ID NO: 4984287 - DNA, 14 bp, Homo sapiens
accaccacacacag

SEQ ID NO: 4984288 - DNA, 14 bp, Homo sapiens
accagaagcccaga

SEQ ID NO: 4984289 - DNA, 13 bp, Homo sapiens
accccagacctca

SEQ ID NO: 4984290 - DNA, 22 bp, Homo sapiens
accccctggcttgaaccttcaa

SEQ ID NO: 4984291 - DNA, 20 bp, Homo sapiens
acccctggctccaggccagg

SEQ ID NO: 4984292 - DNA, 16 bp, Homo sapiens
accgcctcctacagcc

SEQ ID NO: 4984293 - DNA, 14 bp, Homo sapiens
acctccacctccgg

SEQ ID NO: 4984294 - DNA, 16 bp, Homo sapiens
acctccacctccgggt

SEQ ID NO: 4984295 - DNA, 21 bp, Homo sapiens
acctccatccccctctgtctg

SEQ ID NO: 4984296 - DNA, 13 bp, Homo sapiens
acctctgcctccc

SEQ ID NO: 4984297 - DNA, 17 bp, Homo sapiens
accttcaaagcttttgt

SEQ ID NO: 4984298 - DNA, 23 bp, Homo sapiens
accttcaaagcttttgtaaaata

SEQ ID NO: 4984299 - DNA, 16 bp, Homo sapiens
accttccaagagcctg

SEQ ID NO: 4984300 - DNA, 17 bp, Homo sapiens
accttccaagagcctga

SEQ ID NO: 4984301 - DNA, 14 bp, Homo sapiens
accttcctcctccc

SEQ ID NO: 4984302 - DNA, 15 bp, Homo sapiens
accttctgtggctgt

SEQ ID NO: 4984303 - DNA, 16 bp, Homo sapiens
accttggtcctgcctc

SEQ ID NO: 4984304 - DNA, 17 bp, Homo sapiens
accttggtcctgcctct

SEQ ID NO: 4984305 - DNA, 22 bp, Homo sapiens
acgatctcggctcactgcaacc

SEQ ID NO: 4984306 - DNA, 21 bp, Homo sapiens
actaacctggtattttaagag

SEQ ID NO: 4984307 - DNA, 18 bp, Homo sapiens
actacactttgctagtga

SEQ ID NO: 4984308 - DNA, 13 bp, Homo sapiens
actactcacttct

SEQ ID NO: 4984309 - DNA, 13 bp, Homo sapiens
actaggtaaaatt

SEQ ID NO: 4984310 - DNA, 22 bp, Homo sapiens
actaggtgcccagaatgaggct

SEQ ID NO: 4984311 - DNA, 17 bp, Homo sapiens
actcaggcccaaagcct

SEQ ID NO: 4984312 - DNA, 14 bp, Homo sapiens
actccaccaagcct

SEQ ID NO: 4984313 - DNA, 14 bp, Homo sapiens
actcctaacctcgg

SEQ ID NO: 4984314 - DNA, 13 bp, Homo sapiens
actcctcctagcc

SEQ ID NO: 4984315 - DNA, 12 bp, Homo sapiens
actctactgctg

SEQ ID NO: 4984316 - DNA, 14 bp, Homo sapiens
actctactgctgct

SEQ ID NO: 4984317 - DNA, 19 bp, Homo sapiens
actctcgagacttctctgt

SEQ ID NO: 4984318 - DNA, 23 bp, Homo sapiens
actcttggagcctgcagagctgc

SEQ ID NO: 4984319 - DNA, 17 bp, Homo sapiens
actgagcttggaagctt

SEQ ID NO: 4984320 - DNA, 18 bp, Homo sapiens
actgatcttactctactg

SEQ ID NO: 4984321 - DNA, 16 bp, Homo sapiens
actgcaacctctgcct

SEQ ID NO: 4984322 - DNA, 18 bp, Homo sapiens
actgctaagaatatttga

SEQ ID NO: 4984323 - DNA, 15 bp, Homo sapiens
actggagtgcagtgg

SEQ ID NO: 4984324 - DNA, 23 bp, Homo sapiens
actggccagtggctggatctgtg

SEQ ID NO: 4984325 - DNA, 12 bp, Homo sapiens
actgggagccta

SEQ ID NO: 4984326 - DNA, 23 bp, Homo sapiens
actgggagcctacccacccccag

SEQ ID NO: 4984327 - DNA, 23 bp, Homo sapiens
actgttctctttaaaatatttgt

SEQ ID NO: 4984328 - DNA, 20 bp, Homo sapiens
acttccaagtgataatttta

SEQ ID NO: 4984329 - DNA, 20 bp, Homo sapiens
acttctcctttaaattcttt

SEQ ID NO: 4984330 - DNA, 14 bp, Homo sapiens
acttgcatgaatta

SEQ ID NO: 4984331 - DNA, 21 bp, Homo sapiens
acttgcatgaattactgtata

SEQ ID NO: 4984332 - DNA, 12 bp, Homo sapiens
acttgtgtatat

SEQ ID NO: 4984333 - DNA, 15 bp, Homo sapiens
acttttaaagaaaaa

SEQ ID NO: 4984334 - DNA, 11 bp, Homo sapiens
agaaacatgaa

SEQ ID NO: 4984335 - DNA, 12 bp, Homo sapiens
agaagcccagaa

SEQ ID NO: 4984336 - DNA, 13 bp, Homo sapiens
agaagcccagaat

SEQ ID NO: 4984337 - DNA, 13 bp, Homo sapiens
agaataaactggc

SEQ ID NO: 4984338 - DNA, 20 bp, Homo sapiens
agaatgaggctgctttccaa

SEQ ID NO: 4984339 - DNA, 13 bp, Homo sapiens
agaatgtcagtat

SEQ ID NO: 4984340 - DNA, 15 bp, Homo sapiens
agaatgtcagtatgt

SEQ ID NO: 4984341 - DNA, 21 bp, Homo sapiens
agacatttgctatgagctggg

SEQ ID NO: 4984342 - DNA, 19 bp, Homo sapiens
agaccccctggagactaac

SEQ ID NO: 4984343 - DNA, 16 bp, Homo sapiens
agactccaccaagcct

SEQ ID NO: 4984344 - DNA, 17 bp, Homo sapiens
agagaataaactagatc

SEQ ID NO: 4984345 - DNA, 14 bp, Homo sapiens
agagctgcgggctg

SEQ ID NO: 4984346 - DNA, 22 bp, Homo sapiens
agagggactgttcttttgtccc

SEQ ID NO: 4984347 - DNA, 19 bp, Homo sapiens
agatattaggggggaaagt

SEQ ID NO: 4984348 - DNA, 23 bp, Homo sapiens
agatgatgaaaatatttaaaggc

SEQ ID NO: 4984349 - DNA, 14 bp, Homo sapiens
agatgatttggtca

SEQ ID NO: 4984350 - DNA, 19 bp, Homo sapiens
agcaatctgcattttaaca

SEQ ID NO: 4984351 - DNA, 23 bp, Homo sapiens
agcaccccagacctcacctccat

SEQ ID NO: 4984352 - DNA, 21 bp, Homo sapiens
agcaggtccccagctttggct

SEQ ID NO: 4984353 - DNA, 14 bp, Homo sapiens
agcagtgggcctgg

SEQ ID NO: 4984354 - DNA, 15 bp, Homo sapiens
agcatgacaactttt

SEQ ID NO: 4984355 - DNA, 20 bp, Homo sapiens
agcatgacaacttttaaaga

SEQ ID NO: 4984356 - DNA, 13 bp, Homo sapiens
agccagaggtctg

SEQ ID NO: 4984357 - DNA, 19 bp, Homo sapiens
agcccaaaccaccagaagc

SEQ ID NO: 4984358 - DNA, 17 bp, Homo sapiens
agcctcgacacagagtg

SEQ ID NO: 4984359 - DNA, 18 bp, Homo sapiens
agcctcgacacagagtgg

SEQ ID NO: 4984360 - DNA, 12 bp, Homo sapiens
tgtatgtggggg

SEQ ID NO: 4984361 - DNA, 22 bp, Homo sapiens
tgtatgtgggggtctgtgtgtt

SEQ ID NO: 4984362 - DNA, 14 bp, Homo sapiens
tgtcagaaacatga

SEQ ID NO: 4984363 - DNA, 16 bp, Homo sapiens
tgtcagaaacatgaaa

SEQ ID NO: 4984364 - DNA, 19 bp, Homo sapiens
tgtcagtatgtggaagtgt

SEQ ID NO: 4984365 - DNA, 20 bp, Homo sapiens
tgtcagtatgtggaagtgtg

SEQ ID NO: 4984366 - DNA, 22 bp, Homo sapiens
tgtcagtatgtggaagtgtggg

SEQ ID NO: 4984367 - DNA, 21 bp, Homo sapiens
tgtccttttcccccagcacct

SEQ ID NO: 4984368 - DNA, 15 bp, Homo sapiens
tgtgaacagcggctg

SEQ ID NO: 4984369 - DNA, 14 bp, Homo sapiens
tgtgcaagagaggg

SEQ ID NO: 4984370 - DNA, 16 bp, Homo sapiens
tgtgcctcggcctccc

SEQ ID NO: 4984371 - DNA, 14 bp, Homo sapiens
tgtgctctccaagc

SEQ ID NO: 4984372 - DNA, 19 bp, Homo sapiens
tgtgctctccaagcccagt

SEQ ID NO: 4984373 - DNA, 23 bp, Homo sapiens
tgtggcagtttggcaaactctcc

SEQ ID NO: 4984374 - DNA, 16 bp, Homo sapiens
tgtgggggtctgtgtg

SEQ ID NO: 4984375 - DNA, 18 bp, Homo sapiens
tgtgtatattttaatgaa

SEQ ID NO: 4984376 - DNA, 14 bp, Homo sapiens
tgtgtgggagtgtg

SEQ ID NO: 4984377 - DNA, 14 bp, Homo sapiens
tgtgtgtgtatgtg

SEQ ID NO: 4984378 - DNA, 23 bp, Homo sapiens
tgtgttgtgtgtgggagtgtgta

SEQ ID NO: 4984379 - DNA, 13 bp, Homo sapiens
tgtgtttatgtgt

SEQ ID NO: 4984380 - DNA, 21 bp, Homo sapiens
tgttaacaagaggggaaaaca

SEQ ID NO: 4984381 - DNA, 16 bp, Homo sapiens
tgttctctttaaaata

SEQ ID NO: 4984382 - DNA, 16 bp, Homo sapiens
tgttcttttgtcccag

SEQ ID NO: 4984383 - DNA, 18 bp, Homo sapiens
tgttgggagtgaggatgt

SEQ ID NO: 4984384 - DNA, 14 bp, Homo sapiens
tgttgtgtgtggga

SEQ ID NO: 4984385 - DNA, 15 bp, Homo sapiens
tgttgtgtgtgggag

SEQ ID NO: 4984386 - DNA, 14 bp, Homo sapiens
tgtttacagaggac

SEQ ID NO: 4984387 - DNA, 13 bp, Homo sapiens
tgtttatgtgtgt

SEQ ID NO: 4984388 - DNA, 12 bp, Homo sapiens
ttaactcagtct

SEQ ID NO: 4984389 - DNA, 21 bp, Homo sapiens
ttacatatctgtcccctgcta

SEQ ID NO: 4984390 - DNA, 14 bp, Homo sapiens
ttactgtatataaa

SEQ ID NO: 4984391 - DNA, 16 bp, Homo sapiens
ttactgtatataaact

SEQ ID NO: 4984392 - DNA, 15 bp, Homo sapiens
ttagaagaagtgtgt

SEQ ID NO: 4984393 - DNA, 15 bp, Homo sapiens
ttagtgctaaacaag

SEQ ID NO: 4984394 - DNA, 19 bp, Homo sapiens
ttatatatatatatatttc

SEQ ID NO: 4984395 - DNA, 14 bp, Homo sapiens
ttatcaacatttgt

SEQ ID NO: 4984396 - DNA, 17 bp, Homo sapiens
ttattccttcttactct

SEQ ID NO: 4984397 - DNA, 20 bp, Homo sapiens
ttatttgtccttttccccca

SEQ ID NO: 4984398 - DNA, 16 bp, Homo sapiens
ttcaaaaaacttgtaa

SEQ ID NO: 4984399 - DNA, 19 bp, Homo sapiens
ttcactcttggagcctgca

SEQ ID NO: 4984400 - DNA, 23 bp, Homo sapiens
ttccaaagttcttatctctagct

SEQ ID NO: 4984401 - DNA, 18 bp, Homo sapiens
ttccactcctcctagcca

SEQ ID NO: 4984402 - DNA, 12 bp, Homo sapiens
ttccagcctgcc

SEQ ID NO: 4984403 - DNA, 14 bp, Homo sapiens
ttccagcctgccac

SEQ ID NO: 4984404 - DNA, 16 bp, Homo sapiens
ttccagcctgccactc

SEQ ID NO: 4984405 - DNA, 17 bp, Homo sapiens
ttcccatttactcttga

SEQ ID NO: 4984406 - DNA, 15 bp, Homo sapiens
ttcccccagcaccta

SEQ ID NO: 4984407 - DNA, 15 bp, Homo sapiens
ttccctcccaacaga

SEQ ID NO: 4984408 - DNA, 16 bp, Homo sapiens
ttccctgaaggaacca

SEQ ID NO: 4984409 - DNA, 13 bp, Homo sapiens
ttctgagagctgt

SEQ ID NO: 4984410 - DNA, 14 bp, Homo sapiens
ttctgcctcagcct

SEQ ID NO: 4984411 - DNA, 14 bp, Homo sapiens
ttcttccaattatt

SEQ ID NO: 4984412 - DNA, 15 bp, Homo sapiens
ttgaactgagcttgg

SEQ ID NO: 4984413 - DNA, 19 bp, Homo sapiens
ttgacaaagtcaagccaca

SEQ ID NO: 4984414 - DNA, 16 bp, Homo sapiens
ttgacctctataaact

SEQ ID NO: 4984415 - DNA, 22 bp, Homo sapiens
ttgccacagatgatacttccaa

SEQ ID NO: 4984416 - DNA, 11 bp, Homo sapiens
ttggagcctgc

SEQ ID NO: 4984417 - DNA, 15 bp, Homo sapiens
ttggagcctgcagag

SEQ ID NO: 4984418 - DNA, 16 bp, Homo sapiens
ttggcaaactctccac

SEQ ID NO: 4984419 - DNA, 23 bp, Homo sapiens
ttggcaaactctccaccacacgt

SEQ ID NO: 4984420 - DNA, 15 bp, Homo sapiens
ttgggacccctggtg

SEQ ID NO: 4984421 - DNA, 20 bp, Homo sapiens
ttgggacccctggtggttca

SEQ ID NO: 4984422 - DNA, 19 bp, Homo sapiens
ttgggtggggggcttcata

SEQ ID NO: 4984423 - DNA, 14 bp, Homo sapiens
ttgtctttaaacag

SEQ ID NO: 4984424 - DNA, 10 bp, Homo sapiens
ttgtgtgtgg

SEQ ID NO: 4984425 - DNA, 16 bp, Homo sapiens
ttgtgtgtgggagtgt

SEQ ID NO: 4984426 - DNA, 23 bp, Homo sapiens
ttgtttaaaactcagaatataac

SEQ ID NO: 4984427 - DNA, 18 bp, Homo sapiens
ttgtttagaagaagtgtg

SEQ ID NO: 4984428 - DNA, 16 bp, Homo sapiens
tttactagctgtgcaa

SEQ ID NO: 4984429 - DNA, 17 bp, Homo sapiens
tttagaagaagtgtgtc

SEQ ID NO: 4984430 - DNA, 19 bp, Homo sapiens
tttagaagaagtgtgtcac

SEQ ID NO: 4984431 - DNA, 19 bp, Homo sapiens
tttataaactaggtaaaat

SEQ ID NO: 4984432 - DNA, 12 bp, Homo sapiens
tttatgtgatgg

SEQ ID NO: 4984433 - DNA, 15 bp, Homo sapiens
tttatttataaacta

SEQ ID NO: 4984434 - DNA, 23 bp, Homo sapiens
tttctgaaagatgagtaatttct

SEQ ID NO: 4984435 - DNA, 17 bp, Homo sapiens
tttgaatgtatgcttca

SEQ ID NO: 4984436 - DNA, 16 bp, Homo sapiens
tttgaggtggaagagg

SEQ ID NO: 4984437 - DNA, 23 bp, Homo sapiens
tttgctcagtgtctggctgcaga

SEQ ID NO: 4984438 - DNA, 15 bp, Homo sapiens
tttggaatgaagaaa

SEQ ID NO: 4984439 - DNA, 17 bp, Homo sapiens
tttgtaaatttatgtga

SEQ ID NO: 4984440 - DNA, 19 bp, Homo sapiens
ttttaagagaaaactgcag

SEQ ID NO: 4984441 - DNA, 12 bp, Homo sapiens
ttttatttgttt

SEQ ID NO: 4984442 - DNA, 22 bp, Homo sapiens
tttttatcatgtcgtaggtaaa

SEQ ID NO: 4984443 - DNA, 12 bp, Homo sapiens
gaccccctggag

SEQ ID NO: 4984444 - DNA, 19 bp, Homo sapiens
gacctacctgcagtgggaa

SEQ ID NO: 4984445 - DNA, 14 bp, Homo sapiens
gacctaggcaagtt

SEQ ID NO: 4984446 - DNA, 16 bp, Homo sapiens
gactggcagtaaccta

SEQ ID NO: 4984447 - DNA, 21 bp, Homo sapiens
gacttctctgtgaacttccct

SEQ ID NO: 4984448 - DNA, 22 bp, Homo sapiens
gagaagccagctttcctcatca

SEQ ID NO: 4984449 - DNA, 17 bp, Homo sapiens
gagaatgtcagtatgtg

SEQ ID NO: 4984450 - DNA, 20 bp, Homo sapiens
gagacagggttttgccatgt

SEQ ID NO: 4984451 - DNA, 19 bp, Homo sapiens
gagatgatgaaaatattta

SEQ ID NO: 4984452 - DNA, 15 bp, Homo sapiens
gagcagtgggcctgg

SEQ ID NO: 4984453 - DNA, 12 bp, Homo sapiens
gagcctgcagag

SEQ ID NO: 4984454 - DNA, 20 bp, Homo sapiens
gagctgtgcatcagctagaa

SEQ ID NO: 4984455 - DNA, 13 bp, Homo sapiens
gaggcaggtcccc

SEQ ID NO: 4984456 - DNA, 16 bp, Homo sapiens
gaggcaggtccccaga

SEQ ID NO: 4984457 - DNA, 18 bp, Homo sapiens
gagtcagggagagctgaa

SEQ ID NO: 4984458 - DNA, 18 bp, Homo sapiens
gagtgtactagtagttaa

SEQ ID NO: 4984459 - DNA, 22 bp, Homo sapiens
gagtgtgtaatttaaaattgtg

SEQ ID NO: 4984460 - DNA, 22 bp, Homo sapiens
gataaatattatattatatata

SEQ ID NO: 4984461 - DNA, 19 bp, Homo sapiens
gataataacagcaccccat

SEQ ID NO: 4984462 - DNA, 15 bp, Homo sapiens
gatactctcagattt

SEQ ID NO: 4984463 - DNA, 22 bp, Homo sapiens
gatagatgtgtggacacattgg

SEQ ID NO: 4984464 - DNA, 14 bp, Homo sapiens
gatcattatcagcc

SEQ ID NO: 4984465 - DNA, 18 bp, Homo sapiens
gatccacccaccttggcc

SEQ ID NO: 4984466 - DNA, 23 bp, Homo sapiens
gatccagccctgagttcctagcc

SEQ ID NO: 4984467 - DNA, 17 bp, Homo sapiens
gatctcggctcactgca

SEQ ID NO: 4984468 - DNA, 21 bp, Homo sapiens
gatgctttatgcaactaactg

SEQ ID NO: 4984469 - DNA, 15 bp, Homo sapiens
gatgggtcagttgta

SEQ ID NO: 4984470 - DNA, 21 bp, Homo sapiens
gatgtggaaaagccaagaggc

SEQ ID NO: 4984471 - DNA, 22 bp, Homo sapiens
gattaagatctcagtggttaag

SEQ ID NO: 4984472 - DNA, 20 bp, Homo sapiens
gattcttgtgcctcggcctc

SEQ ID NO: 4984473 - DNA, 22 bp, Homo sapiens
gcaaatccttgtgggaaaagaa

SEQ ID NO: 4984474 - DNA, 19 bp, Homo sapiens
gcaactacagaagtggaag

SEQ ID NO: 4984475 - DNA, 22 bp, Homo sapiens
gcaatgtagaggggaaaagaga

SEQ ID NO: 4984476 - DNA, 17 bp, Homo sapiens
gcaccacactcagccct

SEQ ID NO: 4984477 - DNA, 23 bp, Homo sapiens
gcaggtccccagactccaccaag

SEQ ID NO: 4984478 - DNA, 16 bp, Homo sapiens
gcagtgggcctggcca

SEQ ID NO: 4984479 - DNA, 20 bp, Homo sapiens
gccaatgtgaacagcggctg

SEQ ID NO: 4984480 - DNA, 14 bp, Homo sapiens
gccactcaggccca

SEQ ID NO: 4984481 - DNA, 18 bp, Homo sapiens
gccagactggagtgcagt

SEQ ID NO: 4984482 - DNA, 16 bp, Homo sapiens
gccagaggaaggaaaa

SEQ ID NO: 4984483 - DNA, 14 bp, Homo sapiens
gccagtggctggat

SEQ ID NO: 4984484 - DNA, 21 bp, Homo sapiens
gcccaaaccaccagaagccca

SEQ ID NO: 4984485 - DNA, 23 bp, Homo sapiens
gcccaaaccaccagaagcccaga

SEQ ID NO: 4984486 - DNA, 11 bp, Homo sapiens
gcccctgccag

SEQ ID NO: 4984487 - DNA, 16 bp, Homo sapiens
gccctgagttcctagc

SEQ ID NO: 4984488 - DNA, 18 bp, Homo sapiens
gccctgagttcctagcca

SEQ ID NO: 4984489 - DNA, 16 bp, Homo sapiens
gcctccctagtagctg

SEQ ID NO: 4984490 - DNA, 20 bp, Homo sapiens
gcctcctacagcccacctgg

SEQ ID NO: 4984491 - DNA, 15 bp, Homo sapiens
gcctgcagagctgcg

SEQ ID NO: 4984492 - DNA, 15 bp, Homo sapiens
gcctgccactcaggc

SEQ ID NO: 4984493 - DNA, 23 bp, Homo sapiens
gcctgccactcaggcccaaagcc

SEQ ID NO: 4984494 - DNA, 14 bp, Homo sapiens
gcctgcctctgcct

SEQ ID NO: 4984495 - DNA, 15 bp, Homo sapiens
gcctgcctctgcctc

SEQ ID NO: 4984496 - DNA, 14 bp, Homo sapiens
gcctggtcagccca

SEQ ID NO: 4984497 - DNA, 15 bp, Homo sapiens
gcgaattttaaaaga

SEQ ID NO: 4984498 - DNA, 13 bp, Homo sapiens
gcgcacaccacca

SEQ ID NO: 4984499 - DNA, 15 bp, Homo sapiens
gcggctggacttgga

SEQ ID NO: 4984500 - DNA, 16 bp, Homo sapiens
gctaagaatatttgaa

SEQ ID NO: 4984501 - DNA, 17 bp, Homo sapiens
gctaagaatatttgaat

SEQ ID NO: 4984502 - DNA, 14 bp, Homo sapiens
gctatgagggcctt

SEQ ID NO: 4984503 - DNA, 20 bp, Homo sapiens
gctcactgcaacctctgcct

SEQ ID NO: 4984504 - DNA, 17 bp, Homo sapiens
gctccccctccacctgc

SEQ ID NO: 4984505 - DNA, 18 bp, Homo sapiens
gctccccctccacctgct

SEQ ID NO: 4984506 - DNA, 17 bp, Homo sapiens
gctgactactcacttct

SEQ ID NO: 4984507 - DNA, 15 bp, Homo sapiens
gctgcctaataaaga

SEQ ID NO: 4984508 - DNA, 13 bp, Homo sapiens
gctggacttggag

SEQ ID NO: 4984509 - DNA, 13 bp, Homo sapiens
gctggatctgtga

SEQ ID NO: 4984510 - DNA, 20 bp, Homo sapiens
gctgggaataagtgccagga

SEQ ID NO: 4984511 - DNA, 22 bp, Homo sapiens
gctgggcttggcagcccgggtc

SEQ ID NO: 4984512 - DNA, 16 bp, Homo sapiens
gctgtttgcgtgaatg

SEQ ID NO: 4984513 - DNA, 11 bp, Homo sapiens
gcttcatacag

SEQ ID NO: 4984514 - DNA, 12 bp, Homo sapiens
gcttgaaccttc

SEQ ID NO: 4984515 - DNA, 14 bp, Homo sapiens
gctttccaaagcca

SEQ ID NO: 4984516 - DNA, 19 bp, Homo sapiens
gctttcctcatcaggccat

SEQ ID NO: 4984517 - DNA, 19 bp, Homo sapiens
gctttgaggtggaagaggg

SEQ ID NO: 4984518 - DNA, 22 bp, Homo sapiens
gctttgaggtggaagagggctg

SEQ ID NO: 4984519 - DNA, 22 bp, Homo sapiens
gcttttcctcaaagggagagag

SEQ ID NO: 4984520 - DNA, 21 bp, Homo sapiens
ggaaccaaagcgaattttaaa

SEQ ID NO: 4984521 - DNA, 20 bp, Homo sapiens
ggaactgctgggcttggcag

SEQ ID NO: 4984522 - DNA, 19 bp, Homo sapiens
ggacagtatttgtggggag

SEQ ID NO: 4984523 - DNA, 18 bp, Homo sapiens
ggacccctggtggttcac

SEQ ID NO: 4984524 - DNA, 21 bp, Homo sapiens
ggagatagccccacaggaggt

SEQ ID NO: 4984525 - DNA, 16 bp, Homo sapiens
ggagcctacccacccc

SEQ ID NO: 4984526 - DNA, 16 bp, Homo sapiens
ggagccttgctctgtt

SEQ ID NO: 4984527 - DNA, 17 bp, Homo sapiens
ggatggaatgatgggtc

SEQ ID NO: 4984528 - DNA, 13 bp, Homo sapiens
ggatgtctgggcc

SEQ ID NO: 4984529 - DNA, 13 bp, Homo sapiens
ggattcaattcct

SEQ ID NO: 4984530 - DNA, 16 bp, Homo sapiens
ggattctgagagctgt

SEQ ID NO: 4984531 - DNA, 17 bp, Homo sapiens
ggattgggcccctgcca

SEQ ID NO: 4984532 - DNA, 19 bp, Homo sapiens
ggcaggctcatttcactaa

SEQ ID NO: 4984533 - DNA, 19 bp, Homo sapiens
ggcaggtccccagactcca

SEQ ID NO: 4984534 - DNA, 20 bp, Homo sapiens
ggcccagagtttacattcta

SEQ ID NO: 4984535 - DNA, 19 bp, Homo sapiens
ggcccctgccagaccccct

SEQ ID NO: 4984536 - DNA, 20 bp, Homo sapiens
ggcctctcattccagaggaa

SEQ ID NO: 4984537 - DNA, 16 bp, Homo sapiens
ggccttgagtccccca

SEQ ID NO: 4984538 - DNA, 15 bp, Homo sapiens
ggcgtgctacctgca

SEQ ID NO: 4984539 - DNA, 19 bp, Homo sapiens
ggctaccccccctcctgct

SEQ ID NO: 4984540 - DNA, 16 bp, Homo sapiens
ggctccaggccagggg

SEQ ID NO: 4984541 - DNA, 20 bp, Homo sapiens
gggacaccaagccttggctc

SEQ ID NO: 4984542 - DNA, 18 bp, Homo sapiens
gggacaggggcaggagga

SEQ ID NO: 4984543 - DNA, 18 bp, Homo sapiens
gggctcagagtggggtag

SEQ ID NO: 4984544 - DNA, 23 bp, Homo sapiens
ggggtctgtgtgtttatgtgtgt

SEQ ID NO: 4984545 - DNA, 19 bp, Homo sapiens
gggttccagcaccacactc

SEQ ID NO: 4984546 - DNA, 16 bp, Homo sapiens
ggtagggaaataatag

SEQ ID NO: 4984547 - DNA, 23 bp, Homo sapiens
ggtcagcccaaaccaccagaagc

SEQ ID NO: 4984548 - DNA, 21 bp, Homo sapiens
ggtgaccttccaagagcctga

SEQ ID NO: 4984549 - DNA, 12 bp, Homo sapiens
tcagtatgtgga

SEQ ID NO: 4984550 - DNA, 16 bp, Homo sapiens
tcatgtcgtaggtaaa

SEQ ID NO: 4984551 - DNA, 14 bp, Homo sapiens
tcattccagaggaa

SEQ ID NO: 4984552 - DNA, 21 bp, Homo sapiens
tcattgcactgatcttactct

SEQ ID NO: 4984553 - DNA, 21 bp, Homo sapiens
tcattggattctgagagctgt

SEQ ID NO: 4984554 - DNA, 15 bp, Homo sapiens
tcatttagtgctaaa

SEQ ID NO: 4984555 - DNA, 15 bp, Homo sapiens
tccaacaagttgcct

SEQ ID NO: 4984556 - DNA, 23 bp, Homo sapiens
tccaatcccatctattctctgcc

SEQ ID NO: 4984557 - DNA, 18 bp, Homo sapiens
tccaccaagcctggtcag

SEQ ID NO: 4984558 - DNA, 22 bp, Homo sapiens
tccaccaagcctggtcagccca

SEQ ID NO: 4984559 - DNA, 21 bp, Homo sapiens
tccactcctcctagccaccca

SEQ ID NO: 4984560 - DNA, 16 bp, Homo sapiens
tccacttccccacact

SEQ ID NO: 4984561 - DNA, 21 bp, Homo sapiens
tccacttccccacacttccca

SEQ ID NO: 4984562 - DNA, 11 bp, Homo sapiens
tccagcctgcc

SEQ ID NO: 4984563 - DNA, 13 bp, Homo sapiens
tccagcctgccac

SEQ ID NO: 4984564 - DNA, 22 bp, Homo sapiens
tccccagactccaccaagcctg

SEQ ID NO: 4984565 - DNA, 17 bp, Homo sapiens
aaaagataaatattata

SEQ ID NO: 4984566 - DNA, 15 bp, Homo sapiens
aaaagatgcaatgta

SEQ ID NO: 4984567 - DNA, 13 bp, Homo sapiens
aaaaggaggaaat

SEQ ID NO: 4984568 - DNA, 23 bp, Homo sapiens
aaaaggtagatcctgagatgatt

SEQ ID NO: 4984569 - DNA, 20 bp, Homo sapiens
aaaatacctattttatatga

SEQ ID NO: 4984570 - DNA, 13 bp, Homo sapiens
aaaatatgatact

SEQ ID NO: 4984571 - DNA, 17 bp, Homo sapiens
aaaatgggaagactgag

SEQ ID NO: 4984572 - DNA, 19 bp, Homo sapiens
aaaccaccagaagcccaga

SEQ ID NO: 4984573 - DNA, 13 bp, Homo sapiens
aaacttagaggaa

SEQ ID NO: 4984574 - DNA, 17 bp, Homo sapiens
aaacttagaggaaaagg

SEQ ID NO: 4984575 - DNA, 15 bp, Homo sapiens
aaagataaatattat

SEQ ID NO: 4984576 - DNA, 15 bp, Homo sapiens
aaagatgagtaattt

SEQ ID NO: 4984577 - DNA, 16 bp, Homo sapiens
aaagcttttgtaaaat

SEQ ID NO: 4984578 - DNA, 13 bp, Homo sapiens
aaagttcttatct

SEQ ID NO: 4984579 - DNA, 18 bp, Homo sapiens
aaataagctcgagtgaat

SEQ ID NO: 4984580 - DNA, 14 bp, Homo sapiens
aaataatagggaaa

SEQ ID NO: 4984581 - DNA, 14 bp, Homo sapiens
aaatctatgattcc

SEQ ID NO: 4984582 - DNA, 15 bp, Homo sapiens
aaattgtgatgtgtc

SEQ ID NO: 4984583 - DNA, 15 bp, Homo sapiens
aaatttatgtgatgg

SEQ ID NO: 4984584 - DNA, 17 bp, Homo sapiens
aacaagaggggaaaaca

SEQ ID NO: 4984585 - DNA, 14 bp, Homo sapiens
attttaagagaaaa

SEQ ID NO: 4984586 - DNA, 16 bp, Homo sapiens
attttaagggggaaaa

SEQ ID NO: 4984587 - DNA, 13 bp, Homo sapiens
attttatatgatg

SEQ ID NO: 4984588 - DNA, 23 bp, Homo sapiens
attttgcccttgacaaagtcaag

SEQ ID NO: 4984589 - DNA, 15 bp, Homo sapiens
caaaccaccagaagc

SEQ ID NO: 4984590 - DNA, 20 bp, Homo sapiens
caaagcgaattttaaaagat

SEQ ID NO: 4984591 - DNA, 15 bp, Homo sapiens
caaagtgcacctcaa

SEQ ID NO: 4984592 - DNA, 22 bp, Homo sapiens
caaagttgccacagatgatact

SEQ ID NO: 4984593 - DNA, 19 bp, Homo sapiens
caacctctgcctcccgggt

SEQ ID NO: 4984594 - DNA, 20 bp, Homo sapiens
caacctctgcctcccgggtt

SEQ ID NO: 4984595 - DNA, 23 bp, Homo sapiens
caactaactgtttacatatctgt

SEQ ID NO: 4984596 - DNA, 15 bp, Homo sapiens
tccctagtagctggg

SEQ ID NO: 4984597 - DNA, 21 bp, Homo sapiens
tccctagtagctgggattaca

SEQ ID NO: 4984598 - DNA, 21 bp, Homo sapiens
tccctcccaacagagctgggc

SEQ ID NO: 4984599 - DNA, 17 bp, Homo sapiens
tccctctactgggagcc

SEQ ID NO: 4984600 - DNA, 20 bp, Homo sapiens
tccctgaaggaaccaaagcg

SEQ ID NO: 4984601 - DNA, 11 bp, Homo sapiens
tccctgaggca

SEQ ID NO: 4984602 - DNA, 16 bp, Homo sapiens
tccctggacagagcta

SEQ ID NO: 4984603 - DNA, 19 bp, Homo sapiens
tccgcctgcctctgcctcc

SEQ ID NO: 4984604 - DNA, 20 bp, Homo sapiens
tcctaccttggtcctgcctc

SEQ ID NO: 4984605 - DNA, 21 bp, Homo sapiens
tcctaccttggtcctgcctct

SEQ ID NO: 4984606 - DNA, 20 bp, Homo sapiens
tcctagccacccaccacact

SEQ ID NO: 4984607 - DNA, 16 bp, Homo sapiens
tcctcactcccagttc

SEQ ID NO: 4984608 - DNA, 20 bp, Homo sapiens
tcctcattataaaatgggaa

SEQ ID NO: 4984609 - DNA, 11 bp, Homo sapiens
tccttctcctc

SEQ ID NO: 4984610 - DNA, 13 bp, Homo sapiens
tccttctcctctt

SEQ ID NO: 4984611 - DNA, 18 bp, Homo sapiens
tcctttgatctcgctgta

SEQ ID NO: 4984612 - DNA, 17 bp, Homo sapiens
tcgatatcctgatctcg

SEQ ID NO: 4984613 - DNA, 20 bp, Homo sapiens
tcgatatcctgatctcgtga

SEQ ID NO: 4984614 - DNA, 18 bp, Homo sapiens
tctaaagctttggacaag

SEQ ID NO: 4984615 - DNA, 18 bp, Homo sapiens
tctaaatgttggaatgtt

SEQ ID NO: 4984616 - DNA, 19 bp, Homo sapiens
tctactgggagcctaccca

SEQ ID NO: 4984617 - DNA, 14 bp, Homo sapiens
tctagcatttcttc

SEQ ID NO: 4984618 - DNA, 14 bp, Homo sapiens
tctcactctgtcac

SEQ ID NO: 4984619 - DNA, 19 bp, Homo sapiens
tctcagattttaaggggga

SEQ ID NO: 4984620 - DNA, 22 bp, Homo sapiens
tctcaggatttcaccagaagtt

SEQ ID NO: 4984621 - DNA, 22 bp, Homo sapiens
tctcagtggttaagattcctaa

SEQ ID NO: 4984622 - DNA, 18 bp, Homo sapiens
tctcgagacttctctgtg

SEQ ID NO: 4984623 - DNA, 18 bp, Homo sapiens
tctcgtgatccgcctgcc

SEQ ID NO: 4984624 - DNA, 22 bp, Homo sapiens
tctcgttaatcatcagttcctt

SEQ ID NO: 4984625 - DNA, 14 bp, Homo sapiens
tctctgggccccag

SEQ ID NO: 4984626 - DNA, 22 bp, Homo sapiens
tctgcctcccaaagtgctggga

SEQ ID NO: 4984627 - DNA, 11 bp, Homo sapiens
tctggccctat

SEQ ID NO: 4984628 - DNA, 14 bp, Homo sapiens
tctggctgcagagc

SEQ ID NO: 4984629 - DNA, 16 bp, Homo sapiens
tctggtgaccttccaa

SEQ ID NO: 4984630 - DNA, 20 bp, Homo sapiens
tctgtgaacttccctaccct

SEQ ID NO: 4984631 - DNA, 18 bp, Homo sapiens
tctgtgtgtgtgtatgtg

SEQ ID NO: 4984632 - DNA, 19 bp, Homo sapiens
tctgtgtgtgtgtatgtgg

SEQ ID NO: 4984633 - DNA, 22 bp, Homo sapiens
tctgtgtgtgtgtatgtggggg

SEQ ID NO: 4984634 - DNA, 15 bp, Homo sapiens
tctgtgtgtttatgt

SEQ ID NO: 4984635 - DNA, 19 bp, Homo sapiens
tctgtgtgtttatgtgtgt

SEQ ID NO: 4984636 - DNA, 14 bp, Homo sapiens
tcttaacagtctcc

SEQ ID NO: 4984637 - DNA, 15 bp, Homo sapiens
tcttgaactgagctt

SEQ ID NO: 4984638 - DNA, 16 bp, Homo sapiens
tcttgtgcctcggcct

SEQ ID NO: 4984639 - DNA, 16 bp, Homo sapiens
tctttaaaatatttgt

SEQ ID NO: 4984640 - DNA, 19 bp, Homo sapiens
tctttcctaccttggtcct

SEQ ID NO: 4984641 - DNA, 13 bp, Homo sapiens
tgaaaagaggtgt

SEQ ID NO: 4984642 - DNA, 12 bp, Homo sapiens
tgaaaatattta

SEQ ID NO: 4984643 - DNA, 15 bp, Homo sapiens
tgaacagcggctgga

SEQ ID NO: 4984644 - DNA, 21 bp, Homo sapiens
tgaacagcggctggacttgga

SEQ ID NO: 4984645 - DNA, 20 bp, Homo sapiens
tgaagagaagggcagggctg

SEQ ID NO: 4984646 - DNA, 19 bp, Homo sapiens
tgaatattgatgttaacaa

SEQ ID NO: 4984647 - DNA, 20 bp, Homo sapiens
tgaattactgtatataaact

SEQ ID NO: 4984648 - DNA, 18 bp, Homo sapiens
tgacaacttttaaagaaa

SEQ ID NO: 4984649 - DNA, 17 bp, Homo sapiens
tgacaggtttgggaccc

SEQ ID NO: 4984650 - DNA, 18 bp, Homo sapiens
tgaccttccaagagcctg

SEQ ID NO: 4984651 - DNA, 16 bp, Homo sapiens
tgagatgatttggtca

SEQ ID NO: 4984652 - DNA, 20 bp, Homo sapiens
tgagctggggatgtctctca

SEQ ID NO: 4984653 - DNA, 23 bp, Homo sapiens
tgaggctgctttccaaagccaat

SEQ ID NO: 4984654 - DNA, 14 bp, Homo sapiens
tgaggtgggagatg

SEQ ID NO: 4984655 - DNA, 24 bp, Homo sapiens
tgataagcagtcatcctcagatca

SEQ ID NO: 4984656 - DNA, 23 bp, Homo sapiens
tgatccacccaccttggcctccc

SEQ ID NO: 4984657 - DNA, 17 bp, Homo sapiens
tgatccagccctgagtt

SEQ ID NO: 4984658 - DNA, 16 bp, Homo sapiens
tgatccgcctgcctct

SEQ ID NO: 4984659 - DNA, 17 bp, Homo sapiens
tgatctcgtgatccgcc

SEQ ID NO: 4984660 - DNA, 13 bp, Homo sapiens
tgatttatttgtc

SEQ ID NO: 4984661 - DNA, 20 bp, Homo sapiens
tgcacctcaaatcttctaat

SEQ ID NO: 4984662 - DNA, 11 bp, Homo sapiens
tgcagagctgc

SEQ ID NO: 4984663 - DNA, 23 bp, Homo sapiens
tgcattgtgtcagaaacatgaaa

SEQ ID NO: 4984664 - DNA, 17 bp, Homo sapiens
tgcctaataaagagact

SEQ ID NO: 4984665 - DNA, 15 bp, Homo sapiens
tgcctcagcctccca

SEQ ID NO: 4984666 - DNA, 15 bp, Homo sapiens
tgcctttactatatg

SEQ ID NO: 4984667 - DNA, 17 bp, Homo sapiens
tgcgcacagccccagct

SEQ ID NO: 4984668 - DNA, 22 bp, Homo sapiens
tgctatgagctggggatgtctc

SEQ ID NO: 4984669 - DNA, 17 bp, Homo sapiens
tgctctccaagcccagt

SEQ ID NO: 4984670 - DNA, 19 bp, Homo sapiens
tgctctgtgcccaccctcc

SEQ ID NO: 4984671 - DNA, 14 bp, Homo sapiens
tgctgcctaataaa

SEQ ID NO: 4984672 - DNA, 22 bp, Homo sapiens
tgctgtgcattagatattaggg

SEQ ID NO: 4984673 - DNA, 16 bp, Homo sapiens
tgctgttatccctgcc

SEQ ID NO: 4984674 - DNA, 14 bp, Homo sapiens
tgcttcatacaggg

SEQ ID NO: 4984675 - DNA, 14 bp, Homo sapiens
tgctttccaaagcc

SEQ ID NO: 4984676 - DNA, 20 bp, Homo sapiens
tggaagcttctggtgacctt

SEQ ID NO: 4984677 - DNA, 23 bp, Homo sapiens
tggaagtgtgggtctgtgtgtgt

SEQ ID NO: 4984678 - DNA, 15 bp, Homo sapiens
tggaattattttaaa

SEQ ID NO: 4984679 - DNA, 14 bp, Homo sapiens
tggagctgttccat

SEQ ID NO: 4984680 - DNA, 14 bp, Homo sapiens
tggccagtggctgg

SEQ ID NO: 4984681 - DNA, 23 bp, Homo sapiens
tggccagtggctggatctgtgag

SEQ ID NO: 4984682 - DNA, 16 bp, Homo sapiens
tggctatgagggcctt

SEQ ID NO: 4984683 - DNA, 15 bp, Homo sapiens
tggctccaggccagg

SEQ ID NO: 4984684 - DNA, 16 bp, Homo sapiens
tggctcttgaactgag

SEQ ID NO: 4984685 - DNA, 22 bp, Homo sapiens
tggctcttgaactgagcttgga

SEQ ID NO: 4984686 - DNA, 22 bp, Homo sapiens
tggctgcagagcagtgggcctg

SEQ ID NO: 4984687 - DNA, 22 bp, Homo sapiens
tggctgccttgtgaaggaatta

SEQ ID NO: 4984688 - DNA, 22 bp, Homo sapiens
tgggagtgaggatgtctgggcc

SEQ ID NO: 4984689 - DNA, 11 bp, Homo sapiens
tgggagtgtgt

SEQ ID NO: 4984690 - DNA, 15 bp, Homo sapiens
tgggcccctgccaga

SEQ ID NO: 4984691 - DNA, 17 bp, Homo sapiens
tggggatagatgtgtgg

SEQ ID NO: 4984692 - DNA, 14 bp, Homo sapiens
tgggggtctgtgtg

SEQ ID NO: 4984693 - DNA, 18 bp, Homo sapiens
tgggggtctgtgtgttta

SEQ ID NO: 4984694 - DNA, 21 bp, Homo sapiens
tggggtaggttgggagaatgt

SEQ ID NO: 4984695 - DNA, 12 bp, Homo sapiens
tgggtctgtgtg

SEQ ID NO: 4984696 - DNA, 13 bp, Homo sapiens
tggtaggaactgc

SEQ ID NO: 4984697 - DNA, 20 bp, Homo sapiens
tggtaggaactgctgggctt

SEQ ID NO: 4984698 - DNA, 10 bp, Homo sapiens
tggtcagccc

SEQ ID NO: 4984699 - DNA, 12 bp, Homo sapiens
tggtcctgcctc

SEQ ID NO: 4984700 - DNA, 21 bp, Homo sapiens
tggtgaccttccaagagcctg

SEQ ID NO: 4984701 - DNA, 16 bp, Homo sapiens
tggtgtccttctcctc

SEQ ID NO: 4984702 - DNA, 23 bp, Homo sapiens
tggtgtccttctcctcttgtagc

SEQ ID NO: 4984703 - DNA, 22 bp, Homo sapiens
tggtgttcaaaaaacttgtaaa

SEQ ID NO: 4984704 - DNA, 20 bp, Homo sapiens
tggttcactcttggagcctg

SEQ ID NO: 4984705 - DNA, 21 bp, Homo sapiens
tggttcactcttggagcctgc

SEQ ID NO: 4984706 - DNA, 18 bp, Homo sapiens
tgtaaaataaaaccacca

SEQ ID NO: 4984707 - DNA, 19 bp, Homo sapiens
tgtaaacaatgtaaagtaa

SEQ ID NO: 4984708 - DNA, 16 bp, Homo sapiens
tgtaaagtaagacatc

SEQ ID NO: 4984709 - DNA, 17 bp, Homo sapiens
tgtaatttaaaattgtg

SEQ ID NO: 4984710 - DNA, 18 bp, Homo sapiens
tgtaatttaaaattgtga

SEQ ID NO: 4984711 - DNA, 21 bp, Homo sapiens
tgtagccagaattctggacaa

SEQ ID NO: 4984712 - DNA, 14 bp, Homo sapiens
tgtatgcttcatac

SEQ ID NO: 4984713 - DNA, 19 bp, Homo sapiens
tgtatgcttcatacaggga

SEQ ID NO: 4984714 - DNA, 19 bp, Homo sapiens
ggttcactcttggagcctg

SEQ ID NO: 4984715 - DNA, 20 bp, Homo sapiens
ggttcactcttggagcctgc

SEQ ID NO: 4984716 - DNA, 21 bp, Homo sapiens
ggttcactcttggagcctgca

SEQ ID NO: 4984717 - DNA, 16 bp, Homo sapiens
gtaaataaaggaacca

SEQ ID NO: 4984718 - DNA, 16 bp, Homo sapiens
gtaaatttatgtgatg

SEQ ID NO: 4984719 - DNA, 13 bp, Homo sapiens
gtaatctttaaac

SEQ ID NO: 4984720 - DNA, 15 bp, Homo sapiens
gtaatgaaacttgga

SEQ ID NO: 4984721 - DNA, 15 bp, Homo sapiens
gtagagccagaggtc

SEQ ID NO: 4984722 - DNA, 14 bp, Homo sapiens
gtaggttgggagaa

SEQ ID NO: 4984723 - DNA, 17 bp, Homo sapiens
gtatattttaatgaata

SEQ ID NO: 4984724 - DNA, 12 bp, Homo sapiens
gtatgcttcata

SEQ ID NO: 4984725 - DNA, 13 bp, Homo sapiens
gtatgcttcatac

SEQ ID NO: 4984726 - DNA, 21 bp, Homo sapiens
aaacatgcttgaataactgag

SEQ ID NO: 4984727 - DNA, 15 bp, Homo sapiens
aaactaggtaaaatt

SEQ ID NO: 4984728 - DNA, 19 bp, Homo sapiens
aaactcagaatataacatg

SEQ ID NO: 4984729 - DNA, 20 bp, Homo sapiens
aaactctcgagacttctctg

SEQ ID NO: 4984730 - DNA, 21 bp, Homo sapiens
aaactggctggcccagagttt

SEQ ID NO: 4984731 - DNA, 20 bp, Homo sapiens
aaactgttctctttaaaata

SEQ ID NO: 4984732 - DNA, 20 bp, Homo sapiens
aaacttccacaagagtgaat

SEQ ID NO: 4984733 - DNA, 16 bp, Homo sapiens
aaagataaatattata

SEQ ID NO: 4984734 - DNA, 17 bp, Homo sapiens
aaagccaatgtgaacag

SEQ ID NO: 4984735 - DNA, 16 bp, Homo sapiens
aaagctttggacaagt

SEQ ID NO: 4984736 - DNA, 21 bp, Homo sapiens
aaagttcccactccttcagga

SEQ ID NO: 4984737 - DNA, 9 bp, Homo sapiens
aaatgaggg

SEQ ID NO: 4984738 - DNA, 17 bp, Homo sapiens
aaatgttggaatgttat

SEQ ID NO: 4984739 - DNA, 12 bp, Homo sapiens
aaattgtgatgt

SEQ ID NO: 4984740 - DNA, 12 bp, Homo sapiens
aacaagttgcct

SEQ ID NO: 4984741 - DNA, 14 bp, Homo sapiens
aacaatgtaaagta

SEQ ID NO: 4984742 - DNA, 13 bp, Homo sapiens
aacatgtaaaatc

SEQ ID NO: 4984743 - DNA, 19 bp, Homo sapiens
aaccaaagcgaattttaaa

SEQ ID NO: 4984744 - DNA, 14 bp, Homo sapiens
aaccaccagaagcc

SEQ ID NO: 4984745 - DNA, 17 bp, Homo sapiens
aaccccccatttcttcc

SEQ ID NO: 4984746 - DNA, 20 bp, Homo sapiens
aacccctggctccaggccag

SEQ ID NO: 4984747 - DNA, 20 bp, Homo sapiens
aacctctgcctcccgggttc

SEQ ID NO: 4984748 - DNA, 15 bp, Homo sapiens
aactcctaacctcgg

SEQ ID NO: 4984749 - DNA, 13 bp, Homo sapiens
aactgagcttgga

SEQ ID NO: 4984750 - DNA, 21 bp, Homo sapiens
aactgagcttggaagcttctg

SEQ ID NO: 4984751 - DNA, 15 bp, Homo sapiens
aacttccacaagagt

SEQ ID NO: 4984752 - DNA, 19 bp, Homo sapiens
aagaagtgtgtcaccctta

SEQ ID NO: 4984753 - DNA, 14 bp, Homo sapiens
aagaggggaaaaca

SEQ ID NO: 4984754 - DNA, 18 bp, Homo sapiens
aagcaccccagtcactag

SEQ ID NO: 4984755 - DNA, 21 bp, Homo sapiens
aagcatgacaacttttaaaga

SEQ ID NO: 4984756 - DNA, 18 bp, Homo sapiens
aagcccagttcagcttgg

SEQ ID NO: 4984757 - DNA, 19 bp, Homo sapiens
aagcccagttcagcttggg

SEQ ID NO: 4984758 - DNA, 23 bp, Homo sapiens
aaggctatggggatagatgtgtg

SEQ ID NO: 4984759 - DNA, 20 bp, Homo sapiens
aaggtagatcctgagatgat

SEQ ID NO: 4984760 - DNA, 13 bp, Homo sapiens
aagtacttaaact

SEQ ID NO: 4984761 - DNA, 20 bp, Homo sapiens
aagtccttgacctctataaa

SEQ ID NO: 4984762 - DNA, 17 bp, Homo sapiens
aagtgtgggtctgtgtg

SEQ ID NO: 4984763 - DNA, 15 bp, Homo sapiens
aatcatcagttcctt

SEQ ID NO: 4984764 - DNA, 18 bp, Homo sapiens
aatctgcattttaacaag

SEQ ID NO: 4984765 - DNA, 16 bp, Homo sapiens
aatgtatgcttcatac

SEQ ID NO: 4984766 - DNA, 21 bp, Homo sapiens
aatgttatgggatgtaaacaa

SEQ ID NO: 4984767 - DNA, 22 bp, Homo sapiens
aatgttatgggatgtaaacaat

SEQ ID NO: 4984768 - DNA, 14 bp, Homo sapiens
aattactgtatata

SEQ ID NO: 4984769 - DNA, 20 bp, Homo sapiens
aattactgtatataaactcc

SEQ ID NO: 4984770 - DNA, 16 bp, Homo sapiens
aattccacaccctcac

SEQ ID NO: 4984771 - DNA, 22 bp, Homo sapiens
aattctttgacctgttgggagt

SEQ ID NO: 4984772 - DNA, 21 bp, Homo sapiens
aattgggtggggggcttcata

SEQ ID NO: 4984773 - DNA, 22 bp, Homo sapiens
aattgggtggggggcttcatac

SEQ ID NO: 4984774 - DNA, 14 bp, Homo sapiens
aatttatgtgatgg

SEQ ID NO: 4984775 - DNA, 13 bp, Homo sapiens
acaaaattttgtt

SEQ ID NO: 4984776 - DNA, 15 bp, Homo sapiens
acaaaattttgttta

SEQ ID NO: 4984777 - DNA, 23 bp, Homo sapiens
acaaaattttgtttaaaactcag

SEQ ID NO: 4984778 - DNA, 20 bp, Homo sapiens
acaacttttaaagaaaaata

SEQ ID NO: 4984779 - DNA, 13 bp, Homo sapiens
acaagcaccccag

SEQ ID NO: 4984780 - DNA, 15 bp, Homo sapiens
acaagtaagaaaaat

SEQ ID NO: 4984781 - DNA, 11 bp, Homo sapiens
acaagttgcct

SEQ ID NO: 4984782 - DNA, 12 bp, Homo sapiens
acaatgtaaagt

SEQ ID NO: 4984783 - DNA, 15 bp, Homo sapiens
acagacactacatat

SEQ ID NO: 4984784 - DNA, 20 bp, Homo sapiens
acagacactacatatctaaa

SEQ ID NO: 4984785 - DNA, 18 bp, Homo sapiens
acagcggctggacttgga

SEQ ID NO: 4984786 - DNA, 18 bp, Homo sapiens
acatgaaatgcttccaag

SEQ ID NO: 4984787 - DNA, 16 bp, Homo sapiens
accaaagcgaatttta

SEQ ID NO: 4984788 - DNA, 18 bp, Homo sapiens
accaagcctggtcagccc

SEQ ID NO: 4984789 - DNA, 19 bp, Homo sapiens
accaagcctggtcagccca

SEQ ID NO: 4984790 - DNA, 16 bp, Homo sapiens
accagaagcccagaat

SEQ ID NO: 4984791 - DNA, 16 bp, Homo sapiens
accaggaccctttctc

SEQ ID NO: 4984792 - DNA, 14 bp, Homo sapiens
accatctctttacc

SEQ ID NO: 4984793 - DNA, 22 bp, Homo sapiens
acccagctatggttctctcgca

SEQ ID NO: 4984794 - DNA, 13 bp, Homo sapiens
accccctggcttg

SEQ ID NO: 4984795 - DNA, 22 bp, Homo sapiens
acccctggctccaggccagggg

SEQ ID NO: 4984796 - DNA, 12 bp, Homo sapiens
acctccacctcc

SEQ ID NO: 4984797 - DNA, 19 bp, Homo sapiens
acctccatccccctctgtc

SEQ ID NO: 4984798 - DNA, 20 bp, Homo sapiens
acctccatccccctctgtct

SEQ ID NO: 4984799 - DNA, 17 bp, Homo sapiens
acctctgcctcccgggt

SEQ ID NO: 4984800 - DNA, 20 bp, Homo sapiens
acctggcttttctttctacc

SEQ ID NO: 4984801 - DNA, 17 bp, Homo sapiens
actcagaatataacatg

SEQ ID NO: 4984802 - DNA, 20 bp, Homo sapiens
actcagaatataacatgtaa

SEQ ID NO: 4984803 - DNA, 15 bp, Homo sapiens
actcctcctagccac

SEQ ID NO: 4984804 - DNA, 18 bp, Homo sapiens
actcctcctagccaccca

SEQ ID NO: 4984805 - DNA, 18 bp, Homo sapiens
actctactgctgctgaca

SEQ ID NO: 4984806 - DNA, 21 bp, Homo sapiens
actctcgagacttctctgtga

SEQ ID NO: 4984807 - DNA, 15 bp, Homo sapiens
actcttggagcctgc

SEQ ID NO: 4984808 - DNA, 13 bp, Homo sapiens
actgagcttggaa

SEQ ID NO: 4984809 - DNA, 17 bp, Homo sapiens
actgcaacctctgcctc

SEQ ID NO: 4984810 - DNA, 17 bp, Homo sapiens
actgcgcacagccccag

SEQ ID NO: 4984811 - DNA, 14 bp, Homo sapiens
actggagtgcagtg

SEQ ID NO: 4984812 - DNA, 21 bp, Homo sapiens
actggcagtaacctagtgaat

SEQ ID NO: 4984813 - DNA, 19 bp, Homo sapiens
actgttccctgaggtggga

SEQ ID NO: 4984814 - DNA, 22 bp, Homo sapiens
acttccacaagagtgaatttga

SEQ ID NO: 4984815 - DNA, 12 bp, Homo sapiens
agaaaaatatga

SEQ ID NO: 4984816 - DNA, 17 bp, Homo sapiens
agaaacttagaggaaaa

SEQ ID NO: 4984817 - DNA, 14 bp, Homo sapiens
agaagaagtgtgtc

SEQ ID NO: 4984818 - DNA, 22 bp, Homo sapiens
agaagtggaagtgcttgatatg

SEQ ID NO: 4984819 - DNA, 17 bp, Homo sapiens
agaataaggcacaaaat

SEQ ID NO: 4984820 - DNA, 14 bp, Homo sapiens
agaatataacatgt

SEQ ID NO: 4984821 - DNA, 16 bp, Homo sapiens
agaatgtcagtatgtg

SEQ ID NO: 4984822 - DNA, 17 bp, Homo sapiens
agaatgtcagtatgtgg

SEQ ID NO: 4984823 - DNA, 19 bp, Homo sapiens
agaatgtcagtatgtggaa

SEQ ID NO: 4984824 - DNA, 16 bp, Homo sapiens
agacactacatatcta

SEQ ID NO: 4984825 - DNA, 16 bp, Homo sapiens
agacatctactacagc

SEQ ID NO: 4984826 - DNA, 15 bp, Homo sapiens
agaccccctggagac

SEQ ID NO: 4984827 - DNA, 15 bp, Homo sapiens
agagcctgagagtga

SEQ ID NO: 4984828 - DNA, 15 bp, Homo sapiens
agaggaaggaaaagg

SEQ ID NO: 4984829 - DNA, 16 bp, Homo sapiens
agaggggaaaagagat

SEQ ID NO: 4984830 - DNA, 19 bp, Homo sapiens
agagtggggtaggttggga

SEQ ID NO: 4984831 - DNA, 12 bp, Homo sapiens
agataaatatta

SEQ ID NO: 4984832 - DNA, 19 bp, Homo sapiens
agatagccccacaggaggt

SEQ ID NO: 4984833 - DNA, 18 bp, Homo sapiens
agatgatgaaaatattta

SEQ ID NO: 4984834 - DNA, 20 bp, Homo sapiens
agcaatctgcattttaacaa

SEQ ID NO: 4984835 - DNA, 13 bp, Homo sapiens
agcaccccagacc

SEQ ID NO: 4984836 - DNA, 20 bp, Homo sapiens
agcaggtccccagctttggc

SEQ ID NO: 4984837 - DNA, 17 bp, Homo sapiens
agcatgacaacttttaa

SEQ ID NO: 4984838 - DNA, 15 bp, Homo sapiens
agccaagaggctgca

SEQ ID NO: 4984839 - DNA, 15 bp, Homo sapiens
agccaggccactggc

SEQ ID NO: 4984840 - DNA, 14 bp, Homo sapiens
agcctccacttccc

SEQ ID NO: 4984841 - DNA, 18 bp, Homo sapiens
agcctgactttctctcca

SEQ ID NO: 4984842 - DNA, 12 bp, Homo sapiens
agcctgcagagc

SEQ ID NO: 4984843 - DNA, 15 bp, Homo sapiens
ccaccagaagcccag

SEQ ID NO: 4984844 - DNA, 18 bp, Homo sapiens
ccaccagaagcccagaat

SEQ ID NO: 4984845 - DNA, 19 bp, Homo sapiens
ccacccccaggacccctga

SEQ ID NO: 4984846 - DNA, 21 bp, Homo sapiens
ccaccttggcctcccaaagtg

SEQ ID NO: 4984847 - DNA, 16 bp, Homo sapiens
ccagaattctggacaa

SEQ ID NO: 4984848 - DNA, 16 bp, Homo sapiens
ccagaccccctggaga

SEQ ID NO: 4984849 - DNA, 17 bp, Homo sapiens
ccagaggaaggaaaagg

SEQ ID NO: 4984850 - DNA, 18 bp, Homo sapiens
ccagaggaaggaaaagga

SEQ ID NO: 4984851 - DNA, 19 bp, Homo sapiens
ccaggaccctttctccaca

SEQ ID NO: 4984852 - DNA, 16 bp, Homo sapiens
ccaggccactggcccc

SEQ ID NO: 4984853 - DNA, 22 bp, Homo sapiens
ccagggggccagtccctgaggc

SEQ ID NO: 4984854 - DNA, 23 bp, Homo sapiens
ccagggggccagtccctgaggca

SEQ ID NO: 4984855 - DNA, 16 bp, Homo sapiens
ccatccccctctgtct

SEQ ID NO: 4984856 - DNA, 14 bp, Homo sapiens
ccatctattctctg

SEQ ID NO: 4984857 - DNA, 17 bp, Homo sapiens
cccaaaccaccagaagc

SEQ ID NO: 4984858 - DNA, 18 bp, Homo sapiens
cccaaaccaccagaagcc

SEQ ID NO: 4984859 - DNA, 21 bp, Homo sapiens
cccaagtctctgggccccagg

SEQ ID NO: 4984860 - DNA, 16 bp, Homo sapiens
cccacaggaggtggtc

SEQ ID NO: 4984861 - DNA, 22 bp, Homo sapiens
cccagaataaactggcagctca

SEQ ID NO: 4984862 - DNA, 24 bp, Homo sapiens
cccagaataaactggcagctcagc

SEQ ID NO: 4984863 - DNA, 19 bp, Homo sapiens
cccaggcaccccctggctt

SEQ ID NO: 4984864 - DNA, 18 bp, Homo sapiens
cccatctattctctgcct

SEQ ID NO: 4984865 - DNA, 10 bp, Homo sapiens
cccctgccag

SEQ ID NO: 4984866 - DNA, 23 bp, Homo sapiens
cccctggtggttcactcttggag

SEQ ID NO: 4984867 - DNA, 13 bp, Homo sapiens
ccctccacctgct

SEQ ID NO: 4984868 - DNA, 23 bp, Homo sapiens
ccctccactctcctcttccaggc

SEQ ID NO: 4984869 - DNA, 14 bp, Homo sapiens
ccctgaaggaacca

SEQ ID NO: 4984870 - DNA, 18 bp, Homo sapiens
ccctgaggcaggtcccca

SEQ ID NO: 4984871 - DNA, 13 bp, Homo sapiens
ccctggctccagg

SEQ ID NO: 4984872 - DNA, 10 bp, Homo sapiens
ccctggcttg

SEQ ID NO: 4984873 - DNA, 17 bp, Homo sapiens
ccgcctcctacagccca

SEQ ID NO: 4984874 - DNA, 17 bp, Homo sapiens
cctaccctacccccaca

SEQ ID NO: 4984875 - DNA, 12 bp, Homo sapiens
cctagccaccca

SEQ ID NO: 4984876 - DNA, 14 bp, Homo sapiens
cctagtagctggga

SEQ ID NO: 4984877 - DNA, 20 bp, Homo sapiens
cctagtagctgggattacag

SEQ ID NO: 4984878 - DNA, 21 bp, Homo sapiens
cctataatacaaatacacaat

SEQ ID NO: 4984879 - DNA, 12 bp, Homo sapiens
cctcacctccat

SEQ ID NO: 4984880 - DNA, 13 bp, Homo sapiens
cctcagcctccca

SEQ ID NO: 4984881 - DNA, 23 bp, Homo sapiens
cctcagcctcccaagtagctggg

SEQ ID NO: 4984882 - DNA, 13 bp, Homo sapiens
cctccactctcct

SEQ ID NO: 4984883 - DNA, 19 bp, Homo sapiens
cctcccaacagagctgggc

SEQ ID NO: 4984884 - DNA, 17 bp, Homo sapiens
cctcctgctgcctaata

SEQ ID NO: 4984885 - DNA, 18 bp, Homo sapiens
cctctgcctcccaaagtg

SEQ ID NO: 4984886 - DNA, 19 bp, Homo sapiens
cctgaagagaagggcaggg

SEQ ID NO: 4984887 - DNA, 17 bp, Homo sapiens
cctgagatctctgcagg

SEQ ID NO: 4984888 - DNA, 18 bp, Homo sapiens
cctgagatctctgcagga

SEQ ID NO: 4984889 - DNA, 18 bp, Homo sapiens
cctgaggcaggtccccag

SEQ ID NO: 4984890 - DNA, 19 bp, Homo sapiens
cctgaggcaggtccccaga

SEQ ID NO: 4984891 - DNA, 18 bp, Homo sapiens
cctgagttcctagccacc

SEQ ID NO: 4984892 - DNA, 19 bp, Homo sapiens
cctgagttcctagccaccg

SEQ ID NO: 4984893 - DNA, 14 bp, Homo sapiens
cctgccactcaggc

SEQ ID NO: 4984894 - DNA, 16 bp, Homo sapiens
cctggctccaggccag

SEQ ID NO: 4984895 - DNA, 20 bp, Homo sapiens
cctggtcctcacactcaccc

SEQ ID NO: 4984896 - DNA, 17 bp, Homo sapiens
cctgtgccttttgccat

SEQ ID NO: 4984897 - DNA, 17 bp, Homo sapiens
ccttcaaagcttttgta

SEQ ID NO: 4984898 - DNA, 23 bp, Homo sapiens
ccttcacatttactagctgtgca

SEQ ID NO: 4984899 - DNA, 10 bp, Homo sapiens
ccttctcctc

SEQ ID NO: 4984900 - DNA, 23 bp, Homo sapiens
ccttctcctcttgtagccagaat

SEQ ID NO: 4984901 - DNA, 16 bp, Homo sapiens
ccttggtcctgcctct

SEQ ID NO: 4984902 - DNA, 22 bp, Homo sapiens
ccttggtcctgcctctttgagt

SEQ ID NO: 4984903 - DNA, 14 bp, Homo sapiens
cctttactttctct

SEQ ID NO: 4984904 - DNA, 16 bp, Homo sapiens
cctttactttctctct

SEQ ID NO: 4984905 - DNA, 14 bp, Homo sapiens
cctttctccacagg

SEQ ID NO: 4984906 - DNA, 14 bp, Homo sapiens
cctttgtcccagaa

SEQ ID NO: 4984907 - DNA, 15 bp, Homo sapiens
cgcacaccaccacac

SEQ ID NO: 4984908 - DNA, 14 bp, Homo sapiens
cgcctgcctctgcc

SEQ ID NO: 4984909 - DNA, 15 bp, Homo sapiens
cgcctgcctctgcct

SEQ ID NO: 4984910 - DNA, 18 bp, Homo sapiens
cggcagcatcccagccag

SEQ ID NO: 4984911 - DNA, 17 bp, Homo sapiens
cggctcactgcaacctc

SEQ ID NO: 4984912 - DNA, 14 bp, Homo sapiens
ctaagctcctcctt

SEQ ID NO: 4984913 - DNA, 15 bp, Homo sapiens
ctaataaagagactg

SEQ ID NO: 4984914 - DNA, 16 bp, Homo sapiens
ctaataaagagactga

SEQ ID NO: 4984915 - DNA, 19 bp, Homo sapiens
ctaatgatcaaaacatgct

SEQ ID NO: 4984916 - DNA, 18 bp, Homo sapiens
ctaccttggtcctgcctc

SEQ ID NO: 4984917 - DNA, 22 bp, Homo sapiens
ctactcacttctcctttaaatt

SEQ ID NO: 4984918 - DNA, 23 bp, Homo sapiens
ctactgttataattattccttct

SEQ ID NO: 4984919 - DNA, 19 bp, Homo sapiens
ctagccaccgcctcctaca

SEQ ID NO: 4984920 - DNA, 16 bp, Homo sapiens
ctagctgtgcaacctt

SEQ ID NO: 4984921 - DNA, 20 bp, Homo sapiens
ctatatgttgaccattccaa

SEQ ID NO: 4984922 - DNA, 16 bp, Homo sapiens
ctatctgtttacagtg

SEQ ID NO: 4984923 - DNA, 20 bp, Homo sapiens
ctatctgtttacagtgttcc

SEQ ID NO: 4984924 - DNA, 21 bp, Homo sapiens
ctatctgtttacagtgttccg

SEQ ID NO: 4984925 - DNA, 20 bp, Homo sapiens
ctatggggatagatgtgtgg

SEQ ID NO: 4984926 - DNA, 23 bp, Homo sapiens
ctattttatatgatgggggaaaa

SEQ ID NO: 4984927 - DNA, 13 bp, Homo sapiens
ctcacactcaccc

SEQ ID NO: 4984928 - DNA, 12 bp, Homo sapiens
ctcactctgtca

SEQ ID NO: 4984929 - DNA, 20 bp, Homo sapiens
ctcactgcaacctccacctc

SEQ ID NO: 4984930 - DNA, 22 bp, Homo sapiens
ctcactgcaacctctgcctccc

SEQ ID NO: 4984931 - DNA, 23 bp, Homo sapiens
ctcactgctaagaatatttgaat

SEQ ID NO: 4984932 - DNA, 16 bp, Homo sapiens
ctcaggcccaaagcct

SEQ ID NO: 4984933 - DNA, 20 bp, Homo sapiens
ctcaggcctgactctcagca

SEQ ID NO: 4984934 - DNA, 21 bp, Homo sapiens
ctcagtgtctggctgcagagc

SEQ ID NO: 4984935 - DNA, 17 bp, Homo sapiens
ctcagttctcttcactc

SEQ ID NO: 4984936 - DNA, 15 bp, Homo sapiens
ctcattccagaggaa

SEQ ID NO: 4984937 - DNA, 23 bp, Homo sapiens
ctccaccaagcctggtcagccca

SEQ ID NO: 4984938 - DNA, 16 bp, Homo sapiens
ctcctagccacccacc

SEQ ID NO: 4984939 - DNA, 21 bp, Homo sapiens
ctcctgctgcctaataaagag

SEQ ID NO: 4984940 - DNA, 12 bp, Homo sapiens
ctcgagtgaatt

SEQ ID NO: 4984941 - DNA, 18 bp, Homo sapiens
ctcgggtgatccacccac

SEQ ID NO: 4984942 - DNA, 19 bp, Homo sapiens
ctctccagcggtccaaagt

SEQ ID NO: 4984943 - DNA, 13 bp, Homo sapiens
ctctgtcacccag

SEQ ID NO: 4984944 - DNA, 18 bp, Homo sapiens
ctctgtgaacttccctac

SEQ ID NO: 4984945 - DNA, 19 bp, Homo sapiens
ctctgttcctgagccccca

SEQ ID NO: 4984946 - DNA, 13 bp, Homo sapiens
ctctttaaaatat

SEQ ID NO: 4984947 - DNA, 17 bp, Homo sapiens
ctgaggcaggtccccag

SEQ ID NO: 4984948 - DNA, 19 bp, Homo sapiens
ctgaggcaggtccccagac

SEQ ID NO: 4984949 - DNA, 16 bp, Homo sapiens
ctgcaaatccttgtgg

SEQ ID NO: 4984950 - DNA, 19 bp, Homo sapiens
ctgcaaatccttgtgggaa

SEQ ID NO: 4984951 - DNA, 16 bp, Homo sapiens
ctgcaacctccacctc

SEQ ID NO: 4984952 - DNA, 23 bp, Homo sapiens
ctgcaacctccacctccgggttc

SEQ ID NO: 4984953 - DNA, 14 bp, Homo sapiens
ctgcaacctctgcc

SEQ ID NO: 4984954 - DNA, 18 bp, Homo sapiens
ctgcaacctctgcctccc

SEQ ID NO: 4984955 - DNA, 15 bp, Homo sapiens
ctgcagccaggccac

SEQ ID NO: 4984956 - DNA, 16 bp, Homo sapiens
ctgcagccaggccact

SEQ ID NO: 4984957 - DNA, 17 bp, Homo sapiens
ctgcagccaggccactg

SEQ ID NO: 4984958 - DNA, 21 bp, Homo sapiens
ctgcaggtcagtttggaatga

SEQ ID NO: 4984959 - DNA, 17 bp, Homo sapiens
tgaggcaggtccccaga

SEQ ID NO: 4984960 - DNA, 22 bp, Homo sapiens
tgagggtgactatggagctgag

SEQ ID NO: 4984961 - DNA, 19 bp, Homo sapiens
tgaggtggaagagggctgc

SEQ ID NO: 4984962 - DNA, 24 bp, Homo sapiens
tgagttacttgctgccctgtgctc

SEQ ID NO: 4984963 - DNA, 18 bp, Homo sapiens
tgagttcataaatttatg

SEQ ID NO: 4984964 - DNA, 18 bp, Homo sapiens
tgagttcctagccaccgc

SEQ ID NO: 4984965 - DNA, 21 bp, Homo sapiens
tgatagaaggctatggggata

SEQ ID NO: 4984966 - DNA, 16 bp, Homo sapiens
tgatagtaggccttca

SEQ ID NO: 4984967 - DNA, 22 bp, Homo sapiens
tgatccacccaccttggcctcc

SEQ ID NO: 4984968 - DNA, 20 bp, Homo sapiens
tgatccgcctgcctctgcct

SEQ ID NO: 4984969 - DNA, 18 bp, Homo sapiens
tgatgaaaatatttaaag

SEQ ID NO: 4984970 - DNA, 15 bp, Homo sapiens
tgatgggtcagttgt

SEQ ID NO: 4984971 - DNA, 19 bp, Homo sapiens
tgcaacctccacctccggg

SEQ ID NO: 4984972 - DNA, 20 bp, Homo sapiens
tgcaacctccacctccgggt

SEQ ID NO: 4984973 - DNA, 21 bp, Homo sapiens
tgcaacctccacctccgggtt

SEQ ID NO: 4984974 - DNA, 14 bp, Homo sapiens
tgcaacctctgcct

SEQ ID NO: 4984975 - DNA, 17 bp, Homo sapiens
tgcaggaaatggctgtg

SEQ ID NO: 4984976 - DNA, 19 bp, Homo sapiens
tgccagactggagtgcagt

SEQ ID NO: 4984977 - DNA, 16 bp, Homo sapiens
tgccatcatgtttaca

SEQ ID NO: 4984978 - DNA, 17 bp, Homo sapiens
tgcccaccctccactct

SEQ ID NO: 4984979 - DNA, 18 bp, Homo sapiens
tgcccagaatgaggctgc

SEQ ID NO: 4984980 - DNA, 19 bp, Homo sapiens
tgcccagaatgaggctgct

SEQ ID NO: 4984981 - DNA, 13 bp, Homo sapiens
tgcctcggcctcc

SEQ ID NO: 4984982 - DNA, 17 bp, Homo sapiens
tgcctggtcctcacact

SEQ ID NO: 4984983 - DNA, 18 bp, Homo sapiens
tgctaaacaagtaagaaa

SEQ ID NO: 4984984 - DNA, 23 bp, Homo sapiens
tgctaaacaagtaagaaaaataa

SEQ ID NO: 4984985 - DNA, 22 bp, Homo sapiens
tgctaagaatatttgaatgtat

SEQ ID NO: 4984986 - DNA, 20 bp, Homo sapiens
tgctactagattgtgagctc

SEQ ID NO: 4984987 - DNA, 16 bp, Homo sapiens
tgctatgagctgggga

SEQ ID NO: 4984988 - DNA, 19 bp, Homo sapiens
tgctcagtgtctggctgca

SEQ ID NO: 4984989 - DNA, 11 bp, Homo sapiens
tgcttcataca

SEQ ID NO: 4984990 - DNA, 21 bp, Homo sapiens
tgcttgatatgtaagtacttc

SEQ ID NO: 4984991 - DNA, 19 bp, Homo sapiens
tggaaaagccaagaggctg

SEQ ID NO: 4984992 - DNA, 20 bp, Homo sapiens
tggaatgatgggtcagttgt

SEQ ID NO: 4984993 - DNA, 20 bp, Homo sapiens
tggaattattttaaaagata

SEQ ID NO: 4984994 - DNA, 22 bp, Homo sapiens
tggaattgggtggggggcttca

SEQ ID NO: 4984995 - DNA, 15 bp, Homo sapiens
tggatctgtgagggg

SEQ ID NO: 4984996 - DNA, 19 bp, Homo sapiens
tggatctgtgaggggctct

SEQ ID NO: 4984997 - DNA, 20 bp, Homo sapiens
tggattcaattcctgtcctt

SEQ ID NO: 4984998 - DNA, 17 bp, Homo sapiens
tggattctgagagctgt

SEQ ID NO: 4984999 - DNA, 15 bp, Homo sapiens
tggcctccagaggag

SEQ ID NO: 4985000 - DNA, 20 bp, Homo sapiens
tggctccattggtgttgaca

SEQ ID NO: 4985001 - DNA, 15 bp, Homo sapiens
tggctgcagagcagt

SEQ ID NO: 4985002 - DNA, 18 bp, Homo sapiens
tggctgcagagcagtggg

SEQ ID NO: 4985003 - DNA, 16 bp, Homo sapiens
tggctgtggagtgtgg

SEQ ID NO: 4985004 - DNA, 13 bp, Homo sapiens
tggcttgaacctt

SEQ ID NO: 4985005 - DNA, 20 bp, Homo sapiens
tgggagaatgtcagtatgtg

SEQ ID NO: 4985006 - DNA, 22 bp, Homo sapiens
tgggagaatgtcagtatgtgga

SEQ ID NO: 4985007 - DNA, 14 bp, Homo sapiens
tgggagatgtggaa

SEQ ID NO: 4985008 - DNA, 22 bp, Homo sapiens
tggggacaggggcaggaggaag

SEQ ID NO: 4985009 - DNA, 18 bp, Homo sapiens
tggggatagatgtgtgga

SEQ ID NO: 4985010 - DNA, 20 bp, Homo sapiens
tggggattgggcccctgcca

SEQ ID NO: 4985011 - DNA, 15 bp, Homo sapiens
tggggctcagagtgg

SEQ ID NO: 4985012 - DNA, 17 bp, Homo sapiens
tggggggcttcatacac

SEQ ID NO: 4985013 - DNA, 13 bp, Homo sapiens
tgggtctgtgtgt

SEQ ID NO: 4985014 - DNA, 16 bp, Homo sapiens
tgggtggggggcttca

SEQ ID NO: 4985015 - DNA, 18 bp, Homo sapiens
tggtattttaagagaaaa

SEQ ID NO: 4985016 - DNA, 14 bp, Homo sapiens
tggtcctcacactc

SEQ ID NO: 4985017 - DNA, 14 bp, Homo sapiens
tggtctccactggg

SEQ ID NO: 4985018 - DNA, 19 bp, Homo sapiens
tggtctcgatatcctgatc

SEQ ID NO: 4985019 - DNA, 21 bp, Homo sapiens
tggtgttcaaaaaacttgtaa

SEQ ID NO: 4985020 - DNA, 22 bp, Homo sapiens
tggttcactcttggagcctgca

SEQ ID NO: 4985021 - DNA, 15 bp, Homo sapiens
tggttccagcctgcc

SEQ ID NO: 4985022 - DNA, 16 bp, Homo sapiens
tgtaaaataaaaccac

SEQ ID NO: 4985023 - DNA, 17 bp, Homo sapiens
tgtaaataaaggaacca

SEQ ID NO: 4985024 - DNA, 21 bp, Homo sapiens
tgtaatttaaaattgtgatgt

SEQ ID NO: 4985025 - DNA, 14 bp, Homo sapiens
tgtacctctgcctc

SEQ ID NO: 4985026 - DNA, 13 bp, Homo sapiens
tgtatgcttcata

SEQ ID NO: 4985027 - DNA, 21 bp, Homo sapiens
tgtatgtgggggtctgtgtgt

SEQ ID NO: 4985028 - DNA, 22 bp, Homo sapiens
tgtcacccttaggccagcacca

SEQ ID NO: 4985029 - DNA, 18 bp, Homo sapiens
tgtcagtatgtggaagtg

SEQ ID NO: 4985030 - DNA, 12 bp, Homo sapiens
tgtccttctcct

SEQ ID NO: 4985031 - DNA, 13 bp, Homo sapiens
tgtccttctcctc

SEQ ID NO: 4985032 - DNA, 14 bp, Homo sapiens
tgtctggctgcaga

SEQ ID NO: 4985033 - DNA, 16 bp, Homo sapiens
tgtctggctgcagagc

SEQ ID NO: 4985034 - DNA, 21 bp, Homo sapiens
tgtctttccactcctcctagc

SEQ ID NO: 4985035 - DNA, 17 bp, Homo sapiens
tgtgacccactgcgcac

SEQ ID NO: 4985036 - DNA, 23 bp, Homo sapiens
tgtgcccaccctccactctcctc

SEQ ID NO: 4985037 - DNA, 16 bp, Homo sapiens
tgtgccttttgccatc

SEQ ID NO: 4985038 - DNA, 19 bp, Homo sapiens
tgtggaaaagccaagaggc

SEQ ID NO: 4985039 - DNA, 23 bp, Homo sapiens
tgtggaaaagccaagaggctgca

SEQ ID NO: 4985040 - DNA, 14 bp, Homo sapiens
tgtgggagtgtgta

SEQ ID NO: 4985041 - DNA, 15 bp, Homo sapiens
tgtgggagtgtgtaa

SEQ ID NO: 4985042 - DNA, 11 bp, Homo sapiens
tgtgtaattta

SEQ ID NO: 4985043 - DNA, 18 bp, Homo sapiens
tgtgtaatttaaaattgt

SEQ ID NO: 4985044 - DNA, 19 bp, Homo sapiens
tgtgtaatttaaaattgtg

SEQ ID NO: 4985045 - DNA, 23 bp, Homo sapiens
tgtgtatgtgggggtctgtgtgt

SEQ ID NO: 4985046 - DNA, 17 bp, Homo sapiens
tgtgtcagaaacatgaa

SEQ ID NO: 4985047 - DNA, 13 bp, Homo sapiens
tgtgtgctctcca

SEQ ID NO: 4985048 - DNA, 11 bp, Homo sapiens
tgtgtgtatgt

SEQ ID NO: 4985049 - DNA, 12 bp, Homo sapiens
tgtgtgtgggag

SEQ ID NO: 4985050 - DNA, 16 bp, Homo sapiens
tgtgtgtgtgtatgtg

SEQ ID NO: 4985051 - DNA, 16 bp, Homo sapiens
tgtttatgtgtgtgtg

SEQ ID NO: 4985052 - DNA, 21 bp, Homo sapiens
ttaaaatatttgtctttaaac

SEQ ID NO: 4985053 - DNA, 22 bp, Homo sapiens
ttaaaatatttgtctttaaaca

SEQ ID NO: 4985054 - DNA, 13 bp, Homo sapiens
ttaaaattgtgat

SEQ ID NO: 4985055 - DNA, 13 bp, Homo sapiens
ttaaagaaaaata

SEQ ID NO: 4985056 - DNA, 19 bp, Homo sapiens
ttaacaagaggggaaaaca

SEQ ID NO: 4985057 - DNA, 15 bp, Homo sapiens
ttaacagtctccaat

SEQ ID NO: 4985058 - DNA, 15 bp, Homo sapiens
ttacatatctgtccc

SEQ ID NO: 4985059 - DNA, 21 bp, Homo sapiens
ttactaggtgcccagaatgag

SEQ ID NO: 4985060 - DNA, 16 bp, Homo sapiens
ttagaagaagtgtgtc

SEQ ID NO: 4985061 - DNA, 13 bp, Homo sapiens
ttagaggaaaagg

SEQ ID NO: 4985062 - DNA, 18 bp, Homo sapiens
ttatgggatgtaaacaat

SEQ ID NO: 4985063 - DNA, 12 bp, Homo sapiens
ttatttataaac

SEQ ID NO: 4985064 - DNA, 14 bp, Homo sapiens
ttcactcttggagc

SEQ ID NO: 4985065 - DNA, 23 bp, Homo sapiens
ttcagagtcctcattataaaatg

SEQ ID NO: 4985066 - DNA, 14 bp, Homo sapiens
ttccaaagttctta

SEQ ID NO: 4985067 - DNA, 19 bp, Homo sapiens
ttccaaagttcttatctct

SEQ ID NO: 4985068 - DNA, 14 bp, Homo sapiens
ttccaagagcctga

SEQ ID NO: 4985069 - DNA, 16 bp, Homo sapiens
ttccactcctcctagc

SEQ ID NO: 4985070 - DNA, 21 bp, Homo sapiens
ttcctagccaccgcctcctac

SEQ ID NO: 4985071 - DNA, 22 bp, Homo sapiens
ttcctagccaccgcctcctaca

SEQ ID NO: 4985072 - DNA, 21 bp, Homo sapiens
ttcctgaggaagagggactgt

SEQ ID NO: 4985073 - DNA, 15 bp, Homo sapiens
ttcctgtccttcaca

SEQ ID NO: 4985074 - DNA, 15 bp, Homo sapiens
ttctagcatttcttc

SEQ ID NO: 4985075 - DNA, 17 bp, Homo sapiens
tgagagctgtgcatcag

SEQ ID NO: 4985076 - DNA, 17 bp, Homo sapiens
tgaggaagagggactgt

SEQ ID NO: 4985077 - DNA, 13 bp, Homo sapiens
tgaggcaggtccc

SEQ ID NO: 4985078 - DNA, 16 bp, Homo sapiens
tgaggctgctttccaa

SEQ ID NO: 4985079 - DNA, 14 bp, Homo sapiens
tgagttcctagcca

SEQ ID NO: 4985080 - DNA, 17 bp, Homo sapiens
tgagttggctgggaata

SEQ ID NO: 4985081 - DNA, 23 bp, Homo sapiens
tgataattttatttataaactag

SEQ ID NO: 4985082 - DNA, 12 bp, Homo sapiens
tgatacttccaa

SEQ ID NO: 4985083 - DNA, 19 bp, Homo sapiens
tgatacttccaagtgataa

SEQ ID NO: 4985084 - DNA, 20 bp, Homo sapiens
tgatatgtaagtacttccac

SEQ ID NO: 4985085 - DNA, 18 bp, Homo sapiens
tgatccagccctgagttc

SEQ ID NO: 4985086 - DNA, 22 bp, Homo sapiens
tgatctcgctgtaagatttgtc

SEQ ID NO: 4985087 - DNA, 21 bp, Homo sapiens
tgatcttactctactgctgct

SEQ ID NO: 4985088 - DNA, 14 bp, Homo sapiens
tgatgaaaatattt

SEQ ID NO: 4985089 - DNA, 15 bp, Homo sapiens
tgatgaaaatattta

SEQ ID NO: 4985090 - DNA, 22 bp, Homo sapiens
tgatttggtcagattgggataa

SEQ ID NO: 4985091 - DNA, 13 bp, Homo sapiens
tgcaacctccacc

SEQ ID NO: 4985092 - DNA, 20 bp, Homo sapiens
tgcaacctctgcctcccggg

SEQ ID NO: 4985093 - DNA, 23 bp, Homo sapiens
tgcaacctctgcctcccgggttc

SEQ ID NO: 4985094 - DNA, 22 bp, Homo sapiens
tgcaatgtagaggggaaaagag

SEQ ID NO: 4985095 - DNA, 22 bp, Homo sapiens
tgcagagcagtgggcctggcca

SEQ ID NO: 4985096 - DNA, 20 bp, Homo sapiens
tgccagactggagtgcagtg

SEQ ID NO: 4985097 - DNA, 18 bp, Homo sapiens
tgccaggatggaatgatg

SEQ ID NO: 4985098 - DNA, 17 bp, Homo sapiens
tgcccagaatgaggctg

SEQ ID NO: 4985099 - DNA, 15 bp, Homo sapiens
tgcctaataaagaga

SEQ ID NO: 4985100 - DNA, 15 bp, Homo sapiens
tgcctctgcctccca

SEQ ID NO: 4985101 - DNA, 21 bp, Homo sapiens
tgctaaacaagtaagaaaaat

SEQ ID NO: 4985102 - DNA, 17 bp, Homo sapiens
tgctaagaatatttgaa

SEQ ID NO: 4985103 - DNA, 19 bp, Homo sapiens
tgctatgagctggggatgt

SEQ ID NO: 4985104 - DNA, 20 bp, Homo sapiens
tgctatgagctggggatgtc

SEQ ID NO: 4985105 - DNA, 17 bp, Homo sapiens
tgctgcctaataaagag

SEQ ID NO: 4985106 - DNA, 16 bp, Homo sapiens
tgcttcatacagggat

SEQ ID NO: 4985107 - DNA, 13 bp, Homo sapiens
tgctttatgcaac

SEQ ID NO: 4985108 - DNA, 15 bp, Homo sapiens
tggaagagggctgca

SEQ ID NO: 4985109 - DNA, 21 bp, Homo sapiens
tggaagtgtgggtctgtgtgt

SEQ ID NO: 4985110 - DNA, 17 bp, Homo sapiens
tggaattattttaaaag

SEQ ID NO: 4985111 - DNA, 17 bp, Homo sapiens
tggactgttccctgagg

SEQ ID NO: 4985112 - DNA, 11 bp, Homo sapiens
tggagcctgca

SEQ ID NO: 4985113 - DNA, 16 bp, Homo sapiens
tggagcctgcagagct

SEQ ID NO: 4985114 - DNA, 19 bp, Homo sapiens
tggattcaattcctgtcct

SEQ ID NO: 4985115 - DNA, 17 bp, Homo sapiens
tggcacgatctcggctc

SEQ ID NO: 4985116 - DNA, 14 bp, Homo sapiens
tggcccctgagatc

SEQ ID NO: 4985117 - DNA, 19 bp, Homo sapiens
tgggagaatgtcagtatgt

SEQ ID NO: 4985118 - DNA, 14 bp, Homo sapiens
tgggccccaggcac

SEQ ID NO: 4985119 - DNA, 22 bp, Homo sapiens
tggggagggatttggggctcag

SEQ ID NO: 4985120 - DNA, 14 bp, Homo sapiens
tggggctgattgta

SEQ ID NO: 4985121 - DNA, 11 bp, Homo sapiens
tgggggatgta

SEQ ID NO: 4985122 - DNA, 15 bp, Homo sapiens
tgggtctgtgtgtgt

SEQ ID NO: 4985123 - DNA, 20 bp, Homo sapiens
tgggtggggggcttcataca

SEQ ID NO: 4985124 - DNA, 21 bp, Homo sapiens
tgggtggggggcttcatacac

SEQ ID NO: 4985125 - DNA, 11 bp, Homo sapiens
tggtcagccca

SEQ ID NO: 4985126 - DNA, 13 bp, Homo sapiens
tggtcctgcctct

SEQ ID NO: 4985127 - DNA, 16 bp, Homo sapiens
tggtcctgcctctttg

SEQ ID NO: 4985128 - DNA, 19 bp, Homo sapiens
tggtcctgcctctttgagt

SEQ ID NO: 4985129 - DNA, 22 bp, Homo sapiens
tggtgaccttccaagagcctga

SEQ ID NO: 4985130 - DNA, 13 bp, Homo sapiens
tggtgtccttctc

SEQ ID NO: 4985131 - DNA, 17 bp, Homo sapiens
tggttcactcttggagc

SEQ ID NO: 4985132 - DNA, 15 bp, Homo sapiens
tgtaaatttatgtga

SEQ ID NO: 4985133 - DNA, 16 bp, Homo sapiens
tgtaaatttatgtgat

SEQ ID NO: 4985134 - DNA, 20 bp, Homo sapiens
tgtaatttaaaattgtgatg

SEQ ID NO: 4985135 - DNA, 17 bp, Homo sapiens
tgtatattttaatgaat

SEQ ID NO: 4985136 - DNA, 16 bp, Homo sapiens
tgtatgcttcatacag

SEQ ID NO: 4985137 - DNA, 11 bp, Homo sapiens
tgtccttctcc

SEQ ID NO: 4985138 - DNA, 22 bp, Homo sapiens
tgtccttctcctcttgtagcca

SEQ ID NO: 4985139 - DNA, 17 bp, Homo sapiens
tgtctggctgcagagca

SEQ ID NO: 4985140 - DNA, 18 bp, Homo sapiens
tgtgaggggctctctcat

SEQ ID NO: 4985141 - DNA, 11 bp, Homo sapiens
tgtgatgtgtc

SEQ ID NO: 4985142 - DNA, 14 bp, Homo sapiens
tgtgggtctgtgtg

SEQ ID NO: 4985143 - DNA, 16 bp, Homo sapiens
tgtgggtctgtgtgtg

SEQ ID NO: 4985144 - DNA, 20 bp, Homo sapiens
tgtgggtctgtgtgtgtgta

SEQ ID NO: 4985145 - DNA, 23 bp, Homo sapiens
tgtgtaatttaaaattgtgatgt

SEQ ID NO: 4985146 - DNA, 14 bp, Homo sapiens
tgtgtatgtggggg

SEQ ID NO: 4985147 - DNA, 15 bp, Homo sapiens
tgtgtcagaaacatg

SEQ ID NO: 4985148 - DNA, 21 bp, Homo sapiens
tgtgtcagaaacatgaaatgc

SEQ ID NO: 4985149 - DNA, 13 bp, Homo sapiens
tgtgtgtgtgtat

SEQ ID NO: 4985150 - DNA, 23 bp, Homo sapiens
tgttgaccattccaaagttctta

SEQ ID NO: 4985151 - DNA, 21 bp, Homo sapiens
tgtttaaaactcagaatataa

SEQ ID NO: 4985152 - DNA, 21 bp, Homo sapiens
tgtttacagaggacagtattt

SEQ ID NO: 4985153 - DNA, 12 bp, Homo sapiens
tgtttacagtgt

SEQ ID NO: 4985154 - DNA, 21 bp, Homo sapiens
ttaaaactcagaatataacat

SEQ ID NO: 4985155 - DNA, 18 bp, Homo sapiens
ttaaaagataaatattat

SEQ ID NO: 4985156 - DNA, 15 bp, Homo sapiens
ttaagggggaaaact

SEQ ID NO: 4985157 - DNA, 19 bp, Homo sapiens
ttaagggggaaaactgttc

SEQ ID NO: 4985158 - DNA, 20 bp, Homo sapiens
ttagagtatacctcctatat

SEQ ID NO: 4985159 - DNA, 16 bp, Homo sapiens
ttatgggatgtaaaca

SEQ ID NO: 4985160 - DNA, 10 bp, Homo sapiens
ttatgtgtgt

SEQ ID NO: 4985161 - DNA, 12 bp, Homo sapiens
ttatgtgtgtgt

SEQ ID NO: 4985162 - DNA, 15 bp, Homo sapiens
ttattacagtccttc

SEQ ID NO: 4985163 - DNA, 21 bp, Homo sapiens
ttatttgtttgagacagggtc

SEQ ID NO: 4985164 - DNA, 23 bp, Homo sapiens
attgggtggggggcttcatacac

SEQ ID NO: 4985165 - DNA, 17 bp, Homo sapiens
attgtagagccagaggt

SEQ ID NO: 4985166 - DNA, 13 bp, Homo sapiens
attgtgatgtgtc

SEQ ID NO: 4985167 - DNA, 18 bp, Homo sapiens
attgtgtcagaaacatga

SEQ ID NO: 4985168 - DNA, 20 bp, Homo sapiens
attgtgtcagaaacatgaaa

SEQ ID NO: 4985169 - DNA, 19 bp, Homo sapiens
atttaaaattgtgatgtgt

SEQ ID NO: 4985170 - DNA, 19 bp, Homo sapiens
atttagtgctaaacaagta

SEQ ID NO: 4985171 - DNA, 18 bp, Homo sapiens
atttataaactaggtaaa

SEQ ID NO: 4985172 - DNA, 18 bp, Homo sapiens
atttcaccagaagttaca

SEQ ID NO: 4985173 - DNA, 23 bp, Homo sapiens
atttcttaacagtctccaatccc

SEQ ID NO: 4985174 - DNA, 18 bp, Homo sapiens
atttgaatgtatgcttca

SEQ ID NO: 4985175 - DNA, 23 bp, Homo sapiens
atttgaatgtatgcttcatacag

SEQ ID NO: 4985176 - DNA, 13 bp, Homo sapiens
atttgcattgtgt

SEQ ID NO: 4985177 - DNA, 18 bp, Homo sapiens
atttgtaaatttatgtga

SEQ ID NO: 4985178 - DNA, 15 bp, Homo sapiens
atttgtctttaaaca

SEQ ID NO: 4985179 - DNA, 11 bp, Homo sapiens
attttaacaag

SEQ ID NO: 4985180 - DNA, 18 bp, Homo sapiens
attttaagggggaaaact

SEQ ID NO: 4985181 - DNA, 15 bp, Homo sapiens
attttaatgaatatt

SEQ ID NO: 4985182 - DNA, 20 bp, Homo sapiens
attttttttatcatgtcgta

SEQ ID NO: 4985183 - DNA, 20 bp, Homo sapiens
caaaccaccagaagcccaga

SEQ ID NO: 4985184 - DNA, 19 bp, Homo sapiens
caaagcgaattttaaaaga

SEQ ID NO: 4985185 - DNA, 14 bp, Homo sapiens
caaagcttttgtaa

SEQ ID NO: 4985186 - DNA, 16 bp, Homo sapiens
caaagtcaagccacat

SEQ ID NO: 4985187 - DNA, 11 bp, Homo sapiens
caaagttctta

SEQ ID NO: 4985188 - DNA, 13 bp, Homo sapiens
caacaagttgcct

SEQ ID NO: 4985189 - DNA, 17 bp, Homo sapiens
caacaatcccaaggccc

SEQ ID NO: 4985190 - DNA, 17 bp, Homo sapiens
caagcaccccagacctc

SEQ ID NO: 4985191 - DNA, 18 bp, Homo sapiens
caagccattctgcctcag

SEQ ID NO: 4985192 - DNA, 22 bp, Homo sapiens
caagccattctgcctcagcctc

SEQ ID NO: 4985193 - DNA, 18 bp, Homo sapiens
caagcctggtcagcccaa

SEQ ID NO: 4985194 - DNA, 18 bp, Homo sapiens
caagtccttgacctctat

SEQ ID NO: 4985195 - DNA, 21 bp, Homo sapiens
caagtccttgacctctataaa

SEQ ID NO: 4985196 - DNA, 23 bp, Homo sapiens
caagtgataattttatttataaa

SEQ ID NO: 4985197 - DNA, 20 bp, Homo sapiens
caattattacagtccttcaa

SEQ ID NO: 4985198 - DNA, 11 bp, Homo sapiens
cacaagcaccc

SEQ ID NO: 4985199 - DNA, 14 bp, Homo sapiens
cacaagcaccccag

SEQ ID NO: 4985200 - DNA, 21 bp, Homo sapiens
cacaatcctccaagaatttga

SEQ ID NO: 4985201 - DNA, 22 bp, Homo sapiens
cacatggtgacttttgaaaaga

SEQ ID NO: 4985202 - DNA, 17 bp, Homo sapiens
cacatttactagctgtg

SEQ ID NO: 4985203 - DNA, 19 bp, Homo sapiens
cacatttactagctgtgca

SEQ ID NO: 4985204 - DNA, 14 bp, Homo sapiens
caccacactcagcc

SEQ ID NO: 4985205 - DNA, 15 bp, Homo sapiens
caccagaagcccaga

SEQ ID NO: 4985206 - DNA, 18 bp, Homo sapiens
cacccaggctgcagtgca

SEQ ID NO: 4985207 - DNA, 20 bp, Homo sapiens
cacccaggctgcagtgcaat

SEQ ID NO: 4985208 - DNA, 19 bp, Homo sapiens
caccgccccttctccaaca

SEQ ID NO: 4985209 - DNA, 13 bp, Homo sapiens
cacgatctcggct

SEQ ID NO: 4985210 - DNA, 16 bp, Homo sapiens
cacgtaatgaaacttg

SEQ ID NO: 4985211 - DNA, 19 bp, Homo sapiens
cacgtgtggcctgttcttc

SEQ ID NO: 4985212 - DNA, 15 bp, Homo sapiens
cactcttggagcctg

SEQ ID NO: 4985213 - DNA, 19 bp, Homo sapiens
cactcttggagcctgcaga

SEQ ID NO: 4985214 - DNA, 14 bp, Homo sapiens
cactgatccagccc

SEQ ID NO: 4985215 - DNA, 15 bp, Homo sapiens
cactgatccagccct

SEQ ID NO: 4985216 - DNA, 16 bp, Homo sapiens
cactgatccagccctg

SEQ ID NO: 4985217 - DNA, 20 bp, Homo sapiens
cactgcaacctccacctccg

SEQ ID NO: 4985218 - DNA, 17 bp, Homo sapiens
cactgcaacctctgcct

SEQ ID NO: 4985219 - DNA, 16 bp, Homo sapiens
cactttgagaaacacc

SEQ ID NO: 4985220 - DNA, 23 bp, Homo sapiens
cagaacccctggctccaggccag

SEQ ID NO: 4985221 - DNA, 20 bp, Homo sapiens
cagacatctactacagcact

SEQ ID NO: 4985222 - DNA, 20 bp, Homo sapiens
cagagctggattcaattcct

SEQ ID NO: 4985223 - DNA, 11 bp, Homo sapiens
cagagctgggc

SEQ ID NO: 4985224 - DNA, 22 bp, Homo sapiens
cagaggaggggtggtgtccttc

SEQ ID NO: 4985225 - DNA, 23 bp, Homo sapiens
cagatcattatcagcctgtgcca

SEQ ID NO: 4985226 - DNA, 22 bp, Homo sapiens
cagattttaagggggaaaactg

SEQ ID NO: 4985227 - DNA, 17 bp, Homo sapiens
cagcacgtgtggcctgt

SEQ ID NO: 4985228 - DNA, 19 bp, Homo sapiens
cagcatcccagccagggtt

SEQ ID NO: 4985229 - DNA, 18 bp, Homo sapiens
cagccaggccactggccc

SEQ ID NO: 4985230 - DNA, 16 bp, Homo sapiens
cagcccaaaccaccag

SEQ ID NO: 4985231 - DNA, 19 bp, Homo sapiens
cagcccaaaccaccagaag

SEQ ID NO: 4985232 - DNA, 20 bp, Homo sapiens
cagcccaaaccaccagaagc

SEQ ID NO: 4985233 - DNA, 18 bp, Homo sapiens
cagccctcattggctctt

SEQ ID NO: 4985234 - DNA, 19 bp, Homo sapiens
cagccctgagttcctagcc

SEQ ID NO: 4985235 - DNA, 18 bp, Homo sapiens
cagcggctggacttggag

SEQ ID NO: 4985236 - DNA, 17 bp, Homo sapiens
cagctcactgcaacctc

SEQ ID NO: 4985237 - DNA, 21 bp, Homo sapiens
caggagtccctgccatcatgt

SEQ ID NO: 4985238 - DNA, 21 bp, Homo sapiens
caggatggtctcgatatcctg

SEQ ID NO: 4985239 - DNA, 22 bp, Homo sapiens
caggatttcaccagaagttaca

SEQ ID NO: 4985240 - DNA, 16 bp, Homo sapiens
cagggatggtgttcaa

SEQ ID NO: 4985241 - DNA, 18 bp, Homo sapiens
caggtccccagctttggc

SEQ ID NO: 4985242 - DNA, 19 bp, Homo sapiens
caggtgtgacccactgcgc

SEQ ID NO: 4985243 - DNA, 23 bp, Homo sapiens
caggtttgggacccctggtggtt

SEQ ID NO: 4985244 - DNA, 15 bp, Homo sapiens
cagtatttgtgggga

SEQ ID NO: 4985245 - DNA, 14 bp, Homo sapiens
cagtccctgaggca

SEQ ID NO: 4985246 - DNA, 22 bp, Homo sapiens
cagtctttaatctgagaggcca

SEQ ID NO: 4985247 - DNA, 18 bp, Homo sapiens
cagtggctggatctgtga

SEQ ID NO: 4985248 - DNA, 20 bp, Homo sapiens
cagtggctggatctgtgagg

SEQ ID NO: 4985249 - DNA, 15 bp, Homo sapiens
cagttcagcttgggg

SEQ ID NO: 4985250 - DNA, 19 bp, Homo sapiens
cagttccctggacagagct

SEQ ID NO: 4985251 - DNA, 20 bp, Homo sapiens
cagttccctggacagagcta

SEQ ID NO: 4985252 - DNA, 15 bp, Homo sapiens
catacctggccctgt

SEQ ID NO: 4985253 - DNA, 19 bp, Homo sapiens
catcatgtttacagaggac

SEQ ID NO: 4985254 - DNA, 13 bp, Homo sapiens
catccaaagttcc

SEQ ID NO: 4985255 - DNA, 14 bp, Homo sapiens
catccccctctgtc

SEQ ID NO: 4985256 - DNA, 17 bp, Homo sapiens
catctgtacctctgcct

SEQ ID NO: 4985257 - DNA, 18 bp, Homo sapiens
catgaattactgtatata

SEQ ID NO: 4985258 - DNA, 18 bp, Homo sapiens
catgagataatatgcaga

SEQ ID NO: 4985259 - DNA, 21 bp, Homo sapiens
catggagatagccccacagga

SEQ ID NO: 4985260 - DNA, 18 bp, Homo sapiens
catggcctccagaggagg

SEQ ID NO: 4985261 - DNA, 17 bp, Homo sapiens
catggctccccctccac

SEQ ID NO: 4985262 - DNA, 20 bp, Homo sapiens
catggtgacttttgaaaaga

SEQ ID NO: 4985263 - DNA, 22 bp, Homo sapiens
cattacctcagtgagaagccag

SEQ ID NO: 4985264 - DNA, 22 bp, Homo sapiens
cattagatattaggggggaaag

SEQ ID NO: 4985265 - DNA, 20 bp, Homo sapiens
cattctgcctcagcctccca

SEQ ID NO: 4985266 - DNA, 23 bp, Homo sapiens
cattctgcctcagcctcccaagt

SEQ ID NO: 4985267 - DNA, 17 bp, Homo sapiens
cattgtgtcagaaacat

SEQ ID NO: 4985268 - DNA, 15 bp, Homo sapiens
catttactcttgaga

SEQ ID NO: 4985269 - DNA, 17 bp, Homo sapiens
catttagtgctaaacaa

SEQ ID NO: 4985270 - DNA, 20 bp, Homo sapiens
ccaaaccaccagaagcccag

SEQ ID NO: 4985271 - DNA, 17 bp, Homo sapiens
ccaaagcgaattttaaa

SEQ ID NO: 4985272 - DNA, 19 bp, Homo sapiens
ccaaagtgctgggattaca

SEQ ID NO: 4985273 - DNA, 19 bp, Homo sapiens
ccaaagtgttaggattaca

SEQ ID NO: 4985274 - DNA, 14 bp, Homo sapiens
ccaaagttcttatc

SEQ ID NO: 4985275 - DNA, 20 bp, Homo sapiens
ccaagtagctgggagtacag

SEQ ID NO: 4985276 - DNA, 19 bp, Homo sapiens
ccaattcgaactttttcca

SEQ ID NO: 4985277 - DNA, 19 bp, Homo sapiens
ccacactgatccagccctg

SEQ ID NO: 4985278 - DNA, 13 bp, Homo sapiens
ccaccagaagccc

SEQ ID NO: 4985279 - DNA, 14 bp, Homo sapiens
gtttaatttacaca

SEQ ID NO: 4985280 - DNA, 15 bp, Homo sapiens
gtttacagtgttccg

SEQ ID NO: 4985281 - DNA, 16 bp, Homo sapiens
gtttagaagaagtgtg

SEQ ID NO: 4985282 - DNA, 15 bp, Homo sapiens
gtttctgaagtactt

SEQ ID NO: 4985283 - DNA, 19 bp, Homo sapiens
gtttctgaagtacttaaac

SEQ ID NO: 4985284 - DNA, 16 bp, Homo sapiens
gtttgggacccctggt

SEQ ID NO: 4985285 - DNA, 15 bp, Homo sapiens
gttttttcatctgta

SEQ ID NO: 4985286 - DNA, 12 bp, Homo sapiens
taaaactcagaa

SEQ ID NO: 4985287 - DNA, 13 bp, Homo sapiens
taaaactcagaat

SEQ ID NO: 4985288 - DNA, 21 bp, Homo sapiens
taaaatatttgtctttaaaca

SEQ ID NO: 4985289 - DNA, 14 bp, Homo sapiens
taaaatttgttgtt

SEQ ID NO: 4985290 - DNA, 19 bp, Homo sapiens
taaacaagtaagaaaaata

SEQ ID NO: 4985291 - DNA, 16 bp, Homo sapiens
taaacaatgtaaagta

SEQ ID NO: 4985292 - DNA, 20 bp, Homo sapiens
taaactccttaacttcaggg

SEQ ID NO: 4985293 - DNA, 16 bp, Homo sapiens
taaagaaaaatatgat

SEQ ID NO: 4985294 - DNA, 21 bp, Homo sapiens
taaaggccctatctgtttaca

SEQ ID NO: 4985295 - DNA, 17 bp, Homo sapiens
taaatgttggaatgtta

SEQ ID NO: 4985296 - DNA, 13 bp, Homo sapiens
taaattctttcct

SEQ ID NO: 4985297 - DNA, 22 bp, Homo sapiens
taactgtttacatatctgtccc

SEQ ID NO: 4985298 - DNA, 19 bp, Homo sapiens
taagatctcagtggttaag

SEQ ID NO: 4985299 - DNA, 18 bp, Homo sapiens
taagggggaaaactgttc

SEQ ID NO: 4985300 - DNA, 22 bp, Homo sapiens
taagtacttccacttgtgtata

SEQ ID NO: 4985301 - DNA, 15 bp, Homo sapiens
taatctttaaactgg

SEQ ID NO: 4985302 - DNA, 16 bp, Homo sapiens
taatttaaaattgtga

SEQ ID NO: 4985303 - DNA, 14 bp, Homo sapiens
tacagaggacagta

SEQ ID NO: 4985304 - DNA, 19 bp, Homo sapiens
taccccccctcctgctgcc

SEQ ID NO: 4985305 - DNA, 16 bp, Homo sapiens
tactgggagcctaccc

SEQ ID NO: 4985306 - DNA, 14 bp, Homo sapiens
tagaagaagtgtgt

SEQ ID NO: 4985307 - DNA, 23 bp, Homo sapiens
tagaccacggctgccccttccac

SEQ ID NO: 4985308 - DNA, 12 bp, Homo sapiens
tagaggaaaagg

SEQ ID NO: 4985309 - DNA, 16 bp, Homo sapiens
tagccccacaggaggt

SEQ ID NO: 4985310 - DNA, 22 bp, Homo sapiens
taggagagggggcgatatagag

SEQ ID NO: 4985311 - DNA, 18 bp, Homo sapiens
tagtgaatttctgaaaga

SEQ ID NO: 4985312 - DNA, 14 bp, Homo sapiens
tataaaatgggaag

SEQ ID NO: 4985313 - DNA, 15 bp, Homo sapiens
tatcagcacgtgtgg

SEQ ID NO: 4985314 - DNA, 16 bp, Homo sapiens
tatctgtttacagtgt

SEQ ID NO: 4985315 - DNA, 15 bp, Homo sapiens
tatgatgggggaaaa

SEQ ID NO: 4985316 - DNA, 14 bp, Homo sapiens
tatgggatgtaaac

SEQ ID NO: 4985317 - DNA, 18 bp, Homo sapiens
tatggggatagatgtgtg

SEQ ID NO: 4985318 - DNA, 18 bp, Homo sapiens
tatgtgggggtctgtgtg

SEQ ID NO: 4985319 - DNA, 20 bp, Homo sapiens
tatgtgggggtctgtgtgtt

SEQ ID NO: 4985320 - DNA, 13 bp, Homo sapiens
tattacagtcctt

SEQ ID NO: 4985321 - DNA, 17 bp, Homo sapiens
tattccttcttactctc

SEQ ID NO: 4985322 - DNA, 14 bp, Homo sapiens
tattctctgccttt

SEQ ID NO: 4985323 - DNA, 21 bp, Homo sapiens
tatttgaatgtatgcttcata

SEQ ID NO: 4985324 - DNA, 23 bp, Homo sapiens
tatttgaatgtatgcttcataca

SEQ ID NO: 4985325 - DNA, 17 bp, Homo sapiens
tatttgtaaatttatgt

SEQ ID NO: 4985326 - DNA, 15 bp, Homo sapiens
tattttaatgaatat

SEQ ID NO: 4985327 - DNA, 18 bp, Homo sapiens
tcacatttactagctgtg

SEQ ID NO: 4985328 - DNA, 15 bp, Homo sapiens
tcacctccatccccc

SEQ ID NO: 4985329 - DNA, 19 bp, Homo sapiens
tcacctccatccccctctg

SEQ ID NO: 4985330 - DNA, 17 bp, Homo sapiens
tcactcccagttccctg

SEQ ID NO: 4985331 - DNA, 17 bp, Homo sapiens
tcactcttggagcctgc

SEQ ID NO: 4985332 - DNA, 16 bp, Homo sapiens
tcactgcaacctccac

SEQ ID NO: 4985333 - DNA, 19 bp, Homo sapiens
tcactgcaacctctgcctc

SEQ ID NO: 4985334 - DNA, 19 bp, Homo sapiens
tcactgctaagaatatttg

SEQ ID NO: 4985335 - DNA, 19 bp, Homo sapiens
tcagaaacatgaaatgctt

SEQ ID NO: 4985336 - DNA, 19 bp, Homo sapiens
tcagaatataacatgtaaa

SEQ ID NO: 4985337 - DNA, 20 bp, Homo sapiens
tcagatcattatcagcctgt

SEQ ID NO: 4985338 - DNA, 21 bp, Homo sapiens
tcagcctcccaagtagctggg

SEQ ID NO: 4985339 - DNA, 12 bp, Homo sapiens
tcattataaaat

SEQ ID NO: 4985340 - DNA, 22 bp, Homo sapiens
tccaaagttcttatctctagct

SEQ ID NO: 4985341 - DNA, 13 bp, Homo sapiens
tccaagagcctga

SEQ ID NO: 4985342 - DNA, 14 bp, Homo sapiens
tccaagagcctgag

SEQ ID NO: 4985343 - DNA, 17 bp, Homo sapiens
tccacccaccttggcct

SEQ ID NO: 4985344 - DNA, 15 bp, Homo sapiens
tccactcctcctagc

SEQ ID NO: 4985345 - DNA, 21 bp, Homo sapiens
tccagaggaggggtggtgtcc

SEQ ID NO: 4985346 - DNA, 14 bp, Homo sapiens
tccaggtggcatca

SEQ ID NO: 4985347 - DNA, 16 bp, Homo sapiens
tccccctccacctgct

SEQ ID NO: 4985348 - DNA, 15 bp, Homo sapiens
tccctctactgggag

SEQ ID NO: 4985349 - DNA, 18 bp, Homo sapiens
tccctctactgggagcct

SEQ ID NO: 4985350 - DNA, 20 bp, Homo sapiens
tccctgaggcaggtccccag

SEQ ID NO: 4985351 - DNA, 21 bp, Homo sapiens
tccctgaggcaggtccccaga

SEQ ID NO: 4985352 - DNA, 16 bp, Homo sapiens
tccgcctgcctctgcc

SEQ ID NO: 4985353 - DNA, 20 bp, Homo sapiens
tcctataatacaaatacaca

SEQ ID NO: 4985354 - DNA, 23 bp, Homo sapiens
tcctcctttactttctctctcct

SEQ ID NO: 4985355 - DNA, 21 bp, Homo sapiens
tcctcttggtgtcgtttccct

SEQ ID NO: 4985356 - DNA, 15 bp, Homo sapiens
tcctctttgatgtca

SEQ ID NO: 4985357 - DNA, 16 bp, Homo sapiens
tcctgctgcctaataa

SEQ ID NO: 4985358 - DNA, 16 bp, Homo sapiens
tccttcttactctcct

SEQ ID NO: 4985359 - DNA, 19 bp, Homo sapiens
tccttgacctctataaact

SEQ ID NO: 4985360 - DNA, 16 bp, Homo sapiens
tcgagacttctctgtg

SEQ ID NO: 4985361 - DNA, 18 bp, Homo sapiens
tctaatgatcaaaacatg

SEQ ID NO: 4985362 - DNA, 14 bp, Homo sapiens
tctactgctgctga

SEQ ID NO: 4985363 - DNA, 16 bp, Homo sapiens
tctactgggagcctac

SEQ ID NO: 4985364 - DNA, 22 bp, Homo sapiens
tctatgattccaggtggcatca

SEQ ID NO: 4985365 - DNA, 16 bp, Homo sapiens
tctcactctgtcaccc

SEQ ID NO: 4985366 - DNA, 20 bp, Homo sapiens
tctccaatcccatctattct

SEQ ID NO: 4985367 - DNA, 15 bp, Homo sapiens
tctcctcttctagca

SEQ ID NO: 4985368 - DNA, 21 bp, Homo sapiens
tctcgagacttctctgtgaac

SEQ ID NO: 4985369 - DNA, 15 bp, Homo sapiens
tctctctcctctttg

SEQ ID NO: 4985370 - DNA, 18 bp, Homo sapiens
tctctgggccccaggcac

SEQ ID NO: 4985371 - DNA, 21 bp, Homo sapiens
tctgccaccatgcctaatttt

SEQ ID NO: 4985372 - DNA, 23 bp, Homo sapiens
tctgccctcacaattaggcttca

SEQ ID NO: 4985373 - DNA, 16 bp, Homo sapiens
tctgcctcagcctccc

SEQ ID NO: 4985374 - DNA, 16 bp, Homo sapiens
tctgcctcccgggttc

SEQ ID NO: 4985375 - DNA, 18 bp, Homo sapiens
tctggtgaccttccaaga

SEQ ID NO: 4985376 - DNA, 23 bp, Homo sapiens
tctggtgaccttccaagagcctg

SEQ ID NO: 4985377 - DNA, 13 bp, Homo sapiens
tctgtgtgtgtgt

SEQ ID NO: 4985378 - DNA, 15 bp, Homo sapiens
tctgtgtgtgtgtat

SEQ ID NO: 4985379 - DNA, 21 bp, Homo sapiens
tctgtgtgtgtgtatgtgggg

SEQ ID NO: 4985380 - DNA, 15 bp, Homo sapiens
tcttaacagtctcca

SEQ ID NO: 4985381 - DNA, 17 bp, Homo sapiens
tcttctagcatttcttc

SEQ ID NO: 4985382 - DNA, 18 bp, Homo sapiens
tcttgaactgagcttgga

SEQ ID NO: 4985383 - DNA, 13 bp, Homo sapiens
tcttggagcctgc

SEQ ID NO: 4985384 - DNA, 14 bp, Homo sapiens
tcttggagcctgca

SEQ ID NO: 4985385 - DNA, 22 bp, Homo sapiens
tgaaaagaggtgtgcaagagag

SEQ ID NO: 4985386 - DNA, 12 bp, Homo sapiens
tgaaacttggat

SEQ ID NO: 4985387 - DNA, 16 bp, Homo sapiens
tgaactcctaacctcg

SEQ ID NO: 4985388 - DNA, 12 bp, Homo sapiens
tgaactgagctt

SEQ ID NO: 4985389 - DNA, 15 bp, Homo sapiens
tgaactgagcttgga

SEQ ID NO: 4985390 - DNA, 17 bp, Homo sapiens
tgaagaaattgtggggg

SEQ ID NO: 4985391 - DNA, 13 bp, Homo sapiens
tgaatttctaaat

SEQ ID NO: 4985392 - DNA, 17 bp, Homo sapiens
tgacatacatccaacat

SEQ ID NO: 4985393 - DNA, 23 bp, Homo sapiens
tgaccattccaaagttcttatct

SEQ ID NO: 4985394 - DNA, 19 bp, Homo sapiens
tgaccttccaagagcctga

SEQ ID NO: 4985395 - DNA, 14 bp, Homo sapiens
tgaggcaggtcccc

SEQ ID NO: 4985396 - DNA, 13 bp, Homo sapiens
aacagcaactaca

SEQ ID NO: 4985397 - DNA, 23 bp, Homo sapiens
aacagcaccccatagagttgtga

SEQ ID NO: 4985398 - DNA, 16 bp, Homo sapiens
aacatgatttatttgt

SEQ ID NO: 4985399 - DNA, 18 bp, Homo sapiens
aaccaccagaagcccaga

SEQ ID NO: 4985400 - DNA, 21 bp, Homo sapiens
aacctggtattttaagagaaa

SEQ ID NO: 4985401 - DNA, 18 bp, Homo sapiens
aaccttcaaagcttttgt

SEQ ID NO: 4985402 - DNA, 14 bp, Homo sapiens
agcctgcagagctg

SEQ ID NO: 4985403 - DNA, 18 bp, Homo sapiens
agcctgccactcaggccc

SEQ ID NO: 4985404 - DNA, 20 bp, Homo sapiens
agcctggtcagcccaaacca

SEQ ID NO: 4985405 - DNA, 15 bp, Homo sapiens
agcgaattttaaaag

SEQ ID NO: 4985406 - DNA, 18 bp, Homo sapiens
agcgattcttgtgcctcg

SEQ ID NO: 4985407 - DNA, 20 bp, Homo sapiens
agcggctggaattgggtggg

SEQ ID NO: 4985408 - DNA, 19 bp, Homo sapiens
agctcactgcaacctccac

SEQ ID NO: 4985409 - DNA, 20 bp, Homo sapiens
agctcagacatctactacag

SEQ ID NO: 4985410 - DNA, 20 bp, Homo sapiens
agctgtgtgctctccaagcc

SEQ ID NO: 4985411 - DNA, 23 bp, Homo sapiens
agcttggggacaggggcaggagg

SEQ ID NO: 4985412 - DNA, 16 bp, Homo sapiens
aggaaccataatcaat

SEQ ID NO: 4985413 - DNA, 22 bp, Homo sapiens
aggaactgctgggcttggcagc

SEQ ID NO: 4985414 - DNA, 22 bp, Homo sapiens
aggaggggtggtgtccttctcc

SEQ ID NO: 4985415 - DNA, 23 bp, Homo sapiens
aggagggttgggcgtgctacctg

SEQ ID NO: 4985416 - DNA, 18 bp, Homo sapiens
aggatttcaccagaagtt

SEQ ID NO: 4985417 - DNA, 16 bp, Homo sapiens
aggcaccccctggctt

SEQ ID NO: 4985418 - DNA, 11 bp, Homo sapiens
aggcaggtccc

SEQ ID NO: 4985419 - DNA, 23 bp, Homo sapiens
aggccagggggccagtccctgag

SEQ ID NO: 4985420 - DNA, 13 bp, Homo sapiens
aggcccaaagcct

SEQ ID NO: 4985421 - DNA, 21 bp, Homo sapiens
aggcctctcattccagaggaa

SEQ ID NO: 4985422 - DNA, 14 bp, Homo sapiens
aggctgctttccaa

SEQ ID NO: 4985423 - DNA, 15 bp, Homo sapiens
agggatgcatggaga

SEQ ID NO: 4985424 - DNA, 16 bp, Homo sapiens
agggtctcactctgtc

SEQ ID NO: 4985425 - DNA, 22 bp, Homo sapiens
agggtcttggttccagcctgcc

SEQ ID NO: 4985426 - DNA, 21 bp, Homo sapiens
aggtggaattattttaaaaga

SEQ ID NO: 4985427 - DNA, 22 bp, Homo sapiens
aggtggcatcagtgtctttcca

SEQ ID NO: 4985428 - DNA, 23 bp, Homo sapiens
aggtggcatcagtgtctttccac

SEQ ID NO: 4985429 - DNA, 20 bp, Homo sapiens
agtccctgaggcaggtcccc

SEQ ID NO: 4985430 - DNA, 23 bp, Homo sapiens
agtccctgaggcaggtccccaga

SEQ ID NO: 4985431 - DNA, 18 bp, Homo sapiens
agtgaatttctaaatgtt

SEQ ID NO: 4985432 - DNA, 14 bp, Homo sapiens
agtgaggatgtctg

SEQ ID NO: 4985433 - DNA, 22 bp, Homo sapiens
agtgatgcttttagttttaaaa

SEQ ID NO: 4985434 - DNA, 14 bp, Homo sapiens
agtgtctggctgca

SEQ ID NO: 4985435 - DNA, 15 bp, Homo sapiens
agtgtgggtctgtgt

SEQ ID NO: 4985436 - DNA, 17 bp, Homo sapiens
agtgtgggtctgtgtgt

SEQ ID NO: 4985437 - DNA, 23 bp, Homo sapiens
agtgtgggtctgtgtgtgtgtat

SEQ ID NO: 4985438 - DNA, 14 bp, Homo sapiens
agttcagcttgggg

SEQ ID NO: 4985439 - DNA, 17 bp, Homo sapiens
agttcctagccaccgcc

SEQ ID NO: 4985440 - DNA, 18 bp, Homo sapiens
agttcttatctctagctc

SEQ ID NO: 4985441 - DNA, 20 bp, Homo sapiens
agttgtatcagcacgtgtgg

SEQ ID NO: 4985442 - DNA, 14 bp, Homo sapiens
agtttacattctaa

SEQ ID NO: 4985443 - DNA, 15 bp, Homo sapiens
agtttggaatgaaga

SEQ ID NO: 4985444 - DNA, 18 bp, Homo sapiens
agtttggcaaactctcca

SEQ ID NO: 4985445 - DNA, 14 bp, Homo sapiens
agttttaaaagtct

SEQ ID NO: 4985446 - DNA, 18 bp, Homo sapiens
ataaactggcagctcagc

SEQ ID NO: 4985447 - DNA, 12 bp, Homo sapiens
ataaatattata

SEQ ID NO: 4985448 - DNA, 22 bp, Homo sapiens
ataaatattatattatatatat

SEQ ID NO: 4985449 - DNA, 17 bp, Homo sapiens
ataagctcgagtgaatt

SEQ ID NO: 4985450 - DNA, 12 bp, Homo sapiens
ataatagggaaa

SEQ ID NO: 4985451 - DNA, 20 bp, Homo sapiens
ataattattccttcttactc

SEQ ID NO: 4985452 - DNA, 21 bp, Homo sapiens
ataattttatttataaactag

SEQ ID NO: 4985453 - DNA, 16 bp, Homo sapiens
atacagggatggtgtt

SEQ ID NO: 4985454 - DNA, 19 bp, Homo sapiens
atagaaggctatggggata

SEQ ID NO: 4985455 - DNA, 12 bp, Homo sapiens
atagatgtgtgg

SEQ ID NO: 4985456 - DNA, 13 bp, Homo sapiens
atagatgtgtgga

SEQ ID NO: 4985457 - DNA, 14 bp, Homo sapiens
atagatgtgtggac

SEQ ID NO: 4985458 - DNA, 14 bp, Homo sapiens
atatgtaagtactt

SEQ ID NO: 4985459 - DNA, 20 bp, Homo sapiens
atatttgtaaatttatgtga

SEQ ID NO: 4985460 - DNA, 12 bp, Homo sapiens
atcaaaacatgc

SEQ ID NO: 4985461 - DNA, 13 bp, Homo sapiens
atcaggccattgt

SEQ ID NO: 4985462 - DNA, 16 bp, Homo sapiens
atcaggccattgtccc

SEQ ID NO: 4985463 - DNA, 23 bp, Homo sapiens
atcagttcctttgatctcgctgt

SEQ ID NO: 4985464 - DNA, 19 bp, Homo sapiens
atccacccaccttggcctc

SEQ ID NO: 4985465 - DNA, 21 bp, Homo sapiens
atccagccctgagttcctagc

SEQ ID NO: 4985466 - DNA, 19 bp, Homo sapiens
atccccctctgtctgccct

SEQ ID NO: 4985467 - DNA, 13 bp, Homo sapiens
atccgcctgcctc

SEQ ID NO: 4985468 - DNA, 14 bp, Homo sapiens
atccgcctgcctct

SEQ ID NO: 4985469 - DNA, 15 bp, Homo sapiens
atctcagctcactgc

SEQ ID NO: 4985470 - DNA, 16 bp, Homo sapiens
atctcggctcactgca

SEQ ID NO: 4985471 - DNA, 16 bp, Homo sapiens
atctcgtgatccgcct

SEQ ID NO: 4985472 - DNA, 23 bp, Homo sapiens
atctcgtgatccgcctgcctctg

SEQ ID NO: 4985473 - DNA, 19 bp, Homo sapiens
atctctagctcagacatct

SEQ ID NO: 4985474 - DNA, 14 bp, Homo sapiens
atcttactctactg

SEQ ID NO: 4985475 - DNA, 18 bp, Homo sapiens
atctttaaactggctggc

SEQ ID NO: 4985476 - DNA, 16 bp, Homo sapiens
atgaaaatatttaaag

SEQ ID NO: 4985477 - DNA, 21 bp, Homo sapiens
atgaattactgtatataaact

SEQ ID NO: 4985478 - DNA, 22 bp, Homo sapiens
atgacaacttttaaagaaaaat

SEQ ID NO: 4985479 - DNA, 22 bp, Homo sapiens
atgaggctgctttccaaagcca

SEQ ID NO: 4985480 - DNA, 13 bp, Homo sapiens
atgagggtcttgg

SEQ ID NO: 4985481 - DNA, 13 bp, Homo sapiens
atgatcaaaacat

SEQ ID NO: 4985482 - DNA, 13 bp, Homo sapiens
atgatgaaaatat

SEQ ID NO: 4985483 - DNA, 14 bp, Homo sapiens
atgatgggggaaaa

SEQ ID NO: 4985484 - DNA, 16 bp, Homo sapiens
atgattccaggtggca

SEQ ID NO: 4985485 - DNA, 22 bp, Homo sapiens
atgcagattttgcccttgacaa

SEQ ID NO: 4985486 - DNA, 21 bp, Homo sapiens
atgcctaatttttttctattt

SEQ ID NO: 4985487 - DNA, 13 bp, Homo sapiens
atgcttcatacag

SEQ ID NO: 4985488 - DNA, 21 bp, Homo sapiens
atggaatgatgggtcagttgt

SEQ ID NO: 4985489 - DNA, 23 bp, Homo sapiens
atggagatagccccacaggaggt

SEQ ID NO: 4985490 - DNA, 16 bp, Homo sapiens
atggctgtggagtgtg

SEQ ID NO: 4985491 - DNA, 19 bp, Homo sapiens
atgtagaggggaaaagaga

SEQ ID NO: 4985492 - DNA, 14 bp, Homo sapiens
atgtcagtatgtgg

SEQ ID NO: 4985493 - DNA, 15 bp, Homo sapiens
atgtggaagtgtggg

SEQ ID NO: 4985494 - DNA, 23 bp, Homo sapiens
atgtggaagtgtgggtctgtgtg

SEQ ID NO: 4985495 - DNA, 16 bp, Homo sapiens
atgtgggggtctgtgt

SEQ ID NO: 4985496 - DNA, 18 bp, Homo sapiens
atgtgggggtctgtgtgt

SEQ ID NO: 4985497 - DNA, 22 bp, Homo sapiens
attacaggcgcacaccaccaca

SEQ ID NO: 4985498 - DNA, 15 bp, Homo sapiens
attccaaagttctta

SEQ ID NO: 4985499 - DNA, 14 bp, Homo sapiens
attctgagagctgt

SEQ ID NO: 4985500 - DNA, 19 bp, Homo sapiens
attcttgtgcctcggcctc

SEQ ID NO: 4985501 - DNA, 22 bp, Homo sapiens
attggattctgagagctgtgca

SEQ ID NO: 4985502 - DNA, 20 bp, Homo sapiens
attgggtggggggcttcata

SEQ ID NO: 4985503 - DNA, 22 bp, Homo sapiens
attgggtggggggcttcataca

SEQ ID NO: 4985504 - DNA, 12 bp, Homo sapiens
attggtgttgac

SEQ ID NO: 4985505 - DNA, 15 bp, Homo sapiens
atttaaaattgtgat

SEQ ID NO: 4985506 - DNA, 20 bp, Homo sapiens
atttaaaattgtgatgtgtc

SEQ ID NO: 4985507 - DNA, 21 bp, Homo sapiens
atttaaaggccctatctgttt

SEQ ID NO: 4985508 - DNA, 16 bp, Homo sapiens
atttagtgctaaacaa

SEQ ID NO: 4985509 - DNA, 17 bp, Homo sapiens
atttcactaagctcctc

SEQ ID NO: 4985510 - DNA, 23 bp, Homo sapiens
atttccctgaaggaaccaaagcg

SEQ ID NO: 4985511 - DNA, 21 bp, Homo sapiens
atttgaatgtatgcttcatac

SEQ ID NO: 4985512 - DNA, 22 bp, Homo sapiens
atttgaatgtatgcttcataca

SEQ ID NO: 4985513 - DNA, 20 bp, Homo sapiens
atttgctatgagctggggat

SEQ ID NO: 4985514 - DNA, 20 bp, Homo sapiens
atttgtcaaggctgactact

SEQ ID NO: 4985515 - DNA, 22 bp, Homo sapiens
atttgtggggagggatttgggg

SEQ ID NO: 4985516 - DNA, 14 bp, Homo sapiens
atttgtttgagaca

SEQ ID NO: 4985517 - DNA, 20 bp, Homo sapiens
attttaaaagatgcaatgta

SEQ ID NO: 4985518 - DNA, 13 bp, Homo sapiens
caagaggggaaaa

SEQ ID NO: 4985519 - DNA, 19 bp, Homo sapiens
caagcatgacaacttttaa

SEQ ID NO: 4985520 - DNA, 15 bp, Homo sapiens
caagcctggtcagcc

SEQ ID NO: 4985521 - DNA, 16 bp, Homo sapiens
caagcctggtcagccc

SEQ ID NO: 4985522 - DNA, 18 bp, Homo sapiens
caagtaagaaaaataagc

SEQ ID NO: 4985523 - DNA, 20 bp, Homo sapiens
cacaacacaagcaccccaga

SEQ ID NO: 4985524 - DNA, 19 bp, Homo sapiens
cacacgtaatgaaacttgg

SEQ ID NO: 4985525 - DNA, 20 bp, Homo sapiens
cacacgtaatgaaacttgga

SEQ ID NO: 4985526 - DNA, 20 bp, Homo sapiens
cacaggttttttcaatttat

SEQ ID NO: 4985527 - DNA, 20 bp, Homo sapiens
caccaagcctggtcagccca

SEQ ID NO: 4985528 - DNA, 21 bp, Homo sapiens
caccaagcctggtcagcccaa

SEQ ID NO: 4985529 - DNA, 15 bp, Homo sapiens
caccacactcagccc

SEQ ID NO: 4985530 - DNA, 19 bp, Homo sapiens
caccacactgatccagccc

SEQ ID NO: 4985531 - DNA, 14 bp, Homo sapiens
caccagaagcccag

SEQ ID NO: 4985532 - DNA, 16 bp, Homo sapiens
caccagaagcccagaa

SEQ ID NO: 4985533 - DNA, 13 bp, Homo sapiens
caccagaagttac

SEQ ID NO: 4985534 - DNA, 13 bp, Homo sapiens
caccccagacctc

SEQ ID NO: 4985535 - DNA, 21 bp, Homo sapiens
caccccagacctcacctccat

SEQ ID NO: 4985536 - DNA, 13 bp, Homo sapiens
cacctccatcccc

SEQ ID NO: 4985537 - DNA, 22 bp, Homo sapiens
cacctccatccccctctgtctg

SEQ ID NO: 4985538 - DNA, 15 bp, Homo sapiens
caccttggcctccca

SEQ ID NO: 4985539 - DNA, 19 bp, Homo sapiens
cacgtaatgaaacttggat

SEQ ID NO: 4985540 - DNA, 17 bp, Homo sapiens
cactacatatctaaagc

SEQ ID NO: 4985541 - DNA, 13 bp, Homo sapiens
cactcctcctagc

SEQ ID NO: 4985542 - DNA, 19 bp, Homo sapiens
cactctgtcacccaggctg

SEQ ID NO: 4985543 - DNA, 21 bp, Homo sapiens
cactcttggagcctgcagagc

SEQ ID NO: 4985544 - DNA, 22 bp, Homo sapiens
cactcttggagcctgcagagct

SEQ ID NO: 4985545 - DNA, 16 bp, Homo sapiens
cactgcaacctccacc

SEQ ID NO: 4985546 - DNA, 17 bp, Homo sapiens
cactgcaacctccacct

SEQ ID NO: 4985547 - DNA, 16 bp, Homo sapiens
cactgcaacctctgcc

SEQ ID NO: 4985548 - DNA, 18 bp, Homo sapiens
cactgcaacctctgcctc

SEQ ID NO: 4985549 - DNA, 17 bp, Homo sapiens
cactggcccctgagatc

SEQ ID NO: 4985550 - DNA, 15 bp, Homo sapiens
cactggggattgggc

SEQ ID NO: 4985551 - DNA, 16 bp, Homo sapiens
cactggggattgggcc

SEQ ID NO: 4985552 - DNA, 17 bp, Homo sapiens
cactggggattgggccc

SEQ ID NO: 4985553 - DNA, 18 bp, Homo sapiens
cactggggattgggcccc

SEQ ID NO: 4985554 - DNA, 14 bp, Homo sapiens
cagaagcccagaat

SEQ ID NO: 4985555 - DNA, 21 bp, Homo sapiens
cagaataaactggcagctcag

SEQ ID NO: 4985556 - DNA, 14 bp, Homo sapiens
cagaatgaggctgc

SEQ ID NO: 4985557 - DNA, 19 bp, Homo sapiens
cagacactacatatctaaa

SEQ ID NO: 4985558 - DNA, 16 bp, Homo sapiens
cagacctcacctccat

SEQ ID NO: 4985559 - DNA, 15 bp, Homo sapiens
cagagcagtgggcct

SEQ ID NO: 4985560 - DNA, 22 bp, Homo sapiens
cagagcagtgggcctggccagc

SEQ ID NO: 4985561 - DNA, 18 bp, Homo sapiens
cagagctaaactctcgag

SEQ ID NO: 4985562 - DNA, 16 bp, Homo sapiens
cagagctgcgggctgg

SEQ ID NO: 4985563 - DNA, 16 bp, Homo sapiens
cagagtttacattcta

SEQ ID NO: 4985564 - DNA, 19 bp, Homo sapiens
cagattttaagggggaaaa

SEQ ID NO: 4985565 - DNA, 12 bp, Homo sapiens
cagcaatctgca

SEQ ID NO: 4985566 - DNA, 23 bp, Homo sapiens
cagcccaaaccaccagaagccca

SEQ ID NO: 4985567 - DNA, 18 bp, Homo sapiens
cagccctgagttcctagc

SEQ ID NO: 4985568 - DNA, 21 bp, Homo sapiens
cagccctgagttcctagccac

SEQ ID NO: 4985569 - DNA, 21 bp, Homo sapiens
cagcctacactattctagcag

SEQ ID NO: 4985570 - DNA, 11 bp, Homo sapiens
cagcctgccac

SEQ ID NO: 4985571 - DNA, 12 bp, Homo sapiens
cagcctgccact

SEQ ID NO: 4985572 - DNA, 17 bp, Homo sapiens
cagcggctggaattggg

SEQ ID NO: 4985573 - DNA, 15 bp, Homo sapiens
cagctcactgcaacc

SEQ ID NO: 4985574 - DNA, 13 bp, Homo sapiens
caggaggaagggg

SEQ ID NO: 4985575 - DNA, 14 bp, Homo sapiens
caggagtccctgcc

SEQ ID NO: 4985576 - DNA, 15 bp, Homo sapiens
caggagtccctgcca

SEQ ID NO: 4985577 - DNA, 19 bp, Homo sapiens
caggcaaagtgcacctcaa

SEQ ID NO: 4985578 - DNA, 21 bp, Homo sapiens
caggcccccagaacccctggc

SEQ ID NO: 4985579 - DNA, 13 bp, Homo sapiens
caggcgcacacca

SEQ ID NO: 4985580 - DNA, 13 bp, Homo sapiens
caggctgcagtgc

SEQ ID NO: 4985581 - DNA, 17 bp, Homo sapiens
cagtaacctagtgaatt

SEQ ID NO: 4985582 - DNA, 12 bp, Homo sapiens
cagtatgtggaa

SEQ ID NO: 4985583 - DNA, 18 bp, Homo sapiens
cagtctccaatcccatct

SEQ ID NO: 4985584 - DNA, 14 bp, Homo sapiens
cagtgggcctggcc

SEQ ID NO: 4985585 - DNA, 15 bp, Homo sapiens
cagtgggcctggcca

SEQ ID NO: 4985586 - DNA, 17 bp, Homo sapiens
cagtttggcaaactctc

SEQ ID NO: 4985587 - DNA, 17 bp, Homo sapiens
catcagttcctttgatc

SEQ ID NO: 4985588 - DNA, 13 bp, Homo sapiens
catcatgtttaca

SEQ ID NO: 4985589 - DNA, 22 bp, Homo sapiens
catccccctctgtctgccctca

SEQ ID NO: 4985590 - DNA, 19 bp, Homo sapiens
catctgtttaatttacaca

SEQ ID NO: 4985591 - DNA, 23 bp, Homo sapiens
catgacaacttttaaagaaaaat

SEQ ID NO: 4985592 - DNA, 19 bp, Homo sapiens
catggggctgattgtattt

SEQ ID NO: 4985593 - DNA, 16 bp, Homo sapiens
cattccaaagttctta

SEQ ID NO: 4985594 - DNA, 13 bp, Homo sapiens
cattctaatttgc

SEQ ID NO: 4985595 - DNA, 22 bp, Homo sapiens
cattgtgtcagaaacatgaaat

SEQ ID NO: 4985596 - DNA, 22 bp, Homo sapiens
catttactagctgtgcaacctt

SEQ ID NO: 4985597 - DNA, 20 bp, Homo sapiens
catttcactaagctcctcct

SEQ ID NO: 4985598 - DNA, 17 bp, Homo sapiens
ccaaaccaccagaagcc

SEQ ID NO: 4985599 - DNA, 22 bp, Homo sapiens
ccaaagtgctgggattacaggt

SEQ ID NO: 4985600 - DNA, 22 bp, Homo sapiens
ccaaagtgttaggattacaggc

SEQ ID NO: 4985601 - DNA, 22 bp, Homo sapiens
ccaaatgagggtcttggttcca

SEQ ID NO: 4985602 - DNA, 19 bp, Homo sapiens
ccaatgtgaacagcggctg

SEQ ID NO: 4985603 - DNA, 20 bp, Homo sapiens
ccacacagacttgggcaggg

SEQ ID NO: 4985604 - DNA, 21 bp, Homo sapiens
ccaccacactgatccagccct

SEQ ID NO: 4985605 - DNA, 16 bp, Homo sapiens
ccacccccaggacccc

SEQ ID NO: 4985606 - DNA, 18 bp, Homo sapiens
ccacccccaggacccctg

SEQ ID NO: 4985607 - DNA, 13 bp, Homo sapiens
ccaccgcctccta

SEQ ID NO: 4985608 - DNA, 14 bp, Homo sapiens
ccactcctcctagc

SEQ ID NO: 4985609 - DNA, 15 bp, Homo sapiens
ccagaagcccagaat

SEQ ID NO: 4985610 - DNA, 22 bp, Homo sapiens
ccagaataaactggcagctcag

SEQ ID NO: 4985611 - DNA, 14 bp, Homo sapiens
ccagactccaccaa

SEQ ID NO: 4985612 - DNA, 18 bp, Homo sapiens
ccagactccaccaagcct

SEQ ID NO: 4985613 - DNA, 23 bp, Homo sapiens
ccagaggaggggtggtgtccttc

SEQ ID NO: 4985614 - DNA, 14 bp, Homo sapiens
ccagccctgagttc

SEQ ID NO: 4985615 - DNA, 23 bp, Homo sapiens
ccaggccactggcccctgagatc

SEQ ID NO: 4985616 - DNA, 20 bp, Homo sapiens
ccatcatgtttacagaggac

SEQ ID NO: 4985617 - DNA, 22 bp, Homo sapiens
ccatcatgtttacagaggacag

SEQ ID NO: 4985618 - DNA, 17 bp, Homo sapiens
ccatctattctctgcct

SEQ ID NO: 4985619 - DNA, 20 bp, Homo sapiens
ccattctgcctcagcctccc

SEQ ID NO: 4985620 - DNA, 21 bp, Homo sapiens
ccattctgcctcagcctccca

SEQ ID NO: 4985621 - DNA, 16 bp, Homo sapiens
gcccagaatgaggctg

SEQ ID NO: 4985622 - DNA, 17 bp, Homo sapiens
gcccagaatgaggctgc

SEQ ID NO: 4985623 - DNA, 16 bp, Homo sapiens
gcccctgagatctctg

SEQ ID NO: 4985624 - DNA, 16 bp, Homo sapiens
gcccctgccagacccc

SEQ ID NO: 4985625 - DNA, 12 bp, Homo sapiens
gcctaataaaga

SEQ ID NO: 4985626 - DNA, 17 bp, Homo sapiens
gcctacccacccccagg

SEQ ID NO: 4985627 - DNA, 14 bp, Homo sapiens
gcctccagaggagg

SEQ ID NO: 4985628 - DNA, 16 bp, Homo sapiens
gcctcccaagtagctg

SEQ ID NO: 4985629 - DNA, 18 bp, Homo sapiens
gcctcccaagtagctggg

SEQ ID NO: 4985630 - DNA, 18 bp, Homo sapiens
gcctccctagtagctggg

SEQ ID NO: 4985631 - DNA, 14 bp, Homo sapiens
gccttgctctgttg

SEQ ID NO: 4985632 - DNA, 16 bp, Homo sapiens
gcggctggacttggag

SEQ ID NO: 4985633 - DNA, 17 bp, Homo sapiens
gcgtctgccaccatgcc

SEQ ID NO: 4985634 - DNA, 18 bp, Homo sapiens
gcgtctgccaccatgcct

SEQ ID NO: 4985635 - DNA, 18 bp, Homo sapiens
gctaaacaagtaagaaaa

SEQ ID NO: 4985636 - DNA, 12 bp, Homo sapiens
gctaaactctcg

SEQ ID NO: 4985637 - DNA, 14 bp, Homo sapiens
gctaagaatatttg

SEQ ID NO: 4985638 - DNA, 21 bp, Homo sapiens
gctatggggatagatgtgtgg

SEQ ID NO: 4985639 - DNA, 21 bp, Homo sapiens
gctcactgcaacctctgcctc

SEQ ID NO: 4985640 - DNA, 21 bp, Homo sapiens
gctcactgctaagaatatttg

SEQ ID NO: 4985641 - DNA, 22 bp, Homo sapiens
gctcagtgtctggctgcagagc

SEQ ID NO: 4985642 - DNA, 18 bp, Homo sapiens
gctccaggccagggggcc

SEQ ID NO: 4985643 - DNA, 23 bp, Homo sapiens
gctcctcctttactttctctctc

SEQ ID NO: 4985644 - DNA, 17 bp, Homo sapiens
gctctgtgcccaccctc

SEQ ID NO: 4985645 - DNA, 14 bp, Homo sapiens
gctgaggcctctca

SEQ ID NO: 4985646 - DNA, 21 bp, Homo sapiens
gctgcagagcagtgggcctgg

SEQ ID NO: 4985647 - DNA, 23 bp, Homo sapiens
gctgcagccaggccactggcccc

SEQ ID NO: 4985648 - DNA, 14 bp, Homo sapiens
gctgcctaataaag

SEQ ID NO: 4985649 - DNA, 16 bp, Homo sapiens
gctgggattacaggtg

SEQ ID NO: 4985650 - DNA, 20 bp, Homo sapiens
gctgtagacatttgctatga

SEQ ID NO: 4985651 - DNA, 10 bp, Homo sapiens
gcttcataca

SEQ ID NO: 4985652 - DNA, 14 bp, Homo sapiens
ggaactgctgggct

SEQ ID NO: 4985653 - DNA, 17 bp, Homo sapiens
ggaagtgcttgatatgt

SEQ ID NO: 4985654 - DNA, 12 bp, Homo sapiens
ggaagtgtgggt

SEQ ID NO: 4985655 - DNA, 14 bp, Homo sapiens
ggaattattttaaa

SEQ ID NO: 4985656 - DNA, 15 bp, Homo sapiens
ggaattattttaaaa

SEQ ID NO: 4985657 - DNA, 23 bp, Homo sapiens
ggaattgggtggggggcttcata

SEQ ID NO: 4985658 - DNA, 18 bp, Homo sapiens
ggacagtatttgtgggga

SEQ ID NO: 4985659 - DNA, 22 bp, Homo sapiens
ggagaatgtcagtatgtggaag

SEQ ID NO: 4985660 - DNA, 20 bp, Homo sapiens
ggagatagccccacaggagg

SEQ ID NO: 4985661 - DNA, 21 bp, Homo sapiens
ggaggtagctttgaggtggaa

SEQ ID NO: 4985662 - DNA, 15 bp, Homo sapiens
ggatagatgtgtgga

SEQ ID NO: 4985663 - DNA, 18 bp, Homo sapiens
ggattgggcccctgccag

SEQ ID NO: 4985664 - DNA, 15 bp, Homo sapiens
ggcagggctgaggcc

SEQ ID NO: 4985665 - DNA, 14 bp, Homo sapiens
ggcaggtccccaga

SEQ ID NO: 4985666 - DNA, 23 bp, Homo sapiens
ggccagtccctgaggcaggtccc

SEQ ID NO: 4985667 - DNA, 19 bp, Homo sapiens
ggccagtggctggatctgt

SEQ ID NO: 4985668 - DNA, 21 bp, Homo sapiens
ggcccctgagatctctgcagg

SEQ ID NO: 4985669 - DNA, 17 bp, Homo sapiens
ggcccctgccagacccc

SEQ ID NO: 4985670 - DNA, 17 bp, Homo sapiens
ggccctgtgccttggtg

SEQ ID NO: 4985671 - DNA, 21 bp, Homo sapiens
ggctcactgcaacctctgcct

SEQ ID NO: 4985672 - DNA, 14 bp, Homo sapiens
ggctcagagtgggg

SEQ ID NO: 4985673 - DNA, 22 bp, Homo sapiens
ggctgcagccaggccactggcc

SEQ ID NO: 4985674 - DNA, 18 bp, Homo sapiens
ggctggacttggaggtag

SEQ ID NO: 4985675 - DNA, 20 bp, Homo sapiens
gggacccctggtggttcact

SEQ ID NO: 4985676 - DNA, 22 bp, Homo sapiens
gggagaatgtcagtatgtggaa

SEQ ID NO: 4985677 - DNA, 14 bp, Homo sapiens
gggatagatgtgtg

SEQ ID NO: 4985678 - DNA, 15 bp, Homo sapiens
gggattgggcccctg

SEQ ID NO: 4985679 - DNA, 13 bp, Homo sapiens
gggcccctgccag

SEQ ID NO: 4985680 - DNA, 13 bp, Homo sapiens
gggcttcatacac

SEQ ID NO: 4985681 - DNA, 21 bp, Homo sapiens
gggtcatctgtacctctgcct

SEQ ID NO: 4985682 - DNA, 17 bp, Homo sapiens
gggtctcactctgtcac

SEQ ID NO: 4985683 - DNA, 20 bp, Homo sapiens
gggtcttggttccagcctgc

SEQ ID NO: 4985684 - DNA, 19 bp, Homo sapiens
gggtggggggcttcataca

SEQ ID NO: 4985685 - DNA, 16 bp, Homo sapiens
gggtggtgtccttctc

SEQ ID NO: 4985686 - DNA, 17 bp, Homo sapiens
ggtagctttgaggtgga

SEQ ID NO: 4985687 - DNA, 15 bp, Homo sapiens
ggtctcactctgtca

SEQ ID NO: 4985688 - DNA, 11 bp, Homo sapiens
ggtctgtgtgt

SEQ ID NO: 4985689 - DNA, 21 bp, Homo sapiens
ggtctgtgtgtgtgtatgtgg

SEQ ID NO: 4985690 - DNA, 21 bp, Homo sapiens
ggtcttggttccagcctgcca

SEQ ID NO: 4985691 - DNA, 19 bp, Homo sapiens
ggtgaccttccaagagcct

SEQ ID NO: 4985692 - DNA, 20 bp, Homo sapiens
ggtgaccttccaagagcctg

SEQ ID NO: 4985693 - DNA, 15 bp, Homo sapiens
ggtggaattatttta

SEQ ID NO: 4985694 - DNA, 22 bp, Homo sapiens
ggtggttcactcttggagcctg

SEQ ID NO: 4985695 - DNA, 23 bp, Homo sapiens
ggttcactcttggagcctgcaga

SEQ ID NO: 4985696 - DNA, 19 bp, Homo sapiens
gtaaaataaaaccaccaaa

SEQ ID NO: 4985697 - DNA, 19 bp, Homo sapiens
gtaatttaaaattgtgatg

SEQ ID NO: 4985698 - DNA, 20 bp, Homo sapiens
gtaatttaaaattgtgatgt

SEQ ID NO: 4985699 - DNA, 19 bp, Homo sapiens
gtatattttaatgaatatt

SEQ ID NO: 4985700 - DNA, 16 bp, Homo sapiens
gtatgtggaagtgtgg

SEQ ID NO: 4985701 - DNA, 17 bp, Homo sapiens
gtatgtggaagtgtggg

SEQ ID NO: 4985702 - DNA, 21 bp, Homo sapiens
gtcacccaggctgcagtgcaa

SEQ ID NO: 4985703 - DNA, 18 bp, Homo sapiens
gtcactaggatgcagatg

SEQ ID NO: 4985704 - DNA, 23 bp, Homo sapiens
gtcagcccaaaccaccagaagcc

SEQ ID NO: 4985705 - DNA, 14 bp, Homo sapiens
gtcagtttggaatg

SEQ ID NO: 4985706 - DNA, 16 bp, Homo sapiens
gtccctgaagagaagg

SEQ ID NO: 4985707 - DNA, 12 bp, Homo sapiens
gtcctgcctctt

SEQ ID NO: 4985708 - DNA, 21 bp, Homo sapiens
gtccttcacatttactagctg

SEQ ID NO: 4985709 - DNA, 16 bp, Homo sapiens
gtccttctcctcttgt

SEQ ID NO: 4985710 - DNA, 20 bp, Homo sapiens
gtccttttcccccagcacct

SEQ ID NO: 4985711 - DNA, 18 bp, Homo sapiens
gtctctgggccccaggca

SEQ ID NO: 4985712 - DNA, 12 bp, Homo sapiens
gtctggctgcag

SEQ ID NO: 4985713 - DNA, 21 bp, Homo sapiens
gtctgtgtgtttatgtgtgtg

SEQ ID NO: 4985714 - DNA, 22 bp, Homo sapiens
gtctgtgtgtttatgtgtgtgt

SEQ ID NO: 4985715 - DNA, 19 bp, Homo sapiens
gtcttggttccagcctgcc

SEQ ID NO: 4985716 - DNA, 19 bp, Homo sapiens
gtgaccttccaagagcctg

SEQ ID NO: 4985717 - DNA, 22 bp, Homo sapiens
gtgaccttccaagagcctgaga

SEQ ID NO: 4985718 - DNA, 21 bp, Homo sapiens
gtgactatggagctgagcagg

SEQ ID NO: 4985719 - DNA, 22 bp, Homo sapiens
gtgatccacccaccttggcctc

SEQ ID NO: 4985720 - DNA, 18 bp, Homo sapiens
gtgatccgcctgcctctg

SEQ ID NO: 4985721 - DNA, 21 bp, Homo sapiens
gtgccaggatggaatgatggg

SEQ ID NO: 4985722 - DNA, 12 bp, Homo sapiens
gtgctacctgca

SEQ ID NO: 4985723 - DNA, 14 bp, Homo sapiens
gtggaagtgtgggt

SEQ ID NO: 4985724 - DNA, 18 bp, Homo sapiens
gtggaattattttaaaag

SEQ ID NO: 4985725 - DNA, 20 bp, Homo sapiens
gtggaattattttaaaagat

SEQ ID NO: 4985726 - DNA, 13 bp, Homo sapiens
gtgggagtgtgta

SEQ ID NO: 4985727 - DNA, 14 bp, Homo sapiens
gtgggagtgtgtaa

SEQ ID NO: 4985728 - DNA, 16 bp, Homo sapiens
gtggggggcttcatac

SEQ ID NO: 4985729 - DNA, 15 bp, Homo sapiens
gtgggggtctgtgtg

SEQ ID NO: 4985730 - DNA, 13 bp, Homo sapiens
gtgggtctgtgtg

SEQ ID NO: 4985731 - DNA, 16 bp, Homo sapiens
gtgggtctgtgtgtgt

SEQ ID NO: 4985732 - DNA, 20 bp, Homo sapiens
gtgtaatttaaaattgtgat

SEQ ID NO: 4985733 - DNA, 23 bp, Homo sapiens
gtgtaatttaaaattgtgatgtg

SEQ ID NO: 4985734 - DNA, 13 bp, Homo sapiens
gtgtatgtggggg

SEQ ID NO: 4985735 - DNA, 21 bp, Homo sapiens
gtgtatgtgggggtctgtgtg

SEQ ID NO: 4985736 - DNA, 15 bp, Homo sapiens
gtgtccttctcctct

SEQ ID NO: 4985737 - DNA, 20 bp, Homo sapiens
aagggaagccttttgcaaat

SEQ ID NO: 4985738 - DNA, 15 bp, Homo sapiens
aagtaaaaatattaa

SEQ ID NO: 4985739 - DNA, 16 bp, Homo sapiens
aagtatagaaaatctt

SEQ ID NO: 4985740 - DNA, 21 bp, Homo sapiens
aagtataggataaattacatt

SEQ ID NO: 4985741 - DNA, 22 bp, Homo sapiens
aagtataggataaattacatta

SEQ ID NO: 4985742 - DNA, 17 bp, Homo sapiens
aagtatcaagtatagaa

SEQ ID NO: 4985743 - DNA, 21 bp, Homo sapiens
aagtcactggccagtggctgg

SEQ ID NO: 4985744 - DNA, 17 bp, Homo sapiens
aagtgtgggtctgtgtg

SEQ ID NO: 4985745 - DNA, 23 bp, Homo sapiens
aagttattaagaggtaagactta

SEQ ID NO: 4985746 - DNA, 13 bp, Homo sapiens
aagtttgaacatt

SEQ ID NO: 4985747 - DNA, 18 bp, Homo sapiens
aataaagcattttgcaaa

SEQ ID NO: 4985748 - DNA, 12 bp, Homo sapiens
aataagtctgat

SEQ ID NO: 4985749 - DNA, 13 bp, Homo sapiens
aatagcacatgat

SEQ ID NO: 4985750 - DNA, 14 bp, Homo sapiens
aatagcacatgatt

SEQ ID NO: 4985751 - DNA, 18 bp, Homo sapiens
aataggcactttaaaaca

SEQ ID NO: 4985752 - DNA, 15 bp, Homo sapiens
aatatagaaaactaa

SEQ ID NO: 4985753 - DNA, 20 bp, Homo sapiens
aatatagaaaactaatctaa

SEQ ID NO: 4985754 - DNA, 13 bp, Homo sapiens
aatatgtttcaca

SEQ ID NO: 4985755 - DNA, 20 bp, Homo sapiens
aatcataaactatattctgt

SEQ ID NO: 4985756 - DNA, 22 bp, Homo sapiens
aatcatgtcagtctgcttagaa

SEQ ID NO: 4985757 - DNA, 23 bp, Homo sapiens
aatcatgtcagtctgcttagaaa

SEQ ID NO: 4985758 - DNA, 15 bp, Homo sapiens
aatctaggaaaatta

SEQ ID NO: 4985759 - DNA, 15 bp, Homo sapiens
aatctgatgggcctg

SEQ ID NO: 4985760 - DNA, 20 bp, Homo sapiens
aatctgatgggcctggctgg

SEQ ID NO: 4985761 - DNA, 12 bp, Homo sapiens
aatgaaaacaat

SEQ ID NO: 4985762 - DNA, 16 bp, Homo sapiens
aatgaaaacaatgcag

SEQ ID NO: 4985763 - DNA, 17 bp, Homo sapiens
aatgaggcattacaaat

SEQ ID NO: 4985764 - DNA, 16 bp, Homo sapiens
aatgcaaaaaaaatta

SEQ ID NO: 4985765 - DNA, 21 bp, Homo sapiens
aatggaaattaaaactcattt

SEQ ID NO: 4985766 - DNA, 14 bp, Homo sapiens
aatggtagcatttt

SEQ ID NO: 4985767 - DNA, 14 bp, Homo sapiens
aatgtaggctggct

SEQ ID NO: 4985768 - DNA, 23 bp, Homo sapiens
aatgtcagttctgatatggaagc

SEQ ID NO: 4985769 - DNA, 19 bp, Homo sapiens
aattaaaactcatttagga

SEQ ID NO: 4985770 - DNA, 18 bp, Homo sapiens
aattaactaaggaaatat

SEQ ID NO: 4985771 - DNA, 13 bp, Homo sapiens
aattatgaaaata

SEQ ID NO: 4985772 - DNA, 17 bp, Homo sapiens
aattcacaaagtaattt

SEQ ID NO: 4985773 - DNA, 22 bp, Homo sapiens
aattctttgacctgttgggagt

SEQ ID NO: 4985774 - DNA, 17 bp, Homo sapiens
aattgacattgaaatct

SEQ ID NO: 4985775 - DNA, 18 bp, Homo sapiens
aattgacattgaaatcta

SEQ ID NO: 4985776 - DNA, 14 bp, Homo sapiens
aattgtgatgtgtc

SEQ ID NO: 4985777 - DNA, 21 bp, Homo sapiens
aattgtttgacggcaaggttt

SEQ ID NO: 4985778 - DNA, 14 bp, Homo sapiens
aatttactgattcc

SEQ ID NO: 4985779 - DNA, 23 bp, Homo sapiens
aattttctttcatacattatatt

SEQ ID NO: 4985780 - DNA, 20 bp, Homo sapiens
acaaaagcaattttcattta

SEQ ID NO: 4985781 - DNA, 18 bp, Homo sapiens
acaacactttccctctct

SEQ ID NO: 4985782 - DNA, 21 bp, Homo sapiens
acaacactttccctctctgga

SEQ ID NO: 4985783 - DNA, 13 bp, Homo sapiens
acaacctaaaaaa

SEQ ID NO: 4985784 - DNA, 23 bp, Homo sapiens
acaacttataattacaatgcaca

SEQ ID NO: 4985785 - DNA, 19 bp, Homo sapiens
acaataaagcattttgcaa

SEQ ID NO: 4985786 - DNA, 20 bp, Homo sapiens
acaataaagcattttgcaaa

SEQ ID NO: 4985787 - DNA, 16 bp, Homo sapiens
acacacagagatatgc

SEQ ID NO: 4985788 - DNA, 18 bp, Homo sapiens
acacacatggatgagcac

SEQ ID NO: 4985789 - DNA, 14 bp, Homo sapiens
acacacggatgcac

SEQ ID NO: 4985790 - DNA, 15 bp, Homo sapiens
acacagatatgcaca

SEQ ID NO: 4985791 - DNA, 18 bp, Homo sapiens
acacaggtttagttgact

SEQ ID NO: 4985792 - DNA, 18 bp, Homo sapiens
acacattaataaacaatc

SEQ ID NO: 4985793 - DNA, 23 bp, Homo sapiens
acacggatgcacagagatatgca

SEQ ID NO: 4985794 - DNA, 23 bp, Homo sapiens
acactcaagtgccattcatcctt

SEQ ID NO: 4985795 - DNA, 19 bp, Homo sapiens
acactgagatccagagagg

SEQ ID NO: 4985796 - DNA, 20 bp, Homo sapiens
acacttatttttttcccaag

SEQ ID NO: 4985797 - DNA, 15 bp, Homo sapiens
acagaagattacaaa

SEQ ID NO: 4985798 - DNA, 21 bp, Homo sapiens
acagacactcccacttggcat

SEQ ID NO: 4985799 - DNA, 17 bp, Homo sapiens
acagagacagaaacaga

SEQ ID NO: 4985800 - DNA, 22 bp, Homo sapiens
acagagacctgccctcaagagc

SEQ ID NO: 4985801 - DNA, 14 bp, Homo sapiens
acagagagagactg

SEQ ID NO: 4985802 - DNA, 21 bp, Homo sapiens
acagagagagactgagggaga

SEQ ID NO: 4985803 - DNA, 16 bp, Homo sapiens
acagagatatgcacac

SEQ ID NO: 4985804 - DNA, 23 bp, Homo sapiens
acagaggacagtatttgtgggga

SEQ ID NO: 4985805 - DNA, 21 bp, Homo sapiens
acagagtggaataagacagag

SEQ ID NO: 4985806 - DNA, 19 bp, Homo sapiens
acagatatgcacacacatg

SEQ ID NO: 4985807 - DNA, 17 bp, Homo sapiens
acagtagaggcatgaac

SEQ ID NO: 4985808 - DNA, 12 bp, Homo sapiens
acagtgagagac

SEQ ID NO: 4985809 - DNA, 13 bp, Homo sapiens
acatatacatact

SEQ ID NO: 4985810 - DNA, 18 bp, Homo sapiens
acatggatgcacgcacat

SEQ ID NO: 4985811 - DNA, 15 bp, Homo sapiens
acattatattcctct

SEQ ID NO: 4985812 - DNA, 17 bp, Homo sapiens
acattatgttattggaa

SEQ ID NO: 4985813 - DNA, 20 bp, Homo sapiens
acattatgttattggaattt

SEQ ID NO: 4985814 - DNA, 15 bp, Homo sapiens
acattcaatcttgcc

SEQ ID NO: 4985815 - DNA, 17 bp, Homo sapiens
acattgaaatctaggaa

SEQ ID NO: 4985816 - DNA, 23 bp, Homo sapiens
acattgaaatctaggaaaattat

SEQ ID NO: 4985817 - DNA, 15 bp, Homo sapiens
acatttttgtacatt

SEQ ID NO: 4985818 - DNA, 17 bp, Homo sapiens
acatttttgtacattat

SEQ ID NO: 4985819 - DNA, 20 bp, Homo sapiens
acatttttgtacattatgtt

SEQ ID NO: 4985820 - DNA, 17 bp, Homo sapiens
accaaatcattgtatca

SEQ ID NO: 4985821 - DNA, 22 bp, Homo sapiens
accagcatggtagtggcaaaga

SEQ ID NO: 4985822 - DNA, 14 bp, Homo sapiens
accaggaagcacag

SEQ ID NO: 4985823 - DNA, 22 bp, Homo sapiens
acccagctatggttctctcgca

SEQ ID NO: 4985824 - DNA, 20 bp, Homo sapiens
accccagcaattatgaaaat

SEQ ID NO: 4985825 - DNA, 21 bp, Homo sapiens
acctaataagtgctactttgc

SEQ ID NO: 4985826 - DNA, 14 bp, Homo sapiens
acctcctaaaacaa

SEQ ID NO: 4985827 - DNA, 13 bp, Homo sapiens
acgaaagaaggca

SEQ ID NO: 4985828 - DNA, 18 bp, Homo sapiens
acgcacatagagatatgc

SEQ ID NO: 4985829 - DNA, 16 bp, Homo sapiens
acggatgcacacacag

SEQ ID NO: 4985830 - DNA, 15 bp, Homo sapiens
acggatgcacagaga

SEQ ID NO: 4985831 - DNA, 22 bp, Homo sapiens
acgtagatttttgctcttctgt

SEQ ID NO: 4985832 - DNA, 11 bp, Homo sapiens
acgtcattcag

SEQ ID NO: 4985833 - DNA, 15 bp, Homo sapiens
actaaggaaatattt

SEQ ID NO: 4985834 - DNA, 22 bp, Homo sapiens
actatctgtgcgtagaagttct

SEQ ID NO: 4985835 - DNA, 17 bp, Homo sapiens
actctaaagaaacagaa

SEQ ID NO: 4985836 - DNA, 18 bp, Homo sapiens
actctatgatgattgctt

SEQ ID NO: 4985837 - DNA, 22 bp, Homo sapiens
actctgaggacatggagagaga

SEQ ID NO: 4985838 - DNA, 15 bp, Homo sapiens
actgagcataagtcc

SEQ ID NO: 4985839 - DNA, 15 bp, Homo sapiens
actgattccagcaag

SEQ ID NO: 4985840 - DNA, 23 bp, Homo sapiens
actggccagtggctggatctgtg

SEQ ID NO: 4985841 - DNA, 21 bp, Homo sapiens
actggcgtgaacccaggaggc

SEQ ID NO: 4985842 - DNA, 17 bp, Homo sapiens
actgggtgtaaacacat

SEQ ID NO: 4985843 - DNA, 20 bp, Homo sapiens
actgtgctccagcctgggca

SEQ ID NO: 4985844 - DNA, 15 bp, Homo sapiens
acttaatgaaaacaa

SEQ ID NO: 4985845 - DNA, 16 bp, Homo sapiens
acttaatgaaaacaat

SEQ ID NO: 4985846 - DNA, 20 bp, Homo sapiens
acttgctcaagttcaccagc

SEQ ID NO: 4985847 - DNA, 12 bp, Homo sapiens
actttaaaagca

SEQ ID NO: 4985848 - DNA, 14 bp, Homo sapiens
actttaaaagcatt

SEQ ID NO: 4985849 - DNA, 13 bp, Homo sapiens
actttccctctct

SEQ ID NO: 4985850 - DNA, 19 bp, Homo sapiens
actttccctctctggacct

SEQ ID NO: 4985851 - DNA, 16 bp, Homo sapiens
acttttaaaactatat

SEQ ID NO: 4985852 - DNA, 16 bp, Homo sapiens
agaaaatgctagaaga

SEQ ID NO: 4985853 - DNA, 21 bp, Homo sapiens
agaaataacagaagaaaatag

SEQ ID NO: 4985854 - DNA, 15 bp, Homo sapiens
agaactcctgaaatc

SEQ ID NO: 4985855 - DNA, 17 bp, Homo sapiens
agaactcgttaaagcaa

SEQ ID NO: 4985856 - DNA, 18 bp, Homo sapiens
agaactcgttaaagcaaa

SEQ ID NO: 4985857 - DNA, 16 bp, Homo sapiens
agaagttctagtgttt

SEQ ID NO: 4985858 - DNA, 17 bp, Homo sapiens
agaagttctagtgtttt

SEQ ID NO: 4985859 - DNA, 20 bp, Homo sapiens
agaataggcactttaaaaca

SEQ ID NO: 4985860 - DNA, 19 bp, Homo sapiens
agaattgacattgaaatct

SEQ ID NO: 4985861 - DNA, 14 bp, Homo sapiens
agacagaaacagag

SEQ ID NO: 4985862 - DNA, 18 bp, Homo sapiens
agacagaaacagagagag

SEQ ID NO: 4985863 - DNA, 20 bp, Homo sapiens
agacagaaacagagagagac

SEQ ID NO: 4985864 - DNA, 18 bp, Homo sapiens
atagaattgacattgaaa

SEQ ID NO: 4985865 - DNA, 22 bp, Homo sapiens
atagagtgtgatgtatgtgtaa

SEQ ID NO: 4985866 - DNA, 13 bp, Homo sapiens
atagatgtgtgga

SEQ ID NO: 4985867 - DNA, 16 bp, Homo sapiens
atagcacatgattttc

SEQ ID NO: 4985868 - DNA, 22 bp, Homo sapiens
atagctaggtgacatatacata

SEQ ID NO: 4985869 - DNA, 18 bp, Homo sapiens
ataggataaattacatta

SEQ ID NO: 4985870 - DNA, 19 bp, Homo sapiens
ataggataaattacattaa

SEQ ID NO: 4985871 - DNA, 17 bp, Homo sapiens
ataggcactttaaaaca

SEQ ID NO: 4985872 - DNA, 18 bp, Homo sapiens
atatacacatggatgcac

SEQ ID NO: 4985873 - DNA, 23 bp, Homo sapiens
atatagctaggtgacatatacat

SEQ ID NO: 4985874 - DNA, 17 bp, Homo sapiens
atatatttgtcattttc

SEQ ID NO: 4985875 - DNA, 18 bp, Homo sapiens
atatattttttaaaataa

SEQ ID NO: 4985876 - DNA, 18 bp, Homo sapiens
atatcaaggtggaaatgg

SEQ ID NO: 4985877 - DNA, 19 bp, Homo sapiens
atatcattttgtggatata

SEQ ID NO: 4985878 - DNA, 16 bp, Homo sapiens
atatccaagtttgaat

SEQ ID NO: 4985879 - DNA, 23 bp, Homo sapiens
atatgtagatgtatgcacacaca

SEQ ID NO: 4985880 - DNA, 22 bp, Homo sapiens
atattaactgacgaagaagcaa

SEQ ID NO: 4985881 - DNA, 21 bp, Homo sapiens
atattcctctaaaactctcaa

SEQ ID NO: 4985882 - DNA, 15 bp, Homo sapiens
atatttatttatgta

SEQ ID NO: 4985883 - DNA, 16 bp, Homo sapiens
atatttgatctaagtt

SEQ ID NO: 4985884 - DNA, 16 bp, Homo sapiens
atcaagtatagaaaat

SEQ ID NO: 4985885 - DNA, 19 bp, Homo sapiens
atcaagtatagaaaatctt

SEQ ID NO: 4985886 - DNA, 13 bp, Homo sapiens
atcaatgaagatt

SEQ ID NO: 4985887 - DNA, 21 bp, Homo sapiens
atcaatgaagattaacactga

SEQ ID NO: 4985888 - DNA, 16 bp, Homo sapiens
atcagattcttgctgt

SEQ ID NO: 4985889 - DNA, 14 bp, Homo sapiens
atcagcctgtgcca

SEQ ID NO: 4985890 - DNA, 18 bp, Homo sapiens
atcatgtttacagaggac

SEQ ID NO: 4985891 - DNA, 20 bp, Homo sapiens
atcattctgcttccgtattt

SEQ ID NO: 4985892 - DNA, 21 bp, Homo sapiens
atccactgggtgtaaacacat

SEQ ID NO: 4985893 - DNA, 18 bp, Homo sapiens
atcctcctgggattggct

SEQ ID NO: 4985894 - DNA, 16 bp, Homo sapiens
atctaggaaaattatt

SEQ ID NO: 4985895 - DNA, 20 bp, Homo sapiens
atctcaagcaagtttaatca

SEQ ID NO: 4985896 - DNA, 23 bp, Homo sapiens
atctctgattccctgatttaata

SEQ ID NO: 4985897 - DNA, 22 bp, Homo sapiens
atctggatatcaaggtggaaat

SEQ ID NO: 4985898 - DNA, 23 bp, Homo sapiens
atctggatatcaaggtggaaatg

SEQ ID NO: 4985899 - DNA, 24 bp, Homo sapiens
atctggatatcaaggtggaaatgg

SEQ ID NO: 4985900 - DNA, 16 bp, Homo sapiens
atctgtacctctgcct

SEQ ID NO: 4985901 - DNA, 22 bp, Homo sapiens
atctgtcaaagaaaacttccaa

SEQ ID NO: 4985902 - DNA, 13 bp, Homo sapiens
atcttaaaaacaa

SEQ ID NO: 4985903 - DNA, 12 bp, Homo sapiens
atctttaaatag

SEQ ID NO: 4985904 - DNA, 16 bp, Homo sapiens
atctttccctccttgg

SEQ ID NO: 4985905 - DNA, 17 bp, Homo sapiens
atgaaaagcctctgttt

SEQ ID NO: 4985906 - DNA, 21 bp, Homo sapiens
atgaaaagctatcttaaaata

SEQ ID NO: 4985907 - DNA, 18 bp, Homo sapiens
atgactctaaagaaacag

SEQ ID NO: 4985908 - DNA, 16 bp, Homo sapiens
atgaggcattacaaat

SEQ ID NO: 4985909 - DNA, 19 bp, Homo sapiens
atgagggccaccaggaagc

SEQ ID NO: 4985910 - DNA, 17 bp, Homo sapiens
atgcacacacacagaga

SEQ ID NO: 4985911 - DNA, 19 bp, Homo sapiens
atgcacagagatatgcaca

SEQ ID NO: 4985912 - DNA, 17 bp, Homo sapiens
atgcacgcacacatcag

SEQ ID NO: 4985913 - DNA, 17 bp, Homo sapiens
atgcagtacaggacata

SEQ ID NO: 4985914 - DNA, 17 bp, Homo sapiens
atgcccagctcagtgcc

SEQ ID NO: 4985915 - DNA, 14 bp, Homo sapiens
atgcgctgtggcca

SEQ ID NO: 4985916 - DNA, 15 bp, Homo sapiens
atgctacagtaataa

SEQ ID NO: 4985917 - DNA, 18 bp, Homo sapiens
atgctggtagctagtgat

SEQ ID NO: 4985918 - DNA, 22 bp, Homo sapiens
atggaatagaaaagatgagagg

SEQ ID NO: 4985919 - DNA, 17 bp, Homo sapiens
atggaattcacaaagta

SEQ ID NO: 4985920 - DNA, 14 bp, Homo sapiens
atggagagagactc

SEQ ID NO: 4985921 - DNA, 16 bp, Homo sapiens
atggcccatttaatga

SEQ ID NO: 4985922 - DNA, 22 bp, Homo sapiens
atggcccatttaatgattgatt

SEQ ID NO: 4985923 - DNA, 13 bp, Homo sapiens
atggcgcaggaac

SEQ ID NO: 4985924 - DNA, 21 bp, Homo sapiens
atgggagctgtcaagcatgta

SEQ ID NO: 4985925 - DNA, 13 bp, Homo sapiens
atggtagcatttt

SEQ ID NO: 4985926 - DNA, 23 bp, Homo sapiens
atggtagcattttaaacaaaata

SEQ ID NO: 4985927 - DNA, 16 bp, Homo sapiens
atggttctcaggcctg

SEQ ID NO: 4985928 - DNA, 22 bp, Homo sapiens
atgtacacacacagatgcacac

SEQ ID NO: 4985929 - DNA, 13 bp, Homo sapiens
atgtcagacacag

SEQ ID NO: 4985930 - DNA, 15 bp, Homo sapiens
atgtcagacacagat

SEQ ID NO: 4985931 - DNA, 13 bp, Homo sapiens
atgtcagtatgtg

SEQ ID NO: 4985932 - DNA, 14 bp, Homo sapiens
atgtcagttctgat

SEQ ID NO: 4985933 - DNA, 23 bp, Homo sapiens
atgtgacaacatttttgtacatt

SEQ ID NO: 4985934 - DNA, 18 bp, Homo sapiens
atgtgctgtgtgacattg

SEQ ID NO: 4985935 - DNA, 10 bp, Homo sapiens
atgtgtgtgt

SEQ ID NO: 4985936 - DNA, 15 bp, Homo sapiens
atgtttacagaggac

SEQ ID NO: 4985937 - DNA, 19 bp, Homo sapiens
atgtttacagaggacagta

SEQ ID NO: 4985938 - DNA, 20 bp, Homo sapiens
atgtttatttaaaagagcag

SEQ ID NO: 4985939 - DNA, 16 bp, Homo sapiens
attaaacgtcattcag

SEQ ID NO: 4985940 - DNA, 14 bp, Homo sapiens
attaaggacattta

SEQ ID NO: 4985941 - DNA, 13 bp, Homo sapiens
attacattaaaat

SEQ ID NO: 4985942 - DNA, 23 bp, Homo sapiens
attaggttgaaacatatctctta

SEQ ID NO: 4985943 - DNA, 23 bp, Homo sapiens
attatattcctctaaaactctca

SEQ ID NO: 4985944 - DNA, 13 bp, Homo sapiens
attatgaaaataa

SEQ ID NO: 4985945 - DNA, 14 bp, Homo sapiens
attatggaaacaga

SEQ ID NO: 4985946 - DNA, 15 bp, Homo sapiens
attatgttattggaa

SEQ ID NO: 4985947 - DNA, 17 bp, Homo sapiens
attatgttattggaatt

SEQ ID NO: 4985948 - DNA, 23 bp, Homo sapiens
attcaacccatttactttggtca

SEQ ID NO: 4985949 - DNA, 16 bp, Homo sapiens
attcacaaagtaattt

SEQ ID NO: 4985950 - DNA, 17 bp, Homo sapiens
attcacaaagtaatttg

SEQ ID NO: 4985951 - DNA, 15 bp, Homo sapiens
attcagaagcatcac

SEQ ID NO: 4985952 - DNA, 15 bp, Homo sapiens
attcatcaatgaaga

SEQ ID NO: 4985953 - DNA, 19 bp, Homo sapiens
attcctaaaattatggaaa

SEQ ID NO: 4985954 - DNA, 23 bp, Homo sapiens
attcctcatttgttcattaaacg

SEQ ID NO: 4985955 - DNA, 22 bp, Homo sapiens
attctgtgacatgctaattatt

SEQ ID NO: 4985956 - DNA, 17 bp, Homo sapiens
attgacattgaaatcta

SEQ ID NO: 4985957 - DNA, 13 bp, Homo sapiens
attgatttcaagt

SEQ ID NO: 4985958 - DNA, 18 bp, Homo sapiens
attgcttccacccacacg

SEQ ID NO: 4985959 - DNA, 12 bp, Homo sapiens
attggtgttgac

SEQ ID NO: 4985960 - DNA, 15 bp, Homo sapiens
attgtgatgtgtcct

SEQ ID NO: 4985961 - DNA, 14 bp, Homo sapiens
atttaatatgcaaa

SEQ ID NO: 4985962 - DNA, 15 bp, Homo sapiens
atttaatatgcaaag

SEQ ID NO: 4985963 - DNA, 15 bp, Homo sapiens
atttacaaatgtttt

SEQ ID NO: 4985964 - DNA, 18 bp, Homo sapiens
atttccatttacttaaga

SEQ ID NO: 4985965 - DNA, 22 bp, Homo sapiens
atttccatttacttaagactta

SEQ ID NO: 4985966 - DNA, 17 bp, Homo sapiens
atttgggttactatttc

SEQ ID NO: 4985967 - DNA, 22 bp, Homo sapiens
atttgtggggagggatttgggg

SEQ ID NO: 4985968 - DNA, 15 bp, Homo sapiens
atttgttcattaaac

SEQ ID NO: 4985969 - DNA, 19 bp, Homo sapiens
attttaatttactgattcc

SEQ ID NO: 4985970 - DNA, 21 bp, Homo sapiens
attttcttttgttttcttcat

SEQ ID NO: 4985971 - DNA, 13 bp, Homo sapiens
attttgaaattgt

SEQ ID NO: 4985972 - DNA, 13 bp, Homo sapiens
attttgtggatat

SEQ ID NO: 4985973 - DNA, 16 bp, Homo sapiens
atttttgctcttctgt

SEQ ID NO: 4985974 - DNA, 13 bp, Homo sapiens
atttttgtacatt

SEQ ID NO: 4985975 - DNA, 15 bp, Homo sapiens
atttttgtacattat

SEQ ID NO: 4985976 - DNA, 16 bp, Homo sapiens
atttttgtacattatg

SEQ ID NO: 4985977 - DNA, 14 bp, Homo sapiens
attttttaaaataa

SEQ ID NO: 4985978 - DNA, 13 bp, Homo sapiens
atttttttcccaa

SEQ ID NO: 4985979 - DNA, 22 bp, Homo sapiens
atttttttcccaaggagtaacc

SEQ ID NO: 4985980 - DNA, 14 bp, Homo sapiens
caaaaagatttatt

SEQ ID NO: 4985981 - DNA, 21 bp, Homo sapiens
caaaatagaaagttgcaaggc

SEQ ID NO: 4985982 - DNA, 22 bp, Homo sapiens
caaaatagaaagttgcaaggca

SEQ ID NO: 4985983 - DNA, 20 bp, Homo sapiens
caaagagaggtccagagtcc

SEQ ID NO: 4985984 - DNA, 21 bp, Homo sapiens
caaagcgctaagtaaaaatat

SEQ ID NO: 4985985 - DNA, 20 bp, Homo sapiens
caaagtaatttggaaattag

SEQ ID NO: 4985986 - DNA, 17 bp, Homo sapiens
caaagtagatcatgcat

SEQ ID NO: 4985987 - DNA, 20 bp, Homo sapiens
caaataatattactctatga

SEQ ID NO: 4985988 - DNA, 23 bp, Homo sapiens
caaatcaggttttcttttaagaa

SEQ ID NO: 4985989 - DNA, 16 bp, Homo sapiens
caaatcattgtatcaa

SEQ ID NO: 4985990 - DNA, 16 bp, Homo sapiens
caaatgtttatttaaa

SEQ ID NO: 4985991 - DNA, 23 bp, Homo sapiens
ctcagtttccctctgtatacaag

SEQ ID NO: 4985992 - DNA, 14 bp, Homo sapiens
ctcatctttccctc

SEQ ID NO: 4985993 - DNA, 23 bp, Homo sapiens
ctcatgatagaaggctatgggga

SEQ ID NO: 4985994 - DNA, 19 bp, Homo sapiens
ctccaggcagcagacacat

SEQ ID NO: 4985995 - DNA, 13 bp, Homo sapiens
ctccatgtgtgct

SEQ ID NO: 4985996 - DNA, 11 bp, Homo sapiens
ctcctgaaatc

SEQ ID NO: 4985997 - DNA, 20 bp, Homo sapiens
ctcctgaaatcatatagaaa

SEQ ID NO: 4985998 - DNA, 15 bp, Homo sapiens
ctcctgaaatctaca

SEQ ID NO: 4985999 - DNA, 22 bp, Homo sapiens
ctctacccatcttaaaaacaac

SEQ ID NO: 4986000 - DNA, 22 bp, Homo sapiens
ctctgtatacaaggatcagatt

SEQ ID NO: 4986001 - DNA, 22 bp, Homo sapiens
ctgaaatcatatagaaaggctg

SEQ ID NO: 4986002 - DNA, 18 bp, Homo sapiens
ctgaaatgtcagttctga

SEQ ID NO: 4986003 - DNA, 20 bp, Homo sapiens
ctgaaatgtcagttctgata

SEQ ID NO: 4986004 - DNA, 17 bp, Homo sapiens
ctgacgaagaagcaact

SEQ ID NO: 4986005 - DNA, 15 bp, Homo sapiens
ctgactccatgtgtg

SEQ ID NO: 4986006 - DNA, 13 bp, Homo sapiens
ctgagatccagag

SEQ ID NO: 4986007 - DNA, 15 bp, Homo sapiens
ctgagcctcacagca

SEQ ID NO: 4986008 - DNA, 16 bp, Homo sapiens
ctgagcctcacagcag

SEQ ID NO: 4986009 - DNA, 17 bp, Homo sapiens
ctgagcctcacagcagt

SEQ ID NO: 4986010 - DNA, 16 bp, Homo sapiens
ctgagggagagactct

SEQ ID NO: 4986011 - DNA, 17 bp, Homo sapiens
ctgagtgtacagagtgg

SEQ ID NO: 4986012 - DNA, 16 bp, Homo sapiens
ctgatatggaagcacc

SEQ ID NO: 4986013 - DNA, 15 bp, Homo sapiens
ctgattccagcaaga

SEQ ID NO: 4986014 - DNA, 13 bp, Homo sapiens
ctgattgtattta

SEQ ID NO: 4986015 - DNA, 19 bp, Homo sapiens
ctgcaacatacaggtgcct

SEQ ID NO: 4986016 - DNA, 22 bp, Homo sapiens
ctgccatcatgtttacagagga

SEQ ID NO: 4986017 - DNA, 23 bp, Homo sapiens
ctgccatcatgtttacagaggac

SEQ ID NO: 4986018 - DNA, 16 bp, Homo sapiens
ctgccctcaagagcaa

SEQ ID NO: 4986019 - DNA, 18 bp, Homo sapiens
ctgctgggaggttaaaaa

SEQ ID NO: 4986020 - DNA, 11 bp, Homo sapiens
ctggacctcag

SEQ ID NO: 4986021 - DNA, 14 bp, Homo sapiens
ctggatatcaaggt

SEQ ID NO: 4986022 - DNA, 21 bp, Homo sapiens
ctggatatcaaggtggaaatg

SEQ ID NO: 4986023 - DNA, 23 bp, Homo sapiens
ctggatgcccatccactgggtgt

SEQ ID NO: 4986024 - DNA, 16 bp, Homo sapiens
ctggcaaagcagaatg

SEQ ID NO: 4986025 - DNA, 18 bp, Homo sapiens
ctggcccttgatgcccag

SEQ ID NO: 4986026 - DNA, 14 bp, Homo sapiens
ctgggattggctgt

SEQ ID NO: 4986027 - DNA, 15 bp, Homo sapiens
ctgggcaacagagca

SEQ ID NO: 4986028 - DNA, 18 bp, Homo sapiens
ctgggcaacagagcaaga

SEQ ID NO: 4986029 - DNA, 17 bp, Homo sapiens
ctggtcccacacttatc

SEQ ID NO: 4986030 - DNA, 15 bp, Homo sapiens
ctgtatacaaggatc

SEQ ID NO: 4986031 - DNA, 21 bp, Homo sapiens
ctgtattagcagcaaaacaaa

SEQ ID NO: 4986032 - DNA, 14 bp, Homo sapiens
ctgtgtgtgtgtat

SEQ ID NO: 4986033 - DNA, 15 bp, Homo sapiens
ctgtgtgtgtgtatg

SEQ ID NO: 4986034 - DNA, 18 bp, Homo sapiens
ctgtgtgtgtgtatgtgg

SEQ ID NO: 4986035 - DNA, 16 bp, Homo sapiens
cttaaaatatagaaaa

SEQ ID NO: 4986036 - DNA, 23 bp, Homo sapiens
cttaatgagactttaaaagcatt

SEQ ID NO: 4986037 - DNA, 22 bp, Homo sapiens
cttacgaaaaaatggtagcatt

SEQ ID NO: 4986038 - DNA, 23 bp, Homo sapiens
cttagaaataacagaagaaaata

SEQ ID NO: 4986039 - DNA, 15 bp, Homo sapiens
cttaggccagcacca

SEQ ID NO: 4986040 - DNA, 19 bp, Homo sapiens
cttataattacaatgcaca

SEQ ID NO: 4986041 - DNA, 15 bp, Homo sapiens
cttccgtattttaat

SEQ ID NO: 4986042 - DNA, 17 bp, Homo sapiens
cttctacctcttggctg

SEQ ID NO: 4986043 - DNA, 14 bp, Homo sapiens
cttctcctgaaatc

SEQ ID NO: 4986044 - DNA, 14 bp, Homo sapiens
cttctcttcccata

SEQ ID NO: 4986045 - DNA, 10 bp, Homo sapiens
cttctgcagt

SEQ ID NO: 4986046 - DNA, 22 bp, Homo sapiens
cttctgtatgtgacaacatttt

SEQ ID NO: 4986047 - DNA, 15 bp, Homo sapiens
ctttaaaagcatttt

SEQ ID NO: 4986048 - DNA, 22 bp, Homo sapiens
ctttcatacattatattcctct

SEQ ID NO: 4986049 - DNA, 14 bp, Homo sapiens
ctttccctctctgg

SEQ ID NO: 4986050 - DNA, 21 bp, Homo sapiens
ctttcctaaatataaatgaaa

SEQ ID NO: 4986051 - DNA, 14 bp, Homo sapiens
cttttgtcccagaa

SEQ ID NO: 4986052 - DNA, 16 bp, Homo sapiens
cttttgttttcttcat

SEQ ID NO: 4986053 - DNA, 12 bp, Homo sapiens
gaaaacaatgca

SEQ ID NO: 4986054 - DNA, 14 bp, Homo sapiens
gaaaagtttataaa

SEQ ID NO: 4986055 - DNA, 14 bp, Homo sapiens
gaaacagagagaga

SEQ ID NO: 4986056 - DNA, 16 bp, Homo sapiens
gaaacattctttccta

SEQ ID NO: 4986057 - DNA, 18 bp, Homo sapiens
gaaacattctttcctaaa

SEQ ID NO: 4986058 - DNA, 17 bp, Homo sapiens
gaaactggcaaagcaga

SEQ ID NO: 4986059 - DNA, 21 bp, Homo sapiens
gaaagttgcaaggcaaatgtt

SEQ ID NO: 4986060 - DNA, 18 bp, Homo sapiens
gaaataacagaagaaaat

SEQ ID NO: 4986061 - DNA, 21 bp, Homo sapiens
gaaatcatatagaaaggctgg

SEQ ID NO: 4986062 - DNA, 15 bp, Homo sapiens
gaaatctacaggcct

SEQ ID NO: 4986063 - DNA, 18 bp, Homo sapiens
gaaatctaggaaaattat

SEQ ID NO: 4986064 - DNA, 17 bp, Homo sapiens
gaaatgtggagaacatt

SEQ ID NO: 4986065 - DNA, 17 bp, Homo sapiens
gaaattaggttgaaaca

SEQ ID NO: 4986066 - DNA, 22 bp, Homo sapiens
taaacaaaatagaaagttgcaa

SEQ ID NO: 4986067 - DNA, 19 bp, Homo sapiens
taaacatatccaagtttga

SEQ ID NO: 4986068 - DNA, 14 bp, Homo sapiens
taaagaagtttgaa

SEQ ID NO: 4986069 - DNA, 20 bp, Homo sapiens
taaagcaaagcgctaagtaa

SEQ ID NO: 4986070 - DNA, 17 bp, Homo sapiens
taaagcattttgcaaac

SEQ ID NO: 4986071 - DNA, 14 bp, Homo sapiens
taaattacattaaa

SEQ ID NO: 4986072 - DNA, 13 bp, Homo sapiens
taaatttatgtga

SEQ ID NO: 4986073 - DNA, 13 bp, Homo sapiens
taacaataaagca

SEQ ID NO: 4986074 - DNA, 19 bp, Homo sapiens
taacagaagaaaatagaat

SEQ ID NO: 4986075 - DNA, 22 bp, Homo sapiens
taacttaaaagaacatgtatat

SEQ ID NO: 4986076 - DNA, 13 bp, Homo sapiens
taacttcattttt

SEQ ID NO: 4986077 - DNA, 14 bp, Homo sapiens
taacttcatttttc

SEQ ID NO: 4986078 - DNA, 20 bp, Homo sapiens
taacttcatttttctaataa

SEQ ID NO: 4986079 - DNA, 16 bp, Homo sapiens
taagaaaaacatctgg

SEQ ID NO: 4986080 - DNA, 18 bp, Homo sapiens
taagaaaatgctagaaga

SEQ ID NO: 4986081 - DNA, 21 bp, Homo sapiens
taagacttagtactatctgtg

SEQ ID NO: 4986082 - DNA, 19 bp, Homo sapiens
taagaggtaagacttagta

SEQ ID NO: 4986083 - DNA, 15 bp, Homo sapiens
taagccaaaactgag

SEQ ID NO: 4986084 - DNA, 20 bp, Homo sapiens
taagtatcaagtatagaaaa

SEQ ID NO: 4986085 - DNA, 22 bp, Homo sapiens
taagttattaagaggtaagact

SEQ ID NO: 4986086 - DNA, 13 bp, Homo sapiens
taataaatatgtt

SEQ ID NO: 4986087 - DNA, 20 bp, Homo sapiens
taataaatatgtttcacaca

SEQ ID NO: 4986088 - DNA, 13 bp, Homo sapiens
taatgaaaacaat

SEQ ID NO: 4986089 - DNA, 20 bp, Homo sapiens
taatgaccatgaaagacttc

SEQ ID NO: 4986090 - DNA, 18 bp, Homo sapiens
taatgaggcattacaaat

SEQ ID NO: 4986091 - DNA, 16 bp, Homo sapiens
taatttaaaattgtga

SEQ ID NO: 4986092 - DNA, 20 bp, Homo sapiens
taatttaaaattgtgatgtg

SEQ ID NO: 4986093 - DNA, 12 bp, Homo sapiens
tacaaaagcaat

SEQ ID NO: 4986094 - DNA, 18 bp, Homo sapiens
tacacactgtacacataa

SEQ ID NO: 4986095 - DNA, 15 bp, Homo sapiens
tacacatggatgcac

SEQ ID NO: 4986096 - DNA, 21 bp, Homo sapiens
tacactcaagtgccattcatc

SEQ ID NO: 4986097 - DNA, 22 bp, Homo sapiens
tacagagtggaataagacagag

SEQ ID NO: 4986098 - DNA, 14 bp, Homo sapiens
tacaggacatatat

SEQ ID NO: 4986099 - DNA, 15 bp, Homo sapiens
tacaggcctcagggt

SEQ ID NO: 4986100 - DNA, 13 bp, Homo sapiens
tacagtaataaat

SEQ ID NO: 4986101 - DNA, 20 bp, Homo sapiens
tacatgtgtgtatatgtaga

SEQ ID NO: 4986102 - DNA, 21 bp, Homo sapiens
tacattaaaatagcacatgat

SEQ ID NO: 4986103 - DNA, 13 bp, Homo sapiens
tacattttacaca

SEQ ID NO: 4986104 - DNA, 15 bp, Homo sapiens
taccacttttgcaaa

SEQ ID NO: 4986105 - DNA, 23 bp, Homo sapiens
tacgaaaaaatggtagcatttta

SEQ ID NO: 4986106 - DNA, 12 bp, Homo sapiens
tactatttcttg

SEQ ID NO: 4986107 - DNA, 22 bp, Homo sapiens
tactatttcttgtggttataac

SEQ ID NO: 4986108 - DNA, 22 bp, Homo sapiens
tactcgggaggctgaggcagga

SEQ ID NO: 4986109 - DNA, 20 bp, Homo sapiens
tactctatgatgattgcttc

SEQ ID NO: 4986110 - DNA, 15 bp, Homo sapiens
tactgatatcagagt

SEQ ID NO: 4986111 - DNA, 15 bp, Homo sapiens
tactgattccagcaa

SEQ ID NO: 4986112 - DNA, 14 bp, Homo sapiens
tactgtttcagtcc

SEQ ID NO: 4986113 - DNA, 19 bp, Homo sapiens
tagaaaactaatctaaact

SEQ ID NO: 4986114 - DNA, 13 bp, Homo sapiens
tagaaataacaga

SEQ ID NO: 4986115 - DNA, 14 bp, Homo sapiens
tagaagaagtgtgt

SEQ ID NO: 4986116 - DNA, 22 bp, Homo sapiens
tagaagttctagtgttttcaat

SEQ ID NO: 4986117 - DNA, 16 bp, Homo sapiens
tagaataggcacttta

SEQ ID NO: 4986118 - DNA, 21 bp, Homo sapiens
tagaattgacattgaaatcta

SEQ ID NO: 4986119 - DNA, 22 bp, Homo sapiens
tagaggagggcatgggagggag

SEQ ID NO: 4986120 - DNA, 18 bp, Homo sapiens
tagagtatcagttgcagg

SEQ ID NO: 4986121 - DNA, 16 bp, Homo sapiens
tagatgtatgcacaca

SEQ ID NO: 4986122 - DNA, 20 bp, Homo sapiens
tagatgtatgcacacacata

SEQ ID NO: 4986123 - DNA, 11 bp, Homo sapiens
tagatgtgtgg

SEQ ID NO: 4986124 - DNA, 14 bp, Homo sapiens
tagcattttaaaca

SEQ ID NO: 4986125 - DNA, 17 bp, Homo sapiens
tagccatctcaagcaag

SEQ ID NO: 4986126 - DNA, 17 bp, Homo sapiens
tagctaggtgacatata

SEQ ID NO: 4986127 - DNA, 12 bp, Homo sapiens
taggaaaattat

SEQ ID NO: 4986128 - DNA, 12 bp, Homo sapiens
taggataaatta

SEQ ID NO: 4986129 - DNA, 17 bp, Homo sapiens
taggataaattacatta

SEQ ID NO: 4986130 - DNA, 18 bp, Homo sapiens
taggataaattacattaa

SEQ ID NO: 4986131 - DNA, 12 bp, Homo sapiens
tttgtacattat

SEQ ID NO: 4986132 - DNA, 22 bp, Homo sapiens
tttgtacattatgttattggaa

SEQ ID NO: 4986133 - DNA, 12 bp, Homo sapiens
tttgtcattttc

SEQ ID NO: 4986134 - DNA, 14 bp, Homo sapiens
ttttctttcataca

SEQ ID NO: 4986135 - DNA, 19 bp, Homo sapiens
ttttgaaaaaagtatagga

SEQ ID NO: 4986136 - DNA, 18 bp, Homo sapiens
ttttgcaaataagtgtat

SEQ ID NO: 4986137 - DNA, 20 bp, Homo sapiens
ttttgctcttctgtatgtga

SEQ ID NO: 4986138 - DNA, 13 bp, Homo sapiens
ttttgtacattat

SEQ ID NO: 4986139 - DNA, 13 bp, Homo sapiens
tttttgtacatta

SEQ ID NO: 4986140 - DNA, 14 bp, Homo sapiens
tttttgtacattat

SEQ ID NO: 4986141 - DNA, 18 bp, Homo sapiens
ttttttaaaataagtctg

SEQ ID NO: 4986142 - DNA, 23 bp, Homo sapiens
aattaaaccagactctgttgcaa

SEQ ID NO: 4986143 - DNA, 21 bp, Homo sapiens
aattaactgctaacttctatt

SEQ ID NO: 4986144 - DNA, 21 bp, Homo sapiens
aattacaatatgtatttatgt

SEQ ID NO: 4986145 - DNA, 18 bp, Homo sapiens
aattactgatatcagagt

SEQ ID NO: 4986146 - DNA, 15 bp, Homo sapiens
aattaggttgaaaca

SEQ ID NO: 4986147 - DNA, 13 bp, Homo sapiens
aattcacaaagta

SEQ ID NO: 4986148 - DNA, 20 bp, Homo sapiens
aattcctcatttgttcatta

SEQ ID NO: 4986149 - DNA, 16 bp, Homo sapiens
aattgggcactattta

SEQ ID NO: 4986150 - DNA, 18 bp, Homo sapiens
aattgggcactatttatt

SEQ ID NO: 4986151 - DNA, 11 bp, Homo sapiens
aattgtgatgt

SEQ ID NO: 4986152 - DNA, 17 bp, Homo sapiens
aatttcagttctagttg

SEQ ID NO: 4986153 - DNA, 21 bp, Homo sapiens
aatttccatttacttaagact

SEQ ID NO: 4986154 - DNA, 22 bp, Homo sapiens
aatttccatttacttaagactt

SEQ ID NO: 4986155 - DNA, 21 bp, Homo sapiens
aatttctttctaaaacacatt

SEQ ID NO: 4986156 - DNA, 14 bp, Homo sapiens
aattttaaacatat

SEQ ID NO: 4986157 - DNA, 19 bp, Homo sapiens
aattttctttcatacatta

SEQ ID NO: 4986158 - DNA, 20 bp, Homo sapiens
aattttctttcatacattat

SEQ ID NO: 4986159 - DNA, 21 bp, Homo sapiens
aattttctttcatacattata

SEQ ID NO: 4986160 - DNA, 14 bp, Homo sapiens
acaaaatagaaagt

SEQ ID NO: 4986161 - DNA, 20 bp, Homo sapiens
acaacatttttgtacattat

SEQ ID NO: 4986162 - DNA, 17 bp, Homo sapiens
acaataaagcattttgc

SEQ ID NO: 4986163 - DNA, 24 bp, Homo sapiens
acaatgcagtacaggacatatatt

SEQ ID NO: 4986164 - DNA, 22 bp, Homo sapiens
acacacagatggtcacacagag

SEQ ID NO: 4986165 - DNA, 17 bp, Homo sapiens
acacactgtacacataa

SEQ ID NO: 4986166 - DNA, 21 bp, Homo sapiens
acacagatggtcacacagaga

SEQ ID NO: 4986167 - DNA, 15 bp, Homo sapiens
acacattaataaaca

SEQ ID NO: 4986168 - DNA, 21 bp, Homo sapiens
acacgactgcaacatacaggt

SEQ ID NO: 4986169 - DNA, 21 bp, Homo sapiens
acactcaagtgccattcatcc

SEQ ID NO: 4986170 - DNA, 15 bp, Homo sapiens
acagaaacagagaga

SEQ ID NO: 4986171 - DNA, 12 bp, Homo sapiens
acagagcaagac

SEQ ID NO: 4986172 - DNA, 17 bp, Homo sapiens
acagagttggtgttcat

SEQ ID NO: 4986173 - DNA, 20 bp, Homo sapiens
acagagttggtgttcataat

SEQ ID NO: 4986174 - DNA, 15 bp, Homo sapiens
acagatatacacatg

SEQ ID NO: 4986175 - DNA, 14 bp, Homo sapiens
acagatatgcacac

SEQ ID NO: 4986176 - DNA, 12 bp, Homo sapiens
acagatgaaaag

SEQ ID NO: 4986177 - DNA, 21 bp, Homo sapiens
acagatgcacacacagatgca

SEQ ID NO: 4986178 - DNA, 20 bp, Homo sapiens
acaggtccaaggctggtccc

SEQ ID NO: 4986179 - DNA, 18 bp, Homo sapiens
acatatattttttaaaat

SEQ ID NO: 4986180 - DNA, 20 bp, Homo sapiens
acatatattttttaaaataa

SEQ ID NO: 4986181 - DNA, 16 bp, Homo sapiens
acatctagtagttgtt

SEQ ID NO: 4986182 - DNA, 20 bp, Homo sapiens
acatctagtagttgttctga

SEQ ID NO: 4986183 - DNA, 14 bp, Homo sapiens
acatggatgcacac

SEQ ID NO: 4986184 - DNA, 22 bp, Homo sapiens
acatgtgtgtatatgtagatgt

SEQ ID NO: 4986185 - DNA, 14 bp, Homo sapiens
acattaataaacaa

SEQ ID NO: 4986186 - DNA, 23 bp, Homo sapiens
acattatgttattggaattttct

SEQ ID NO: 4986187 - DNA, 21 bp, Homo sapiens
acatttgggttactatttctt

SEQ ID NO: 4986188 - DNA, 16 bp, Homo sapiens
accaggaagcacaggt

SEQ ID NO: 4986189 - DNA, 17 bp, Homo sapiens
accaggaagcacaggtc

SEQ ID NO: 4986190 - DNA, 20 bp, Homo sapiens
accatcctggctaacacggt

SEQ ID NO: 4986191 - DNA, 14 bp, Homo sapiens
accatgaaagactt

SEQ ID NO: 4986192 - DNA, 14 bp, Homo sapiens
acccacacgactgc

SEQ ID NO: 4986193 - DNA, 20 bp, Homo sapiens
acccaggatttgctgggaga

SEQ ID NO: 4986194 - DNA, 20 bp, Homo sapiens
acctgcacgtgatctgctgg

SEQ ID NO: 4986195 - DNA, 18 bp, Homo sapiens
acgtttgactagccatct

SEQ ID NO: 4986196 - DNA, 15 bp, Homo sapiens
actaactttttgaat

SEQ ID NO: 4986197 - DNA, 16 bp, Homo sapiens
actaaggaaatatttc

SEQ ID NO: 4986198 - DNA, 21 bp, Homo sapiens
actaatagagacacagagatg

SEQ ID NO: 4986199 - DNA, 18 bp, Homo sapiens
actatatttatttatgta

SEQ ID NO: 4986200 - DNA, 20 bp, Homo sapiens
actatctgtgcgtagaagtt

SEQ ID NO: 4986201 - DNA, 17 bp, Homo sapiens
actattcatcaatgaag

SEQ ID NO: 4986202 - DNA, 17 bp, Homo sapiens
actatttatttacaaat

SEQ ID NO: 4986203 - DNA, 16 bp, Homo sapiens
actcatctttccctcc

SEQ ID NO: 4986204 - DNA, 20 bp, Homo sapiens
actccaggcagcagacacat

SEQ ID NO: 4986205 - DNA, 22 bp, Homo sapiens
actccaggcagcagacacatgc

SEQ ID NO: 4986206 - DNA, 12 bp, Homo sapiens
actcctgaaatc

SEQ ID NO: 4986207 - DNA, 21 bp, Homo sapiens
actcgggaggctgaggcagga

SEQ ID NO: 4986208 - DNA, 15 bp, Homo sapiens
actcgttaaagcaaa

SEQ ID NO: 4986209 - DNA, 16 bp, Homo sapiens
actcgttaaagcaaag

SEQ ID NO: 4986210 - DNA, 16 bp, Homo sapiens
actctaaagaaacaga

SEQ ID NO: 4986211 - DNA, 23 bp, Homo sapiens
actctaaagaaacagaagattac

SEQ ID NO: 4986212 - DNA, 19 bp, Homo sapiens
actgacgaagaagcaacta

SEQ ID NO: 4986213 - DNA, 13 bp, Homo sapiens
actgagggagaga

SEQ ID NO: 4986214 - DNA, 23 bp, Homo sapiens
actgatcatgtttatgagaaact

SEQ ID NO: 4986215 - DNA, 15 bp, Homo sapiens
actggcaaagcagaa

SEQ ID NO: 4986216 - DNA, 16 bp, Homo sapiens
actgtcagttcatcct

SEQ ID NO: 4986217 - DNA, 15 bp, Homo sapiens
acttcatttttctaa

SEQ ID NO: 4986218 - DNA, 21 bp, Homo sapiens
acttctctacccatcttaaaa

SEQ ID NO: 4986219 - DNA, 12 bp, Homo sapiens
actttaaaacac

SEQ ID NO: 4986220 - DNA, 16 bp, Homo sapiens
agaaaactaatctaaa

SEQ ID NO: 4986221 - DNA, 13 bp, Homo sapiens
agaaaacttccaa

SEQ ID NO: 4986222 - DNA, 15 bp, Homo sapiens
agaaaagtttataaa

SEQ ID NO: 4986223 - DNA, 15 bp, Homo sapiens
agaaacagagagaga

SEQ ID NO: 4986224 - DNA, 17 bp, Homo sapiens
agaaacagagagagaca

SEQ ID NO: 4986225 - DNA, 16 bp, Homo sapiens
agaaactggcaaagca

SEQ ID NO: 4986226 - DNA, 13 bp, Homo sapiens
agaaataacagaa

SEQ ID NO: 4986227 - DNA, 16 bp, Homo sapiens
agaacattcaatcttg

SEQ ID NO: 4986228 - DNA, 14 bp, Homo sapiens
agaactcctgaaat

SEQ ID NO: 4986229 - DNA, 19 bp, Homo sapiens
agaactcgttaaagcaaag

SEQ ID NO: 4986230 - DNA, 19 bp, Homo sapiens
agaagaaaatagaattgac

SEQ ID NO: 4986231 - DNA, 23 bp, Homo sapiens
agaagcaactaagttaataataa

SEQ ID NO: 4986232 - DNA, 19 bp, Homo sapiens
agaaggcatggacttctgg

SEQ ID NO: 4986233 - DNA, 15 bp, Homo sapiens
agaatgtcagtatgt

SEQ ID NO: 4986234 - DNA, 17 bp, Homo sapiens
agaatgtcagtatgtgg

SEQ ID NO: 4986235 - DNA, 19 bp, Homo sapiens
agaatgtcagtatgtggaa

SEQ ID NO: 4986236 - DNA, 16 bp, Homo sapiens
agaattgacattgaaa

SEQ ID NO: 4986237 - DNA, 14 bp, Homo sapiens
agacaattcagaag

SEQ ID NO: 4986238 - DNA, 14 bp, Homo sapiens
agacacatgccagg

SEQ ID NO: 4986239 - DNA, 17 bp, Homo sapiens
agacagaaacagagaga

SEQ ID NO: 4986240 - DNA, 17 bp, Homo sapiens
agacgttgtaatgcaca

SEQ ID NO: 4986241 - DNA, 19 bp, Homo sapiens
agactaatagagacacaga

SEQ ID NO: 4986242 - DNA, 23 bp, Homo sapiens
agactccaagattcaaagagact

SEQ ID NO: 4986243 - DNA, 14 bp, Homo sapiens
agactccatagttt

SEQ ID NO: 4986244 - DNA, 15 bp, Homo sapiens
agactgagggagaga

SEQ ID NO: 4986245 - DNA, 16 bp, Homo sapiens
agactgagggagagac

SEQ ID NO: 4986246 - DNA, 18 bp, Homo sapiens
agactggcgtgaacccag

SEQ ID NO: 4986247 - DNA, 21 bp, Homo sapiens
agacttaatgagactttaaaa

SEQ ID NO: 4986248 - DNA, 22 bp, Homo sapiens
agacttctctacccatcttaaa

SEQ ID NO: 4986249 - DNA, 14 bp, Homo sapiens
agactttaaaagca

SEQ ID NO: 4986250 - DNA, 21 bp, Homo sapiens
agagacagaaacagagagaga

SEQ ID NO: 4986251 - DNA, 15 bp, Homo sapiens
agagacagagagaga

SEQ ID NO: 4986252 - DNA, 15 bp, Homo sapiens
agagactcaaagaga

SEQ ID NO: 4986253 - DNA, 21 bp, Homo sapiens
agagactccaagattcaaaga

SEQ ID NO: 4986254 - DNA, 14 bp, Homo sapiens
agagactgagggag

SEQ ID NO: 4986255 - DNA, 20 bp, Homo sapiens
agagagacagagacagagag

SEQ ID NO: 4986256 - DNA, 21 bp, Homo sapiens
agagagacagagacagagaga

SEQ ID NO: 4986257 - DNA, 18 bp, Homo sapiens
agagagactcaaagagac

SEQ ID NO: 4986258 - DNA, 15 bp, Homo sapiens
agagaggctggatga

SEQ ID NO: 4986259 - DNA, 13 bp, Homo sapiens
agagagtggctgg

SEQ ID NO: 4986260 - DNA, 14 bp, Homo sapiens
agagagtggctggg

SEQ ID NO: 4986261 - DNA, 17 bp, Homo sapiens
agagagtggctggggca

SEQ ID NO: 4986262 - DNA, 20 bp, Homo sapiens
agaggctggatgacttgctc

SEQ ID NO: 4986263 - DNA, 21 bp, Homo sapiens
agaggctggatgacttgctca

SEQ ID NO: 4986264 - DNA, 22 bp, Homo sapiens
agagggactgttcttttgtccc

SEQ ID NO: 4986265 - DNA, 12 bp, Homo sapiens
agaggggcaggg

SEQ ID NO: 4986266 - DNA, 16 bp, Homo sapiens
agaggggcaggggagt

SEQ ID NO: 4986267 - DNA, 21 bp, Homo sapiens
agagtaggctattcctgagag

SEQ ID NO: 4986268 - DNA, 19 bp, Homo sapiens
agagtatcagttgcaggtg

SEQ ID NO: 4986269 - DNA, 20 bp, Homo sapiens
cccagcactttgggaggctg

SEQ ID NO: 4986270 - DNA, 22 bp, Homo sapiens
cccagctactcgggaggctgag

SEQ ID NO: 4986271 - DNA, 21 bp, Homo sapiens
cccagctatggttctctcgca

SEQ ID NO: 4986272 - DNA, 22 bp, Homo sapiens
cccgatggaggactccaggcag

SEQ ID NO: 4986273 - DNA, 14 bp, Homo sapiens
ccctctctggacct

SEQ ID NO: 4986274 - DNA, 19 bp, Homo sapiens
ccctctctggacctcagtt

SEQ ID NO: 4986275 - DNA, 14 bp, Homo sapiens
ccctctgtatacaa

SEQ ID NO: 4986276 - DNA, 21 bp, Homo sapiens
ccctgatttaatatgcaaagt

SEQ ID NO: 4986277 - DNA, 20 bp, Homo sapiens
cccttgatgcccagctcagt

SEQ ID NO: 4986278 - DNA, 22 bp, Homo sapiens
cccttgatgcccagctcagtgc

SEQ ID NO: 4986279 - DNA, 22 bp, Homo sapiens
ccgggtcatctgtacctctgcc

SEQ ID NO: 4986280 - DNA, 14 bp, Homo sapiens
cctcctaaaacaac

SEQ ID NO: 4986281 - DNA, 17 bp, Homo sapiens
cctctgtatacaaggat

SEQ ID NO: 4986282 - DNA, 15 bp, Homo sapiens
cctcttggctgcctt

SEQ ID NO: 4986283 - DNA, 14 bp, Homo sapiens
cctgactctcagca

SEQ ID NO: 4986284 - DNA, 23 bp, Homo sapiens
cctgatttaatatgcaaagtcta

SEQ ID NO: 4986285 - DNA, 20 bp, Homo sapiens
cctgccatcatgtttacaga

SEQ ID NO: 4986286 - DNA, 20 bp, Homo sapiens
cctgctgagcctcacagcag

SEQ ID NO: 4986287 - DNA, 11 bp, Homo sapiens
ccttcctgctg

SEQ ID NO: 4986288 - DNA, 14 bp, Homo sapiens
cgaagaagcaacta

SEQ ID NO: 4986289 - DNA, 16 bp, Homo sapiens
cgatgtacacacacag

SEQ ID NO: 4986290 - DNA, 18 bp, Homo sapiens
cgatgtgcgcacacacag

SEQ ID NO: 4986291 - DNA, 19 bp, Homo sapiens
cgccaggatggcgcaggaa

SEQ ID NO: 4986292 - DNA, 23 bp, Homo sapiens
cgccaggatggcgcaggaactca

SEQ ID NO: 4986293 - DNA, 16 bp, Homo sapiens
cgcgccaggatggcgc

SEQ ID NO: 4986294 - DNA, 15 bp, Homo sapiens
cgctaagtaaaaata

SEQ ID NO: 4986295 - DNA, 15 bp, Homo sapiens
cggatgcacagagat

SEQ ID NO: 4986296 - DNA, 17 bp, Homo sapiens
cgggaggctgaggcagg

SEQ ID NO: 4986297 - DNA, 15 bp, Homo sapiens
cgggtcatctgtacc

SEQ ID NO: 4986298 - DNA, 22 bp, Homo sapiens
cgggtcatctgtacctctgcct

SEQ ID NO: 4986299 - DNA, 16 bp, Homo sapiens
cgtctctactaaaaat

SEQ ID NO: 4986300 - DNA, 19 bp, Homo sapiens
cgtgaacccaggaggcgga

SEQ ID NO: 4986301 - DNA, 15 bp, Homo sapiens
cgtgagtgtgacttt

SEQ ID NO: 4986302 - DNA, 17 bp, Homo sapiens
cgtttgactagccatct

SEQ ID NO: 4986303 - DNA, 22 bp, Homo sapiens
ctaaagaaacagaagattacaa

SEQ ID NO: 4986304 - DNA, 17 bp, Homo sapiens
ctaaagaagtttgaaca

SEQ ID NO: 4986305 - DNA, 17 bp, Homo sapiens
ctaactttttgaattct

SEQ ID NO: 4986306 - DNA, 13 bp, Homo sapiens
ctaaggaaatatt

SEQ ID NO: 4986307 - DNA, 16 bp, Homo sapiens
ctaagttaataataat

SEQ ID NO: 4986308 - DNA, 17 bp, Homo sapiens
ctaatagagacacagag

SEQ ID NO: 4986309 - DNA, 20 bp, Homo sapiens
ctactaaaaatgcaaaaaaa

SEQ ID NO: 4986310 - DNA, 15 bp, Homo sapiens
ctactttttctttga

SEQ ID NO: 4986311 - DNA, 15 bp, Homo sapiens
ctaggaaaattattc

SEQ ID NO: 4986312 - DNA, 14 bp, Homo sapiens
ctaggaggtaatga

SEQ ID NO: 4986313 - DNA, 20 bp, Homo sapiens
ctatatttattgatttcaag

SEQ ID NO: 4986314 - DNA, 13 bp, Homo sapiens
ctatatttattta

SEQ ID NO: 4986315 - DNA, 20 bp, Homo sapiens
ctatcttaaaatatagaaaa

SEQ ID NO: 4986316 - DNA, 16 bp, Homo sapiens
ctatggcccatctgta

SEQ ID NO: 4986317 - DNA, 22 bp, Homo sapiens
ctatgttggcattaacaataaa

SEQ ID NO: 4986318 - DNA, 15 bp, Homo sapiens
ctattcatcaatgaa

SEQ ID NO: 4986319 - DNA, 17 bp, Homo sapiens
ctattcctgagagctgc

SEQ ID NO: 4986320 - DNA, 15 bp, Homo sapiens
ctatttatttacaaa

SEQ ID NO: 4986321 - DNA, 18 bp, Homo sapiens
ctcaagcaagtttaatca

SEQ ID NO: 4986322 - DNA, 19 bp, Homo sapiens
ctcaagtgccattcatcct

SEQ ID NO: 4986323 - DNA, 23 bp, Homo sapiens
ctcaggccgaaggaggagtcagg

SEQ ID NO: 4986324 - DNA, 14 bp, Homo sapiens
ctcaggctgctgct

SEQ ID NO: 4986325 - DNA, 22 bp, Homo sapiens
ctcagtgccacaaagctcaata

SEQ ID NO: 4986326 - DNA, 20 bp, Homo sapiens
ctcatctttccctccttggt

SEQ ID NO: 4986327 - DNA, 17 bp, Homo sapiens
ctcattccagaggaagg

SEQ ID NO: 4986328 - DNA, 17 bp, Homo sapiens
ctcatttgttcattaaa

SEQ ID NO: 4986329 - DNA, 17 bp, Homo sapiens
ctccattggtgttgaca

SEQ ID NO: 4986330 - DNA, 21 bp, Homo sapiens
ctcctgaaatcatatagaaag

SEQ ID NO: 4986331 - DNA, 23 bp, Homo sapiens
ctcctgaaatcatatagaaaggc

SEQ ID NO: 4986332 - DNA, 15 bp, Homo sapiens
ctcgttaaagcaaag

SEQ ID NO: 4986333 - DNA, 15 bp, Homo sapiens
ctctaaaactctcaa

SEQ ID NO: 4986334 - DNA, 19 bp, Homo sapiens
ctgaaatgtcagttctgat

SEQ ID NO: 4986335 - DNA, 19 bp, Homo sapiens
ctgagatccagagaggctg

SEQ ID NO: 4986336 - DNA, 19 bp, Homo sapiens
ctgagcataagtcctctag

SEQ ID NO: 4986337 - DNA, 19 bp, Homo sapiens
ctgaggacatggagagaga

SEQ ID NO: 4986338 - DNA, 17 bp, Homo sapiens
ctgaggcaggagactgg

SEQ ID NO: 4986339 - DNA, 18 bp, Homo sapiens
ctgaggcaggagactggc

SEQ ID NO: 4986340 - DNA, 16 bp, Homo sapiens
ctgattccctgattta

SEQ ID NO: 4986341 - DNA, 18 bp, Homo sapiens
ctgcatgggaaaaatgtt

SEQ ID NO: 4986342 - DNA, 19 bp, Homo sapiens
ctgcgtcgaactgtcctgg

SEQ ID NO: 4986343 - DNA, 22 bp, Homo sapiens
ctgctgggaggttaaaaagaaa

SEQ ID NO: 4986344 - DNA, 14 bp, Homo sapiens
ctggaggcagacag

SEQ ID NO: 4986345 - DNA, 18 bp, Homo sapiens
ctggatatagctaggtga

SEQ ID NO: 4986346 - DNA, 12 bp, Homo sapiens
ctggcaaagcag

SEQ ID NO: 4986347 - DNA, 19 bp, Homo sapiens
ctggcaaagcagaatgtga

SEQ ID NO: 4986348 - DNA, 13 bp, Homo sapiens
ctggccctgtgcc

SEQ ID NO: 4986349 - DNA, 22 bp, Homo sapiens
ctggcgtgaacccaggaggcgg

SEQ ID NO: 4986350 - DNA, 16 bp, Homo sapiens
ctggctaacacggtga

SEQ ID NO: 4986351 - DNA, 20 bp, Homo sapiens
ctgggaggttaaaaagaaaa

SEQ ID NO: 4986352 - DNA, 19 bp, Homo sapiens
ctgggcaacagagcaagac

SEQ ID NO: 4986353 - DNA, 18 bp, Homo sapiens
ctgtagctgtattagcag

SEQ ID NO: 4986354 - DNA, 21 bp, Homo sapiens
ctgtatacaaggatcagattc

SEQ ID NO: 4986355 - DNA, 16 bp, Homo sapiens
ctgtgccttttgccat

SEQ ID NO: 4986356 - DNA, 21 bp, Homo sapiens
ctgtgggttttaacattttta

SEQ ID NO: 4986357 - DNA, 16 bp, Homo sapiens
ctgtgtgtttatgtgt

SEQ ID NO: 4986358 - DNA, 18 bp, Homo sapiens
ctgtgtgtttatgtgtgt

SEQ ID NO: 4986359 - DNA, 21 bp, Homo sapiens
cttagaaataacagaagaaaa

SEQ ID NO: 4986360 - DNA, 17 bp, Homo sapiens
cttatcttacgaaaaaa

SEQ ID NO: 4986361 - DNA, 18 bp, Homo sapiens
cttattggcagctctact

SEQ ID NO: 4986362 - DNA, 21 bp, Homo sapiens
cttccaaaaagatttattaat

SEQ ID NO: 4986363 - DNA, 17 bp, Homo sapiens
cttccacccacacgact

SEQ ID NO: 4986364 - DNA, 15 bp, Homo sapiens
cttctcctgaaatct

SEQ ID NO: 4986365 - DNA, 18 bp, Homo sapiens
cttgatgcccagctcagt

SEQ ID NO: 4986366 - DNA, 19 bp, Homo sapiens
cttgctcaagttcaccagc

SEQ ID NO: 4986367 - DNA, 22 bp, Homo sapiens
ctttaaaagcattttttaacct

SEQ ID NO: 4986368 - DNA, 23 bp, Homo sapiens
ctttaagaaaaacatctggatat

SEQ ID NO: 4986369 - DNA, 15 bp, Homo sapiens
ctttcatacattata

SEQ ID NO: 4986370 - DNA, 16 bp, Homo sapiens
ctttcatacattatat

SEQ ID NO: 4986371 - DNA, 14 bp, Homo sapiens
cttttaagaatcaa

SEQ ID NO: 4986372 - DNA, 19 bp, Homo sapiens
ctttttaccctttaaaaaa

SEQ ID NO: 4986373 - DNA, 17 bp, Homo sapiens
gaaaaaatggtagcatt

SEQ ID NO: 4986374 - DNA, 16 bp, Homo sapiens
gaaaagatgagaggca

SEQ ID NO: 4986375 - DNA, 19 bp, Homo sapiens
gaaaagcctctgttttgat

SEQ ID NO: 4986376 - DNA, 17 bp, Homo sapiens
gaaaatagaattgacat

SEQ ID NO: 4986377 - DNA, 11 bp, Homo sapiens
gaaaatgctga

SEQ ID NO: 4986378 - DNA, 15 bp, Homo sapiens
gaaacagagagagac

SEQ ID NO: 4986379 - DNA, 16 bp, Homo sapiens
gaaacagagagagaca

SEQ ID NO: 4986380 - DNA, 18 bp, Homo sapiens
gaaacagagagagacaga

SEQ ID NO: 4986381 - DNA, 20 bp, Homo sapiens
gaacattcaatcttgccgtc

SEQ ID NO: 4986382 - DNA, 16 bp, Homo sapiens
gaacatttcatggtgt

SEQ ID NO: 4986383 - DNA, 18 bp, Homo sapiens
gaactcgttaaagcaaag

SEQ ID NO: 4986384 - DNA, 21 bp, Homo sapiens
gaagaagggaagccttttgca

SEQ ID NO: 4986385 - DNA, 17 bp, Homo sapiens
gaagaggggtcttttat

SEQ ID NO: 4986386 - DNA, 15 bp, Homo sapiens
gaagccttttgcaaa

SEQ ID NO: 4986387 - DNA, 16 bp, Homo sapiens
gaagccttttgcaaat

SEQ ID NO: 4986388 - DNA, 20 bp, Homo sapiens
gaagccttttgcaaatagta

SEQ ID NO: 4986389 - DNA, 24 bp, Homo sapiens
gaagtgtgggtctgtgtgtgtgta

SEQ ID NO: 4986390 - DNA, 15 bp, Homo sapiens
gaagttctagtgttt

SEQ ID NO: 4986391 - DNA, 20 bp, Homo sapiens
gaataagtgccaggatggaa

SEQ ID NO: 4986392 - DNA, 13 bp, Homo sapiens
gaatattgccaat

SEQ ID NO: 4986393 - DNA, 22 bp, Homo sapiens
gaatgtaggctggctttcagag

SEQ ID NO: 4986394 - DNA, 19 bp, Homo sapiens
gaatgtcagtatgtggaag

SEQ ID NO: 4986395 - DNA, 16 bp, Homo sapiens
gaattcctaaaattat

SEQ ID NO: 4986396 - DNA, 19 bp, Homo sapiens
taatttaaaattgtgatgt

SEQ ID NO: 4986397 - DNA, 15 bp, Homo sapiens
taatttactgattcc

SEQ ID NO: 4986398 - DNA, 22 bp, Homo sapiens
taatttcagttctagttgattg

SEQ ID NO: 4986399 - DNA, 16 bp, Homo sapiens
taatttccatttactt

SEQ ID NO: 4986400 - DNA, 22 bp, Homo sapiens
taatttccatttacttaagact

SEQ ID NO: 4986401 - DNA, 17 bp, Homo sapiens
tacaatatgtatttatg

SEQ ID NO: 4986402 - DNA, 17 bp, Homo sapiens
tacacactgtacacata

SEQ ID NO: 4986403 - DNA, 18 bp, Homo sapiens
tacagaggacagtatttg

SEQ ID NO: 4986404 - DNA, 12 bp, Homo sapiens
tacattatgtta

SEQ ID NO: 4986405 - DNA, 13 bp, Homo sapiens
tacattatgttat

SEQ ID NO: 4986406 - DNA, 15 bp, Homo sapiens
tacattatgttattg

SEQ ID NO: 4986407 - DNA, 21 bp, Homo sapiens
tacatttgctccatcctcctg

SEQ ID NO: 4986408 - DNA, 15 bp, Homo sapiens
tacattttacacact

SEQ ID NO: 4986409 - DNA, 22 bp, Homo sapiens
tacattttacacactgtacaca

SEQ ID NO: 4986410 - DNA, 15 bp, Homo sapiens
tacccatcttaaaaa

SEQ ID NO: 4986411 - DNA, 18 bp, Homo sapiens
tacccatcttaaaaacaa

SEQ ID NO: 4986412 - DNA, 20 bp, Homo sapiens
tacctactttttctttgatt

SEQ ID NO: 4986413 - DNA, 13 bp, Homo sapiens
tacctcttggctg

SEQ ID NO: 4986414 - DNA, 16 bp, Homo sapiens
tactaaaaatgcaaaa

SEQ ID NO: 4986415 - DNA, 15 bp, Homo sapiens
tactcgggaggctga

SEQ ID NO: 4986416 - DNA, 14 bp, Homo sapiens
tactgattccagca

SEQ ID NO: 4986417 - DNA, 15 bp, Homo sapiens
tactgtttcagtcct

SEQ ID NO: 4986418 - DNA, 14 bp, Homo sapiens
tacttaagacttaa

SEQ ID NO: 4986419 - DNA, 14 bp, Homo sapiens
tagaaaatcttcat

SEQ ID NO: 4986420 - DNA, 19 bp, Homo sapiens
tagatgtatgcacacacat

SEQ ID NO: 4986421 - DNA, 17 bp, Homo sapiens
tagcacatgattttctt

SEQ ID NO: 4986422 - DNA, 18 bp, Homo sapiens
tagcacatgattttcttt

SEQ ID NO: 4986423 - DNA, 13 bp, Homo sapiens
tagccatctcaag

SEQ ID NO: 4986424 - DNA, 16 bp, Homo sapiens
taggcactttaaaaca

SEQ ID NO: 4986425 - DNA, 18 bp, Homo sapiens
tagtattttttacatttt

SEQ ID NO: 4986426 - DNA, 12 bp, Homo sapiens
tatagaaaatct

SEQ ID NO: 4986427 - DNA, 13 bp, Homo sapiens
tataggataaatt

SEQ ID NO: 4986428 - DNA, 14 bp, Homo sapiens
tataggataaatta

SEQ ID NO: 4986429 - DNA, 18 bp, Homo sapiens
tataggataaattacatt

SEQ ID NO: 4986430 - DNA, 13 bp, Homo sapiens
tatagttttgaca

SEQ ID NO: 4986431 - DNA, 18 bp, Homo sapiens
tatatgtagatgtatgca

SEQ ID NO: 4986432 - DNA, 14 bp, Homo sapiens
tatattatttgcag

SEQ ID NO: 4986433 - DNA, 20 bp, Homo sapiens
tatatttgtaaatttatgtg

SEQ ID NO: 4986434 - DNA, 16 bp, Homo sapiens
tatcaaggtggaaatg

SEQ ID NO: 4986435 - DNA, 14 bp, Homo sapiens
tatcagcacgtgtg

SEQ ID NO: 4986436 - DNA, 15 bp, Homo sapiens
tatcagcacgtgtgg

SEQ ID NO: 4986437 - DNA, 12 bp, Homo sapiens
tatcttaaaata

SEQ ID NO: 4986438 - DNA, 16 bp, Homo sapiens
tatcttacgaaaaaat

SEQ ID NO: 4986439 - DNA, 16 bp, Homo sapiens
tatggaagcacccatt

SEQ ID NO: 4986440 - DNA, 17 bp, Homo sapiens
tatggggatagatgtgt

SEQ ID NO: 4986441 - DNA, 18 bp, Homo sapiens
tatggggatagatgtgtg

SEQ ID NO: 4986442 - DNA, 20 bp, Homo sapiens
tatgtagatgtatgcacaca

SEQ ID NO: 4986443 - DNA, 20 bp, Homo sapiens
tatgtgggggtctgtgtgtt

SEQ ID NO: 4986444 - DNA, 13 bp, Homo sapiens
tatgtgtaataaa

SEQ ID NO: 4986445 - DNA, 15 bp, Homo sapiens
tatgttggcattaac

SEQ ID NO: 4986446 - DNA, 20 bp, Homo sapiens
tatgtttttgtttttttcct

SEQ ID NO: 4986447 - DNA, 12 bp, Homo sapiens
tattactctatg

SEQ ID NO: 4986448 - DNA, 18 bp, Homo sapiens
tattagcagcaaaacaaa

SEQ ID NO: 4986449 - DNA, 12 bp, Homo sapiens
tattatttgcag

SEQ ID NO: 4986450 - DNA, 18 bp, Homo sapiens
tattcatcaatgaagatt

SEQ ID NO: 4986451 - DNA, 23 bp, Homo sapiens
tattgattcacctcctaaaacaa

SEQ ID NO: 4986452 - DNA, 21 bp, Homo sapiens
tattgatttaacttcattttt

SEQ ID NO: 4986453 - DNA, 12 bp, Homo sapiens
tattggaatttt

SEQ ID NO: 4986454 - DNA, 21 bp, Homo sapiens
tatttacaaatgttttgctca

SEQ ID NO: 4986455 - DNA, 13 bp, Homo sapiens
tattttaatttac

SEQ ID NO: 4986456 - DNA, 12 bp, Homo sapiens
tcaaagagactc

SEQ ID NO: 4986457 - DNA, 15 bp, Homo sapiens
tcaagtatagaaaat

SEQ ID NO: 4986458 - DNA, 14 bp, Homo sapiens
tcaatcatgtcagt

SEQ ID NO: 4986459 - DNA, 13 bp, Homo sapiens
tcaattttaaaca

SEQ ID NO: 4986460 - DNA, 16 bp, Homo sapiens
tcaattttaaacatat

SEQ ID NO: 4986461 - DNA, 12 bp, Homo sapiens
tcacacagagat

SEQ ID NO: 4986462 - DNA, 18 bp, Homo sapiens
tcacagcagtgagactgg

SEQ ID NO: 4986463 - DNA, 16 bp, Homo sapiens
tcacctcctaaaacaa

SEQ ID NO: 4986464 - DNA, 12 bp, Homo sapiens
tcactattcatc

SEQ ID NO: 4986465 - DNA, 22 bp, Homo sapiens
tcagacaattcagaagcatcac

SEQ ID NO: 4986466 - DNA, 19 bp, Homo sapiens
tcagagaacctaataagtg

SEQ ID NO: 4986467 - DNA, 13 bp, Homo sapiens
tcagattcttgct

SEQ ID NO: 4986468 - DNA, 15 bp, Homo sapiens
tcaggccgaaggagg

SEQ ID NO: 4986469 - DNA, 22 bp, Homo sapiens
tcaggctgctgctctgccttca

SEQ ID NO: 4986470 - DNA, 13 bp, Homo sapiens
tcagtcctaatgt

SEQ ID NO: 4986471 - DNA, 16 bp, Homo sapiens
tcagtctgcttagaaa

SEQ ID NO: 4986472 - DNA, 15 bp, Homo sapiens
tcagtgccacaaagc

SEQ ID NO: 4986473 - DNA, 23 bp, Homo sapiens
tcagttcatcctgcatgggaaaa

SEQ ID NO: 4986474 - DNA, 14 bp, Homo sapiens
tcatacattatatt

SEQ ID NO: 4986475 - DNA, 22 bp, Homo sapiens
tcatcctgcatgggaaaaatgt

SEQ ID NO: 4986476 - DNA, 14 bp, Homo sapiens
tcatctttccctcc

SEQ ID NO: 4986477 - DNA, 18 bp, Homo sapiens
tcatctttccctccttgg

SEQ ID NO: 4986478 - DNA, 17 bp, Homo sapiens
tcatgtttatgagaaac

SEQ ID NO: 4986479 - DNA, 20 bp, Homo sapiens
tcattcgtggttgatttcaa

SEQ ID NO: 4986480 - DNA, 12 bp, Homo sapiens
tcatttgttcat

SEQ ID NO: 4986481 - DNA, 20 bp, Homo sapiens
tccaagattcaaagagacta

SEQ ID NO: 4986482 - DNA, 16 bp, Homo sapiens
tccacccacacgactg

SEQ ID NO: 4986483 - DNA, 17 bp, Homo sapiens
tccactgggtgtaaaca

SEQ ID NO: 4986484 - DNA, 21 bp, Homo sapiens
tccacttttaaaactatattt

SEQ ID NO: 4986485 - DNA, 20 bp, Homo sapiens
tccagagaggctggatgact

SEQ ID NO: 4986486 - DNA, 17 bp, Homo sapiens
tccagagtcctggccct

SEQ ID NO: 4986487 - DNA, 21 bp, Homo sapiens
tccagcaagaccaaatcattg

SEQ ID NO: 4986488 - DNA, 19 bp, Homo sapiens
tccatttacttaagactta

SEQ ID NO: 4986489 - DNA, 20 bp, Homo sapiens
tccatttacttaagacttaa

SEQ ID NO: 4986490 - DNA, 13 bp, Homo sapiens
tcccacacttatc

SEQ ID NO: 4986491 - DNA, 11 bp, Homo sapiens
tccctccttgg

SEQ ID NO: 4986492 - DNA, 15 bp, Homo sapiens
tcctactcaacaaaa

SEQ ID NO: 4986493 - DNA, 12 bp, Homo sapiens
tcctcatttgtt

SEQ ID NO: 4986494 - DNA, 22 bp, Homo sapiens
tcctcatttgttcattaaacgt

SEQ ID NO: 4986495 - DNA, 22 bp, Homo sapiens
tcctctagtgaatgtaggctgg

SEQ ID NO: 4986496 - DNA, 18 bp, Homo sapiens
tcctgagagctgcatgtg

SEQ ID NO: 4986497 - DNA, 19 bp, Homo sapiens
tcctgcatgggaaaaatgt

SEQ ID NO: 4986498 - DNA, 13 bp, Homo sapiens
tcctggaggcaga

SEQ ID NO: 4986499 - DNA, 22 bp, Homo sapiens
tctaaccatagctgacctttgt

SEQ ID NO: 4986500 - DNA, 19 bp, Homo sapiens
tctacccatcttaaaaaca

SEQ ID NO: 4986501 - DNA, 21 bp, Homo sapiens
tctacccatcttaaaaacaac

SEQ ID NO: 4986502 - DNA, 12 bp, Homo sapiens
tctactaaaaat

SEQ ID NO: 4986503 - DNA, 14 bp, Homo sapiens
tctaggaaaattat

SEQ ID NO: 4986504 - DNA, 13 bp, Homo sapiens
tctataatttcca

SEQ ID NO: 4986505 - DNA, 12 bp, Homo sapiens
tctcctgaaatc

SEQ ID NO: 4986506 - DNA, 15 bp, Homo sapiens
tctctggacctcagt

SEQ ID NO: 4986507 - DNA, 16 bp, Homo sapiens
tctgcttagaaataac

SEQ ID NO: 4986508 - DNA, 15 bp, Homo sapiens
tctggacctcagttt

SEQ ID NO: 4986509 - DNA, 17 bp, Homo sapiens
tctggacctcagtttcc

SEQ ID NO: 4986510 - DNA, 16 bp, Homo sapiens
tctgtgcgtagaagtt

SEQ ID NO: 4986511 - DNA, 21 bp, Homo sapiens
tctgtgtgtgtgtatgtgggg

SEQ ID NO: 4986512 - DNA, 19 bp, Homo sapiens
tctgtgtgtttatgtgtgt

SEQ ID NO: 4986513 - DNA, 13 bp, Homo sapiens
tcttaaaaacaac

SEQ ID NO: 4986514 - DNA, 18 bp, Homo sapiens
tcttcatggaattcacaa

SEQ ID NO: 4986515 - DNA, 20 bp, Homo sapiens
tcttgccgtcactattcatc

SEQ ID NO: 4986516 - DNA, 16 bp, Homo sapiens
tctttcatacattata

SEQ ID NO: 4986517 - DNA, 17 bp, Homo sapiens
tctttcatacattatat

SEQ ID NO: 4986518 - DNA, 12 bp, Homo sapiens
tctttccctcct

SEQ ID NO: 4986519 - DNA, 13 bp, Homo sapiens
tctttccctcctt

SEQ ID NO: 4986520 - DNA, 22 bp, Homo sapiens
tgaaaaaagtataggataaatt

SEQ ID NO: 4986521 - DNA, 16 bp, Homo sapiens
tgaaaagcctctgttt

SEQ ID NO: 4986522 - DNA, 18 bp, Homo sapiens
tgaaaataatctctgatt

SEQ ID NO: 4986523 - DNA, 22 bp, Homo sapiens
tgaaaataatctctgattccct

SEQ ID NO: 4986524 - DNA, 19 bp, Homo sapiens
tgaaatcatatagaaaggc

SEQ ID NO: 4986525 - DNA, 20 bp, Homo sapiens
tgaaatctacaggcctcagg

SEQ ID NO: 4986526 - DNA, 14 bp, Homo sapiens
agagtggctggggc

SEQ ID NO: 4986527 - DNA, 15 bp, Homo sapiens
agagtttagccctga

SEQ ID NO: 4986528 - DNA, 14 bp, Homo sapiens
agatccagagaggc

SEQ ID NO: 4986529 - DNA, 17 bp, Homo sapiens
agatgcacacacagatg

SEQ ID NO: 4986530 - DNA, 19 bp, Homo sapiens
agatgcacacacagatgca

SEQ ID NO: 4986531 - DNA, 18 bp, Homo sapiens
agatgtacgacttgcata

SEQ ID NO: 4986532 - DNA, 20 bp, Homo sapiens
agatgtatgcacacacatat

SEQ ID NO: 4986533 - DNA, 16 bp, Homo sapiens
agattacaaaagcaat

SEQ ID NO: 4986534 - DNA, 17 bp, Homo sapiens
agatttctgctccaaat

SEQ ID NO: 4986535 - DNA, 14 bp, Homo sapiens
agattttcctattc

SEQ ID NO: 4986536 - DNA, 20 bp, Homo sapiens
agcaaagtagatcatgcata

SEQ ID NO: 4986537 - DNA, 21 bp, Homo sapiens
agcaacaactgtcagttcatc

SEQ ID NO: 4986538 - DNA, 19 bp, Homo sapiens
agcaagaccaaatcattgt

SEQ ID NO: 4986539 - DNA, 15 bp, Homo sapiens
agcacaggtccaagg

SEQ ID NO: 4986540 - DNA, 20 bp, Homo sapiens
agcacaggtccaaggctggt

SEQ ID NO: 4986541 - DNA, 18 bp, Homo sapiens
agcacatgattttctttt

SEQ ID NO: 4986542 - DNA, 14 bp, Homo sapiens
agcagcaaaacaaa

SEQ ID NO: 4986543 - DNA, 16 bp, Homo sapiens
agcatggtagtggcaa

SEQ ID NO: 4986544 - DNA, 20 bp, Homo sapiens
agcatgtatttttgtcaatt

SEQ ID NO: 4986545 - DNA, 13 bp, Homo sapiens
agccaatatttta

SEQ ID NO: 4986546 - DNA, 13 bp, Homo sapiens
agccagaggtctg

SEQ ID NO: 4986547 - DNA, 16 bp, Homo sapiens
agccatctcaagcaag

SEQ ID NO: 4986548 - DNA, 21 bp, Homo sapiens
agcctgggcaacagagcaaga

SEQ ID NO: 4986549 - DNA, 17 bp, Homo sapiens
agcgctaagtaaaaata

SEQ ID NO: 4986550 - DNA, 16 bp, Homo sapiens
agctaaagaagtttga

SEQ ID NO: 4986551 - DNA, 12 bp, Homo sapiens
agctagtgattt

SEQ ID NO: 4986552 - DNA, 19 bp, Homo sapiens
agctagtgatttacacagg

SEQ ID NO: 4986553 - DNA, 20 bp, Homo sapiens
agctagtgatttacacaggt

SEQ ID NO: 4986554 - DNA, 15 bp, Homo sapiens
agctatcttaaaata

SEQ ID NO: 4986555 - DNA, 19 bp, Homo sapiens
agctcagtgccacaaagct

SEQ ID NO: 4986556 - DNA, 14 bp, Homo sapiens
agctgagcaggtgt

SEQ ID NO: 4986557 - DNA, 11 bp, Homo sapiens
aggaaaattat

SEQ ID NO: 4986558 - DNA, 16 bp, Homo sapiens
aggaactgctgggctt

SEQ ID NO: 4986559 - DNA, 14 bp, Homo sapiens
aggaagcacaggtc

SEQ ID NO: 4986560 - DNA, 15 bp, Homo sapiens
aggagataacatttc

SEQ ID NO: 4986561 - DNA, 22 bp, Homo sapiens
aggaggtaatgaccatgaaaga

SEQ ID NO: 4986562 - DNA, 20 bp, Homo sapiens
aggatcagattcttgctgtg

SEQ ID NO: 4986563 - DNA, 13 bp, Homo sapiens
aggatggcgcagg

SEQ ID NO: 4986564 - DNA, 15 bp, Homo sapiens
aggcactttaaaaca

SEQ ID NO: 4986565 - DNA, 18 bp, Homo sapiens
aggcaggagactggcgtg

SEQ ID NO: 4986566 - DNA, 20 bp, Homo sapiens
aggccaggcgcggtggctca

SEQ ID NO: 4986567 - DNA, 16 bp, Homo sapiens
aggcctgactctcagc

SEQ ID NO: 4986568 - DNA, 22 bp, Homo sapiens
aggctatggggatagatgtgtg

SEQ ID NO: 4986569 - DNA, 16 bp, Homo sapiens
agggaagccttttgca

SEQ ID NO: 4986570 - DNA, 19 bp, Homo sapiens
agggaagccttttgcaaat

SEQ ID NO: 4986571 - DNA, 21 bp, Homo sapiens
agggactcatctttccctcct

SEQ ID NO: 4986572 - DNA, 12 bp, Homo sapiens
agggagacagag

SEQ ID NO: 4986573 - DNA, 13 bp, Homo sapiens
agggagggagagg

SEQ ID NO: 4986574 - DNA, 21 bp, Homo sapiens
agggatgttccagtggatgag

SEQ ID NO: 4986575 - DNA, 16 bp, Homo sapiens
agggcatgggagggag

SEQ ID NO: 4986576 - DNA, 21 bp, Homo sapiens
agggccaccaggaagcacagg

SEQ ID NO: 4986577 - DNA, 23 bp, Homo sapiens
aggggcttggtgtttgtaagaaa

SEQ ID NO: 4986578 - DNA, 17 bp, Homo sapiens
agggggctaagctatgg

SEQ ID NO: 4986579 - DNA, 18 bp, Homo sapiens
aggtgccttggggaaatg

SEQ ID NO: 4986580 - DNA, 23 bp, Homo sapiens
aggtttgtttagaagaagtgtgt

SEQ ID NO: 4986581 - DNA, 14 bp, Homo sapiens
agtaaaaatattaa

SEQ ID NO: 4986582 - DNA, 18 bp, Homo sapiens
agtaaaaatattaactga

SEQ ID NO: 4986583 - DNA, 14 bp, Homo sapiens
agtaatttggaaat

SEQ ID NO: 4986584 - DNA, 15 bp, Homo sapiens
agtagatcatgcata

SEQ ID NO: 4986585 - DNA, 20 bp, Homo sapiens
agtataggataaattacatt

SEQ ID NO: 4986586 - DNA, 14 bp, Homo sapiens
agtatgaaaagcta

SEQ ID NO: 4986587 - DNA, 20 bp, Homo sapiens
agtatgaaaagctatcttaa

SEQ ID NO: 4986588 - DNA, 15 bp, Homo sapiens
agtattttttacatt

SEQ ID NO: 4986589 - DNA, 20 bp, Homo sapiens
agtattttttacattttaca

SEQ ID NO: 4986590 - DNA, 19 bp, Homo sapiens
agtcccagctactcgggag

SEQ ID NO: 4986591 - DNA, 23 bp, Homo sapiens
agtcctaatgtgctgtgtgacat

SEQ ID NO: 4986592 - DNA, 20 bp, Homo sapiens
agtctaggttggtagagttt

SEQ ID NO: 4986593 - DNA, 20 bp, Homo sapiens
agtctagttacctacttttt

SEQ ID NO: 4986594 - DNA, 13 bp, Homo sapiens
agtctgaaatggg

SEQ ID NO: 4986595 - DNA, 17 bp, Homo sapiens
agtctgcttagaaataa

SEQ ID NO: 4986596 - DNA, 17 bp, Homo sapiens
agtgaatgtaggctggc

SEQ ID NO: 4986597 - DNA, 22 bp, Homo sapiens
agtgagactggggccactacat

SEQ ID NO: 4986598 - DNA, 15 bp, Homo sapiens
agtgatttacacagg

SEQ ID NO: 4986599 - DNA, 14 bp, Homo sapiens
agtgcagtatagaa

SEQ ID NO: 4986600 - DNA, 14 bp, Homo sapiens
agtggaataagaca

SEQ ID NO: 4986601 - DNA, 13 bp, Homo sapiens
agtggctggggca

SEQ ID NO: 4986602 - DNA, 22 bp, Homo sapiens
agtggctggggcatggaaggca

SEQ ID NO: 4986603 - DNA, 18 bp, Homo sapiens
agtgtgatgtatgtgtaa

SEQ ID NO: 4986604 - DNA, 22 bp, Homo sapiens
agtgtgatgtatgtgtaataaa

SEQ ID NO: 4986605 - DNA, 15 bp, Homo sapiens
agtgtgggtctgtgt

SEQ ID NO: 4986606 - DNA, 16 bp, Homo sapiens
agtgtgggtctgtgtg

SEQ ID NO: 4986607 - DNA, 21 bp, Homo sapiens
agttaatggggtagaggaggg

SEQ ID NO: 4986608 - DNA, 21 bp, Homo sapiens
agttacctactttttctttga

SEQ ID NO: 4986609 - DNA, 21 bp, Homo sapiens
agttattaagaggtaagactt

SEQ ID NO: 4986610 - DNA, 18 bp, Homo sapiens
agttcatcctgcatggga

SEQ ID NO: 4986611 - DNA, 18 bp, Homo sapiens
agttgattgcgagaattt

SEQ ID NO: 4986612 - DNA, 20 bp, Homo sapiens
agttgcaggtgccaatgact

SEQ ID NO: 4986613 - DNA, 18 bp, Homo sapiens
agtttagccctgaacatt

SEQ ID NO: 4986614 - DNA, 13 bp, Homo sapiens
agtttccctctgt

SEQ ID NO: 4986615 - DNA, 17 bp, Homo sapiens
ataaagcattttgcaaa

SEQ ID NO: 4986616 - DNA, 13 bp, Homo sapiens
ataaatttctgct

SEQ ID NO: 4986617 - DNA, 21 bp, Homo sapiens
ataacagaagaaaatagaatt

SEQ ID NO: 4986618 - DNA, 18 bp, Homo sapiens
ataacttaatgaaaacaa

SEQ ID NO: 4986619 - DNA, 19 bp, Homo sapiens
ataacttaatgaaaacaat

SEQ ID NO: 4986620 - DNA, 23 bp, Homo sapiens
ataacttaatgaaaacaatgcag

SEQ ID NO: 4986621 - DNA, 22 bp, Homo sapiens
ataagtcctctagtgaatgtag

SEQ ID NO: 4986622 - DNA, 11 bp, Homo sapiens
ataagtctgat

SEQ ID NO: 4986623 - DNA, 16 bp, Homo sapiens
ataataatgactctaa

SEQ ID NO: 4986624 - DNA, 19 bp, Homo sapiens
ataatctctgattccctga

SEQ ID NO: 4986625 - DNA, 23 bp, Homo sapiens
ataatctctgattccctgattta

SEQ ID NO: 4986626 - DNA, 21 bp, Homo sapiens
ataatctgatgggcctggctg

SEQ ID NO: 4986627 - DNA, 23 bp, Homo sapiens
ataatctgatgggcctggctggg

SEQ ID NO: 4986628 - DNA, 14 bp, Homo sapiens
ataatgactctaaa

SEQ ID NO: 4986629 - DNA, 15 bp, Homo sapiens
atagaaaagatgaga

SEQ ID NO: 4986630 - DNA, 18 bp, Homo sapiens
atagaaagttgcaaggca

SEQ ID NO: 4986631 - DNA, 23 bp, Homo sapiens
atagaaagttgcaaggcaaatgt

SEQ ID NO: 4986632 - DNA, 22 bp, Homo sapiens
atagaataggcactttaaaaca

SEQ ID NO: 4986633 - DNA, 22 bp, Homo sapiens
atagaattgacattgaaatcta

SEQ ID NO: 4986634 - DNA, 17 bp, Homo sapiens
atagattgctcaaatca

SEQ ID NO: 4986635 - DNA, 17 bp, Homo sapiens
atagcacatgattttct

SEQ ID NO: 4986636 - DNA, 18 bp, Homo sapiens
atagcacatgattttctt

SEQ ID NO: 4986637 - DNA, 23 bp, Homo sapiens
atagcacatgattttcttttgtt

SEQ ID NO: 4986638 - DNA, 17 bp, Homo sapiens
ataggataaattacatt

SEQ ID NO: 4986639 - DNA, 19 bp, Homo sapiens
atatagaaaactaatctaa

SEQ ID NO: 4986640 - DNA, 14 bp, Homo sapiens
atatattatttgca

SEQ ID NO: 4986641 - DNA, 17 bp, Homo sapiens
atatcaaggtggaaatg

SEQ ID NO: 4986642 - DNA, 16 bp, Homo sapiens
atatgtagatgtatgc

SEQ ID NO: 4986643 - DNA, 20 bp, Homo sapiens
atatgtagatgtatgcacac

SEQ ID NO: 4986644 - DNA, 18 bp, Homo sapiens
atattaaaaaaagacata

SEQ ID NO: 4986645 - DNA, 22 bp, Homo sapiens
atattatttgcagtgcagtata

SEQ ID NO: 4986646 - DNA, 16 bp, Homo sapiens
atattgccaatgctac

SEQ ID NO: 4986647 - DNA, 14 bp, Homo sapiens
atatttatttatgt

SEQ ID NO: 4986648 - DNA, 18 bp, Homo sapiens
atcaaggtggaaatggcc

SEQ ID NO: 4986649 - DNA, 13 bp, Homo sapiens
atcaagtatagaa

SEQ ID NO: 4986650 - DNA, 15 bp, Homo sapiens
atcaagtatagaaaa

SEQ ID NO: 4986651 - DNA, 21 bp, Homo sapiens
atcaagtatagaaaatcttca

SEQ ID NO: 4986652 - DNA, 20 bp, Homo sapiens
atcaatcatgtcagtctgct

SEQ ID NO: 4986653 - DNA, 21 bp, Homo sapiens
gaattttctttcatacattat

SEQ ID NO: 4986654 - DNA, 12 bp, Homo sapiens
gacaacattttt

SEQ ID NO: 4986655 - DNA, 15 bp, Homo sapiens
gacacagattggcca

SEQ ID NO: 4986656 - DNA, 17 bp, Homo sapiens
gacacatgccagggcca

SEQ ID NO: 4986657 - DNA, 19 bp, Homo sapiens
gacagaaacagagagagac

SEQ ID NO: 4986658 - DNA, 16 bp, Homo sapiens
gacagagacagagaga

SEQ ID NO: 4986659 - DNA, 12 bp, Homo sapiens
gacagagagaga

SEQ ID NO: 4986660 - DNA, 19 bp, Homo sapiens
gacaggcgctggacagagg

SEQ ID NO: 4986661 - DNA, 21 bp, Homo sapiens
gacatatattttttaaaataa

SEQ ID NO: 4986662 - DNA, 22 bp, Homo sapiens
gacccaagaactcctgaaatca

SEQ ID NO: 4986663 - DNA, 18 bp, Homo sapiens
gaccttgtagtgagccga

SEQ ID NO: 4986664 - DNA, 17 bp, Homo sapiens
gacctttcctgaggaag

SEQ ID NO: 4986665 - DNA, 17 bp, Homo sapiens
gacgtttgactagccat

SEQ ID NO: 4986666 - DNA, 19 bp, Homo sapiens
gacgtttgactagccatct

SEQ ID NO: 4986667 - DNA, 21 bp, Homo sapiens
gactcatctttccctccttgg

SEQ ID NO: 4986668 - DNA, 22 bp, Homo sapiens
gactcatctttccctccttggt

SEQ ID NO: 4986669 - DNA, 12 bp, Homo sapiens
gactgagggaga

SEQ ID NO: 4986670 - DNA, 21 bp, Homo sapiens
gactgcaacatacaggtgcct

SEQ ID NO: 4986671 - DNA, 20 bp, Homo sapiens
gactgctgggaggttaaaaa

SEQ ID NO: 4986672 - DNA, 19 bp, Homo sapiens
gactggggccactacattt

SEQ ID NO: 4986673 - DNA, 20 bp, Homo sapiens
gacttgctcaagttcaccag

SEQ ID NO: 4986674 - DNA, 22 bp, Homo sapiens
gagaagccagctttcctcatca

SEQ ID NO: 4986675 - DNA, 14 bp, Homo sapiens
gagacacagagatg

SEQ ID NO: 4986676 - DNA, 18 bp, Homo sapiens
gagacagaaacagagaga

SEQ ID NO: 4986677 - DNA, 18 bp, Homo sapiens
gagacagtagaggcatga

SEQ ID NO: 4986678 - DNA, 18 bp, Homo sapiens
gagactcaaagagactcc

SEQ ID NO: 4986679 - DNA, 14 bp, Homo sapiens
gagactgagggaga

SEQ ID NO: 4986680 - DNA, 19 bp, Homo sapiens
gagactggcgtgaacccag

SEQ ID NO: 4986681 - DNA, 14 bp, Homo sapiens
gagaggcagaggca

SEQ ID NO: 4986682 - DNA, 14 bp, Homo sapiens
gagagtggctgggg

SEQ ID NO: 4986683 - DNA, 20 bp, Homo sapiens
gagagtggctggggcatgga

SEQ ID NO: 4986684 - DNA, 21 bp, Homo sapiens
gagatgaagggggctaagcta

SEQ ID NO: 4986685 - DNA, 13 bp, Homo sapiens
gagcctcacagca

SEQ ID NO: 4986686 - DNA, 14 bp, Homo sapiens
gagcctcacagcag

SEQ ID NO: 4986687 - DNA, 17 bp, Homo sapiens
gaggacatggagagaga

SEQ ID NO: 4986688 - DNA, 15 bp, Homo sapiens
gaggatgtctgggcc

SEQ ID NO: 4986689 - DNA, 13 bp, Homo sapiens
gaggcattacaaa

SEQ ID NO: 4986690 - DNA, 14 bp, Homo sapiens
gagggagagactct

SEQ ID NO: 4986691 - DNA, 17 bp, Homo sapiens
gagggcatgggagggag

SEQ ID NO: 4986692 - DNA, 17 bp, Homo sapiens
gagggccaccaggaagc

SEQ ID NO: 4986693 - DNA, 18 bp, Homo sapiens
gagtgaggatgtctgggc

SEQ ID NO: 4986694 - DNA, 13 bp, Homo sapiens
gagtggctggggc

SEQ ID NO: 4986695 - DNA, 17 bp, Homo sapiens
gagtggctggggcatgg

SEQ ID NO: 4986696 - DNA, 15 bp, Homo sapiens
gagtgtacagagtgg

SEQ ID NO: 4986697 - DNA, 22 bp, Homo sapiens
gagtgtgtaatttaaaattgtg

SEQ ID NO: 4986698 - DNA, 14 bp, Homo sapiens
gataaattacatta

SEQ ID NO: 4986699 - DNA, 15 bp, Homo sapiens
gataaattacattaa

SEQ ID NO: 4986700 - DNA, 13 bp, Homo sapiens
gatagatgtgtgg

SEQ ID NO: 4986701 - DNA, 20 bp, Homo sapiens
gatatcaaggtggaaatggc

SEQ ID NO: 4986702 - DNA, 17 bp, Homo sapiens
gatatgggtagtatttt

SEQ ID NO: 4986703 - DNA, 18 bp, Homo sapiens
gatatgggtagtattttt

SEQ ID NO: 4986704 - DNA, 14 bp, Homo sapiens
gatcatgcatagag

SEQ ID NO: 4986705 - DNA, 17 bp, Homo sapiens
gatcatgcatagagtgt

SEQ ID NO: 4986706 - DNA, 19 bp, Homo sapiens
gatcgagaccatcctggct

SEQ ID NO: 4986707 - DNA, 15 bp, Homo sapiens
gatgagaggcagagg

SEQ ID NO: 4986708 - DNA, 20 bp, Homo sapiens
gatgcacacgcacatagaga

SEQ ID NO: 4986709 - DNA, 16 bp, Homo sapiens
gatggaatagaaaaga

SEQ ID NO: 4986710 - DNA, 14 bp, Homo sapiens
gatggcgcaggaac

SEQ ID NO: 4986711 - DNA, 18 bp, Homo sapiens
gatggtcacacagagata

SEQ ID NO: 4986712 - DNA, 20 bp, Homo sapiens
gatgtatgcacacacatata

SEQ ID NO: 4986713 - DNA, 15 bp, Homo sapiens
gattacaaaagcaat

SEQ ID NO: 4986714 - DNA, 22 bp, Homo sapiens
gattatatcattttgtggatat

SEQ ID NO: 4986715 - DNA, 19 bp, Homo sapiens
gattccagcaagaccaaat

SEQ ID NO: 4986716 - DNA, 16 bp, Homo sapiens
gattccgcagtgagag

SEQ ID NO: 4986717 - DNA, 18 bp, Homo sapiens
gattgtgtcccattcccc

SEQ ID NO: 4986718 - DNA, 20 bp, Homo sapiens
gattgtgtcccattccccca

SEQ ID NO: 4986719 - DNA, 14 bp, Homo sapiens
gattttcttttgtt

SEQ ID NO: 4986720 - DNA, 21 bp, Homo sapiens
gatttttgctcttctgtatgt

SEQ ID NO: 4986721 - DNA, 12 bp, Homo sapiens
gcaaagagaggt

SEQ ID NO: 4986722 - DNA, 17 bp, Homo sapiens
gcaaataagtgtatttt

SEQ ID NO: 4986723 - DNA, 20 bp, Homo sapiens
gcaacaactgtcagttcatc

SEQ ID NO: 4986724 - DNA, 14 bp, Homo sapiens
gcaagattgtgtcc

SEQ ID NO: 4986725 - DNA, 22 bp, Homo sapiens
gcaaggcaaatgtttatttaaa

SEQ ID NO: 4986726 - DNA, 14 bp, Homo sapiens
gcaaggtttaagtt

SEQ ID NO: 4986727 - DNA, 19 bp, Homo sapiens
gcaaggtttaagttattaa

SEQ ID NO: 4986728 - DNA, 12 bp, Homo sapiens
gcaattatgaaa

SEQ ID NO: 4986729 - DNA, 16 bp, Homo sapiens
gcaattatgaaaataa

SEQ ID NO: 4986730 - DNA, 15 bp, Homo sapiens
gcacacacagatgca

SEQ ID NO: 4986731 - DNA, 17 bp, Homo sapiens
gcacaggtccaaggctg

SEQ ID NO: 4986732 - DNA, 18 bp, Homo sapiens
gcacaggtccaaggctgg

SEQ ID NO: 4986733 - DNA, 19 bp, Homo sapiens
gcacaggtccaaggctggt

SEQ ID NO: 4986734 - DNA, 19 bp, Homo sapiens
gcacatgattttcttttgt

SEQ ID NO: 4986735 - DNA, 23 bp, Homo sapiens
gcacccattatgcgctgtggcca

SEQ ID NO: 4986736 - DNA, 15 bp, Homo sapiens
gcagaggcagacagg

SEQ ID NO: 4986737 - DNA, 22 bp, Homo sapiens
gcagcaacaactgtcagttcat

SEQ ID NO: 4986738 - DNA, 17 bp, Homo sapiens
gcagcagacacatgcca

SEQ ID NO: 4986739 - DNA, 14 bp, Homo sapiens
gcagtgagactggg

SEQ ID NO: 4986740 - DNA, 23 bp, Homo sapiens
gcagtgagagagtggctggggca

SEQ ID NO: 4986741 - DNA, 18 bp, Homo sapiens
gcagttaatggggtagag

SEQ ID NO: 4986742 - DNA, 18 bp, Homo sapiens
gcatgtatttttgtcaat

SEQ ID NO: 4986743 - DNA, 14 bp, Homo sapiens
gcattaacaataaa

SEQ ID NO: 4986744 - DNA, 12 bp, Homo sapiens
gcattttgcaaa

SEQ ID NO: 4986745 - DNA, 13 bp, Homo sapiens
gcattttgcaaac

SEQ ID NO: 4986746 - DNA, 19 bp, Homo sapiens
gcattttttaacctcctaa

SEQ ID NO: 4986747 - DNA, 19 bp, Homo sapiens
gccaagcccacctgcacgt

SEQ ID NO: 4986748 - DNA, 18 bp, Homo sapiens
gccaaggttgtcctggag

SEQ ID NO: 4986749 - DNA, 16 bp, Homo sapiens
gccaccaggaagcaca

SEQ ID NO: 4986750 - DNA, 15 bp, Homo sapiens
gccacgattgcagga

SEQ ID NO: 4986751 - DNA, 20 bp, Homo sapiens
gccagaaaccttcctgctga

SEQ ID NO: 4986752 - DNA, 16 bp, Homo sapiens
gcccacctgcacgtga

SEQ ID NO: 4986753 - DNA, 14 bp, Homo sapiens
gcccagctcagtgc

SEQ ID NO: 4986754 - DNA, 15 bp, Homo sapiens
gcctcacagcagtga

SEQ ID NO: 4986755 - DNA, 16 bp, Homo sapiens
gcctcagggtgggaga

SEQ ID NO: 4986756 - DNA, 22 bp, Homo sapiens
gcctcagggtgggagatgaagg

SEQ ID NO: 4986757 - DNA, 18 bp, Homo sapiens
gcctgggcaacagagcaa

SEQ ID NO: 4986758 - DNA, 17 bp, Homo sapiens
gcctgtcagctaaagaa

SEQ ID NO: 4986759 - DNA, 15 bp, Homo sapiens
gcctgtggagagaaa

SEQ ID NO: 4986760 - DNA, 14 bp, Homo sapiens
gcgccaggatggcg

SEQ ID NO: 4986761 - DNA, 20 bp, Homo sapiens
gcgtgaacccaggaggcgga

SEQ ID NO: 4986762 - DNA, 15 bp, Homo sapiens
gctaaagaagtttga

SEQ ID NO: 4986763 - DNA, 19 bp, Homo sapiens
gctaacacggtgaaacccg

SEQ ID NO: 4986764 - DNA, 13 bp, Homo sapiens
gctacagtaataa

SEQ ID NO: 4986765 - DNA, 14 bp, Homo sapiens
gctacagtaataaa

SEQ ID NO: 4986766 - DNA, 17 bp, Homo sapiens
gctactcgggaggctga

SEQ ID NO: 4986767 - DNA, 23 bp, Homo sapiens
gctactcgggaggctgaggcagg

SEQ ID NO: 4986768 - DNA, 17 bp, Homo sapiens
gctatgagctggggatg

SEQ ID NO: 4986769 - DNA, 14 bp, Homo sapiens
gctcaagttcacca

SEQ ID NO: 4986770 - DNA, 17 bp, Homo sapiens
gctgagcctcacagcag

SEQ ID NO: 4986771 - DNA, 14 bp, Homo sapiens
gctgaggcaggaga

SEQ ID NO: 4986772 - DNA, 16 bp, Homo sapiens
gctggcctcaggctgc

SEQ ID NO: 4986773 - DNA, 20 bp, Homo sapiens
gctgggaataagtgccagga

SEQ ID NO: 4986774 - DNA, 21 bp, Homo sapiens
gctggggcatggaaggcaaga

SEQ ID NO: 4986775 - DNA, 14 bp, Homo sapiens
gctggtcccacact

SEQ ID NO: 4986776 - DNA, 22 bp, Homo sapiens
gcttggtgtttgtaagaaaatg

SEQ ID NO: 4986777 - DNA, 19 bp, Homo sapiens
gcttgtaccacttttgcaa

SEQ ID NO: 4986778 - DNA, 22 bp, Homo sapiens
gcttttcctcaaagggagagag

SEQ ID NO: 4986779 - DNA, 17 bp, Homo sapiens
ggaaacagatgaaaagc

SEQ ID NO: 4986780 - DNA, 14 bp, Homo sapiens
ggaactgctgggct

SEQ ID NO: 4986781 - DNA, 15 bp, Homo sapiens
ttataaaagtgaata

SEQ ID NO: 4986782 - DNA, 14 bp, Homo sapiens
ttatcattctgctt

SEQ ID NO: 4986783 - DNA, 13 bp, Homo sapiens
ttatcttacgaaa

SEQ ID NO: 4986784 - DNA, 23 bp, Homo sapiens
ttatgagaaactggcaaagcaga

SEQ ID NO: 4986785 - DNA, 14 bp, Homo sapiens
ttatgtgtgtgtgt

SEQ ID NO: 4986786 - DNA, 16 bp, Homo sapiens
ttatgttattggaatt

SEQ ID NO: 4986787 - DNA, 18 bp, Homo sapiens
ttattaagaggtaagact

SEQ ID NO: 4986788 - DNA, 21 bp, Homo sapiens
ttatttgcagtgcagtataga

SEQ ID NO: 4986789 - DNA, 22 bp, Homo sapiens
ttcaaagagactaatagagaca

SEQ ID NO: 4986790 - DNA, 14 bp, Homo sapiens
ttcaatacactcaa

SEQ ID NO: 4986791 - DNA, 16 bp, Homo sapiens
ttcagatttgccttat

SEQ ID NO: 4986792 - DNA, 22 bp, Homo sapiens
ttcagtcctaatgtgctgtgtg

SEQ ID NO: 4986793 - DNA, 12 bp, Homo sapiens
ttcatacattat

SEQ ID NO: 4986794 - DNA, 13 bp, Homo sapiens
ttcatacattata

SEQ ID NO: 4986795 - DNA, 12 bp, Homo sapiens
ttcatcaatgaa

SEQ ID NO: 4986796 - DNA, 22 bp, Homo sapiens
ttcatcctgcatgggaaaaatg

SEQ ID NO: 4986797 - DNA, 14 bp, Homo sapiens
ttccagtggatgag

SEQ ID NO: 4986798 - DNA, 18 bp, Homo sapiens
ttccatttacttaagact

SEQ ID NO: 4986799 - DNA, 13 bp, Homo sapiens
ttccctccttggt

SEQ ID NO: 4986800 - DNA, 16 bp, Homo sapiens
ttccctctctggacct

SEQ ID NO: 4986801 - DNA, 12 bp, Homo sapiens
ttcctcatttgt

SEQ ID NO: 4986802 - DNA, 13 bp, Homo sapiens
ttctaaaacacat

SEQ ID NO: 4986803 - DNA, 13 bp, Homo sapiens
ttctatgttggca

SEQ ID NO: 4986804 - DNA, 20 bp, Homo sapiens
ttctatgttggcattaacaa

SEQ ID NO: 4986805 - DNA, 18 bp, Homo sapiens
ttctgatttttaatttgt

SEQ ID NO: 4986806 - DNA, 15 bp, Homo sapiens
ttctggatatagcta

SEQ ID NO: 4986807 - DNA, 12 bp, Homo sapiens
ttcttttaagaa

SEQ ID NO: 4986808 - DNA, 23 bp, Homo sapiens
ttgaacatttgggttactatttc

SEQ ID NO: 4986809 - DNA, 22 bp, Homo sapiens
ttgacagagttggtgttcataa

SEQ ID NO: 4986810 - DNA, 18 bp, Homo sapiens
ttgataaaagattttcct

SEQ ID NO: 4986811 - DNA, 18 bp, Homo sapiens
ttgatttaacttcatttt

SEQ ID NO: 4986812 - DNA, 22 bp, Homo sapiens
ttgcaaataagtgtattttgaa

SEQ ID NO: 4986813 - DNA, 21 bp, Homo sapiens
ttggaaattaggttgaaacat

SEQ ID NO: 4986814 - DNA, 20 bp, Homo sapiens
ttggaatgggagtctgaaat

SEQ ID NO: 4986815 - DNA, 22 bp, Homo sapiens
ttggaatgggagtctgaaatgg

SEQ ID NO: 4986816 - DNA, 16 bp, Homo sapiens
ttggcagctctactct

SEQ ID NO: 4986817 - DNA, 23 bp, Homo sapiens
ttgggcactatttatttacaaat

SEQ ID NO: 4986818 - DNA, 14 bp, Homo sapiens
ttggggaaatgtgg

SEQ ID NO: 4986819 - DNA, 12 bp, Homo sapiens
ttgtacattatg

SEQ ID NO: 4986820 - DNA, 17 bp, Homo sapiens
ttgtacattatgttatt

SEQ ID NO: 4986821 - DNA, 20 bp, Homo sapiens
ttgtacattatgttattgga

SEQ ID NO: 4986822 - DNA, 9 bp, Homo sapiens
ttgtgtccc

SEQ ID NO: 4986823 - DNA, 22 bp, Homo sapiens
ttgtgtcccattcccccagtgc

SEQ ID NO: 4986824 - DNA, 10 bp, Homo sapiens
ttgtgtgtgg

SEQ ID NO: 4986825 - DNA, 14 bp, Homo sapiens
ttgttttcttcatt

SEQ ID NO: 4986826 - DNA, 14 bp, Homo sapiens
tttaaaagtccact

SEQ ID NO: 4986827 - DNA, 16 bp, Homo sapiens
tttaaacaaaatagaa

SEQ ID NO: 4986828 - DNA, 13 bp, Homo sapiens
tttaaacatatcc

SEQ ID NO: 4986829 - DNA, 19 bp, Homo sapiens
tttaacttcatttttctaa

SEQ ID NO: 4986830 - DNA, 16 bp, Homo sapiens
tttaagttattaagag

SEQ ID NO: 4986831 - DNA, 12 bp, Homo sapiens
tttaatatgcaa

SEQ ID NO: 4986832 - DNA, 12 bp, Homo sapiens
tttacaaatgtt

SEQ ID NO: 4986833 - DNA, 22 bp, Homo sapiens
tttacacactgtacacataagc

SEQ ID NO: 4986834 - DNA, 14 bp, Homo sapiens
tttacttaagactt

SEQ ID NO: 4986835 - DNA, 17 bp, Homo sapiens
tttagaagaagtgtgtc

SEQ ID NO: 4986836 - DNA, 19 bp, Homo sapiens
tttagaagaagtgtgtcac

SEQ ID NO: 4986837 - DNA, 12 bp, Homo sapiens
tttatgtgatgg

SEQ ID NO: 4986838 - DNA, 14 bp, Homo sapiens
tttatttacaaatg

SEQ ID NO: 4986839 - DNA, 16 bp, Homo sapiens
tttcaattttaaacat

SEQ ID NO: 4986840 - DNA, 17 bp, Homo sapiens
tttccatttacttaaga

SEQ ID NO: 4986841 - DNA, 11 bp, Homo sapiens
tttccctcctt

SEQ ID NO: 4986842 - DNA, 13 bp, Homo sapiens
tttccctctgtat

SEQ ID NO: 4986843 - DNA, 19 bp, Homo sapiens
tttctcttactatatttat

SEQ ID NO: 4986844 - DNA, 14 bp, Homo sapiens
tttctttgattttc

SEQ ID NO: 4986845 - DNA, 20 bp, Homo sapiens
tttcttttgttttcttcatt

SEQ ID NO: 4986846 - DNA, 22 bp, Homo sapiens
tttgactagccatctcaagcaa

SEQ ID NO: 4986847 - DNA, 18 bp, Homo sapiens
tttgatatgggtagtatt

SEQ ID NO: 4986848 - DNA, 19 bp, Homo sapiens
tttgctcttctgtatgtga

SEQ ID NO: 4986849 - DNA, 16 bp, Homo sapiens
tttgtacattatgtta

SEQ ID NO: 4986850 - DNA, 14 bp, Homo sapiens
tttgttcattaaac

SEQ ID NO: 4986851 - DNA, 18 bp, Homo sapiens
tttgttttcttcatttct

SEQ ID NO: 4986852 - DNA, 14 bp, Homo sapiens
ttttaaacaaaata

SEQ ID NO: 4986853 - DNA, 18 bp, Homo sapiens
ttttcaataaatttctgc

SEQ ID NO: 4986854 - DNA, 16 bp, Homo sapiens
ttttcttcatttctct

SEQ ID NO: 4986855 - DNA, 14 bp, Homo sapiens
ttttgttttcttca

SEQ ID NO: 4986856 - DNA, 22 bp, Homo sapiens
caaattaactaaggaaatattt

SEQ ID NO: 4986857 - DNA, 19 bp, Homo sapiens
caacactttccctctctgg

SEQ ID NO: 4986858 - DNA, 21 bp, Homo sapiens
caacatttttgtacattatgt

SEQ ID NO: 4986859 - DNA, 23 bp, Homo sapiens
caacatttttgtacattatgtta

SEQ ID NO: 4986860 - DNA, 17 bp, Homo sapiens
caactaagttaataata

SEQ ID NO: 4986861 - DNA, 16 bp, Homo sapiens
caactgtcagttcatc

SEQ ID NO: 4986862 - DNA, 17 bp, Homo sapiens
caagaactcctgaaatc

SEQ ID NO: 4986863 - DNA, 18 bp, Homo sapiens
caagattcaaagagacta

SEQ ID NO: 4986864 - DNA, 15 bp, Homo sapiens
caagattgtgtccca

SEQ ID NO: 4986865 - DNA, 20 bp, Homo sapiens
caagattgtgtcccattccc

SEQ ID NO: 4986866 - DNA, 15 bp, Homo sapiens
caagcatgtattttt

SEQ ID NO: 4986867 - DNA, 15 bp, Homo sapiens
caaggatcagattct

SEQ ID NO: 4986868 - DNA, 19 bp, Homo sapiens
caaggatcagattcttgct

SEQ ID NO: 4986869 - DNA, 21 bp, Homo sapiens
caaggctggtcccacacttat

SEQ ID NO: 4986870 - DNA, 17 bp, Homo sapiens
caaggtttaagttatta

SEQ ID NO: 4986871 - DNA, 14 bp, Homo sapiens
caagtatagaaaat

SEQ ID NO: 4986872 - DNA, 18 bp, Homo sapiens
caataaagcattttgcaa

SEQ ID NO: 4986873 - DNA, 19 bp, Homo sapiens
caatagattgctcaaatca

SEQ ID NO: 4986874 - DNA, 17 bp, Homo sapiens
caattaccagaaagata

SEQ ID NO: 4986875 - DNA, 13 bp, Homo sapiens
caattttaaacat

SEQ ID NO: 4986876 - DNA, 14 bp, Homo sapiens
cacacacagatatg

SEQ ID NO: 4986877 - DNA, 20 bp, Homo sapiens
cacacagatatgcacacaca

SEQ ID NO: 4986878 - DNA, 13 bp, Homo sapiens
cacacagatgcac

SEQ ID NO: 4986879 - DNA, 15 bp, Homo sapiens
cacaccgatgtgcgc

SEQ ID NO: 4986880 - DNA, 20 bp, Homo sapiens
cacagagatatgcacacaca

SEQ ID NO: 4986881 - DNA, 14 bp, Homo sapiens
cacagatatgcaca

SEQ ID NO: 4986882 - DNA, 16 bp, Homo sapiens
cacagatgcacacaca

SEQ ID NO: 4986883 - DNA, 22 bp, Homo sapiens
cacagatgcacacacagatgca

SEQ ID NO: 4986884 - DNA, 16 bp, Homo sapiens
cacagcagtgagactg

SEQ ID NO: 4986885 - DNA, 15 bp, Homo sapiens
cacaggtttagttga

SEQ ID NO: 4986886 - DNA, 19 bp, Homo sapiens
cacataagccaaaactgag

SEQ ID NO: 4986887 - DNA, 21 bp, Homo sapiens
cacataagccaaaactgagca

SEQ ID NO: 4986888 - DNA, 14 bp, Homo sapiens
cacattaataaaca

SEQ ID NO: 4986889 - DNA, 16 bp, Homo sapiens
caccccagcaattatg

SEQ ID NO: 4986890 - DNA, 22 bp, Homo sapiens
cacgcacatgccaatgcacgca

SEQ ID NO: 4986891 - DNA, 23 bp, Homo sapiens
cacgcacatgccaatgcacgcac

SEQ ID NO: 4986892 - DNA, 16 bp, Homo sapiens
cacggatgcacagaga

SEQ ID NO: 4986893 - DNA, 21 bp, Homo sapiens
cactagacgttgtaatgcaca

SEQ ID NO: 4986894 - DNA, 18 bp, Homo sapiens
cactcaagtgccattcat

SEQ ID NO: 4986895 - DNA, 12 bp, Homo sapiens
cactgaatctaa

SEQ ID NO: 4986896 - DNA, 19 bp, Homo sapiens
cacttatttttttcccaag

SEQ ID NO: 4986897 - DNA, 22 bp, Homo sapiens
cacttctggatatagctaggtg

SEQ ID NO: 4986898 - DNA, 23 bp, Homo sapiens
cacttctggatatagctaggtga

SEQ ID NO: 4986899 - DNA, 13 bp, Homo sapiens
cactttaaaacac

SEQ ID NO: 4986900 - DNA, 13 bp, Homo sapiens
cacttttaaaact

SEQ ID NO: 4986901 - DNA, 18 bp, Homo sapiens
cagaaaccttcctgctga

SEQ ID NO: 4986902 - DNA, 21 bp, Homo sapiens
cagaagattacaaaagcaatt

SEQ ID NO: 4986903 - DNA, 21 bp, Homo sapiens
cagagacagaaacagagagag

SEQ ID NO: 4986904 - DNA, 14 bp, Homo sapiens
cagagagagacaga

SEQ ID NO: 4986905 - DNA, 17 bp, Homo sapiens
cagagagagacagagac

SEQ ID NO: 4986906 - DNA, 22 bp, Homo sapiens
cagaggacagtatttgtgggga

SEQ ID NO: 4986907 - DNA, 21 bp, Homo sapiens
cagagtaggctattcctgaga

SEQ ID NO: 4986908 - DNA, 18 bp, Homo sapiens
cagagtggaataagacag

SEQ ID NO: 4986909 - DNA, 15 bp, Homo sapiens
cagatatacacatgg

SEQ ID NO: 4986910 - DNA, 18 bp, Homo sapiens
cagatatgcacacacatg

SEQ ID NO: 4986911 - DNA, 22 bp, Homo sapiens
cagatatgcacacacatggatg

SEQ ID NO: 4986912 - DNA, 18 bp, Homo sapiens
cagatggtcacacagaga

SEQ ID NO: 4986913 - DNA, 16 bp, Homo sapiens
cagcaattatgaaaat

SEQ ID NO: 4986914 - DNA, 14 bp, Homo sapiens
cagcagcaacaact

SEQ ID NO: 4986915 - DNA, 18 bp, Homo sapiens
cagcagcaacaactgtca

SEQ ID NO: 4986916 - DNA, 15 bp, Homo sapiens
cagcagtgagactgg

SEQ ID NO: 4986917 - DNA, 16 bp, Homo sapiens
cagcagtgagactggg

SEQ ID NO: 4986918 - DNA, 22 bp, Homo sapiens
cagctaaagaagtttgaacatt

SEQ ID NO: 4986919 - DNA, 17 bp, Homo sapiens
cagctactcgggaggct

SEQ ID NO: 4986920 - DNA, 19 bp, Homo sapiens
cagctactcgggaggctga

SEQ ID NO: 4986921 - DNA, 22 bp, Homo sapiens
caggagactggcgtgaacccag

SEQ ID NO: 4986922 - DNA, 23 bp, Homo sapiens
caggagactggcgtgaacccagg

SEQ ID NO: 4986923 - DNA, 19 bp, Homo sapiens
caggtccaaggctggtccc

SEQ ID NO: 4986924 - DNA, 17 bp, Homo sapiens
caggtgccaatgactaa

SEQ ID NO: 4986925 - DNA, 17 bp, Homo sapiens
caggtttagttgactaa

SEQ ID NO: 4986926 - DNA, 15 bp, Homo sapiens
cagtctgcttagaaa

SEQ ID NO: 4986927 - DNA, 22 bp, Homo sapiens
cagtctttaatctgagaggcca

SEQ ID NO: 4986928 - DNA, 21 bp, Homo sapiens
cagtgagagagtggctggggc

SEQ ID NO: 4986929 - DNA, 22 bp, Homo sapiens
cagtgagagagtggctggggca

SEQ ID NO: 4986930 - DNA, 21 bp, Homo sapiens
cagtgcacacggatgcacaga

SEQ ID NO: 4986931 - DNA, 14 bp, Homo sapiens
cagtgcagtataga

SEQ ID NO: 4986932 - DNA, 12 bp, Homo sapiens
cagtgcggccag

SEQ ID NO: 4986933 - DNA, 19 bp, Homo sapiens
cagtggatgagggccacca

SEQ ID NO: 4986934 - DNA, 18 bp, Homo sapiens
cagttcatcctgcatggg

SEQ ID NO: 4986935 - DNA, 16 bp, Homo sapiens
cataaactatattctg

SEQ ID NO: 4986936 - DNA, 20 bp, Homo sapiens
cataagccaaaactgagcat

SEQ ID NO: 4986937 - DNA, 22 bp, Homo sapiens
cataagtcctctagtgaatgta

SEQ ID NO: 4986938 - DNA, 21 bp, Homo sapiens
cataattcacacattaataaa

SEQ ID NO: 4986939 - DNA, 23 bp, Homo sapiens
cataattcacacattaataaaca

SEQ ID NO: 4986940 - DNA, 18 bp, Homo sapiens
cataatttcagttctagt

SEQ ID NO: 4986941 - DNA, 14 bp, Homo sapiens
catacattatattc

SEQ ID NO: 4986942 - DNA, 14 bp, Homo sapiens
catatccaagtttg

SEQ ID NO: 4986943 - DNA, 19 bp, Homo sapiens
catcaatgaagattaacac

SEQ ID NO: 4986944 - DNA, 21 bp, Homo sapiens
catctcaagcaagtttaatca

SEQ ID NO: 4986945 - DNA, 22 bp, Homo sapiens
catctcaagcaagtttaatcaa

SEQ ID NO: 4986946 - DNA, 14 bp, Homo sapiens
catcttaaaaacaa

SEQ ID NO: 4986947 - DNA, 19 bp, Homo sapiens
catgagttggctgggaata

SEQ ID NO: 4986948 - DNA, 20 bp, Homo sapiens
catgcatagagtgtgatgta

SEQ ID NO: 4986949 - DNA, 23 bp, Homo sapiens
catggaaggcaagattgtgtccc

SEQ ID NO: 4986950 - DNA, 12 bp, Homo sapiens
catggagagaga

SEQ ID NO: 4986951 - DNA, 13 bp, Homo sapiens
catgggagggagg

SEQ ID NO: 4986952 - DNA, 19 bp, Homo sapiens
catgtcagtctgcttagaa

SEQ ID NO: 4986953 - DNA, 22 bp, Homo sapiens
cattatgttattggaattttct

SEQ ID NO: 4986954 - DNA, 14 bp, Homo sapiens
cattcaaaaacccc

SEQ ID NO: 4986955 - DNA, 14 bp, Homo sapiens
cattccagaggaag

SEQ ID NO: 4986956 - DNA, 14 bp, Homo sapiens
cattctttcctaaa

SEQ ID NO: 4986957 - DNA, 13 bp, Homo sapiens
catttacttaaga

SEQ ID NO: 4986958 - DNA, 12 bp, Homo sapiens
cattttaaacaa

SEQ ID NO: 4986959 - DNA, 13 bp, Homo sapiens
cattttaaacaaa

SEQ ID NO: 4986960 - DNA, 23 bp, Homo sapiens
cattttaaacaaaatagaaagtt

SEQ ID NO: 4986961 - DNA, 15 bp, Homo sapiens
catttttgtacatta

SEQ ID NO: 4986962 - DNA, 16 bp, Homo sapiens
catttttgtacattat

SEQ ID NO: 4986963 - DNA, 17 bp, Homo sapiens
ccaagaactcctgaaat

SEQ ID NO: 4986964 - DNA, 19 bp, Homo sapiens
ccaagccttggctctaccc

SEQ ID NO: 4986965 - DNA, 15 bp, Homo sapiens
ccaaggttgtcctgg

SEQ ID NO: 4986966 - DNA, 16 bp, Homo sapiens
ccacacttatcagcag

SEQ ID NO: 4986967 - DNA, 22 bp, Homo sapiens
ccagagaggctggatgacttgc

SEQ ID NO: 4986968 - DNA, 15 bp, Homo sapiens
ccagagccttaataa

SEQ ID NO: 4986969 - DNA, 22 bp, Homo sapiens
ccagagtcctggcccttgatgc

SEQ ID NO: 4986970 - DNA, 15 bp, Homo sapiens
ccagcaattatgaaa

SEQ ID NO: 4986971 - DNA, 21 bp, Homo sapiens
ccagcactttgggaggctgag

SEQ ID NO: 4986972 - DNA, 21 bp, Homo sapiens
ccagctactcgggaggctgag

SEQ ID NO: 4986973 - DNA, 23 bp, Homo sapiens
ccatctcaagcaagtttaatcaa

SEQ ID NO: 4986974 - DNA, 10 bp, Homo sapiens
ccatgaaaga

SEQ ID NO: 4986975 - DNA, 13 bp, Homo sapiens
ccatgtcagacac

SEQ ID NO: 4986976 - DNA, 17 bp, Homo sapiens
ccatttacttaagactt

SEQ ID NO: 4986977 - DNA, 23 bp, Homo sapiens
ccatttacttaagacttaatgag

SEQ ID NO: 4986978 - DNA, 16 bp, Homo sapiens
cccagcaattatgaaa

SEQ ID NO: 4986979 - DNA, 20 bp, Homo sapiens
cccagctactcgggaggctg

SEQ ID NO: 4986980 - DNA, 22 bp, Homo sapiens
cccagctcagtgccacaaagct

SEQ ID NO: 4986981 - DNA, 20 bp, Homo sapiens
cccattatgcgctgtggcca

SEQ ID NO: 4986982 - DNA, 23 bp, Homo sapiens
cccgatggaggactccaggcagc

SEQ ID NO: 4986983 - DNA, 18 bp, Homo sapiens
gaaattaggttgaaacat

SEQ ID NO: 4986984 - DNA, 20 bp, Homo sapiens
gaactgatcatgtttatgag

SEQ ID NO: 4986985 - DNA, 20 bp, Homo sapiens
gaactgctgggcttggcagc

SEQ ID NO: 4986986 - DNA, 13 bp, Homo sapiens
gaagaagggaagc

SEQ ID NO: 4986987 - DNA, 23 bp, Homo sapiens
gaagaagggaagccttttgcaaa

SEQ ID NO: 4986988 - DNA, 17 bp, Homo sapiens
gaagagaagggcagggc

SEQ ID NO: 4986989 - DNA, 21 bp, Homo sapiens
gaagcacaggtccaaggctgg

SEQ ID NO: 4986990 - DNA, 20 bp, Homo sapiens
gaagcacccattatgcgctg

SEQ ID NO: 4986991 - DNA, 20 bp, Homo sapiens
gaaggcatggacttctggat

SEQ ID NO: 4986992 - DNA, 12 bp, Homo sapiens
gaagggaagcct

SEQ ID NO: 4986993 - DNA, 21 bp, Homo sapiens
gaagtgtgggtctgtgtgtgt

SEQ ID NO: 4986994 - DNA, 16 bp, Homo sapiens
gaagttctagtgtttt

SEQ ID NO: 4986995 - DNA, 13 bp, Homo sapiens
gaagtttgaacat

SEQ ID NO: 4986996 - DNA, 13 bp, Homo sapiens
gaatgtaggctgg

SEQ ID NO: 4986997 - DNA, 15 bp, Homo sapiens
gaatgtcacttctgg

SEQ ID NO: 4986998 - DNA, 13 bp, Homo sapiens
gaatgtcagtatg

SEQ ID NO: 4986999 - DNA, 13 bp, Homo sapiens
gaattttctttca

SEQ ID NO: 4987000 - DNA, 16 bp, Homo sapiens
gaattttctttcatac

SEQ ID NO: 4987001 - DNA, 19 bp, Homo sapiens
gaattttctttcatacatt

SEQ ID NO: 4987002 - DNA, 19 bp, Homo sapiens
gacaacatttttgtacatt

SEQ ID NO: 4987003 - DNA, 21 bp, Homo sapiens
gacaacatttttgtacattat

SEQ ID NO: 4987004 - DNA, 13 bp, Homo sapiens
gacagagagagac

SEQ ID NO: 4987005 - DNA, 17 bp, Homo sapiens
gacagagagagactgag

SEQ ID NO: 4987006 - DNA, 17 bp, Homo sapiens
gacagaggggcagggga

SEQ ID NO: 4987007 - DNA, 19 bp, Homo sapiens
gacagagttggtgttcata

SEQ ID NO: 4987008 - DNA, 15 bp, Homo sapiens
gacagtatttgtggg

SEQ ID NO: 4987009 - DNA, 17 bp, Homo sapiens
gacatatattttttaaa

SEQ ID NO: 4987010 - DNA, 20 bp, Homo sapiens
gacatatattttttaaaata

SEQ ID NO: 4987011 - DNA, 14 bp, Homo sapiens
gacattgaaatcta

SEQ ID NO: 4987012 - DNA, 21 bp, Homo sapiens
gacattgaaatctaggaaaat

SEQ ID NO: 4987013 - DNA, 16 bp, Homo sapiens
gactaatagagacaca

SEQ ID NO: 4987014 - DNA, 16 bp, Homo sapiens
gactccaggcagcaga

SEQ ID NO: 4987015 - DNA, 19 bp, Homo sapiens
gacttgcatacctgctttt

SEQ ID NO: 4987016 - DNA, 19 bp, Homo sapiens
gagaaactggcaaagcaga

SEQ ID NO: 4987017 - DNA, 19 bp, Homo sapiens
gagaacattcaatcttgcc

SEQ ID NO: 4987018 - DNA, 17 bp, Homo sapiens
gagacagaaacagagag

SEQ ID NO: 4987019 - DNA, 14 bp, Homo sapiens
gagacagagagaga

SEQ ID NO: 4987020 - DNA, 15 bp, Homo sapiens
gagacagagagagac

SEQ ID NO: 4987021 - DNA, 16 bp, Homo sapiens
gagacagtagaggcat

SEQ ID NO: 4987022 - DNA, 15 bp, Homo sapiens
gagactccatagttt

SEQ ID NO: 4987023 - DNA, 16 bp, Homo sapiens
gagactgagggagaga

SEQ ID NO: 4987024 - DNA, 22 bp, Homo sapiens
gagactggcgtgaacccaggag

SEQ ID NO: 4987025 - DNA, 16 bp, Homo sapiens
gagactttaaaagcat

SEQ ID NO: 4987026 - DNA, 15 bp, Homo sapiens
gagagacagagacag

SEQ ID NO: 4987027 - DNA, 11 bp, Homo sapiens
gagagagactg

SEQ ID NO: 4987028 - DNA, 23 bp, Homo sapiens
gagaggtccagagtcctggccct

SEQ ID NO: 4987029 - DNA, 22 bp, Homo sapiens
gagatatgcacacacacggatg

SEQ ID NO: 4987030 - DNA, 15 bp, Homo sapiens
gagcctcacagcagt

SEQ ID NO: 4987031 - DNA, 18 bp, Homo sapiens
gagcctcacagcagtgag

SEQ ID NO: 4987032 - DNA, 18 bp, Homo sapiens
gaggactccaggcagcag

SEQ ID NO: 4987033 - DNA, 23 bp, Homo sapiens
gaggactccaggcagcagacaca

SEQ ID NO: 4987034 - DNA, 18 bp, Homo sapiens
gaggcagaggcagacagg

SEQ ID NO: 4987035 - DNA, 18 bp, Homo sapiens
gaggctgaggcaggagac

SEQ ID NO: 4987036 - DNA, 13 bp, Homo sapiens
gaggctggatgac

SEQ ID NO: 4987037 - DNA, 19 bp, Homo sapiens
gaggctggatgacttgctc

SEQ ID NO: 4987038 - DNA, 21 bp, Homo sapiens
gaggctggatgacttgctcaa

SEQ ID NO: 4987039 - DNA, 20 bp, Homo sapiens
gagggagacagagacagaaa

SEQ ID NO: 4987040 - DNA, 12 bp, Homo sapiens
gagggagaggtg

SEQ ID NO: 4987041 - DNA, 15 bp, Homo sapiens
gagggagggagaggt

SEQ ID NO: 4987042 - DNA, 14 bp, Homo sapiens
gagggatgttccag

SEQ ID NO: 4987043 - DNA, 18 bp, Homo sapiens
gagggcatgggagggagg

SEQ ID NO: 4987044 - DNA, 19 bp, Homo sapiens
gagtatcagttgcaggtgc

SEQ ID NO: 4987045 - DNA, 18 bp, Homo sapiens
gagtcagggagagctgaa

SEQ ID NO: 4987046 - DNA, 20 bp, Homo sapiens
gagtctgaaatggggctact

SEQ ID NO: 4987047 - DNA, 13 bp, Homo sapiens
gagtgtgtaattt

SEQ ID NO: 4987048 - DNA, 13 bp, Homo sapiens
gataaattacatt

SEQ ID NO: 4987049 - DNA, 21 bp, Homo sapiens
gatatagctaggtgacatata

SEQ ID NO: 4987050 - DNA, 16 bp, Homo sapiens
gatcagattcttgctg

SEQ ID NO: 4987051 - DNA, 13 bp, Homo sapiens
gatccagagaggc

SEQ ID NO: 4987052 - DNA, 11 bp, Homo sapiens
gatgagaggca

SEQ ID NO: 4987053 - DNA, 18 bp, Homo sapiens
gatgagggccaccaggaa

SEQ ID NO: 4987054 - DNA, 15 bp, Homo sapiens
gattccctgatttaa

SEQ ID NO: 4987055 - DNA, 16 bp, Homo sapiens
gattgcgagaattttc

SEQ ID NO: 4987056 - DNA, 17 bp, Homo sapiens
gattgtgtcccattccc

SEQ ID NO: 4987057 - DNA, 19 bp, Homo sapiens
gattgtgtcccattccccc

SEQ ID NO: 4987058 - DNA, 14 bp, Homo sapiens
gatttaatatgcaa

SEQ ID NO: 4987059 - DNA, 20 bp, Homo sapiens
gatttggggctcagagtggg

SEQ ID NO: 4987060 - DNA, 23 bp, Homo sapiens
gattttcttttgttttcttcatt

SEQ ID NO: 4987061 - DNA, 16 bp, Homo sapiens
gcaaaaaaaattagcc

SEQ ID NO: 4987062 - DNA, 21 bp, Homo sapiens
gcaaagcgctaagtaaaaata

SEQ ID NO: 4987063 - DNA, 23 bp, Homo sapiens
gcaaagcgctaagtaaaaatatt

SEQ ID NO: 4987064 - DNA, 21 bp, Homo sapiens
gcaaataagtgtattttgaaa

SEQ ID NO: 4987065 - DNA, 14 bp, Homo sapiens
gcaaatagtagagt

SEQ ID NO: 4987066 - DNA, 19 bp, Homo sapiens
gcaaatgtttatttaaaag

SEQ ID NO: 4987067 - DNA, 13 bp, Homo sapiens
gcacacacacaga

SEQ ID NO: 4987068 - DNA, 14 bp, Homo sapiens
gcacacacacagag

SEQ ID NO: 4987069 - DNA, 17 bp, Homo sapiens
gcacacacacggatgca

SEQ ID NO: 4987070 - DNA, 13 bp, Homo sapiens
gcacacacatgga

SEQ ID NO: 4987071 - DNA, 21 bp, Homo sapiens
gcacacacatggatgagcaca

SEQ ID NO: 4987072 - DNA, 12 bp, Homo sapiens
gcacacctgtgg

SEQ ID NO: 4987073 - DNA, 13 bp, Homo sapiens
gcacacggatgca

SEQ ID NO: 4987074 - DNA, 18 bp, Homo sapiens
gcacagagatatgcacac

SEQ ID NO: 4987075 - DNA, 22 bp, Homo sapiens
gcacaggtccaaggctggtccc

SEQ ID NO: 4987076 - DNA, 14 bp, Homo sapiens
gcacatgattttct

SEQ ID NO: 4987077 - DNA, 17 bp, Homo sapiens
gcactatttatttacaa

SEQ ID NO: 4987078 - DNA, 13 bp, Homo sapiens
gcactttaaaaca

SEQ ID NO: 4987079 - DNA, 18 bp, Homo sapiens
gcactttgggaggctgag

SEQ ID NO: 4987080 - DNA, 13 bp, Homo sapiens
gcagcagacacat

SEQ ID NO: 4987081 - DNA, 12 bp, Homo sapiens
gcaggcacctgt

SEQ ID NO: 4987082 - DNA, 13 bp, Homo sapiens
gcaggggagtgcc

SEQ ID NO: 4987083 - DNA, 13 bp, Homo sapiens
gcagtgagactgg

SEQ ID NO: 4987084 - DNA, 21 bp, Homo sapiens
gcagttaatggggtagaggag

SEQ ID NO: 4987085 - DNA, 15 bp, Homo sapiens
gcataagtcctctag

SEQ ID NO: 4987086 - DNA, 16 bp, Homo sapiens
gcatcaccatgcatgg

SEQ ID NO: 4987087 - DNA, 18 bp, Homo sapiens
gcatgggagggagggaga

SEQ ID NO: 4987088 - DNA, 19 bp, Homo sapiens
gcatgggagggagggagag

SEQ ID NO: 4987089 - DNA, 21 bp, Homo sapiens
gcatgggagggagggagaggt

SEQ ID NO: 4987090 - DNA, 18 bp, Homo sapiens
gcattatatttgtaaatt

SEQ ID NO: 4987091 - DNA, 23 bp, Homo sapiens
gcattttaaacaaaatagaaagt

SEQ ID NO: 4987092 - DNA, 14 bp, Homo sapiens
gccaccaggaagca

SEQ ID NO: 4987093 - DNA, 19 bp, Homo sapiens
gccactgtgctccagcctg

SEQ ID NO: 4987094 - DNA, 17 bp, Homo sapiens
gccagagccttaataaa

SEQ ID NO: 4987095 - DNA, 14 bp, Homo sapiens
gccaggatggaatg

SEQ ID NO: 4987096 - DNA, 14 bp, Homo sapiens
gccaggatggcgca

SEQ ID NO: 4987097 - DNA, 23 bp, Homo sapiens
gccagtggctggatctgtgaggg

SEQ ID NO: 4987098 - DNA, 21 bp, Homo sapiens
gccatcatgtttacagaggac

SEQ ID NO: 4987099 - DNA, 16 bp, Homo sapiens
gccatgtcagacacag

SEQ ID NO: 4987100 - DNA, 12 bp, Homo sapiens
gccattggagtc

SEQ ID NO: 4987101 - DNA, 21 bp, Homo sapiens
gccgggcgtggtggcaggcac

SEQ ID NO: 4987102 - DNA, 19 bp, Homo sapiens
gcctcacagcagtgagact

SEQ ID NO: 4987103 - DNA, 20 bp, Homo sapiens
gcctctcattccagaggaag

SEQ ID NO: 4987104 - DNA, 20 bp, Homo sapiens
gcctgggcaacagagcaaga

SEQ ID NO: 4987105 - DNA, 21 bp, Homo sapiens
gcctgggcaacagagcaagac

SEQ ID NO: 4987106 - DNA, 13 bp, Homo sapiens
gcgagaattttca

SEQ ID NO: 4987107 - DNA, 23 bp, Homo sapiens
gcgccactgtgctccagcctggg

SEQ ID NO: 4987108 - DNA, 18 bp, Homo sapiens
gcgctggacagaggggca

SEQ ID NO: 4987109 - DNA, 22 bp, Homo sapiens
gctaattctttgacctgttggg

SEQ ID NO: 4987110 - DNA, 15 bp, Homo sapiens
gctacagtaataaat

SEQ ID NO: 4987111 - DNA, 20 bp, Homo sapiens
tcactattcatcaatgaaga

SEQ ID NO: 4987112 - DNA, 22 bp, Homo sapiens
tcactattcatcaatgaagatt

SEQ ID NO: 4987113 - DNA, 19 bp, Homo sapiens
tcagaactcgttaaagcaa

SEQ ID NO: 4987114 - DNA, 14 bp, Homo sapiens
tcagattcttgctg

SEQ ID NO: 4987115 - DNA, 15 bp, Homo sapiens
tcagattcttgctgt

SEQ ID NO: 4987116 - DNA, 16 bp, Homo sapiens
tcagcagcaacaactg

SEQ ID NO: 4987117 - DNA, 23 bp, Homo sapiens
tcagctaaagaagtttgaacatt

SEQ ID NO: 4987118 - DNA, 22 bp, Homo sapiens
tcagtctttaatctgagaggcc

SEQ ID NO: 4987119 - DNA, 15 bp, Homo sapiens
tcagttctagttgat

SEQ ID NO: 4987120 - DNA, 13 bp, Homo sapiens
tcagttctgatat

SEQ ID NO: 4987121 - DNA, 13 bp, Homo sapiens
tcagttgcaggtg

SEQ ID NO: 4987122 - DNA, 18 bp, Homo sapiens
tcagtttccctctgtata

SEQ ID NO: 4987123 - DNA, 16 bp, Homo sapiens
tcataaatttatggtt

SEQ ID NO: 4987124 - DNA, 13 bp, Homo sapiens
tcatacattatat

SEQ ID NO: 4987125 - DNA, 24 bp, Homo sapiens
tcatcctttaagaaaaacatctgg

SEQ ID NO: 4987126 - DNA, 16 bp, Homo sapiens
tcatctttccctcctt

SEQ ID NO: 4987127 - DNA, 17 bp, Homo sapiens
tcatctttccctccttg

SEQ ID NO: 4987128 - DNA, 17 bp, Homo sapiens
tcatgtttacagaggac

SEQ ID NO: 4987129 - DNA, 14 bp, Homo sapiens
tcattccagaggaa

SEQ ID NO: 4987130 - DNA, 18 bp, Homo sapiens
tcatttgttcattaaacg

SEQ ID NO: 4987131 - DNA, 20 bp, Homo sapiens
tccactgggtgtaaacacat

SEQ ID NO: 4987132 - DNA, 13 bp, Homo sapiens
tccagagaggctg

SEQ ID NO: 4987133 - DNA, 24 bp, Homo sapiens
tccagagaggctggatgacttgct

SEQ ID NO: 4987134 - DNA, 15 bp, Homo sapiens
tccagagtcctggcc

SEQ ID NO: 4987135 - DNA, 21 bp, Homo sapiens
tccagagtcctggcccttgat

SEQ ID NO: 4987136 - DNA, 13 bp, Homo sapiens
tcccagcactttg

SEQ ID NO: 4987137 - DNA, 22 bp, Homo sapiens
tcccagcactttgggaggctga

SEQ ID NO: 4987138 - DNA, 23 bp, Homo sapiens
tcccagcactttgggaggctgag

SEQ ID NO: 4987139 - DNA, 23 bp, Homo sapiens
tcccagctactcgggaggctgag

SEQ ID NO: 4987140 - DNA, 19 bp, Homo sapiens
tcccattcccccagtgcgg

SEQ ID NO: 4987141 - DNA, 12 bp, Homo sapiens
tccctccttggt

SEQ ID NO: 4987142 - DNA, 15 bp, Homo sapiens
tccgtagttttgata

SEQ ID NO: 4987143 - DNA, 20 bp, Homo sapiens
tcctaaaacaacagatgtac

SEQ ID NO: 4987144 - DNA, 22 bp, Homo sapiens
tcctaaaattatggaaacagat

SEQ ID NO: 4987145 - DNA, 20 bp, Homo sapiens
tcctgctgagcctcacagca

SEQ ID NO: 4987146 - DNA, 20 bp, Homo sapiens
tcctggcccttgatgcccag

SEQ ID NO: 4987147 - DNA, 19 bp, Homo sapiens
tcctgtccctcatccatag

SEQ ID NO: 4987148 - DNA, 15 bp, Homo sapiens
tctaaagaaacagaa

SEQ ID NO: 4987149 - DNA, 22 bp, Homo sapiens
tctaagttgcatctttaatcct

SEQ ID NO: 4987150 - DNA, 15 bp, Homo sapiens
tctacctcttggctg

SEQ ID NO: 4987151 - DNA, 16 bp, Homo sapiens
tctactaaaaatgcaa

SEQ ID NO: 4987152 - DNA, 18 bp, Homo sapiens
tctagtgttttcaatttt

SEQ ID NO: 4987153 - DNA, 21 bp, Homo sapiens
tctagttgattgcgagaattt

SEQ ID NO: 4987154 - DNA, 19 bp, Homo sapiens
tctataatttccatttact

SEQ ID NO: 4987155 - DNA, 22 bp, Homo sapiens
tctataatttccatttacttaa

SEQ ID NO: 4987156 - DNA, 16 bp, Homo sapiens
tctcattccagaggaa

SEQ ID NO: 4987157 - DNA, 20 bp, Homo sapiens
tctcctgaaatctacaggcc

SEQ ID NO: 4987158 - DNA, 20 bp, Homo sapiens
tctctgattccctgatttaa

SEQ ID NO: 4987159 - DNA, 17 bp, Homo sapiens
tctctggacctcagttt

SEQ ID NO: 4987160 - DNA, 16 bp, Homo sapiens
tctcttatcttacgaa

SEQ ID NO: 4987161 - DNA, 21 bp, Homo sapiens
tctgaaatgtcagttctgata

SEQ ID NO: 4987162 - DNA, 20 bp, Homo sapiens
tctgaggacatggagagaga

SEQ ID NO: 4987163 - DNA, 17 bp, Homo sapiens
tctgatgggcctggctg

SEQ ID NO: 4987164 - DNA, 19 bp, Homo sapiens
tctgattccctgatttaat

SEQ ID NO: 4987165 - DNA, 13 bp, Homo sapiens
tctgatttaattg

SEQ ID NO: 4987166 - DNA, 17 bp, Homo sapiens
tctgctccaaattttca

SEQ ID NO: 4987167 - DNA, 17 bp, Homo sapiens
tctgcttagaaataaca

SEQ ID NO: 4987168 - DNA, 22 bp, Homo sapiens
tctgcttagaaataacagaaga

SEQ ID NO: 4987169 - DNA, 19 bp, Homo sapiens
tctgcttccgtattttaat

SEQ ID NO: 4987170 - DNA, 22 bp, Homo sapiens
tctggatatcaaggtggaaatg

SEQ ID NO: 4987171 - DNA, 11 bp, Homo sapiens
tctggccctat

SEQ ID NO: 4987172 - DNA, 19 bp, Homo sapiens
tctgtatgtgacaacattt

SEQ ID NO: 4987173 - DNA, 13 bp, Homo sapiens
tctgtgtgtgtgt

SEQ ID NO: 4987174 - DNA, 15 bp, Homo sapiens
tctgtgtgtttatgt

SEQ ID NO: 4987175 - DNA, 16 bp, Homo sapiens
tctgtgtgtttatgtg

SEQ ID NO: 4987176 - DNA, 14 bp, Homo sapiens
tcttatcttacgaa

SEQ ID NO: 4987177 - DNA, 22 bp, Homo sapiens
tcttcattacctcagtgagaag

SEQ ID NO: 4987178 - DNA, 19 bp, Homo sapiens
tcttgccgtcactattcat

SEQ ID NO: 4987179 - DNA, 16 bp, Homo sapiens
tctttccctccttggt

SEQ ID NO: 4987180 - DNA, 18 bp, Homo sapiens
tctttgaaaaataaagtt

SEQ ID NO: 4987181 - DNA, 16 bp, Homo sapiens
tcttttgttttcttca

SEQ ID NO: 4987182 - DNA, 17 bp, Homo sapiens
tcttttgttttcttcat

SEQ ID NO: 4987183 - DNA, 22 bp, Homo sapiens
tgaaaagcctctgttttgatat

SEQ ID NO: 4987184 - DNA, 22 bp, Homo sapiens
tgaaaagctatcttaaaatata

SEQ ID NO: 4987185 - DNA, 17 bp, Homo sapiens
tgaaatggggctactgt

SEQ ID NO: 4987186 - DNA, 13 bp, Homo sapiens
tgaaatgtcagtt

SEQ ID NO: 4987187 - DNA, 15 bp, Homo sapiens
tgaagattaacactg

SEQ ID NO: 4987188 - DNA, 21 bp, Homo sapiens
tgaataacctgaggattctat

SEQ ID NO: 4987189 - DNA, 23 bp, Homo sapiens
tgaatgtaggctggctttcagag

SEQ ID NO: 4987190 - DNA, 13 bp, Homo sapiens
tgacatatacata

SEQ ID NO: 4987191 - DNA, 13 bp, Homo sapiens
tgacattgaaatc

SEQ ID NO: 4987192 - DNA, 15 bp, Homo sapiens
tgaccatgaaagact

SEQ ID NO: 4987193 - DNA, 16 bp, Homo sapiens
tgaccatgaaagactt

SEQ ID NO: 4987194 - DNA, 22 bp, Homo sapiens
tgacccaagaactcctgaaatc

SEQ ID NO: 4987195 - DNA, 21 bp, Homo sapiens
tgactctaaagaaacagaaga

SEQ ID NO: 4987196 - DNA, 22 bp, Homo sapiens
tgagactggggccactacattt

SEQ ID NO: 4987197 - DNA, 14 bp, Homo sapiens
tgagactttaaaag

SEQ ID NO: 4987198 - DNA, 15 bp, Homo sapiens
tgagagagtggctgg

SEQ ID NO: 4987199 - DNA, 16 bp, Homo sapiens
tgagagctgcatgtgt

SEQ ID NO: 4987200 - DNA, 15 bp, Homo sapiens
tgagcctcacagcag

SEQ ID NO: 4987201 - DNA, 18 bp, Homo sapiens
tgaggacatggagagaga

SEQ ID NO: 4987202 - DNA, 19 bp, Homo sapiens
tgaggacatggagagagac

SEQ ID NO: 4987203 - DNA, 14 bp, Homo sapiens
tgagtgtgactttt

SEQ ID NO: 4987204 - DNA, 17 bp, Homo sapiens
tgagttggctgggaata

SEQ ID NO: 4987205 - DNA, 18 bp, Homo sapiens
tgatcatgtttatgagaa

SEQ ID NO: 4987206 - DNA, 16 bp, Homo sapiens
tgatgcccagctcagt

SEQ ID NO: 4987207 - DNA, 16 bp, Homo sapiens
tgattgcgagaatttt

SEQ ID NO: 4987208 - DNA, 17 bp, Homo sapiens
tgattgcgagaattttc

SEQ ID NO: 4987209 - DNA, 20 bp, Homo sapiens
tgcaaaaaaaattagccggg

SEQ ID NO: 4987210 - DNA, 21 bp, Homo sapiens
tgcaaataagtgtattttgaa

SEQ ID NO: 4987211 - DNA, 16 bp, Homo sapiens
tgcaacatacaggtgc

SEQ ID NO: 4987212 - DNA, 14 bp, Homo sapiens
tgcaaggcaaatgt

SEQ ID NO: 4987213 - DNA, 19 bp, Homo sapiens
tgcacacacacggatgcac

SEQ ID NO: 4987214 - DNA, 23 bp, Homo sapiens
tgcacacacagatgcacacacag

SEQ ID NO: 4987215 - DNA, 15 bp, Homo sapiens
tgcacacacatatat

SEQ ID NO: 4987216 - DNA, 21 bp, Homo sapiens
tgcacacacatggatgagcac

SEQ ID NO: 4987217 - DNA, 16 bp, Homo sapiens
tgcacacggatgcaca

SEQ ID NO: 4987218 - DNA, 22 bp, Homo sapiens
tgcacacttatttttttcccaa

SEQ ID NO: 4987219 - DNA, 18 bp, Homo sapiens
tgcacagagatatgcaca

SEQ ID NO: 4987220 - DNA, 19 bp, Homo sapiens
tgcacagagatatgcacac

SEQ ID NO: 4987221 - DNA, 18 bp, Homo sapiens
tgcagtacaggacatata

SEQ ID NO: 4987222 - DNA, 16 bp, Homo sapiens
tgcagtgcagtataga

SEQ ID NO: 4987223 - DNA, 17 bp, Homo sapiens
tgcatgggaaaaatgtt

SEQ ID NO: 4987224 - DNA, 17 bp, Homo sapiens
tgccaaggttgtcctgg

SEQ ID NO: 4987225 - DNA, 23 bp, Homo sapiens
tgccagggccatgtcagacacag

SEQ ID NO: 4987226 - DNA, 13 bp, Homo sapiens
tgccattcatcct

SEQ ID NO: 4987227 - DNA, 14 bp, Homo sapiens
tgccattcatcctt

SEQ ID NO: 4987228 - DNA, 19 bp, Homo sapiens
tgcccagctcagtgccaca

SEQ ID NO: 4987229 - DNA, 22 bp, Homo sapiens
tgcgcacacacaccgatgtaca

SEQ ID NO: 4987230 - DNA, 13 bp, Homo sapiens
tgctacagtaata

SEQ ID NO: 4987231 - DNA, 15 bp, Homo sapiens
tgctagaagaaaaca

SEQ ID NO: 4987232 - DNA, 16 bp, Homo sapiens
tgctatgagctgggga

SEQ ID NO: 4987233 - DNA, 19 bp, Homo sapiens
tgctatgagctggggatgt

SEQ ID NO: 4987234 - DNA, 20 bp, Homo sapiens
tgctatgagctggggatgtc

SEQ ID NO: 4987235 - DNA, 18 bp, Homo sapiens
tgctattgtagagccaga

SEQ ID NO: 4987236 - DNA, 13 bp, Homo sapiens
tgctccagcctgg

SEQ ID NO: 4987237 - DNA, 16 bp, Homo sapiens
tgctggcctcaggctg

SEQ ID NO: 4987238 - DNA, 19 bp, Homo sapiens
actcaagtgccattcatcc

SEQ ID NO: 4987239 - DNA, 13 bp, Homo sapiens
actcatctttccc

SEQ ID NO: 4987240 - DNA, 17 bp, Homo sapiens
actcatctttccctcct

SEQ ID NO: 4987241 - DNA, 20 bp, Homo sapiens
actcatctttccctccttgg

SEQ ID NO: 4987242 - DNA, 15 bp, Homo sapiens
actctatgatgattg

SEQ ID NO: 4987243 - DNA, 17 bp, Homo sapiens
actctatgatgattgct

SEQ ID NO: 4987244 - DNA, 13 bp, Homo sapiens
actgagatccaga

SEQ ID NO: 4987245 - DNA, 20 bp, Homo sapiens
actgagatccagagaggctg

SEQ ID NO: 4987246 - DNA, 21 bp, Homo sapiens
actgatcatgtttatgagaaa

SEQ ID NO: 4987247 - DNA, 22 bp, Homo sapiens
actgattccagcaagaccaaat

SEQ ID NO: 4987248 - DNA, 13 bp, Homo sapiens
actggcaaagcag

SEQ ID NO: 4987249 - DNA, 16 bp, Homo sapiens
actgggtgtaaacaca

SEQ ID NO: 4987250 - DNA, 18 bp, Homo sapiens
actgtgctccagcctggg

SEQ ID NO: 4987251 - DNA, 11 bp, Homo sapiens
acttaagactt

SEQ ID NO: 4987252 - DNA, 18 bp, Homo sapiens
acttatttttttcccaag

SEQ ID NO: 4987253 - DNA, 14 bp, Homo sapiens
acttttgcaaataa

SEQ ID NO: 4987254 - DNA, 12 bp, Homo sapiens
agaaacagaaga

SEQ ID NO: 4987255 - DNA, 18 bp, Homo sapiens
agaaacattctttcctaa

SEQ ID NO: 4987256 - DNA, 22 bp, Homo sapiens
agaaactggcaaagcagaatgt

SEQ ID NO: 4987257 - DNA, 22 bp, Homo sapiens
agaaagttgcaaggcaaatgtt

SEQ ID NO: 4987258 - DNA, 18 bp, Homo sapiens
agaacattcaatcttgcc

SEQ ID NO: 4987259 - DNA, 16 bp, Homo sapiens
agaagattacaaaagc

SEQ ID NO: 4987260 - DNA, 17 bp, Homo sapiens
agaagcatcaccatgca

SEQ ID NO: 4987261 - DNA, 23 bp, Homo sapiens
agaagcatcaccatgcatggtgg

SEQ ID NO: 4987262 - DNA, 22 bp, Homo sapiens
agaagtggagagaaaatacaaa

SEQ ID NO: 4987263 - DNA, 22 bp, Homo sapiens
agaataggcactttaaaacact

SEQ ID NO: 4987264 - DNA, 16 bp, Homo sapiens
agaatgtcagtatgtg

SEQ ID NO: 4987265 - DNA, 17 bp, Homo sapiens
agaattgacattgaaat

SEQ ID NO: 4987266 - DNA, 18 bp, Homo sapiens
agaattgacattgaaatc

SEQ ID NO: 4987267 - DNA, 16 bp, Homo sapiens
agacagaaacagagag

SEQ ID NO: 4987268 - DNA, 17 bp, Homo sapiens
agacagagagagactga

SEQ ID NO: 4987269 - DNA, 19 bp, Homo sapiens
agaccaaatcattgtatca

SEQ ID NO: 4987270 - DNA, 16 bp, Homo sapiens
agactaatagagacac

SEQ ID NO: 4987271 - DNA, 17 bp, Homo sapiens
agactggcgtgaaccca

SEQ ID NO: 4987272 - DNA, 22 bp, Homo sapiens
agactggcgtgaacccaggagg

SEQ ID NO: 4987273 - DNA, 13 bp, Homo sapiens
agagacacagaga

SEQ ID NO: 4987274 - DNA, 19 bp, Homo sapiens
agagactcaaagagactcc

SEQ ID NO: 4987275 - DNA, 13 bp, Homo sapiens
agagagacagaga

SEQ ID NO: 4987276 - DNA, 12 bp, Homo sapiens
agagagagactg

SEQ ID NO: 4987277 - DNA, 13 bp, Homo sapiens
agagaggctggat

SEQ ID NO: 4987278 - DNA, 14 bp, Homo sapiens
agagatatgcacac

SEQ ID NO: 4987279 - DNA, 20 bp, Homo sapiens
agaggacagtatttgtgggg

SEQ ID NO: 4987280 - DNA, 16 bp, Homo sapiens
agaggctggatgactt

SEQ ID NO: 4987281 - DNA, 13 bp, Homo sapiens
agaggtggggagg

SEQ ID NO: 4987282 - DNA, 21 bp, Homo sapiens
agagtatcagttgcaggtgcc

SEQ ID NO: 4987283 - DNA, 14 bp, Homo sapiens
agagtcctggccct

SEQ ID NO: 4987284 - DNA, 16 bp, Homo sapiens
agagtggaataagaca

SEQ ID NO: 4987285 - DNA, 13 bp, Homo sapiens
agagtggctgggg

SEQ ID NO: 4987286 - DNA, 12 bp, Homo sapiens
agatataccaag

SEQ ID NO: 4987287 - DNA, 16 bp, Homo sapiens
agatgagaggcagagg

SEQ ID NO: 4987288 - DNA, 21 bp, Homo sapiens
agatggaatagaaaagatgag

SEQ ID NO: 4987289 - DNA, 22 bp, Homo sapiens
agatggaatagaaaagatgaga

SEQ ID NO: 4987290 - DNA, 23 bp, Homo sapiens
agatggtcacacagagatacgca

SEQ ID NO: 4987291 - DNA, 13 bp, Homo sapiens
agatgtatgcaca

SEQ ID NO: 4987292 - DNA, 18 bp, Homo sapiens
agatgtatgcacacacat

SEQ ID NO: 4987293 - DNA, 23 bp, Homo sapiens
agatgtatgcacacacatatatt

SEQ ID NO: 4987294 - DNA, 21 bp, Homo sapiens
agattcttgctgtgacccaag

SEQ ID NO: 4987295 - DNA, 16 bp, Homo sapiens
agcaaagcgctaagta

SEQ ID NO: 4987296 - DNA, 16 bp, Homo sapiens
agcacatgattttctt

SEQ ID NO: 4987297 - DNA, 11 bp, Homo sapiens
agcagacacat

SEQ ID NO: 4987298 - DNA, 21 bp, Homo sapiens
agcatggtagtggcaaagaga

SEQ ID NO: 4987299 - DNA, 13 bp, Homo sapiens
agcattttaaaca

SEQ ID NO: 4987300 - DNA, 15 bp, Homo sapiens
agcattttaaacaaa

SEQ ID NO: 4987301 - DNA, 20 bp, Homo sapiens
agcattttaaacaaaataga

SEQ ID NO: 4987302 - DNA, 15 bp, Homo sapiens
agccaaaactgagca

SEQ ID NO: 4987303 - DNA, 18 bp, Homo sapiens
agccctgaacatttcatg

SEQ ID NO: 4987304 - DNA, 17 bp, Homo sapiens
agcctctgttttgatat

SEQ ID NO: 4987305 - DNA, 14 bp, Homo sapiens
agcgctaagtaaaa

SEQ ID NO: 4987306 - DNA, 18 bp, Homo sapiens
agcgctaagtaaaaatat

SEQ ID NO: 4987307 - DNA, 19 bp, Homo sapiens
agctaattctttgacctgt

SEQ ID NO: 4987308 - DNA, 20 bp, Homo sapiens
agctaggtgacatatacata

SEQ ID NO: 4987309 - DNA, 13 bp, Homo sapiens
agctagtgattta

SEQ ID NO: 4987310 - DNA, 21 bp, Homo sapiens
agctagtgatttacacaggtt

SEQ ID NO: 4987311 - DNA, 20 bp, Homo sapiens
agctatggcccatctgtatg

SEQ ID NO: 4987312 - DNA, 15 bp, Homo sapiens
agctggggatgtctc

SEQ ID NO: 4987313 - DNA, 21 bp, Homo sapiens
aggaaaattattctataattt

SEQ ID NO: 4987314 - DNA, 19 bp, Homo sapiens
aggaagaggggtcttttat

SEQ ID NO: 4987315 - DNA, 21 bp, Homo sapiens
aggaagcacaggtccaaggct

SEQ ID NO: 4987316 - DNA, 22 bp, Homo sapiens
aggaagcacaggtccaaggctg

SEQ ID NO: 4987317 - DNA, 17 bp, Homo sapiens
aggacatggagagagac

SEQ ID NO: 4987318 - DNA, 18 bp, Homo sapiens
aggacatggagagagact

SEQ ID NO: 4987319 - DNA, 19 bp, Homo sapiens
aggactccaggcagcagac

SEQ ID NO: 4987320 - DNA, 18 bp, Homo sapiens
aggagataacatttcaac

SEQ ID NO: 4987321 - DNA, 17 bp, Homo sapiens
aggagggatgttccagt

SEQ ID NO: 4987322 - DNA, 18 bp, Homo sapiens
aggagggatgttccagtg

SEQ ID NO: 4987323 - DNA, 16 bp, Homo sapiens
aggagggcatgggagg

SEQ ID NO: 4987324 - DNA, 21 bp, Homo sapiens
aggagtccctgccatcatgtt

SEQ ID NO: 4987325 - DNA, 17 bp, Homo sapiens
aggcagaggcagacagg

SEQ ID NO: 4987326 - DNA, 15 bp, Homo sapiens
aggcgctggacagag

SEQ ID NO: 4987327 - DNA, 18 bp, Homo sapiens
aggctgaggcaggagact

SEQ ID NO: 4987328 - DNA, 16 bp, Homo sapiens
aggctgaggcgggtgg

SEQ ID NO: 4987329 - DNA, 17 bp, Homo sapiens
agggactcatctttccc

SEQ ID NO: 4987330 - DNA, 19 bp, Homo sapiens
agggactcatctttccctc

SEQ ID NO: 4987331 - DNA, 22 bp, Homo sapiens
agggactcatctttccctcctt

SEQ ID NO: 4987332 - DNA, 23 bp, Homo sapiens
agggactcatctttccctccttg

SEQ ID NO: 4987333 - DNA, 13 bp, Homo sapiens
agggagacagaga

SEQ ID NO: 4987334 - DNA, 12 bp, Homo sapiens
agggatgttcca

SEQ ID NO: 4987335 - DNA, 22 bp, Homo sapiens
agggatttggggctcagagtgg

SEQ ID NO: 4987336 - DNA, 17 bp, Homo sapiens
agggccaccaggaagca

SEQ ID NO: 4987337 - DNA, 19 bp, Homo sapiens
aggtaatgaccatgaaaga

SEQ ID NO: 4987338 - DNA, 20 bp, Homo sapiens
aggtaatgaccatgaaagac

SEQ ID NO: 4987339 - DNA, 21 bp, Homo sapiens
aggtcaggagatcgagaccat

SEQ ID NO: 4987340 - DNA, 23 bp, Homo sapiens
aggttgggagaatgtcagtatgt

SEQ ID NO: 4987341 - DNA, 15 bp, Homo sapiens
agtaaccaatttctt

SEQ ID NO: 4987342 - DNA, 20 bp, Homo sapiens
agtaaccaatttctttctaa

SEQ ID NO: 4987343 - DNA, 19 bp, Homo sapiens
agtaataaatgaatgtcac

SEQ ID NO: 4987344 - DNA, 22 bp, Homo sapiens
agtaatttggaaattaggttga

SEQ ID NO: 4987345 - DNA, 15 bp, Homo sapiens
agtatagaaaatctt

SEQ ID NO: 4987346 - DNA, 16 bp, Homo sapiens
agtatagaaaatcttc

SEQ ID NO: 4987347 - DNA, 21 bp, Homo sapiens
agtcctggcccttgatgccca

SEQ ID NO: 4987348 - DNA, 19 bp, Homo sapiens
agtctagttacctactttt

SEQ ID NO: 4987349 - DNA, 11 bp, Homo sapiens
agtctgattta

SEQ ID NO: 4987350 - DNA, 12 bp, Homo sapiens
agtctgatttaa

SEQ ID NO: 4987351 - DNA, 17 bp, Homo sapiens
agtgaataacctgagga

SEQ ID NO: 4987352 - DNA, 14 bp, Homo sapiens
agtgaggatgtctg

SEQ ID NO: 4987353 - DNA, 14 bp, Homo sapiens
agtgccacaaagct

SEQ ID NO: 4987354 - DNA, 15 bp, Homo sapiens
agtgccacaaagctc

SEQ ID NO: 4987355 - DNA, 13 bp, Homo sapiens
agtgctactttgc

SEQ ID NO: 4987356 - DNA, 16 bp, Homo sapiens
agtggctggggcatgg

SEQ ID NO: 4987357 - DNA, 23 bp, Homo sapiens
agtgtgatgtatgtgtaataaat

SEQ ID NO: 4987358 - DNA, 16 bp, Homo sapiens
agttaataataatgac

SEQ ID NO: 4987359 - DNA, 20 bp, Homo sapiens
agttaatggggtagaggagg

SEQ ID NO: 4987360 - DNA, 18 bp, Homo sapiens
agttcataaatttatggt

SEQ ID NO: 4987361 - DNA, 20 bp, Homo sapiens
agttgattgcgagaattttc

SEQ ID NO: 4987362 - DNA, 22 bp, Homo sapiens
agttgcaggtgccaatgactaa

SEQ ID NO: 4987363 - DNA, 13 bp, Homo sapiens
agttgttctgaaa

SEQ ID NO: 4987364 - DNA, 22 bp, Homo sapiens
agtttagccctgaacatttcat

SEQ ID NO: 4987365 - DNA, 13 bp, Homo sapiens
agtttataaaagt

SEQ ID NO: 4987366 - DNA, 21 bp, Homo sapiens
agtttgaattcctaaaattat

SEQ ID NO: 4987367 - DNA, 16 bp, Homo sapiens
ataaagcattttgcaa

SEQ ID NO: 4987368 - DNA, 12 bp, Homo sapiens
ataaatgaatgt

SEQ ID NO: 4987369 - DNA, 17 bp, Homo sapiens
tcaattaccagaaagat

SEQ ID NO: 4987370 - DNA, 18 bp, Homo sapiens
tcactattcatcaatgaa

SEQ ID NO: 4987371 - DNA, 17 bp, Homo sapiens
tcagacaattcagaagc

SEQ ID NO: 4987372 - DNA, 13 bp, Homo sapiens
tcagacacagatt

SEQ ID NO: 4987373 - DNA, 20 bp, Homo sapiens
tcagatcattatcagcctgt

SEQ ID NO: 4987374 - DNA, 19 bp, Homo sapiens
tcagattcttgctgtgacc

SEQ ID NO: 4987375 - DNA, 17 bp, Homo sapiens
tcagatttgccttattg

SEQ ID NO: 4987376 - DNA, 22 bp, Homo sapiens
tcagatttgccttattggcagc

SEQ ID NO: 4987377 - DNA, 23 bp, Homo sapiens
tcagcagcaacaactgtcagttc

SEQ ID NO: 4987378 - DNA, 23 bp, Homo sapiens
tcagggactcatctttccctcct

SEQ ID NO: 4987379 - DNA, 19 bp, Homo sapiens
tcaggttttcttttaagaa

SEQ ID NO: 4987380 - DNA, 20 bp, Homo sapiens
tcaggttttcttttaagaat

SEQ ID NO: 4987381 - DNA, 23 bp, Homo sapiens
tcaggttttcttttaagaatcaa

SEQ ID NO: 4987382 - DNA, 12 bp, Homo sapiens
tcagtatgtgga

SEQ ID NO: 4987383 - DNA, 14 bp, Homo sapiens
tcagtatgtggaag

SEQ ID NO: 4987384 - DNA, 19 bp, Homo sapiens
tcagtctgcttagaaataa

SEQ ID NO: 4987385 - DNA, 21 bp, Homo sapiens
tcagtctgcttagaaataaca

SEQ ID NO: 4987386 - DNA, 19 bp, Homo sapiens
tcagtgcacacggatgcac

SEQ ID NO: 4987387 - DNA, 22 bp, Homo sapiens
tcataatttcagttctagttga

SEQ ID NO: 4987388 - DNA, 12 bp, Homo sapiens
tcatacattata

SEQ ID NO: 4987389 - DNA, 22 bp, Homo sapiens
tcatcaatgaagattaacactg

SEQ ID NO: 4987390 - DNA, 19 bp, Homo sapiens
tcatctttccctccttggt

SEQ ID NO: 4987391 - DNA, 22 bp, Homo sapiens
tcatgatagaaggctatgggga

SEQ ID NO: 4987392 - DNA, 13 bp, Homo sapiens
tcatgtcttttta

SEQ ID NO: 4987393 - DNA, 14 bp, Homo sapiens
tcattaaacgtcat

SEQ ID NO: 4987394 - DNA, 21 bp, Homo sapiens
tcattcgtggttgatttcaat

SEQ ID NO: 4987395 - DNA, 13 bp, Homo sapiens
tcatttgttcatt

SEQ ID NO: 4987396 - DNA, 15 bp, Homo sapiens
tccacttttaaaact

SEQ ID NO: 4987397 - DNA, 17 bp, Homo sapiens
tccaggcagcagacaca

SEQ ID NO: 4987398 - DNA, 18 bp, Homo sapiens
tccaggcagcagacacat

SEQ ID NO: 4987399 - DNA, 13 bp, Homo sapiens
tccagtggatgag

SEQ ID NO: 4987400 - DNA, 12 bp, Homo sapiens
tcccccagtgcg

SEQ ID NO: 4987401 - DNA, 13 bp, Homo sapiens
tccctgatttaat

SEQ ID NO: 4987402 - DNA, 14 bp, Homo sapiens
tccgcagtgagaga

SEQ ID NO: 4987403 - DNA, 16 bp, Homo sapiens
tccgtagttttgataa

SEQ ID NO: 4987404 - DNA, 12 bp, Homo sapiens
tcctaaaacaac

SEQ ID NO: 4987405 - DNA, 16 bp, Homo sapiens
tcctaaaacaacagat

SEQ ID NO: 4987406 - DNA, 20 bp, Homo sapiens
tcctaatgtgctgtgtgaca

SEQ ID NO: 4987407 - DNA, 18 bp, Homo sapiens
tcctaggaggtaatgacc

SEQ ID NO: 4987408 - DNA, 14 bp, Homo sapiens
tcctattccttggt

SEQ ID NO: 4987409 - DNA, 18 bp, Homo sapiens
tcctcatttgttcattaa

SEQ ID NO: 4987410 - DNA, 19 bp, Homo sapiens
tcctgaaatctacaggcct

SEQ ID NO: 4987411 - DNA, 19 bp, Homo sapiens
tcctgagagctgcatgtgt

SEQ ID NO: 4987412 - DNA, 20 bp, Homo sapiens
tcgacgtttgactagccatc

SEQ ID NO: 4987413 - DNA, 23 bp, Homo sapiens
tcgggaggctgaggcaggagact

SEQ ID NO: 4987414 - DNA, 19 bp, Homo sapiens
tctagtagttgttctgaaa

SEQ ID NO: 4987415 - DNA, 11 bp, Homo sapiens
tctagtgaatg

SEQ ID NO: 4987416 - DNA, 14 bp, Homo sapiens
tctagtgttttcaa

SEQ ID NO: 4987417 - DNA, 17 bp, Homo sapiens
tctagttacctactttt

SEQ ID NO: 4987418 - DNA, 22 bp, Homo sapiens
tctagttgattgcgagaatttt

SEQ ID NO: 4987419 - DNA, 15 bp, Homo sapiens
tctatgatgattgct

SEQ ID NO: 4987420 - DNA, 17 bp, Homo sapiens
tctattaaggacattta

SEQ ID NO: 4987421 - DNA, 15 bp, Homo sapiens
tctcaagcaagttta

SEQ ID NO: 4987422 - DNA, 22 bp, Homo sapiens
tctcctgaaatctacaggcctc

SEQ ID NO: 4987423 - DNA, 21 bp, Homo sapiens
tctcttatcttacgaaaaaat

SEQ ID NO: 4987424 - DNA, 23 bp, Homo sapiens
tctgaggacatggagagagactc

SEQ ID NO: 4987425 - DNA, 12 bp, Homo sapiens
tctgcttagaaa

SEQ ID NO: 4987426 - DNA, 16 bp, Homo sapiens
tctggatatcaaggtg

SEQ ID NO: 4987427 - DNA, 11 bp, Homo sapiens
tctgtgtgtgt

SEQ ID NO: 4987428 - DNA, 18 bp, Homo sapiens
tctgtgtgtgtgtatgtg

SEQ ID NO: 4987429 - DNA, 19 bp, Homo sapiens
tctgtgtgtgtgtatgtgg

SEQ ID NO: 4987430 - DNA, 22 bp, Homo sapiens
tcttaaaaacaacgaaagaagg

SEQ ID NO: 4987431 - DNA, 13 bp, Homo sapiens
tcttctcggggac

SEQ ID NO: 4987432 - DNA, 21 bp, Homo sapiens
tcttctgtatgtgacaacatt

SEQ ID NO: 4987433 - DNA, 22 bp, Homo sapiens
tcttgccgtcactattcatcaa

SEQ ID NO: 4987434 - DNA, 23 bp, Homo sapiens
tcttgtggttataacttaatgaa

SEQ ID NO: 4987435 - DNA, 12 bp, Homo sapiens
tctttcatacat

SEQ ID NO: 4987436 - DNA, 14 bp, Homo sapiens
tctttcatacatta

SEQ ID NO: 4987437 - DNA, 15 bp, Homo sapiens
tctttcatacattat

SEQ ID NO: 4987438 - DNA, 22 bp, Homo sapiens
tgaaacatatctcttatcttac

SEQ ID NO: 4987439 - DNA, 22 bp, Homo sapiens
tgaaatcatatagaaaggctgg

SEQ ID NO: 4987440 - DNA, 15 bp, Homo sapiens
tgaaatctaggaaaa

SEQ ID NO: 4987441 - DNA, 19 bp, Homo sapiens
tgaaatctaggaaaattat

SEQ ID NO: 4987442 - DNA, 17 bp, Homo sapiens
tgaaatgtcagttctga

SEQ ID NO: 4987443 - DNA, 20 bp, Homo sapiens
tgaaatgtcagttctgatat

SEQ ID NO: 4987444 - DNA, 19 bp, Homo sapiens
tgaacacacatggatgcac

SEQ ID NO: 4987445 - DNA, 20 bp, Homo sapiens
tgaactgatcatgtttatga

SEQ ID NO: 4987446 - DNA, 20 bp, Homo sapiens
tgaagagaagggcagggctg

SEQ ID NO: 4987447 - DNA, 22 bp, Homo sapiens
tgaagagaagggcagggctgag

SEQ ID NO: 4987448 - DNA, 14 bp, Homo sapiens
tgaagattaacact

SEQ ID NO: 4987449 - DNA, 18 bp, Homo sapiens
tgaagattaacactgaga

SEQ ID NO: 4987450 - DNA, 12 bp, Homo sapiens
gtgccaatgact

SEQ ID NO: 4987451 - DNA, 14 bp, Homo sapiens
gtgccttttgccat

SEQ ID NO: 4987452 - DNA, 14 bp, Homo sapiens
gtgcgcacacacag

SEQ ID NO: 4987453 - DNA, 21 bp, Homo sapiens
gtgctgagtgtacagagtgga

SEQ ID NO: 4987454 - DNA, 23 bp, Homo sapiens
gtggaaatggcccatttaatgat

SEQ ID NO: 4987455 - DNA, 17 bp, Homo sapiens
gtggaagaagggaagcc

SEQ ID NO: 4987456 - DNA, 21 bp, Homo sapiens
gtggaagtgtgggtctgtgtg

SEQ ID NO: 4987457 - DNA, 23 bp, Homo sapiens
gtggatgagggccaccaggaagc

SEQ ID NO: 4987458 - DNA, 14 bp, Homo sapiens
gtgggggtctgtgt

SEQ ID NO: 4987459 - DNA, 16 bp, Homo sapiens
gtgggtctgtgtgtgt

SEQ ID NO: 4987460 - DNA, 12 bp, Homo sapiens
gtggttgatttc

SEQ ID NO: 4987461 - DNA, 16 bp, Homo sapiens
gtggttgatttcaata

SEQ ID NO: 4987462 - DNA, 14 bp, Homo sapiens
gtgtaaacacatct

SEQ ID NO: 4987463 - DNA, 13 bp, Homo sapiens
gtgtatgtggggg

SEQ ID NO: 4987464 - DNA, 14 bp, Homo sapiens
gtgtgggtctgtgt

SEQ ID NO: 4987465 - DNA, 13 bp, Homo sapiens
gtgtgtatgtggg

SEQ ID NO: 4987466 - DNA, 20 bp, Homo sapiens
gtgtgtcacccttaggccag

SEQ ID NO: 4987467 - DNA, 12 bp, Homo sapiens
gtgtgttgtgtg

SEQ ID NO: 4987468 - DNA, 17 bp, Homo sapiens
gtgtgttgtgtgtggga

SEQ ID NO: 4987469 - DNA, 14 bp, Homo sapiens
gtgtgtttatgtgt

SEQ ID NO: 4987470 - DNA, 16 bp, Homo sapiens
gtgtgtttatgtgtgt

SEQ ID NO: 4987471 - DNA, 14 bp, Homo sapiens
gttaaaaagaaaag

SEQ ID NO: 4987472 - DNA, 22 bp, Homo sapiens
gttaaaaagaaaagtttataaa

SEQ ID NO: 4987473 - DNA, 14 bp, Homo sapiens
gttcataatttcag

SEQ ID NO: 4987474 - DNA, 15 bp, Homo sapiens
gttccagtggatgag

SEQ ID NO: 4987475 - DNA, 23 bp, Homo sapiens
gttccagtggatgagggccacca

SEQ ID NO: 4987476 - DNA, 20 bp, Homo sapiens
gttctgaaatgtcagttctg

SEQ ID NO: 4987477 - DNA, 21 bp, Homo sapiens
gttgggagaatgtcagtatgt

SEQ ID NO: 4987478 - DNA, 14 bp, Homo sapiens
gttgtgtgtgggag

SEQ ID NO: 4987479 - DNA, 16 bp, Homo sapiens
gttgtgtgtgggagtg

SEQ ID NO: 4987480 - DNA, 16 bp, Homo sapiens
gtttatgtgtgtgtgt

SEQ ID NO: 4987481 - DNA, 15 bp, Homo sapiens
gtttcacacaaacaa

SEQ ID NO: 4987482 - DNA, 20 bp, Homo sapiens
gtttgactagccatctcaag

SEQ ID NO: 4987483 - DNA, 13 bp, Homo sapiens
gtttgtaagaaaa

SEQ ID NO: 4987484 - DNA, 18 bp, Homo sapiens
gttttcaattttaaacat

SEQ ID NO: 4987485 - DNA, 20 bp, Homo sapiens
gttttcaattttaaacatat

SEQ ID NO: 4987486 - DNA, 19 bp, Homo sapiens
taaaacaacagatgtacga

SEQ ID NO: 4987487 - DNA, 22 bp, Homo sapiens
taaaagtctagttacctacttt

SEQ ID NO: 4987488 - DNA, 18 bp, Homo sapiens
taaaataagtctgattta

SEQ ID NO: 4987489 - DNA, 18 bp, Homo sapiens
taaaatagcacatgattt

SEQ ID NO: 4987490 - DNA, 16 bp, Homo sapiens
taaaattatggaaaca

SEQ ID NO: 4987491 - DNA, 16 bp, Homo sapiens
taaacaaaatagaaag

SEQ ID NO: 4987492 - DNA, 18 bp, Homo sapiens
taaacaaaatagaaagtt

SEQ ID NO: 4987493 - DNA, 20 bp, Homo sapiens
taaacatatccaagtttgaa

SEQ ID NO: 4987494 - DNA, 22 bp, Homo sapiens
taaagcaaagcgctaagtaaaa

SEQ ID NO: 4987495 - DNA, 13 bp, Homo sapiens
taaattacattaa

SEQ ID NO: 4987496 - DNA, 18 bp, Homo sapiens
taaccaatttctttctaa

SEQ ID NO: 4987497 - DNA, 15 bp, Homo sapiens
taactaaggaaatat

SEQ ID NO: 4987498 - DNA, 15 bp, Homo sapiens
taacttaatgaaaac

SEQ ID NO: 4987499 - DNA, 17 bp, Homo sapiens
taagctatggcccatct

SEQ ID NO: 4987500 - DNA, 20 bp, Homo sapiens
taaggaagaggggtctttta

SEQ ID NO: 4987501 - DNA, 22 bp, Homo sapiens
taagtgccaggatggaatgatg

SEQ ID NO: 4987502 - DNA, 13 bp, Homo sapiens
taagttaataata

SEQ ID NO: 4987503 - DNA, 15 bp, Homo sapiens
taatatgcaaagtct

SEQ ID NO: 4987504 - DNA, 17 bp, Homo sapiens
taatattactctatgat

SEQ ID NO: 4987505 - DNA, 13 bp, Homo sapiens
taatatttttcct

SEQ ID NO: 4987506 - DNA, 16 bp, Homo sapiens
taatgaggcattacaa

SEQ ID NO: 4987507 - DNA, 20 bp, Homo sapiens
taatttactgattccagcaa

SEQ ID NO: 4987508 - DNA, 12 bp, Homo sapiens
tacaaatgtttt

SEQ ID NO: 4987509 - DNA, 21 bp, Homo sapiens
tacaaggatcagattcttgct

SEQ ID NO: 4987510 - DNA, 20 bp, Homo sapiens
tacagagtggaataagacag

SEQ ID NO: 4987511 - DNA, 16 bp, Homo sapiens
tacatgtgtgtatatg

SEQ ID NO: 4987512 - DNA, 19 bp, Homo sapiens
tacattaaagatttctgct

SEQ ID NO: 4987513 - DNA, 14 bp, Homo sapiens
tacattatgttatt

SEQ ID NO: 4987514 - DNA, 21 bp, Homo sapiens
tacattatgttattggaattt

SEQ ID NO: 4987515 - DNA, 19 bp, Homo sapiens
tacccatcttaaaaacaac

SEQ ID NO: 4987516 - DNA, 18 bp, Homo sapiens
tactctatgatgattgct

SEQ ID NO: 4987517 - DNA, 13 bp, Homo sapiens
tactgtttcagtc

SEQ ID NO: 4987518 - DNA, 12 bp, Homo sapiens
tacttaagactt

SEQ ID NO: 4987519 - DNA, 20 bp, Homo sapiens
tagaagttctagtgttttca

SEQ ID NO: 4987520 - DNA, 22 bp, Homo sapiens
tagaataggcactttaaaacac

SEQ ID NO: 4987521 - DNA, 21 bp, Homo sapiens
tagaggcatgaacacacatgg

SEQ ID NO: 4987522 - DNA, 18 bp, Homo sapiens
tagagtgtgatgtatgtg

SEQ ID NO: 4987523 - DNA, 21 bp, Homo sapiens
tagagtttagccctgaacatt

SEQ ID NO: 4987524 - DNA, 13 bp, Homo sapiens
tagcacatgattt

SEQ ID NO: 4987525 - DNA, 16 bp, Homo sapiens
tagcattttaaacaaa

SEQ ID NO: 4987526 - DNA, 15 bp, Homo sapiens
ccatttaatgattga

SEQ ID NO: 4987527 - DNA, 20 bp, Homo sapiens
ccctcaagagcaaagtagat

SEQ ID NO: 4987528 - DNA, 15 bp, Homo sapiens
ccctctgtatacaag

SEQ ID NO: 4987529 - DNA, 23 bp, Homo sapiens
ccctgattttatcattctgcttc

SEQ ID NO: 4987530 - DNA, 15 bp, Homo sapiens
ccctggcctgtggag

SEQ ID NO: 4987531 - DNA, 13 bp, Homo sapiens
cctattccttggt

SEQ ID NO: 4987532 - DNA, 20 bp, Homo sapiens
cctcctgggattggctgtga

SEQ ID NO: 4987533 - DNA, 16 bp, Homo sapiens
cctccttggtgattcc

SEQ ID NO: 4987534 - DNA, 18 bp, Homo sapiens
cctctcattccagaggaa

SEQ ID NO: 4987535 - DNA, 21 bp, Homo sapiens
cctgaaatcatatagaaaggc

SEQ ID NO: 4987536 - DNA, 19 bp, Homo sapiens
cctgaggaagagggactgt

SEQ ID NO: 4987537 - DNA, 17 bp, Homo sapiens
cctgggcaacagagcaa

SEQ ID NO: 4987538 - DNA, 16 bp, Homo sapiens
ccttggggaaatgtgg

SEQ ID NO: 4987539 - DNA, 14 bp, Homo sapiens
cctttgtcccagaa

SEQ ID NO: 4987540 - DNA, 11 bp, Homo sapiens
ccttttgcaaa

SEQ ID NO: 4987541 - DNA, 12 bp, Homo sapiens
cgaaagaaggca

SEQ ID NO: 4987542 - DNA, 13 bp, Homo sapiens
cgaactgtcctgg

SEQ ID NO: 4987543 - DNA, 19 bp, Homo sapiens
cgctaagtaaaaatattaa

SEQ ID NO: 4987544 - DNA, 14 bp, Homo sapiens
cgctgatcattgga

SEQ ID NO: 4987545 - DNA, 18 bp, Homo sapiens
cggatgcacacacagatg

SEQ ID NO: 4987546 - DNA, 13 bp, Homo sapiens
cggatgcacagag

SEQ ID NO: 4987547 - DNA, 13 bp, Homo sapiens
cggggacacaggc

SEQ ID NO: 4987548 - DNA, 20 bp, Homo sapiens
cggtggctcacgcctgtaat

SEQ ID NO: 4987549 - DNA, 21 bp, Homo sapiens
cgtagatttttgctcttctgt

SEQ ID NO: 4987550 - DNA, 15 bp, Homo sapiens
cgtcactattcatca

SEQ ID NO: 4987551 - DNA, 14 bp, Homo sapiens
cgtggtggcaggca

SEQ ID NO: 4987552 - DNA, 13 bp, Homo sapiens
cgtggttgatttc

SEQ ID NO: 4987553 - DNA, 13 bp, Homo sapiens
ctaaaactctcaa

SEQ ID NO: 4987554 - DNA, 22 bp, Homo sapiens
ctaaactgtagctgtattagca

SEQ ID NO: 4987555 - DNA, 21 bp, Homo sapiens
ctaaagaaacagaagattaca

SEQ ID NO: 4987556 - DNA, 16 bp, Homo sapiens
ctaactttttgaattc

SEQ ID NO: 4987557 - DNA, 14 bp, Homo sapiens
ctaagttaataata

SEQ ID NO: 4987558 - DNA, 14 bp, Homo sapiens
ctaataatcataaa

SEQ ID NO: 4987559 - DNA, 15 bp, Homo sapiens
ctacaggcctcaggg

SEQ ID NO: 4987560 - DNA, 13 bp, Homo sapiens
ctacagtaataaa

SEQ ID NO: 4987561 - DNA, 13 bp, Homo sapiens
ctactcaacaaaa

SEQ ID NO: 4987562 - DNA, 17 bp, Homo sapiens
ctactcgggaggctgag

SEQ ID NO: 4987563 - DNA, 18 bp, Homo sapiens
ctagccatctcaagcaag

SEQ ID NO: 4987564 - DNA, 15 bp, Homo sapiens
ctaggtgacatatac

SEQ ID NO: 4987565 - DNA, 19 bp, Homo sapiens
ctagtgaatgtaggctggc

SEQ ID NO: 4987566 - DNA, 18 bp, Homo sapiens
ctagtgatttacacaggt

SEQ ID NO: 4987567 - DNA, 23 bp, Homo sapiens
ctagttgattgcgagaattttca

SEQ ID NO: 4987568 - DNA, 16 bp, Homo sapiens
ctatatttatttatgt

SEQ ID NO: 4987569 - DNA, 19 bp, Homo sapiens
ctatcttaaaatatagaaa

SEQ ID NO: 4987570 - DNA, 12 bp, Homo sapiens
ctattccttggt

SEQ ID NO: 4987571 - DNA, 14 bp, Homo sapiens
ctcaaagagactcc

SEQ ID NO: 4987572 - DNA, 22 bp, Homo sapiens
ctcaaagagactccaagattca

SEQ ID NO: 4987573 - DNA, 13 bp, Homo sapiens
ctcaagcaagttt

SEQ ID NO: 4987574 - DNA, 13 bp, Homo sapiens
ctcaagttcacca

SEQ ID NO: 4987575 - DNA, 14 bp, Homo sapiens
ctcaagttcaccag

SEQ ID NO: 4987576 - DNA, 20 bp, Homo sapiens
ctcaagttcaccagcatggt

SEQ ID NO: 4987577 - DNA, 22 bp, Homo sapiens
ctcaataggagggatgttccag

SEQ ID NO: 4987578 - DNA, 18 bp, Homo sapiens
ctcatctttccctccttg

SEQ ID NO: 4987579 - DNA, 12 bp, Homo sapiens
ctcctaaaacaa

SEQ ID NO: 4987580 - DNA, 18 bp, Homo sapiens
ctcctgggattggctgtg

SEQ ID NO: 4987581 - DNA, 20 bp, Homo sapiens
ctctatgatgattgcttcca

SEQ ID NO: 4987582 - DNA, 16 bp, Homo sapiens
ctctctggacctcagt

SEQ ID NO: 4987583 - DNA, 14 bp, Homo sapiens
ctctggacctcagt

SEQ ID NO: 4987584 - DNA, 16 bp, Homo sapiens
ctctggacctcagttt

SEQ ID NO: 4987585 - DNA, 18 bp, Homo sapiens
ctgaaatcatatagaaag

SEQ ID NO: 4987586 - DNA, 20 bp, Homo sapiens
ctgaaatctacaggcctcag

SEQ ID NO: 4987587 - DNA, 23 bp, Homo sapiens
ctgaaatggggctactgtttcag

SEQ ID NO: 4987588 - DNA, 13 bp, Homo sapiens
ctgaaatgtcagt

SEQ ID NO: 4987589 - DNA, 21 bp, Homo sapiens
ctgaagagaagggcagggctg

SEQ ID NO: 4987590 - DNA, 12 bp, Homo sapiens
ctgagaggccac

SEQ ID NO: 4987591 - DNA, 18 bp, Homo sapiens
ctgagatccagagaggct

SEQ ID NO: 4987592 - DNA, 23 bp, Homo sapiens
ctgaggaagagggactgttcttt

SEQ ID NO: 4987593 - DNA, 21 bp, Homo sapiens
ctgaggacatggagagagact

SEQ ID NO: 4987594 - DNA, 23 bp, Homo sapiens
ctgaggacatggagagagactca

SEQ ID NO: 4987595 - DNA, 22 bp, Homo sapiens
ctgctgagcctcacagcagtga

SEQ ID NO: 4987596 - DNA, 13 bp, Homo sapiens
gatgacttgctca

SEQ ID NO: 4987597 - DNA, 22 bp, Homo sapiens
gatgattgcttccacccacacg

SEQ ID NO: 4987598 - DNA, 16 bp, Homo sapiens
gatgcacacacagata

SEQ ID NO: 4987599 - DNA, 21 bp, Homo sapiens
gatgggtcagttgtatcagca

SEQ ID NO: 4987600 - DNA, 21 bp, Homo sapiens
gatgtgtcctgataagctgag

SEQ ID NO: 4987601 - DNA, 16 bp, Homo sapiens
gattttcgacgtttga

SEQ ID NO: 4987602 - DNA, 13 bp, Homo sapiens
gcaaaaaaaatta

SEQ ID NO: 4987603 - DNA, 23 bp, Homo sapiens
gcaaatagtagagtatcagttgc

SEQ ID NO: 4987604 - DNA, 18 bp, Homo sapiens
gcaacaactgtcagttca

SEQ ID NO: 4987605 - DNA, 20 bp, Homo sapiens
gcaactaagttaataataat

SEQ ID NO: 4987606 - DNA, 22 bp, Homo sapiens
gcaaggtttaagttattaagag

SEQ ID NO: 4987607 - DNA, 14 bp, Homo sapiens
gcaattatgaaaat

SEQ ID NO: 4987608 - DNA, 22 bp, Homo sapiens
gcacacacacaccaatgcgcac

SEQ ID NO: 4987609 - DNA, 23 bp, Homo sapiens
gcacacacagatatacacatgga

SEQ ID NO: 4987610 - DNA, 20 bp, Homo sapiens
gcacacacagatatgcacac

SEQ ID NO: 4987611 - DNA, 11 bp, Homo sapiens
gcacaggtcca

SEQ ID NO: 4987612 - DNA, 20 bp, Homo sapiens
gcacatagagatatgcacac

SEQ ID NO: 4987613 - DNA, 20 bp, Homo sapiens
gcacatgccaatgcacgcac

SEQ ID NO: 4987614 - DNA, 19 bp, Homo sapiens
gcacgtgatctgctggcct

SEQ ID NO: 4987615 - DNA, 21 bp, Homo sapiens
gcactatttatttacaaatgt

SEQ ID NO: 4987616 - DNA, 14 bp, Homo sapiens
gcagaggcagacag

SEQ ID NO: 4987617 - DNA, 21 bp, Homo sapiens
gcagccctggcctgtggagag

SEQ ID NO: 4987618 - DNA, 16 bp, Homo sapiens
gcaggtgccaatgact

SEQ ID NO: 4987619 - DNA, 22 bp, Homo sapiens
gcataagtcctctagtgaatgt

SEQ ID NO: 4987620 - DNA, 21 bp, Homo sapiens
gcatggaaggcaagattgtgt

SEQ ID NO: 4987621 - DNA, 14 bp, Homo sapiens
gcatgggagggagg

SEQ ID NO: 4987622 - DNA, 15 bp, Homo sapiens
gccaaggttgtcctg

SEQ ID NO: 4987623 - DNA, 13 bp, Homo sapiens
gccaatgactaac

SEQ ID NO: 4987624 - DNA, 21 bp, Homo sapiens
gccaatgctacagtaataaat

SEQ ID NO: 4987625 - DNA, 23 bp, Homo sapiens
gccactacatttgctccatcctc

SEQ ID NO: 4987626 - DNA, 16 bp, Homo sapiens
gccaggatggcgcagg

SEQ ID NO: 4987627 - DNA, 14 bp, Homo sapiens
gccagtggctggat

SEQ ID NO: 4987628 - DNA, 17 bp, Homo sapiens
gccatcatgtttacaga

SEQ ID NO: 4987629 - DNA, 14 bp, Homo sapiens
gccatgtcagacac

SEQ ID NO: 4987630 - DNA, 16 bp, Homo sapiens
gcccagctcagtgcca

SEQ ID NO: 4987631 - DNA, 19 bp, Homo sapiens
gcctctcattccagaggaa

SEQ ID NO: 4987632 - DNA, 11 bp, Homo sapiens
gcctggctggg

SEQ ID NO: 4987633 - DNA, 18 bp, Homo sapiens
gctaaagaagtttgaaca

SEQ ID NO: 4987634 - DNA, 20 bp, Homo sapiens
gctaaagaagtttgaacatt

SEQ ID NO: 4987635 - DNA, 16 bp, Homo sapiens
gctaagtaaaaatatt

SEQ ID NO: 4987636 - DNA, 18 bp, Homo sapiens
gctactcgggaggctgag

SEQ ID NO: 4987637 - DNA, 14 bp, Homo sapiens
gctagaagaaaaca

SEQ ID NO: 4987638 - DNA, 22 bp, Homo sapiens
gctaggtgacatatacatactt

SEQ ID NO: 4987639 - DNA, 19 bp, Homo sapiens
gctatggggatagatgtgt

SEQ ID NO: 4987640 - DNA, 19 bp, Homo sapiens
gctcagtgccacaaagctc

SEQ ID NO: 4987641 - DNA, 17 bp, Homo sapiens
gctccatcctcctggga

SEQ ID NO: 4987642 - DNA, 23 bp, Homo sapiens
gctctgtgggttttaacattttt

SEQ ID NO: 4987643 - DNA, 19 bp, Homo sapiens
gctcttctgtatgtgacaa

SEQ ID NO: 4987644 - DNA, 22 bp, Homo sapiens
gctgagcctcacagcagtgaga

SEQ ID NO: 4987645 - DNA, 13 bp, Homo sapiens
gctgaggcaggag

SEQ ID NO: 4987646 - DNA, 21 bp, Homo sapiens
gctgaggcaggagactggcgt

SEQ ID NO: 4987647 - DNA, 14 bp, Homo sapiens
gctggggatgtctc

SEQ ID NO: 4987648 - DNA, 16 bp, Homo sapiens
gcttccgtattttaat

SEQ ID NO: 4987649 - DNA, 20 bp, Homo sapiens
ggaactgctgggcttggcag

SEQ ID NO: 4987650 - DNA, 17 bp, Homo sapiens
ggaagaagggaagcctt

SEQ ID NO: 4987651 - DNA, 23 bp, Homo sapiens
ggaagggacaccaagccttggct

SEQ ID NO: 4987652 - DNA, 12 bp, Homo sapiens
ggaagtgtgggt

SEQ ID NO: 4987653 - DNA, 19 bp, Homo sapiens
ggactcatctttccctcct

SEQ ID NO: 4987654 - DNA, 14 bp, Homo sapiens
ggagacagagacag

SEQ ID NO: 4987655 - DNA, 15 bp, Homo sapiens
ggagacagagacaga

SEQ ID NO: 4987656 - DNA, 19 bp, Homo sapiens
ggaggactccaggcagcag

SEQ ID NO: 4987657 - DNA, 12 bp, Homo sapiens
ggaggctgaggc

SEQ ID NO: 4987658 - DNA, 12 bp, Homo sapiens
ggagggatttgg

SEQ ID NO: 4987659 - DNA, 17 bp, Homo sapiens
ggagtctgaaatggggc

SEQ ID NO: 4987660 - DNA, 15 bp, Homo sapiens
ggataaattacatta

SEQ ID NO: 4987661 - DNA, 17 bp, Homo sapiens
ggatcagattcttgctg

SEQ ID NO: 4987662 - DNA, 16 bp, Homo sapiens
ggcaacagagcaagac

SEQ ID NO: 4987663 - DNA, 17 bp, Homo sapiens
ggcaacagagcaagact

SEQ ID NO: 4987664 - DNA, 23 bp, Homo sapiens
agacagaaacagagagagacaga

SEQ ID NO: 4987665 - DNA, 13 bp, Homo sapiens
agacagagagaga

SEQ ID NO: 4987666 - DNA, 19 bp, Homo sapiens
agacaggcgctggacagag

SEQ ID NO: 4987667 - DNA, 21 bp, Homo sapiens
agacaggcgctggacagaggg

SEQ ID NO: 4987668 - DNA, 15 bp, Homo sapiens
agaccatcctggcta

SEQ ID NO: 4987669 - DNA, 20 bp, Homo sapiens
agactaatagagacacagag

SEQ ID NO: 4987670 - DNA, 16 bp, Homo sapiens
agactccatagtttgg

SEQ ID NO: 4987671 - DNA, 13 bp, Homo sapiens
agactgagggaga

SEQ ID NO: 4987672 - DNA, 17 bp, Homo sapiens
agactgagggagagact

SEQ ID NO: 4987673 - DNA, 14 bp, Homo sapiens
agactggggccact

SEQ ID NO: 4987674 - DNA, 20 bp, Homo sapiens
agacttaatgagactttaaa

SEQ ID NO: 4987675 - DNA, 14 bp, Homo sapiens
agacttatcaacat

SEQ ID NO: 4987676 - DNA, 21 bp, Homo sapiens
agagaaacattctttcctaaa

SEQ ID NO: 4987677 - DNA, 18 bp, Homo sapiens
agagacagaaacagagag

SEQ ID NO: 4987678 - DNA, 18 bp, Homo sapiens
agagactcaaagagactc

SEQ ID NO: 4987679 - DNA, 20 bp, Homo sapiens
agagactgagggagagactc

SEQ ID NO: 4987680 - DNA, 21 bp, Homo sapiens
agagaggctggatgacttgct

SEQ ID NO: 4987681 - DNA, 12 bp, Homo sapiens
agagaggtccag

SEQ ID NO: 4987682 - DNA, 16 bp, Homo sapiens
agagagtggctggggc

SEQ ID NO: 4987683 - DNA, 13 bp, Homo sapiens
agagcaggccagg

SEQ ID NO: 4987684 - DNA, 21 bp, Homo sapiens
agagcaggccaggcgcggtgg

SEQ ID NO: 4987685 - DNA, 14 bp, Homo sapiens
agaggagggcatgg

SEQ ID NO: 4987686 - DNA, 24 bp, Homo sapiens
agaggcatgaacacacatggatgc

SEQ ID NO: 4987687 - DNA, 17 bp, Homo sapiens
agaggctggatgacttg

SEQ ID NO: 4987688 - DNA, 23 bp, Homo sapiens
agaggctggatgacttgctcaag

SEQ ID NO: 4987689 - DNA, 17 bp, Homo sapiens
agaggggcaggggagtg

SEQ ID NO: 4987690 - DNA, 16 bp, Homo sapiens
agaggtccagagtcct

SEQ ID NO: 4987691 - DNA, 23 bp, Homo sapiens
agaggtggggagggagacagaga

SEQ ID NO: 4987692 - DNA, 17 bp, Homo sapiens
agagtatcagttgcagg

SEQ ID NO: 4987693 - DNA, 13 bp, Homo sapiens
agagtcctggccc

SEQ ID NO: 4987694 - DNA, 20 bp, Homo sapiens
agagtgtgatgtatgtgtaa

SEQ ID NO: 4987695 - DNA, 19 bp, Homo sapiens
agatatgcacacacagatg

SEQ ID NO: 4987696 - DNA, 18 bp, Homo sapiens
agatccagagaggctgga

SEQ ID NO: 4987697 - DNA, 21 bp, Homo sapiens
agatccagagaggctggatga

SEQ ID NO: 4987698 - DNA, 23 bp, Homo sapiens
agatgcacacacaccgatgctga

SEQ ID NO: 4987699 - DNA, 17 bp, Homo sapiens
agatggaatagaaaaga

SEQ ID NO: 4987700 - DNA, 14 bp, Homo sapiens
agattacaaaagca

SEQ ID NO: 4987701 - DNA, 14 bp, Homo sapiens
agattgctcaaatc

SEQ ID NO: 4987702 - DNA, 18 bp, Homo sapiens
agcaacaactgtcagttc

SEQ ID NO: 4987703 - DNA, 23 bp, Homo sapiens
agcaagaccaaatcattgtatca

SEQ ID NO: 4987704 - DNA, 19 bp, Homo sapiens
aaaaagttgttttatccat

SEQ ID NO: 4987705 - DNA, 15 bp, Homo sapiens
aaaaatattaactga

SEQ ID NO: 4987706 - DNA, 19 bp, Homo sapiens
aaaaatggtagcattttaa

SEQ ID NO: 4987707 - DNA, 20 bp, Homo sapiens
aaaaatggtagcattttaaa

SEQ ID NO: 4987708 - DNA, 13 bp, Homo sapiens
aaaaatgttggaa

SEQ ID NO: 4987709 - DNA, 13 bp, Homo sapiens
aaaactaatctaa

SEQ ID NO: 4987710 - DNA, 14 bp, Homo sapiens
aaaactaatctaaa

SEQ ID NO: 4987711 - DNA, 21 bp, Homo sapiens
aaaactatttatgaatattaa

SEQ ID NO: 4987712 - DNA, 13 bp, Homo sapiens
aaaactgagcata

SEQ ID NO: 4987713 - DNA, 16 bp, Homo sapiens
aaaagtccacttttaa

SEQ ID NO: 4987714 - DNA, 15 bp, Homo sapiens
aaaatcttcatggaa

SEQ ID NO: 4987715 - DNA, 15 bp, Homo sapiens
aaaatgttggaatgg

SEQ ID NO: 4987716 - DNA, 17 bp, Homo sapiens
acaggtccaaggctggt

SEQ ID NO: 4987717 - DNA, 12 bp, Homo sapiens
acaggtgccttg

SEQ ID NO: 4987718 - DNA, 23 bp, Homo sapiens
acagtgagagactccatagtttg

SEQ ID NO: 4987719 - DNA, 18 bp, Homo sapiens
acatagagatatgcacac

SEQ ID NO: 4987720 - DNA, 17 bp, Homo sapiens
acatatacatacttaca

SEQ ID NO: 4987721 - DNA, 19 bp, Homo sapiens
acatatattttttaaaata

SEQ ID NO: 4987722 - DNA, 18 bp, Homo sapiens
acatctggatatcaaggt

SEQ ID NO: 4987723 - DNA, 13 bp, Homo sapiens
acatggagagaga

SEQ ID NO: 4987724 - DNA, 18 bp, Homo sapiens
acattaaagatttctgct

SEQ ID NO: 4987725 - DNA, 16 bp, Homo sapiens
acattatgttattgga

SEQ ID NO: 4987726 - DNA, 19 bp, Homo sapiens
acattgaaatctaggaaaa

SEQ ID NO: 4987727 - DNA, 18 bp, Homo sapiens
acatttttgtacattatg

SEQ ID NO: 4987728 - DNA, 21 bp, Homo sapiens
acatttttgtacattatgtta

SEQ ID NO: 4987729 - DNA, 16 bp, Homo sapiens
accaatttctttctaa

SEQ ID NO: 4987730 - DNA, 15 bp, Homo sapiens
accaggaagcacagg

SEQ ID NO: 4987731 - DNA, 19 bp, Homo sapiens
accaggaagcacaggtcca

SEQ ID NO: 4987732 - DNA, 12 bp, Homo sapiens
accatgaaagac

SEQ ID NO: 4987733 - DNA, 17 bp, Homo sapiens
acccaagaactcctgaa

SEQ ID NO: 4987734 - DNA, 12 bp, Homo sapiens
acccaggaggcg

SEQ ID NO: 4987735 - DNA, 14 bp, Homo sapiens
acccatcttaaaaa

SEQ ID NO: 4987736 - DNA, 20 bp, Homo sapiens
acctaataagtgctactttg

SEQ ID NO: 4987737 - DNA, 22 bp, Homo sapiens
acctactttttctttgattttc

SEQ ID NO: 4987738 - DNA, 17 bp, Homo sapiens
acctcagtttccctctg

SEQ ID NO: 4987739 - DNA, 18 bp, Homo sapiens
acctcagtttccctctgt

SEQ ID NO: 4987740 - DNA, 15 bp, Homo sapiens
acctgagacatatta

SEQ ID NO: 4987741 - DNA, 13 bp, Homo sapiens
acgaaaaaatggt

SEQ ID NO: 4987742 - DNA, 20 bp, Homo sapiens
acgaggtcaggagatcgaga

SEQ ID NO: 4987743 - DNA, 15 bp, Homo sapiens
acgcacacatcagtg

SEQ ID NO: 4987744 - DNA, 20 bp, Homo sapiens
acgtccacagagtataaata

SEQ ID NO: 4987745 - DNA, 15 bp, Homo sapiens
actaaaaatgcaaaa

SEQ ID NO: 4987746 - DNA, 19 bp, Homo sapiens
actaagttaataataatga

SEQ ID NO: 4987747 - DNA, 21 bp, Homo sapiens
actaagttaataataatgact

SEQ ID NO: 4987748 - DNA, 18 bp, Homo sapiens
actagccatctcaagcaa

SEQ ID NO: 4987749 - DNA, 16 bp, Homo sapiens
actatatttatttatg

SEQ ID NO: 4987750 - DNA, 18 bp, Homo sapiens
actatttatttacaaatg

SEQ ID NO: 4987751 - DNA, 18 bp, Homo sapiens
actcaagtgccattcatc

SEQ ID NO: 4987752 - DNA, 23 bp, Homo sapiens
tgaattcctaaaattatggaaac

SEQ ID NO: 4987753 - DNA, 20 bp, Homo sapiens
tgacaacatttttgtacatt

SEQ ID NO: 4987754 - DNA, 22 bp, Homo sapiens
tgacaacatttttgtacattat

SEQ ID NO: 4987755 - DNA, 23 bp, Homo sapiens
tgacaacatttttgtacattatg

SEQ ID NO: 4987756 - DNA, 18 bp, Homo sapiens
tgacatatacatacttac

SEQ ID NO: 4987757 - DNA, 14 bp, Homo sapiens
tgactaatgaggca

SEQ ID NO: 4987758 - DNA, 20 bp, Homo sapiens
tgactaatgaggcattacaa

SEQ ID NO: 4987759 - DNA, 18 bp, Homo sapiens
tgactccatgtgtgctgt

SEQ ID NO: 4987760 - DNA, 13 bp, Homo sapiens
tgacttgctcaag

SEQ ID NO: 4987761 - DNA, 20 bp, Homo sapiens
tgagaacttctcttcccata

SEQ ID NO: 4987762 - DNA, 18 bp, Homo sapiens
tgagactttaaaagcatt

SEQ ID NO: 4987763 - DNA, 16 bp, Homo sapiens
tgagcctcacagcagt

SEQ ID NO: 4987764 - DNA, 17 bp, Homo sapiens
tgaggaagagggactgt

SEQ ID NO: 4987765 - DNA, 17 bp, Homo sapiens
tgaggacatggagagag

SEQ ID NO: 4987766 - DNA, 20 bp, Homo sapiens
tgaggcgggtggatcacgag

SEQ ID NO: 4987767 - DNA, 13 bp, Homo sapiens
tgagggagagact

SEQ ID NO: 4987768 - DNA, 22 bp, Homo sapiens
tgagggtgactatggagctgag

SEQ ID NO: 4987769 - DNA, 16 bp, Homo sapiens
tgagttggctgggaat

SEQ ID NO: 4987770 - DNA, 18 bp, Homo sapiens
tgataaaagattttccta

SEQ ID NO: 4987771 - DNA, 21 bp, Homo sapiens
tgatagaaggctatggggata

SEQ ID NO: 4987772 - DNA, 16 bp, Homo sapiens
tgatgattgcttccac

SEQ ID NO: 4987773 - DNA, 19 bp, Homo sapiens
tgatgcccagctcagtgcc

SEQ ID NO: 4987774 - DNA, 15 bp, Homo sapiens
tgatgggtcagttgt

SEQ ID NO: 4987775 - DNA, 21 bp, Homo sapiens
tgattcacctcctaaaacaac

SEQ ID NO: 4987776 - DNA, 15 bp, Homo sapiens
tgattccctgattta

SEQ ID NO: 4987777 - DNA, 16 bp, Homo sapiens
tgattccctgatttaa

SEQ ID NO: 4987778 - DNA, 15 bp, Homo sapiens
tgattgcgagaattt

SEQ ID NO: 4987779 - DNA, 18 bp, Homo sapiens
tgattgcgagaattttca

SEQ ID NO: 4987780 - DNA, 14 bp, Homo sapiens
tgatttacacaggt

SEQ ID NO: 4987781 - DNA, 15 bp, Homo sapiens
tgcaaaaaaaattag

SEQ ID NO: 4987782 - DNA, 23 bp, Homo sapiens
tgcaaataagtgtattttgaaat

SEQ ID NO: 4987783 - DNA, 23 bp, Homo sapiens
tgcaaatagtagagtatcagttg

SEQ ID NO: 4987784 - DNA, 13 bp, Homo sapiens
tgcacacacacag

SEQ ID NO: 4987785 - DNA, 16 bp, Homo sapiens
tgcacacacacagaga

SEQ ID NO: 4987786 - DNA, 20 bp, Homo sapiens
tgcacacgcacatagagata

SEQ ID NO: 4987787 - DNA, 16 bp, Homo sapiens
tgcacgcacacatcag

SEQ ID NO: 4987788 - DNA, 13 bp, Homo sapiens
tgcaggtgccaat

SEQ ID NO: 4987789 - DNA, 16 bp, Homo sapiens
tgcaggtgccaatgac

SEQ ID NO: 4987790 - DNA, 16 bp, Homo sapiens
tgcagtacaggacata

SEQ ID NO: 4987791 - DNA, 10 bp, Homo sapiens
tgcagtgcag

SEQ ID NO: 4987792 - DNA, 17 bp, Homo sapiens
tgcagtgcagtatagaa

SEQ ID NO: 4987793 - DNA, 22 bp, Homo sapiens
tgccaatgctacagtaataaat

SEQ ID NO: 4987794 - DNA, 16 bp, Homo sapiens
tgccacaaagctcaat

SEQ ID NO: 4987795 - DNA, 16 bp, Homo sapiens
tgccatcatgtttaca

SEQ ID NO: 4987796 - DNA, 15 bp, Homo sapiens
tgcccagctcagtgc

SEQ ID NO: 4987797 - DNA, 18 bp, Homo sapiens
tgcccagctcagtgccac

SEQ ID NO: 4987798 - DNA, 15 bp, Homo sapiens
tgcgagaattttcaa

SEQ ID NO: 4987799 - DNA, 14 bp, Homo sapiens
tgctagaagaaaac

SEQ ID NO: 4987800 - DNA, 22 bp, Homo sapiens
tgctatgagctggggatgtctc

SEQ ID NO: 4987801 - DNA, 23 bp, Homo sapiens
tgctcagggactcatctttccct

SEQ ID NO: 4987802 - DNA, 15 bp, Homo sapiens
tgctccatcctcctg

SEQ ID NO: 4987803 - DNA, 21 bp, Homo sapiens
tgctgagcctcacagcagtga

SEQ ID NO: 4987804 - DNA, 23 bp, Homo sapiens
tgctgagtgtacagagtggaata

SEQ ID NO: 4987805 - DNA, 23 bp, Homo sapiens
tgctgtatccatccatggggctg

SEQ ID NO: 4987806 - DNA, 19 bp, Homo sapiens
tggaaattaggttgaaaca

SEQ ID NO: 4987807 - DNA, 20 bp, Homo sapiens
tggaaggcaagattgtgtcc

SEQ ID NO: 4987808 - DNA, 14 bp, Homo sapiens
tggaagtgtgggtc

SEQ ID NO: 4987809 - DNA, 14 bp, Homo sapiens
tggaataagacaga

SEQ ID NO: 4987810 - DNA, 18 bp, Homo sapiens
tggaatgggagtctgaaa

SEQ ID NO: 4987811 - DNA, 16 bp, Homo sapiens
tggaattcacaaagta

SEQ ID NO: 4987812 - DNA, 19 bp, Homo sapiens
tggacttctggatgcccat

SEQ ID NO: 4987813 - DNA, 21 bp, Homo sapiens
tggatatagctaggtgacata

SEQ ID NO: 4987814 - DNA, 13 bp, Homo sapiens
tggatatcaaggt

SEQ ID NO: 4987815 - DNA, 21 bp, Homo sapiens
tggatatcaaggtggaaatgg

SEQ ID NO: 4987816 - DNA, 17 bp, Homo sapiens
tggatgacttgctcaag

SEQ ID NO: 4987817 - DNA, 18 bp, Homo sapiens
tggatgagggccaccagg

SEQ ID NO: 4987818 - DNA, 14 bp, Homo sapiens
tggcaggcacctgt

SEQ ID NO: 4987819 - DNA, 12 bp, Homo sapiens
tggcattaacaa

SEQ ID NO: 4987820 - DNA, 17 bp, Homo sapiens
tggcccatctgtatgct

SEQ ID NO: 4987821 - DNA, 22 bp, Homo sapiens
tggctgccttgtgaaggaatta

SEQ ID NO: 4987822 - DNA, 19 bp, Homo sapiens
tgggaaaaatgttggaatg

SEQ ID NO: 4987823 - DNA, 16 bp, Homo sapiens
tgggagctgtcaagca

SEQ ID NO: 4987824 - DNA, 22 bp, Homo sapiens
tgggagtgaggatgtctgggcc

SEQ ID NO: 4987825 - DNA, 13 bp, Homo sapiens
tgggagtgtgtaa

SEQ ID NO: 4987826 - DNA, 15 bp, Homo sapiens
tgggcaacagagcaa

SEQ ID NO: 4987827 - DNA, 19 bp, Homo sapiens
tgggcaacagagcaagact

SEQ ID NO: 4987828 - DNA, 20 bp, Homo sapiens
tggggatagatgtgtggaca

SEQ ID NO: 4987829 - DNA, 19 bp, Homo sapiens
tggggctactgtttcagtc

SEQ ID NO: 4987830 - DNA, 14 bp, Homo sapiens
tggggctgattgta

SEQ ID NO: 4987831 - DNA, 18 bp, Homo sapiens
tggggcttctcctgaaat

SEQ ID NO: 4987832 - DNA, 11 bp, Homo sapiens
tgggggatgta

SEQ ID NO: 4987833 - DNA, 18 bp, Homo sapiens
tgggggtctgtgtgttta

SEQ ID NO: 4987834 - DNA, 12 bp, Homo sapiens
tggtagcatttt

SEQ ID NO: 4987835 - DNA, 18 bp, Homo sapiens
tggtagcattttaaacaa

SEQ ID NO: 4987836 - DNA, 19 bp, Homo sapiens
tggtagcattttaaacaaa

SEQ ID NO: 4987837 - DNA, 18 bp, Homo sapiens
tggtagctagtgatttac

SEQ ID NO: 4987838 - DNA, 20 bp, Homo sapiens
tggtaggaactgctgggctt

SEQ ID NO: 4987839 - DNA, 20 bp, Homo sapiens
tgtaaacacatctagtagtt

SEQ ID NO: 4987840 - DNA, 15 bp, Homo sapiens
tgtaaatttatgtga

SEQ ID NO: 4987841 - DNA, 14 bp, Homo sapiens
tgtaataaatatgt

SEQ ID NO: 4987842 - DNA, 22 bp, Homo sapiens
tgtaatttaaaattgtgatgtg

SEQ ID NO: 4987843 - DNA, 14 bp, Homo sapiens
tgtacctctgcctc

SEQ ID NO: 4987844 - DNA, 15 bp, Homo sapiens
tgtagtgagccgaga

SEQ ID NO: 4987845 - DNA, 12 bp, Homo sapiens
tgtatacaagga

SEQ ID NO: 4987846 - DNA, 23 bp, Homo sapiens
tgtatacaaggatcagattcttg

SEQ ID NO: 4987847 - DNA, 17 bp, Homo sapiens
tgtatgcacacacatat

SEQ ID NO: 4987848 - DNA, 21 bp, Homo sapiens
tgtatgcacacacatatatta

SEQ ID NO: 4987849 - DNA, 21 bp, Homo sapiens
tgtatgctggtagctagtgat

SEQ ID NO: 4987850 - DNA, 16 bp, Homo sapiens
tgtatttttgtcaatt

SEQ ID NO: 4987851 - DNA, 20 bp, Homo sapiens
tgtatttttgtcaattacca

SEQ ID NO: 4987852 - DNA, 20 bp, Homo sapiens
tgtcagtatgtggaagtgtg

SEQ ID NO: 4987853 - DNA, 17 bp, Homo sapiens
tgtcagtctgcttagaa

SEQ ID NO: 4987854 - DNA, 19 bp, Homo sapiens
tgtcagtctgcttagaaat

SEQ ID NO: 4987855 - DNA, 21 bp, Homo sapiens
tgtcattcgtggttgatttca

SEQ ID NO: 4987856 - DNA, 11 bp, Homo sapiens
tgtgatgtgtc

SEQ ID NO: 4987857 - DNA, 16 bp, Homo sapiens
tgtgccttttgccatc

SEQ ID NO: 4987858 - DNA, 15 bp, Homo sapiens
tgtggaagtgtgggt

SEQ ID NO: 4987859 - DNA, 18 bp, Homo sapiens
tgtgtaatttaaaattgt

SEQ ID NO: 4987860 - DNA, 22 bp, Homo sapiens
tgtgtaatttaaaattgtgatg

SEQ ID NO: 4987861 - DNA, 13 bp, Homo sapiens
tgtgtatgtgggg

SEQ ID NO: 4987862 - DNA, 15 bp, Homo sapiens
tgtgtgggagtgtgt

SEQ ID NO: 4987863 - DNA, 18 bp, Homo sapiens
tgtgtgttgtgtgtggga

SEQ ID NO: 4987864 - DNA, 14 bp, Homo sapiens
tgttattggaattt

SEQ ID NO: 4987865 - DNA, 23 bp, Homo sapiens
tgttggaatgggagtctgaaatg

SEQ ID NO: 4987866 - DNA, 15 bp, Homo sapiens
tgttggcattaacaa

SEQ ID NO: 4987867 - DNA, 21 bp, Homo sapiens
tgtttacagaggacagtattt

SEQ ID NO: 4987868 - DNA, 16 bp, Homo sapiens
tgtttagaagaagtgt

SEQ ID NO: 4987869 - DNA, 17 bp, Homo sapiens
tgttttgctcaatagat

SEQ ID NO: 4987870 - DNA, 14 bp, Homo sapiens
ttaaaagcattttt

SEQ ID NO: 4987871 - DNA, 17 bp, Homo sapiens
ttaaaataagtctgatt

SEQ ID NO: 4987872 - DNA, 13 bp, Homo sapiens
ttaaaattgtgat

SEQ ID NO: 4987873 - DNA, 13 bp, Homo sapiens
ttaaagatttctg

SEQ ID NO: 4987874 - DNA, 14 bp, Homo sapiens
ttaacactgagatc

SEQ ID NO: 4987875 - DNA, 16 bp, Homo sapiens
ttaatgagactttaaa

SEQ ID NO: 4987876 - DNA, 23 bp, Homo sapiens
ttaatttactgattccagcaaga

SEQ ID NO: 4987877 - DNA, 11 bp, Homo sapiens
ttacaaatgtt

SEQ ID NO: 4987878 - DNA, 15 bp, Homo sapiens
ttacagaggacagta

SEQ ID NO: 4987879 - DNA, 22 bp, Homo sapiens
ttacattaaaatagcacatgat

SEQ ID NO: 4987880 - DNA, 20 bp, Homo sapiens
ttacctttccagtatgaaaa

SEQ ID NO: 4987881 - DNA, 15 bp, Homo sapiens
ttactatttcttgtg

SEQ ID NO: 4987882 - DNA, 15 bp, Homo sapiens
ttagaagaagtgtgt

SEQ ID NO: 4987883 - DNA, 16 bp, Homo sapiens
ttagaagaagtgtgtc

SEQ ID NO: 4987884 - DNA, 15 bp, Homo sapiens
gaaggctatggggat

SEQ ID NO: 4987885 - DNA, 19 bp, Homo sapiens
gaagggcagggctgaggcc

SEQ ID NO: 4987886 - DNA, 17 bp, Homo sapiens
gaagtgtgggtctgtgt

SEQ ID NO: 4987887 - DNA, 18 bp, Homo sapiens
gaagtgtgggtctgtgtg

SEQ ID NO: 4987888 - DNA, 19 bp, Homo sapiens
gaagtgtgggtctgtgtgt

SEQ ID NO: 4987889 - DNA, 18 bp, Homo sapiens
gaatgggagtctgaaatg

SEQ ID NO: 4987890 - DNA, 16 bp, Homo sapiens
gaattgacattgaaat

SEQ ID NO: 4987891 - DNA, 22 bp, Homo sapiens
gaattttctttcatacattata

SEQ ID NO: 4987892 - DNA, 18 bp, Homo sapiens
gacagaaacagagagaga

SEQ ID NO: 4987893 - DNA, 22 bp, Homo sapiens
gacagagacagaaacagagaga

SEQ ID NO: 4987894 - DNA, 15 bp, Homo sapiens
gacagagagagactg

SEQ ID NO: 4987895 - DNA, 15 bp, Homo sapiens
gacatggagagagac

SEQ ID NO: 4987896 - DNA, 19 bp, Homo sapiens
gaccaaatcattgtatcaa

SEQ ID NO: 4987897 - DNA, 12 bp, Homo sapiens
gacccaagaact

SEQ ID NO: 4987898 - DNA, 15 bp, Homo sapiens
gactatggagctgag

SEQ ID NO: 4987899 - DNA, 17 bp, Homo sapiens
gactcatctttccctcc

SEQ ID NO: 4987900 - DNA, 18 bp, Homo sapiens
gactcatctttccctcct

SEQ ID NO: 4987901 - DNA, 20 bp, Homo sapiens
gactccaggcagcagacaca

SEQ ID NO: 4987902 - DNA, 21 bp, Homo sapiens
gactccaggcagcagacacat

SEQ ID NO: 4987903 - DNA, 12 bp, Homo sapiens
gactgcaacata

SEQ ID NO: 4987904 - DNA, 19 bp, Homo sapiens
gactgcaacatacaggtgc

SEQ ID NO: 4987905 - DNA, 23 bp, Homo sapiens
gacttaatgagactttaaaagca

SEQ ID NO: 4987906 - DNA, 17 bp, Homo sapiens
gacttgctcaagttcac

SEQ ID NO: 4987907 - DNA, 18 bp, Homo sapiens
gagaaactggcaaagcag

SEQ ID NO: 4987908 - DNA, 14 bp, Homo sapiens
gagacagaaacaga

SEQ ID NO: 4987909 - DNA, 18 bp, Homo sapiens
gagacagagagagactga

SEQ ID NO: 4987910 - DNA, 15 bp, Homo sapiens
gagactgagggagag

SEQ ID NO: 4987911 - DNA, 18 bp, Homo sapiens
gagactgagggagagact

SEQ ID NO: 4987912 - DNA, 14 bp, Homo sapiens
gagactttaaaagc

SEQ ID NO: 4987913 - DNA, 17 bp, Homo sapiens
gagactttaaaagcatt

SEQ ID NO: 4987914 - DNA, 21 bp, Homo sapiens
gagagacagagacagagagag

SEQ ID NO: 4987915 - DNA, 16 bp, Homo sapiens
gagagactcaaagaga

SEQ ID NO: 4987916 - DNA, 16 bp, Homo sapiens
gagagactgagggaga

SEQ ID NO: 4987917 - DNA, 17 bp, Homo sapiens
gagagactgagggagag

SEQ ID NO: 4987918 - DNA, 22 bp, Homo sapiens
gagagagactgagggagagact

SEQ ID NO: 4987919 - DNA, 21 bp, Homo sapiens
gagaggctggatgacttgctc

SEQ ID NO: 4987920 - DNA, 22 bp, Homo sapiens
gagaggtggggagggagacaga

SEQ ID NO: 4987921 - DNA, 12 bp, Homo sapiens
gagatatgcaca

SEQ ID NO: 4987922 - DNA, 14 bp, Homo sapiens
gagatcgagaccat

SEQ ID NO: 4987923 - DNA, 20 bp, Homo sapiens
gagccgagatcgcgccactg

SEQ ID NO: 4987924 - DNA, 22 bp, Homo sapiens
gaggacagtatttgtggggagg

SEQ ID NO: 4987925 - DNA, 13 bp, Homo sapiens
gaggagggcatgg

SEQ ID NO: 4987926 - DNA, 16 bp, Homo sapiens
gaggcaggagactggc

SEQ ID NO: 4987927 - DNA, 22 bp, Homo sapiens
gaggcctctcattccagaggaa

SEQ ID NO: 4987928 - DNA, 20 bp, Homo sapiens
gaggcggaccttgtagtgag

SEQ ID NO: 4987929 - DNA, 18 bp, Homo sapiens
gaggctggatgacttgct

SEQ ID NO: 4987930 - DNA, 14 bp, Homo sapiens
gagggagggagagg

SEQ ID NO: 4987931 - DNA, 17 bp, Homo sapiens
gaggggcaggggagtgc

SEQ ID NO: 4987932 - DNA, 16 bp, Homo sapiens
gaggttaaaaagaaaa

SEQ ID NO: 4987933 - DNA, 22 bp, Homo sapiens
gaggtttgtttagaagaagtgt

SEQ ID NO: 4987934 - DNA, 13 bp, Homo sapiens
gagtcctggccct

SEQ ID NO: 4987935 - DNA, 12 bp, Homo sapiens
gagtctgaaatg

SEQ ID NO: 4987936 - DNA, 14 bp, Homo sapiens
gagtggctggggca

SEQ ID NO: 4987937 - DNA, 15 bp, Homo sapiens
gagtgtgactttttg

SEQ ID NO: 4987938 - DNA, 21 bp, Homo sapiens
gagtgtgtaatttaaaattgt

SEQ ID NO: 4987939 - DNA, 18 bp, Homo sapiens
gagtttagccctgaacat

SEQ ID NO: 4987940 - DNA, 14 bp, Homo sapiens
gatagatgtgtgga

SEQ ID NO: 4987941 - DNA, 22 bp, Homo sapiens
gatagatgtgtggacacattgg

SEQ ID NO: 4987942 - DNA, 17 bp, Homo sapiens
gatatcaaggtggaaat

SEQ ID NO: 4987943 - DNA, 21 bp, Homo sapiens
gatcagattcttgctgtgacc

SEQ ID NO: 4987944 - DNA, 14 bp, Homo sapiens
gatcattatcagcc

SEQ ID NO: 4987945 - DNA, 18 bp, Homo sapiens
gatccagagaggctggat

SEQ ID NO: 4987946 - DNA, 16 bp, Homo sapiens
gatcgagaccatcctg

SEQ ID NO: 4987947 - DNA, 17 bp, Homo sapiens
ataacagaagaaaatag

SEQ ID NO: 4987948 - DNA, 16 bp, Homo sapiens
ataacttaatgaaaac

SEQ ID NO: 4987949 - DNA, 14 bp, Homo sapiens
ataagtctgattta

SEQ ID NO: 4987950 - DNA, 14 bp, Homo sapiens
ataagtgctacttt

SEQ ID NO: 4987951 - DNA, 13 bp, Homo sapiens
ataagtgtatttt

SEQ ID NO: 4987952 - DNA, 14 bp, Homo sapiens
ataatctctgattc

SEQ ID NO: 4987953 - DNA, 20 bp, Homo sapiens
ataatctgatgggcctggct

SEQ ID NO: 4987954 - DNA, 13 bp, Homo sapiens
ataatgactctaa

SEQ ID NO: 4987955 - DNA, 16 bp, Homo sapiens
ataattcacacattaa

SEQ ID NO: 4987956 - DNA, 16 bp, Homo sapiens
atacacatggatgcac

SEQ ID NO: 4987957 - DNA, 18 bp, Homo sapiens
atacatacttacatgtgt

SEQ ID NO: 4987958 - DNA, 19 bp, Homo sapiens
atagaaggctatggggata

SEQ ID NO: 4987959 - DNA, 16 bp, Homo sapiens
atagagtgtgatgtat

SEQ ID NO: 4987960 - DNA, 11 bp, Homo sapiens
atagatgtgtg

SEQ ID NO: 4987961 - DNA, 12 bp, Homo sapiens
atagatgtgtgg

SEQ ID NO: 4987962 - DNA, 22 bp, Homo sapiens
atatacatacttacatgtgtgt

SEQ ID NO: 4987963 - DNA, 19 bp, Homo sapiens
atatcctaggaggtaatga

SEQ ID NO: 4987964 - DNA, 19 bp, Homo sapiens
atatgcacacacagatgca

SEQ ID NO: 4987965 - DNA, 16 bp, Homo sapiens
atatgggtagtatttt

SEQ ID NO: 4987966 - DNA, 21 bp, Homo sapiens
atatgtttcacacaaacaagg

SEQ ID NO: 4987967 - DNA, 21 bp, Homo sapiens
atattaactgacgaagaagca

SEQ ID NO: 4987968 - DNA, 13 bp, Homo sapiens
atattactctatg

SEQ ID NO: 4987969 - DNA, 14 bp, Homo sapiens
atattactctatga

SEQ ID NO: 4987970 - DNA, 20 bp, Homo sapiens
atatttgtaaatttatgtga

SEQ ID NO: 4987971 - DNA, 15 bp, Homo sapiens
atattttttaaaata

SEQ ID NO: 4987972 - DNA, 17 bp, Homo sapiens
atattttttaaaataag

SEQ ID NO: 4987973 - DNA, 17 bp, Homo sapiens
atcaacagtgagagact

SEQ ID NO: 4987974 - DNA, 15 bp, Homo sapiens
atcagattcttgctg

SEQ ID NO: 4987975 - DNA, 22 bp, Homo sapiens
atcagcagcaacaactgtcagt

SEQ ID NO: 4987976 - DNA, 13 bp, Homo sapiens
atcaggccattgt

SEQ ID NO: 4987977 - DNA, 20 bp, Homo sapiens
atcaggttttcttttaagaa

SEQ ID NO: 4987978 - DNA, 19 bp, Homo sapiens
atcagttgcaggtgccaat

SEQ ID NO: 4987979 - DNA, 20 bp, Homo sapiens
atcagttgcaggtgccaatg

SEQ ID NO: 4987980 - DNA, 15 bp, Homo sapiens
atcatgcatagagtg

SEQ ID NO: 4987981 - DNA, 17 bp, Homo sapiens
atccagagaggctggat

SEQ ID NO: 4987982 - DNA, 21 bp, Homo sapiens
atcctgcatgggaaaaatgtt

SEQ ID NO: 4987983 - DNA, 18 bp, Homo sapiens
atccttttctattaagat

SEQ ID NO: 4987984 - DNA, 14 bp, Homo sapiens
atctaggaaaatta

SEQ ID NO: 4987985 - DNA, 12 bp, Homo sapiens
atctagtagttg

SEQ ID NO: 4987986 - DNA, 21 bp, Homo sapiens
atctagtagttgttctgaaat

SEQ ID NO: 4987987 - DNA, 18 bp, Homo sapiens
atctcttatcttacgaaa

SEQ ID NO: 4987988 - DNA, 20 bp, Homo sapiens
atctcttatcttacgaaaaa

SEQ ID NO: 4987989 - DNA, 20 bp, Homo sapiens
atctgagaggccacagtgca

SEQ ID NO: 4987990 - DNA, 17 bp, Homo sapiens
atctgatgggcctggct

SEQ ID NO: 4987991 - DNA, 20 bp, Homo sapiens
atctgatgggcctggctggg

SEQ ID NO: 4987992 - DNA, 23 bp, Homo sapiens
atctgatgggcctggctgggagt

SEQ ID NO: 4987993 - DNA, 15 bp, Homo sapiens
atctggatatcaagg

SEQ ID NO: 4987994 - DNA, 21 bp, Homo sapiens
atctggatatcaaggtggaaa

SEQ ID NO: 4987995 - DNA, 13 bp, Homo sapiens
atctttccctcct

SEQ ID NO: 4987996 - DNA, 17 bp, Homo sapiens
atctttccctccttggt

SEQ ID NO: 4987997 - DNA, 21 bp, Homo sapiens
atgaatgtcacttctggatat

SEQ ID NO: 4987998 - DNA, 18 bp, Homo sapiens
atgagttggctgggaata

SEQ ID NO: 4987999 - DNA, 21 bp, Homo sapiens
atgcacacgcacatagagata

SEQ ID NO: 4988000 - DNA, 13 bp, Homo sapiens
atgcacagagata

SEQ ID NO: 4988001 - DNA, 16 bp, Homo sapiens
atgcatagagtgtgat

SEQ ID NO: 4988002 - DNA, 16 bp, Homo sapiens
atgctagaagaaaaca

SEQ ID NO: 4988003 - DNA, 14 bp, Homo sapiens
atggaatagaaaag

SEQ ID NO: 4988004 - DNA, 23 bp, Homo sapiens
atggaatagaaaagatgagaggc

SEQ ID NO: 4988005 - DNA, 16 bp, Homo sapiens
atggaattcacaaagt

SEQ ID NO: 4988006 - DNA, 20 bp, Homo sapiens
atggaattcacaaagtaatt

SEQ ID NO: 4988007 - DNA, 17 bp, Homo sapiens
atggaggactccaggca

SEQ ID NO: 4988008 - DNA, 20 bp, Homo sapiens
atgggaaaaatgttggaatg

SEQ ID NO: 4988009 - DNA, 15 bp, Homo sapiens
atgggagtctgaaat

SEQ ID NO: 4988010 - DNA, 18 bp, Homo sapiens
atggtagcattttaaaca

SEQ ID NO: 4988011 - DNA, 22 bp, Homo sapiens
atgtaggctggctttcagagta

SEQ ID NO: 4988012 - DNA, 17 bp, Homo sapiens
atgtatataaacatgct

SEQ ID NO: 4988013 - DNA, 15 bp, Homo sapiens
atgtatgcacacaca

SEQ ID NO: 4988014 - DNA, 17 bp, Homo sapiens
atgtatgcacacacata

SEQ ID NO: 4988015 - DNA, 17 bp, Homo sapiens
atgtatttttgtcaatt

SEQ ID NO: 4988016 - DNA, 18 bp, Homo sapiens
atgtcagtctgcttagaa

SEQ ID NO: 4988017 - DNA, 19 bp, Homo sapiens
atgtcagtctgcttagaaa

SEQ ID NO: 4988018 - DNA, 16 bp, Homo sapiens
atgtgcgcacacacag

SEQ ID NO: 4988019 - DNA, 16 bp, Homo sapiens
atgtgctgtgtgacat

SEQ ID NO: 4988020 - DNA, 13 bp, Homo sapiens
atgtggaagtgtg

SEQ ID NO: 4988021 - DNA, 22 bp, Homo sapiens
atgtggaagtgtgggtctgtgt

SEQ ID NO: 4988022 - DNA, 22 bp, Homo sapiens
atgtgtaataaatatgtttcac

SEQ ID NO: 4988023 - DNA, 22 bp, Homo sapiens
atgtgtgtgtgttgtgtgtggg

SEQ ID NO: 4988024 - DNA, 16 bp, Homo sapiens
atgttattggaatttt

SEQ ID NO: 4988025 - DNA, 23 bp, Homo sapiens
atgttattggaattttctttcat

SEQ ID NO: 4988026 - DNA, 21 bp, Homo sapiens
atgttggcattaacaataaag

SEQ ID NO: 4988027 - DNA, 18 bp, Homo sapiens
attaactaaggaaatatt

SEQ ID NO: 4988028 - DNA, 17 bp, Homo sapiens
attactgatatcagagt

SEQ ID NO: 4988029 - DNA, 23 bp, Homo sapiens
cagtatgaaaagctatcttaaaa

SEQ ID NO: 4988030 - DNA, 12 bp, Homo sapiens
cagtatgtggaa

SEQ ID NO: 4988031 - DNA, 16 bp, Homo sapiens
cagtctgcttagaaat

SEQ ID NO: 4988032 - DNA, 18 bp, Homo sapiens
cagtgcacacggatgcac

SEQ ID NO: 4988033 - DNA, 19 bp, Homo sapiens
cagtgccacaaagctcaat

SEQ ID NO: 4988034 - DNA, 16 bp, Homo sapiens
cagtggctggatctgt

SEQ ID NO: 4988035 - DNA, 20 bp, Homo sapiens
cagtggctggatctgtgagg

SEQ ID NO: 4988036 - DNA, 13 bp, Homo sapiens
cagttctagttga

SEQ ID NO: 4988037 - DNA, 15 bp, Homo sapiens
catacctggccctgt

SEQ ID NO: 4988038 - DNA, 13 bp, Homo sapiens
catatagaaaggc

SEQ ID NO: 4988039 - DNA, 16 bp, Homo sapiens
catatattttttaaaa

SEQ ID NO: 4988040 - DNA, 20 bp, Homo sapiens
catatattttttaaaataag

SEQ ID NO: 4988041 - DNA, 21 bp, Homo sapiens
catatattttttaaaataagt

SEQ ID NO: 4988042 - DNA, 16 bp, Homo sapiens
catatccaagtttgaa

SEQ ID NO: 4988043 - DNA, 23 bp, Homo sapiens
catatctcttatcttacgaaaaa

SEQ ID NO: 4988044 - DNA, 14 bp, Homo sapiens
catcaatgaagatt

SEQ ID NO: 4988045 - DNA, 14 bp, Homo sapiens
catcctgcatggga

SEQ ID NO: 4988046 - DNA, 19 bp, Homo sapiens
catctgtatgctggtagct

SEQ ID NO: 4988047 - DNA, 15 bp, Homo sapiens
catcttaaaaacaac

SEQ ID NO: 4988048 - DNA, 13 bp, Homo sapiens
catctttccctcc

SEQ ID NO: 4988049 - DNA, 14 bp, Homo sapiens
catctttccctcct

SEQ ID NO: 4988050 - DNA, 16 bp, Homo sapiens
catctttccctccttg

SEQ ID NO: 4988051 - DNA, 18 bp, Homo sapiens
catctttccctccttggt

SEQ ID NO: 4988052 - DNA, 20 bp, Homo sapiens
catgccagggccatgtcaga

SEQ ID NO: 4988053 - DNA, 21 bp, Homo sapiens
cattacctcagtgagaagcca

SEQ ID NO: 4988054 - DNA, 23 bp, Homo sapiens
cattatgttattggaattttctt

SEQ ID NO: 4988055 - DNA, 13 bp, Homo sapiens
cattcagtactta

SEQ ID NO: 4988056 - DNA, 23 bp, Homo sapiens
cattcatcctttaagaaaaacat

SEQ ID NO: 4988057 - DNA, 14 bp, Homo sapiens
catttacttaagac

SEQ ID NO: 4988058 - DNA, 16 bp, Homo sapiens
catttacttaagactt

SEQ ID NO: 4988059 - DNA, 17 bp, Homo sapiens
catttacttaagactta

SEQ ID NO: 4988060 - DNA, 15 bp, Homo sapiens
catttactttggtca

SEQ ID NO: 4988061 - DNA, 16 bp, Homo sapiens
cattttaaacaaaata

SEQ ID NO: 4988062 - DNA, 19 bp, Homo sapiens
cattttacacactgtacac

SEQ ID NO: 4988063 - DNA, 18 bp, Homo sapiens
catttttgtacattatgt

SEQ ID NO: 4988064 - DNA, 20 bp, Homo sapiens
catttttgtacattatgtta

SEQ ID NO: 4988065 - DNA, 17 bp, Homo sapiens
ccaaaactgagcataag

SEQ ID NO: 4988066 - DNA, 17 bp, Homo sapiens
ccaagattcaaagagac

SEQ ID NO: 4988067 - DNA, 15 bp, Homo sapiens
ccaaggctggtccca

SEQ ID NO: 4988068 - DNA, 18 bp, Homo sapiens
ccaatacgtagatttttg

SEQ ID NO: 4988069 - DNA, 14 bp, Homo sapiens
ccaattcctcattt

SEQ ID NO: 4988070 - DNA, 23 bp, Homo sapiens
ccaattcctcatttgttcattaa

SEQ ID NO: 4988071 - DNA, 16 bp, Homo sapiens
ccagagtcctggccct

SEQ ID NO: 4988072 - DNA, 21 bp, Homo sapiens
ccagcagccctggcctgtgga

SEQ ID NO: 4988073 - DNA, 23 bp, Homo sapiens
ccagctactcgggaggctgaggc

SEQ ID NO: 4988074 - DNA, 11 bp, Homo sapiens
ccagctcagtg

SEQ ID NO: 4988075 - DNA, 16 bp, Homo sapiens
ccaggatggcgcagga

SEQ ID NO: 4988076 - DNA, 18 bp, Homo sapiens
ccaggatttgctgggaga

SEQ ID NO: 4988077 - DNA, 15 bp, Homo sapiens
ccaggcagcagacac

SEQ ID NO: 4988078 - DNA, 17 bp, Homo sapiens
ccaggcagcagacacat

SEQ ID NO: 4988079 - DNA, 20 bp, Homo sapiens
ccatcatgtttacagaggac

SEQ ID NO: 4988080 - DNA, 15 bp, Homo sapiens
ccatgtcagacacag

SEQ ID NO: 4988081 - DNA, 21 bp, Homo sapiens
ccatgtcagacacagattggc

SEQ ID NO: 4988082 - DNA, 12 bp, Homo sapiens
ccatgtgtgctg

SEQ ID NO: 4988083 - DNA, 13 bp, Homo sapiens
ccatgtgtgctgt

SEQ ID NO: 4988084 - DNA, 14 bp, Homo sapiens
ccatttaatgattg

SEQ ID NO: 4988085 - DNA, 23 bp, Homo sapiens
tagcattttaaacaaaatagaaa

SEQ ID NO: 4988086 - DNA, 15 bp, Homo sapiens
tagctaggtgacata

SEQ ID NO: 4988087 - DNA, 19 bp, Homo sapiens
tagctagtgatttacacag

SEQ ID NO: 4988088 - DNA, 19 bp, Homo sapiens
taggagggatgttccagtg

SEQ ID NO: 4988089 - DNA, 13 bp, Homo sapiens
tagtagagtatca

SEQ ID NO: 4988090 - DNA, 16 bp, Homo sapiens
tagtgatttacacagg

SEQ ID NO: 4988091 - DNA, 22 bp, Homo sapiens
tagttacctactttttctttga

SEQ ID NO: 4988092 - DNA, 20 bp, Homo sapiens
tagttgattgcgagaatttt

SEQ ID NO: 4988093 - DNA, 22 bp, Homo sapiens
tataaacatgcttgcattatat

SEQ ID NO: 4988094 - DNA, 16 bp, Homo sapiens
tataacttaatgaaaa

SEQ ID NO: 4988095 - DNA, 17 bp, Homo sapiens
tataattacaatgcaca

SEQ ID NO: 4988096 - DNA, 15 bp, Homo sapiens
tataatttccattta

SEQ ID NO: 4988097 - DNA, 20 bp, Homo sapiens
tataatttccatttacttaa

SEQ ID NO: 4988098 - DNA, 21 bp, Homo sapiens
tataatttccatttacttaag

SEQ ID NO: 4988099 - DNA, 22 bp, Homo sapiens
tataatttccatttacttaaga

SEQ ID NO: 4988100 - DNA, 21 bp, Homo sapiens
tatacaaggatcagattcttg

SEQ ID NO: 4988101 - DNA, 19 bp, Homo sapiens
tatacatacttacatgtgt

SEQ ID NO: 4988102 - DNA, 19 bp, Homo sapiens
tataggataaattacatta

SEQ ID NO: 4988103 - DNA, 20 bp, Homo sapiens
tatatgtagatgtatgcaca

SEQ ID NO: 4988104 - DNA, 18 bp, Homo sapiens
tatattttttaaaataag

SEQ ID NO: 4988105 - DNA, 19 bp, Homo sapiens
tatattttttaaaataagt

SEQ ID NO: 4988106 - DNA, 21 bp, Homo sapiens
tatcaaattatttttaagttt

SEQ ID NO: 4988107 - DNA, 19 bp, Homo sapiens
tatcaagtatagaaaatct

SEQ ID NO: 4988108 - DNA, 12 bp, Homo sapiens
tatccttttcta

SEQ ID NO: 4988109 - DNA, 19 bp, Homo sapiens
tatgaaaagctatcttaaa

SEQ ID NO: 4988110 - DNA, 21 bp, Homo sapiens
tatgagaaactggcaaagcag

SEQ ID NO: 4988111 - DNA, 23 bp, Homo sapiens
tatgagctggggatgtctctcat

SEQ ID NO: 4988112 - DNA, 16 bp, Homo sapiens
tatgatctatgctata

SEQ ID NO: 4988113 - DNA, 20 bp, Homo sapiens
tatggggatagatgtgtgga

SEQ ID NO: 4988114 - DNA, 14 bp, Homo sapiens
tatgtgacaacatt

SEQ ID NO: 4988115 - DNA, 22 bp, Homo sapiens
tatgtgacaacatttttgtaca

SEQ ID NO: 4988116 - DNA, 16 bp, Homo sapiens
tatgtggaagtgtggg

SEQ ID NO: 4988117 - DNA, 11 bp, Homo sapiens
tatgtgtgtgt

SEQ ID NO: 4988118 - DNA, 14 bp, Homo sapiens
tatgtgtgtgtgtt

SEQ ID NO: 4988119 - DNA, 20 bp, Homo sapiens
tatgttattggaattttctt

SEQ ID NO: 4988120 - DNA, 12 bp, Homo sapiens
tattcccatgag

SEQ ID NO: 4988121 - DNA, 13 bp, Homo sapiens
tattgatttcaag

SEQ ID NO: 4988122 - DNA, 14 bp, Homo sapiens
tattgccaatgcta

SEQ ID NO: 4988123 - DNA, 13 bp, Homo sapiens
tattggaattttc

SEQ ID NO: 4988124 - DNA, 15 bp, Homo sapiens
tattggaattttctt

SEQ ID NO: 4988125 - DNA, 16 bp, Homo sapiens
tatttatttacaaatg

SEQ ID NO: 4988126 - DNA, 20 bp, Homo sapiens
tatttcttgtggttataact

SEQ ID NO: 4988127 - DNA, 23 bp, Homo sapiens
tatttcttgtggttataacttaa

SEQ ID NO: 4988128 - DNA, 20 bp, Homo sapiens
tatttgcagtgcagtataga

SEQ ID NO: 4988129 - DNA, 16 bp, Homo sapiens
tatttgtaaatttatg

SEQ ID NO: 4988130 - DNA, 17 bp, Homo sapiens
tatttgtaaatttatgt

SEQ ID NO: 4988131 - DNA, 21 bp, Homo sapiens
tattttaatttactgattcca

SEQ ID NO: 4988132 - DNA, 19 bp, Homo sapiens
tcaaattatttttaagttt

SEQ ID NO: 4988133 - DNA, 18 bp, Homo sapiens
tcaagtgccattcatcct

SEQ ID NO: 4988134 - DNA, 19 bp, Homo sapiens
ttagcagcaaaacaaacga

SEQ ID NO: 4988135 - DNA, 15 bp, Homo sapiens
ttagccctgaacatt

SEQ ID NO: 4988136 - DNA, 14 bp, Homo sapiens
ttaggttgaaacat

SEQ ID NO: 4988137 - DNA, 16 bp, Homo sapiens
ttaggttgaaacatat

SEQ ID NO: 4988138 - DNA, 21 bp, Homo sapiens
ttatattcctctaaaactctc

SEQ ID NO: 4988139 - DNA, 13 bp, Homo sapiens
ttatgaaaataat

SEQ ID NO: 4988140 - DNA, 21 bp, Homo sapiens
ttatgagaaactggcaaagca

SEQ ID NO: 4988141 - DNA, 24 bp, Homo sapiens
ttatgggagctgtcaagcatgtat

SEQ ID NO: 4988142 - DNA, 10 bp, Homo sapiens
ttatgtgtgt

SEQ ID NO: 4988143 - DNA, 19 bp, Homo sapiens
ttattaagaggtaagactt

SEQ ID NO: 4988144 - DNA, 19 bp, Homo sapiens
ttattggaattttctttca

SEQ ID NO: 4988145 - DNA, 13 bp, Homo sapiens
ttcaaagagacta

SEQ ID NO: 4988146 - DNA, 17 bp, Homo sapiens
ttcaattttaaacatat

SEQ ID NO: 4988147 - DNA, 16 bp, Homo sapiens
ttcacaaagtaatttg

SEQ ID NO: 4988148 - DNA, 18 bp, Homo sapiens
ttcacaaagtaatttgga

SEQ ID NO: 4988149 - DNA, 17 bp, Homo sapiens
ttcacctcctaaaacaa

SEQ ID NO: 4988150 - DNA, 16 bp, Homo sapiens
ttcatacattatattc

SEQ ID NO: 4988151 - DNA, 16 bp, Homo sapiens
ttcatcctgcatggga

SEQ ID NO: 4988152 - DNA, 12 bp, Homo sapiens
ttccctccttgg

SEQ ID NO: 4988153 - DNA, 17 bp, Homo sapiens
ttcctcatttgttcatt

SEQ ID NO: 4988154 - DNA, 23 bp, Homo sapiens
ttcctcatttgttcattaaacgt

SEQ ID NO: 4988155 - DNA, 14 bp, Homo sapiens
ttcctgctgagcct

SEQ ID NO: 4988156 - DNA, 20 bp, Homo sapiens
ttctattaagatatatttgt

SEQ ID NO: 4988157 - DNA, 23 bp, Homo sapiens
ttctctacccatcttaaaaacaa

SEQ ID NO: 4988158 - DNA, 19 bp, Homo sapiens
ttctgcttccgtattttaa

SEQ ID NO: 4988159 - DNA, 17 bp, Homo sapiens
ttctttctaaaacacat

SEQ ID NO: 4988160 - DNA, 18 bp, Homo sapiens
ttctttctaaaacacatt

SEQ ID NO: 4988161 - DNA, 17 bp, Homo sapiens
ttcttttaagaatcaat

SEQ ID NO: 4988162 - DNA, 22 bp, Homo sapiens
ttgaattcctaaaattatggaa

SEQ ID NO: 4988163 - DNA, 23 bp, Homo sapiens
ttgacattgaaatctaggaaaat

SEQ ID NO: 4988164 - DNA, 16 bp, Homo sapiens
ttgcaaggcaaatgtt

SEQ ID NO: 4988165 - DNA, 14 bp, Homo sapiens
ttgcaggtgccaat

SEQ ID NO: 4988166 - DNA, 20 bp, Homo sapiens
ttgctatgagctggggatgt

SEQ ID NO: 4988167 - DNA, 18 bp, Homo sapiens
ttgctcaagttcaccagc

SEQ ID NO: 4988168 - DNA, 23 bp, Homo sapiens
ttggaaattaggttgaaacatat

SEQ ID NO: 4988169 - DNA, 13 bp, Homo sapiens
ttggaattttctt

SEQ ID NO: 4988170 - DNA, 23 bp, Homo sapiens
gctagaagaaaacaaactgtcac

SEQ ID NO: 4988171 - DNA, 16 bp, Homo sapiens
gctagtgatttacaca

SEQ ID NO: 4988172 - DNA, 21 bp, Homo sapiens
gctatggggatagatgtgtgg

SEQ ID NO: 4988173 - DNA, 23 bp, Homo sapiens
gctcaatagattgctcaaatcag

SEQ ID NO: 4988174 - DNA, 19 bp, Homo sapiens
gctgagcctcacagcagtg

SEQ ID NO: 4988175 - DNA, 21 bp, Homo sapiens
gctgagcctcacagcagtgag

SEQ ID NO: 4988176 - DNA, 14 bp, Homo sapiens
gctgaggcctctca

SEQ ID NO: 4988177 - DNA, 14 bp, Homo sapiens
gctgattgtattta

SEQ ID NO: 4988178 - DNA, 17 bp, Homo sapiens
gctggacagaggggcag

SEQ ID NO: 4988179 - DNA, 22 bp, Homo sapiens
gctgggcttggcagcccgggtc

SEQ ID NO: 4988180 - DNA, 16 bp, Homo sapiens
gctggtagctagtgat

SEQ ID NO: 4988181 - DNA, 15 bp, Homo sapiens
gctgtcctctgaagg

SEQ ID NO: 4988182 - DNA, 15 bp, Homo sapiens
gcttctcctgaaatc

SEQ ID NO: 4988183 - DNA, 19 bp, Homo sapiens
gctttcctcatcaggccat

SEQ ID NO: 4988184 - DNA, 15 bp, Homo sapiens
ggaactgctgggctt

SEQ ID NO: 4988185 - DNA, 23 bp, Homo sapiens
ggaagaagggaagccttttgcaa

SEQ ID NO: 4988186 - DNA, 20 bp, Homo sapiens
ggaagcacaggtccaaggct

SEQ ID NO: 4988187 - DNA, 18 bp, Homo sapiens
ggacagtatttgtgggga

SEQ ID NO: 4988188 - DNA, 19 bp, Homo sapiens
ggacagtatttgtggggag

SEQ ID NO: 4988189 - DNA, 15 bp, Homo sapiens
ggacatggagagaga

SEQ ID NO: 4988190 - DNA, 16 bp, Homo sapiens
ggacatggagagagac

SEQ ID NO: 4988191 - DNA, 21 bp, Homo sapiens
ggacctcagtttccctctgta

SEQ ID NO: 4988192 - DNA, 21 bp, Homo sapiens
ggactcatctttccctccttg

SEQ ID NO: 4988193 - DNA, 22 bp, Homo sapiens
ggagagactctgaggacatgga

SEQ ID NO: 4988194 - DNA, 21 bp, Homo sapiens
ggagaggtggggagggagaca

SEQ ID NO: 4988195 - DNA, 20 bp, Homo sapiens
ggaggcggaccttgtagtga

SEQ ID NO: 4988196 - DNA, 16 bp, Homo sapiens
ggagggatgttccagt

SEQ ID NO: 4988197 - DNA, 22 bp, Homo sapiens
ggagtaaccaatttctttctaa

SEQ ID NO: 4988198 - DNA, 14 bp, Homo sapiens
ggatagatgtgtgg

SEQ ID NO: 4988199 - DNA, 16 bp, Homo sapiens
ggatcagattcttgct

SEQ ID NO: 4988200 - DNA, 13 bp, Homo sapiens
ggatgtctgggcc

SEQ ID NO: 4988201 - DNA, 14 bp, Homo sapiens
ggatgttccagtgg

SEQ ID NO: 4988202 - DNA, 16 bp, Homo sapiens
ggcaaatgtttattta

SEQ ID NO: 4988203 - DNA, 18 bp, Homo sapiens
ggcaagattgtgtcccat

SEQ ID NO: 4988204 - DNA, 20 bp, Homo sapiens
ggcacctgtagtcccagcta

SEQ ID NO: 4988205 - DNA, 18 bp, Homo sapiens
ggcattaacaataaagca

SEQ ID NO: 4988206 - DNA, 23 bp, Homo sapiens
ggccaccaggaagcacaggtcca

SEQ ID NO: 4988207 - DNA, 21 bp, Homo sapiens
ggccagaaaccttcctgctga

SEQ ID NO: 4988208 - DNA, 17 bp, Homo sapiens
ggccctgtgccttggtg

SEQ ID NO: 4988209 - DNA, 22 bp, Homo sapiens
ggcccttgatgcccagctcagt

SEQ ID NO: 4988210 - DNA, 21 bp, Homo sapiens
ggcctggctgggagtggaaga

SEQ ID NO: 4988211 - DNA, 21 bp, Homo sapiens
ggctatggggatagatgtgtg

SEQ ID NO: 4988212 - DNA, 17 bp, Homo sapiens
ggctggatctgtgaggg

SEQ ID NO: 4988213 - DNA, 19 bp, Homo sapiens
gggagaatgtcagtatgtg

SEQ ID NO: 4988214 - DNA, 22 bp, Homo sapiens
gggagaatgtcagtatgtggaa

SEQ ID NO: 4988215 - DNA, 12 bp, Homo sapiens
gggagagactct

SEQ ID NO: 4988216 - DNA, 11 bp, Homo sapiens
gggagtgtgta

SEQ ID NO: 4988217 - DNA, 13 bp, Homo sapiens
gggatagatgtgt

SEQ ID NO: 4988218 - DNA, 16 bp, Homo sapiens
gggcatgggagggagg

SEQ ID NO: 4988219 - DNA, 20 bp, Homo sapiens
gggcatgggagggagggaga

SEQ ID NO: 4988220 - DNA, 21 bp, Homo sapiens
ggggcaggggagtgccaaggt

SEQ ID NO: 4988221 - DNA, 23 bp, Homo sapiens
ggggtctgtgtgtttatgtgtgt

SEQ ID NO: 4988222 - DNA, 21 bp, Homo sapiens
gggtcatctgtacctctgcct

SEQ ID NO: 4988223 - DNA, 18 bp, Homo sapiens
gggtcattcatggcctgg

SEQ ID NO: 4988224 - DNA, 18 bp, Homo sapiens
ggtagtggcaaagagagg

SEQ ID NO: 4988225 - DNA, 17 bp, Homo sapiens
ggtccaaggctggtccc

SEQ ID NO: 4988226 - DNA, 11 bp, Homo sapiens
ggtctgtgtgt

SEQ ID NO: 4988227 - DNA, 18 bp, Homo sapiens
ggtgctgagtgtacagag

SEQ ID NO: 4988228 - DNA, 23 bp, Homo sapiens
ggttataacttaatgaaaacaat

SEQ ID NO: 4988229 - DNA, 19 bp, Homo sapiens
gtaaaactcactgaatcta

SEQ ID NO: 4988230 - DNA, 17 bp, Homo sapiens
gtaaatttatgtgatgg

SEQ ID NO: 4988231 - DNA, 19 bp, Homo sapiens
gtaagaaaatgctagaaga

SEQ ID NO: 4988232 - DNA, 21 bp, Homo sapiens
gtactatctgtgcgtagaagt

SEQ ID NO: 4988233 - DNA, 15 bp, Homo sapiens
gtagagccagaggtc

SEQ ID NO: 4988234 - DNA, 23 bp, Homo sapiens
gtagaggcatgaacacacatgga

SEQ ID NO: 4988235 - DNA, 20 bp, Homo sapiens
gtagatgtatgcacacacat

SEQ ID NO: 4988236 - DNA, 13 bp, Homo sapiens
gtagcattttaaa

SEQ ID NO: 4988237 - DNA, 21 bp, Homo sapiens
gtaggctattcctgagagctg

SEQ ID NO: 4988238 - DNA, 20 bp, Homo sapiens
gtataggataaattacatta

SEQ ID NO: 4988239 - DNA, 20 bp, Homo sapiens
gtatgtgggggtctgtgtgt

SEQ ID NO: 4988240 - DNA, 16 bp, Homo sapiens
gtcaagcatgtatttt

SEQ ID NO: 4988241 - DNA, 14 bp, Homo sapiens
gtcactattcatca

SEQ ID NO: 4988242 - DNA, 19 bp, Homo sapiens
gtcactattcatcaatgaa

SEQ ID NO: 4988243 - DNA, 18 bp, Homo sapiens
gtcagacacagattggcc

SEQ ID NO: 4988244 - DNA, 21 bp, Homo sapiens
gtcagtatgtggaagtgtggg

SEQ ID NO: 4988245 - DNA, 17 bp, Homo sapiens
gtccagagtcctggccc

SEQ ID NO: 4988246 - DNA, 16 bp, Homo sapiens
gtcccacacttatcag

SEQ ID NO: 4988247 - DNA, 11 bp, Homo sapiens
gtctgaaatgg

SEQ ID NO: 4988248 - DNA, 20 bp, Homo sapiens
gtctgtgtgtgtgtatgtgg

SEQ ID NO: 4988249 - DNA, 11 bp, Homo sapiens
gtctgtgtgtt

SEQ ID NO: 4988250 - DNA, 17 bp, Homo sapiens
gtgaactgatcatgttt

SEQ ID NO: 4988251 - DNA, 21 bp, Homo sapiens
gtgactatggagctgagcagg

SEQ ID NO: 4988252 - DNA, 15 bp, Homo sapiens
gtgagagagtggctg

SEQ ID NO: 4988253 - DNA, 15 bp, Homo sapiens
gtgattccgcagtga

SEQ ID NO: 4988254 - DNA, 14 bp, Homo sapiens
gtgatttacacagg

SEQ ID NO: 4988255 - DNA, 15 bp, Homo sapiens
gtgatttacacaggt

SEQ ID NO: 4988256 - DNA, 21 bp, Homo sapiens
gtgccaggatggaatgatggg

SEQ ID NO: 4988257 - DNA, 19 bp, Homo sapiens
gtgccttggggaaatgtgg

SEQ ID NO: 4988258 - DNA, 22 bp, Homo sapiens
gtggaagtgtgggtctgtgtgt

SEQ ID NO: 4988259 - DNA, 21 bp, Homo sapiens
gtggatcacgaggtcaggaga

SEQ ID NO: 4988260 - DNA, 14 bp, Homo sapiens
gtggatgagggcca

SEQ ID NO: 4988261 - DNA, 18 bp, Homo sapiens
gtggcaaagagaggtcca

SEQ ID NO: 4988262 - DNA, 22 bp, Homo sapiens
gtggcaaagagaggtccagagt

SEQ ID NO: 4988263 - DNA, 17 bp, Homo sapiens
gtggctggatctgtgag

SEQ ID NO: 4988264 - DNA, 13 bp, Homo sapiens
gtgggagtgtgta

SEQ ID NO: 4988265 - DNA, 14 bp, Homo sapiens
gtgggagtgtgtaa

SEQ ID NO: 4988266 - DNA, 13 bp, Homo sapiens
gtgggtctgtgtg

SEQ ID NO: 4988267 - DNA, 23 bp, Homo sapiens
gtggtggcaggcacctgtagtcc

SEQ ID NO: 4988268 - DNA, 20 bp, Homo sapiens
gtgtaatttaaaattgtgat

SEQ ID NO: 4988269 - DNA, 22 bp, Homo sapiens
gtgtaatttaaaattgtgatgt

SEQ ID NO: 4988270 - DNA, 21 bp, Homo sapiens
gtgtatgtgggggtctgtgtg

SEQ ID NO: 4988271 - DNA, 17 bp, Homo sapiens
gtgtgggagtgtgtaat

SEQ ID NO: 4988272 - DNA, 14 bp, Homo sapiens
gtgtgtaatttaaa

SEQ ID NO: 4988273 - DNA, 13 bp, Homo sapiens
gtgtgtgtatgtg

SEQ ID NO: 4988274 - DNA, 12 bp, Homo sapiens
gtgtttatgtgt

SEQ ID NO: 4988275 - DNA, 15 bp, Homo sapiens
gttaataataatgac

SEQ ID NO: 4988276 - DNA, 14 bp, Homo sapiens
gttacctacttttt

SEQ ID NO: 4988277 - DNA, 20 bp, Homo sapiens
gttcattaaacgtcattcag

SEQ ID NO: 4988278 - DNA, 14 bp, Homo sapiens
gttctagtgttttc

SEQ ID NO: 4988279 - DNA, 17 bp, Homo sapiens
gttctagtgttttcaat

SEQ ID NO: 4988280 - DNA, 14 bp, Homo sapiens
gttgggagaatgtc

SEQ ID NO: 4988281 - DNA, 18 bp, Homo sapiens
gttgtatcagcacgtgtg

SEQ ID NO: 4988282 - DNA, 12 bp, Homo sapiens
gttgtgtgtggg

SEQ ID NO: 4988283 - DNA, 13 bp, Homo sapiens
gttgtgtgtggga

SEQ ID NO: 4988284 - DNA, 22 bp, Homo sapiens
gttgtgtgtgggagtgtgtaat

SEQ ID NO: 4988285 - DNA, 19 bp, Homo sapiens
gttgttctgaaatgtcagt

SEQ ID NO: 4988286 - DNA, 19 bp, Homo sapiens
gtttaaaagtccactttta

SEQ ID NO: 4988287 - DNA, 16 bp, Homo sapiens
gtttagaagaagtgtg

SEQ ID NO: 4988288 - DNA, 13 bp, Homo sapiens
gtttatgtgtgtg

SEQ ID NO: 4988289 - DNA, 14 bp, Homo sapiens
gtttcgacgtttga

SEQ ID NO: 4988290 - DNA, 14 bp, Homo sapiens
gttttcttttaaga

SEQ ID NO: 4988291 - DNA, 18 bp, Homo sapiens
taaaaacaacgaaagaag

SEQ ID NO: 4988292 - DNA, 14 bp, Homo sapiens
taaaactatttatg

SEQ ID NO: 4988293 - DNA, 17 bp, Homo sapiens
taaaataagtctgattt

SEQ ID NO: 4988294 - DNA, 19 bp, Homo sapiens
taaaataagtctgatttaa

SEQ ID NO: 4988295 - DNA, 16 bp, Homo sapiens
taaaattgtgatgtgt

SEQ ID NO: 4988296 - DNA, 15 bp, Homo sapiens
taaacaaaatagaaa

SEQ ID NO: 4988297 - DNA, 19 bp, Homo sapiens
taggataaattacattaaa

SEQ ID NO: 4988298 - DNA, 15 bp, Homo sapiens
taggctattcctgag

SEQ ID NO: 4988299 - DNA, 17 bp, Homo sapiens
taggctattcctgagag

SEQ ID NO: 4988300 - DNA, 13 bp, Homo sapiens
taggtgacatata

SEQ ID NO: 4988301 - DNA, 23 bp, Homo sapiens
tagtattttttacattttacaca

SEQ ID NO: 4988302 - DNA, 17 bp, Homo sapiens
tagtgatttacacaggt

SEQ ID NO: 4988303 - DNA, 18 bp, Homo sapiens
tagtgatttacacaggtt

SEQ ID NO: 4988304 - DNA, 17 bp, Homo sapiens
tagtggcaaagagaggt

SEQ ID NO: 4988305 - DNA, 21 bp, Homo sapiens
tagtgttttcaattttaaaca

SEQ ID NO: 4988306 - DNA, 22 bp, Homo sapiens
tagtgttttcaattttaaacat

SEQ ID NO: 4988307 - DNA, 23 bp, Homo sapiens
tagtgttttcaattttaaacata

SEQ ID NO: 4988308 - DNA, 15 bp, Homo sapiens
tagttacctactttt

SEQ ID NO: 4988309 - DNA, 21 bp, Homo sapiens
tagttgattgcgagaattttc

SEQ ID NO: 4988310 - DNA, 14 bp, Homo sapiens
tataacttaatgaa

SEQ ID NO: 4988311 - DNA, 19 bp, Homo sapiens
tataacttaatgaaaacaa

SEQ ID NO: 4988312 - DNA, 23 bp, Homo sapiens
tatacaaggatcagattcttgct

SEQ ID NO: 4988313 - DNA, 15 bp, Homo sapiens
tatagaaaatcttca

SEQ ID NO: 4988314 - DNA, 20 bp, Homo sapiens
tatagaataggcactttaaa

SEQ ID NO: 4988315 - DNA, 22 bp, Homo sapiens
tatagctaggtgacatatacat

SEQ ID NO: 4988316 - DNA, 20 bp, Homo sapiens
tataggataaattacattaa

SEQ ID NO: 4988317 - DNA, 22 bp, Homo sapiens
tataggataaattacattaaaa

SEQ ID NO: 4988318 - DNA, 15 bp, Homo sapiens
tatatgtagatgtat

SEQ ID NO: 4988319 - DNA, 16 bp, Homo sapiens
tatcaagtatagaaaa

SEQ ID NO: 4988320 - DNA, 17 bp, Homo sapiens
tatcagttgcaggtgcc

SEQ ID NO: 4988321 - DNA, 13 bp, Homo sapiens
tatcttacgaaaa

SEQ ID NO: 4988322 - DNA, 13 bp, Homo sapiens
tatgcaaagtcta

SEQ ID NO: 4988323 - DNA, 14 bp, Homo sapiens
tatgcacacacata

SEQ ID NO: 4988324 - DNA, 16 bp, Homo sapiens
tatgcacacacatata

SEQ ID NO: 4988325 - DNA, 15 bp, Homo sapiens
tatgcacacacatgg

SEQ ID NO: 4988326 - DNA, 23 bp, Homo sapiens
tatgctggtagctagtgatttac

SEQ ID NO: 4988327 - DNA, 16 bp, Homo sapiens
tatggcccatctgtat

SEQ ID NO: 4988328 - DNA, 13 bp, Homo sapiens
tatgggagctgtc

SEQ ID NO: 4988329 - DNA, 19 bp, Homo sapiens
tatggggatagatgtgtgg

SEQ ID NO: 4988330 - DNA, 21 bp, Homo sapiens
tatggtaggaactgctgggct

SEQ ID NO: 4988331 - DNA, 12 bp, Homo sapiens
tatgtggaagtg

SEQ ID NO: 4988332 - DNA, 23 bp, Homo sapiens
tatgttattggaattttctttca

SEQ ID NO: 4988333 - DNA, 20 bp, Homo sapiens
tattaagaggtaagacttag

SEQ ID NO: 4988334 - DNA, 14 bp, Homo sapiens
tattactctatgat

SEQ ID NO: 4988335 - DNA, 14 bp, Homo sapiens
tattattaaatgta

SEQ ID NO: 4988336 - DNA, 20 bp, Homo sapiens
tattatttgcagtgcagtat

SEQ ID NO: 4988337 - DNA, 15 bp, Homo sapiens
tatttatttacaaat

SEQ ID NO: 4988338 - DNA, 13 bp, Homo sapiens
tatttatttatgt

SEQ ID NO: 4988339 - DNA, 22 bp, Homo sapiens
tatttgcagtgcagtatagaat

SEQ ID NO: 4988340 - DNA, 12 bp, Homo sapiens
tattttgaaatt

SEQ ID NO: 4988341 - DNA, 16 bp, Homo sapiens
tcaaatcaggttttct

SEQ ID NO: 4988342 - DNA, 18 bp, Homo sapiens
tcaagcaagtttaatcaa

SEQ ID NO: 4988343 - DNA, 20 bp, Homo sapiens
tcaagcaagtttaatcaatg

SEQ ID NO: 4988344 - DNA, 15 bp, Homo sapiens
tcaagcatgtatttt

SEQ ID NO: 4988345 - DNA, 21 bp, Homo sapiens
tcaaggtggaaatggcccatt

SEQ ID NO: 4988346 - DNA, 17 bp, Homo sapiens
tcaagtatagaaaatct

SEQ ID NO: 4988347 - DNA, 16 bp, Homo sapiens
tcaagtgccattcatc

SEQ ID NO: 4988348 - DNA, 19 bp, Homo sapiens
tcaagtgccattcatcctt

SEQ ID NO: 4988349 - DNA, 21 bp, Homo sapiens
tcaataaaccttttgtttcct

SEQ ID NO: 4988350 - DNA, 17 bp, Homo sapiens
tcaatacactcaagtgc

SEQ ID NO: 4988351 - DNA, 19 bp, Homo sapiens
tcaataggagggatgttcc

SEQ ID NO: 4988352 - DNA, 14 bp, Homo sapiens
tcaattttaaacat

SEQ ID NO: 4988353 - DNA, 15 bp, Homo sapiens
tcaattttaaacata

SEQ ID NO: 4988354 - DNA, 23 bp, Homo sapiens
tcacagcaagtcactggccagtg

SEQ ID NO: 4988355 - DNA, 23 bp, Homo sapiens
tcacagcagtgagactggggcca

SEQ ID NO: 4988356 - DNA, 11 bp, Homo sapiens
tcacctcctaa

SEQ ID NO: 4988357 - DNA, 17 bp, Homo sapiens
tcactaagtatgatcta

SEQ ID NO: 4988358 - DNA, 22 bp, Homo sapiens
tggaaatggcccatttaatgat

SEQ ID NO: 4988359 - DNA, 20 bp, Homo sapiens
tggaaattaggttgaaacat

SEQ ID NO: 4988360 - DNA, 22 bp, Homo sapiens
tggaaattaggttgaaacatat

SEQ ID NO: 4988361 - DNA, 20 bp, Homo sapiens
tggaagtgtgggtctgtgtg

SEQ ID NO: 4988362 - DNA, 18 bp, Homo sapiens
tggaataagacagagacc

SEQ ID NO: 4988363 - DNA, 23 bp, Homo sapiens
tggaatagaaaagatgagaggca

SEQ ID NO: 4988364 - DNA, 20 bp, Homo sapiens
tggaatgatgggtcagttgt

SEQ ID NO: 4988365 - DNA, 20 bp, Homo sapiens
tggaatgggagtctgaaatg

SEQ ID NO: 4988366 - DNA, 21 bp, Homo sapiens
tggaattttctttcatacatt

SEQ ID NO: 4988367 - DNA, 22 bp, Homo sapiens
tggagaacattcaatcttgccg

SEQ ID NO: 4988368 - DNA, 19 bp, Homo sapiens
tggatgagggccaccagga

SEQ ID NO: 4988369 - DNA, 16 bp, Homo sapiens
tggcaaagagaggtcc

SEQ ID NO: 4988370 - DNA, 13 bp, Homo sapiens
tggcaaagcagaa

SEQ ID NO: 4988371 - DNA, 18 bp, Homo sapiens
tggcaaagcagaatgtga

SEQ ID NO: 4988372 - DNA, 16 bp, Homo sapiens
tggcattaacaataaa

SEQ ID NO: 4988373 - DNA, 19 bp, Homo sapiens
tggcattaacaataaagca

SEQ ID NO: 4988374 - DNA, 23 bp, Homo sapiens
tggccagtggctggatctgtgag

SEQ ID NO: 4988375 - DNA, 16 bp, Homo sapiens
tggcccttgatgccca

SEQ ID NO: 4988376 - DNA, 21 bp, Homo sapiens
tggcctgttcttctatgggtt

SEQ ID NO: 4988377 - DNA, 19 bp, Homo sapiens
tgggagaatgtcagtatgt

SEQ ID NO: 4988378 - DNA, 22 bp, Homo sapiens
tgggagaatgtcagtatgtgga

SEQ ID NO: 4988379 - DNA, 21 bp, Homo sapiens
tgggagtgaggatgtctgggc

SEQ ID NO: 4988380 - DNA, 20 bp, Homo sapiens
tgggcactatttatttacaa

SEQ ID NO: 4988381 - DNA, 21 bp, Homo sapiens
tggggagggagacagagacag

SEQ ID NO: 4988382 - DNA, 17 bp, Homo sapiens
tggggatagatgtgtgg

SEQ ID NO: 4988383 - DNA, 21 bp, Homo sapiens
tggggctactgtttcagtcct

SEQ ID NO: 4988384 - DNA, 17 bp, Homo sapiens
tggtagctagtgattta

SEQ ID NO: 4988385 - DNA, 20 bp, Homo sapiens
tggtgttcataatttcagtt

SEQ ID NO: 4988386 - DNA, 16 bp, Homo sapiens
tggttataacttaatg

SEQ ID NO: 4988387 - DNA, 18 bp, Homo sapiens
tgtaatttaaaattgtga

SEQ ID NO: 4988388 - DNA, 16 bp, Homo sapiens
tgtatatgtagatgta

SEQ ID NO: 4988389 - DNA, 23 bp, Homo sapiens
tgtatcaaattatttttaagttt

SEQ ID NO: 4988390 - DNA, 15 bp, Homo sapiens
tgtatgcacacacat

SEQ ID NO: 4988391 - DNA, 17 bp, Homo sapiens
tgtatgtgacaacattt

SEQ ID NO: 4988392 - DNA, 22 bp, Homo sapiens
tgtatgtgggggtctgtgtgtt

SEQ ID NO: 4988393 - DNA, 17 bp, Homo sapiens
tgtatgtgtaataaata

SEQ ID NO: 4988394 - DNA, 14 bp, Homo sapiens
tgtatttttgtcaa

SEQ ID NO: 4988395 - DNA, 16 bp, Homo sapiens
tgtcaattaccagaaa

SEQ ID NO: 4988396 - DNA, 22 bp, Homo sapiens
tgtcacccttaggccagcacca

SEQ ID NO: 4988397 - DNA, 12 bp, Homo sapiens
tgtcacttctgg

SEQ ID NO: 4988398 - DNA, 14 bp, Homo sapiens
tgtcagacacagat

SEQ ID NO: 4988399 - DNA, 18 bp, Homo sapiens
tgtcagtatgtggaagtg

SEQ ID NO: 4988400 - DNA, 22 bp, Homo sapiens
tgtcagtatgtggaagtgtggg

SEQ ID NO: 4988401 - DNA, 20 bp, Homo sapiens
tgtcagtctgcttagaaata

SEQ ID NO: 4988402 - DNA, 13 bp, Homo sapiens
tgtcttctttgct

SEQ ID NO: 4988403 - DNA, 12 bp, Homo sapiens
tgtgacaacatt

SEQ ID NO: 4988404 - DNA, 18 bp, Homo sapiens
tgtgacaacatttttgta

SEQ ID NO: 4988405 - DNA, 20 bp, Homo sapiens
tgtgctgtgtgacattggga

SEQ ID NO: 4988406 - DNA, 14 bp, Homo sapiens
tgtggagaacattc

SEQ ID NO: 4988407 - DNA, 14 bp, Homo sapiens
tgtgggagtgtgta

SEQ ID NO: 4988408 - DNA, 16 bp, Homo sapiens
tgtgggggtctgtgtg

SEQ ID NO: 4988409 - DNA, 14 bp, Homo sapiens
tgtgggtctgtgtg

SEQ ID NO: 4988410 - DNA, 16 bp, Homo sapiens
tgtgggtctgtgtgtg

SEQ ID NO: 4988411 - DNA, 23 bp, Homo sapiens
tgtggttataacttaatgaaaac

SEQ ID NO: 4988412 - DNA, 19 bp, Homo sapiens
tgtgtaatttaaaattgtg

SEQ ID NO: 4988413 - DNA, 11 bp, Homo sapiens
tgtgtatgtgg

SEQ ID NO: 4988414 - DNA, 16 bp, Homo sapiens
tgtgtgggagtgtgta

SEQ ID NO: 4988415 - DNA, 11 bp, Homo sapiens
tgtgtgtatgt

SEQ ID NO: 4988416 - DNA, 20 bp, Homo sapiens
tgtgtgtgggagtgtgtaat

SEQ ID NO: 4988417 - DNA, 14 bp, Homo sapiens
tgtgtgtgtatgtg

SEQ ID NO: 4988418 - DNA, 23 bp, Homo sapiens
tgtgttgtgtgtgggagtgtgta

SEQ ID NO: 4988419 - DNA, 15 bp, Homo sapiens
tgtgtttatgtgtgt

SEQ ID NO: 4988420 - DNA, 22 bp, Homo sapiens
tgttcatcaacagtgagagact

SEQ ID NO: 4988421 - DNA, 21 bp, Homo sapiens
tgttcattaaacgtcattcag

SEQ ID NO: 4988422 - DNA, 16 bp, Homo sapiens
tgttcttttgtcccag

SEQ ID NO: 4988423 - DNA, 15 bp, Homo sapiens
tgttgtgtgtgggag

SEQ ID NO: 4988424 - DNA, 16 bp, Homo sapiens
tgttgtgtgtgggagt

SEQ ID NO: 4988425 - DNA, 14 bp, Homo sapiens
tgtttacagaggac

SEQ ID NO: 4988426 - DNA, 15 bp, Homo sapiens
ttaaaactcatttag

SEQ ID NO: 4988427 - DNA, 15 bp, Homo sapiens
ttaaaataagtctga

SEQ ID NO: 4988428 - DNA, 18 bp, Homo sapiens
ttaaaattgtgatgtgtc

SEQ ID NO: 4988429 - DNA, 22 bp, Homo sapiens
ttaaacatatccaagtttgaat

SEQ ID NO: 4988430 - DNA, 14 bp, Homo sapiens
ttaaagatttctgc

SEQ ID NO: 4988431 - DNA, 17 bp, Homo sapiens
ttaagaaaaacatctgg

SEQ ID NO: 4988432 - DNA, 12 bp, Homo sapiens
ttactatttctt

SEQ ID NO: 4988433 - DNA, 19 bp, Homo sapiens
ttactctatgatgattgct

SEQ ID NO: 4988434 - DNA, 22 bp, Homo sapiens
ttacttaagacttaatgagact

SEQ ID NO: 4988435 - DNA, 14 bp, Homo sapiens
ttagaagaagtgtg

SEQ ID NO: 4988436 - DNA, 14 bp, Homo sapiens
ttatcaacatttgt

SEQ ID NO: 4988437 - DNA, 15 bp, Homo sapiens
ttatcagcagcaaca

SEQ ID NO: 4988438 - DNA, 14 bp, Homo sapiens
ttattggaattttc

SEQ ID NO: 4988439 - DNA, 14 bp, Homo sapiens
ttatttacaaatgt

SEQ ID NO: 4988440 - DNA, 23 bp, Homo sapiens
ttcaaagagactaatagagacac

SEQ ID NO: 4988441 - DNA, 12 bp, Homo sapiens
ttcataatttca

SEQ ID NO: 4988442 - DNA, 22 bp, Homo sapiens
ttcccataccacccaaaatcat

SEQ ID NO: 4988443 - DNA, 21 bp, Homo sapiens
ttcctgaggaagagggactgt

SEQ ID NO: 4988444 - DNA, 22 bp, Homo sapiens
ttctagttgattgcgagaattt

SEQ ID NO: 4988445 - DNA, 19 bp, Homo sapiens
ttctgctccaaattttcaa

SEQ ID NO: 4988446 - DNA, 16 bp, Homo sapiens
ttctttcatacattat

SEQ ID NO: 4988447 - DNA, 19 bp, Homo sapiens
ttcttttgttttcttcatt

SEQ ID NO: 4988448 - DNA, 20 bp, Homo sapiens
ttcttttgttttcttcattt

SEQ ID NO: 4988449 - DNA, 21 bp, Homo sapiens
ttgacagagttggtgttcata

SEQ ID NO: 4988450 - DNA, 21 bp, Homo sapiens
ttgactaatgaggcattacaa

SEQ ID NO: 4988451 - DNA, 17 bp, Homo sapiens
ttgactagccatctcaa

SEQ ID NO: 4988452 - DNA, 17 bp, Homo sapiens
ttgatgcccagctcagt

SEQ ID NO: 4988453 - DNA, 21 bp, Homo sapiens
ttgattcacctcctaaaacaa

SEQ ID NO: 4988454 - DNA, 22 bp, Homo sapiens
ttgattcacctcctaaaacaac

SEQ ID NO: 4988455 - DNA, 12 bp, Homo sapiens
ttgatttcaagt

SEQ ID NO: 4988456 - DNA, 15 bp, Homo sapiens
ttgccagagccttaa

SEQ ID NO: 4988457 - DNA, 15 bp, Homo sapiens
ttgcgagaattttca

SEQ ID NO: 4988458 - DNA, 14 bp, Homo sapiens
ttggaattttcttt

SEQ ID NO: 4988459 - DNA, 22 bp, Homo sapiens
ttggaattttctttcatacatt

SEQ ID NO: 4988460 - DNA, 16 bp, Homo sapiens
ttggtgattccgcagt

SEQ ID NO: 4988461 - DNA, 19 bp, Homo sapiens
ttgtaaatttatgtgatgg

SEQ ID NO: 4988462 - DNA, 11 bp, Homo sapiens
ttgtacattat

SEQ ID NO: 4988463 - DNA, 16 bp, Homo sapiens
ttgtgtgtgggagtgt

SEQ ID NO: 4988464 - DNA, 21 bp, Homo sapiens
ttgttctgaaatgtcagttct

SEQ ID NO: 4988465 - DNA, 23 bp, Homo sapiens
ttgttctgaaatgtcagttctga

SEQ ID NO: 4988466 - DNA, 18 bp, Homo sapiens
ttgtttagaagaagtgtg

SEQ ID NO: 4988467 - DNA, 13 bp, Homo sapiens
tttaaaactatat

SEQ ID NO: 4988468 - DNA, 13 bp, Homo sapiens
tttaaacaaaata

SEQ ID NO: 4988469 - DNA, 16 bp, Homo sapiens
tttaatatgcaaagtc

SEQ ID NO: 4988470 - DNA, 19 bp, Homo sapiens
tttacacactgtacacata

SEQ ID NO: 4988471 - DNA, 21 bp, Homo sapiens
tttacacaggtttagttgact

SEQ ID NO: 4988472 - DNA, 20 bp, Homo sapiens
tttacagaggacagtatttg

SEQ ID NO: 4988473 - DNA, 13 bp, Homo sapiens
tttacattttaca

SEQ ID NO: 4988474 - DNA, 12 bp, Homo sapiens
tttacttaagac

SEQ ID NO: 4988475 - DNA, 13 bp, Homo sapiens
tttatgtgtgtgt

SEQ ID NO: 4988476 - DNA, 15 bp, Homo sapiens
tttcaattttaaaca

SEQ ID NO: 4988477 - DNA, 17 bp, Homo sapiens
tttcatacattatattc

SEQ ID NO: 4988478 - DNA, 14 bp, Homo sapiens
tttccctccttggt

SEQ ID NO: 4988479 - DNA, 22 bp, Homo sapiens
tttctgctccaaattttcaata

SEQ ID NO: 4988480 - DNA, 16 bp, Homo sapiens
tttctttcatacatta

SEQ ID NO: 4988481 - DNA, 22 bp, Homo sapiens
tttgacagagttggtgttcata

SEQ ID NO: 4988482 - DNA, 23 bp, Homo sapiens
tttgacctgttgggagtgaggat

SEQ ID NO: 4988483 - DNA, 19 bp, Homo sapiens
tttgcagtgcagtatagaa

SEQ ID NO: 4988484 - DNA, 17 bp, Homo sapiens
tttgtaaatttatgtga

SEQ ID NO: 4988485 - DNA, 13 bp, Homo sapiens
aaaagattttcct

SEQ ID NO: 4988486 - DNA, 13 bp, Homo sapiens
aaaataagtctga

SEQ ID NO: 4988487 - DNA, 13 bp, Homo sapiens
aaaatagaaagtt

SEQ ID NO: 4988488 - DNA, 23 bp, Homo sapiens
aaaatcttcatggaattcacaaa

SEQ ID NO: 4988489 - DNA, 16 bp, Homo sapiens
aaacaaaatagaaagt

SEQ ID NO: 4988490 - DNA, 13 bp, Homo sapiens
aaacagagagaga

SEQ ID NO: 4988491 - DNA, 14 bp, Homo sapiens
aaacagatgaaaag

SEQ ID NO: 4988492 - DNA, 14 bp, Homo sapiens
aaacatatctctta

SEQ ID NO: 4988493 - DNA, 23 bp, Homo sapiens
aaacatatctcttatcttacgaa

SEQ ID NO: 4988494 - DNA, 18 bp, Homo sapiens
aaacatctggatatcaag

SEQ ID NO: 4988495 - DNA, 18 bp, Homo sapiens
aaactatatttatttatg

SEQ ID NO: 4988496 - DNA, 23 bp, Homo sapiens
aaagagactaatagagacacaga

SEQ ID NO: 4988497 - DNA, 15 bp, Homo sapiens
aaagtctagttacct

SEQ ID NO: 4988498 - DNA, 22 bp, Homo sapiens
aaagtctagttacctacttttt

SEQ ID NO: 4988499 - DNA, 12 bp, Homo sapiens
aaagtttcagaa

SEQ ID NO: 4988500 - DNA, 17 bp, Homo sapiens
aaataacagaagaaaat

SEQ ID NO: 4988501 - DNA, 13 bp, Homo sapiens
aaataatctctga

SEQ ID NO: 4988502 - DNA, 20 bp, Homo sapiens
aaatagaattgacattgaaa

SEQ ID NO: 4988503 - DNA, 15 bp, Homo sapiens
aaatataaatgaaaa

SEQ ID NO: 4988504 - DNA, 13 bp, Homo sapiens
aaatattaactga

SEQ ID NO: 4988505 - DNA, 20 bp, Homo sapiens
aaatcatatagaaaggctgg

SEQ ID NO: 4988506 - DNA, 20 bp, Homo sapiens
aaatctacaggcctcagggt

SEQ ID NO: 4988507 - DNA, 21 bp, Homo sapiens
aaatctacaggcctcagggtg

SEQ ID NO: 4988508 - DNA, 17 bp, Homo sapiens
aaatctaggaaaattat

SEQ ID NO: 4988509 - DNA, 21 bp, Homo sapiens
aaatgaatgtcacttctggat

SEQ ID NO: 4988510 - DNA, 16 bp, Homo sapiens
aaatggtagcatttta

SEQ ID NO: 4988511 - DNA, 18 bp, Homo sapiens
aaatggtagcattttaaa

SEQ ID NO: 4988512 - DNA, 17 bp, Homo sapiens
aaatgtttatttaaaag

SEQ ID NO: 4988513 - DNA, 22 bp, Homo sapiens
aaatgtttatttaaaagagcag

SEQ ID NO: 4988514 - DNA, 19 bp, Homo sapiens
aaattaactaaggaaatat

SEQ ID NO: 4988515 - DNA, 14 bp, Homo sapiens
aaattaggttgaaa

SEQ ID NO: 4988516 - DNA, 19 bp, Homo sapiens
aaattaggttgaaacatat

SEQ ID NO: 4988517 - DNA, 12 bp, Homo sapiens
aaatttatgtga

SEQ ID NO: 4988518 - DNA, 15 bp, Homo sapiens
aaatttatgtgatgg

SEQ ID NO: 4988519 - DNA, 15 bp, Homo sapiens
aacaaaatagaaagt

SEQ ID NO: 4988520 - DNA, 23 bp, Homo sapiens
aacaaggcctgtcagctaaagaa

SEQ ID NO: 4988521 - DNA, 13 bp, Homo sapiens
aacagaagaaaat

SEQ ID NO: 4988522 - DNA, 15 bp, Homo sapiens
aacagaagattacaa

SEQ ID NO: 4988523 - DNA, 13 bp, Homo sapiens
aacagatgaaaag

SEQ ID NO: 4988524 - DNA, 14 bp, Homo sapiens
aacagatgaaaagc

SEQ ID NO: 4988525 - DNA, 14 bp, Homo sapiens
aacatacaggtgcc

SEQ ID NO: 4988526 - DNA, 19 bp, Homo sapiens
aacatatccaagtttgaat

SEQ ID NO: 4988527 - DNA, 13 bp, Homo sapiens
aacatctggatat

SEQ ID NO: 4988528 - DNA, 17 bp, Homo sapiens
aacattcaatcttgccg

SEQ ID NO: 4988529 - DNA, 17 bp, Homo sapiens
aaccaattcctcatttg

SEQ ID NO: 4988530 - DNA, 14 bp, Homo sapiens
aacgaaagaaggca

SEQ ID NO: 4988531 - DNA, 12 bp, Homo sapiens
aacgtcattcag

SEQ ID NO: 4988532 - DNA, 17 bp, Homo sapiens
aacgtccacagagtata

SEQ ID NO: 4988533 - DNA, 20 bp, Homo sapiens
aactgatcatgtttatgaga

SEQ ID NO: 4988534 - DNA, 14 bp, Homo sapiens
aactgtcagttcat

SEQ ID NO: 4988535 - DNA, 17 bp, Homo sapiens
aactgtcagttcatcct

SEQ ID NO: 4988536 - DNA, 14 bp, Homo sapiens
aacttataattaca

SEQ ID NO: 4988537 - DNA, 22 bp, Homo sapiens
aagaactcctgaaatcatatag

SEQ ID NO: 4988538 - DNA, 16 bp, Homo sapiens
aagacttaatgagact

SEQ ID NO: 4988539 - DNA, 15 bp, Homo sapiens
aagattacaaaagca

SEQ ID NO: 4988540 - DNA, 20 bp, Homo sapiens
aagcaaagcgctaagtaaaa

SEQ ID NO: 4988541 - DNA, 14 bp, Homo sapiens
aagcagaatgtgat

SEQ ID NO: 4988542 - DNA, 22 bp, Homo sapiens
aagcagacgtgagtgtgacttt

SEQ ID NO: 4988543 - DNA, 18 bp, Homo sapiens
aaggaaaaactgatgttt

SEQ ID NO: 4988544 - DNA, 14 bp, Homo sapiens
aaggatcagattct

SEQ ID NO: 4988545 - DNA, 23 bp, Homo sapiens
aaggctatggggatagatgtgtg

SEQ ID NO: 4988546 - DNA, 16 bp, Homo sapiens
aagtaatttggaaatt

SEQ ID NO: 4988547 - DNA, 23 bp, Homo sapiens
aagtataggataaattacattaa

SEQ ID NO: 4988548 - DNA, 20 bp, Homo sapiens
aagtctaggttggtagagtt

SEQ ID NO: 4988549 - DNA, 17 bp, Homo sapiens
aagtgtattttgaaatt

SEQ ID NO: 4988550 - DNA, 10 bp, Homo sapiens
aagtgtgggt

SEQ ID NO: 4988551 - DNA, 22 bp, Homo sapiens
aagttcaccagcatggtagtgg

SEQ ID NO: 4988552 - DNA, 14 bp, Homo sapiens
aagttctagtgttt

SEQ ID NO: 4988553 - DNA, 21 bp, Homo sapiens
aagttctagtgttttcaattt

SEQ ID NO: 4988554 - DNA, 21 bp, Homo sapiens
aagtttgaattcctaaaatta

SEQ ID NO: 4988555 - DNA, 17 bp, Homo sapiens
aataaagcattttgcaa

SEQ ID NO: 4988556 - DNA, 15 bp, Homo sapiens
aataagtctgattta

SEQ ID NO: 4988557 - DNA, 17 bp, Homo sapiens
aataagtgccaggatgg

SEQ ID NO: 4988558 - DNA, 16 bp, Homo sapiens
aataagtgctactttg

SEQ ID NO: 4988559 - DNA, 14 bp, Homo sapiens
aataatgactctaa

SEQ ID NO: 4988560 - DNA, 15 bp, Homo sapiens
aataatgactctaaa

SEQ ID NO: 4988561 - DNA, 21 bp, Homo sapiens
aatagaattgacattgaaatc

SEQ ID NO: 4988562 - DNA, 19 bp, Homo sapiens
aatagattgctcaaatcag

SEQ ID NO: 4988563 - DNA, 14 bp, Homo sapiens
aataggcactttaa

SEQ ID NO: 4988564 - DNA, 15 bp, Homo sapiens
aataggcactttaaa

SEQ ID NO: 4988565 - DNA, 14 bp, Homo sapiens
aatatgcaaagtct

SEQ ID NO: 4988566 - DNA, 18 bp, Homo sapiens
aatatgcaaagtctaggt

SEQ ID NO: 4988567 - DNA, 15 bp, Homo sapiens
aatatgtttcacaca

SEQ ID NO: 4988568 - DNA, 21 bp, Homo sapiens
aatattaactgacgaagaagc

SEQ ID NO: 4988569 - DNA, 23 bp, Homo sapiens
aatattgccaatgctacagtaat

SEQ ID NO: 4988570 - DNA, 13 bp, Homo sapiens
aatctaaactgta

SEQ ID NO: 4988571 - DNA, 13 bp, Homo sapiens
aatgaatgtcact

SEQ ID NO: 4988572 - DNA, 16 bp, Homo sapiens
aatgactctaaagaaa

SEQ ID NO: 4988573 - DNA, 20 bp, Homo sapiens
aatgagactttaaaagcatt

SEQ ID NO: 4988574 - DNA, 17 bp, Homo sapiens
aatgcaaaaaaaattag

SEQ ID NO: 4988575 - DNA, 24 bp, Homo sapiens
aatgcacacacacagagatatgca

SEQ ID NO: 4988576 - DNA, 22 bp, Homo sapiens
aatgcagtacaggacatatatt

SEQ ID NO: 4988577 - DNA, 14 bp, Homo sapiens
aatgctagaagaaa

SEQ ID NO: 4988578 - DNA, 17 bp, Homo sapiens
aatgggagtctgaaatg

SEQ ID NO: 4988579 - DNA, 21 bp, Homo sapiens
aatggggtagaggagggcatg

SEQ ID NO: 4988580 - DNA, 16 bp, Homo sapiens
aatggtagcattttaa

SEQ ID NO: 4988581 - DNA, 21 bp, Homo sapiens
aatggtagcattttaaacaaa

SEQ ID NO: 4988582 - DNA, 13 bp, Homo sapiens
aatgtcagtatgt

SEQ ID NO: 4988583 - DNA, 16 bp, Homo sapiens
aatgtcagtatgtgga

SEQ ID NO: 4988584 - DNA, 14 bp, Homo sapiens
atcagcagcaacaa

SEQ ID NO: 4988585 - DNA, 13 bp, Homo sapiens
atcagttgcaggt

SEQ ID NO: 4988586 - DNA, 16 bp, Homo sapiens
atcatgtcagtctgct

SEQ ID NO: 4988587 - DNA, 23 bp, Homo sapiens
atcatgtttacagaggacagtat

SEQ ID NO: 4988588 - DNA, 22 bp, Homo sapiens
atcattggatcctactcaacaa

SEQ ID NO: 4988589 - DNA, 20 bp, Homo sapiens
atccactgggtgtaaacaca

SEQ ID NO: 4988590 - DNA, 19 bp, Homo sapiens
atccatagcacctccacat

SEQ ID NO: 4988591 - DNA, 15 bp, Homo sapiens
atctagtagttgttc

SEQ ID NO: 4988592 - DNA, 15 bp, Homo sapiens
atctcaagcaagttt

SEQ ID NO: 4988593 - DNA, 14 bp, Homo sapiens
atctgatgggcctg

SEQ ID NO: 4988594 - DNA, 16 bp, Homo sapiens
atctgatgggcctggc

SEQ ID NO: 4988595 - DNA, 18 bp, Homo sapiens
atctgatgggcctggctg

SEQ ID NO: 4988596 - DNA, 23 bp, Homo sapiens
atctgtatgctggtagctagtga

SEQ ID NO: 4988597 - DNA, 21 bp, Homo sapiens
atctgtcaaagaaaacttcca

SEQ ID NO: 4988598 - DNA, 21 bp, Homo sapiens
atctgtgaggggctctctcat

SEQ ID NO: 4988599 - DNA, 21 bp, Homo sapiens
atcttaaaaacaacgaaagaa

SEQ ID NO: 4988600 - DNA, 22 bp, Homo sapiens
atcttcatggaattcacaaagt

SEQ ID NO: 4988601 - DNA, 12 bp, Homo sapiens
atctttccctcc

SEQ ID NO: 4988602 - DNA, 14 bp, Homo sapiens
atctttccctcctt

SEQ ID NO: 4988603 - DNA, 22 bp, Homo sapiens
atgaacacacatggatgcacac

SEQ ID NO: 4988604 - DNA, 18 bp, Homo sapiens
atgaagattaacactgag

SEQ ID NO: 4988605 - DNA, 19 bp, Homo sapiens
atgaatgtcacttctggat

SEQ ID NO: 4988606 - DNA, 15 bp, Homo sapiens
atgactctaaagaaa

SEQ ID NO: 4988607 - DNA, 12 bp, Homo sapiens
atgacttgctca

SEQ ID NO: 4988608 - DNA, 16 bp, Homo sapiens
atgagggccaccagga

SEQ ID NO: 4988609 - DNA, 14 bp, Homo sapiens
atgattttcttttg

SEQ ID NO: 4988610 - DNA, 15 bp, Homo sapiens
atgcacacacatata

SEQ ID NO: 4988611 - DNA, 16 bp, Homo sapiens
atgcacacacatatat

SEQ ID NO: 4988612 - DNA, 19 bp, Homo sapiens
atgcagtacaggacatata

SEQ ID NO: 4988613 - DNA, 23 bp, Homo sapiens
atgccagggccatgtcagacaca

SEQ ID NO: 4988614 - DNA, 17 bp, Homo sapiens
atgctacagtaataaat

SEQ ID NO: 4988615 - DNA, 17 bp, Homo sapiens
atgctggtagctagtga

SEQ ID NO: 4988616 - DNA, 14 bp, Homo sapiens
atggacttctggat

SEQ ID NO: 4988617 - DNA, 21 bp, Homo sapiens
atggagagagactcaaagaga

SEQ ID NO: 4988618 - DNA, 18 bp, Homo sapiens
atggaggactccaggcag

SEQ ID NO: 4988619 - DNA, 19 bp, Homo sapiens
atggaggactccaggcagc

SEQ ID NO: 4988620 - DNA, 21 bp, Homo sapiens
atggaggactccaggcagcag

SEQ ID NO: 4988621 - DNA, 16 bp, Homo sapiens
atgggagggagggaga

SEQ ID NO: 4988622 - DNA, 20 bp, Homo sapiens
atggggatagatgtgtggac

SEQ ID NO: 4988623 - DNA, 17 bp, Homo sapiens
atgtagatgtatgcaca

SEQ ID NO: 4988624 - DNA, 19 bp, Homo sapiens
atgtagatgtatgcacaca

SEQ ID NO: 4988625 - DNA, 16 bp, Homo sapiens
atgtatgcacacacat

SEQ ID NO: 4988626 - DNA, 17 bp, Homo sapiens
atgtatgtgtaataaat

SEQ ID NO: 4988627 - DNA, 16 bp, Homo sapiens
atgtatttatgtcttt

SEQ ID NO: 4988628 - DNA, 15 bp, Homo sapiens
atgtcacttctggat

SEQ ID NO: 4988629 - DNA, 18 bp, Homo sapiens
atgtcacttctggatata

SEQ ID NO: 4988630 - DNA, 21 bp, Homo sapiens
atgtcagacacagattggcca

SEQ ID NO: 4988631 - DNA, 14 bp, Homo sapiens
atgtcagtatgtgg

SEQ ID NO: 4988632 - DNA, 16 bp, Homo sapiens
atgtcagtatgtggaa

SEQ ID NO: 4988633 - DNA, 20 bp, Homo sapiens
atgtcagtctgcttagaaat

SEQ ID NO: 4988634 - DNA, 22 bp, Homo sapiens
atgtcagtctgcttagaaataa

SEQ ID NO: 4988635 - DNA, 21 bp, Homo sapiens
atgtcagttctgatatggaag

SEQ ID NO: 4988636 - DNA, 13 bp, Homo sapiens
atgtgacaacatt

SEQ ID NO: 4988637 - DNA, 16 bp, Homo sapiens
atgtgacaacattttt

SEQ ID NO: 4988638 - DNA, 19 bp, Homo sapiens
atgtgctgtgtgacattgg

SEQ ID NO: 4988639 - DNA, 15 bp, Homo sapiens
atgtggaagtgtggg

SEQ ID NO: 4988640 - DNA, 16 bp, Homo sapiens
atgtggaagtgtgggt

SEQ ID NO: 4988641 - DNA, 17 bp, Homo sapiens
atgtgggggtctgtgtg

SEQ ID NO: 4988642 - DNA, 17 bp, Homo sapiens
atgtgtaataaatatgt

SEQ ID NO: 4988643 - DNA, 23 bp, Homo sapiens
atgtgtgtgtgttgtgtgtggga

SEQ ID NO: 4988644 - DNA, 12 bp, Homo sapiens
atgttattggaa

SEQ ID NO: 4988645 - DNA, 17 bp, Homo sapiens
atgttattggaattttc

SEQ ID NO: 4988646 - DNA, 19 bp, Homo sapiens
atgttattggaattttctt

SEQ ID NO: 4988647 - DNA, 23 bp, Homo sapiens
atgttggcattaacaataaagca

SEQ ID NO: 4988648 - DNA, 17 bp, Homo sapiens
atgtttcacacaaacaa

SEQ ID NO: 4988649 - DNA, 21 bp, Homo sapiens
attaactaaggaaatatttca

SEQ ID NO: 4988650 - DNA, 19 bp, Homo sapiens
attaactgacgaagaagca

SEQ ID NO: 4988651 - DNA, 22 bp, Homo sapiens
attaactgacgaagaagcaact

SEQ ID NO: 4988652 - DNA, 18 bp, Homo sapiens
attaagaggtaagactta

SEQ ID NO: 4988653 - DNA, 16 bp, Homo sapiens
attactgatatcagag

SEQ ID NO: 4988654 - DNA, 19 bp, Homo sapiens
attatatcattttgtggat

SEQ ID NO: 4988655 - DNA, 20 bp, Homo sapiens
attatgttattggaattttc

SEQ ID NO: 4988656 - DNA, 14 bp, Homo sapiens
attcaaagagacta

SEQ ID NO: 4988657 - DNA, 18 bp, Homo sapiens
attcatcctttaagaaaa

SEQ ID NO: 4988658 - DNA, 17 bp, Homo sapiens
attcatggcctggggga

SEQ ID NO: 4988659 - DNA, 13 bp, Homo sapiens
attcccccagtgc

SEQ ID NO: 4988660 - DNA, 17 bp, Homo sapiens
attccctgatttaatat

SEQ ID NO: 4988661 - DNA, 13 bp, Homo sapiens
attcctcatttgt

SEQ ID NO: 4988662 - DNA, 17 bp, Homo sapiens
attcgtggttgatttca

SEQ ID NO: 4988663 - DNA, 12 bp, Homo sapiens
attctataattt

SEQ ID NO: 4988664 - DNA, 16 bp, Homo sapiens
attctatgttggcatt

SEQ ID NO: 4988665 - DNA, 13 bp, Homo sapiens
attcttctgcagt

SEQ ID NO: 4988666 - DNA, 13 bp, Homo sapiens
attctttcctaaa

SEQ ID NO: 4988667 - DNA, 23 bp, Homo sapiens
attgcaggagtccctgccatcat

SEQ ID NO: 4988668 - DNA, 15 bp, Homo sapiens
attgcgagaattttc

SEQ ID NO: 4988669 - DNA, 12 bp, Homo sapiens
attggaattttc

SEQ ID NO: 4988670 - DNA, 13 bp, Homo sapiens
attggaattttct

SEQ ID NO: 4988671 - DNA, 13 bp, Homo sapiens
attgtgatgtgtc

SEQ ID NO: 4988672 - DNA, 17 bp, Homo sapiens
attgtgtcccattcccc

SEQ ID NO: 4988673 - DNA, 13 bp, Homo sapiens
atttaatgattga

SEQ ID NO: 4988674 - DNA, 20 bp, Homo sapiens
atttacacaggtttagttga

SEQ ID NO: 4988675 - DNA, 16 bp, Homo sapiens
atttactgattccagc

SEQ ID NO: 4988676 - DNA, 19 bp, Homo sapiens
atttacttaagacttaatg

SEQ ID NO: 4988677 - DNA, 17 bp, Homo sapiens
atttattgatttcaagt

SEQ ID NO: 4988678 - DNA, 15 bp, Homo sapiens
atttatttacaaatg

SEQ ID NO: 4988679 - DNA, 18 bp, Homo sapiens
atttatttacaaatgttt

SEQ ID NO: 4988680 - DNA, 19 bp, Homo sapiens
atttccatttacttaagac

SEQ ID NO: 4988681 - DNA, 20 bp, Homo sapiens
atttccatttacttaagact

SEQ ID NO: 4988682 - DNA, 19 bp, Homo sapiens
atttgaggagataacattt

SEQ ID NO: 4988683 - DNA, 16 bp, Homo sapiens
atttgctatgagctgg

SEQ ID NO: 4988684 - DNA, 18 bp, Homo sapiens
atttgtaaatttatgtga

SEQ ID NO: 4988685 - DNA, 19 bp, Homo sapiens
atttgtaaatttatgtgat

SEQ ID NO: 4988686 - DNA, 15 bp, Homo sapiens
attttaaacaaaata

SEQ ID NO: 4988687 - DNA, 21 bp, Homo sapiens
attttctttcatacattatat

SEQ ID NO: 4988688 - DNA, 12 bp, Homo sapiens
atttttctcatg

SEQ ID NO: 4988689 - DNA, 23 bp, Homo sapiens
atttttgctcttctgtatgtgac

SEQ ID NO: 4988690 - DNA, 19 bp, Homo sapiens
atttttgtacattatgtta

SEQ ID NO: 4988691 - DNA, 23 bp, Homo sapiens
attttttaacctcctaagtatca

SEQ ID NO: 4988692 - DNA, 18 bp, Homo sapiens
caaaaaaaattagccggg

SEQ ID NO: 4988693 - DNA, 12 bp, Homo sapiens
caaaatagaaag

SEQ ID NO: 4988694 - DNA, 17 bp, Homo sapiens
caaacacaccgatgcac

SEQ ID NO: 4988695 - DNA, 13 bp, Homo sapiens
caaagagaggtcc

SEQ ID NO: 4988696 - DNA, 19 bp, Homo sapiens
caaagcgctaagtaaaaat

SEQ ID NO: 4988697 - DNA, 13 bp, Homo sapiens
caaagtttcagaa

SEQ ID NO: 4988698 - DNA, 18 bp, Homo sapiens
caaatgtttatttaaaag

SEQ ID NO: 4988699 - DNA, 18 bp, Homo sapiens
caaattaactaaggaaat

SEQ ID NO: 4988700 - DNA, 18 bp, Homo sapiens
caacatttttgtacatta

SEQ ID NO: 4988701 - DNA, 14 bp, Homo sapiens
caactgtcagttca

SEQ ID NO: 4988702 - DNA, 21 bp, Homo sapiens
caagaccaaatcattgtatca

SEQ ID NO: 4988703 - DNA, 22 bp, Homo sapiens
caagagaaacattctttcctaa

SEQ ID NO: 4988704 - DNA, 23 bp, Homo sapiens
caagagaaacattctttcctaaa

SEQ ID NO: 4988705 - DNA, 15 bp, Homo sapiens
caagattcaaagaga

SEQ ID NO: 4988706 - DNA, 21 bp, Homo sapiens
caagcatgtatttttgtcaat

SEQ ID NO: 4988707 - DNA, 14 bp, Homo sapiens
caaggctggtccca

SEQ ID NO: 4988708 - DNA, 15 bp, Homo sapiens
caaggtttaagttat

SEQ ID NO: 4988709 - DNA, 15 bp, Homo sapiens
caagtatagaaaatc

SEQ ID NO: 4988710 - DNA, 13 bp, Homo sapiens
caataaagcattt

SEQ ID NO: 4988711 - DNA, 23 bp, Homo sapiens
caatacactcaagtgccattcat

SEQ ID NO: 4988712 - DNA, 20 bp, Homo sapiens
caataggagggatgttccag

SEQ ID NO: 4988713 - DNA, 13 bp, Homo sapiens
caatcatgtcagt

SEQ ID NO: 4988714 - DNA, 16 bp, Homo sapiens
caatgcacacacacag

SEQ ID NO: 4988715 - DNA, 17 bp, Homo sapiens
cacacacagatgcacac

SEQ ID NO: 4988716 - DNA, 15 bp, Homo sapiens
cacacacggatgcac

SEQ ID NO: 4988717 - DNA, 22 bp, Homo sapiens
cacacagagatatgcacacaca

SEQ ID NO: 4988718 - DNA, 15 bp, Homo sapiens
cacacatcagtgcac

SEQ ID NO: 4988719 - DNA, 15 bp, Homo sapiens
cacacatggatgcac

SEQ ID NO: 4988720 - DNA, 15 bp, Homo sapiens
cacaccgatgcacac

SEQ ID NO: 4988721 - DNA, 20 bp, Homo sapiens
cacacttatttttttcccaa

SEQ ID NO: 4988722 - DNA, 16 bp, Homo sapiens
cacagagatatgcaca

SEQ ID NO: 4988723 - DNA, 22 bp, Homo sapiens
cacagatatacacatggatgca

SEQ ID NO: 4988724 - DNA, 18 bp, Homo sapiens
cacagatatgcacacaca

SEQ ID NO: 4988725 - DNA, 18 bp, Homo sapiens
cacagatgcacacacaga

SEQ ID NO: 4988726 - DNA, 13 bp, Homo sapiens
cacagattggcca

SEQ ID NO: 4988727 - DNA, 17 bp, Homo sapiens
cacagcagtgagactgg

SEQ ID NO: 4988728 - DNA, 20 bp, Homo sapiens
cacaggtttagttgactaat

SEQ ID NO: 4988729 - DNA, 22 bp, Homo sapiens
cacataagccaaaactgagcat

SEQ ID NO: 4988730 - DNA, 14 bp, Homo sapiens
cacatagagatatg

SEQ ID NO: 4988731 - DNA, 16 bp, Homo sapiens
cacatagagatatgca

SEQ ID NO: 4988732 - DNA, 19 bp, Homo sapiens
caccaggaagcacaggtcc

SEQ ID NO: 4988733 - DNA, 16 bp, Homo sapiens
caccgatgcacacgca

SEQ ID NO: 4988734 - DNA, 16 bp, Homo sapiens
cacctcctaaaacaac

SEQ ID NO: 4988735 - DNA, 19 bp, Homo sapiens
cacctgcacgtgatctgct

SEQ ID NO: 4988736 - DNA, 15 bp, Homo sapiens
cacctgtagtcccag

SEQ ID NO: 4988737 - DNA, 17 bp, Homo sapiens
cacctgtggtgcctgcc

SEQ ID NO: 4988738 - DNA, 23 bp, Homo sapiens
cactccaataggtgctgagtgta

SEQ ID NO: 4988739 - DNA, 19 bp, Homo sapiens
cactgagatccagagaggc

SEQ ID NO: 4988740 - DNA, 19 bp, Homo sapiens
cagaagattacaaaagcaa

SEQ ID NO: 4988741 - DNA, 17 bp, Homo sapiens
cagacgtgagtgtgact

SEQ ID NO: 4988742 - DNA, 20 bp, Homo sapiens
cagacgtgagtgtgactttt

SEQ ID NO: 4988743 - DNA, 13 bp, Homo sapiens
cagagacagaaac

SEQ ID NO: 4988744 - DNA, 16 bp, Homo sapiens
cagagagagacagaga

SEQ ID NO: 4988745 - DNA, 21 bp, Homo sapiens
cagagagagactgagggagag

SEQ ID NO: 4988746 - DNA, 20 bp, Homo sapiens
cagagatatgcacacaccga

SEQ ID NO: 4988747 - DNA, 14 bp, Homo sapiens
cagagtcctggccc

SEQ ID NO: 4988748 - DNA, 15 bp, Homo sapiens
cagagtcctggccct

SEQ ID NO: 4988749 - DNA, 17 bp, Homo sapiens
cagagttggtgttcata

SEQ ID NO: 4988750 - DNA, 14 bp, Homo sapiens
cagatatacacatg

SEQ ID NO: 4988751 - DNA, 18 bp, Homo sapiens
cagatatacacatggatg

SEQ ID NO: 4988752 - DNA, 19 bp, Homo sapiens
cagatatacacatggatgc

SEQ ID NO: 4988753 - DNA, 23 bp, Homo sapiens
cagatcattatcagcctgtgcca

SEQ ID NO: 4988754 - DNA, 15 bp, Homo sapiens
cagatggtcacacag

SEQ ID NO: 4988755 - DNA, 14 bp, Homo sapiens
cagcagtgagactg

SEQ ID NO: 4988756 - DNA, 19 bp, Homo sapiens
cagcctgggcaacagagca

SEQ ID NO: 4988757 - DNA, 20 bp, Homo sapiens
cagcctgggcaacagagcaa

SEQ ID NO: 4988758 - DNA, 24 bp, Homo sapiens
cagctactcgggaggctgaggcag

SEQ ID NO: 4988759 - DNA, 13 bp, Homo sapiens
caggaagcacagg

SEQ ID NO: 4988760 - DNA, 14 bp, Homo sapiens
caggacgagatgac

SEQ ID NO: 4988761 - DNA, 23 bp, Homo sapiens
caggagatcgagaccatcctggc

SEQ ID NO: 4988762 - DNA, 21 bp, Homo sapiens
caggagtccctgccatcatgt

SEQ ID NO: 4988763 - DNA, 14 bp, Homo sapiens
caggatggcgcagg

SEQ ID NO: 4988764 - DNA, 19 bp, Homo sapiens
caggcacctgtagtcccag

SEQ ID NO: 4988765 - DNA, 16 bp, Homo sapiens
caggcagcagacacat

SEQ ID NO: 4988766 - DNA, 14 bp, Homo sapiens
caggcctcagggtg

SEQ ID NO: 4988767 - DNA, 16 bp, Homo sapiens
caggcgctggacagag

SEQ ID NO: 4988768 - DNA, 17 bp, Homo sapiens
caggcgctggacagagg

SEQ ID NO: 4988769 - DNA, 23 bp, Homo sapiens
cagggactcatctttccctcctt

SEQ ID NO: 4988770 - DNA, 16 bp, Homo sapiens
cagggctgaggcctct

SEQ ID NO: 4988771 - DNA, 18 bp, Homo sapiens
cagggctgaggcctctca

SEQ ID NO: 4988772 - DNA, 18 bp, Homo sapiens
caggttttcttttaagaa

SEQ ID NO: 4988773 - DNA, 17 bp, Homo sapiens
cagtaataaatgaatgt

SEQ ID NO: 4988774 - DNA, 21 bp, Homo sapiens
cagtaataaatgaatgtcact

SEQ ID NO: 4988775 - DNA, 23 bp, Homo sapiens
cagtagaggcatgaacacacatg

SEQ ID NO: 4988776 - DNA, 12 bp, Homo sapiens
cagtatagaata

SEQ ID NO: 4988777 - DNA, 18 bp, Homo sapiens
cagtatagaataggcact

SEQ ID NO: 4988778 - DNA, 21 bp, Homo sapiens
cagtatgaaaagctatcttaa

SEQ ID NO: 4988779 - DNA, 23 bp, Homo sapiens
cagtgagagagtggctggggcat

SEQ ID NO: 4988780 - DNA, 15 bp, Homo sapiens
cagtgcacacggatg

SEQ ID NO: 4988781 - DNA, 17 bp, Homo sapiens
cagtggatgagggccac

SEQ ID NO: 4988782 - DNA, 18 bp, Homo sapiens
cagtggctggatctgtga

SEQ ID NO: 4988783 - DNA, 16 bp, Homo sapiens
cagttctagttgattg

SEQ ID NO: 4988784 - DNA, 21 bp, Homo sapiens
cagttgcaggtgccaatgact

SEQ ID NO: 4988785 - DNA, 22 bp, Homo sapiens
cagtttccctctgtatacaagg

SEQ ID NO: 4988786 - DNA, 13 bp, Homo sapiens
catacattatatt

SEQ ID NO: 4988787 - DNA, 22 bp, Homo sapiens
catagagatatgcacacacaga

SEQ ID NO: 4988788 - DNA, 14 bp, Homo sapiens
catatagaaaggct

SEQ ID NO: 4988789 - DNA, 15 bp, Homo sapiens
catatattttttaaa

SEQ ID NO: 4988790 - DNA, 20 bp, Homo sapiens
catatctcttatcttacgaa

SEQ ID NO: 4988791 - DNA, 14 bp, Homo sapiens
catcaccatgcatg

SEQ ID NO: 4988792 - DNA, 13 bp, Homo sapiens
catcatgtttaca

SEQ ID NO: 4988793 - DNA, 19 bp, Homo sapiens
catcatgtttacagaggac

SEQ ID NO: 4988794 - DNA, 21 bp, Homo sapiens
catcatgtttacagaggacag

SEQ ID NO: 4988795 - DNA, 19 bp, Homo sapiens
catccatggggctgattgt

SEQ ID NO: 4988796 - DNA, 17 bp, Homo sapiens
catctggatatcaaggt

SEQ ID NO: 4988797 - DNA, 17 bp, Homo sapiens
catctttccctccttgg

SEQ ID NO: 4988798 - DNA, 21 bp, Homo sapiens
catctttccctccttggtgat

SEQ ID NO: 4988799 - DNA, 17 bp, Homo sapiens
catgaaagacttctcta

SEQ ID NO: 4988800 - DNA, 13 bp, Homo sapiens
catggaaggcaag

SEQ ID NO: 4988801 - DNA, 19 bp, Homo sapiens
catggaattcacaaagtaa

SEQ ID NO: 4988802 - DNA, 17 bp, Homo sapiens
catggacttctggatgc

SEQ ID NO: 4988803 - DNA, 16 bp, Homo sapiens
catggagagagactca

SEQ ID NO: 4988804 - DNA, 23 bp, Homo sapiens
catggagagagactcaaagagac

SEQ ID NO: 4988805 - DNA, 13 bp, Homo sapiens
catggatgcacac

SEQ ID NO: 4988806 - DNA, 14 bp, Homo sapiens
catgggagggaggg

SEQ ID NO: 4988807 - DNA, 19 bp, Homo sapiens
catggggctgattgtattt

SEQ ID NO: 4988808 - DNA, 13 bp, Homo sapiens
catgtcagacaca

SEQ ID NO: 4988809 - DNA, 14 bp, Homo sapiens
catgtcagacacag

SEQ ID NO: 4988810 - DNA, 17 bp, Homo sapiens
cattaaacgtcattcag

SEQ ID NO: 4988811 - DNA, 22 bp, Homo sapiens
cattacctcagtgagaagccag

SEQ ID NO: 4988812 - DNA, 19 bp, Homo sapiens
cattatgttattggaattt

SEQ ID NO: 4988813 - DNA, 20 bp, Homo sapiens
cattatgttattggaatttt

SEQ ID NO: 4988814 - DNA, 13 bp, Homo sapiens
cattcccccagtg

SEQ ID NO: 4988815 - DNA, 22 bp, Homo sapiens
cattgaaatctaggaaaattat

SEQ ID NO: 4988816 - DNA, 19 bp, Homo sapiens
cattgtccctgaagagaag

SEQ ID NO: 4988817 - DNA, 15 bp, Homo sapiens
catttacttaagact

SEQ ID NO: 4988818 - DNA, 14 bp, Homo sapiens
catttgttcattaa

SEQ ID NO: 4988819 - DNA, 17 bp, Homo sapiens
catttgttcattaaacg

SEQ ID NO: 4988820 - DNA, 17 bp, Homo sapiens
cattttaaacaaaatag

SEQ ID NO: 4988821 - DNA, 20 bp, Homo sapiens
catttttctaataatcataa

SEQ ID NO: 4988822 - DNA, 19 bp, Homo sapiens
ccaagattcaaagagacta

SEQ ID NO: 4988823 - DNA, 20 bp, Homo sapiens
ccacacagacttgggcaggg

SEQ ID NO: 4988824 - DNA, 16 bp, Homo sapiens
ccacaccctcactgct

SEQ ID NO: 4988825 - DNA, 13 bp, Homo sapiens
ccacagagtataa

SEQ ID NO: 4988826 - DNA, 20 bp, Homo sapiens
ccactgtgctccagcctggg

SEQ ID NO: 4988827 - DNA, 14 bp, Homo sapiens
ccagagtcctggcc

SEQ ID NO: 4988828 - DNA, 15 bp, Homo sapiens
ccagagtcctggccc

SEQ ID NO: 4988829 - DNA, 21 bp, Homo sapiens
ccagcaagaccaaatcattgt

SEQ ID NO: 4988830 - DNA, 13 bp, Homo sapiens
ccaggaagcacag

SEQ ID NO: 4988831 - DNA, 17 bp, Homo sapiens
ccaggaagcacaggtcc

SEQ ID NO: 4988832 - DNA, 22 bp, Homo sapiens
ccaggaggcggaccttgtagtg

SEQ ID NO: 4988833 - DNA, 16 bp, Homo sapiens
ccagggccatgtcaga

SEQ ID NO: 4988834 - DNA, 22 bp, Homo sapiens
ccatcatgtttacagaggacag

SEQ ID NO: 4988835 - DNA, 23 bp, Homo sapiens
ccatccactgggtgtaaacacat

SEQ ID NO: 4988836 - DNA, 22 bp, Homo sapiens
ccatctgtatgctggtagctag

SEQ ID NO: 4988837 - DNA, 16 bp, Homo sapiens
ccatcttaaaaacaac

SEQ ID NO: 4988838 - DNA, 12 bp, Homo sapiens
ccattcatcctt

SEQ ID NO: 4988839 - DNA, 18 bp, Homo sapiens
cccagaatgcctcctgca

SEQ ID NO: 4988840 - DNA, 16 bp, Homo sapiens
ggaagaagggaagcct

SEQ ID NO: 4988841 - DNA, 13 bp, Homo sapiens
ggaagcacaggtc

SEQ ID NO: 4988842 - DNA, 21 bp, Homo sapiens
ggaagtgtgggtctgtgtgtg

SEQ ID NO: 4988843 - DNA, 22 bp, Homo sapiens
ggaagtgtgggtctgtgtgtgt

SEQ ID NO: 4988844 - DNA, 17 bp, Homo sapiens
ggaataagacagagacc

SEQ ID NO: 4988845 - DNA, 18 bp, Homo sapiens
ggaatagaaaagatgaga

SEQ ID NO: 4988846 - DNA, 11 bp, Homo sapiens
ggaattttctt

SEQ ID NO: 4988847 - DNA, 21 bp, Homo sapiens
ggaattttctttcatacatta

SEQ ID NO: 4988848 - DNA, 22 bp, Homo sapiens
ggacaacactttccctctctgg

SEQ ID NO: 4988849 - DNA, 16 bp, Homo sapiens
ggactcatctttccct

SEQ ID NO: 4988850 - DNA, 23 bp, Homo sapiens
ggactcatctttccctccttggt

SEQ ID NO: 4988851 - DNA, 22 bp, Homo sapiens
ggactccaggcagcagacacat

SEQ ID NO: 4988852 - DNA, 22 bp, Homo sapiens
ggagaatgtcagtatgtggaag

SEQ ID NO: 4988853 - DNA, 14 bp, Homo sapiens
ggagacagtagagg

SEQ ID NO: 4988854 - DNA, 13 bp, Homo sapiens
ggagagagactca

SEQ ID NO: 4988855 - DNA, 14 bp, Homo sapiens
ggagggagggagag

SEQ ID NO: 4988856 - DNA, 11 bp, Homo sapiens
ggagtgtgtaa

SEQ ID NO: 4988857 - DNA, 13 bp, Homo sapiens
ggatagatgtgtg

SEQ ID NO: 4988858 - DNA, 17 bp, Homo sapiens
ggatggaatgatgggtc

SEQ ID NO: 4988859 - DNA, 15 bp, Homo sapiens
ggcactatttattta

SEQ ID NO: 4988860 - DNA, 16 bp, Homo sapiens
ggcactttaaaacact

SEQ ID NO: 4988861 - DNA, 23 bp, Homo sapiens
ggcagacaggcgctggacagagg

SEQ ID NO: 4988862 - DNA, 14 bp, Homo sapiens
ggcagcagacacat

SEQ ID NO: 4988863 - DNA, 19 bp, Homo sapiens
ggccagtggctggatctgt

SEQ ID NO: 4988864 - DNA, 17 bp, Homo sapiens
ggccatgtcagacacag

SEQ ID NO: 4988865 - DNA, 16 bp, Homo sapiens
ggcccatttaatgatt

SEQ ID NO: 4988866 - DNA, 15 bp, Homo sapiens
ggcgtgaacccagga

SEQ ID NO: 4988867 - DNA, 14 bp, Homo sapiens
ggctcagagtgggg

SEQ ID NO: 4988868 - DNA, 18 bp, Homo sapiens
gggaggctgaggcaggag

SEQ ID NO: 4988869 - DNA, 15 bp, Homo sapiens
gggcgtggtggcagg

SEQ ID NO: 4988870 - DNA, 14 bp, Homo sapiens
gggctactgtttca

SEQ ID NO: 4988871 - DNA, 18 bp, Homo sapiens
gggctcagagtggggtag

SEQ ID NO: 4988872 - DNA, 13 bp, Homo sapiens
ggggatagatgtg

SEQ ID NO: 4988873 - DNA, 16 bp, Homo sapiens
ggtaggaactgctggg

SEQ ID NO: 4988874 - DNA, 20 bp, Homo sapiens
ggtccaaggctggtcccaca

SEQ ID NO: 4988875 - DNA, 21 bp, Homo sapiens
ggtctgtgtgtgtgtatgtgg

SEQ ID NO: 4988876 - DNA, 22 bp, Homo sapiens
ggtttgtttagaagaagtgtgt

SEQ ID NO: 4988877 - DNA, 16 bp, Homo sapiens
gtaaaaatattaactg

SEQ ID NO: 4988878 - DNA, 16 bp, Homo sapiens
gtaaatttatgtgatg

SEQ ID NO: 4988879 - DNA, 17 bp, Homo sapiens
gtaatgaccatgaaaga

SEQ ID NO: 4988880 - DNA, 19 bp, Homo sapiens
gtaatttaaaattgtgatg

SEQ ID NO: 4988881 - DNA, 20 bp, Homo sapiens
gtaatttaaaattgtgatgt

SEQ ID NO: 4988882 - DNA, 14 bp, Homo sapiens
gtacacataagcca

SEQ ID NO: 4988883 - DNA, 19 bp, Homo sapiens
gtacagagtggaataagac

SEQ ID NO: 4988884 - DNA, 17 bp, Homo sapiens
gtacaggacatatattt

SEQ ID NO: 4988885 - DNA, 22 bp, Homo sapiens
gtagaagttctagtgttttcaa

SEQ ID NO: 4988886 - DNA, 15 bp, Homo sapiens
gtagcattttaaaca

SEQ ID NO: 4988887 - DNA, 13 bp, Homo sapiens
gtagtgagccgag

SEQ ID NO: 4988888 - DNA, 19 bp, Homo sapiens
gtagtggcaaagagaggtc

SEQ ID NO: 4988889 - DNA, 15 bp, Homo sapiens
gtataggataaatta

SEQ ID NO: 4988890 - DNA, 14 bp, Homo sapiens
gtatgcacacacat

SEQ ID NO: 4988891 - DNA, 17 bp, Homo sapiens
gtatgtggaagtgtggg

SEQ ID NO: 4988892 - DNA, 19 bp, Homo sapiens
gtatgtgggggtctgtgtg

SEQ ID NO: 4988893 - DNA, 20 bp, Homo sapiens
gtcaattaccagaaagataa

SEQ ID NO: 4988894 - DNA, 18 bp, Homo sapiens
gtcactattcatcaatga

SEQ ID NO: 4988895 - DNA, 19 bp, Homo sapiens
gtcagtctgcttagaaata

SEQ ID NO: 4988896 - DNA, 13 bp, Homo sapiens
gtcagttgtatca

SEQ ID NO: 4988897 - DNA, 13 bp, Homo sapiens
gtcattttctctt

SEQ ID NO: 4988898 - DNA, 16 bp, Homo sapiens
gtccaaggctggtccc

SEQ ID NO: 4988899 - DNA, 19 bp, Homo sapiens
gtcccacacttatcagcag

SEQ ID NO: 4988900 - DNA, 22 bp, Homo sapiens
gtcctaatgtgctgtgtgacat

SEQ ID NO: 4988901 - DNA, 21 bp, Homo sapiens
gtctgaaatggggctactgtt

SEQ ID NO: 4988902 - DNA, 11 bp, Homo sapiens
gtctgtgtgtg

SEQ ID NO: 4988903 - DNA, 12 bp, Homo sapiens
gtctgtgtgtgt

SEQ ID NO: 4988904 - DNA, 21 bp, Homo sapiens
gtctgtgtgtttatgtgtgtg

SEQ ID NO: 4988905 - DNA, 18 bp, Homo sapiens
gtgaataacctgaggatt

SEQ ID NO: 4988906 - DNA, 23 bp, Homo sapiens
gtgaatgtaggctggctttcaga

SEQ ID NO: 4988907 - DNA, 20 bp, Homo sapiens
gtgacaacatttttgtacat

SEQ ID NO: 4988908 - DNA, 22 bp, Homo sapiens
gtgacccaagaactcctgaaat

SEQ ID NO: 4988909 - DNA, 16 bp, Homo sapiens
gtgagagagtggctgg

SEQ ID NO: 4988910 - DNA, 19 bp, Homo sapiens
gtgagagagtggctggggc

SEQ ID NO: 4988911 - DNA, 18 bp, Homo sapiens
gtgagtgtgactttttga

SEQ ID NO: 4988912 - DNA, 10 bp, Homo sapiens
gtgatgtgtc

SEQ ID NO: 4988913 - DNA, 16 bp, Homo sapiens
gtgccaaggttgtcct

SEQ ID NO: 4988914 - DNA, 12 bp, Homo sapiens
gtgccattcatc

SEQ ID NO: 4988915 - DNA, 17 bp, Homo sapiens
gtgccttggggaaatgt

SEQ ID NO: 4988916 - DNA, 14 bp, Homo sapiens
gtggaagtgtgggt

SEQ ID NO: 4988917 - DNA, 15 bp, Homo sapiens
gtggaagtgtgggtc

SEQ ID NO: 4988918 - DNA, 20 bp, Homo sapiens
gtggaagtgtgggtctgtgt

SEQ ID NO: 4988919 - DNA, 22 bp, Homo sapiens
gtggagagaaagccaaggctgc

SEQ ID NO: 4988920 - DNA, 13 bp, Homo sapiens
gtggctggggcat

SEQ ID NO: 4988921 - DNA, 12 bp, Homo sapiens
gtggggagggag

SEQ ID NO: 4988922 - DNA, 16 bp, Homo sapiens
gtgggggtctgtgtgt

SEQ ID NO: 4988923 - DNA, 19 bp, Homo sapiens
gtggggtaggttgggagaa

SEQ ID NO: 4988924 - DNA, 21 bp, Homo sapiens
gtggtcttgccttctgatttt

SEQ ID NO: 4988925 - DNA, 14 bp, Homo sapiens
gtggtggcaggcac

SEQ ID NO: 4988926 - DNA, 20 bp, Homo sapiens
gtggttataacttaatgaaa

SEQ ID NO: 4988927 - DNA, 15 bp, Homo sapiens
gtgtaaacacatcta

SEQ ID NO: 4988928 - DNA, 21 bp, Homo sapiens
gtgtcccattcccccagtgcg

SEQ ID NO: 4988929 - DNA, 19 bp, Homo sapiens
gtgtgacattgggacaaca

SEQ ID NO: 4988930 - DNA, 15 bp, Homo sapiens
gtgtgtatgtggggg

SEQ ID NO: 4988931 - DNA, 16 bp, Homo sapiens
gtgtgtgggagtgtgt

SEQ ID NO: 4988932 - DNA, 17 bp, Homo sapiens
gtgtgtgttgtgtgtgg

SEQ ID NO: 4988933 - DNA, 23 bp, Homo sapiens
gttaataataatgactctaaaga

SEQ ID NO: 4988934 - DNA, 14 bp, Homo sapiens
gttataacttaatg

SEQ ID NO: 4988935 - DNA, 21 bp, Homo sapiens
gttataacttaatgaaaacaa

SEQ ID NO: 4988936 - DNA, 16 bp, Homo sapiens
gttattggaattttct

SEQ ID NO: 4988937 - DNA, 18 bp, Homo sapiens
gttcattaaacgtcattc

SEQ ID NO: 4988938 - DNA, 12 bp, Homo sapiens
gttgaaacatat

SEQ ID NO: 4988939 - DNA, 14 bp, Homo sapiens
gtttagttgactaa

SEQ ID NO: 4988940 - DNA, 16 bp, Homo sapiens
gtttgacggcaaggtt

SEQ ID NO: 4988941 - DNA, 15 bp, Homo sapiens
gttttaacattttta

SEQ ID NO: 4988942 - DNA, 16 bp, Homo sapiens
taaaacaacagatgta

SEQ ID NO: 4988943 - DNA, 23 bp, Homo sapiens
taaaactcactgaatctaaccat

SEQ ID NO: 4988944 - DNA, 14 bp, Homo sapiens
taaaataagtctga

SEQ ID NO: 4988945 - DNA, 15 bp, Homo sapiens
taaaataagtctgat

SEQ ID NO: 4988946 - DNA, 19 bp, Homo sapiens
taaaattatggaaacagat

SEQ ID NO: 4988947 - DNA, 13 bp, Homo sapiens
taaagaagtttga

SEQ ID NO: 4988948 - DNA, 17 bp, Homo sapiens
taaatatgtttcacaca

SEQ ID NO: 4988949 - DNA, 22 bp, Homo sapiens
taaatgtacctgagacatatta

SEQ ID NO: 4988950 - DNA, 23 bp, Homo sapiens
taacaataaagcattttgcaaac

SEQ ID NO: 4988951 - DNA, 16 bp, Homo sapiens
taacaggacgagatga

SEQ ID NO: 4988952 - DNA, 13 bp, Homo sapiens
taactaaggaaat

SEQ ID NO: 4988953 - DNA, 16 bp, Homo sapiens
taactaaggaaatatt

SEQ ID NO: 4988954 - DNA, 20 bp, Homo sapiens
taactgacgaagaagcaact

SEQ ID NO: 4988955 - DNA, 23 bp, Homo sapiens
taagaaaatgctagaagaaaaca

SEQ ID NO: 4988956 - DNA, 15 bp, Homo sapiens
taagacttaatgaga

SEQ ID NO: 4988957 - DNA, 21 bp, Homo sapiens
taagatatatttgtcattttc

SEQ ID NO: 4988958 - DNA, 16 bp, Homo sapiens
taagtaaaaatattaa

SEQ ID NO: 4988959 - DNA, 23 bp, Homo sapiens
taagttattaagaggtaagactt

SEQ ID NO: 4988960 - DNA, 19 bp, Homo sapiens
taataaatgaatgtcactt

SEQ ID NO: 4988961 - DNA, 16 bp, Homo sapiens
taatatgcaaagtcta

SEQ ID NO: 4988962 - DNA, 23 bp, Homo sapiens
taatctctgattccctgatttaa

SEQ ID NO: 4988963 - DNA, 14 bp, Homo sapiens
taatgaccatgaaa

SEQ ID NO: 4988964 - DNA, 16 bp, Homo sapiens
taatgactctaaagaa

SEQ ID NO: 4988965 - DNA, 22 bp, Homo sapiens
taattaaaccagactctgttgc

SEQ ID NO: 4988966 - DNA, 20 bp, Homo sapiens
taattgggcactatttattt

SEQ ID NO: 4988967 - DNA, 15 bp, Homo sapiens
taatttaaaattgtg

SEQ ID NO: 4988968 - DNA, 17 bp, Homo sapiens
tgaaatctaggaaaatt

SEQ ID NO: 4988969 - DNA, 18 bp, Homo sapiens
tgaaatctaggaaaatta

SEQ ID NO: 4988970 - DNA, 17 bp, Homo sapiens
tgaagattaacactgag

SEQ ID NO: 4988971 - DNA, 14 bp, Homo sapiens
tgaatttttttcct

SEQ ID NO: 4988972 - DNA, 19 bp, Homo sapiens
tgacagagttggtgttcat

SEQ ID NO: 4988973 - DNA, 21 bp, Homo sapiens
tgacattgaaatctaggaaaa

SEQ ID NO: 4988974 - DNA, 14 bp, Homo sapiens
tgactctaaagaaa

SEQ ID NO: 4988975 - DNA, 21 bp, Homo sapiens
tgagaaactggcaaagcagaa

SEQ ID NO: 4988976 - DNA, 12 bp, Homo sapiens
tgagactttaaa

SEQ ID NO: 4988977 - DNA, 13 bp, Homo sapiens
tgagactttaaaa

SEQ ID NO: 4988978 - DNA, 16 bp, Homo sapiens
tgagatccagagaggc

SEQ ID NO: 4988979 - DNA, 20 bp, Homo sapiens
tgagctggggatgtctctca

SEQ ID NO: 4988980 - DNA, 12 bp, Homo sapiens
tgaggacatgga

SEQ ID NO: 4988981 - DNA, 22 bp, Homo sapiens
tgagggccaccaggaagcacag

SEQ ID NO: 4988982 - DNA, 18 bp, Homo sapiens
tgagttcataaatttatg

SEQ ID NO: 4988983 - DNA, 24 bp, Homo sapiens
tgataagcagtcatcctcagatca

SEQ ID NO: 4988984 - DNA, 18 bp, Homo sapiens
tgatatgggtagtatttt

SEQ ID NO: 4988985 - DNA, 16 bp, Homo sapiens
tgatgtttaaaagtcc

SEQ ID NO: 4988986 - DNA, 14 bp, Homo sapiens
tgatttcaatacac

SEQ ID NO: 4988987 - DNA, 19 bp, Homo sapiens
tgatttcaatacactcaag

SEQ ID NO: 4988988 - DNA, 18 bp, Homo sapiens
tgcaaataagtgtatttt

SEQ ID NO: 4988989 - DNA, 21 bp, Homo sapiens
tgcacacacacggatgcacac

SEQ ID NO: 4988990 - DNA, 14 bp, Homo sapiens
tgcacacacatgga

SEQ ID NO: 4988991 - DNA, 16 bp, Homo sapiens
tgcacacgcacataga

SEQ ID NO: 4988992 - DNA, 13 bp, Homo sapiens
tgcagtatagaat

SEQ ID NO: 4988993 - DNA, 19 bp, Homo sapiens
tgcagttaatggggtagag

SEQ ID NO: 4988994 - DNA, 17 bp, Homo sapiens
tgccaatgctacagtaa

SEQ ID NO: 4988995 - DNA, 17 bp, Homo sapiens
tgccagagccttaataa

SEQ ID NO: 4988996 - DNA, 18 bp, Homo sapiens
tgccaggatggaatgatg

SEQ ID NO: 4988997 - DNA, 22 bp, Homo sapiens
tgccatcatgtttacagaggac

SEQ ID NO: 4988998 - DNA, 17 bp, Homo sapiens
tgccattcatcctttaa

SEQ ID NO: 4988999 - DNA, 13 bp, Homo sapiens
tgcccagctcagt

SEQ ID NO: 4989000 - DNA, 14 bp, Homo sapiens
tgcccagctcagtg

SEQ ID NO: 4989001 - DNA, 19 bp, Homo sapiens
tgccctcaagagcaaagta

SEQ ID NO: 4989002 - DNA, 20 bp, Homo sapiens
tgccgtcactattcatcaat

SEQ ID NO: 4989003 - DNA, 16 bp, Homo sapiens
tgccttggggaaatgt

SEQ ID NO: 4989004 - DNA, 18 bp, Homo sapiens
tgccttggggaaatgtgg

SEQ ID NO: 4989005 - DNA, 13 bp, Homo sapiens
tgcgagaattttc

SEQ ID NO: 4989006 - DNA, 14 bp, Homo sapiens
tgcgagaattttca

SEQ ID NO: 4989007 - DNA, 22 bp, Homo sapiens
tgcgcacacacagatatgcaca

SEQ ID NO: 4989008 - DNA, 11 bp, Homo sapiens
tgctactttgc

SEQ ID NO: 4989009 - DNA, 17 bp, Homo sapiens
tgctattttcttatcct

SEQ ID NO: 4989010 - DNA, 13 bp, Homo sapiens
tgctcttctgtat

SEQ ID NO: 4989011 - DNA, 19 bp, Homo sapiens
tgctgagcctcacagcagt

SEQ ID NO: 4989012 - DNA, 22 bp, Homo sapiens
tgctggagacagtagaggcatg

SEQ ID NO: 4989013 - DNA, 13 bp, Homo sapiens
tgctgtgtgacat

SEQ ID NO: 4989014 - DNA, 21 bp, Homo sapiens
tggaaattaggttgaaacata

SEQ ID NO: 4989015 - DNA, 23 bp, Homo sapiens
tggaagtgtgggtctgtgtgtgt

SEQ ID NO: 4989016 - DNA, 22 bp, Homo sapiens
tggaattttctttcatacatta

SEQ ID NO: 4989017 - DNA, 23 bp, Homo sapiens
tggaattttctttcatacattat

SEQ ID NO: 4989018 - DNA, 14 bp, Homo sapiens
tggacagaggggca

SEQ ID NO: 4989019 - DNA, 19 bp, Homo sapiens
tggagacagtagaggcatg

SEQ ID NO: 4989020 - DNA, 16 bp, Homo sapiens
tggagagaaaatacaa

SEQ ID NO: 4989021 - DNA, 23 bp, Homo sapiens
tggatgagggccaccaggaagca

SEQ ID NO: 4989022 - DNA, 14 bp, Homo sapiens
tggccagtggctgg

SEQ ID NO: 4989023 - DNA, 15 bp, Homo sapiens
tggccagtggctgga

SEQ ID NO: 4989024 - DNA, 16 bp, Homo sapiens
tggccagtggctggat

SEQ ID NO: 4989025 - DNA, 15 bp, Homo sapiens
tggcgcaggaactca

SEQ ID NO: 4989026 - DNA, 20 bp, Homo sapiens
tggctccattggtgttgaca

SEQ ID NO: 4989027 - DNA, 14 bp, Homo sapiens
tggctggggcatgg

SEQ ID NO: 4989028 - DNA, 23 bp, Homo sapiens
tgggaataagtgccaggatggaa

SEQ ID NO: 4989029 - DNA, 20 bp, Homo sapiens
tgggagaatgtcagtatgtg

SEQ ID NO: 4989030 - DNA, 18 bp, Homo sapiens
tgggagggagggagaggt

SEQ ID NO: 4989031 - DNA, 15 bp, Homo sapiens
tgggaggttaaaaag

SEQ ID NO: 4989032 - DNA, 14 bp, Homo sapiens
tgggagtctgaaat

SEQ ID NO: 4989033 - DNA, 16 bp, Homo sapiens
tgggagtctgaaatgg

SEQ ID NO: 4989034 - DNA, 11 bp, Homo sapiens
tgggagtgtgt

SEQ ID NO: 4989035 - DNA, 14 bp, Homo sapiens
tggggagggatttg

SEQ ID NO: 4989036 - DNA, 22 bp, Homo sapiens
tggggagggatttggggctcag

SEQ ID NO: 4989037 - DNA, 18 bp, Homo sapiens
tggggatagatgtgtgga

SEQ ID NO: 4989038 - DNA, 16 bp, Homo sapiens
tggggctactgtttca

SEQ ID NO: 4989039 - DNA, 15 bp, Homo sapiens
tggggctcagagtgg

SEQ ID NO: 4989040 - DNA, 19 bp, Homo sapiens
tggggcttctcctgaaatc

SEQ ID NO: 4989041 - DNA, 14 bp, Homo sapiens
tgggggtctgtgtg

SEQ ID NO: 4989042 - DNA, 15 bp, Homo sapiens
tgggtgtaaacacat

SEQ ID NO: 4989043 - DNA, 22 bp, Homo sapiens
tggtagctagtgatttacacag

SEQ ID NO: 4989044 - DNA, 13 bp, Homo sapiens
tggtaggaactgc

SEQ ID NO: 4989045 - DNA, 20 bp, Homo sapiens
tgtaaaagtctagttaccta

SEQ ID NO: 4989046 - DNA, 16 bp, Homo sapiens
tgtaaatttatgtgat

SEQ ID NO: 4989047 - DNA, 17 bp, Homo sapiens
tgtaaatttatgtgatg

SEQ ID NO: 4989048 - DNA, 21 bp, Homo sapiens
tgtaataaatatgtttcacac

SEQ ID NO: 4989049 - DNA, 22 bp, Homo sapiens
tgtaataaatatgtttcacaca

SEQ ID NO: 4989050 - DNA, 21 bp, Homo sapiens
tgtacagagtggaataagaca

SEQ ID NO: 4989051 - DNA, 16 bp, Homo sapiens
tgtaccacttttgcaa

SEQ ID NO: 4989052 - DNA, 17 bp, Homo sapiens
tgtaccacttttgcaaa

SEQ ID NO: 4989053 - DNA, 14 bp, Homo sapiens
tgtagatgtatgca

SEQ ID NO: 4989054 - DNA, 18 bp, Homo sapiens
tgtagatgtatgcacaca

SEQ ID NO: 4989055 - DNA, 16 bp, Homo sapiens
tgtatgctggtagcta

SEQ ID NO: 4989056 - DNA, 12 bp, Homo sapiens
tgtatgtggggg

SEQ ID NO: 4989057 - DNA, 20 bp, Homo sapiens
tgtatgtgggggtctgtgtg

SEQ ID NO: 4989058 - DNA, 21 bp, Homo sapiens
tgtatgtgggggtctgtgtgt

SEQ ID NO: 4989059 - DNA, 19 bp, Homo sapiens
tgtcagtatgtggaagtgt

SEQ ID NO: 4989060 - DNA, 14 bp, Homo sapiens
tgtcagttcatcct

SEQ ID NO: 4989061 - DNA, 15 bp, Homo sapiens
tgtcagttcatcctg

SEQ ID NO: 4989062 - DNA, 19 bp, Homo sapiens
tgtcagttctgatatggaa

SEQ ID NO: 4989063 - DNA, 14 bp, Homo sapiens
tgtcattttctctt

SEQ ID NO: 4989064 - DNA, 16 bp, Homo sapiens
tgtcttctttgctaga

SEQ ID NO: 4989065 - DNA, 18 bp, Homo sapiens
tgtgaggggctctctcat

SEQ ID NO: 4989066 - DNA, 11 bp, Homo sapiens
tgtgtaattta

SEQ ID NO: 4989067 - DNA, 12 bp, Homo sapiens
tgtgtatgtggg

SEQ ID NO: 4989068 - DNA, 14 bp, Homo sapiens
tgtgtgggagtgtg

SEQ ID NO: 4989069 - DNA, 13 bp, Homo sapiens
tgtgtgtgtgtat

SEQ ID NO: 4989070 - DNA, 16 bp, Homo sapiens
tgtgtgtgtgtatgtg

SEQ ID NO: 4989071 - DNA, 23 bp, Homo sapiens
tgttattggaattttctttcata

SEQ ID NO: 4989072 - DNA, 14 bp, Homo sapiens
tgttgtgtgtggga

SEQ ID NO: 4989073 - DNA, 13 bp, Homo sapiens
tgtttatgtgtgt

SEQ ID NO: 4989074 - DNA, 20 bp, Homo sapiens
tgttttaagccaatatttta

SEQ ID NO: 4989075 - DNA, 21 bp, Homo sapiens
tgttttcaattttaaacatat

SEQ ID NO: 4989076 - DNA, 13 bp, Homo sapiens
tgttttcttcatt

SEQ ID NO: 4989077 - DNA, 22 bp, Homo sapiens
ttaaaaacaacgaaagaaggca

SEQ ID NO: 4989078 - DNA, 15 bp, Homo sapiens
ttaaaactatattta

SEQ ID NO: 4989079 - DNA, 18 bp, Homo sapiens
ttaaaatagcacatgatt

SEQ ID NO: 4989080 - DNA, 12 bp, Homo sapiens
ttaactcagtct

SEQ ID NO: 4989081 - DNA, 23 bp, Homo sapiens
ttaagacttaatgagactttaaa

SEQ ID NO: 4989082 - DNA, 18 bp, Homo sapiens
ttaatgagactttaaaag

SEQ ID NO: 4989083 - DNA, 23 bp, Homo sapiens
ttaatgagactttaaaagcattt

SEQ ID NO: 4989084 - DNA, 15 bp, Homo sapiens
ttaatgattgattat

SEQ ID NO: 4989085 - DNA, 13 bp, Homo sapiens
ttaattgggcact

SEQ ID NO: 4989086 - DNA, 18 bp, Homo sapiens
ttacacactgtacacata

SEQ ID NO: 4989087 - DNA, 22 bp, Homo sapiens
ttacacaggtttagttgactaa

SEQ ID NO: 4989088 - DNA, 23 bp, Homo sapiens
ttacacaggtttagttgactaat

SEQ ID NO: 4989089 - DNA, 24 bp, Homo sapiens
ttacattaaaatagcacatgattt

SEQ ID NO: 4989090 - DNA, 14 bp, Homo sapiens
ttacattttacaca

SEQ ID NO: 4989091 - DNA, 15 bp, Homo sapiens
ttacattttacacac

SEQ ID NO: 4989092 - DNA, 16 bp, Homo sapiens
ttactgatatcagagt

SEQ ID NO: 4989093 - DNA, 16 bp, Homo sapiens
ttagaaataacagaag

SEQ ID NO: 4989094 - DNA, 16 bp, Homo sapiens
ttagcctttgtcccag

SEQ ID NO: 4989095 - DNA, 16 bp, Homo sapiens
ttagttgactaatgag

SEQ ID NO: 4989096 - DNA, 13 bp, Homo sapiens
aaaagaaaagttt

SEQ ID NO: 4989097 - DNA, 12 bp, Homo sapiens
aaaagcattttt

SEQ ID NO: 4989098 - DNA, 19 bp, Homo sapiens
aaaagctatcttaaaatat

SEQ ID NO: 4989099 - DNA, 22 bp, Homo sapiens
aaaagctatcttaaaatataga

SEQ ID NO: 4989100 - DNA, 14 bp, Homo sapiens
aaaataatctctga

SEQ ID NO: 4989101 - DNA, 17 bp, Homo sapiens
aaaatagaattgacatt

SEQ ID NO: 4989102 - DNA, 16 bp, Homo sapiens
aaaatagcacatgatt

SEQ ID NO: 4989103 - DNA, 22 bp, Homo sapiens
aaaatggtagcattttaaacaa

SEQ ID NO: 4989104 - DNA, 17 bp, Homo sapiens
aaaattatggaaacaga

SEQ ID NO: 4989105 - DNA, 18 bp, Homo sapiens
aaaattatggaaacagat

SEQ ID NO: 4989106 - DNA, 16 bp, Homo sapiens
aaacacaccgatgcac

SEQ ID NO: 4989107 - DNA, 18 bp, Homo sapiens
aaacagagagagacagag

SEQ ID NO: 4989108 - DNA, 13 bp, Homo sapiens
aaacatctggata

SEQ ID NO: 4989109 - DNA, 17 bp, Homo sapiens
aaacattctttcctaaa

SEQ ID NO: 4989110 - DNA, 21 bp, Homo sapiens
aaacccgtctctactaaaaat

SEQ ID NO: 4989111 - DNA, 15 bp, Homo sapiens
aaactggcaaagcag

SEQ ID NO: 4989112 - DNA, 16 bp, Homo sapiens
aaactggcaaagcaga

SEQ ID NO: 4989113 - DNA, 16 bp, Homo sapiens
aaactgtagctgtatt

SEQ ID NO: 4989114 - DNA, 23 bp, Homo sapiens
aaagaaggcatggacttctggat

SEQ ID NO: 4989115 - DNA, 13 bp, Homo sapiens
aaagatttctgct

SEQ ID NO: 4989116 - DNA, 20 bp, Homo sapiens
aaagcagttgagattctcta

SEQ ID NO: 4989117 - DNA, 17 bp, Homo sapiens
aaagcctctgttttgat

SEQ ID NO: 4989118 - DNA, 20 bp, Homo sapiens
aaagcgctaagtaaaaatat

SEQ ID NO: 4989119 - DNA, 18 bp, Homo sapiens
aaagctatcttaaaatat

SEQ ID NO: 4989120 - DNA, 19 bp, Homo sapiens
aaataagtgtattttgaaa

SEQ ID NO: 4989121 - DNA, 20 bp, Homo sapiens
aaataagtgtattttgaaat

SEQ ID NO: 4989122 - DNA, 15 bp, Homo sapiens
aaataatctctgatt

SEQ ID NO: 4989123 - DNA, 22 bp, Homo sapiens
aaatatgtttcacacaaacaag

SEQ ID NO: 4989124 - DNA, 14 bp, Homo sapiens
aaatcaggttttct

SEQ ID NO: 4989125 - DNA, 22 bp, Homo sapiens
aaatcaggttttcttttaagaa

SEQ ID NO: 4989126 - DNA, 18 bp, Homo sapiens
aaatgcaaaaaaaattag

SEQ ID NO: 4989127 - DNA, 20 bp, Homo sapiens
aaatggtagcattttaaaca

SEQ ID NO: 4989128 - DNA, 22 bp, Homo sapiens
aaatggtagcattttaaacaaa

SEQ ID NO: 4989129 - DNA, 16 bp, Homo sapiens
aaatgtcagttctgat

SEQ ID NO: 4989130 - DNA, 15 bp, Homo sapiens
aaatgtttatttaaa

SEQ ID NO: 4989131 - DNA, 11 bp, Homo sapiens
aaatgttttgc

SEQ ID NO: 4989132 - DNA, 15 bp, Homo sapiens
aaattaaaactcatt

SEQ ID NO: 4989133 - DNA, 22 bp, Homo sapiens
aaattaactgctaacttctatt

SEQ ID NO: 4989134 - DNA, 17 bp, Homo sapiens
aaattaggttgaaacat

SEQ ID NO: 4989135 - DNA, 18 bp, Homo sapiens
aaattaggttgaaacata

SEQ ID NO: 4989136 - DNA, 20 bp, Homo sapiens
aaattattctataatttcca

SEQ ID NO: 4989137 - DNA, 15 bp, Homo sapiens
aaattgtgatgtgtc

SEQ ID NO: 4989138 - DNA, 14 bp, Homo sapiens
aacaactgtcagtt

SEQ ID NO: 4989139 - DNA, 15 bp, Homo sapiens
aacaataaagcattt

SEQ ID NO: 4989140 - DNA, 15 bp, Homo sapiens
aacacaccgatgcac

SEQ ID NO: 4989141 - DNA, 20 bp, Homo sapiens
aacacatttaaaattttaaa

SEQ ID NO: 4989142 - DNA, 20 bp, Homo sapiens
aacactgagatccagagagg

SEQ ID NO: 4989143 - DNA, 22 bp, Homo sapiens
aacactttccctctctggacct

SEQ ID NO: 4989144 - DNA, 20 bp, Homo sapiens
aacagatgaaaagcctctgt

SEQ ID NO: 4989145 - DNA, 14 bp, Homo sapiens
aacatatccaagtt

SEQ ID NO: 4989146 - DNA, 17 bp, Homo sapiens
aacatttttgtacatta

SEQ ID NO: 4989147 - DNA, 12 bp, Homo sapiens
aaccaatttctt

SEQ ID NO: 4989148 - DNA, 18 bp, Homo sapiens
aacgtcattcagtactta

SEQ ID NO: 4989149 - DNA, 18 bp, Homo sapiens
aactcgttaaagcaaagc

SEQ ID NO: 4989150 - DNA, 22 bp, Homo sapiens
aactgacgaagaagcaactaag

SEQ ID NO: 4989151 - DNA, 14 bp, Homo sapiens
aactgatcatgttt

SEQ ID NO: 4989152 - DNA, 17 bp, Homo sapiens
aactgctaacttctatt

SEQ ID NO: 4989153 - DNA, 22 bp, Homo sapiens
aactggcaaagcagaatgtgat

SEQ ID NO: 4989154 - DNA, 13 bp, Homo sapiens
aactgtcagttca

SEQ ID NO: 4989155 - DNA, 18 bp, Homo sapiens
aactttttgaattctatg

SEQ ID NO: 4989156 - DNA, 15 bp, Homo sapiens
aagaagggaagcctt

SEQ ID NO: 4989157 - DNA, 21 bp, Homo sapiens
aagaagggaagccttttgcaa

SEQ ID NO: 4989158 - DNA, 19 bp, Homo sapiens
aagaagtgtgtcaccctta

SEQ ID NO: 4989159 - DNA, 18 bp, Homo sapiens
aagagaagggcagggctg

SEQ ID NO: 4989160 - DNA, 19 bp, Homo sapiens
aagagactaatagagacac

SEQ ID NO: 4989161 - DNA, 23 bp, Homo sapiens
aagagactccaagattcaaagag

SEQ ID NO: 4989162 - DNA, 14 bp, Homo sapiens
aagagaggtccaga

SEQ ID NO: 4989163 - DNA, 20 bp, Homo sapiens
aagatatatttgtcattttc

SEQ ID NO: 4989164 - DNA, 14 bp, Homo sapiens
aagattcaaagaga

SEQ ID NO: 4989165 - DNA, 20 bp, Homo sapiens
aagattttcctattccttgg

SEQ ID NO: 4989166 - DNA, 23 bp, Homo sapiens
aagcaaagcgctaagtaaaaata

SEQ ID NO: 4989167 - DNA, 19 bp, Homo sapiens
aagcagttgagattctcta

SEQ ID NO: 4989168 - DNA, 15 bp, Homo sapiens
aagcattttgcaaac

SEQ ID NO: 4989169 - DNA, 19 bp, Homo sapiens
aagcgctaagtaaaaatat

SEQ ID NO: 4989170 - DNA, 21 bp, Homo sapiens
aagcgctaagtaaaaatatta

SEQ ID NO: 4989171 - DNA, 17 bp, Homo sapiens
aagctatcttaaaatat

SEQ ID NO: 4989172 - DNA, 18 bp, Homo sapiens
aagctatcttaaaatata

SEQ ID NO: 4989173 - DNA, 23 bp, Homo sapiens
aagctatcttaaaatatagaaaa

SEQ ID NO: 4989174 - DNA, 19 bp, Homo sapiens
aagctatggcccatctgta

SEQ ID NO: 4989175 - DNA, 14 bp, Homo sapiens
agcaagtttaatca

SEQ ID NO: 4989176 - DNA, 15 bp, Homo sapiens
agcaattatgaaaat

SEQ ID NO: 4989177 - DNA, 17 bp, Homo sapiens
agcaattatgaaaataa

SEQ ID NO: 4989178 - DNA, 21 bp, Homo sapiens
agcacaggtccaaggctggtc

SEQ ID NO: 4989179 - DNA, 22 bp, Homo sapiens
agcacaggtccaaggctggtcc

SEQ ID NO: 4989180 - DNA, 20 bp, Homo sapiens
agcacatgattttcttttgt

SEQ ID NO: 4989181 - DNA, 19 bp, Homo sapiens
agcactttgggaggctgag

SEQ ID NO: 4989182 - DNA, 13 bp, Homo sapiens
agcagaatgtgat

SEQ ID NO: 4989183 - DNA, 16 bp, Homo sapiens
agcagacacatgccag

SEQ ID NO: 4989184 - DNA, 13 bp, Homo sapiens
agcatctcccagt

SEQ ID NO: 4989185 - DNA, 19 bp, Homo sapiens
agcattttaaacaaaatag

SEQ ID NO: 4989186 - DNA, 15 bp, Homo sapiens
agccatctcaagcaa

SEQ ID NO: 4989187 - DNA, 22 bp, Homo sapiens
agccgggcgtggtggcaggcac

SEQ ID NO: 4989188 - DNA, 18 bp, Homo sapiens
agcctcacagcagtgaga

SEQ ID NO: 4989189 - DNA, 22 bp, Homo sapiens
agcctcacagcagtgagactgg

SEQ ID NO: 4989190 - DNA, 14 bp, Homo sapiens
agcctctgttttga

SEQ ID NO: 4989191 - DNA, 13 bp, Homo sapiens
agccttttgcaaa

SEQ ID NO: 4989192 - DNA, 19 bp, Homo sapiens
agccttttgcaaatagtag

SEQ ID NO: 4989193 - DNA, 15 bp, Homo sapiens
agctactcgggaggc

SEQ ID NO: 4989194 - DNA, 19 bp, Homo sapiens
agctaggtgacatatacat

SEQ ID NO: 4989195 - DNA, 14 bp, Homo sapiens
agctagtgatttac

SEQ ID NO: 4989196 - DNA, 20 bp, Homo sapiens
agctcagtgccacaaagctc

SEQ ID NO: 4989197 - DNA, 22 bp, Homo sapiens
agctgtattagcagcaaaacaa

SEQ ID NO: 4989198 - DNA, 13 bp, Homo sapiens
aggaaatatttca

SEQ ID NO: 4989199 - DNA, 19 bp, Homo sapiens
aggacagtatttgtgggga

SEQ ID NO: 4989200 - DNA, 14 bp, Homo sapiens
aggactccaggcag

SEQ ID NO: 4989201 - DNA, 20 bp, Homo sapiens
aggagatcgagaccatcctg

SEQ ID NO: 4989202 - DNA, 14 bp, Homo sapiens
aggcaaatgtttat

SEQ ID NO: 4989203 - DNA, 15 bp, Homo sapiens
aggcaggagactggc

SEQ ID NO: 4989204 - DNA, 18 bp, Homo sapiens
aggcatggacttctggat

SEQ ID NO: 4989205 - DNA, 21 bp, Homo sapiens
aggcctctcattccagaggaa

SEQ ID NO: 4989206 - DNA, 19 bp, Homo sapiens
aggctatggggatagatgt

SEQ ID NO: 4989207 - DNA, 21 bp, Homo sapiens
aggctatggggatagatgtgt

SEQ ID NO: 4989208 - DNA, 22 bp, Homo sapiens
aggctattcctgagagctgcat

SEQ ID NO: 4989209 - DNA, 16 bp, Homo sapiens
aggctgaggcaggaga

SEQ ID NO: 4989210 - DNA, 17 bp, Homo sapiens
aggctggatgacttgct

SEQ ID NO: 4989211 - DNA, 17 bp, Homo sapiens
aggctggctttcagagt

SEQ ID NO: 4989212 - DNA, 19 bp, Homo sapiens
aggctggctttcagagtag

SEQ ID NO: 4989213 - DNA, 18 bp, Homo sapiens
agggaagccttttgcaaa

SEQ ID NO: 4989214 - DNA, 13 bp, Homo sapiens
agggagagactct

SEQ ID NO: 4989215 - DNA, 17 bp, Homo sapiens
agggcatgggagggagg

SEQ ID NO: 4989216 - DNA, 21 bp, Homo sapiens
aggtaatgaccatgaaagact

SEQ ID NO: 4989217 - DNA, 16 bp, Homo sapiens
aggttaaaaagaaaag

SEQ ID NO: 4989218 - DNA, 17 bp, Homo sapiens
aggttttcttttaagaa

SEQ ID NO: 4989219 - DNA, 15 bp, Homo sapiens
agtaaaaatattaac

SEQ ID NO: 4989220 - DNA, 22 bp, Homo sapiens
agtaacaaaagtatagttttga

SEQ ID NO: 4989221 - DNA, 16 bp, Homo sapiens
agtataggataaatta

SEQ ID NO: 4989222 - DNA, 16 bp, Homo sapiens
agtatcaagtatagaa

SEQ ID NO: 4989223 - DNA, 19 bp, Homo sapiens
agtatgtggaagtgtgggt

SEQ ID NO: 4989224 - DNA, 20 bp, Homo sapiens
agtattgatttaacttcatt

SEQ ID NO: 4989225 - DNA, 14 bp, Homo sapiens
agtatttgtgggga

SEQ ID NO: 4989226 - DNA, 18 bp, Homo sapiens
agtattttttacatttta

SEQ ID NO: 4989227 - DNA, 24 bp, Homo sapiens
agtattttttacattttacacact

SEQ ID NO: 4989228 - DNA, 22 bp, Homo sapiens
agtcctggcccttgatgcccag

SEQ ID NO: 4989229 - DNA, 11 bp, Homo sapiens
agtctgaaatg

SEQ ID NO: 4989230 - DNA, 16 bp, Homo sapiens
agtgaatgtaggctgg

SEQ ID NO: 4989231 - DNA, 21 bp, Homo sapiens
agtgagagagtggctggggca

SEQ ID NO: 4989232 - DNA, 14 bp, Homo sapiens
agtgatttacacag

SEQ ID NO: 4989233 - DNA, 16 bp, Homo sapiens
agtgatttacacaggt

SEQ ID NO: 4989234 - DNA, 19 bp, Homo sapiens
agtgccaaggttgtcctgg

SEQ ID NO: 4989235 - DNA, 22 bp, Homo sapiens
agtgccacaaagctcaatagga

SEQ ID NO: 4989236 - DNA, 16 bp, Homo sapiens
agtggctggatctgtg

SEQ ID NO: 4989237 - DNA, 16 bp, Homo sapiens
agtggggtaggttggg

SEQ ID NO: 4989238 - DNA, 19 bp, Homo sapiens
agttcaccagcatggtagt

SEQ ID NO: 4989239 - DNA, 16 bp, Homo sapiens
agttgactaatgaggc

SEQ ID NO: 4989240 - DNA, 19 bp, Homo sapiens
agttgattgcgagaatttt

SEQ ID NO: 4989241 - DNA, 19 bp, Homo sapiens
agttgcaaggcaaatgttt

SEQ ID NO: 4989242 - DNA, 20 bp, Homo sapiens
agttgtatcagcacgtgtgg

SEQ ID NO: 4989243 - DNA, 23 bp, Homo sapiens
agttgtatcagcacgtgtggcct

SEQ ID NO: 4989244 - DNA, 17 bp, Homo sapiens
agttgttctgaaatgtc

SEQ ID NO: 4989245 - DNA, 20 bp, Homo sapiens
agtttccctctgtatacaag

SEQ ID NO: 4989246 - DNA, 18 bp, Homo sapiens
agtttcttccttttttct

SEQ ID NO: 4989247 - DNA, 17 bp, Homo sapiens
agttttgacagagttgg

SEQ ID NO: 4989248 - DNA, 16 bp, Homo sapiens
ataaactatattctgt

SEQ ID NO: 4989249 - DNA, 18 bp, Homo sapiens
ataaatatgtttcacaca

SEQ ID NO: 4989250 - DNA, 15 bp, Homo sapiens
ataaattacattaaa

SEQ ID NO: 4989251 - DNA, 14 bp, Homo sapiens
ataacagaagaaaa

SEQ ID NO: 4989252 - DNA, 15 bp, Homo sapiens
ataacttaatgaaaa

SEQ ID NO: 4989253 - DNA, 13 bp, Homo sapiens
ataagtctgattt

SEQ ID NO: 4989254 - DNA, 21 bp, Homo sapiens
ataagtgtattttgaaattgt

SEQ ID NO: 4989255 - DNA, 18 bp, Homo sapiens
ataatcacaacccttcag

SEQ ID NO: 4989256 - DNA, 23 bp, Homo sapiens
ataatttccatttacttaagact

SEQ ID NO: 4989257 - DNA, 23 bp, Homo sapiens
atacaggtgccttggggaaatgt

SEQ ID NO: 4989258 - DNA, 20 bp, Homo sapiens
atacatacttacatgtgtgt

SEQ ID NO: 4989259 - DNA, 22 bp, Homo sapiens
atagaaaactaatctaaactgt

SEQ ID NO: 4989260 - DNA, 20 bp, Homo sapiens
atagaaaagatgagaggcag

SEQ ID NO: 4989261 - DNA, 20 bp, Homo sapiens
ccctgccatcatgtttacag

SEQ ID NO: 4989262 - DNA, 22 bp, Homo sapiens
ccctggcctgtggagagaaagc

SEQ ID NO: 4989263 - DNA, 16 bp, Homo sapiens
cctaaaattatggaaa

SEQ ID NO: 4989264 - DNA, 18 bp, Homo sapiens
cctctctggacctcagtt

SEQ ID NO: 4989265 - DNA, 19 bp, Homo sapiens
cctgaagagaagggcaggg

SEQ ID NO: 4989266 - DNA, 22 bp, Homo sapiens
cctgatttaatatgcaaagtct

SEQ ID NO: 4989267 - DNA, 18 bp, Homo sapiens
cctgcatgggaaaaatgt

SEQ ID NO: 4989268 - DNA, 18 bp, Homo sapiens
cctgccatcatgtttaca

SEQ ID NO: 4989269 - DNA, 21 bp, Homo sapiens
cctggcctgtggagagaaagc

SEQ ID NO: 4989270 - DNA, 23 bp, Homo sapiens
cctgtcattcgtggttgatttca

SEQ ID NO: 4989271 - DNA, 17 bp, Homo sapiens
cctgtgccttttgccat

SEQ ID NO: 4989272 - DNA, 18 bp, Homo sapiens
ccttaataaacgtccaca

SEQ ID NO: 4989273 - DNA, 20 bp, Homo sapiens
ccttggtgattccgcagtga

SEQ ID NO: 4989274 - DNA, 12 bp, Homo sapiens
cgagaattttca

SEQ ID NO: 4989275 - DNA, 21 bp, Homo sapiens
cgattgcaggagtccctgcca

SEQ ID NO: 4989276 - DNA, 23 bp, Homo sapiens
cgattgcaggagtccctgccatc

SEQ ID NO: 4989277 - DNA, 16 bp, Homo sapiens
cgggaggctgaggcag

SEQ ID NO: 4989278 - DNA, 18 bp, Homo sapiens
cggtgttattccaaggga

SEQ ID NO: 4989279 - DNA, 16 bp, Homo sapiens
cgtcactattcatcaa

SEQ ID NO: 4989280 - DNA, 19 bp, Homo sapiens
cgtccacagagtataaata

SEQ ID NO: 4989281 - DNA, 17 bp, Homo sapiens
cgtgagtgtgacttttt

SEQ ID NO: 4989282 - DNA, 14 bp, Homo sapiens
cgttgtaatgcaca

SEQ ID NO: 4989283 - DNA, 22 bp, Homo sapiens
ctaaaaatgcaaaaaaaattag

SEQ ID NO: 4989284 - DNA, 17 bp, Homo sapiens
ctaaaacaacagatgta

SEQ ID NO: 4989285 - DNA, 16 bp, Homo sapiens
ctaagtaaaaatatta

SEQ ID NO: 4989286 - DNA, 17 bp, Homo sapiens
ctaagtaaaaatattaa

SEQ ID NO: 4989287 - DNA, 20 bp, Homo sapiens
ctaagtaaaaatattaactg

SEQ ID NO: 4989288 - DNA, 21 bp, Homo sapiens
ctaagtaaaaatattaactga

SEQ ID NO: 4989289 - DNA, 19 bp, Homo sapiens
ctaataagtgctactttgc

SEQ ID NO: 4989290 - DNA, 18 bp, Homo sapiens
ctaatgaggcattacaaa

SEQ ID NO: 4989291 - DNA, 22 bp, Homo sapiens
ctactctggaggtttgtttaga

SEQ ID NO: 4989292 - DNA, 21 bp, Homo sapiens
ctagtgaatgtaggctggctt

SEQ ID NO: 4989293 - DNA, 17 bp, Homo sapiens
ctagtgatttacacagg

SEQ ID NO: 4989294 - DNA, 18 bp, Homo sapiens
ctagtgttttcaatttta

SEQ ID NO: 4989295 - DNA, 22 bp, Homo sapiens
ctagtgttttcaattttaaaca

SEQ ID NO: 4989296 - DNA, 16 bp, Homo sapiens
ctagttacctactttt

SEQ ID NO: 4989297 - DNA, 21 bp, Homo sapiens
ctagttgattgcgagaatttt

SEQ ID NO: 4989298 - DNA, 19 bp, Homo sapiens
ctataatttccatttactt

SEQ ID NO: 4989299 - DNA, 14 bp, Homo sapiens
ctattgtagagcca

SEQ ID NO: 4989300 - DNA, 16 bp, Homo sapiens
ctatttatttacaaat

SEQ ID NO: 4989301 - DNA, 15 bp, Homo sapiens
ctcaagagcaaagta

SEQ ID NO: 4989302 - DNA, 23 bp, Homo sapiens
ctcaagcaagtttaatcaatgat

SEQ ID NO: 4989303 - DNA, 14 bp, Homo sapiens
ctcacagcagtgag

SEQ ID NO: 4989304 - DNA, 18 bp, Homo sapiens
ctcacagcagtgagactg

SEQ ID NO: 4989305 - DNA, 19 bp, Homo sapiens
ctcacagcagtgagactgg

SEQ ID NO: 4989306 - DNA, 19 bp, Homo sapiens
ctcacgctgatcattggat

SEQ ID NO: 4989307 - DNA, 20 bp, Homo sapiens
ctcaggcctgactctcagca

SEQ ID NO: 4989308 - DNA, 21 bp, Homo sapiens
ctcagggactcatctttccct

SEQ ID NO: 4989309 - DNA, 23 bp, Homo sapiens
ctcagggactcatctttccctcc

SEQ ID NO: 4989310 - DNA, 17 bp, Homo sapiens
ctcagtgccacaaagct

SEQ ID NO: 4989311 - DNA, 14 bp, Homo sapiens
aaaattatggaaac

SEQ ID NO: 4989312 - DNA, 19 bp, Homo sapiens
aaaattcaacccatttact

SEQ ID NO: 4989313 - DNA, 18 bp, Homo sapiens
aaacacatctagtagttg

SEQ ID NO: 4989314 - DNA, 17 bp, Homo sapiens
aaacagatgaaaagcct

SEQ ID NO: 4989315 - DNA, 20 bp, Homo sapiens
aaacccgtctctactaaaaa

SEQ ID NO: 4989316 - DNA, 12 bp, Homo sapiens
aaactaatctaa

SEQ ID NO: 4989317 - DNA, 23 bp, Homo sapiens
aaagacttctctacccatcttaa

SEQ ID NO: 4989318 - DNA, 20 bp, Homo sapiens
aaagagaggtccagagtcct

SEQ ID NO: 4989319 - DNA, 15 bp, Homo sapiens
aaagcctctcactaa

SEQ ID NO: 4989320 - DNA, 16 bp, Homo sapiens
aaagcctctgttttga

SEQ ID NO: 4989321 - DNA, 14 bp, Homo sapiens
aaagctatcttaaa

SEQ ID NO: 4989322 - DNA, 14 bp, Homo sapiens
aaagctcaatagga

SEQ ID NO: 4989323 - DNA, 19 bp, Homo sapiens
aaaggctggggtgggccct

SEQ ID NO: 4989324 - DNA, 22 bp, Homo sapiens
aaagtaatttggaaattaggtt

SEQ ID NO: 4989325 - DNA, 18 bp, Homo sapiens
aaagtttataaaagtgaa

SEQ ID NO: 4989326 - DNA, 16 bp, Homo sapiens
aaataacagaagaaaa

SEQ ID NO: 4989327 - DNA, 12 bp, Homo sapiens
aaataagtctga

SEQ ID NO: 4989328 - DNA, 14 bp, Homo sapiens
aaataagtctgatt

SEQ ID NO: 4989329 - DNA, 14 bp, Homo sapiens
aaataagtgtattt

SEQ ID NO: 4989330 - DNA, 18 bp, Homo sapiens
aaataatattactctatg

SEQ ID NO: 4989331 - DNA, 16 bp, Homo sapiens
aaatagaaagttgcaa

SEQ ID NO: 4989332 - DNA, 22 bp, Homo sapiens
aaatagaaagttgcaaggcaaa

SEQ ID NO: 4989333 - DNA, 15 bp, Homo sapiens
aaatagcacatgatt

SEQ ID NO: 4989334 - DNA, 20 bp, Homo sapiens
aaatagtagagtatcagttg

SEQ ID NO: 4989335 - DNA, 18 bp, Homo sapiens
aaatcaggttttctttta

SEQ ID NO: 4989336 - DNA, 19 bp, Homo sapiens
aaatctacaggcctcaggg

SEQ ID NO: 4989337 - DNA, 16 bp, Homo sapiens
aaatcttcatggaatt

SEQ ID NO: 4989338 - DNA, 20 bp, Homo sapiens
aaatcttcatggaattcaca

SEQ ID NO: 4989339 - DNA, 22 bp, Homo sapiens
aaatcttcatggaattcacaaa

SEQ ID NO: 4989340 - DNA, 16 bp, Homo sapiens
caacagtgagagactc

SEQ ID NO: 4989341 - DNA, 17 bp, Homo sapiens
caacatttttgtacatt

SEQ ID NO: 4989342 - DNA, 19 bp, Homo sapiens
caacatttttgtacattat

SEQ ID NO: 4989343 - DNA, 14 bp, Homo sapiens
caactaagttaata

SEQ ID NO: 4989344 - DNA, 15 bp, Homo sapiens
caactaagttaataa

SEQ ID NO: 4989345 - DNA, 15 bp, Homo sapiens
caactgtcagttcat

SEQ ID NO: 4989346 - DNA, 15 bp, Homo sapiens
caagaactcctgaaa

SEQ ID NO: 4989347 - DNA, 14 bp, Homo sapiens
caagagcaaagtag

SEQ ID NO: 4989348 - DNA, 17 bp, Homo sapiens
caagccttggctctacc

SEQ ID NO: 4989349 - DNA, 21 bp, Homo sapiens
caaggcctgtcagctaaagaa

SEQ ID NO: 4989350 - DNA, 22 bp, Homo sapiens
caaggtggaaatggcccattta

SEQ ID NO: 4989351 - DNA, 13 bp, Homo sapiens
caagtatagaaaa

SEQ ID NO: 4989352 - DNA, 17 bp, Homo sapiens
caagtgccattcatcct

SEQ ID NO: 4989353 - DNA, 12 bp, Homo sapiens
caagtttgaatt

SEQ ID NO: 4989354 - DNA, 22 bp, Homo sapiens
caatgactaactttttgaattc

SEQ ID NO: 4989355 - DNA, 17 bp, Homo sapiens
caatgcacacacacaga

SEQ ID NO: 4989356 - DNA, 18 bp, Homo sapiens
caatgcacacacacagag

SEQ ID NO: 4989357 - DNA, 11 bp, Homo sapiens
caattatgaaa

SEQ ID NO: 4989358 - DNA, 15 bp, Homo sapiens
cacacaaacaaggcc

SEQ ID NO: 4989359 - DNA, 13 bp, Homo sapiens
cacacacagagat

SEQ ID NO: 4989360 - DNA, 19 bp, Homo sapiens
cacacacagatatgcacac

SEQ ID NO: 4989361 - DNA, 16 bp, Homo sapiens
cacacagagatatgca

SEQ ID NO: 4989362 - DNA, 18 bp, Homo sapiens
cacacagatgcacacaca

SEQ ID NO: 4989363 - DNA, 19 bp, Homo sapiens
cacacagatgcacacacag

SEQ ID NO: 4989364 - DNA, 14 bp, Homo sapiens
cacacatggatgca

SEQ ID NO: 4989365 - DNA, 15 bp, Homo sapiens
cacaccaatgcgcac

SEQ ID NO: 4989366 - DNA, 22 bp, Homo sapiens
cacacgactgcaacatacaggt

SEQ ID NO: 4989367 - DNA, 14 bp, Homo sapiens
cacacgccaatgca

SEQ ID NO: 4989368 - DNA, 20 bp, Homo sapiens
cacagatatacacatggatg

SEQ ID NO: 4989369 - DNA, 22 bp, Homo sapiens
cacagatatgcacacacatgga

SEQ ID NO: 4989370 - DNA, 16 bp, Homo sapiens
cacagatggtcacaca

SEQ ID NO: 4989371 - DNA, 18 bp, Homo sapiens
cacagatggtcacacaga

SEQ ID NO: 4989372 - DNA, 20 bp, Homo sapiens
cacagatggtcacacagaga

SEQ ID NO: 4989373 - DNA, 22 bp, Homo sapiens
cacatctagtagttgttctgaa

SEQ ID NO: 4989374 - DNA, 13 bp, Homo sapiens
cacatgattttct

SEQ ID NO: 4989375 - DNA, 18 bp, Homo sapiens
cacatgattttcttttgt

SEQ ID NO: 4989376 - DNA, 19 bp, Homo sapiens
cacgtgtggcctgttcttc

SEQ ID NO: 4989377 - DNA, 12 bp, Homo sapiens
cactattcatca

SEQ ID NO: 4989378 - DNA, 21 bp, Homo sapiens
cactattcatcaatgaagatt

SEQ ID NO: 4989379 - DNA, 14 bp, Homo sapiens
cactcaagtgccat

SEQ ID NO: 4989380 - DNA, 22 bp, Homo sapiens
cactgagatccagagaggctgg

SEQ ID NO: 4989381 - DNA, 18 bp, Homo sapiens
cactgggtgtaaacacat

SEQ ID NO: 4989382 - DNA, 14 bp, Homo sapiens
cactgtacacataa

SEQ ID NO: 4989383 - DNA, 16 bp, Homo sapiens
cagaaacagagagaga

SEQ ID NO: 4989384 - DNA, 18 bp, Homo sapiens
cagaactcgttaaagcaa

SEQ ID NO: 4989385 - DNA, 13 bp, Homo sapiens
cagaagaaaatag

SEQ ID NO: 4989386 - DNA, 22 bp, Homo sapiens
cagaagaaaatagaattgacat

SEQ ID NO: 4989387 - DNA, 13 bp, Homo sapiens
cagaagattacaa

SEQ ID NO: 4989388 - DNA, 21 bp, Homo sapiens
cagacaattcagaagcatcac

SEQ ID NO: 4989389 - DNA, 19 bp, Homo sapiens
cagagacagaaacagagag

SEQ ID NO: 4989390 - DNA, 16 bp, Homo sapiens
cagagacagagagaga

SEQ ID NO: 4989391 - DNA, 13 bp, Homo sapiens
cagagagagacag

SEQ ID NO: 4989392 - DNA, 13 bp, Homo sapiens
cagagagagactg

SEQ ID NO: 4989393 - DNA, 14 bp, Homo sapiens
cagagaggctggat

SEQ ID NO: 4989394 - DNA, 17 bp, Homo sapiens
cagagaggctggatgac

SEQ ID NO: 4989395 - DNA, 18 bp, Homo sapiens
cagaggggcaggggagtg

SEQ ID NO: 4989396 - DNA, 22 bp, Homo sapiens
cagagtaggctattcctgagag

SEQ ID NO: 4989397 - DNA, 16 bp, Homo sapiens
cagagtcctggccctt

SEQ ID NO: 4989398 - DNA, 19 bp, Homo sapiens
cagattcttgctgtgaccc

SEQ ID NO: 4989399 - DNA, 19 bp, Homo sapiens
cagcaacaactgtcagttc

SEQ ID NO: 4989400 - DNA, 20 bp, Homo sapiens
cagcaacaactgtcagttca

SEQ ID NO: 4989401 - DNA, 17 bp, Homo sapiens
cagcacgtgtggcctgt

SEQ ID NO: 4989402 - DNA, 18 bp, Homo sapiens
cagcactttgggaggctg

SEQ ID NO: 4989403 - DNA, 16 bp, Homo sapiens
cagcagcaacaactgt

SEQ ID NO: 4989404 - DNA, 19 bp, Homo sapiens
cagcagccctggcctgtgg

SEQ ID NO: 4989405 - DNA, 19 bp, Homo sapiens
cagcatggtagtggcaaag

SEQ ID NO: 4989406 - DNA, 16 bp, Homo sapiens
caggaagcacaggtcc

SEQ ID NO: 4989407 - DNA, 14 bp, Homo sapiens
caggagtccctgcc

SEQ ID NO: 4989408 - DNA, 23 bp, Homo sapiens
caggatggcgcaggaactcaata

SEQ ID NO: 4989409 - DNA, 17 bp, Homo sapiens
caggatttgctgggaga

SEQ ID NO: 4989410 - DNA, 15 bp, Homo sapiens
caggcagcagacaca

SEQ ID NO: 4989411 - DNA, 15 bp, Homo sapiens
caggcctgactctca

SEQ ID NO: 4989412 - DNA, 23 bp, Homo sapiens
caggcgctggacagaggggcagg

SEQ ID NO: 4989413 - DNA, 20 bp, Homo sapiens
cagggccatgtcagacacag

SEQ ID NO: 4989414 - DNA, 19 bp, Homo sapiens
caggttttcttttaagaat

SEQ ID NO: 4989415 - DNA, 12 bp, Homo sapiens
cagtaacacgct

SEQ ID NO: 4989416 - DNA, 23 bp, Homo sapiens
ctgcttagaaataacagaagaaa

SEQ ID NO: 4989417 - DNA, 14 bp, Homo sapiens
ctggacctcagttt

SEQ ID NO: 4989418 - DNA, 12 bp, Homo sapiens
ctggaggtttgt

SEQ ID NO: 4989419 - DNA, 18 bp, Homo sapiens
ctggatgacttgctcaag

SEQ ID NO: 4989420 - DNA, 21 bp, Homo sapiens
ctggccagtggctggatctgt

SEQ ID NO: 4989421 - DNA, 23 bp, Homo sapiens
ctggccctatgcttccggcctcc

SEQ ID NO: 4989422 - DNA, 22 bp, Homo sapiens
ctggcccttgatgcccagctca

SEQ ID NO: 4989423 - DNA, 23 bp, Homo sapiens
ctggctgggagtggaagaaggga

SEQ ID NO: 4989424 - DNA, 15 bp, Homo sapiens
ctggctttcagagta

SEQ ID NO: 4989425 - DNA, 17 bp, Homo sapiens
ctgggattggctgtgaa

SEQ ID NO: 4989426 - DNA, 22 bp, Homo sapiens
ctggggatgtctctcatgacca

SEQ ID NO: 4989427 - DNA, 17 bp, Homo sapiens
ctggggcatggaaggca

SEQ ID NO: 4989428 - DNA, 14 bp, Homo sapiens
ctggggtgggccct

SEQ ID NO: 4989429 - DNA, 15 bp, Homo sapiens
ctgggtgtaaacaca

SEQ ID NO: 4989430 - DNA, 18 bp, Homo sapiens
ctgtatacaaggatcaga

SEQ ID NO: 4989431 - DNA, 22 bp, Homo sapiens
ctgtcagctaaagaagtttgaa

SEQ ID NO: 4989432 - DNA, 21 bp, Homo sapiens
ctgtgacccaagaactcctga

SEQ ID NO: 4989433 - DNA, 19 bp, Homo sapiens
ctgtgaggggctctctcat

SEQ ID NO: 4989434 - DNA, 21 bp, Homo sapiens
ctgtgtgtgtgtatgtggggg

SEQ ID NO: 4989435 - DNA, 20 bp, Homo sapiens
ctgtgtgtttatgtgtgtgt

SEQ ID NO: 4989436 - DNA, 15 bp, Homo sapiens
cttaagacttaatga

SEQ ID NO: 4989437 - DNA, 17 bp, Homo sapiens
cttaagacttaatgaga

SEQ ID NO: 4989438 - DNA, 15 bp, Homo sapiens
cttaatgaaaacaat

SEQ ID NO: 4989439 - DNA, 19 bp, Homo sapiens
cttaatgagactttaaaag

SEQ ID NO: 4989440 - DNA, 21 bp, Homo sapiens
cttcatggaattcacaaagta

SEQ ID NO: 4989441 - DNA, 20 bp, Homo sapiens
cttctctacccatcttaaaa

SEQ ID NO: 4989442 - DNA, 15 bp, Homo sapiens
cttctggatatagct

SEQ ID NO: 4989443 - DNA, 15 bp, Homo sapiens
cttgccgtcactatt

SEQ ID NO: 4989444 - DNA, 17 bp, Homo sapiens
cttgctcaagttcacca

SEQ ID NO: 4989445 - DNA, 19 bp, Homo sapiens
cttggtgattccgcagtga

SEQ ID NO: 4989446 - DNA, 22 bp, Homo sapiens
cttgtggttataacttaatgaa

SEQ ID NO: 4989447 - DNA, 23 bp, Homo sapiens
cttgtggttataacttaatgaaa

SEQ ID NO: 4989448 - DNA, 20 bp, Homo sapiens
ctttaagaaaaacatctgga

SEQ ID NO: 4989449 - DNA, 21 bp, Homo sapiens
ctttaagaaaaacatctggat

SEQ ID NO: 4989450 - DNA, 16 bp, Homo sapiens
ctttccagtatgaaaa

SEQ ID NO: 4989451 - DNA, 18 bp, Homo sapiens
ctttccctccttggtgat

SEQ ID NO: 4989452 - DNA, 18 bp, Homo sapiens
ctttttgaaaaaagtata

SEQ ID NO: 4989453 - DNA, 22 bp, Homo sapiens
gaaaaaatggtagcattttaaa

SEQ ID NO: 4989454 - DNA, 18 bp, Homo sapiens
gaaaagatgagaggcaga

SEQ ID NO: 4989455 - DNA, 21 bp, Homo sapiens
gaaaagctatcttaaaatata

SEQ ID NO: 4989456 - DNA, 24 bp, Homo sapiens
gaaaagctatcttaaaatatagaa

SEQ ID NO: 4989457 - DNA, 20 bp, Homo sapiens
gaaaagggactgctgggagg

SEQ ID NO: 4989458 - DNA, 19 bp, Homo sapiens
gaaaatgctagaagaaaac

SEQ ID NO: 4989459 - DNA, 16 bp, Homo sapiens
gaaaattattctataa

SEQ ID NO: 4989460 - DNA, 13 bp, Homo sapiens
gaaacagagagag

SEQ ID NO: 4989461 - DNA, 18 bp, Homo sapiens
gaaacagatgaaaagcct

SEQ ID NO: 4989462 - DNA, 17 bp, Homo sapiens
gaaacattctttcctaa

SEQ ID NO: 4989463 - DNA, 22 bp, Homo sapiens
gaaacccgtctctactaaaaat

SEQ ID NO: 4989464 - DNA, 16 bp, Homo sapiens
gaaactggcaaagcag

SEQ ID NO: 4989465 - DNA, 22 bp, Homo sapiens
gaaagttgcaaggcaaatgttt

SEQ ID NO: 4989466 - DNA, 17 bp, Homo sapiens
gaaataacagaagaaaa

SEQ ID NO: 4989467 - DNA, 19 bp, Homo sapiens
gaaattaggttgaaacata

SEQ ID NO: 4989468 - DNA, 20 bp, Homo sapiens
gaaattaggttgaaacatat

SEQ ID NO: 4989469 - DNA, 22 bp, Homo sapiens
gaacctaataagtgctactttg

SEQ ID NO: 4989470 - DNA, 16 bp, Homo sapiens
gaactcgttaaagcaa

SEQ ID NO: 4989471 - DNA, 22 bp, Homo sapiens
gaactgatcatgtttatgagaa

SEQ ID NO: 4989472 - DNA, 15 bp, Homo sapiens
gaagaaaatagaatt

SEQ ID NO: 4989473 - DNA, 21 bp, Homo sapiens
gaagaaaatagaattgacatt

SEQ ID NO: 4989474 - DNA, 12 bp, Homo sapiens
gaagattaacac

SEQ ID NO: 4989475 - DNA, 23 bp, Homo sapiens
gaagcaactaagttaataataat

SEQ ID NO: 4989476 - DNA, 18 bp, Homo sapiens
gaagccttttgcaaatag

SEQ ID NO: 4989477 - DNA, 14 bp, Homo sapiens
aaatgaatgtcact

SEQ ID NO: 4989478 - DNA, 19 bp, Homo sapiens
aaatgaatgtcacttctgg

SEQ ID NO: 4989479 - DNA, 17 bp, Homo sapiens
aaatgcaaaaaaaatta

SEQ ID NO: 4989480 - DNA, 14 bp, Homo sapiens
aaattatggaaaca

SEQ ID NO: 4989481 - DNA, 21 bp, Homo sapiens
aaattatggaaacagatgaaa

SEQ ID NO: 4989482 - DNA, 12 bp, Homo sapiens
aaattgtgatgt

SEQ ID NO: 4989483 - DNA, 23 bp, Homo sapiens
aaattgtttgacggcaaggttta

SEQ ID NO: 4989484 - DNA, 14 bp, Homo sapiens
aacaacgaaagaag

SEQ ID NO: 4989485 - DNA, 14 bp, Homo sapiens
aacaataaagcatt

SEQ ID NO: 4989486 - DNA, 22 bp, Homo sapiens
aacaataaagcattttgcaaac

SEQ ID NO: 4989487 - DNA, 17 bp, Homo sapiens
aacacacatggatgcac

SEQ ID NO: 4989488 - DNA, 23 bp, Homo sapiens
aacagtgagagactccatagttt

SEQ ID NO: 4989489 - DNA, 16 bp, Homo sapiens
aacatacaggtgcctt

SEQ ID NO: 4989490 - DNA, 20 bp, Homo sapiens
aacattctttcctaaatata

SEQ ID NO: 4989491 - DNA, 18 bp, Homo sapiens
aacatttttgtacattat

SEQ ID NO: 4989492 - DNA, 17 bp, Homo sapiens
aacctgaggattctatt

SEQ ID NO: 4989493 - DNA, 17 bp, Homo sapiens
aactaagttaataataa

SEQ ID NO: 4989494 - DNA, 16 bp, Homo sapiens
aactgatcatgtttat

SEQ ID NO: 4989495 - DNA, 13 bp, Homo sapiens
aacttaatgaaaa

SEQ ID NO: 4989496 - DNA, 14 bp, Homo sapiens
aagaaaacttccaa

SEQ ID NO: 4989497 - DNA, 18 bp, Homo sapiens
aagaaaagtttataaaag

SEQ ID NO: 4989498 - DNA, 13 bp, Homo sapiens
aagaaacagaaga

SEQ ID NO: 4989499 - DNA, 12 bp, Homo sapiens
aagagaggtcca

SEQ ID NO: 4989500 - DNA, 13 bp, Homo sapiens
aagagcaaagtag

SEQ ID NO: 4989501 - DNA, 13 bp, Homo sapiens
aagagcaggccag

SEQ ID NO: 4989502 - DNA, 15 bp, Homo sapiens
aagattcaaagagac

SEQ ID NO: 4989503 - DNA, 21 bp, Homo sapiens
aagattgtgtcccattccccc

SEQ ID NO: 4989504 - DNA, 19 bp, Homo sapiens
aagatttctgctccaaatt

SEQ ID NO: 4989505 - DNA, 23 bp, Homo sapiens
aagcagacgtgagtgtgactttt

SEQ ID NO: 4989506 - DNA, 16 bp, Homo sapiens
aagccaatattttaag

SEQ ID NO: 4989507 - DNA, 19 bp, Homo sapiens
aaggatcagattcttgctg

SEQ ID NO: 4989508 - DNA, 20 bp, Homo sapiens
aaggcctgtcagctaaagaa

SEQ ID NO: 4989509 - DNA, 14 bp, Homo sapiens
aaggtggaaatggc

SEQ ID NO: 4989510 - DNA, 12 bp, Homo sapiens
aagtatagaaaa

SEQ ID NO: 4989511 - DNA, 18 bp, Homo sapiens
aagtatagaaaatcttca

SEQ ID NO: 4989512 - DNA, 20 bp, Homo sapiens
aagtataggataaattacat

SEQ ID NO: 4989513 - DNA, 21 bp, Homo sapiens
aagtgtattttgaaattgttt

SEQ ID NO: 4989514 - DNA, 21 bp, Homo sapiens
aagttattaagaggtaagact

SEQ ID NO: 4989515 - DNA, 22 bp, Homo sapiens
aagttctagtgttttcaatttt

SEQ ID NO: 4989516 - DNA, 19 bp, Homo sapiens
aataaagcattttgcaaac

SEQ ID NO: 4989517 - DNA, 22 bp, Homo sapiens
aataacagaagaaaatagaatt

SEQ ID NO: 4989518 - DNA, 14 bp, Homo sapiens
aataagtgtatttt

SEQ ID NO: 4989519 - DNA, 16 bp, Homo sapiens
aatagagacacagaga

SEQ ID NO: 4989520 - DNA, 19 bp, Homo sapiens
aatagcacatgattttctt

SEQ ID NO: 4989521 - DNA, 22 bp, Homo sapiens
aatagtagagtatcagttgcag

SEQ ID NO: 4989522 - DNA, 21 bp, Homo sapiens
aatatagaaaactaatctaaa

SEQ ID NO: 4989523 - DNA, 22 bp, Homo sapiens
aatattaactgacgaagaagca

SEQ ID NO: 4989524 - DNA, 21 bp, Homo sapiens
aatcaatcatgtcagtctgct

SEQ ID NO: 4989525 - DNA, 21 bp, Homo sapiens
aatcaggttttcttttaagaa

SEQ ID NO: 4989526 - DNA, 13 bp, Homo sapiens
aatcattgtatca

SEQ ID NO: 4989527 - DNA, 17 bp, Homo sapiens
aatgaagattaacactg

SEQ ID NO: 4989528 - DNA, 17 bp, Homo sapiens
aatgagactttaaaagc

SEQ ID NO: 4989529 - DNA, 12 bp, Homo sapiens
aatgattgatta

SEQ ID NO: 4989530 - DNA, 16 bp, Homo sapiens
aatgggagtctgaaat

SEQ ID NO: 4989531 - DNA, 15 bp, Homo sapiens
aatgtcagtatgtgg

SEQ ID NO: 4989532 - DNA, 22 bp, Homo sapiens
aatgtcagtatgtggaagtgtg

SEQ ID NO: 4989533 - DNA, 18 bp, Homo sapiens
aatgtcagttctgatatg

SEQ ID NO: 4989534 - DNA, 14 bp, Homo sapiens
aattaggttgaaac

SEQ ID NO: 4989535 - DNA, 17 bp, Homo sapiens
aattaggttgaaacata

SEQ ID NO: 4989536 - DNA, 18 bp, Homo sapiens
aattaggttgaaacatat

SEQ ID NO: 4989537 - DNA, 22 bp, Homo sapiens
aattaggttgaaacatatctct

SEQ ID NO: 4989538 - DNA, 16 bp, Homo sapiens
aattcagaagcatcac

SEQ ID NO: 4989539 - DNA, 13 bp, Homo sapiens
aattcctcatttg

SEQ ID NO: 4989540 - DNA, 14 bp, Homo sapiens
aattcctcatttgt

SEQ ID NO: 4989541 - DNA, 15 bp, Homo sapiens
aattcctcatttgtt

SEQ ID NO: 4989542 - DNA, 23 bp, Homo sapiens
aattcctcatttgttcattaaac

SEQ ID NO: 4989543 - DNA, 22 bp, Homo sapiens
aattctatgttggcattaacaa

SEQ ID NO: 4989544 - DNA, 18 bp, Homo sapiens
aattctttgacctgttgg

SEQ ID NO: 4989545 - DNA, 14 bp, Homo sapiens
aatttataattaca

SEQ ID NO: 4989546 - DNA, 12 bp, Homo sapiens
aatttctgcttg

SEQ ID NO: 4989547 - DNA, 17 bp, Homo sapiens
aattttcaaataaggaa

SEQ ID NO: 4989548 - DNA, 13 bp, Homo sapiens
acaaatgttttgc

SEQ ID NO: 4989549 - DNA, 23 bp, Homo sapiens
acaacatttttgtacattatgtt

SEQ ID NO: 4989550 - DNA, 22 bp, Homo sapiens
acaactgtcagttcatcctgca

SEQ ID NO: 4989551 - DNA, 15 bp, Homo sapiens
acaaggatcagattc

SEQ ID NO: 4989552 - DNA, 16 bp, Homo sapiens
acaatttataattaca

SEQ ID NO: 4989553 - DNA, 13 bp, Homo sapiens
acacacacagaga

SEQ ID NO: 4989554 - DNA, 19 bp, Homo sapiens
acacacagatatacacatg

SEQ ID NO: 4989555 - DNA, 14 bp, Homo sapiens
acacacagatatgc

SEQ ID NO: 4989556 - DNA, 18 bp, Homo sapiens
acacacatatattatttg

SEQ ID NO: 4989557 - DNA, 16 bp, Homo sapiens
acacaccgatgtacac

SEQ ID NO: 4989558 - DNA, 20 bp, Homo sapiens
acacactgtacacataagcc

SEQ ID NO: 4989559 - DNA, 13 bp, Homo sapiens
acacattaataaa

SEQ ID NO: 4989560 - DNA, 15 bp, Homo sapiens
acacttatcagcagc

SEQ ID NO: 4989561 - DNA, 17 bp, Homo sapiens
acagaaacagagagaga

SEQ ID NO: 4989562 - DNA, 22 bp, Homo sapiens
acagaaacagagagagacagag

SEQ ID NO: 4989563 - DNA, 18 bp, Homo sapiens
acagaagaaaatagaatt

SEQ ID NO: 4989564 - DNA, 23 bp, Homo sapiens
acagagacagaaacagagagaga

SEQ ID NO: 4989565 - DNA, 17 bp, Homo sapiens
acagagacagagagaga

SEQ ID NO: 4989566 - DNA, 13 bp, Homo sapiens
acagaggggcagg

SEQ ID NO: 4989567 - DNA, 22 bp, Homo sapiens
acagagtggaataagacagaga

SEQ ID NO: 4989568 - DNA, 23 bp, Homo sapiens
acagagtggaataagacagagac

SEQ ID NO: 4989569 - DNA, 18 bp, Homo sapiens
acagagttggtgttcata

SEQ ID NO: 4989570 - DNA, 17 bp, Homo sapiens
acagatatacacatgga

SEQ ID NO: 4989571 - DNA, 14 bp, Homo sapiens
acagcagtgagact

SEQ ID NO: 4989572 - DNA, 14 bp, Homo sapiens
acaggacatatatt

SEQ ID NO: 4989573 - DNA, 17 bp, Homo sapiens
attaggttgaaacatat

SEQ ID NO: 4989574 - DNA, 13 bp, Homo sapiens
attatgttattgg

SEQ ID NO: 4989575 - DNA, 21 bp, Homo sapiens
attatgttattggaattttct

SEQ ID NO: 4989576 - DNA, 16 bp, Homo sapiens
attcacacattaataa

SEQ ID NO: 4989577 - DNA, 18 bp, Homo sapiens
attcacctcctaaaacaa

SEQ ID NO: 4989578 - DNA, 14 bp, Homo sapiens
attcctaaaattat

SEQ ID NO: 4989579 - DNA, 18 bp, Homo sapiens
attcctcatttgttcatt

SEQ ID NO: 4989580 - DNA, 14 bp, Homo sapiens
attcctctaaaact

SEQ ID NO: 4989581 - DNA, 19 bp, Homo sapiens
attctttgacctgttggga

SEQ ID NO: 4989582 - DNA, 15 bp, Homo sapiens
attgacattgaaatc

SEQ ID NO: 4989583 - DNA, 22 bp, Homo sapiens
attgacattgaaatctaggaaa

SEQ ID NO: 4989584 - DNA, 22 bp, Homo sapiens
attgacccacaaagtttcagaa

SEQ ID NO: 4989585 - DNA, 18 bp, Homo sapiens
attgatttaacttcattt

SEQ ID NO: 4989586 - DNA, 20 bp, Homo sapiens
attgatttaacttcattttt

SEQ ID NO: 4989587 - DNA, 16 bp, Homo sapiens
attgcgagaattttca

SEQ ID NO: 4989588 - DNA, 14 bp, Homo sapiens
attggaattttctt

SEQ ID NO: 4989589 - DNA, 21 bp, Homo sapiens
attgggcactatttatttaca

SEQ ID NO: 4989590 - DNA, 17 bp, Homo sapiens
atttaaaagagcaggcc

SEQ ID NO: 4989591 - DNA, 19 bp, Homo sapiens
atttaaaattgtgatgtgt

SEQ ID NO: 4989592 - DNA, 20 bp, Homo sapiens
atttaaaattgtgatgtgtc

SEQ ID NO: 4989593 - DNA, 16 bp, Homo sapiens
atttaatatgcaaagt

SEQ ID NO: 4989594 - DNA, 19 bp, Homo sapiens
atttaattgggcactattt

SEQ ID NO: 4989595 - DNA, 18 bp, Homo sapiens
atttatgaatattaaaaa

SEQ ID NO: 4989596 - DNA, 16 bp, Homo sapiens
atttattgatttcaag

SEQ ID NO: 4989597 - DNA, 13 bp, Homo sapiens
atttatttatgta

SEQ ID NO: 4989598 - DNA, 14 bp, Homo sapiens
atttatttatgtag

SEQ ID NO: 4989599 - DNA, 13 bp, Homo sapiens
atttctttctaaa

SEQ ID NO: 4989600 - DNA, 20 bp, Homo sapiens
atttctttctaaaacacatt

SEQ ID NO: 4989601 - DNA, 21 bp, Homo sapiens
attttaaacaaaatagaaagt

SEQ ID NO: 4989602 - DNA, 18 bp, Homo sapiens
attttctttcatacatta

SEQ ID NO: 4989603 - DNA, 19 bp, Homo sapiens
attttctttcatacattat

SEQ ID NO: 4989604 - DNA, 20 bp, Homo sapiens
attttctttcatacattata

SEQ ID NO: 4989605 - DNA, 15 bp, Homo sapiens
attttgaaattgttt

SEQ ID NO: 4989606 - DNA, 19 bp, Homo sapiens
attttttacattttacaca

SEQ ID NO: 4989607 - DNA, 13 bp, Homo sapiens
caaaaaaaattag

SEQ ID NO: 4989608 - DNA, 13 bp, Homo sapiens
caaaatagaaagt

SEQ ID NO: 4989609 - DNA, 11 bp, Homo sapiens
caaaatcataa

SEQ ID NO: 4989610 - DNA, 23 bp, Homo sapiens
caaactttattgattcacctcct

SEQ ID NO: 4989611 - DNA, 15 bp, Homo sapiens
caaagagaggtccag

SEQ ID NO: 4989612 - DNA, 17 bp, Homo sapiens
caaagcgctaagtaaaa

SEQ ID NO: 4989613 - DNA, 15 bp, Homo sapiens
caaagtctaggttgg

SEQ ID NO: 4989614 - DNA, 16 bp, Homo sapiens
caaataagtgtatttt

SEQ ID NO: 4989615 - DNA, 18 bp, Homo sapiens
caaataagtgtattttga

SEQ ID NO: 4989616 - DNA, 19 bp, Homo sapiens
caaataagtgtattttgaa

SEQ ID NO: 4989617 - DNA, 21 bp, Homo sapiens
caaataagtgtattttgaaat

SEQ ID NO: 4989618 - DNA, 21 bp, Homo sapiens
caaatagtagagtatcagttg

SEQ ID NO: 4989619 - DNA, 22 bp, Homo sapiens
caaatagtagagtatcagttgc

SEQ ID NO: 4989620 - DNA, 23 bp, Homo sapiens
caaatagtagagtatcagttgca

SEQ ID NO: 4989621 - DNA, 17 bp, Homo sapiens
caaatgtttatttaaaa

SEQ ID NO: 4989622 - DNA, 20 bp, Homo sapiens
ggcaacagagcaagactcca

SEQ ID NO: 4989623 - DNA, 18 bp, Homo sapiens
ggcactatttatttacaa

SEQ ID NO: 4989624 - DNA, 19 bp, Homo sapiens
ggcactatttatttacaaa

SEQ ID NO: 4989625 - DNA, 18 bp, Homo sapiens
ggcactttaaaacactct

SEQ ID NO: 4989626 - DNA, 15 bp, Homo sapiens
ggcagggctgaggcc

SEQ ID NO: 4989627 - DNA, 14 bp, Homo sapiens
ggcatggacttctg

SEQ ID NO: 4989628 - DNA, 20 bp, Homo sapiens
ggcattaacaataaagcatt

SEQ ID NO: 4989629 - DNA, 15 bp, Homo sapiens
ggccaccaggaagca

SEQ ID NO: 4989630 - DNA, 19 bp, Homo sapiens
ggccaccaggaagcacagg

SEQ ID NO: 4989631 - DNA, 18 bp, Homo sapiens
ggccagcaccatctcttt

SEQ ID NO: 4989632 - DNA, 16 bp, Homo sapiens
ggcctgactctcagca

SEQ ID NO: 4989633 - DNA, 20 bp, Homo sapiens
ggcctgtcagctaaagaagt

SEQ ID NO: 4989634 - DNA, 20 bp, Homo sapiens
ggcggaccttgtagtgagcc

SEQ ID NO: 4989635 - DNA, 21 bp, Homo sapiens
ggcggaccttgtagtgagccg

SEQ ID NO: 4989636 - DNA, 20 bp, Homo sapiens
ggctgaggcaggagactggc

SEQ ID NO: 4989637 - DNA, 20 bp, Homo sapiens
ggctgcgtcgaactgtcctg

SEQ ID NO: 4989638 - DNA, 21 bp, Homo sapiens
ggctgcgtcgaactgtcctgg

SEQ ID NO: 4989639 - DNA, 16 bp, Homo sapiens
ggcttctcctgaaatc

SEQ ID NO: 4989640 - DNA, 19 bp, Homo sapiens
gggactcatctttccctcc

SEQ ID NO: 4989641 - DNA, 21 bp, Homo sapiens
gggagtggaagaagggaagcc

SEQ ID NO: 4989642 - DNA, 17 bp, Homo sapiens
gggccatgtcagacaca

SEQ ID NO: 4989643 - DNA, 20 bp, Homo sapiens
ggtagtggcaaagagaggtc

SEQ ID NO: 4989644 - DNA, 17 bp, Homo sapiens
ggtctgtgtgtgtgtat

SEQ ID NO: 4989645 - DNA, 20 bp, Homo sapiens
ggtctgtgtgtgtgtatgtg

SEQ ID NO: 4989646 - DNA, 15 bp, Homo sapiens
ggtggaaatggccca

SEQ ID NO: 4989647 - DNA, 14 bp, Homo sapiens
ggtgtaaacacatc

SEQ ID NO: 4989648 - DNA, 16 bp, Homo sapiens
ggtgttcataatttca

SEQ ID NO: 4989649 - DNA, 16 bp, Homo sapiens
ggttttcttttaagaa

SEQ ID NO: 4989650 - DNA, 14 bp, Homo sapiens
gtaaaaatattaac

SEQ ID NO: 4989651 - DNA, 18 bp, Homo sapiens
gtaaaagtctagttacct

SEQ ID NO: 4989652 - DNA, 13 bp, Homo sapiens
gtaaacacatcta

SEQ ID NO: 4989653 - DNA, 23 bp, Homo sapiens
gtaaggttttttttatctttaaa

SEQ ID NO: 4989654 - DNA, 13 bp, Homo sapiens
gtacacacacaga

SEQ ID NO: 4989655 - DNA, 16 bp, Homo sapiens
gtaccacttttgcaaa

SEQ ID NO: 4989656 - DNA, 19 bp, Homo sapiens
gtagaagttctagtgtttt

SEQ ID NO: 4989657 - DNA, 19 bp, Homo sapiens
gtagatttttgctcttctg

SEQ ID NO: 4989658 - DNA, 21 bp, Homo sapiens
gtagctagtgatttacacagg

SEQ ID NO: 4989659 - DNA, 14 bp, Homo sapiens
gtaggttgggagaa

SEQ ID NO: 4989660 - DNA, 15 bp, Homo sapiens
gtatagaataggcac

SEQ ID NO: 4989661 - DNA, 21 bp, Homo sapiens
gtatagaataggcactttaaa

SEQ ID NO: 4989662 - DNA, 18 bp, Homo sapiens
gtatcaaattatttttaa

SEQ ID NO: 4989663 - DNA, 18 bp, Homo sapiens
gtatcaagtatagaaaat

SEQ ID NO: 4989664 - DNA, 16 bp, Homo sapiens
gtatgtggaagtgtgg

SEQ ID NO: 4989665 - DNA, 18 bp, Homo sapiens
gtatgtggaagtgtgggt

SEQ ID NO: 4989666 - DNA, 16 bp, Homo sapiens
gtcaatatttgatcta

SEQ ID NO: 4989667 - DNA, 21 bp, Homo sapiens
gtcaattaccagaaagataac

SEQ ID NO: 4989668 - DNA, 17 bp, Homo sapiens
gtcagtatgtggaagtg

SEQ ID NO: 4989669 - DNA, 21 bp, Homo sapiens
gtcattcgtggttgatttcaa

SEQ ID NO: 4989670 - DNA, 20 bp, Homo sapiens
gtcccagaatgcctcctgca

SEQ ID NO: 4989671 - DNA, 22 bp, Homo sapiens
gtctgtgtgtttatgtgtgtgt

SEQ ID NO: 4989672 - DNA, 22 bp, Homo sapiens
gtgacaacatttttgtacatta

SEQ ID NO: 4989673 - DNA, 15 bp, Homo sapiens
gtgacccaagaactc

SEQ ID NO: 4989674 - DNA, 18 bp, Homo sapiens
gtgagagagtggctgggg

SEQ ID NO: 4989675 - DNA, 15 bp, Homo sapiens
gtgatctgctggcct

SEQ ID NO: 4989676 - DNA, 20 bp, Homo sapiens
gtgcagtatagaataggcac

SEQ ID NO: 4989677 - DNA, 20 bp, Homo sapiens
ttggatcctactcaacaaaa

SEQ ID NO: 4989678 - DNA, 16 bp, Homo sapiens
ttgggcactatttatt

SEQ ID NO: 4989679 - DNA, 18 bp, Homo sapiens
ttgggttactatttcttg

SEQ ID NO: 4989680 - DNA, 20 bp, Homo sapiens
ttggtgattccgcagtgaga

SEQ ID NO: 4989681 - DNA, 21 bp, Homo sapiens
ttgtacattatgttattggaa

SEQ ID NO: 4989682 - DNA, 20 bp, Homo sapiens
ttgtaccacttttgcaaata

SEQ ID NO: 4989683 - DNA, 18 bp, Homo sapiens
ttgtatcaaattattttt

SEQ ID NO: 4989684 - DNA, 18 bp, Homo sapiens
ttgtgtcccattccccca

SEQ ID NO: 4989685 - DNA, 13 bp, Homo sapiens
ttgtgtgtgggag

SEQ ID NO: 4989686 - DNA, 15 bp, Homo sapiens
ttgtttagaagaagt

SEQ ID NO: 4989687 - DNA, 16 bp, Homo sapiens
tttaaaataagtctga

SEQ ID NO: 4989688 - DNA, 22 bp, Homo sapiens
tttaaacatatccaagtttgaa

SEQ ID NO: 4989689 - DNA, 18 bp, Homo sapiens
tttacacactgtacacat

SEQ ID NO: 4989690 - DNA, 21 bp, Homo sapiens
tttacacactgtacacataag

SEQ ID NO: 4989691 - DNA, 23 bp, Homo sapiens
tttacacactgtacacataagcc

SEQ ID NO: 4989692 - DNA, 16 bp, Homo sapiens
tttagccctgaacatt

SEQ ID NO: 4989693 - DNA, 17 bp, Homo sapiens
tttatccgtagttttga

SEQ ID NO: 4989694 - DNA, 11 bp, Homo sapiens
tttatgtgtgt

SEQ ID NO: 4989695 - DNA, 14 bp, Homo sapiens
tttcaaataaggaa

SEQ ID NO: 4989696 - DNA, 18 bp, Homo sapiens
tttcaataaatttctgct

SEQ ID NO: 4989697 - DNA, 16 bp, Homo sapiens
tttcacacaaacaagg

SEQ ID NO: 4989698 - DNA, 13 bp, Homo sapiens
tttcagtcctaat

SEQ ID NO: 4989699 - DNA, 13 bp, Homo sapiens
tttccctccttgg

SEQ ID NO: 4989700 - DNA, 17 bp, Homo sapiens
tttctttcatacattat

SEQ ID NO: 4989701 - DNA, 13 bp, Homo sapiens
tttgcaaataagt

SEQ ID NO: 4989702 - DNA, 19 bp, Homo sapiens
tttgctatgagctggggat

SEQ ID NO: 4989703 - DNA, 12 bp, Homo sapiens
tttgctgggaga

SEQ ID NO: 4989704 - DNA, 23 bp, Homo sapiens
tttggaaattaggttgaaacata

SEQ ID NO: 4989705 - DNA, 13 bp, Homo sapiens
tttgtacattatg

SEQ ID NO: 4989706 - DNA, 15 bp, Homo sapiens
tttgtacattatgtt

SEQ ID NO: 4989707 - DNA, 16 bp, Homo sapiens
tttgttttcttcattt

SEQ ID NO: 4989708 - DNA, 17 bp, Homo sapiens
ttttcaattttaaacat

SEQ ID NO: 4989709 - DNA, 13 bp, Homo sapiens
ttttctttgattt

SEQ ID NO: 4989710 - DNA, 23 bp, Homo sapiens
ttttgacagagttggtgttcata

SEQ ID NO: 4989711 - DNA, 13 bp, Homo sapiens
ttttgataaaaga

SEQ ID NO: 4989712 - DNA, 15 bp, Homo sapiens
ttttgctcttctgta

SEQ ID NO: 4989713 - DNA, 15 bp, Homo sapiens
ttttgtacattatgt

SEQ ID NO: 4989714 - DNA, 17 bp, Homo sapiens
ttttgtacattatgtta

SEQ ID NO: 4989715 - DNA, 17 bp, Homo sapiens
tttttatctttaaatag

SEQ ID NO: 4989716 - DNA, 20 bp, Homo sapiens
aaaagcctctgttttgatat

SEQ ID NO: 4989717 - DNA, 16 bp, Homo sapiens
aaaatcttcatggaat

SEQ ID NO: 4989718 - DNA, 17 bp, Homo sapiens
aaaatcttcatggaatt

SEQ ID NO: 4989719 - DNA, 23 bp, Homo sapiens
aaaattaactgctaacttctatt

SEQ ID NO: 4989720 - DNA, 15 bp, Homo sapiens
aaaattatggaaaca

SEQ ID NO: 4989721 - DNA, 16 bp, Homo sapiens
aaaattgtgatgtgtc

SEQ ID NO: 4989722 - DNA, 19 bp, Homo sapiens
aaacagaagattacaaaag

SEQ ID NO: 4989723 - DNA, 22 bp, Homo sapiens
aaacagaagattacaaaagcaa

SEQ ID NO: 4989724 - DNA, 19 bp, Homo sapiens
aaacatatccaagtttgaa

SEQ ID NO: 4989725 - DNA, 23 bp, Homo sapiens
aaactatatttatttatgtagga

SEQ ID NO: 4989726 - DNA, 11 bp, Homo sapiens
aaactgagcat

SEQ ID NO: 4989727 - DNA, 19 bp, Homo sapiens
aaactgatgtttaaaagtc

SEQ ID NO: 4989728 - DNA, 14 bp, Homo sapiens
aaactgtagctgta

SEQ ID NO: 4989729 - DNA, 17 bp, Homo sapiens
aaagaagtttgaacatt

SEQ ID NO: 4989730 - DNA, 22 bp, Homo sapiens
aaagcgctaagtaaaaatatta

SEQ ID NO: 4989731 - DNA, 12 bp, Homo sapiens
aaagctatctta

SEQ ID NO: 4989732 - DNA, 19 bp, Homo sapiens
aaagctatcttaaaatata

SEQ ID NO: 4989733 - DNA, 20 bp, Homo sapiens
aaagctatcttaaaatatag

SEQ ID NO: 4989734 - DNA, 14 bp, Homo sapiens
aaagtaatttggaa

SEQ ID NO: 4989735 - DNA, 22 bp, Homo sapiens
aaagtagatcatgcatagagtg

SEQ ID NO: 4989736 - DNA, 14 bp, Homo sapiens
aaagttgcaaggca

SEQ ID NO: 4989737 - DNA, 15 bp, Homo sapiens
aaagttgcaaggcaa

SEQ ID NO: 4989738 - DNA, 21 bp, Homo sapiens
aaagttgcaaggcaaatgttt

SEQ ID NO: 4989739 - DNA, 16 bp, Homo sapiens
aaataagtctgattta

SEQ ID NO: 4989740 - DNA, 17 bp, Homo sapiens
aaataagtctgatttaa

SEQ ID NO: 4989741 - DNA, 14 bp, Homo sapiens
aaatatgtttcaca

SEQ ID NO: 4989742 - DNA, 16 bp, Homo sapiens
aaatcaggttttcttt

SEQ ID NO: 4989743 - DNA, 19 bp, Homo sapiens
aaatcaggttttcttttaa

SEQ ID NO: 4989744 - DNA, 14 bp, Homo sapiens
aaatctacaggcct

SEQ ID NO: 4989745 - DNA, 22 bp, Homo sapiens
aaatctaggaaaattattctat

SEQ ID NO: 4989746 - DNA, 15 bp, Homo sapiens
aaatgcaaaaaaaat

SEQ ID NO: 4989747 - DNA, 22 bp, Homo sapiens
aaatggcccatttaatgattga

SEQ ID NO: 4989748 - DNA, 15 bp, Homo sapiens
aaatgtcagttctga

SEQ ID NO: 4989749 - DNA, 14 bp, Homo sapiens
aaatgtttatttaa

SEQ ID NO: 4989750 - DNA, 18 bp, Homo sapiens
aaatgtttatttaaaaga

SEQ ID NO: 4989751 - DNA, 22 bp, Homo sapiens
aaatgttttgctcaatagattg

SEQ ID NO: 4989752 - DNA, 16 bp, Homo sapiens
aaattaggttgaaaca

SEQ ID NO: 4989753 - DNA, 10 bp, Homo sapiens
aaattttaaa

SEQ ID NO: 4989754 - DNA, 19 bp, Homo sapiens
aacaactgtcagttcatcc

SEQ ID NO: 4989755 - DNA, 20 bp, Homo sapiens
aacaataaagcattttgcaa

SEQ ID NO: 4989756 - DNA, 21 bp, Homo sapiens
aacacatctagtagttgttct

SEQ ID NO: 4989757 - DNA, 20 bp, Homo sapiens
aacagaagaaaatagaattg

SEQ ID NO: 4989758 - DNA, 20 bp, Homo sapiens
aacatatccaagtttgaatt

SEQ ID NO: 4989759 - DNA, 19 bp, Homo sapiens
aacatttgggttactattt

SEQ ID NO: 4989760 - DNA, 19 bp, Homo sapiens
aacatttttgtacattatg

SEQ ID NO: 4989761 - DNA, 18 bp, Homo sapiens
aactgatcatgtttatga

SEQ ID NO: 4989762 - DNA, 23 bp, Homo sapiens
aactgatcatgtttatgagaaac

SEQ ID NO: 4989763 - DNA, 13 bp, Homo sapiens
aactggcaaagca

SEQ ID NO: 4989764 - DNA, 18 bp, Homo sapiens
aactgtcagttcatcctg

SEQ ID NO: 4989765 - DNA, 22 bp, Homo sapiens
aacttataattacaatgcacaa

SEQ ID NO: 4989766 - DNA, 12 bp, Homo sapiens
aacttcattttt

SEQ ID NO: 4989767 - DNA, 15 bp, Homo sapiens
aagaaaaacatctgg

SEQ ID NO: 4989768 - DNA, 22 bp, Homo sapiens
aagaagggaagccttttgcaaa

SEQ ID NO: 4989769 - DNA, 23 bp, Homo sapiens
aagaagggaagccttttgcaaat

SEQ ID NO: 4989770 - DNA, 21 bp, Homo sapiens
aagagactaatagagacacag

SEQ ID NO: 4989771 - DNA, 17 bp, Homo sapiens
aagattacaaaagcaat

SEQ ID NO: 4989772 - DNA, 18 bp, Homo sapiens
aagattacaaaagcaatt

SEQ ID NO: 4989773 - DNA, 18 bp, Homo sapiens
aagcaactaagttaataa

SEQ ID NO: 4989774 - DNA, 20 bp, Homo sapiens
aagcaactaagttaataata

SEQ ID NO: 4989775 - DNA, 16 bp, Homo sapiens
aagcaattttcattta

SEQ ID NO: 4989776 - DNA, 19 bp, Homo sapiens
aagcaattttcatttacct

SEQ ID NO: 4989777 - DNA, 19 bp, Homo sapiens
aagcacaggtccaaggctg

SEQ ID NO: 4989778 - DNA, 20 bp, Homo sapiens
aagcacaggtccaaggctgg

SEQ ID NO: 4989779 - DNA, 13 bp, Homo sapiens
aagcattttgcaa

SEQ ID NO: 4989780 - DNA, 16 bp, Homo sapiens
aagccaaaactgagca

SEQ ID NO: 4989781 - DNA, 19 bp, Homo sapiens
aagccaaaactgagcataa

SEQ ID NO: 4989782 - DNA, 17 bp, Homo sapiens
aagccttttgcaaatag

SEQ ID NO: 4989783 - DNA, 21 bp, Homo sapiens
aagccttttgcaaatagtaga

SEQ ID NO: 4989784 - DNA, 21 bp, Homo sapiens
aagctatcttaaaatatagaa

SEQ ID NO: 4989785 - DNA, 22 bp, Homo sapiens
aagctatcttaaaatatagaaa

SEQ ID NO: 4989786 - DNA, 17 bp, Homo sapiens
aaggcatggacttctgg

SEQ ID NO: 4989787 - DNA, 17 bp, Homo sapiens
aaggctggtcccacact

SEQ ID NO: 4989788 - DNA, 12 bp, Homo sapiens
aagtaaaaatat

SEQ ID NO: 4989789 - DNA, 19 bp, Homo sapiens
aagtatagaaaatcttcat

SEQ ID NO: 4989790 - DNA, 18 bp, Homo sapiens
aagtatcaagtatagaaa

SEQ ID NO: 4989791 - DNA, 19 bp, Homo sapiens
aagtatcaagtatagaaaa

SEQ ID NO: 4989792 - DNA, 21 bp, Homo sapiens
aagtatcaagtatagaaaatc

SEQ ID NO: 4989793 - DNA, 16 bp, Homo sapiens
aagtgccattcatcct

SEQ ID NO: 4989794 - DNA, 18 bp, Homo sapiens
aagtgtgggtctgtgtgt

SEQ ID NO: 4989795 - DNA, 20 bp, Homo sapiens
aagtgtgggtctgtgtgtgt

SEQ ID NO: 4989796 - DNA, 22 bp, Homo sapiens
aagttattaagaggtaagactt

SEQ ID NO: 4989797 - DNA, 12 bp, Homo sapiens
aagttcaccagc

SEQ ID NO: 4989798 - DNA, 23 bp, Homo sapiens
aataaatgaatgtcacttctgga

SEQ ID NO: 4989799 - DNA, 20 bp, Homo sapiens
aataaccaattcctcatttg

SEQ ID NO: 4989800 - DNA, 18 bp, Homo sapiens
aataataatgactctaaa

SEQ ID NO: 4989801 - DNA, 22 bp, Homo sapiens
aataatcataaactatattctg

SEQ ID NO: 4989802 - DNA, 19 bp, Homo sapiens
aatagaaagttgcaaggca

SEQ ID NO: 4989803 - DNA, 15 bp, Homo sapiens
aatagaattgacatt

SEQ ID NO: 4989804 - DNA, 22 bp, Homo sapiens
aatagaattgacattgaaatct

SEQ ID NO: 4989805 - DNA, 22 bp, Homo sapiens
aatagattgctcaaatcaggtt

SEQ ID NO: 4989806 - DNA, 17 bp, Homo sapiens
aataggcactttaaaac

SEQ ID NO: 4989807 - DNA, 18 bp, Homo sapiens
aatcaggttttcttttaa

SEQ ID NO: 4989808 - DNA, 13 bp, Homo sapiens
aatctacaggcct

SEQ ID NO: 4989809 - DNA, 21 bp, Homo sapiens
aatctctgattccctgattta

SEQ ID NO: 4989810 - DNA, 21 bp, Homo sapiens
aatcttcatggaattcacaaa

SEQ ID NO: 4989811 - DNA, 23 bp, Homo sapiens
aatcttcatggaattcacaaagt

SEQ ID NO: 4989812 - DNA, 17 bp, Homo sapiens
aatgaaaacaatgcagt

SEQ ID NO: 4989813 - DNA, 20 bp, Homo sapiens
aatgactctaaagaaacaga

SEQ ID NO: 4989814 - DNA, 16 bp, Homo sapiens
aatgagactttaaaag

SEQ ID NO: 4989815 - DNA, 12 bp, Homo sapiens
aatgcaaaaaaa

SEQ ID NO: 4989816 - DNA, 20 bp, Homo sapiens
aatgcagtacaggacatata

SEQ ID NO: 4989817 - DNA, 15 bp, Homo sapiens
aatgggagtctgaaa

SEQ ID NO: 4989818 - DNA, 19 bp, Homo sapiens
aatggtagcattttaaaca

SEQ ID NO: 4989819 - DNA, 14 bp, Homo sapiens
aattaaaactcatt

SEQ ID NO: 4989820 - DNA, 17 bp, Homo sapiens
aattaactaaggaaata

SEQ ID NO: 4989821 - DNA, 16 bp, Homo sapiens
aattaccagaaagata

SEQ ID NO: 4989822 - DNA, 20 bp, Homo sapiens
aattattctataatttccat

SEQ ID NO: 4989823 - DNA, 23 bp, Homo sapiens
aattattctataatttccattta

SEQ ID NO: 4989824 - DNA, 16 bp, Homo sapiens
aattccacaccctcac

SEQ ID NO: 4989825 - DNA, 15 bp, Homo sapiens
aattcctaaaattat

SEQ ID NO: 4989826 - DNA, 15 bp, Homo sapiens
aattgggcactattt

SEQ ID NO: 4989827 - DNA, 15 bp, Homo sapiens
aattgtgatgtgtcc

SEQ ID NO: 4989828 - DNA, 15 bp, Homo sapiens
aatttacaacttata

SEQ ID NO: 4989829 - DNA, 14 bp, Homo sapiens
aatttatgtgatgg

SEQ ID NO: 4989830 - DNA, 13 bp, Homo sapiens
aattttaaacata

SEQ ID NO: 4989831 - DNA, 18 bp, Homo sapiens
aattttctttcatacatt

SEQ ID NO: 4989832 - DNA, 21 bp, Homo sapiens
acaaacaaggcctgtcagcta

SEQ ID NO: 4989833 - DNA, 16 bp, Homo sapiens
acaaagtaatttggaa

SEQ ID NO: 4989834 - DNA, 14 bp, Homo sapiens
acaaatgttttgct

SEQ ID NO: 4989835 - DNA, 23 bp, Homo sapiens
acaaatgttttgctcaatagatt

SEQ ID NO: 4989836 - DNA, 18 bp, Homo sapiens
acaacatttttgtacatt

SEQ ID NO: 4989837 - DNA, 21 bp, Homo sapiens
acaacatttttgtacattatg

SEQ ID NO: 4989838 - DNA, 14 bp, Homo sapiens
acacacagatgcac

SEQ ID NO: 4989839 - DNA, 23 bp, Homo sapiens
acacacggatgcacacacagatg

SEQ ID NO: 4989840 - DNA, 17 bp, Homo sapiens
acacagagatatgcaca

SEQ ID NO: 4989841 - DNA, 19 bp, Homo sapiens
acacagatatacacatgga

SEQ ID NO: 4989842 - DNA, 19 bp, Homo sapiens
acacataagccaaaactga

SEQ ID NO: 4989843 - DNA, 16 bp, Homo sapiens
acacgactgcaacata

SEQ ID NO: 4989844 - DNA, 16 bp, Homo sapiens
acactcaagtgccatt

SEQ ID NO: 4989845 - DNA, 15 bp, Homo sapiens
acactgagatccaga

SEQ ID NO: 4989846 - DNA, 16 bp, Homo sapiens
acacttatcagcagca

SEQ ID NO: 4989847 - DNA, 15 bp, Homo sapiens
acagagagagactga

SEQ ID NO: 4989848 - DNA, 21 bp, Homo sapiens
acagatatgcacacacatgga

SEQ ID NO: 4989849 - DNA, 16 bp, Homo sapiens
acagatgcacacacag

SEQ ID NO: 4989850 - DNA, 19 bp, Homo sapiens
acagatggtcacacagaga

SEQ ID NO: 4989851 - DNA, 21 bp, Homo sapiens
acagcagtgagactggggcca

SEQ ID NO: 4989852 - DNA, 17 bp, Homo sapiens
acaggacatatattttt

SEQ ID NO: 4989853 - DNA, 12 bp, Homo sapiens
acaggcctcagg

SEQ ID NO: 4989854 - DNA, 22 bp, Homo sapiens
acaggtgccttggggaaatgtg

SEQ ID NO: 4989855 - DNA, 13 bp, Homo sapiens
acagtaataaatg

SEQ ID NO: 4989856 - DNA, 22 bp, Homo sapiens
acatatacatacttacatgtgt

SEQ ID NO: 4989857 - DNA, 19 bp, Homo sapiens
acatatctcttatcttacg

SEQ ID NO: 4989858 - DNA, 12 bp, Homo sapiens
acatgattttct

SEQ ID NO: 4989859 - DNA, 13 bp, Homo sapiens
acatgattttctt

SEQ ID NO: 4989860 - DNA, 22 bp, Homo sapiens
acatgattttcttttgttttct

SEQ ID NO: 4989861 - DNA, 16 bp, Homo sapiens
acatggagagagactc

SEQ ID NO: 4989862 - DNA, 20 bp, Homo sapiens
acattaaaatagcacatgat

SEQ ID NO: 4989863 - DNA, 21 bp, Homo sapiens
acattaaaatagcacatgatt

SEQ ID NO: 4989864 - DNA, 13 bp, Homo sapiens
acattatgttatt

SEQ ID NO: 4989865 - DNA, 21 bp, Homo sapiens
acattatgttattggaatttt

SEQ ID NO: 4989866 - DNA, 16 bp, Homo sapiens
acattcaatcttgccg

SEQ ID NO: 4989867 - DNA, 15 bp, Homo sapiens
acattctttcctaaa

SEQ ID NO: 4989868 - DNA, 19 bp, Homo sapiens
acattctttcctaaatata

SEQ ID NO: 4989869 - DNA, 13 bp, Homo sapiens
acattgaaatcta

SEQ ID NO: 4989870 - DNA, 20 bp, Homo sapiens
acattgaaatctaggaaaat

SEQ ID NO: 4989871 - DNA, 18 bp, Homo sapiens
acatttgggttactattt

SEQ ID NO: 4989872 - DNA, 16 bp, Homo sapiens
acattttacacactgt

SEQ ID NO: 4989873 - DNA, 17 bp, Homo sapiens
accaattcctcatttgt

SEQ ID NO: 4989874 - DNA, 20 bp, Homo sapiens
accaatttctttctaaaaca

SEQ ID NO: 4989875 - DNA, 14 bp, Homo sapiens
accatctctttacc

SEQ ID NO: 4989876 - DNA, 19 bp, Homo sapiens
accatgaaagacttctcta

SEQ ID NO: 4989877 - DNA, 21 bp, Homo sapiens
acccaagaactcctgaaatca

SEQ ID NO: 4989878 - DNA, 18 bp, Homo sapiens
acccacacgactgcaaca

SEQ ID NO: 4989879 - DNA, 18 bp, Homo sapiens
accgatgtacacacacag

SEQ ID NO: 4989880 - DNA, 12 bp, Homo sapiens
accttcctgctg

SEQ ID NO: 4989881 - DNA, 19 bp, Homo sapiens
acgactgcaacatacaggt

SEQ ID NO: 4989882 - DNA, 21 bp, Homo sapiens
acgcacatagagatatgcaca

SEQ ID NO: 4989883 - DNA, 14 bp, Homo sapiens
acgctgatcattgg

SEQ ID NO: 4989884 - DNA, 11 bp, Homo sapiens
actaaggaaat

SEQ ID NO: 4989885 - DNA, 17 bp, Homo sapiens
actaaggaaatatttca

SEQ ID NO: 4989886 - DNA, 14 bp, Homo sapiens
actaatagagacac

SEQ ID NO: 4989887 - DNA, 19 bp, Homo sapiens
actaatagagacacagaga

SEQ ID NO: 4989888 - DNA, 16 bp, Homo sapiens
actaatctaaactgta

SEQ ID NO: 4989889 - DNA, 19 bp, Homo sapiens
actagccatctcaagcaag

SEQ ID NO: 4989890 - DNA, 21 bp, Homo sapiens
actatatttattgatttcaag

SEQ ID NO: 4989891 - DNA, 12 bp, Homo sapiens
actattcatcaa

SEQ ID NO: 4989892 - DNA, 18 bp, Homo sapiens
actattcatcaatgaaga

SEQ ID NO: 4989893 - DNA, 16 bp, Homo sapiens
actatttatttacaaa

SEQ ID NO: 4989894 - DNA, 19 bp, Homo sapiens
actatttatttacaaatgt

SEQ ID NO: 4989895 - DNA, 13 bp, Homo sapiens
actcagtctttaa

SEQ ID NO: 4989896 - DNA, 18 bp, Homo sapiens
actcatctttccctcctt

SEQ ID NO: 4989897 - DNA, 21 bp, Homo sapiens
actcatctttccctccttggt

SEQ ID NO: 4989898 - DNA, 17 bp, Homo sapiens
actccaggcagcagaca

SEQ ID NO: 4989899 - DNA, 20 bp, Homo sapiens
actccatgtgtgctgtcctc

SEQ ID NO: 4989900 - DNA, 21 bp, Homo sapiens
actctggaggtttgtttagaa

SEQ ID NO: 4989901 - DNA, 14 bp, Homo sapiens
actgattccagcaa

SEQ ID NO: 4989902 - DNA, 15 bp, Homo sapiens
actgtacacataagc

SEQ ID NO: 4989903 - DNA, 14 bp, Homo sapiens
actgtttcagtcct

SEQ ID NO: 4989904 - DNA, 18 bp, Homo sapiens
acttaatgaaaacaatgc

SEQ ID NO: 4989905 - DNA, 16 bp, Homo sapiens
acttaatgagacttta

SEQ ID NO: 4989906 - DNA, 19 bp, Homo sapiens
acttaatgagactttaaaa

SEQ ID NO: 4989907 - DNA, 15 bp, Homo sapiens
acttctcttcccata

SEQ ID NO: 4989908 - DNA, 15 bp, Homo sapiens
acttttgcaaataag

SEQ ID NO: 4989909 - DNA, 13 bp, Homo sapiens
actttttctttga

SEQ ID NO: 4989910 - DNA, 18 bp, Homo sapiens
actttttctttgattttc

SEQ ID NO: 4989911 - DNA, 14 bp, Homo sapiens
actttttgaattct

SEQ ID NO: 4989912 - DNA, 19 bp, Homo sapiens
agaaaagatgagaggcaga

SEQ ID NO: 4989913 - DNA, 23 bp, Homo sapiens
agaaaatcttcatggaattcaca

SEQ ID NO: 4989914 - DNA, 19 bp, Homo sapiens
agaaacattctttcctaaa

SEQ ID NO: 4989915 - DNA, 15 bp, Homo sapiens
agaaactggcaaagc

SEQ ID NO: 4989916 - DNA, 17 bp, Homo sapiens
agaaactggcaaagcag

SEQ ID NO: 4989917 - DNA, 22 bp, Homo sapiens
agaaataacagaagaaaataga

SEQ ID NO: 4989918 - DNA, 19 bp, Homo sapiens
agaactcctgaaatcatat

SEQ ID NO: 4989919 - DNA, 18 bp, Homo sapiens
agaacttctcttcccata

SEQ ID NO: 4989920 - DNA, 14 bp, Homo sapiens
agaagaagtgtgtc

SEQ ID NO: 4989921 - DNA, 18 bp, Homo sapiens
agaagattacaaaagcaa

SEQ ID NO: 4989922 - DNA, 13 bp, Homo sapiens
agaagggaagcct

SEQ ID NO: 4989923 - DNA, 20 bp, Homo sapiens
agaagggaagccttttgcaa

SEQ ID NO: 4989924 - DNA, 15 bp, Homo sapiens
agaagttctagtgtt

SEQ ID NO: 4989925 - DNA, 15 bp, Homo sapiens
agaagtttgaacatt

SEQ ID NO: 4989926 - DNA, 17 bp, Homo sapiens
agaataggcactttaaa

SEQ ID NO: 4989927 - DNA, 18 bp, Homo sapiens
agaataggcactttaaaa

SEQ ID NO: 4989928 - DNA, 13 bp, Homo sapiens
agaatgtcagtat

SEQ ID NO: 4989929 - DNA, 19 bp, Homo sapiens
agaattttcaaataaggaa

SEQ ID NO: 4989930 - DNA, 21 bp, Homo sapiens
agacacatgccagggccatgt

SEQ ID NO: 4989931 - DNA, 12 bp, Homo sapiens
agacagagacag

SEQ ID NO: 4989932 - DNA, 13 bp, Homo sapiens
agacagagacctg

SEQ ID NO: 4989933 - DNA, 17 bp, Homo sapiens
agacagtagaggcatga

SEQ ID NO: 4989934 - DNA, 21 bp, Homo sapiens
agacatttgctatgagctggg

SEQ ID NO: 4989935 - DNA, 22 bp, Homo sapiens
agacctgccctcaagagcaaag

SEQ ID NO: 4989936 - DNA, 21 bp, Homo sapiens
agacgtgagtgtgactttttg

SEQ ID NO: 4989937 - DNA, 23 bp, Homo sapiens
agactggcgtgaacccaggaggc

SEQ ID NO: 4989938 - DNA, 15 bp, Homo sapiens
agagacacagagatg

SEQ ID NO: 4989939 - DNA, 17 bp, Homo sapiens
agagagactcaaagaga

SEQ ID NO: 4989940 - DNA, 17 bp, Homo sapiens
agagagactgagggaga

SEQ ID NO: 4989941 - DNA, 14 bp, Homo sapiens
agagagagacagag

SEQ ID NO: 4989942 - DNA, 13 bp, Homo sapiens
agagatatgcaca

SEQ ID NO: 4989943 - DNA, 15 bp, Homo sapiens
agagcaggccaggcg

SEQ ID NO: 4989944 - DNA, 14 bp, Homo sapiens
agagccttaataaa

SEQ ID NO: 4989945 - DNA, 19 bp, Homo sapiens
agaggctggatgacttgct

SEQ ID NO: 4989946 - DNA, 21 bp, Homo sapiens
agaggtggggagggagacaga

SEQ ID NO: 4989947 - DNA, 12 bp, Homo sapiens
agagtcctggcc

SEQ ID NO: 4989948 - DNA, 19 bp, Homo sapiens
agagtggggtaggttggga

SEQ ID NO: 4989949 - DNA, 19 bp, Homo sapiens
agagttggtgttcataatt

SEQ ID NO: 4989950 - DNA, 14 bp, Homo sapiens
agatatatttgtca

SEQ ID NO: 4989951 - DNA, 11 bp, Homo sapiens
agatatgcaca

SEQ ID NO: 4989952 - DNA, 22 bp, Homo sapiens
agatatgcacacacagatgcac

SEQ ID NO: 4989953 - DNA, 14 bp, Homo sapiens
agatcatgcataga

SEQ ID NO: 4989954 - DNA, 15 bp, Homo sapiens
agatgagaggcagag

SEQ ID NO: 4989955 - DNA, 22 bp, Homo sapiens
agatgcacacacagatgcacac

SEQ ID NO: 4989956 - DNA, 14 bp, Homo sapiens
agatgtatgcacac

SEQ ID NO: 4989957 - DNA, 15 bp, Homo sapiens
agattacaaaagcaa

SEQ ID NO: 4989958 - DNA, 17 bp, Homo sapiens
agattcttgctgtgacc

SEQ ID NO: 4989959 - DNA, 16 bp, Homo sapiens
agattgctcaaatcag

SEQ ID NO: 4989960 - DNA, 13 bp, Homo sapiens
agatttattaatt

SEQ ID NO: 4989961 - DNA, 18 bp, Homo sapiens
agatttttgctcttctgt

SEQ ID NO: 4989962 - DNA, 16 bp, Homo sapiens
agcaacaactgtcagt

SEQ ID NO: 4989963 - DNA, 13 bp, Homo sapiens
agcacaggtccaa

SEQ ID NO: 4989964 - DNA, 12 bp, Homo sapiens
agcagacacatg

SEQ ID NO: 4989965 - DNA, 16 bp, Homo sapiens
agcatcaccatgcatg

SEQ ID NO: 4989966 - DNA, 20 bp, Homo sapiens
agcatggtagtggcaaagag

SEQ ID NO: 4989967 - DNA, 17 bp, Homo sapiens
agcattttaaacaaaat

SEQ ID NO: 4989968 - DNA, 13 bp, Homo sapiens
agcattttgcaaa

SEQ ID NO: 4989969 - DNA, 15 bp, Homo sapiens
agcattttttaacct

SEQ ID NO: 4989970 - DNA, 14 bp, Homo sapiens
agcctcacagcagt

SEQ ID NO: 4989971 - DNA, 12 bp, Homo sapiens
agccttaataaa

SEQ ID NO: 4989972 - DNA, 20 bp, Homo sapiens
agcgctaagtaaaaatatta

SEQ ID NO: 4989973 - DNA, 19 bp, Homo sapiens
agctactcgggaggctgag

SEQ ID NO: 4989974 - DNA, 14 bp, Homo sapiens
agctaggtgacata

SEQ ID NO: 4989975 - DNA, 13 bp, Homo sapiens
agctcaataggag

SEQ ID NO: 4989976 - DNA, 14 bp, Homo sapiens
agctgcctgtgcct

SEQ ID NO: 4989977 - DNA, 22 bp, Homo sapiens
aggaactgctgggcttggcagc

SEQ ID NO: 4989978 - DNA, 16 bp, Homo sapiens
aggaagcacaggtcca

SEQ ID NO: 4989979 - DNA, 12 bp, Homo sapiens
aggacagtattt

SEQ ID NO: 4989980 - DNA, 16 bp, Homo sapiens
aggacatggagagaga

SEQ ID NO: 4989981 - DNA, 18 bp, Homo sapiens
aggactccaggcagcaga

SEQ ID NO: 4989982 - DNA, 23 bp, Homo sapiens
aggactccaggcagcagacacat

SEQ ID NO: 4989983 - DNA, 21 bp, Homo sapiens
aggagggatgttccagtggat

SEQ ID NO: 4989984 - DNA, 15 bp, Homo sapiens
aggataaattacatt

SEQ ID NO: 4989985 - DNA, 17 bp, Homo sapiens
aggatcagattcttgct

SEQ ID NO: 4989986 - DNA, 18 bp, Homo sapiens
aggatcagattcttgctg

SEQ ID NO: 4989987 - DNA, 13 bp, Homo sapiens
aggatgtctgggc

SEQ ID NO: 4989988 - DNA, 16 bp, Homo sapiens
aggatttgctgggaga

SEQ ID NO: 4989989 - DNA, 15 bp, Homo sapiens
aggcagcagacacat

SEQ ID NO: 4989990 - DNA, 19 bp, Homo sapiens
aggcatgaacacacatgga

SEQ ID NO: 4989991 - DNA, 13 bp, Homo sapiens
aggcattacaaat

SEQ ID NO: 4989992 - DNA, 15 bp, Homo sapiens
aggctattcctgaga

SEQ ID NO: 4989993 - DNA, 20 bp, Homo sapiens
aggctattcctgagagctgc

SEQ ID NO: 4989994 - DNA, 12 bp, Homo sapiens
aggctggatgac

SEQ ID NO: 4989995 - DNA, 23 bp, Homo sapiens
agggaagccttttgcaaatagta

SEQ ID NO: 4989996 - DNA, 18 bp, Homo sapiens
agggactcatctttccct

SEQ ID NO: 4989997 - DNA, 18 bp, Homo sapiens
agggatgttccagtggat

SEQ ID NO: 4989998 - DNA, 19 bp, Homo sapiens
agggccaccaggaagcaca

SEQ ID NO: 4989999 - DNA, 13 bp, Homo sapiens
aggtccaaggctg

SEQ ID NO: 4990000 - DNA, 17 bp, Homo sapiens
aggtccaaggctggtcc

SEQ ID NO: 4990001 - DNA, 18 bp, Homo sapiens
aggtccaaggctggtccc

SEQ ID NO: 4990002 - DNA, 21 bp, Homo sapiens
aggtccagagtcctggccctt

SEQ ID NO: 4990003 - DNA, 15 bp, Homo sapiens
aggtgacatatacat

SEQ ID NO: 4990004 - DNA, 21 bp, Homo sapiens
aggtgccttggggaaatgtgg

SEQ ID NO: 4990005 - DNA, 16 bp, Homo sapiens
agtaaaaatattaact

SEQ ID NO: 4990006 - DNA, 16 bp, Homo sapiens
agtaataaatgaatgt

SEQ ID NO: 4990007 - DNA, 18 bp, Homo sapiens
agtagatcatgcatagag

SEQ ID NO: 4990008 - DNA, 12 bp, Homo sapiens
agtatagaatag

SEQ ID NO: 4990009 - DNA, 22 bp, Homo sapiens
agtataggataaattacattaa

SEQ ID NO: 4990010 - DNA, 17 bp, Homo sapiens
agtatcaagtatagaaa

SEQ ID NO: 4990011 - DNA, 12 bp, Homo sapiens
agtatcagttgc

SEQ ID NO: 4990012 - DNA, 22 bp, Homo sapiens
agtatcagttgcaggtgccaat

SEQ ID NO: 4990013 - DNA, 15 bp, Homo sapiens
agtatgtggaagtgt

SEQ ID NO: 4990014 - DNA, 17 bp, Homo sapiens
agtatgtggaagtgtgg

SEQ ID NO: 4990015 - DNA, 19 bp, Homo sapiens
agtattttttacattttac

SEQ ID NO: 4990016 - DNA, 22 bp, Homo sapiens
agtattttttacattttacaca

SEQ ID NO: 4990017 - DNA, 17 bp, Homo sapiens
agtccacttttaaaact

SEQ ID NO: 4990018 - DNA, 12 bp, Homo sapiens
agtctgaaatgg

SEQ ID NO: 4990019 - DNA, 15 bp, Homo sapiens
agtgcagtatagaat

SEQ ID NO: 4990020 - DNA, 16 bp, Homo sapiens
agtgccacaaagctca

SEQ ID NO: 4990021 - DNA, 18 bp, Homo sapiens
agtgccaggatggaatga

SEQ ID NO: 4990022 - DNA, 13 bp, Homo sapiens
agtgccattcatc

SEQ ID NO: 4990023 - DNA, 16 bp, Homo sapiens
agtggcaaagagaggt

SEQ ID NO: 4990024 - DNA, 17 bp, Homo sapiens
agtggcaaagagaggtc

SEQ ID NO: 4990025 - DNA, 16 bp, Homo sapiens
agtgtattttgaaatt

SEQ ID NO: 4990026 - DNA, 17 bp, Homo sapiens
agtgtgggtctgtgtgt

SEQ ID NO: 4990027 - DNA, 19 bp, Homo sapiens
agtgtgggtctgtgtgtgt

SEQ ID NO: 4990028 - DNA, 23 bp, Homo sapiens
agtgtgggtctgtgtgtgtgtat

SEQ ID NO: 4990029 - DNA, 9 bp, Homo sapiens
agtgtgtaa

SEQ ID NO: 4990030 - DNA, 16 bp, Homo sapiens
agtgttttcaatttta

SEQ ID NO: 4990031 - DNA, 18 bp, Homo sapiens
agtgttttcaattttaaa

SEQ ID NO: 4990032 - DNA, 13 bp, Homo sapiens
agttctagtgttt

SEQ ID NO: 4990033 - DNA, 17 bp, Homo sapiens
agttctagttgattgcg

SEQ ID NO: 4990034 - DNA, 18 bp, Homo sapiens
agttctagttgattgcga

SEQ ID NO: 4990035 - DNA, 20 bp, Homo sapiens
agttgcaaggcaaatgttta

SEQ ID NO: 4990036 - DNA, 17 bp, Homo sapiens
agttggtgttcataatt

SEQ ID NO: 4990037 - DNA, 16 bp, Homo sapiens
agtttccctctgtata

SEQ ID NO: 4990038 - DNA, 15 bp, Homo sapiens
ataaatgaatgtcac

SEQ ID NO: 4990039 - DNA, 14 bp, Homo sapiens
ataaattacattaa

SEQ ID NO: 4990040 - DNA, 20 bp, Homo sapiens
ataaccaattcctcatttgt

SEQ ID NO: 4990041 - DNA, 19 bp, Homo sapiens
ataagccaaaactgagcat

SEQ ID NO: 4990042 - DNA, 15 bp, Homo sapiens
ataagtgctactttg

SEQ ID NO: 4990043 - DNA, 23 bp, Homo sapiens
ataataatgactctaaagaaaca

SEQ ID NO: 4990044 - DNA, 20 bp, Homo sapiens
ataatattactctatgatga

SEQ ID NO: 4990045 - DNA, 22 bp, Homo sapiens
ataatttccatttacttaagac

SEQ ID NO: 4990046 - DNA, 22 bp, Homo sapiens
atacaaggatcagattcttgct

SEQ ID NO: 4990047 - DNA, 22 bp, Homo sapiens
atacactcaagtgccattcatc

SEQ ID NO: 4990048 - DNA, 20 bp, Homo sapiens
atacattatattcctctaaa

SEQ ID NO: 4990049 - DNA, 22 bp, Homo sapiens
atacttacatgtgtgtatatgt

SEQ ID NO: 4990050 - DNA, 13 bp, Homo sapiens
atagaaaactaat

SEQ ID NO: 4990051 - DNA, 18 bp, Homo sapiens
atagaaaactaatctaaa

SEQ ID NO: 4990052 - DNA, 17 bp, Homo sapiens
atagaaagttgcaaggc

SEQ ID NO: 4990053 - DNA, 20 bp, Homo sapiens
atagaataggcactttaaaa

SEQ ID NO: 4990054 - DNA, 13 bp, Homo sapiens
atagaattgacat

SEQ ID NO: 4990055 - DNA, 14 bp, Homo sapiens
atagatgtgtggac

SEQ ID NO: 4990056 - DNA, 15 bp, Homo sapiens
atatacatacttaca

SEQ ID NO: 4990057 - DNA, 14 bp, Homo sapiens
atatagaaaactaa

SEQ ID NO: 4990058 - DNA, 22 bp, Homo sapiens
atatattttttaaaataagtct

SEQ ID NO: 4990059 - DNA, 18 bp, Homo sapiens
atatgtagatgtatgcac

SEQ ID NO: 4990060 - DNA, 14 bp, Homo sapiens
atatgtttcacaca

SEQ ID NO: 4990061 - DNA, 18 bp, Homo sapiens
atatgtttcacacaaaca

SEQ ID NO: 4990062 - DNA, 13 bp, Homo sapiens
atatttatttatg

SEQ ID NO: 4990063 - DNA, 13 bp, Homo sapiens
atatttgtcattt

SEQ ID NO: 4990064 - DNA, 15 bp, Homo sapiens
atatttgtcattttc

SEQ ID NO: 4990065 - DNA, 23 bp, Homo sapiens
atattttttaaaataagtctgat

SEQ ID NO: 4990066 - DNA, 14 bp, Homo sapiens
atcaaggtggaaat

SEQ ID NO: 4990067 - DNA, 17 bp, Homo sapiens
atcaagtatagaaaatc

SEQ ID NO: 4990068 - DNA, 21 bp, Homo sapiens
atcagattcttgctgtgaccc

SEQ ID NO: 4990069 - DNA, 16 bp, Homo sapiens
atcaggccattgtccc

SEQ ID NO: 4990070 - DNA, 21 bp, Homo sapiens
atcagttgcaggtgccaatga

SEQ ID NO: 4990071 - DNA, 14 bp, Homo sapiens
atcatgcatagagt

SEQ ID NO: 4990072 - DNA, 17 bp, Homo sapiens
atcatgtttatgagaaa

SEQ ID NO: 4990073 - DNA, 20 bp, Homo sapiens
atcattatcagcctgtgcca

SEQ ID NO: 4990074 - DNA, 22 bp, Homo sapiens
atcattctgcttccgtatttta

SEQ ID NO: 4990075 - DNA, 23 bp, Homo sapiens
atcattgtatcaaattattttta

SEQ ID NO: 4990076 - DNA, 20 bp, Homo sapiens
atccatggggctgattgtat

SEQ ID NO: 4990077 - DNA, 20 bp, Homo sapiens
atctacaggcctcagggtgg

SEQ ID NO: 4990078 - DNA, 20 bp, Homo sapiens
atctcacgctgatcattgga

SEQ ID NO: 4990079 - DNA, 14 bp, Homo sapiens
atctgtatgctggt

SEQ ID NO: 4990080 - DNA, 22 bp, Homo sapiens
atctgtgaggggctctctcatg

SEQ ID NO: 4990081 - DNA, 14 bp, Homo sapiens
atcttaaaaacaac

SEQ ID NO: 4990082 - DNA, 23 bp, Homo sapiens
atcttcatggaattcacaaagta

SEQ ID NO: 4990083 - DNA, 19 bp, Homo sapiens
atctttccctccttggtga

SEQ ID NO: 4990084 - DNA, 17 bp, Homo sapiens
atgaaaagctatcttaa

SEQ ID NO: 4990085 - DNA, 18 bp, Homo sapiens
atgaaaagctatcttaaa

SEQ ID NO: 4990086 - DNA, 22 bp, Homo sapiens
atgaaaagctatcttaaaatat

SEQ ID NO: 4990087 - DNA, 17 bp, Homo sapiens
atgaaaataatctctga

SEQ ID NO: 4990088 - DNA, 19 bp, Homo sapiens
atgaaaataatctctgatt

SEQ ID NO: 4990089 - DNA, 19 bp, Homo sapiens
atgaagattaacactgaga

SEQ ID NO: 4990090 - DNA, 16 bp, Homo sapiens
atgactctaaagaaac

SEQ ID NO: 4990091 - DNA, 20 bp, Homo sapiens
atgagaaactggcaaagcag

SEQ ID NO: 4990092 - DNA, 22 bp, Homo sapiens
atgagaaactggcaaagcagaa

SEQ ID NO: 4990093 - DNA, 21 bp, Homo sapiens
atgagactttaaaagcatttt

SEQ ID NO: 4990094 - DNA, 16 bp, Homo sapiens
atgatgattgcttcca

SEQ ID NO: 4990095 - DNA, 16 bp, Homo sapiens
atgatgggtcagttgt

SEQ ID NO: 4990096 - DNA, 15 bp, Homo sapiens
atgattttcttttgt

SEQ ID NO: 4990097 - DNA, 16 bp, Homo sapiens
atgcaaaaaaaattag

SEQ ID NO: 4990098 - DNA, 14 bp, Homo sapiens
atgcacacacacag

SEQ ID NO: 4990099 - DNA, 19 bp, Homo sapiens
atgcacacacacagagata

SEQ ID NO: 4990100 - DNA, 12 bp, Homo sapiens
atgcacacacag

SEQ ID NO: 4990101 - DNA, 20 bp, Homo sapiens
atgcagtacaggacatatat

SEQ ID NO: 4990102 - DNA, 21 bp, Homo sapiens
atgccagggccatgtcagaca

SEQ ID NO: 4990103 - DNA, 21 bp, Homo sapiens
atgctggtagctagtgattta

SEQ ID NO: 4990104 - DNA, 20 bp, Homo sapiens
atggaatagaaaagatgaga

SEQ ID NO: 4990105 - DNA, 21 bp, Homo sapiens
atggaatgatgggtcagttgt

SEQ ID NO: 4990106 - DNA, 11 bp, Homo sapiens
atggagagaga

SEQ ID NO: 4990107 - DNA, 16 bp, Homo sapiens
atggcctgggggatgt

SEQ ID NO: 4990108 - DNA, 22 bp, Homo sapiens
atgggagctgtcaagcatgtat

SEQ ID NO: 4990109 - DNA, 19 bp, Homo sapiens
atgggagggagggagaggt

SEQ ID NO: 4990110 - DNA, 16 bp, Homo sapiens
atgggagtctgaaatg

SEQ ID NO: 4990111 - DNA, 14 bp, Homo sapiens
atggtagtggcaaa

SEQ ID NO: 4990112 - DNA, 17 bp, Homo sapiens
atggtagtggcaaagag

SEQ ID NO: 4990113 - DNA, 17 bp, Homo sapiens
atgtacgacttgcatac

SEQ ID NO: 4990114 - DNA, 18 bp, Homo sapiens
atgtagatgtatgcacac

SEQ ID NO: 4990115 - DNA, 22 bp, Homo sapiens
atgtagatgtatgcacacacat

SEQ ID NO: 4990116 - DNA, 19 bp, Homo sapiens
atgtattaaaatatcccaa

SEQ ID NO: 4990117 - DNA, 20 bp, Homo sapiens
atgtcagacacagattggcc

SEQ ID NO: 4990118 - DNA, 21 bp, Homo sapiens
atgtcagtctgcttagaaata

SEQ ID NO: 4990119 - DNA, 16 bp, Homo sapiens
atgtcagttctgatat

SEQ ID NO: 4990120 - DNA, 23 bp, Homo sapiens
atgtggaagtgtgggtctgtgtg

SEQ ID NO: 4990121 - DNA, 19 bp, Homo sapiens
atgtggagaacattcaatc

SEQ ID NO: 4990122 - DNA, 16 bp, Homo sapiens
atgtgggggtctgtgt

SEQ ID NO: 4990123 - DNA, 18 bp, Homo sapiens
atgtgggggtctgtgtgt

SEQ ID NO: 4990124 - DNA, 13 bp, Homo sapiens
atgtgtaataaat

SEQ ID NO: 4990125 - DNA, 18 bp, Homo sapiens
atgtgtgtgtgttgtgtg

SEQ ID NO: 4990126 - DNA, 15 bp, Homo sapiens
atgttattggaattt

SEQ ID NO: 4990127 - DNA, 22 bp, Homo sapiens
atgttggcattaacaataaagc

SEQ ID NO: 4990128 - DNA, 17 bp, Homo sapiens
atgtttacagaggacag

SEQ ID NO: 4990129 - DNA, 16 bp, Homo sapiens
atgtttcacacaaaca

SEQ ID NO: 4990130 - DNA, 15 bp, Homo sapiens
attaacaataaagca

SEQ ID NO: 4990131 - DNA, 15 bp, Homo sapiens
attaacactgagatc

SEQ ID NO: 4990132 - DNA, 20 bp, Homo sapiens
attaactgacgaagaagcaa

SEQ ID NO: 4990133 - DNA, 20 bp, Homo sapiens
attactctatgatgattgct

SEQ ID NO: 4990134 - DNA, 16 bp, Homo sapiens
attaggttgaaacata

SEQ ID NO: 4990135 - DNA, 19 bp, Homo sapiens
attaggttgaaacatatct

SEQ ID NO: 4990136 - DNA, 14 bp, Homo sapiens
attatgttattgga

SEQ ID NO: 4990137 - DNA, 22 bp, Homo sapiens
attatgttattggaattttctt

SEQ ID NO: 4990138 - DNA, 21 bp, Homo sapiens
attcacaaagtaatttggaaa

SEQ ID NO: 4990139 - DNA, 19 bp, Homo sapiens
attcacctcctaaaacaac

SEQ ID NO: 4990140 - DNA, 21 bp, Homo sapiens
attcacctcctaaaacaacag

SEQ ID NO: 4990141 - DNA, 12 bp, Homo sapiens
attccagaggaa

SEQ ID NO: 4990142 - DNA, 19 bp, Homo sapiens
attcctcatttgttcatta

SEQ ID NO: 4990143 - DNA, 15 bp, Homo sapiens
attcctctaaaactc

SEQ ID NO: 4990144 - DNA, 12 bp, Homo sapiens
attctttcctaa

SEQ ID NO: 4990145 - DNA, 17 bp, Homo sapiens
attgaaatctaggaaaa

SEQ ID NO: 4990146 - DNA, 18 bp, Homo sapiens
attgacattgaaatctag

SEQ ID NO: 4990147 - DNA, 21 bp, Homo sapiens
attgatttaacttcatttttc

SEQ ID NO: 4990148 - DNA, 23 bp, Homo sapiens
attgctggagacagtagaggcat

SEQ ID NO: 4990149 - DNA, 17 bp, Homo sapiens
attggaattttctttca

SEQ ID NO: 4990150 - DNA, 17 bp, Homo sapiens
attgtagagccagaggt

SEQ ID NO: 4990151 - DNA, 18 bp, Homo sapiens
attgtagagccagaggtc

SEQ ID NO: 4990152 - DNA, 14 bp, Homo sapiens
attgtgatgtgtcc

SEQ ID NO: 4990153 - DNA, 14 bp, Homo sapiens
atttaaaagagcag

SEQ ID NO: 4990154 - DNA, 15 bp, Homo sapiens
atttaaaattgtgat

SEQ ID NO: 4990155 - DNA, 18 bp, Homo sapiens
atttactgattccagcaa

SEQ ID NO: 4990156 - DNA, 13 bp, Homo sapiens
atttacttaagac

SEQ ID NO: 4990157 - DNA, 13 bp, Homo sapiens
atttatttacaaa

SEQ ID NO: 4990158 - DNA, 16 bp, Homo sapiens
atttatttacaaatgt

SEQ ID NO: 4990159 - DNA, 15 bp, Homo sapiens
atttcaatacactca

SEQ ID NO: 4990160 - DNA, 12 bp, Homo sapiens
atttctttctaa

SEQ ID NO: 4990161 - DNA, 20 bp, Homo sapiens
atttgctatgagctggggat

SEQ ID NO: 4990162 - DNA, 16 bp, Homo sapiens
atttgttcattaaacg

SEQ ID NO: 4990163 - DNA, 21 bp, Homo sapiens
attttaaacatatccaagttt

SEQ ID NO: 4990164 - DNA, 20 bp, Homo sapiens
attttcaataaatttctgct

SEQ ID NO: 4990165 - DNA, 16 bp, Homo sapiens
attttctttcatacat

SEQ ID NO: 4990166 - DNA, 17 bp, Homo sapiens
attttctttcatacatt

SEQ ID NO: 4990167 - DNA, 20 bp, Homo sapiens
attttcttttgttttcttca

SEQ ID NO: 4990168 - DNA, 14 bp, Homo sapiens
atttttgtacatta

SEQ ID NO: 4990169 - DNA, 17 bp, Homo sapiens
atttttgtacattatgt

SEQ ID NO: 4990170 - DNA, 18 bp, Homo sapiens
atttttgtacattatgtt

SEQ ID NO: 4990171 - DNA, 20 bp, Homo sapiens
atttttgtacattatgttat

SEQ ID NO: 4990172 - DNA, 21 bp, Homo sapiens
caaacaaggcctgtcagctaa

SEQ ID NO: 4990173 - DNA, 18 bp, Homo sapiens
caaagagaggtccagagt

SEQ ID NO: 4990174 - DNA, 18 bp, Homo sapiens
caaagtaatttggaaatt

SEQ ID NO: 4990175 - DNA, 20 bp, Homo sapiens
caaagtagatcatgcataga

SEQ ID NO: 4990176 - DNA, 13 bp, Homo sapiens
caaataagtgtat

SEQ ID NO: 4990177 - DNA, 17 bp, Homo sapiens
caaataagtgtattttg

SEQ ID NO: 4990178 - DNA, 20 bp, Homo sapiens
caaataagtgtattttgaaa

SEQ ID NO: 4990179 - DNA, 18 bp, Homo sapiens
caaataatattactctat

SEQ ID NO: 4990180 - DNA, 21 bp, Homo sapiens
caaataatattactctatgat

SEQ ID NO: 4990181 - DNA, 16 bp, Homo sapiens
caacaactgtcagttc

SEQ ID NO: 4990182 - DNA, 21 bp, Homo sapiens
caactaagttaataataatga

SEQ ID NO: 4990183 - DNA, 18 bp, Homo sapiens
caactgtcagttcatcct

SEQ ID NO: 4990184 - DNA, 22 bp, Homo sapiens
caacttataattacaatgcaca

SEQ ID NO: 4990185 - DNA, 23 bp, Homo sapiens
caagcagacgtgagtgtgacttt

SEQ ID NO: 4990186 - DNA, 13 bp, Homo sapiens
caaggcaaatgtt

SEQ ID NO: 4990187 - DNA, 19 bp, Homo sapiens
caagtatagaaaatcttca

SEQ ID NO: 4990188 - DNA, 19 bp, Homo sapiens
caataaagcattttgcaaa

SEQ ID NO: 4990189 - DNA, 15 bp, Homo sapiens
caataaatttctgct

SEQ ID NO: 4990190 - DNA, 22 bp, Homo sapiens
caataggtgctgagtgtacaga

SEQ ID NO: 4990191 - DNA, 22 bp, Homo sapiens
caatcttgccgtcactattcat

SEQ ID NO: 4990192 - DNA, 16 bp, Homo sapiens
caatgaagattaacac

SEQ ID NO: 4990193 - DNA, 14 bp, Homo sapiens
caattatgaaaata

SEQ ID NO: 4990194 - DNA, 15 bp, Homo sapiens
caattatgaaaataa

SEQ ID NO: 4990195 - DNA, 21 bp, Homo sapiens
caattcctcatttgttcatta

SEQ ID NO: 4990196 - DNA, 22 bp, Homo sapiens
caattcctcatttgttcattaa

SEQ ID NO: 4990197 - DNA, 12 bp, Homo sapiens
caattttaaaca

SEQ ID NO: 4990198 - DNA, 15 bp, Homo sapiens
caattttaaacatat

SEQ ID NO: 4990199 - DNA, 21 bp, Homo sapiens
cacaaagctcaataggaggga

SEQ ID NO: 4990200 - DNA, 18 bp, Homo sapiens
cacaaagtaatttggaaa

SEQ ID NO: 4990201 - DNA, 21 bp, Homo sapiens
cacacacagagatatgcacac

SEQ ID NO: 4990202 - DNA, 24 bp, Homo sapiens
cacacacggatgcacacacagatg

SEQ ID NO: 4990203 - DNA, 18 bp, Homo sapiens
cacacagatggtcacaca

SEQ ID NO: 4990204 - DNA, 19 bp, Homo sapiens
cacacagatggtcacacag

SEQ ID NO: 4990205 - DNA, 17 bp, Homo sapiens
cacacatggatgagcac

SEQ ID NO: 4990206 - DNA, 17 bp, Homo sapiens
cacacatggatgcacac

SEQ ID NO: 4990207 - DNA, 14 bp, Homo sapiens
cacacgcacataga

SEQ ID NO: 4990208 - DNA, 15 bp, Homo sapiens
cacacggatgcacag

SEQ ID NO: 4990209 - DNA, 12 bp, Homo sapiens
cacagagatatg

SEQ ID NO: 4990210 - DNA, 16 bp, Homo sapiens
cacagagtataaataa

SEQ ID NO: 4990211 - DNA, 18 bp, Homo sapiens
cacagatatacacatgga

SEQ ID NO: 4990212 - DNA, 20 bp, Homo sapiens
cacagatgcacacacagatg

SEQ ID NO: 4990213 - DNA, 18 bp, Homo sapiens
cacatagagatatgcaca

SEQ ID NO: 4990214 - DNA, 23 bp, Homo sapiens
cacatctagtagttgttctgaaa

SEQ ID NO: 4990215 - DNA, 14 bp, Homo sapiens
cacatgattttctt

SEQ ID NO: 4990216 - DNA, 15 bp, Homo sapiens
cacatggatgagcac

SEQ ID NO: 4990217 - DNA, 18 bp, Homo sapiens
caccaggaagcacaggtc

SEQ ID NO: 4990218 - DNA, 13 bp, Homo sapiens
cactattcatcaa

SEQ ID NO: 4990219 - DNA, 18 bp, Homo sapiens
cactatttatttacaaat

SEQ ID NO: 4990220 - DNA, 22 bp, Homo sapiens
cactatttatttacaaatgttt

SEQ ID NO: 4990221 - DNA, 19 bp, Homo sapiens
cagaagaaaatagaattga

SEQ ID NO: 4990222 - DNA, 20 bp, Homo sapiens
cagaagattacaaaagcaat

SEQ ID NO: 4990223 - DNA, 22 bp, Homo sapiens
cagagacagaaacagagagaga

SEQ ID NO: 4990224 - DNA, 13 bp, Homo sapiens
cagagacagagag

SEQ ID NO: 4990225 - DNA, 15 bp, Homo sapiens
cagagacagagagag

SEQ ID NO: 4990226 - DNA, 24 bp, Homo sapiens
cagagaggctggatgacttgctca

SEQ ID NO: 4990227 - DNA, 13 bp, Homo sapiens
cagaggcagacag

SEQ ID NO: 4990228 - DNA, 12 bp, Homo sapiens
cagaggggcagg

SEQ ID NO: 4990229 - DNA, 17 bp, Homo sapiens
cagaggggcaggggagt

SEQ ID NO: 4990230 - DNA, 17 bp, Homo sapiens
cagagtggaataagaca

SEQ ID NO: 4990231 - DNA, 20 bp, Homo sapiens
cagagtggaataagacagag

SEQ ID NO: 4990232 - DNA, 15 bp, Homo sapiens
cagatgcacacacag

SEQ ID NO: 4990233 - DNA, 21 bp, Homo sapiens
cagcaacaactgtcagttcat

SEQ ID NO: 4990234 - DNA, 19 bp, Homo sapiens
cagcaattatgaaaataat

SEQ ID NO: 4990235 - DNA, 17 bp, Homo sapiens
cagcactttgggaggct

SEQ ID NO: 4990236 - DNA, 20 bp, Homo sapiens
cagcactttgggaggctgag

SEQ ID NO: 4990237 - DNA, 12 bp, Homo sapiens
cagcagacacat

SEQ ID NO: 4990238 - DNA, 23 bp, Homo sapiens
cagctactcgggaggctgaggca

SEQ ID NO: 4990239 - DNA, 14 bp, Homo sapiens
cagctcagtgccac

SEQ ID NO: 4990240 - DNA, 15 bp, Homo sapiens
caggagtccctgcca

SEQ ID NO: 4990241 - DNA, 17 bp, Homo sapiens
caggcagcagacacatg

SEQ ID NO: 4990242 - DNA, 21 bp, Homo sapiens
cagggactcatctttccctcc

SEQ ID NO: 4990243 - DNA, 22 bp, Homo sapiens
cagggactcatctttccctcct

SEQ ID NO: 4990244 - DNA, 17 bp, Homo sapiens
cagggccatgtcagaca

SEQ ID NO: 4990245 - DNA, 21 bp, Homo sapiens
cagggccatgtcagacacaga

SEQ ID NO: 4990246 - DNA, 17 bp, Homo sapiens
caggtccaaggctggtc

SEQ ID NO: 4990247 - DNA, 12 bp, Homo sapiens
caggtgttcttc

SEQ ID NO: 4990248 - DNA, 16 bp, Homo sapiens
cagtagaggcatgaac

SEQ ID NO: 4990249 - DNA, 22 bp, Homo sapiens
cagtatagaataggcactttaa

SEQ ID NO: 4990250 - DNA, 15 bp, Homo sapiens
cagtatttgtgggga

SEQ ID NO: 4990251 - DNA, 14 bp, Homo sapiens
cagtctgcttagaa

SEQ ID NO: 4990252 - DNA, 17 bp, Homo sapiens
cagtctgcttagaaata

SEQ ID NO: 4990253 - DNA, 23 bp, Homo sapiens
cagtgcacacggatgcacagaga

SEQ ID NO: 4990254 - DNA, 18 bp, Homo sapiens
cataatcacaacccttca

SEQ ID NO: 4990255 - DNA, 11 bp, Homo sapiens
catacattata

SEQ ID NO: 4990256 - DNA, 16 bp, Homo sapiens
catagagatatgcaca

SEQ ID NO: 4990257 - DNA, 24 bp, Homo sapiens
catagagatatgcacacacagatg

SEQ ID NO: 4990258 - DNA, 21 bp, Homo sapiens
catagtttgggcttgtaccac

SEQ ID NO: 4990259 - DNA, 15 bp, Homo sapiens
catctggatatcaag

SEQ ID NO: 4990260 - DNA, 17 bp, Homo sapiens
catctgtacctctgcct

SEQ ID NO: 4990261 - DNA, 15 bp, Homo sapiens
catctttccctcctt

SEQ ID NO: 4990262 - DNA, 14 bp, Homo sapiens
catgaacacacatg

SEQ ID NO: 4990263 - DNA, 18 bp, Homo sapiens
catgaacacacatggatg

SEQ ID NO: 4990264 - DNA, 12 bp, Homo sapiens
catgattttctt

SEQ ID NO: 4990265 - DNA, 14 bp, Homo sapiens
catggaaggcaaga

SEQ ID NO: 4990266 - DNA, 15 bp, Homo sapiens
catggagagagactc

SEQ ID NO: 4990267 - DNA, 13 bp, Homo sapiens
catggatgagcac

SEQ ID NO: 4990268 - DNA, 15 bp, Homo sapiens
catggatgcacgcac

SEQ ID NO: 4990269 - DNA, 20 bp, Homo sapiens
catggatgcacgcacatgcc

SEQ ID NO: 4990270 - DNA, 15 bp, Homo sapiens
catgtttatgagaaa

SEQ ID NO: 4990271 - DNA, 20 bp, Homo sapiens
cattaaaatagcacatgatt

SEQ ID NO: 4990272 - DNA, 17 bp, Homo sapiens
cattaaagatttctgct

SEQ ID NO: 4990273 - DNA, 17 bp, Homo sapiens
cattaacaataaagcat

SEQ ID NO: 4990274 - DNA, 20 bp, Homo sapiens
cattatattcctctaaaact

SEQ ID NO: 4990275 - DNA, 21 bp, Homo sapiens
cattatgttattggaattttc

SEQ ID NO: 4990276 - DNA, 13 bp, Homo sapiens
cattccagaggaa

SEQ ID NO: 4990277 - DNA, 14 bp, Homo sapiens
cattcccccagtgc

SEQ ID NO: 4990278 - DNA, 15 bp, Homo sapiens
cattcccccagtgcg

SEQ ID NO: 4990279 - DNA, 18 bp, Homo sapiens
cattcgtggttgatttca

SEQ ID NO: 4990280 - DNA, 13 bp, Homo sapiens
cattctttcctaa

SEQ ID NO: 4990281 - DNA, 19 bp, Homo sapiens
cattctttcctaaatataa

SEQ ID NO: 4990282 - DNA, 18 bp, Homo sapiens
catttcaactttgttcct

SEQ ID NO: 4990283 - DNA, 22 bp, Homo sapiens
cattttaaacaaaatagaaagt

SEQ ID NO: 4990284 - DNA, 17 bp, Homo sapiens
catttttgtacattatg

SEQ ID NO: 4990285 - DNA, 23 bp, Homo sapiens
catttttgtacattatgttattg

SEQ ID NO: 4990286 - DNA, 17 bp, Homo sapiens
ccaaatcattgtatcaa

SEQ ID NO: 4990287 - DNA, 23 bp, Homo sapiens
ccaaattttcaataaatttctgc

SEQ ID NO: 4990288 - DNA, 16 bp, Homo sapiens
ccaagggaatattgcc

SEQ ID NO: 4990289 - DNA, 16 bp, Homo sapiens
ccaatttctttctaaa

SEQ ID NO: 4990290 - DNA, 19 bp, Homo sapiens
ccactgggtgtaaacacat

SEQ ID NO: 4990291 - DNA, 23 bp, Homo sapiens
ccagcactttgggaggctgaggc

SEQ ID NO: 4990292 - DNA, 20 bp, Homo sapiens
ccagcagccctggcctgtgg

SEQ ID NO: 4990293 - DNA, 19 bp, Homo sapiens
ccagctccgcgccaggatg

SEQ ID NO: 4990294 - DNA, 17 bp, Homo sapiens
ccaggatggcgcaggaa

SEQ ID NO: 4990295 - DNA, 22 bp, Homo sapiens
ccagtatgaaaagctatcttaa

SEQ ID NO: 4990296 - DNA, 14 bp, Homo sapiens
ccatcctcctggga

SEQ ID NO: 4990297 - DNA, 14 bp, Homo sapiens
ccatctcaagcaag

SEQ ID NO: 4990298 - DNA, 15 bp, Homo sapiens
ccattcccccagtgc

SEQ ID NO: 4990299 - DNA, 16 bp, Homo sapiens
ccattcccccagtgcg

SEQ ID NO: 4990300 - DNA, 13 bp, Homo sapiens
ccattggtgttga

SEQ ID NO: 4990301 - DNA, 20 bp, Homo sapiens
cccacctgcacgtgatctgc

SEQ ID NO: 4990302 - DNA, 18 bp, Homo sapiens
cccagcaattatgaaaat

SEQ ID NO: 4990303 - DNA, 21 bp, Homo sapiens
cccagcagccctggcctgtgg

SEQ ID NO: 4990304 - DNA, 12 bp, Homo sapiens
cccagctcagtg

SEQ ID NO: 4990305 - DNA, 17 bp, Homo sapiens
cccagctcagtgccaca

SEQ ID NO: 4990306 - DNA, 14 bp, Homo sapiens
cccatctgtatgct

SEQ ID NO: 4990307 - DNA, 15 bp, Homo sapiens
cccatttaatgattg

SEQ ID NO: 4990308 - DNA, 22 bp, Homo sapiens
ccccagcaattatgaaaataat

SEQ ID NO: 4990309 - DNA, 13 bp, Homo sapiens
ccctctctggacc

SEQ ID NO: 4990310 - DNA, 24 bp, Homo sapiens
ccctgtgccttggtgtgctgtatc

SEQ ID NO: 4990311 - DNA, 24 bp, Homo sapiens
cccttgatgcccagctcagtgcca

SEQ ID NO: 4990312 - DNA, 20 bp, Homo sapiens
cctaagtatcaagtatagaa

SEQ ID NO: 4990313 - DNA, 23 bp, Homo sapiens
cctactttttctttgattttcga

SEQ ID NO: 4990314 - DNA, 15 bp, Homo sapiens
cctcatttgttcatt

SEQ ID NO: 4990315 - DNA, 21 bp, Homo sapiens
cctctagtgaatgtaggctgg

SEQ ID NO: 4990316 - DNA, 19 bp, Homo sapiens
cctctctggacctcagttt

SEQ ID NO: 4990317 - DNA, 12 bp, Homo sapiens
cctgagagctgc

SEQ ID NO: 4990318 - DNA, 18 bp, Homo sapiens
cctgagagctgcatgtgt

SEQ ID NO: 4990319 - DNA, 17 bp, Homo sapiens
cctggctaacacggtga

SEQ ID NO: 4990320 - DNA, 20 bp, Homo sapiens
cctgtaatcccagcactttg

SEQ ID NO: 4990321 - DNA, 12 bp, Homo sapiens
ccttttgcaaat

SEQ ID NO: 4990322 - DNA, 19 bp, Homo sapiens
cgaaagaaggcatggactt

SEQ ID NO: 4990323 - DNA, 23 bp, Homo sapiens
cgaaagaaggcatggacttctgg

SEQ ID NO: 4990324 - DNA, 17 bp, Homo sapiens
cgacttgcatacctgct

SEQ ID NO: 4990325 - DNA, 23 bp, Homo sapiens
cgatggaggactccaggcagcag

SEQ ID NO: 4990326 - DNA, 19 bp, Homo sapiens
cgatgtacacacacagatg

SEQ ID NO: 4990327 - DNA, 19 bp, Homo sapiens
cgcacatgccaatgcacgc

SEQ ID NO: 4990328 - DNA, 16 bp, Homo sapiens
cgccaggatggcgcag

SEQ ID NO: 4990329 - DNA, 21 bp, Homo sapiens
cggaccttgtagtgagccgag

SEQ ID NO: 4990330 - DNA, 18 bp, Homo sapiens
cgggaggctgaggcagga

SEQ ID NO: 4990331 - DNA, 12 bp, Homo sapiens
cgtagatttttg

SEQ ID NO: 4990332 - DNA, 17 bp, Homo sapiens
cgtgaacccaggaggcg

SEQ ID NO: 4990333 - DNA, 18 bp, Homo sapiens
ctaagtatcaagtataga

SEQ ID NO: 4990334 - DNA, 15 bp, Homo sapiens
ctaagttaataataa

SEQ ID NO: 4990335 - DNA, 14 bp, Homo sapiens
ctaatctaaactgt

SEQ ID NO: 4990336 - DNA, 23 bp, Homo sapiens
ctaatgtgctgtgtgacattggg

SEQ ID NO: 4990337 - DNA, 21 bp, Homo sapiens
ctaattctttgacctgttggg

SEQ ID NO: 4990338 - DNA, 22 bp, Homo sapiens
ctaattctttgacctgttggga

SEQ ID NO: 4990339 - DNA, 17 bp, Homo sapiens
ctacaggcctcagggtg

SEQ ID NO: 4990340 - DNA, 21 bp, Homo sapiens
ctagccatctcaagcaagttt

SEQ ID NO: 4990341 - DNA, 16 bp, Homo sapiens
ctaggtgacatataca

SEQ ID NO: 4990342 - DNA, 16 bp, Homo sapiens
ctagtgatttacacag

SEQ ID NO: 4990343 - DNA, 13 bp, Homo sapiens
ctatcttaaaata

SEQ ID NO: 4990344 - DNA, 20 bp, Homo sapiens
ctatggcccatctgtatgct

SEQ ID NO: 4990345 - DNA, 19 bp, Homo sapiens
ctatggggatagatgtgtg

SEQ ID NO: 4990346 - DNA, 20 bp, Homo sapiens
ctatggggatagatgtgtgg

SEQ ID NO: 4990347 - DNA, 21 bp, Homo sapiens
ctatggggatagatgtgtgga

SEQ ID NO: 4990348 - DNA, 18 bp, Homo sapiens
ctatgttggcattaacaa

SEQ ID NO: 4990349 - DNA, 13 bp, Homo sapiens
ctattcctgagag

SEQ ID NO: 4990350 - DNA, 14 bp, Homo sapiens
ctatttatttacaa

SEQ ID NO: 4990351 - DNA, 15 bp, Homo sapiens
ctcatctttccctcc

SEQ ID NO: 4990352 - DNA, 16 bp, Homo sapiens
ctcatctttccctcct

SEQ ID NO: 4990353 - DNA, 17 bp, Homo sapiens
ctcatctttccctcctt

SEQ ID NO: 4990354 - DNA, 19 bp, Homo sapiens
ctcatctttccctccttgg

SEQ ID NO: 4990355 - DNA, 15 bp, Homo sapiens
ctcattccagaggaa

SEQ ID NO: 4990356 - DNA, 16 bp, Homo sapiens
ctccgcacacctgtgg

SEQ ID NO: 4990357 - DNA, 13 bp, Homo sapiens
ctcctaaaacaac

SEQ ID NO: 4990358 - DNA, 20 bp, Homo sapiens
ctcctaaaacaacagatgta

SEQ ID NO: 4990359 - DNA, 19 bp, Homo sapiens
ctcctgaaatctacaggcc

SEQ ID NO: 4990360 - DNA, 22 bp, Homo sapiens
ctcctgaaatctacaggcctca

SEQ ID NO: 4990361 - DNA, 23 bp, Homo sapiens
ctcctgggattggctgtgaactg

SEQ ID NO: 4990362 - DNA, 21 bp, Homo sapiens
ctccttggtgattccgcagtg

SEQ ID NO: 4990363 - DNA, 21 bp, Homo sapiens
ctctacccatcttaaaaacaa

SEQ ID NO: 4990364 - DNA, 20 bp, Homo sapiens
ctctagtgaatgtaggctgg

SEQ ID NO: 4990365 - DNA, 17 bp, Homo sapiens
ctctggacctcagtttc

SEQ ID NO: 4990366 - DNA, 21 bp, Homo sapiens
ctctgtatacaaggatcagat

SEQ ID NO: 4990367 - DNA, 16 bp, Homo sapiens
ctgagatccagagagg

SEQ ID NO: 4990368 - DNA, 12 bp, Homo sapiens
ctgagcaggtgt

SEQ ID NO: 4990369 - DNA, 19 bp, Homo sapiens
ctgagcctcacagcagtga

SEQ ID NO: 4990370 - DNA, 18 bp, Homo sapiens
ctgaggaagagggactgt

SEQ ID NO: 4990371 - DNA, 12 bp, Homo sapiens
ctgagggagaga

SEQ ID NO: 4990372 - DNA, 23 bp, Homo sapiens
ctgatcatgtttatgagaaactg

SEQ ID NO: 4990373 - DNA, 16 bp, Homo sapiens
ctgatttaatatgcaa

SEQ ID NO: 4990374 - DNA, 11 bp, Homo sapiens
ctgctgggctt

SEQ ID NO: 4990375 - DNA, 16 bp, Homo sapiens
ctgcttccgtatttta

SEQ ID NO: 4990376 - DNA, 23 bp, Homo sapiens
ctggacctcagtttccctctgta

SEQ ID NO: 4990377 - DNA, 20 bp, Homo sapiens
ctggatatcaaggtggaaat

SEQ ID NO: 4990378 - DNA, 14 bp, Homo sapiens
ctggatctgtgagg

SEQ ID NO: 4990379 - DNA, 15 bp, Homo sapiens
ctggatgacttgctc

SEQ ID NO: 4990380 - DNA, 18 bp, Homo sapiens
ctgggaataagtgccagg

SEQ ID NO: 4990381 - DNA, 19 bp, Homo sapiens
ctgggagtggaagaaggga

SEQ ID NO: 4990382 - DNA, 21 bp, Homo sapiens
ctgggattggctgtgaactga

SEQ ID NO: 4990383 - DNA, 16 bp, Homo sapiens
ctggggatgtctctca

SEQ ID NO: 4990384 - DNA, 17 bp, Homo sapiens
ctggggatgtctctcat

SEQ ID NO: 4990385 - DNA, 21 bp, Homo sapiens
ctgggtgccgggctgcacaga

SEQ ID NO: 4990386 - DNA, 16 bp, Homo sapiens
ctgggtgtaaacacat

SEQ ID NO: 4990387 - DNA, 14 bp, Homo sapiens
ctgtacctctgcct

SEQ ID NO: 4990388 - DNA, 22 bp, Homo sapiens
ctgtagtcccagctactcggga

SEQ ID NO: 4990389 - DNA, 22 bp, Homo sapiens
ctgtatgctggtagctagtgat

SEQ ID NO: 4990390 - DNA, 19 bp, Homo sapiens
ctgtatgtgacaacatttt

SEQ ID NO: 4990391 - DNA, 20 bp, Homo sapiens
ctgtcaaagaaaacttccaa

SEQ ID NO: 4990392 - DNA, 15 bp, Homo sapiens
ctgtcagttcatcct

SEQ ID NO: 4990393 - DNA, 19 bp, Homo sapiens
ctgtcagttcatcctgcat

SEQ ID NO: 4990394 - DNA, 14 bp, Homo sapiens
ctgtggagagaaag

SEQ ID NO: 4990395 - DNA, 16 bp, Homo sapiens
ctgtgtgtgtgtatgt

SEQ ID NO: 4990396 - DNA, 20 bp, Homo sapiens
ctgtgtgtgtgtatgtgggg

SEQ ID NO: 4990397 - DNA, 17 bp, Homo sapiens
ctgtgtgtttatgtgtg

SEQ ID NO: 4990398 - DNA, 12 bp, Homo sapiens
cttaaaaacaac

SEQ ID NO: 4990399 - DNA, 14 bp, Homo sapiens
cttaaaaacaacga

SEQ ID NO: 4990400 - DNA, 21 bp, Homo sapiens
cttatcagcagcaacaactgt

SEQ ID NO: 4990401 - DNA, 16 bp, Homo sapiens
cttatttttttcccaa

SEQ ID NO: 4990402 - DNA, 17 bp, Homo sapiens
cttatttttttcccaag

SEQ ID NO: 4990403 - DNA, 16 bp, Homo sapiens
cttcttctcggggaca

SEQ ID NO: 4990404 - DNA, 13 bp, Homo sapiens
cttgctcaagttc

SEQ ID NO: 4990405 - DNA, 13 bp, Homo sapiens
cttggggaaatgt

SEQ ID NO: 4990406 - DNA, 14 bp, Homo sapiens
cttggggaaatgtg

SEQ ID NO: 4990407 - DNA, 13 bp, Homo sapiens
ctttcatacatta

SEQ ID NO: 4990408 - DNA, 14 bp, Homo sapiens
ctttcatacattat

SEQ ID NO: 4990409 - DNA, 13 bp, Homo sapiens
ctttccctccttg

SEQ ID NO: 4990410 - DNA, 14 bp, Homo sapiens
ctttccctccttgg

SEQ ID NO: 4990411 - DNA, 15 bp, Homo sapiens
ctttccctccttggt

SEQ ID NO: 4990412 - DNA, 14 bp, Homo sapiens
ctttgacctgttgg

SEQ ID NO: 4990413 - DNA, 22 bp, Homo sapiens
ctttgtactgtagctaaatgta

SEQ ID NO: 4990414 - DNA, 19 bp, Homo sapiens
cttttaaaactatatttat

SEQ ID NO: 4990415 - DNA, 20 bp, Homo sapiens
cttttgttttcttcatttct

SEQ ID NO: 4990416 - DNA, 19 bp, Homo sapiens
gaaaaaatggtagcatttt

SEQ ID NO: 4990417 - DNA, 15 bp, Homo sapiens
gaaaagcctctgttt

SEQ ID NO: 4990418 - DNA, 13 bp, Homo sapiens
gaaaagctatctt

SEQ ID NO: 4990419 - DNA, 19 bp, Homo sapiens
gaaaagctatcttaaaata

SEQ ID NO: 4990420 - DNA, 13 bp, Homo sapiens
gaaaagtttataa

SEQ ID NO: 4990421 - DNA, 20 bp, Homo sapiens
gaaaatgctagaagaaaaca

SEQ ID NO: 4990422 - DNA, 23 bp, Homo sapiens
gaaacagaagattacaaaagcaa

SEQ ID NO: 4990423 - DNA, 22 bp, Homo sapiens
gaaagacttctctacccatctt

SEQ ID NO: 4990424 - DNA, 17 bp, Homo sapiens
gaaagttgcaaggcaaa

SEQ ID NO: 4990425 - DNA, 19 bp, Homo sapiens
gaaataacagaagaaaata

SEQ ID NO: 4990426 - DNA, 20 bp, Homo sapiens
gaaataacagaagaaaatag

SEQ ID NO: 4990427 - DNA, 22 bp, Homo sapiens
gaaataacagaagaaaatagaa

SEQ ID NO: 4990428 - DNA, 20 bp, Homo sapiens
gaaatggcccatttaatgat

SEQ ID NO: 4990429 - DNA, 17 bp, Homo sapiens
gaaatgtcagttctgat

SEQ ID NO: 4990430 - DNA, 21 bp, Homo sapiens
gaacatttgggttactatttc

SEQ ID NO: 4990431 - DNA, 13 bp, Homo sapiens
gaactattagagc

SEQ ID NO: 4990432 - DNA, 13 bp, Homo sapiens
gaactcctgaaat

SEQ ID NO: 4990433 - DNA, 14 bp, Homo sapiens
gaactcctgaaatc

SEQ ID NO: 4990434 - DNA, 17 bp, Homo sapiens
gaactgctgggcttggc

SEQ ID NO: 4990435 - DNA, 14 bp, Homo sapiens
gaagaagggaagcc

SEQ ID NO: 4990436 - DNA, 15 bp, Homo sapiens
gaagaagggaagcct

SEQ ID NO: 4990437 - DNA, 22 bp, Homo sapiens
gaagaagggaagccttttgcaa

SEQ ID NO: 4990438 - DNA, 13 bp, Homo sapiens
gaagaagtgtgtc

SEQ ID NO: 4990439 - DNA, 23 bp, Homo sapiens
gaagcacaggtccaaggctggtc

SEQ ID NO: 4990440 - DNA, 11 bp, Homo sapiens
gaaggcaagat

SEQ ID NO: 4990441 - DNA, 22 bp, Homo sapiens
gaatagaaaagatgagaggcag

SEQ ID NO: 4990442 - DNA, 16 bp, Homo sapiens
gaataggcactttaaa

SEQ ID NO: 4990443 - DNA, 16 bp, Homo sapiens
gaatgtcagtatgtgg

SEQ ID NO: 4990444 - DNA, 18 bp, Homo sapiens
gaatgtcagtatgtggaa

SEQ ID NO: 4990445 - DNA, 22 bp, Homo sapiens
gaattcacaaagtaatttggaa

SEQ ID NO: 4990446 - DNA, 20 bp, Homo sapiens
gaattcctaaaattatggaa

SEQ ID NO: 4990447 - DNA, 20 bp, Homo sapiens
gaattttctttcatacatta

SEQ ID NO: 4990448 - DNA, 15 bp, Homo sapiens
gacaacatttttgta

SEQ ID NO: 4990449 - DNA, 20 bp, Homo sapiens
gacaacatttttgtacatta

SEQ ID NO: 4990450 - DNA, 22 bp, Homo sapiens
gacaacatttttgtacattatg

SEQ ID NO: 4990451 - DNA, 14 bp, Homo sapiens
gacacagagatgga

SEQ ID NO: 4990452 - DNA, 16 bp, Homo sapiens
gacagaaacagagaga

SEQ ID NO: 4990453 - DNA, 19 bp, Homo sapiens
gacgtgagtgtgacttttt

SEQ ID NO: 4990454 - DNA, 18 bp, Homo sapiens
gactaatagagacacaga

SEQ ID NO: 4990455 - DNA, 20 bp, Homo sapiens
gactaatagagacacagaga

SEQ ID NO: 4990456 - DNA, 20 bp, Homo sapiens
gactagccatctcaagcaag

SEQ ID NO: 4990457 - DNA, 12 bp, Homo sapiens
gactcaaagaga

SEQ ID NO: 4990458 - DNA, 15 bp, Homo sapiens
gactcatctttccct

SEQ ID NO: 4990459 - DNA, 19 bp, Homo sapiens
gactcatctttccctcctt

SEQ ID NO: 4990460 - DNA, 15 bp, Homo sapiens
gactccaggcagcag

SEQ ID NO: 4990461 - DNA, 17 bp, Homo sapiens
gactccaggcagcagac

SEQ ID NO: 4990462 - DNA, 13 bp, Homo sapiens
gactctaaagaaa

SEQ ID NO: 4990463 - DNA, 15 bp, Homo sapiens
gactgagggagagac

SEQ ID NO: 4990464 - DNA, 18 bp, Homo sapiens
gagaaacattctttccta

SEQ ID NO: 4990465 - DNA, 20 bp, Homo sapiens
gagaaacattctttcctaaa

SEQ ID NO: 4990466 - DNA, 17 bp, Homo sapiens
gagaatgtcagtatgtg

SEQ ID NO: 4990467 - DNA, 16 bp, Homo sapiens
gagacacagagatgga

SEQ ID NO: 4990468 - DNA, 20 bp, Homo sapiens
gagacagaaacagagagaga

SEQ ID NO: 4990469 - DNA, 21 bp, Homo sapiens
gagacagaaacagagagagac

SEQ ID NO: 4990470 - DNA, 18 bp, Homo sapiens
gagacctgccctcaagag

SEQ ID NO: 4990471 - DNA, 20 bp, Homo sapiens
gagactaatagagacacaga

SEQ ID NO: 4990472 - DNA, 21 bp, Homo sapiens
gagactaatagagacacagag

SEQ ID NO: 4990473 - DNA, 15 bp, Homo sapiens
gagaggctggatgac

SEQ ID NO: 4990474 - DNA, 16 bp, Homo sapiens
gagaggctggatgact

SEQ ID NO: 4990475 - DNA, 17 bp, Homo sapiens
gagaggtccagagtcct

SEQ ID NO: 4990476 - DNA, 17 bp, Homo sapiens
gagagtggctggggcat

SEQ ID NO: 4990477 - DNA, 17 bp, Homo sapiens
gagcaaagtagatcatg

SEQ ID NO: 4990478 - DNA, 16 bp, Homo sapiens
gaggacatggagagag

SEQ ID NO: 4990479 - DNA, 13 bp, Homo sapiens
gaggctgaggcag

SEQ ID NO: 4990480 - DNA, 16 bp, Homo sapiens
gaggctgaggcaggag

SEQ ID NO: 4990481 - DNA, 18 bp, Homo sapiens
gagggagagactctgagg

SEQ ID NO: 4990482 - DNA, 18 bp, Homo sapiens
gagggccaccaggaagca

SEQ ID NO: 4990483 - DNA, 13 bp, Homo sapiens
gaggggtctttta

SEQ ID NO: 4990484 - DNA, 14 bp, Homo sapiens
gagtccctgccatc

SEQ ID NO: 4990485 - DNA, 18 bp, Homo sapiens
gagtctgaaatggggcta

SEQ ID NO: 4990486 - DNA, 19 bp, Homo sapiens
gagtggaagaagggaagcc

SEQ ID NO: 4990487 - DNA, 13 bp, Homo sapiens
gagttggctggga

SEQ ID NO: 4990488 - DNA, 15 bp, Homo sapiens
gatcacgaggtcagg

SEQ ID NO: 4990489 - DNA, 17 bp, Homo sapiens
gatcagattcttgctgt

SEQ ID NO: 4990490 - DNA, 14 bp, Homo sapiens
gatgcacagagata

SEQ ID NO: 4990491 - DNA, 14 bp, Homo sapiens
gatgcccagctcag

SEQ ID NO: 4990492 - DNA, 13 bp, Homo sapiens
gatggaatgatgg

SEQ ID NO: 4990493 - DNA, 19 bp, Homo sapiens
gatggaggactccaggcag

SEQ ID NO: 4990494 - DNA, 20 bp, Homo sapiens
gatggcaaagaaggagagca

SEQ ID NO: 4990495 - DNA, 15 bp, Homo sapiens
gatgggtcagttgta

SEQ ID NO: 4990496 - DNA, 19 bp, Homo sapiens
gattcacctcctaaaacaa

SEQ ID NO: 4990497 - DNA, 23 bp, Homo sapiens
gattgcaggagtccctgccatca

SEQ ID NO: 4990498 - DNA, 17 bp, Homo sapiens
gatttctgctccaaatt

SEQ ID NO: 4990499 - DNA, 23 bp, Homo sapiens
gcaaataagtgtattttgaaatt

SEQ ID NO: 4990500 - DNA, 17 bp, Homo sapiens
gcaaatgtttatttaaa

SEQ ID NO: 4990501 - DNA, 20 bp, Homo sapiens
gcaaatgtttatttaaaaga

SEQ ID NO: 4990502 - DNA, 18 bp, Homo sapiens
gcaactaagttaataata

SEQ ID NO: 4990503 - DNA, 17 bp, Homo sapiens
gcaaggtttaagttatt

SEQ ID NO: 4990504 - DNA, 19 bp, Homo sapiens
gcaattatgaaaataatct

SEQ ID NO: 4990505 - DNA, 21 bp, Homo sapiens
gcacacacaccgatgctgact

SEQ ID NO: 4990506 - DNA, 20 bp, Homo sapiens
gcacacacacggatgcacac

SEQ ID NO: 4990507 - DNA, 18 bp, Homo sapiens
gcacacacagatgcacac

SEQ ID NO: 4990508 - DNA, 13 bp, Homo sapiens
gcacacctgtggt

SEQ ID NO: 4990509 - DNA, 17 bp, Homo sapiens
gcacacctgtggtgcct

SEQ ID NO: 4990510 - DNA, 21 bp, Homo sapiens
gcacaggtccaaggctggtcc

SEQ ID NO: 4990511 - DNA, 19 bp, Homo sapiens
gcacatagagatatgcaca

SEQ ID NO: 4990512 - DNA, 18 bp, Homo sapiens
gcacatgattttcttttg

SEQ ID NO: 4990513 - DNA, 13 bp, Homo sapiens
gcacgcacatgcc

SEQ ID NO: 4990514 - DNA, 15 bp, Homo sapiens
gcactatttatttac

SEQ ID NO: 4990515 - DNA, 18 bp, Homo sapiens
gcactatttatttacaaa

SEQ ID NO: 4990516 - DNA, 14 bp, Homo sapiens
gcagcaacaactgt

SEQ ID NO: 4990517 - DNA, 22 bp, Homo sapiens
gcagtgagagagtggctggggc

SEQ ID NO: 4990518 - DNA, 16 bp, Homo sapiens
gcattaacaataaagc

SEQ ID NO: 4990519 - DNA, 16 bp, Homo sapiens
gccaagcccacctgca

SEQ ID NO: 4990520 - DNA, 21 bp, Homo sapiens
gccagggccatgtcagacaca

SEQ ID NO: 4990521 - DNA, 23 bp, Homo sapiens
gccatctcaagcaagtttaatca

SEQ ID NO: 4990522 - DNA, 15 bp, Homo sapiens
gccatgtcagacaca

SEQ ID NO: 4990523 - DNA, 18 bp, Homo sapiens
gccgtcactattcatcaa

SEQ ID NO: 4990524 - DNA, 23 bp, Homo sapiens
gccgtcactattcatcaatgaag

SEQ ID NO: 4990525 - DNA, 12 bp, Homo sapiens
gccttttgcaaa

SEQ ID NO: 4990526 - DNA, 13 bp, Homo sapiens
gccttttgcaaat

SEQ ID NO: 4990527 - DNA, 22 bp, Homo sapiens
gcgccactgtgctccagcctgg

SEQ ID NO: 4990528 - DNA, 21 bp, Homo sapiens
gcgctaagtaaaaatattaac

SEQ ID NO: 4990529 - DNA, 19 bp, Homo sapiens
gctaaagaagtttgaacat

SEQ ID NO: 4990530 - DNA, 19 bp, Homo sapiens
gctaagtaaaaatattaac

SEQ ID NO: 4990531 - DNA, 17 bp, Homo sapiens
gctagtgatttacacag

SEQ ID NO: 4990532 - DNA, 15 bp, Homo sapiens
gctcaagttcaccag

SEQ ID NO: 4990533 - DNA, 17 bp, Homo sapiens
gctcaagttcaccagca

SEQ ID NO: 4990534 - DNA, 16 bp, Homo sapiens
gctgaggcaggagact

SEQ ID NO: 4990535 - DNA, 13 bp, Homo sapiens
gctgatcattgga

SEQ ID NO: 4990536 - DNA, 13 bp, Homo sapiens
gctggatctgtga

SEQ ID NO: 4990537 - DNA, 17 bp, Homo sapiens
gctgggtgccgggctgc

SEQ ID NO: 4990538 - DNA, 20 bp, Homo sapiens
gctgtagacatttgctatga

SEQ ID NO: 4990539 - DNA, 12 bp, Homo sapiens
gcttagaaataa

SEQ ID NO: 4990540 - DNA, 19 bp, Homo sapiens
gcttagaaataacagaaga

SEQ ID NO: 4990541 - DNA, 22 bp, Homo sapiens
gcttccacccacacgactgcaa

SEQ ID NO: 4990542 - DNA, 14 bp, Homo sapiens
gcttccgtatttta

SEQ ID NO: 4990543 - DNA, 22 bp, Homo sapiens
gcttgtaccacttttgcaaata

SEQ ID NO: 4990544 - DNA, 20 bp, Homo sapiens
ggaaattaggttgaaacata

SEQ ID NO: 4990545 - DNA, 13 bp, Homo sapiens
ggaataagacaga

SEQ ID NO: 4990546 - DNA, 22 bp, Homo sapiens
ggaatagaaaagatgagaggca

SEQ ID NO: 4990547 - DNA, 23 bp, Homo sapiens
ggaattttctttcatacattata

SEQ ID NO: 4990548 - DNA, 16 bp, Homo sapiens
ggacagaggggcaggg

SEQ ID NO: 4990549 - DNA, 19 bp, Homo sapiens
ggacatatattttttaaaa

SEQ ID NO: 4990550 - DNA, 19 bp, Homo sapiens
ggacatggagagagactca

SEQ ID NO: 4990551 - DNA, 20 bp, Homo sapiens
ggactcatctttccctcctt

SEQ ID NO: 4990552 - DNA, 22 bp, Homo sapiens
ggactcatctttccctccttgg

SEQ ID NO: 4990553 - DNA, 21 bp, Homo sapiens
ggactccaggcagcagacaca

SEQ ID NO: 4990554 - DNA, 14 bp, Homo sapiens
ggaggtaatgacca

SEQ ID NO: 4990555 - DNA, 22 bp, Homo sapiens
ggagtgtgtaatttaaaattgt

SEQ ID NO: 4990556 - DNA, 14 bp, Homo sapiens
ggataaattacatt

SEQ ID NO: 4990557 - DNA, 15 bp, Homo sapiens
ggatagatgtgtgga

SEQ ID NO: 4990558 - DNA, 22 bp, Homo sapiens
ggatgttccagtggatgagggc

SEQ ID NO: 4990559 - DNA, 14 bp, Homo sapiens
ggcagaggcagaca

SEQ ID NO: 4990560 - DNA, 16 bp, Homo sapiens
ggcagcagacacatgc

SEQ ID NO: 4990561 - DNA, 15 bp, Homo sapiens
ggcatggacttctgg

SEQ ID NO: 4990562 - DNA, 16 bp, Homo sapiens
ggccaccaggaagcac

SEQ ID NO: 4990563 - DNA, 12 bp, Homo sapiens
ggccagctccgc

SEQ ID NO: 4990564 - DNA, 16 bp, Homo sapiens
ggccatgtcagacaca

SEQ ID NO: 4990565 - DNA, 12 bp, Homo sapiens
ggccctgtgcct

SEQ ID NO: 4990566 - DNA, 20 bp, Homo sapiens
ggcctctcattccagaggaa

SEQ ID NO: 4990567 - DNA, 20 bp, Homo sapiens
ggcgggtggatcacgaggtc

SEQ ID NO: 4990568 - DNA, 17 bp, Homo sapiens
ggctaagctatggccca

SEQ ID NO: 4990569 - DNA, 15 bp, Homo sapiens
gggaagccttttgca

SEQ ID NO: 4990570 - DNA, 22 bp, Homo sapiens
gggacaacactttccctctctg

SEQ ID NO: 4990571 - DNA, 23 bp, Homo sapiens
gggacaacactttccctctctgg

SEQ ID NO: 4990572 - DNA, 20 bp, Homo sapiens
gggacaccaagccttggctc

SEQ ID NO: 4990573 - DNA, 14 bp, Homo sapiens
gggatagatgtgtg

SEQ ID NO: 4990574 - DNA, 14 bp, Homo sapiens
gggatgtctctcat

SEQ ID NO: 4990575 - DNA, 13 bp, Homo sapiens
gggattggctgtg

SEQ ID NO: 4990576 - DNA, 18 bp, Homo sapiens
ggggaaatgtggagaaca

SEQ ID NO: 4990577 - DNA, 15 bp, Homo sapiens
gggtagaggagggca

SEQ ID NO: 4990578 - DNA, 14 bp, Homo sapiens
ggtagaggagggca

SEQ ID NO: 4990579 - DNA, 14 bp, Homo sapiens
ggtagcattttaaa

SEQ ID NO: 4990580 - DNA, 18 bp, Homo sapiens
ggtaggaactgctgggct

SEQ ID NO: 4990581 - DNA, 16 bp, Homo sapiens
ggtgacatatacatac

SEQ ID NO: 4990582 - DNA, 18 bp, Homo sapiens
ggtgattccgcagtgaga

SEQ ID NO: 4990583 - DNA, 13 bp, Homo sapiens
ggtgtaaacacat

SEQ ID NO: 4990584 - DNA, 19 bp, Homo sapiens
ggttgggagaatgtcagta

SEQ ID NO: 4990585 - DNA, 19 bp, Homo sapiens
gtaaccaatttctttctaa

SEQ ID NO: 4990586 - DNA, 23 bp, Homo sapiens
gtaatttaaaattgtgatgtgtc

SEQ ID NO: 4990587 - DNA, 15 bp, Homo sapiens
gtacaggacatatat

SEQ ID NO: 4990588 - DNA, 23 bp, Homo sapiens
gtacaggacatatattttttaaa

SEQ ID NO: 4990589 - DNA, 18 bp, Homo sapiens
gtagaagttctagtgttt

SEQ ID NO: 4990590 - DNA, 17 bp, Homo sapiens
gtagatgtatgcacaca

SEQ ID NO: 4990591 - DNA, 16 bp, Homo sapiens
gtaggaactgctgggc

SEQ ID NO: 4990592 - DNA, 14 bp, Homo sapiens
gtatagaaaatctt

SEQ ID NO: 4990593 - DNA, 23 bp, Homo sapiens
gtatatgtagatgtatgcacaca

SEQ ID NO: 4990594 - DNA, 13 bp, Homo sapiens
gtatgctggtagc

SEQ ID NO: 4990595 - DNA, 15 bp, Homo sapiens
gtatgtggaagtgtg

SEQ ID NO: 4990596 - DNA, 21 bp, Homo sapiens
gtatgtggaagtgtgggtctg

SEQ ID NO: 4990597 - DNA, 15 bp, Homo sapiens
gtatgtgtaataaat

SEQ ID NO: 4990598 - DNA, 13 bp, Homo sapiens
gtattttgaaatt

SEQ ID NO: 4990599 - DNA, 14 bp, Homo sapiens
gtcaagcatgtatt

SEQ ID NO: 4990600 - DNA, 13 bp, Homo sapiens
gtcagacacagat

SEQ ID NO: 4990601 - DNA, 13 bp, Homo sapiens
gtcagctaaagaa

SEQ ID NO: 4990602 - DNA, 22 bp, Homo sapiens
gtccaaggctggtcccacactt

SEQ ID NO: 4990603 - DNA, 19 bp, Homo sapiens
gtcccattcccccagtgcg

SEQ ID NO: 4990604 - DNA, 23 bp, Homo sapiens
gtcccattcccccagtgcggcca

SEQ ID NO: 4990605 - DNA, 16 bp, Homo sapiens
gtccctgaagagaagg

SEQ ID NO: 4990606 - DNA, 12 bp, Homo sapiens
gtctgcttagaa

SEQ ID NO: 4990607 - DNA, 13 bp, Homo sapiens
gtctgcttagaaa

SEQ ID NO: 4990608 - DNA, 14 bp, Homo sapiens
gtctgcttagaaat

SEQ ID NO: 4990609 - DNA, 16 bp, Homo sapiens
gtctgtgtgtgtgtat

SEQ ID NO: 4990610 - DNA, 19 bp, Homo sapiens
gtgacccaagaactcctga

SEQ ID NO: 4990611 - DNA, 20 bp, Homo sapiens
gtgagagagtggctggggca

SEQ ID NO: 4990612 - DNA, 15 bp, Homo sapiens
gtgaggatgtctggg

SEQ ID NO: 4990613 - DNA, 15 bp, Homo sapiens
gtgagtgtgactttt

SEQ ID NO: 4990614 - DNA, 19 bp, Homo sapiens
gtgatgtatgtgtaataaa

SEQ ID NO: 4990615 - DNA, 14 bp, Homo sapiens
gtgccacaaagctc

SEQ ID NO: 4990616 - DNA, 22 bp, Homo sapiens
gtgccttggggaaatgtggaga

SEQ ID NO: 4990617 - DNA, 23 bp, Homo sapiens
gtgctattgtagagccagaggtc

SEQ ID NO: 4990618 - DNA, 17 bp, Homo sapiens
gtgctgtcctctgaagg

SEQ ID NO: 4990619 - DNA, 19 bp, Homo sapiens
gtgctgtgtgacattggga

SEQ ID NO: 4990620 - DNA, 19 bp, Homo sapiens
gtggaagtgtgggtctgtg

SEQ ID NO: 4990621 - DNA, 13 bp, Homo sapiens
gtggggagggaga

SEQ ID NO: 4990622 - DNA, 19 bp, Homo sapiens
gtggggcttctcctgaaat

SEQ ID NO: 4990623 - DNA, 15 bp, Homo sapiens
gtgggggtctgtgtg

SEQ ID NO: 4990624 - DNA, 17 bp, Homo sapiens
gtggttataacttaatg

SEQ ID NO: 4990625 - DNA, 23 bp, Homo sapiens
gtgtaatttaaaattgtgatgtg

SEQ ID NO: 4990626 - DNA, 12 bp, Homo sapiens
gtgtgctgtcct

SEQ ID NO: 4990627 - DNA, 12 bp, Homo sapiens
gtgtgtatgtgg

SEQ ID NO: 4990628 - DNA, 14 bp, Homo sapiens
gtgtgtgtatgtgg

SEQ ID NO: 4990629 - DNA, 14 bp, Homo sapiens
gtgtgttgtgtgtg

SEQ ID NO: 4990630 - DNA, 15 bp, Homo sapiens
gtgtgtttatgtgtg

SEQ ID NO: 4990631 - DNA, 15 bp, Homo sapiens
gtgttgtgtgtggga

SEQ ID NO: 4990632 - DNA, 16 bp, Homo sapiens
gtgtttatgtgtgtgt

SEQ ID NO: 4990633 - DNA, 17 bp, Homo sapiens
gttataacttaatgaaa

SEQ ID NO: 4990634 - DNA, 10 bp, Homo sapiens
gttcattaaa

SEQ ID NO: 4990635 - DNA, 18 bp, Homo sapiens
gttgattgcgagaatttt

SEQ ID NO: 4990636 - DNA, 21 bp, Homo sapiens
gttgcaggtgccaatgactaa

SEQ ID NO: 4990637 - DNA, 21 bp, Homo sapiens
gttgtaatgcacacttatttt

SEQ ID NO: 4990638 - DNA, 16 bp, Homo sapiens
gtttatgagaaactgg

SEQ ID NO: 4990639 - DNA, 18 bp, Homo sapiens
gtttgactagccatctca

SEQ ID NO: 4990640 - DNA, 16 bp, Homo sapiens
gttttcttaacttaaa

SEQ ID NO: 4990641 - DNA, 20 bp, Homo sapiens
taaaaatgcaaaaaaaatta

SEQ ID NO: 4990642 - DNA, 16 bp, Homo sapiens
taaaactcatttagga

SEQ ID NO: 4990643 - DNA, 14 bp, Homo sapiens
taaaagattttcct

SEQ ID NO: 4990644 - DNA, 14 bp, Homo sapiens
taaaagcatttttt

SEQ ID NO: 4990645 - DNA, 15 bp, Homo sapiens
taaaatatagaaaac

SEQ ID NO: 4990646 - DNA, 15 bp, Homo sapiens
taaaattgtgatgtg

SEQ ID NO: 4990647 - DNA, 17 bp, Homo sapiens
taaacaaaatagaaagt

SEQ ID NO: 4990648 - DNA, 22 bp, Homo sapiens
taaactgtagctgtattagcag

SEQ ID NO: 4990649 - DNA, 18 bp, Homo sapiens
taaagaagtttgaacatt

SEQ ID NO: 4990650 - DNA, 21 bp, Homo sapiens
taaagcaaagcgctaagtaaa

SEQ ID NO: 4990651 - DNA, 16 bp, Homo sapiens
taaagcattttgcaaa

SEQ ID NO: 4990652 - DNA, 23 bp, Homo sapiens
taaataaccaattcctcatttgt

SEQ ID NO: 4990653 - DNA, 12 bp, Homo sapiens
taaattacatta

SEQ ID NO: 4990654 - DNA, 14 bp, Homo sapiens
taacagaagaaaat

SEQ ID NO: 4990655 - DNA, 15 bp, Homo sapiens
taacagaagaaaata

SEQ ID NO: 4990656 - DNA, 17 bp, Homo sapiens
taaccaattcctcattt

SEQ ID NO: 4990657 - DNA, 19 bp, Homo sapiens
taaccaattcctcatttgt

SEQ ID NO: 4990658 - DNA, 16 bp, Homo sapiens
taacttaatgaaaaca

SEQ ID NO: 4990659 - DNA, 18 bp, Homo sapiens
taacttaatgaaaacaat

SEQ ID NO: 4990660 - DNA, 13 bp, Homo sapiens
taagacagagacc

SEQ ID NO: 4990661 - DNA, 16 bp, Homo sapiens
taagacttaatgagac

SEQ ID NO: 4990662 - DNA, 18 bp, Homo sapiens
taagccaaaactgagcat

SEQ ID NO: 4990663 - DNA, 18 bp, Homo sapiens
taagtaaaaatattaact

SEQ ID NO: 4990664 - DNA, 17 bp, Homo sapiens
taagtatcaagtataga

SEQ ID NO: 4990665 - DNA, 19 bp, Homo sapiens
taagtatcaagtatagaaa

SEQ ID NO: 4990666 - DNA, 14 bp, Homo sapiens
taagtctgatttaa

SEQ ID NO: 4990667 - DNA, 14 bp, Homo sapiens
taagtgtattttga

SEQ ID NO: 4990668 - DNA, 20 bp, Homo sapiens
taagttattaagaggtaaga

SEQ ID NO: 4990669 - DNA, 16 bp, Homo sapiens
taataagtgctacttt

SEQ ID NO: 4990670 - DNA, 15 bp, Homo sapiens
taataatgactctaa

SEQ ID NO: 4990671 - DNA, 14 bp, Homo sapiens
taatagagacacag

SEQ ID NO: 4990672 - DNA, 16 bp, Homo sapiens
taatgaaaacaatgca

SEQ ID NO: 4990673 - DNA, 16 bp, Homo sapiens
taatgaccatgaaaga

SEQ ID NO: 4990674 - DNA, 18 bp, Homo sapiens
taatgaccatgaaagact

SEQ ID NO: 4990675 - DNA, 19 bp, Homo sapiens
taatgagactttaaaagca

SEQ ID NO: 4990676 - DNA, 19 bp, Homo sapiens
taattctttgacctgttgg

SEQ ID NO: 4990677 - DNA, 17 bp, Homo sapiens
taattgggcactattta

SEQ ID NO: 4990678 - DNA, 14 bp, Homo sapiens
tacactcaagtgcc

SEQ ID NO: 4990679 - DNA, 14 bp, Homo sapiens
tacagaggacagta

SEQ ID NO: 4990680 - DNA, 18 bp, Homo sapiens
tacattaaagatttctgc

SEQ ID NO: 4990681 - DNA, 16 bp, Homo sapiens
tacattatattcctct

SEQ ID NO: 4990682 - DNA, 22 bp, Homo sapiens
tacattatattcctctaaaact

SEQ ID NO: 4990683 - DNA, 22 bp, Homo sapiens
tacattatgttattggaatttt

SEQ ID NO: 4990684 - DNA, 18 bp, Homo sapiens
tacattttacacactgta

SEQ ID NO: 4990685 - DNA, 17 bp, Homo sapiens
taccacttttgcaaata

SEQ ID NO: 4990686 - DNA, 21 bp, Homo sapiens
tactatttcttgtggttataa

SEQ ID NO: 4990687 - DNA, 16 bp, Homo sapiens
tagaaaagatgagagg

SEQ ID NO: 4990688 - DNA, 18 bp, Homo sapiens
tagaaaagatgagaggca

SEQ ID NO: 4990689 - DNA, 16 bp, Homo sapiens
tagaaataacagaaga

SEQ ID NO: 4990690 - DNA, 19 bp, Homo sapiens
tagaattgacattgaaatc

SEQ ID NO: 4990691 - DNA, 21 bp, Homo sapiens
tagacatttgctatgagctgg

SEQ ID NO: 4990692 - DNA, 15 bp, Homo sapiens
tagagacacagagat

SEQ ID NO: 4990693 - DNA, 22 bp, Homo sapiens
tagatgtatgcacacacatata

SEQ ID NO: 4990694 - DNA, 14 bp, Homo sapiens
tagcagcaaaacaa

SEQ ID NO: 4990695 - DNA, 15 bp, Homo sapiens
tagcattttaaacaa

SEQ ID NO: 4990696 - DNA, 18 bp, Homo sapiens
tagcattttaaacaaaat

SEQ ID NO: 4990697 - DNA, 14 bp, Homo sapiens
tagccctgaacatt

SEQ ID NO: 4990698 - DNA, 22 bp, Homo sapiens
tagccgggcgtggtggcaggca

SEQ ID NO: 4990699 - DNA, 15 bp, Homo sapiens
taggaactgctgggc

SEQ ID NO: 4990700 - DNA, 18 bp, Homo sapiens
taggaactgctgggcttg

SEQ ID NO: 4990701 - DNA, 17 bp, Homo sapiens
taggcactttaaaacac

SEQ ID NO: 4990702 - DNA, 15 bp, Homo sapiens
tagtgatttacacag

SEQ ID NO: 4990703 - DNA, 23 bp, Homo sapiens
tagtggcaaagagaggtccagag

SEQ ID NO: 4990704 - DNA, 22 bp, Homo sapiens
tagttgattgcgagaattttca

SEQ ID NO: 4990705 - DNA, 18 bp, Homo sapiens
tataacttaatgaaaaca

SEQ ID NO: 4990706 - DNA, 23 bp, Homo sapiens
tatagaataggcactttaaaaca

SEQ ID NO: 4990707 - DNA, 19 bp, Homo sapiens
tatagctaggtgacatata

SEQ ID NO: 4990708 - DNA, 15 bp, Homo sapiens
tatcaagtatagaaa

SEQ ID NO: 4990709 - DNA, 15 bp, Homo sapiens
tatcagcagcaacaa

SEQ ID NO: 4990710 - DNA, 19 bp, Homo sapiens
tatcttaaaatatagaaaa

SEQ ID NO: 4990711 - DNA, 16 bp, Homo sapiens
tatgtaggatctgtca

SEQ ID NO: 4990712 - DNA, 16 bp, Homo sapiens
tatgtgacaacatttt

SEQ ID NO: 4990713 - DNA, 18 bp, Homo sapiens
tatgtgggggtctgtgtg

SEQ ID NO: 4990714 - DNA, 19 bp, Homo sapiens
tatgtgggggtctgtgtgt

SEQ ID NO: 4990715 - DNA, 16 bp, Homo sapiens
tatgtgtaataaatat

SEQ ID NO: 4990716 - DNA, 22 bp, Homo sapiens
tatgtgtgtgtgttgtgtgtgg

SEQ ID NO: 4990717 - DNA, 23 bp, Homo sapiens
tatgtgtgtgtgttgtgtgtggg

SEQ ID NO: 4990718 - DNA, 17 bp, Homo sapiens
tatgttggcattaacaa

SEQ ID NO: 4990719 - DNA, 17 bp, Homo sapiens
tattaaatgtaagtcgt

SEQ ID NO: 4990720 - DNA, 16 bp, Homo sapiens
tattagcagcaaaaca

SEQ ID NO: 4990721 - DNA, 21 bp, Homo sapiens
tattatttgcagtgcagtata

SEQ ID NO: 4990722 - DNA, 23 bp, Homo sapiens
tattcatcaatgaagattaacac

SEQ ID NO: 4990723 - DNA, 14 bp, Homo sapiens
tattggaattttct

SEQ ID NO: 4990724 - DNA, 14 bp, Homo sapiens
tatttacaaatgtt

SEQ ID NO: 4990725 - DNA, 21 bp, Homo sapiens
tatttatgtaggatctgtcaa

SEQ ID NO: 4990726 - DNA, 14 bp, Homo sapiens
tatttatttatgta

SEQ ID NO: 4990727 - DNA, 22 bp, Homo sapiens
tatttgaggagataacatttca

SEQ ID NO: 4990728 - DNA, 22 bp, Homo sapiens
tatttgtaaatttatgtgatgg

SEQ ID NO: 4990729 - DNA, 20 bp, Homo sapiens
tattttttacattttacaca

SEQ ID NO: 4990730 - DNA, 22 bp, Homo sapiens
tcaaatcaggttttcttttaag

SEQ ID NO: 4990731 - DNA, 16 bp, Homo sapiens
tcaacagtgagagact

SEQ ID NO: 4990732 - DNA, 22 bp, Homo sapiens
tcaagcagacgtgagtgtgact

SEQ ID NO: 4990733 - DNA, 15 bp, Homo sapiens
tcaagtgccattcat

SEQ ID NO: 4990734 - DNA, 21 bp, Homo sapiens
tcaataggagggatgttccag

SEQ ID NO: 4990735 - DNA, 12 bp, Homo sapiens
tcaatcttgccg

SEQ ID NO: 4990736 - DNA, 16 bp, Homo sapiens
tcaatgatcatctcac

SEQ ID NO: 4990737 - DNA, 21 bp, Homo sapiens
tcaattaccagaaagataaca

SEQ ID NO: 4990738 - DNA, 13 bp, Homo sapiens
tcactattcatca

SEQ ID NO: 4990739 - DNA, 15 bp, Homo sapiens
tcagctaaagaagtt

SEQ ID NO: 4990740 - DNA, 18 bp, Homo sapiens
tcagctaaagaagtttga

SEQ ID NO: 4990741 - DNA, 16 bp, Homo sapiens
tcagtatgtggaagtg

SEQ ID NO: 4990742 - DNA, 13 bp, Homo sapiens
tcagttcatcctg

SEQ ID NO: 4990743 - DNA, 21 bp, Homo sapiens
tcagtttccctctgtatacaa

SEQ ID NO: 4990744 - DNA, 13 bp, Homo sapiens
tcatatagaaagg

SEQ ID NO: 4990745 - DNA, 15 bp, Homo sapiens
tcatctttccctcct

SEQ ID NO: 4990746 - DNA, 18 bp, Homo sapiens
tcattcgtggttgatttc

SEQ ID NO: 4990747 - DNA, 16 bp, Homo sapiens
tcatttgttcattaaa

SEQ ID NO: 4990748 - DNA, 22 bp, Homo sapiens
tccaaaaagatttattaattaa

SEQ ID NO: 4990749 - DNA, 15 bp, Homo sapiens
tccaaggctggtccc

SEQ ID NO: 4990750 - DNA, 21 bp, Homo sapiens
tccaaggctggtcccacactt

SEQ ID NO: 4990751 - DNA, 14 bp, Homo sapiens
tccacagagtataa

SEQ ID NO: 4990752 - DNA, 16 bp, Homo sapiens
tccagagtcctggccc

SEQ ID NO: 4990753 - DNA, 17 bp, Homo sapiens
tccatttacttaagact

SEQ ID NO: 4990754 - DNA, 22 bp, Homo sapiens
tccatttacttaagacttaatg

SEQ ID NO: 4990755 - DNA, 22 bp, Homo sapiens
tcccagctactcgggaggctga

SEQ ID NO: 4990756 - DNA, 13 bp, Homo sapiens
tcccattccccca

SEQ ID NO: 4990757 - DNA, 15 bp, Homo sapiens
tccctctctggacct

SEQ ID NO: 4990758 - DNA, 13 bp, Homo sapiens
tcctaaaacaaca

SEQ ID NO: 4990759 - DNA, 17 bp, Homo sapiens
tcctaaaattatggaaa

SEQ ID NO: 4990760 - DNA, 21 bp, Homo sapiens
tcctaagtatcaagtatagaa

SEQ ID NO: 4990761 - DNA, 20 bp, Homo sapiens
tcctaggaggtaatgaccat

SEQ ID NO: 4990762 - DNA, 13 bp, Homo sapiens
tcctgagagctgc

SEQ ID NO: 4990763 - DNA, 23 bp, Homo sapiens
tcgctgggtgccgggctgcacag

SEQ ID NO: 4990764 - DNA, 12 bp, Homo sapiens
tctaaagaaaca

SEQ ID NO: 4990765 - DNA, 17 bp, Homo sapiens
tctaaagaaacagaaga

SEQ ID NO: 4990766 - DNA, 19 bp, Homo sapiens
tctatgttggcattaacaa

SEQ ID NO: 4990767 - DNA, 15 bp, Homo sapiens
tctcaagcaagtttc

SEQ ID NO: 4990768 - DNA, 21 bp, Homo sapiens
tctcctgaaatctacaggcct

SEQ ID NO: 4990769 - DNA, 18 bp, Homo sapiens
tctctacccatcttaaaa

SEQ ID NO: 4990770 - DNA, 19 bp, Homo sapiens
tctctacccatcttaaaaa

SEQ ID NO: 4990771 - DNA, 20 bp, Homo sapiens
tctctacccatcttaaaaac

SEQ ID NO: 4990772 - DNA, 23 bp, Homo sapiens
tctctacccatcttaaaaacaac

SEQ ID NO: 4990773 - DNA, 14 bp, Homo sapiens
tctctactaaaaat

SEQ ID NO: 4990774 - DNA, 16 bp, Homo sapiens
tctctggacctcagtt

SEQ ID NO: 4990775 - DNA, 14 bp, Homo sapiens
tctgcttagaaata

SEQ ID NO: 4990776 - DNA, 17 bp, Homo sapiens
tctgcttccgtatttta

SEQ ID NO: 4990777 - DNA, 14 bp, Homo sapiens
tctggacctcagtt

SEQ ID NO: 4990778 - DNA, 13 bp, Homo sapiens
tctgtatacaagg

SEQ ID NO: 4990779 - DNA, 15 bp, Homo sapiens
tctgtgtgtgtgtat

SEQ ID NO: 4990780 - DNA, 22 bp, Homo sapiens
tctgtgtgtgtgtatgtggggg

SEQ ID NO: 4990781 - DNA, 20 bp, Homo sapiens
tctgtgtgtttatgtgtgtg

SEQ ID NO: 4990782 - DNA, 19 bp, Homo sapiens
tcttaaaatatagaaaact

SEQ ID NO: 4990783 - DNA, 22 bp, Homo sapiens
tcttcatggaattcacaaagta

SEQ ID NO: 4990784 - DNA, 13 bp, Homo sapiens
tcttcatttctct

SEQ ID NO: 4990785 - DNA, 19 bp, Homo sapiens
tcttgtggttataacttaa

SEQ ID NO: 4990786 - DNA, 19 bp, Homo sapiens
tctttcatacattatattc

SEQ ID NO: 4990787 - DNA, 14 bp, Homo sapiens
tctttccctccttg

SEQ ID NO: 4990788 - DNA, 20 bp, Homo sapiens
tctttcctaaatataaatga

SEQ ID NO: 4990789 - DNA, 21 bp, Homo sapiens
tctttgattttcgacgtttga

SEQ ID NO: 4990790 - DNA, 12 bp, Homo sapiens
tcttttaagaat

SEQ ID NO: 4990791 - DNA, 14 bp, Homo sapiens
tcttttaagaatca

SEQ ID NO: 4990792 - DNA, 19 bp, Homo sapiens
tgaaaagcctctgttttga

SEQ ID NO: 4990793 - DNA, 20 bp, Homo sapiens
tgaaaagcctctgttttgat

SEQ ID NO: 4990794 - DNA, 17 bp, Homo sapiens
tgaaaataatctctgat

SEQ ID NO: 4990795 - DNA, 18 bp, Homo sapiens
tgaaatgtcagttctgat

SEQ ID NO: 4990796 - DNA, 17 bp, Homo sapiens
tgaacatttcatggtgt

SEQ ID NO: 4990797 - DNA, 22 bp, Homo sapiens
tgaacatttgggttactatttc

SEQ ID NO: 4990798 - DNA, 23 bp, Homo sapiens
tgaacatttgggttactatttct

SEQ ID NO: 4990799 - DNA, 16 bp, Homo sapiens
tgaatgtcacttctgg

SEQ ID NO: 4990800 - DNA, 16 bp, Homo sapiens
tgaattcctaaaatta

SEQ ID NO: 4990801 - DNA, 17 bp, Homo sapiens
tgaattcctaaaattat

SEQ ID NO: 4990802 - DNA, 19 bp, Homo sapiens
tgacaacatttttgtacat

SEQ ID NO: 4990803 - DNA, 17 bp, Homo sapiens
tgacatacatccaacat

SEQ ID NO: 4990804 - DNA, 20 bp, Homo sapiens
tgacattgaaatctaggaaa

SEQ ID NO: 4990805 - DNA, 19 bp, Homo sapiens
tgacccacaaagtttcaga

SEQ ID NO: 4990806 - DNA, 22 bp, Homo sapiens
tgactccatgtgtgctgtcctc

SEQ ID NO: 4990807 - DNA, 23 bp, Homo sapiens
tgagactggggccactacatttg

SEQ ID NO: 4990808 - DNA, 20 bp, Homo sapiens
tgagactttaaaagcatttt

SEQ ID NO: 4990809 - DNA, 22 bp, Homo sapiens
tgagagagtggctggggcatgg

SEQ ID NO: 4990810 - DNA, 16 bp, Homo sapiens
tgagaggcagaggcag

SEQ ID NO: 4990811 - DNA, 17 bp, Homo sapiens
tgagatccagagaggct

SEQ ID NO: 4990812 - DNA, 18 bp, Homo sapiens
tgagatccagagaggctg

SEQ ID NO: 4990813 - DNA, 14 bp, Homo sapiens
tgagcctcacagca

SEQ ID NO: 4990814 - DNA, 21 bp, Homo sapiens
tgaggacatggagagagactc

SEQ ID NO: 4990815 - DNA, 15 bp, Homo sapiens
tgagggccaccagga

SEQ ID NO: 4990816 - DNA, 17 bp, Homo sapiens
tgagtgtgactttttga

SEQ ID NO: 4990817 - DNA, 14 bp, Homo sapiens
tgagttggctggga

SEQ ID NO: 4990818 - DNA, 14 bp, Homo sapiens
tgattccagcaaga

SEQ ID NO: 4990819 - DNA, 15 bp, Homo sapiens
tgatttaatatgcaa

SEQ ID NO: 4990820 - DNA, 17 bp, Homo sapiens
tgatttaatatgcaaag

SEQ ID NO: 4990821 - DNA, 12 bp, Homo sapiens
tgatttacacag

SEQ ID NO: 4990822 - DNA, 15 bp, Homo sapiens
tgcaaataagtgtat

SEQ ID NO: 4990823 - DNA, 20 bp, Homo sapiens
tgcacacacacggatgcaca

SEQ ID NO: 4990824 - DNA, 18 bp, Homo sapiens
tgcacacacagatgcaca

SEQ ID NO: 4990825 - DNA, 19 bp, Homo sapiens
tgcacacacagatgcacac

SEQ ID NO: 4990826 - DNA, 13 bp, Homo sapiens
tgcacacacatat

SEQ ID NO: 4990827 - DNA, 18 bp, Homo sapiens
tgcacacacatatattat

SEQ ID NO: 4990828 - DNA, 15 bp, Homo sapiens
tgcacacggatgcac

SEQ ID NO: 4990829 - DNA, 14 bp, Homo sapiens
tgcagtatagaata

SEQ ID NO: 4990830 - DNA, 21 bp, Homo sapiens
tgcattatatttgtaaattta

SEQ ID NO: 4990831 - DNA, 16 bp, Homo sapiens
tgccttggtgtgctgt

SEQ ID NO: 4990832 - DNA, 19 bp, Homo sapiens
tgccttgtgaaggaattat

SEQ ID NO: 4990833 - DNA, 22 bp, Homo sapiens
tgctattgtagagccagaggtc

SEQ ID NO: 4990834 - DNA, 17 bp, Homo sapiens
tgctcaagttcaccagc

SEQ ID NO: 4990835 - DNA, 18 bp, Homo sapiens
tgctcaagttcaccagca

SEQ ID NO: 4990836 - DNA, 18 bp, Homo sapiens
tgctgagcctcacagcag

SEQ ID NO: 4990837 - DNA, 15 bp, Homo sapiens
tgctgtagacatttg

SEQ ID NO: 4990838 - DNA, 19 bp, Homo sapiens
tgctgtgacccaagaactc

SEQ ID NO: 4990839 - DNA, 18 bp, Homo sapiens
tggaaattaaaactcatt

SEQ ID NO: 4990840 - DNA, 13 bp, Homo sapiens
tggaagtgtgggt

SEQ ID NO: 4990841 - DNA, 21 bp, Homo sapiens
tggaagtgtgggtctgtgtgt

SEQ ID NO: 4990842 - DNA, 19 bp, Homo sapiens
tggaatgggagtctgaaat

SEQ ID NO: 4990843 - DNA, 21 bp, Homo sapiens
tggaatgggagtctgaaatgg

SEQ ID NO: 4990844 - DNA, 14 bp, Homo sapiens
tggaattcacaaag

SEQ ID NO: 4990845 - DNA, 11 bp, Homo sapiens
tggaattttct

SEQ ID NO: 4990846 - DNA, 12 bp, Homo sapiens
tggaattttctt

SEQ ID NO: 4990847 - DNA, 20 bp, Homo sapiens
tggaattttctttcatacat

SEQ ID NO: 4990848 - DNA, 22 bp, Homo sapiens
tggacctttcctgaggaagagg

SEQ ID NO: 4990849 - DNA, 11 bp, Homo sapiens
tggacttctgg

SEQ ID NO: 4990850 - DNA, 14 bp, Homo sapiens
tggaggcagacagc

SEQ ID NO: 4990851 - DNA, 23 bp, Homo sapiens
tggatatagctaggtgacatata

SEQ ID NO: 4990852 - DNA, 15 bp, Homo sapiens
tggatctgtgagggg

SEQ ID NO: 4990853 - DNA, 19 bp, Homo sapiens
tggatctgtgaggggctct

SEQ ID NO: 4990854 - DNA, 15 bp, Homo sapiens
tggatgacttgctca

SEQ ID NO: 4990855 - DNA, 15 bp, Homo sapiens
tggcaaagagaggtc

SEQ ID NO: 4990856 - DNA, 18 bp, Homo sapiens
tggcattaacaataaagc

SEQ ID NO: 4990857 - DNA, 14 bp, Homo sapiens
tggcgtgaacccag

SEQ ID NO: 4990858 - DNA, 20 bp, Homo sapiens
tggctggggcatggaaggca

SEQ ID NO: 4990859 - DNA, 14 bp, Homo sapiens
tggctgtgaactga

SEQ ID NO: 4990860 - DNA, 16 bp, Homo sapiens
tgggagggagggagag

SEQ ID NO: 4990861 - DNA, 15 bp, Homo sapiens
tgggagtctgaaatg

SEQ ID NO: 4990862 - DNA, 14 bp, Homo sapiens
tgggcaacagagca

SEQ ID NO: 4990863 - DNA, 19 bp, Homo sapiens
tggggagggagacagagac

SEQ ID NO: 4990864 - DNA, 16 bp, Homo sapiens
tggggatagatgtgtg

SEQ ID NO: 4990865 - DNA, 18 bp, Homo sapiens
tggggctactgtttcagt

SEQ ID NO: 4990866 - DNA, 15 bp, Homo sapiens
tgggggtctgtgtgt

SEQ ID NO: 4990867 - DNA, 15 bp, Homo sapiens
tggggtaggttggga

SEQ ID NO: 4990868 - DNA, 21 bp, Homo sapiens
tggggtaggttgggagaatgt

SEQ ID NO: 4990869 - DNA, 12 bp, Homo sapiens
tgggtctgtgtg

SEQ ID NO: 4990870 - DNA, 13 bp, Homo sapiens
tgggtctgtgtgt

SEQ ID NO: 4990871 - DNA, 15 bp, Homo sapiens
tgggtctgtgtgtgt

SEQ ID NO: 4990872 - DNA, 17 bp, Homo sapiens
tggttataacttaatga

SEQ ID NO: 4990873 - DNA, 12 bp, Homo sapiens
tggttgatttca

SEQ ID NO: 4990874 - DNA, 13 bp, Homo sapiens
tgtaaacacatct

SEQ ID NO: 4990875 - DNA, 17 bp, Homo sapiens
tgtaatttaaaattgtg

SEQ ID NO: 4990876 - DNA, 20 bp, Homo sapiens
tgtaatttaaaattgtgatg

SEQ ID NO: 4990877 - DNA, 21 bp, Homo sapiens
tgtaatttaaaattgtgatgt

SEQ ID NO: 4990878 - DNA, 12 bp, Homo sapiens
tgtacattatgt

SEQ ID NO: 4990879 - DNA, 15 bp, Homo sapiens
tgtatacaaggatca

SEQ ID NO: 4990880 - DNA, 21 bp, Homo sapiens
tgtatatgtagatgtatgcac

SEQ ID NO: 4990881 - DNA, 22 bp, Homo sapiens
tgtatccatccatggggctgat

SEQ ID NO: 4990882 - DNA, 16 bp, Homo sapiens
tgtatgcacacacata

SEQ ID NO: 4990883 - DNA, 19 bp, Homo sapiens
tgtatgcacacacatatat

SEQ ID NO: 4990884 - DNA, 16 bp, Homo sapiens
tgtatgtgtaataaat

SEQ ID NO: 4990885 - DNA, 13 bp, Homo sapiens
tgtattttgaaat

SEQ ID NO: 4990886 - DNA, 12 bp, Homo sapiens
tgtcagacacag

SEQ ID NO: 4990887 - DNA, 13 bp, Homo sapiens
tgtcagacacaga

SEQ ID NO: 4990888 - DNA, 20 bp, Homo sapiens
tgtcagctaaagaagtttga

SEQ ID NO: 4990889 - DNA, 19 bp, Homo sapiens
tgtcattcgtggttgattt

SEQ ID NO: 4990890 - DNA, 23 bp, Homo sapiens
tgtgacaacatttttgtacatta

SEQ ID NO: 4990891 - DNA, 13 bp, Homo sapiens
tgtgacatgctaa

SEQ ID NO: 4990892 - DNA, 17 bp, Homo sapiens
tgtgccttggtgtgctg

SEQ ID NO: 4990893 - DNA, 15 bp, Homo sapiens
tgtgggagtgtgtaa

SEQ ID NO: 4990894 - DNA, 20 bp, Homo sapiens
tgtgggtctgtgtgtgtgta

SEQ ID NO: 4990895 - DNA, 20 bp, Homo sapiens
tgtggttataacttaatgaa

SEQ ID NO: 4990896 - DNA, 23 bp, Homo sapiens
tgtgtaatttaaaattgtgatgt

SEQ ID NO: 4990897 - DNA, 14 bp, Homo sapiens
tgtgtatgtggggg

SEQ ID NO: 4990898 - DNA, 23 bp, Homo sapiens
tgtgtatgtgggggtctgtgtgt

SEQ ID NO: 4990899 - DNA, 12 bp, Homo sapiens
tgtgtgtgggag

SEQ ID NO: 4990900 - DNA, 14 bp, Homo sapiens
tgtgttgtgtgtgg

SEQ ID NO: 4990901 - DNA, 13 bp, Homo sapiens
tgtgtttatgtgt

SEQ ID NO: 4990902 - DNA, 16 bp, Homo sapiens
tgttattggaattttc

SEQ ID NO: 4990903 - DNA, 17 bp, Homo sapiens
tgttattggaattttct

SEQ ID NO: 4990904 - DNA, 18 bp, Homo sapiens
tgttgggagtgaggatgt

SEQ ID NO: 4990905 - DNA, 19 bp, Homo sapiens
tgtttagaagaagtgtgtc

SEQ ID NO: 4990906 - DNA, 15 bp, Homo sapiens
tgtttatgagaaact

SEQ ID NO: 4990907 - DNA, 16 bp, Homo sapiens
tgtttatgtgtgtgtg

SEQ ID NO: 4990908 - DNA, 18 bp, Homo sapiens
tgttttcaattttaaaca

SEQ ID NO: 4990909 - DNA, 18 bp, Homo sapiens
tgttttcttcatttctct

SEQ ID NO: 4990910 - DNA, 20 bp, Homo sapiens
ttaaaaagaaaagtttataa

SEQ ID NO: 4990911 - DNA, 22 bp, Homo sapiens
ttaaaccagactctgttgcaat

SEQ ID NO: 4990912 - DNA, 22 bp, Homo sapiens
ttaaagcaaagcgctaagtaaa

SEQ ID NO: 4990913 - DNA, 15 bp, Homo sapiens
ttaactgacgaagaa

SEQ ID NO: 4990914 - DNA, 16 bp, Homo sapiens
ttaagacttaatgaga

SEQ ID NO: 4990915 - DNA, 23 bp, Homo sapiens
ttaataaacgtccacagagtata

SEQ ID NO: 4990916 - DNA, 21 bp, Homo sapiens
ttaatgagactttaaaagcat

SEQ ID NO: 4990917 - DNA, 18 bp, Homo sapiens
ttaattgggcactattta

SEQ ID NO: 4990918 - DNA, 23 bp, Homo sapiens
ttacgaaaaaatggtagcatttt

SEQ ID NO: 4990919 - DNA, 18 bp, Homo sapiens
ttactctatgatgattgc

SEQ ID NO: 4990920 - DNA, 16 bp, Homo sapiens
ttagccctgaacattt

SEQ ID NO: 4990921 - DNA, 15 bp, Homo sapiens
ttataacttaatgaa

SEQ ID NO: 4990922 - DNA, 21 bp, Homo sapiens
ttataacttaatgaaaacaat

SEQ ID NO: 4990923 - DNA, 13 bp, Homo sapiens
ttataatctgatg

SEQ ID NO: 4990924 - DNA, 22 bp, Homo sapiens
ttataatctgatgggcctggct

SEQ ID NO: 4990925 - DNA, 12 bp, Homo sapiens
ttatgtgtgtgt

SEQ ID NO: 4990926 - DNA, 22 bp, Homo sapiens
ttattccaagggaatattgcca

SEQ ID NO: 4990927 - DNA, 14 bp, Homo sapiens
ttcagaagcatcac

SEQ ID NO: 4990928 - DNA, 16 bp, Homo sapiens
ttcattgctggagaca

SEQ ID NO: 4990929 - DNA, 22 bp, Homo sapiens
ttccacccacacgactgcaaca

SEQ ID NO: 4990930 - DNA, 20 bp, Homo sapiens
ttccagtggatgagggccac

SEQ ID NO: 4990931 - DNA, 19 bp, Homo sapiens
ttccatttacttaagactt

SEQ ID NO: 4990932 - DNA, 13 bp, Homo sapiens
ttcctaaaattat

SEQ ID NO: 4990933 - DNA, 18 bp, Homo sapiens
ttcctaaatataaatgaa

SEQ ID NO: 4990934 - DNA, 13 bp, Homo sapiens
ttcctcatttgtt

SEQ ID NO: 4990935 - DNA, 20 bp, Homo sapiens
ttcctcatttgttcattaaa

SEQ ID NO: 4990936 - DNA, 21 bp, Homo sapiens
ttctataatttccatttactt

SEQ ID NO: 4990937 - DNA, 13 bp, Homo sapiens
ttctcctgaaatc

SEQ ID NO: 4990938 - DNA, 21 bp, Homo sapiens
ttctcctgaaatctacaggcc

SEQ ID NO: 4990939 - DNA, 20 bp, Homo sapiens
ttctgaaatgtcagttctga

SEQ ID NO: 4990940 - DNA, 15 bp, Homo sapiens
ttctgtatgtgacaa

SEQ ID NO: 4990941 - DNA, 20 bp, Homo sapiens
ttctgtatgtgacaacattt

SEQ ID NO: 4990942 - DNA, 17 bp, Homo sapiens
ttctttcatacattata

SEQ ID NO: 4990943 - DNA, 11 bp, Homo sapiens
ttctttcctaa

SEQ ID NO: 4990944 - DNA, 13 bp, Homo sapiens
ttctttgattttc

SEQ ID NO: 4990945 - DNA, 14 bp, Homo sapiens
ttcttttaagaatc

SEQ ID NO: 4990946 - DNA, 14 bp, Homo sapiens
ttgacattgaaatc

SEQ ID NO: 4990947 - DNA, 21 bp, Homo sapiens
ttgactagccatctcaagcaa

SEQ ID NO: 4990948 - DNA, 20 bp, Homo sapiens
ttgattcacctcctaaaaca

SEQ ID NO: 4990949 - DNA, 15 bp, Homo sapiens
ttgattgcgagaatt

SEQ ID NO: 4990950 - DNA, 23 bp, Homo sapiens
ttgccgtcactattcatcaatga

SEQ ID NO: 4990951 - DNA, 12 bp, Homo sapiens
ttgctcttctgt

SEQ ID NO: 4990952 - DNA, 21 bp, Homo sapiens
ttggaatgggagtctgaaatg

SEQ ID NO: 4990953 - DNA, 23 bp, Homo sapiens
ttggaattttctttcatacatta

SEQ ID NO: 4990954 - DNA, 18 bp, Homo sapiens
ttggatcctactcaacaa

SEQ ID NO: 4990955 - DNA, 22 bp, Homo sapiens
ttggccagaaaccttcctgctg

SEQ ID NO: 4990956 - DNA, 18 bp, Homo sapiens
ttgtaaaagtctagttac

SEQ ID NO: 4990957 - DNA, 15 bp, Homo sapiens
ttgtacattatgtta

SEQ ID NO: 4990958 - DNA, 18 bp, Homo sapiens
ttgtccctgaagagaagg

SEQ ID NO: 4990959 - DNA, 12 bp, Homo sapiens
ttgtgatgtgtc

SEQ ID NO: 4990960 - DNA, 16 bp, Homo sapiens
ttgtggatatagttat

SEQ ID NO: 4990961 - DNA, 14 bp, Homo sapiens
tttaaaagcatttt

SEQ ID NO: 4990962 - DNA, 15 bp, Homo sapiens
tttaaaagcattttt

SEQ ID NO: 4990963 - DNA, 16 bp, Homo sapiens
tttaaaattgtgatgt

SEQ ID NO: 4990964 - DNA, 12 bp, Homo sapiens
tttaaacatatc

SEQ ID NO: 4990965 - DNA, 17 bp, Homo sapiens
tttactgattccagcaa

SEQ ID NO: 4990966 - DNA, 13 bp, Homo sapiens
tttagttgactaa

SEQ ID NO: 4990967 - DNA, 13 bp, Homo sapiens
tttatcattctgc

SEQ ID NO: 4990968 - DNA, 22 bp, Homo sapiens
tttatgagaaactggcaaagca

SEQ ID NO: 4990969 - DNA, 16 bp, Homo sapiens
tttattgatttcaagt

SEQ ID NO: 4990970 - DNA, 12 bp, Homo sapiens
tttatttaaaag

SEQ ID NO: 4990971 - DNA, 16 bp, Homo sapiens
tttatttacaaatgtt

SEQ ID NO: 4990972 - DNA, 16 bp, Homo sapiens
tttcaataaatttctg

SEQ ID NO: 4990973 - DNA, 18 bp, Homo sapiens
tttcaattttaaacatat

SEQ ID NO: 4990974 - DNA, 12 bp, Homo sapiens
tttcatacatta

SEQ ID NO: 4990975 - DNA, 15 bp, Homo sapiens
tttcatacattatat

SEQ ID NO: 4990976 - DNA, 21 bp, Homo sapiens
tttcatacattatattcctct

SEQ ID NO: 4990977 - DNA, 14 bp, Homo sapiens
tttctttcatacat

SEQ ID NO: 4990978 - DNA, 18 bp, Homo sapiens
tttgtacattatgttatt

SEQ ID NO: 4990979 - DNA, 11 bp, Homo sapiens
tttgtggggag

SEQ ID NO: 4990980 - DNA, 13 bp, Homo sapiens
tttgttttcttca

SEQ ID NO: 4990981 - DNA, 15 bp, Homo sapiens
ttttaaaataagtct

SEQ ID NO: 4990982 - DNA, 22 bp, Homo sapiens
ttttaaaataagtctgatttaa

SEQ ID NO: 4990983 - DNA, 21 bp, Homo sapiens
ttttatttttctcatgatgag

SEQ ID NO: 4990984 - DNA, 12 bp, Homo sapiens
ttttcaataaat

SEQ ID NO: 4990985 - DNA, 20 bp, Homo sapiens
ttttcaataaatttctgctt

SEQ ID NO: 4990986 - DNA, 15 bp, Homo sapiens
ttttctttgattttc

SEQ ID NO: 4990987 - DNA, 13 bp, Homo sapiens
ttttcttttaaga

SEQ ID NO: 4990988 - DNA, 15 bp, Homo sapiens
ttttcttttaagaat

SEQ ID NO: 4990989 - DNA, 21 bp, Homo sapiens
ttttcttttgttttcttcatt

SEQ ID NO: 4990990 - DNA, 16 bp, Homo sapiens
ttttgctcttctgtat

SEQ ID NO: 4990991 - DNA, 19 bp, Homo sapiens
tttttgctcttctgtatgt

SEQ ID NO: 4990992 - DNA, 13 bp, Homo sapiens
aaaaaaatctaaa

SEQ ID NO: 4990993 - DNA, 12 bp, Homo sapiens
aaaaagaaatta

SEQ ID NO: 4990994 - DNA, 16 bp, Homo sapiens
aaaacaaagacattct

SEQ ID NO: 4990995 - DNA, 16 bp, Homo sapiens
aaaacaatactaaata

SEQ ID NO: 4990996 - DNA, 18 bp, Homo sapiens
aaaacagtgctattctga

SEQ ID NO: 4990997 - DNA, 22 bp, Homo sapiens
aaaacagtgctattctgagtga

SEQ ID NO: 4990998 - DNA, 11 bp, Homo sapiens
aaaagaagagt

SEQ ID NO: 4990999 - DNA, 14 bp, Homo sapiens
aaaataaatgtaaa

SEQ ID NO: 4991000 - DNA, 22 bp, Homo sapiens
aaaatatttgcacacatttaaa

SEQ ID NO: 4991001 - DNA, 20 bp, Homo sapiens
aaaatgcccatttttgctaa

SEQ ID NO: 4991002 - DNA, 15 bp, Homo sapiens
aaaatggaaagaagg

SEQ ID NO: 4991003 - DNA, 16 bp, Homo sapiens
aaaatggctagaatta

SEQ ID NO: 4991004 - DNA, 13 bp, Homo sapiens
aaaatgtagtttt

SEQ ID NO: 4991005 - DNA, 14 bp, Homo sapiens
aaaatgtagtttta

SEQ ID NO: 4991006 - DNA, 22 bp, Homo sapiens
aaaattacgttcttacaagctt

SEQ ID NO: 4991007 - DNA, 19 bp, Homo sapiens
aaaattgcagtttcatgta

SEQ ID NO: 4991008 - DNA, 13 bp, Homo sapiens
aaacaaaatttca

SEQ ID NO: 4991009 - DNA, 18 bp, Homo sapiens
aaacaaaatttcacagtt

SEQ ID NO: 4991010 - DNA, 23 bp, Homo sapiens
aaacaaaatttcacagttctgta

SEQ ID NO: 4991011 - DNA, 14 bp, Homo sapiens
aaacagacaataat

SEQ ID NO: 4991012 - DNA, 18 bp, Homo sapiens
aaacagtgctattctgag

SEQ ID NO: 4991013 - DNA, 12 bp, Homo sapiens
aaaccacagtct

SEQ ID NO: 4991014 - DNA, 12 bp, Homo sapiens
aaactaattgta

SEQ ID NO: 4991015 - DNA, 12 bp, Homo sapiens
aaactttaaaga

SEQ ID NO: 4991016 - DNA, 16 bp, Homo sapiens
aaacttttaggttgtt

SEQ ID NO: 4991017 - DNA, 17 bp, Homo sapiens
aaagaaaatggaaagaa

SEQ ID NO: 4991018 - DNA, 18 bp, Homo sapiens
aaagaaaatggaaagaag

SEQ ID NO: 4991019 - DNA, 17 bp, Homo sapiens
aaagaaaggaaagaagg

SEQ ID NO: 4991020 - DNA, 12 bp, Homo sapiens
aaagaaggaaaa

SEQ ID NO: 4991021 - DNA, 13 bp, Homo sapiens
aaagaaggaaaaa

SEQ ID NO: 4991022 - DNA, 21 bp, Homo sapiens
aaagaaggagatgaatagaag

SEQ ID NO: 4991023 - DNA, 17 bp, Homo sapiens
aaagccaccttgttaca

SEQ ID NO: 4991024 - DNA, 18 bp, Homo sapiens
aaagccaccttgttacaa

SEQ ID NO: 4991025 - DNA, 17 bp, Homo sapiens
aaagcctttgaaaatac

SEQ ID NO: 4991026 - DNA, 13 bp, Homo sapiens
aaagctacagaac

SEQ ID NO: 4991027 - DNA, 13 bp, Homo sapiens
aaagctttatctt

SEQ ID NO: 4991028 - DNA, 17 bp, Homo sapiens
aaagctttatctttgtg

SEQ ID NO: 4991029 - DNA, 12 bp, Homo sapiens
aaaggaaagaag

SEQ ID NO: 4991030 - DNA, 14 bp, Homo sapiens
aaaggaaagaagga

SEQ ID NO: 4991031 - DNA, 23 bp, Homo sapiens
aaaggaaatctcaccccatccca

SEQ ID NO: 4991032 - DNA, 16 bp, Homo sapiens
aaaggaccgttttgta

SEQ ID NO: 4991033 - DNA, 16 bp, Homo sapiens
aaaggatggaagaaag

SEQ ID NO: 4991034 - DNA, 18 bp, Homo sapiens
aaaggatggaagaaagaa

SEQ ID NO: 4991035 - DNA, 16 bp, Homo sapiens
aaagtatgtccttcag

SEQ ID NO: 4991036 - DNA, 18 bp, Homo sapiens
aaagtgaatttttaaaga

SEQ ID NO: 4991037 - DNA, 20 bp, Homo sapiens
aaatacaaccagaaacaatg

SEQ ID NO: 4991038 - DNA, 23 bp, Homo sapiens
aaatagaaagagttctatggaga

SEQ ID NO: 4991039 - DNA, 16 bp, Homo sapiens
aaatatgcatttttct

SEQ ID NO: 4991040 - DNA, 12 bp, Homo sapiens
aaatattggtta

SEQ ID NO: 4991041 - DNA, 20 bp, Homo sapiens
aaatctaaaaattgaactac

SEQ ID NO: 4991042 - DNA, 18 bp, Homo sapiens
aaatctgacataaaaaca

SEQ ID NO: 4991043 - DNA, 18 bp, Homo sapiens
actaagaaagaaaggaaa

SEQ ID NO: 4991044 - DNA, 19 bp, Homo sapiens
actaagaaagaaaggaaag

SEQ ID NO: 4991045 - DNA, 16 bp, Homo sapiens
actaagactgcttcta

SEQ ID NO: 4991046 - DNA, 14 bp, Homo sapiens
actacaaaaagaag

SEQ ID NO: 4991047 - DNA, 23 bp, Homo sapiens
actacaagcttttaactttttaa

SEQ ID NO: 4991048 - DNA, 21 bp, Homo sapiens
actcatagattgcaaatattg

SEQ ID NO: 4991049 - DNA, 18 bp, Homo sapiens
actcatgcaaactgcttt

SEQ ID NO: 4991050 - DNA, 19 bp, Homo sapiens
actcatgcaaactgcttta

SEQ ID NO: 4991051 - DNA, 22 bp, Homo sapiens
actcggatgtgtcctttctgaa

SEQ ID NO: 4991052 - DNA, 12 bp, Homo sapiens
actctaaagatt

SEQ ID NO: 4991053 - DNA, 16 bp, Homo sapiens
actcttaaatcatttg

SEQ ID NO: 4991054 - DNA, 17 bp, Homo sapiens
actcttaaatcatttgg

SEQ ID NO: 4991055 - DNA, 18 bp, Homo sapiens
actgacagcctcccaccc

SEQ ID NO: 4991056 - DNA, 16 bp, Homo sapiens
actgagatcaaaaaaa

SEQ ID NO: 4991057 - DNA, 17 bp, Homo sapiens
actgcaagcatttttcc

SEQ ID NO: 4991058 - DNA, 22 bp, Homo sapiens
actgcaagcatttttccatctg

SEQ ID NO: 4991059 - DNA, 15 bp, Homo sapiens
actgcttctctttgt

SEQ ID NO: 4991060 - DNA, 17 bp, Homo sapiens
actgcttctctttgtgc

SEQ ID NO: 4991061 - DNA, 13 bp, Homo sapiens
actgtactgaaga

SEQ ID NO: 4991062 - DNA, 17 bp, Homo sapiens
actgtactgaagaacag

SEQ ID NO: 4991063 - DNA, 14 bp, Homo sapiens
actgtagaaaggaa

SEQ ID NO: 4991064 - DNA, 16 bp, Homo sapiens
actgtagaaaggaaat

SEQ ID NO: 4991065 - DNA, 22 bp, Homo sapiens
actgtggccatatatgctgtat

SEQ ID NO: 4991066 - DNA, 11 bp, Homo sapiens
acttaaatgag

SEQ ID NO: 4991067 - DNA, 20 bp, Homo sapiens
acttcctcaatgcattgact

SEQ ID NO: 4991068 - DNA, 13 bp, Homo sapiens
acttcttggattt

SEQ ID NO: 4991069 - DNA, 19 bp, Homo sapiens
acttgacccccttgagggt

SEQ ID NO: 4991070 - DNA, 11 bp, Homo sapiens
actttgtgttt

SEQ ID NO: 4991071 - DNA, 21 bp, Homo sapiens
agaaaaaggatggaagaaaga

SEQ ID NO: 4991072 - DNA, 16 bp, Homo sapiens
agaaaatggaaagaag

SEQ ID NO: 4991073 - DNA, 18 bp, Homo sapiens
agaaagaaaatggaaaga

SEQ ID NO: 4991074 - DNA, 20 bp, Homo sapiens
agaaagaaaatggaaagaag

SEQ ID NO: 4991075 - DNA, 22 bp, Homo sapiens
agaaagaaaatggaaagaagga

SEQ ID NO: 4991076 - DNA, 13 bp, Homo sapiens
agaaagaaaggaa

SEQ ID NO: 4991077 - DNA, 14 bp, Homo sapiens
agaaagaaaggaaa

SEQ ID NO: 4991078 - DNA, 16 bp, Homo sapiens
agaaagaaaggaaaga

SEQ ID NO: 4991079 - DNA, 21 bp, Homo sapiens
agaaagaaaggaaagaaggag

SEQ ID NO: 4991080 - DNA, 14 bp, Homo sapiens
agaaaggaaataga

SEQ ID NO: 4991081 - DNA, 15 bp, Homo sapiens
agaaaggaaatagac

SEQ ID NO: 4991082 - DNA, 11 bp, Homo sapiens
agaaatgccag

SEQ ID NO: 4991083 - DNA, 22 bp, Homo sapiens
agaagcactaagactgcttcta

SEQ ID NO: 4991084 - DNA, 18 bp, Homo sapiens
agaagcattgaaaacaaa

SEQ ID NO: 4991085 - DNA, 18 bp, Homo sapiens
agaaggaaaaaaggagga

SEQ ID NO: 4991086 - DNA, 24 bp, Homo sapiens
agaaggaaaaaaggaggatagaaa

SEQ ID NO: 4991087 - DNA, 13 bp, Homo sapiens
agaaggagatgaa

SEQ ID NO: 4991088 - DNA, 13 bp, Homo sapiens
agaataagaattt

SEQ ID NO: 4991089 - DNA, 12 bp, Homo sapiens
agaataggatta

SEQ ID NO: 4991090 - DNA, 16 bp, Homo sapiens
agaatggcttctctgt

SEQ ID NO: 4991091 - DNA, 14 bp, Homo sapiens
agaatttctggtgg

SEQ ID NO: 4991092 - DNA, 14 bp, Homo sapiens
agacaaatgaaata

SEQ ID NO: 4991093 - DNA, 15 bp, Homo sapiens
agacatctgcctgta

SEQ ID NO: 4991094 - DNA, 18 bp, Homo sapiens
agacatctgcctgtaatt

SEQ ID NO: 4991095 - DNA, 19 bp, Homo sapiens
agacatctgcctgtaatta

SEQ ID NO: 4991096 - DNA, 14 bp, Homo sapiens
agaccatcctggct

SEQ ID NO: 4991097 - DNA, 16 bp, Homo sapiens
agactttgctgttact

SEQ ID NO: 4991098 - DNA, 17 bp, Homo sapiens
agactttgctgttactg

SEQ ID NO: 4991099 - DNA, 13 bp, Homo sapiens
agagcgtttggtt

SEQ ID NO: 4991100 - DNA, 20 bp, Homo sapiens
agagttgttgtttgccaagc

SEQ ID NO: 4991101 - DNA, 14 bp, Homo sapiens
agatgaaataattt

SEQ ID NO: 4991102 - DNA, 16 bp, Homo sapiens
agatgaatagaagaaa

SEQ ID NO: 4991103 - DNA, 17 bp, Homo sapiens
agatgctattaagaagg

SEQ ID NO: 4991104 - DNA, 19 bp, Homo sapiens
agatgctattaagaaggca

SEQ ID NO: 4991105 - DNA, 22 bp, Homo sapiens
agatggcaactgtattaaagaa

SEQ ID NO: 4991106 - DNA, 17 bp, Homo sapiens
agattggatttgctgtg

SEQ ID NO: 4991107 - DNA, 22 bp, Homo sapiens
agatttactgctctagaaagta

SEQ ID NO: 4991108 - DNA, 18 bp, Homo sapiens
agattttttttttaagtg

SEQ ID NO: 4991109 - DNA, 22 bp, Homo sapiens
agcagtcctgcctcagcctccg

SEQ ID NO: 4991110 - DNA, 16 bp, Homo sapiens
agcataactaggatta

SEQ ID NO: 4991111 - DNA, 15 bp, Homo sapiens
agcattaactaaatg

SEQ ID NO: 4991112 - DNA, 14 bp, Homo sapiens
agcattctaaatga

SEQ ID NO: 4991113 - DNA, 15 bp, Homo sapiens
agccaccttgttaca

SEQ ID NO: 4991114 - DNA, 19 bp, Homo sapiens
agcccagttgttgcagtga

SEQ ID NO: 4991115 - DNA, 13 bp, Homo sapiens
agcctcccacccc

SEQ ID NO: 4991116 - DNA, 18 bp, Homo sapiens
agccttatgtgttacatt

SEQ ID NO: 4991117 - DNA, 21 bp, Homo sapiens
agccttatgtgttacattatt

SEQ ID NO: 4991118 - DNA, 15 bp, Homo sapiens
agccttgacacactg

SEQ ID NO: 4991119 - DNA, 16 bp, Homo sapiens
agccttgacacactgt

SEQ ID NO: 4991120 - DNA, 15 bp, Homo sapiens
agcctttgaaaatac

SEQ ID NO: 4991121 - DNA, 16 bp, Homo sapiens
agcctttgcctccccg

SEQ ID NO: 4991122 - DNA, 20 bp, Homo sapiens
agcgccaagtggccactggc

SEQ ID NO: 4991123 - DNA, 20 bp, Homo sapiens
agctaatctgcctggtttta

SEQ ID NO: 4991124 - DNA, 16 bp, Homo sapiens
agctactgtagaaagg

SEQ ID NO: 4991125 - DNA, 19 bp, Homo sapiens
agctactgtagaaaggaaa

SEQ ID NO: 4991126 - DNA, 15 bp, Homo sapiens
agctagaatttctgg

SEQ ID NO: 4991127 - DNA, 18 bp, Homo sapiens
agcttaaagcttgatttg

SEQ ID NO: 4991128 - DNA, 15 bp, Homo sapiens
agcttgatttgatct

SEQ ID NO: 4991129 - DNA, 14 bp, Homo sapiens
agctttatctttgt

SEQ ID NO: 4991130 - DNA, 14 bp, Homo sapiens
aggaaaaaaggagg

SEQ ID NO: 4991131 - DNA, 22 bp, Homo sapiens
aggaaaaaaggaggatagaaaa

SEQ ID NO: 4991132 - DNA, 17 bp, Homo sapiens
aggaaagaaggagatga

SEQ ID NO: 4991133 - DNA, 14 bp, Homo sapiens
aggaaatgccaaag

SEQ ID NO: 4991134 - DNA, 14 bp, Homo sapiens
aggaccgttttgta

SEQ ID NO: 4991135 - DNA, 20 bp, Homo sapiens
aggagaatggcgtgaacccg

SEQ ID NO: 4991136 - DNA, 15 bp, Homo sapiens
aggaggatagaaaaa

SEQ ID NO: 4991137 - DNA, 17 bp, Homo sapiens
aggatggaagaaagaag

SEQ ID NO: 4991138 - DNA, 18 bp, Homo sapiens
aggatggaagaaagaagc

SEQ ID NO: 4991139 - DNA, 19 bp, Homo sapiens
aggatggaagaaagaagca

SEQ ID NO: 4991140 - DNA, 20 bp, Homo sapiens
aggatggaagaaagaagcat

SEQ ID NO: 4991141 - DNA, 22 bp, Homo sapiens
aggccaatatattttgaaatat

SEQ ID NO: 4991142 - DNA, 19 bp, Homo sapiens
aggctttatttataaaata

SEQ ID NO: 4991143 - DNA, 14 bp, Homo sapiens
agggagaaatgcca

SEQ ID NO: 4991144 - DNA, 14 bp, Homo sapiens
agggtataatgtgt

SEQ ID NO: 4991145 - DNA, 20 bp, Homo sapiens
agggtcaacatcttttacat

SEQ ID NO: 4991146 - DNA, 15 bp, Homo sapiens
aggtcaagtaataaa

SEQ ID NO: 4991147 - DNA, 13 bp, Homo sapiens
agtataaatctgg

SEQ ID NO: 4991148 - DNA, 15 bp, Homo sapiens
agtatagtagaaaga

SEQ ID NO: 4991149 - DNA, 22 bp, Homo sapiens
agtatttaactacatctgcctc

SEQ ID NO: 4991150 - DNA, 18 bp, Homo sapiens
agtattttccagccttat

SEQ ID NO: 4991151 - DNA, 17 bp, Homo sapiens
agtcacccctgcctaaa

SEQ ID NO: 4991152 - DNA, 16 bp, Homo sapiens
agtcctgcctcagcct

SEQ ID NO: 4991153 - DNA, 16 bp, Homo sapiens
agtctctgctggccca

SEQ ID NO: 4991154 - DNA, 16 bp, Homo sapiens
agtgacataattgtcc

SEQ ID NO: 4991155 - DNA, 16 bp, Homo sapiens
agtgagtgccatgctt

SEQ ID NO: 4991156 - DNA, 19 bp, Homo sapiens
agtgatagctactgtagaa

SEQ ID NO: 4991157 - DNA, 14 bp, Homo sapiens
agtgcaagattttt

SEQ ID NO: 4991158 - DNA, 12 bp, Homo sapiens
agtgccatgctt

SEQ ID NO: 4991159 - DNA, 23 bp, Homo sapiens
agtgctgacccaacagcctctgt

SEQ ID NO: 4991160 - DNA, 20 bp, Homo sapiens
aaatcttagtatagtagaaa

SEQ ID NO: 4991161 - DNA, 18 bp, Homo sapiens
aaatgccaaaatgtactt

SEQ ID NO: 4991162 - DNA, 13 bp, Homo sapiens
aaatggaaagaag

SEQ ID NO: 4991163 - DNA, 14 bp, Homo sapiens
aaatggatatagaa

SEQ ID NO: 4991164 - DNA, 14 bp, Homo sapiens
aaatgtagttttaa

SEQ ID NO: 4991165 - DNA, 15 bp, Homo sapiens
aaatgtagttttaaa

SEQ ID NO: 4991166 - DNA, 21 bp, Homo sapiens
aaatgtagttttaaataaagt

SEQ ID NO: 4991167 - DNA, 15 bp, Homo sapiens
aaattaaagctgcct

SEQ ID NO: 4991168 - DNA, 16 bp, Homo sapiens
aaattagtttgacact

SEQ ID NO: 4991169 - DNA, 19 bp, Homo sapiens
aaattccgattagaccttt

SEQ ID NO: 4991170 - DNA, 21 bp, Homo sapiens
aaattgcagtttcatgtatgt

SEQ ID NO: 4991171 - DNA, 19 bp, Homo sapiens
aaatttcacagttctgtaa

SEQ ID NO: 4991172 - DNA, 15 bp, Homo sapiens
aaatttcacttgaaa

SEQ ID NO: 4991173 - DNA, 18 bp, Homo sapiens
aaatttttttgatgtgct

SEQ ID NO: 4991174 - DNA, 15 bp, Homo sapiens
aacaaagacattctt

SEQ ID NO: 4991175 - DNA, 13 bp, Homo sapiens
aacaatactaaat

SEQ ID NO: 4991176 - DNA, 20 bp, Homo sapiens
aacactcattcttttttcta

SEQ ID NO: 4991177 - DNA, 21 bp, Homo sapiens
aacactcattcttttttctat

SEQ ID NO: 4991178 - DNA, 16 bp, Homo sapiens
aacagtgcaagatttt

SEQ ID NO: 4991179 - DNA, 20 bp, Homo sapiens
aacagtgcacaagattattt

SEQ ID NO: 4991180 - DNA, 21 bp, Homo sapiens
aacatctgatctgtataaaaa

SEQ ID NO: 4991181 - DNA, 18 bp, Homo sapiens
aacctcttatcactaaga

SEQ ID NO: 4991182 - DNA, 19 bp, Homo sapiens
aacctcttatcactaagaa

SEQ ID NO: 4991183 - DNA, 22 bp, Homo sapiens
aacctcttatcactaagaaaga

SEQ ID NO: 4991184 - DNA, 15 bp, Homo sapiens
aactaactgactctg

SEQ ID NO: 4991185 - DNA, 15 bp, Homo sapiens
aactgtattaaagaa

SEQ ID NO: 4991186 - DNA, 17 bp, Homo sapiens
aactgtattaaagaaaa

SEQ ID NO: 4991187 - DNA, 19 bp, Homo sapiens
aagaaaatggaaagaagga

SEQ ID NO: 4991188 - DNA, 22 bp, Homo sapiens
aagaaaatggaaagaaggaaaa

SEQ ID NO: 4991189 - DNA, 11 bp, Homo sapiens
aagaaagaaaa

SEQ ID NO: 4991190 - DNA, 17 bp, Homo sapiens
aagaaaggaaagaagga

SEQ ID NO: 4991191 - DNA, 12 bp, Homo sapiens
aagaagagtttg

SEQ ID NO: 4991192 - DNA, 11 bp, Homo sapiens
aagaaggaaaa

SEQ ID NO: 4991193 - DNA, 19 bp, Homo sapiens
aagacatctgcctgtaatt

SEQ ID NO: 4991194 - DNA, 20 bp, Homo sapiens
aagactccgtctcaaaaaaa

SEQ ID NO: 4991195 - DNA, 12 bp, Homo sapiens
aagaggttttat

SEQ ID NO: 4991196 - DNA, 22 bp, Homo sapiens
aagatggcaactgtattaaaga

SEQ ID NO: 4991197 - DNA, 18 bp, Homo sapiens
aagattagggaaaatgga

SEQ ID NO: 4991198 - DNA, 20 bp, Homo sapiens
aagcactaagactgcttcta

SEQ ID NO: 4991199 - DNA, 14 bp, Homo sapiens
aagcattgaaaaca

SEQ ID NO: 4991200 - DNA, 20 bp, Homo sapiens
aagcattgaaaacaaagaca

SEQ ID NO: 4991201 - DNA, 19 bp, Homo sapiens
aagccaccttgttacaaat

SEQ ID NO: 4991202 - DNA, 14 bp, Homo sapiens
aagctaatctgcct

SEQ ID NO: 4991203 - DNA, 15 bp, Homo sapiens
aagctttatctttgt

SEQ ID NO: 4991204 - DNA, 17 bp, Homo sapiens
aagctttatctttgtgt

SEQ ID NO: 4991205 - DNA, 13 bp, Homo sapiens
aaggaaaaaagga

SEQ ID NO: 4991206 - DNA, 20 bp, Homo sapiens
aaggaaagaaggagatgaat

SEQ ID NO: 4991207 - DNA, 14 bp, Homo sapiens
aaggaaatagactt

SEQ ID NO: 4991208 - DNA, 18 bp, Homo sapiens
aaggagatgaatagaaga

SEQ ID NO: 4991209 - DNA, 20 bp, Homo sapiens
aaggagatgaatagaagaaa

SEQ ID NO: 4991210 - DNA, 17 bp, Homo sapiens
aaggatggaagaaagaa

SEQ ID NO: 4991211 - DNA, 19 bp, Homo sapiens
aagggtaggttagatgcta

SEQ ID NO: 4991212 - DNA, 12 bp, Homo sapiens
aagtcctgcttt

SEQ ID NO: 4991213 - DNA, 16 bp, Homo sapiens
aagtgaatttatgaga

SEQ ID NO: 4991214 - DNA, 16 bp, Homo sapiens
aagtggccactggcat

SEQ ID NO: 4991215 - DNA, 20 bp, Homo sapiens
aagttgaaaagtaaaaaata

SEQ ID NO: 4991216 - DNA, 19 bp, Homo sapiens
aagttgtacttcatttcta

SEQ ID NO: 4991217 - DNA, 19 bp, Homo sapiens
aataatctatattaaatga

SEQ ID NO: 4991218 - DNA, 19 bp, Homo sapiens
aataatgtacatctggcct

SEQ ID NO: 4991219 - DNA, 13 bp, Homo sapiens
aatactaaataaa

SEQ ID NO: 4991220 - DNA, 13 bp, Homo sapiens
aatagaagaaaga

SEQ ID NO: 4991221 - DNA, 14 bp, Homo sapiens
aatattggttagta

SEQ ID NO: 4991222 - DNA, 22 bp, Homo sapiens
aatcaaatcatgtacatttgaa

SEQ ID NO: 4991223 - DNA, 17 bp, Homo sapiens
aatcagggaaactaatt

SEQ ID NO: 4991224 - DNA, 19 bp, Homo sapiens
aatcagggaaactaattgt

SEQ ID NO: 4991225 - DNA, 16 bp, Homo sapiens
aatcatgctcatgtat

SEQ ID NO: 4991226 - DNA, 13 bp, Homo sapiens
aatctcaccccat

SEQ ID NO: 4991227 - DNA, 22 bp, Homo sapiens
aatctggggaagaggttttatt

SEQ ID NO: 4991228 - DNA, 15 bp, Homo sapiens
aatgagggtttctga

SEQ ID NO: 4991229 - DNA, 19 bp, Homo sapiens
aatgattaatcataaagaa

SEQ ID NO: 4991230 - DNA, 20 bp, Homo sapiens
aatgccaggcggacaaagtt

SEQ ID NO: 4991231 - DNA, 17 bp, Homo sapiens
aatgcccatttttgcta

SEQ ID NO: 4991232 - DNA, 16 bp, Homo sapiens
aatgctcatacacagt

SEQ ID NO: 4991233 - DNA, 22 bp, Homo sapiens
aatggatatagaaaatcttagt

SEQ ID NO: 4991234 - DNA, 23 bp, Homo sapiens
aatggatatagaaaatcttagta

SEQ ID NO: 4991235 - DNA, 20 bp, Homo sapiens
aatggtaggtcaagtaataa

SEQ ID NO: 4991236 - DNA, 17 bp, Homo sapiens
aatgtacatctggcctt

SEQ ID NO: 4991237 - DNA, 15 bp, Homo sapiens
aatgtacttaaatga

SEQ ID NO: 4991238 - DNA, 22 bp, Homo sapiens
aatgtcctaacagagaaataga

SEQ ID NO: 4991239 - DNA, 20 bp, Homo sapiens
aatgtgtctatttctgaaag

SEQ ID NO: 4991240 - DNA, 16 bp, Homo sapiens
aattagtttgacactg

SEQ ID NO: 4991241 - DNA, 23 bp, Homo sapiens
aattatcttagtctatagaaatg

SEQ ID NO: 4991242 - DNA, 17 bp, Homo sapiens
aattctgaaatactttt

SEQ ID NO: 4991243 - DNA, 11 bp, Homo sapiens
aattgagaatg

SEQ ID NO: 4991244 - DNA, 15 bp, Homo sapiens
aattgatcagatgct

SEQ ID NO: 4991245 - DNA, 14 bp, Homo sapiens
aattgcagtttcat

SEQ ID NO: 4991246 - DNA, 18 bp, Homo sapiens
aattggcataatttgtct

SEQ ID NO: 4991247 - DNA, 21 bp, Homo sapiens
aatttaacatcactacaaaaa

SEQ ID NO: 4991248 - DNA, 22 bp, Homo sapiens
aatttgaggtctacattcttgg

SEQ ID NO: 4991249 - DNA, 12 bp, Homo sapiens
acaaaaagaaga

SEQ ID NO: 4991250 - DNA, 13 bp, Homo sapiens
acaaaaagaagag

SEQ ID NO: 4991251 - DNA, 11 bp, Homo sapiens
acaaagacatt

SEQ ID NO: 4991252 - DNA, 12 bp, Homo sapiens
acaaatgaaata

SEQ ID NO: 4991253 - DNA, 19 bp, Homo sapiens
acaagcttaaagcttgatt

SEQ ID NO: 4991254 - DNA, 21 bp, Homo sapiens
acaagtattctacctaaatct

SEQ ID NO: 4991255 - DNA, 17 bp, Homo sapiens
acagaccatctgtatgt

SEQ ID NO: 4991256 - DNA, 21 bp, Homo sapiens
acagatttaagccttgacaca

SEQ ID NO: 4991257 - DNA, 12 bp, Homo sapiens
acagcctctgtg

SEQ ID NO: 4991258 - DNA, 20 bp, Homo sapiens
acagtctggagtgatagcta

SEQ ID NO: 4991259 - DNA, 10 bp, Homo sapiens
acagtgcaag

SEQ ID NO: 4991260 - DNA, 15 bp, Homo sapiens
acagttctgtaatgt

SEQ ID NO: 4991261 - DNA, 19 bp, Homo sapiens
acatcactacaaaaagaag

SEQ ID NO: 4991262 - DNA, 13 bp, Homo sapiens
acatcatgtaaga

SEQ ID NO: 4991263 - DNA, 22 bp, Homo sapiens
acatctaaagctttatctttgt

SEQ ID NO: 4991264 - DNA, 16 bp, Homo sapiens
acatctgatctgtata

SEQ ID NO: 4991265 - DNA, 16 bp, Homo sapiens
accagcttagatttta

SEQ ID NO: 4991266 - DNA, 17 bp, Homo sapiens
acccaacagcctctgtg

SEQ ID NO: 4991267 - DNA, 19 bp, Homo sapiens
accccacccttcccctcct

SEQ ID NO: 4991268 - DNA, 14 bp, Homo sapiens
acctattgaattac

SEQ ID NO: 4991269 - DNA, 16 bp, Homo sapiens
acctattgaattacca

SEQ ID NO: 4991270 - DNA, 20 bp, Homo sapiens
acctggatatccatgagctg

SEQ ID NO: 4991271 - DNA, 14 bp, Homo sapiens
accttttattacat

SEQ ID NO: 4991272 - DNA, 23 bp, Homo sapiens
acctttttatatttaaaaaatta

SEQ ID NO: 4991273 - DNA, 17 bp, Homo sapiens
acgaatttaaaatgtag

SEQ ID NO: 4991274 - DNA, 23 bp, Homo sapiens
acgttcttacaagcttaaagctt

SEQ ID NO: 4991275 - DNA, 11 bp, Homo sapiens
actaagaaaga

SEQ ID NO: 4991276 - DNA, 13 bp, Homo sapiens
actaagaaagaaa

SEQ ID NO: 4991277 - DNA, 23 bp, Homo sapiens
tgtcttcagaggctcatctaact

SEQ ID NO: 4991278 - DNA, 17 bp, Homo sapiens
tgtctttttctagactt

SEQ ID NO: 4991279 - DNA, 17 bp, Homo sapiens
tgtgcctcccttttctc

SEQ ID NO: 4991280 - DNA, 19 bp, Homo sapiens
tgtgtaatctaagtatatg

SEQ ID NO: 4991281 - DNA, 14 bp, Homo sapiens
tgtgtcctttctga

SEQ ID NO: 4991282 - DNA, 13 bp, Homo sapiens
tgtgttgcttcaa

SEQ ID NO: 4991283 - DNA, 18 bp, Homo sapiens
tgtgtttaaagtgaattt

SEQ ID NO: 4991284 - DNA, 15 bp, Homo sapiens
tgttacattattcca

SEQ ID NO: 4991285 - DNA, 13 bp, Homo sapiens
tgttactgcttct

SEQ ID NO: 4991286 - DNA, 21 bp, Homo sapiens
tgttactgcttctctttgtgc

SEQ ID NO: 4991287 - DNA, 18 bp, Homo sapiens
tgttattaatgtttcttc

SEQ ID NO: 4991288 - DNA, 20 bp, Homo sapiens
tgttcaataaaggaaatatg

SEQ ID NO: 4991289 - DNA, 14 bp, Homo sapiens
tgttgcttcaaatt

SEQ ID NO: 4991290 - DNA, 21 bp, Homo sapiens
tgtttactcccttctgtagtt

SEQ ID NO: 4991291 - DNA, 16 bp, Homo sapiens
cttctgtagtttttaa

SEQ ID NO: 4991292 - DNA, 20 bp, Homo sapiens
cttctgtagtttttaattaa

SEQ ID NO: 4991293 - DNA, 13 bp, Homo sapiens
cttcttgttcccc

SEQ ID NO: 4991294 - DNA, 17 bp, Homo sapiens
cttgcagaaaatgaatg

SEQ ID NO: 4991295 - DNA, 15 bp, Homo sapiens
cttgttattaatgtt

SEQ ID NO: 4991296 - DNA, 18 bp, Homo sapiens
cttgttattaatgtttct

SEQ ID NO: 4991297 - DNA, 20 bp, Homo sapiens
ctttagaaattaataccact

SEQ ID NO: 4991298 - DNA, 22 bp, Homo sapiens
ctttatccagctagtgccaaat

SEQ ID NO: 4991299 - DNA, 13 bp, Homo sapiens
ctttatctttgtg

SEQ ID NO: 4991300 - DNA, 18 bp, Homo sapiens
ctttgctgttactgcttc

SEQ ID NO: 4991301 - DNA, 23 bp, Homo sapiens
ctttgctgttactgcttctcttt

SEQ ID NO: 4991302 - DNA, 14 bp, Homo sapiens
ctttgtagaataaa

SEQ ID NO: 4991303 - DNA, 15 bp, Homo sapiens
ctttgtcccggggct

SEQ ID NO: 4991304 - DNA, 15 bp, Homo sapiens
ctttgtttaaatgcc

SEQ ID NO: 4991305 - DNA, 16 bp, Homo sapiens
cttttaggttgttacc

SEQ ID NO: 4991306 - DNA, 14 bp, Homo sapiens
cttttattttcatt

SEQ ID NO: 4991307 - DNA, 16 bp, Homo sapiens
cttttattttcattgt

SEQ ID NO: 4991308 - DNA, 17 bp, Homo sapiens
cttttgagtatggctat

SEQ ID NO: 4991309 - DNA, 18 bp, Homo sapiens
cttttttaaagtaaactt

SEQ ID NO: 4991310 - DNA, 20 bp, Homo sapiens
cttttttgatatgataataa

SEQ ID NO: 4991311 - DNA, 11 bp, Homo sapiens
ctttttttcct

SEQ ID NO: 4991312 - DNA, 14 bp, Homo sapiens
ctttttttgttata

SEQ ID NO: 4991313 - DNA, 12 bp, Homo sapiens
gaaaaaaggagg

SEQ ID NO: 4991314 - DNA, 22 bp, Homo sapiens
gaaaaacttttaggttgttacc

SEQ ID NO: 4991315 - DNA, 14 bp, Homo sapiens
gaaaaaggatggaa

SEQ ID NO: 4991316 - DNA, 20 bp, Homo sapiens
gaaaaaggatggaagaaaga

SEQ ID NO: 4991317 - DNA, 22 bp, Homo sapiens
gaaaaaggatggaagaaagaag

SEQ ID NO: 4991318 - DNA, 21 bp, Homo sapiens
gaaaaatcagtttttgactga

SEQ ID NO: 4991319 - DNA, 22 bp, Homo sapiens
gaaaatcttagtatagtagaaa

SEQ ID NO: 4991320 - DNA, 13 bp, Homo sapiens
gaaaatggaaaga

SEQ ID NO: 4991321 - DNA, 17 bp, Homo sapiens
gaaaatggaaagaagga

SEQ ID NO: 4991322 - DNA, 22 bp, Homo sapiens
gaaaatggatatagaaaatctt

SEQ ID NO: 4991323 - DNA, 19 bp, Homo sapiens
gaaaatttcacttgaaatt

SEQ ID NO: 4991324 - DNA, 14 bp, Homo sapiens
gaaagaaaggaaag

SEQ ID NO: 4991325 - DNA, 15 bp, Homo sapiens
gaaagaaaggaaaga

SEQ ID NO: 4991326 - DNA, 13 bp, Homo sapiens
gaaaggaaagaag

SEQ ID NO: 4991327 - DNA, 14 bp, Homo sapiens
gaaaggaaagaagg

SEQ ID NO: 4991328 - DNA, 13 bp, Homo sapiens
gaaagttgctttt

SEQ ID NO: 4991329 - DNA, 12 bp, Homo sapiens
gaagaaagaaaa

SEQ ID NO: 4991330 - DNA, 17 bp, Homo sapiens
gaagcactaagactgct

SEQ ID NO: 4991331 - DNA, 14 bp, Homo sapiens
gaaggaaaaaagga

SEQ ID NO: 4991332 - DNA, 13 bp, Homo sapiens
gaaggagatgaat

SEQ ID NO: 4991333 - DNA, 15 bp, Homo sapiens
gaatagaagaaagaa

SEQ ID NO: 4991334 - DNA, 21 bp, Homo sapiens
gaattggcataatttgtctta

SEQ ID NO: 4991335 - DNA, 13 bp, Homo sapiens
gaatttaaaatgt

SEQ ID NO: 4991336 - DNA, 16 bp, Homo sapiens
gacagcctcccacccc

SEQ ID NO: 4991337 - DNA, 17 bp, Homo sapiens
gacatctgcctgtaatt

SEQ ID NO: 4991338 - DNA, 11 bp, Homo sapiens
gacattcttcc

SEQ ID NO: 4991339 - DNA, 13 bp, Homo sapiens
gactcaaaacact

SEQ ID NO: 4991340 - DNA, 22 bp, Homo sapiens
gactgtggccatatatgctgta

SEQ ID NO: 4991341 - DNA, 18 bp, Homo sapiens
gacttgttttatgctcag

SEQ ID NO: 4991342 - DNA, 11 bp, Homo sapiens
gagaaatgcca

SEQ ID NO: 4991343 - DNA, 13 bp, Homo sapiens
gagactttgctgt

SEQ ID NO: 4991344 - DNA, 17 bp, Homo sapiens
gagactttgctgttact

SEQ ID NO: 4991345 - DNA, 14 bp, Homo sapiens
gagatgaatagaag

SEQ ID NO: 4991346 - DNA, 17 bp, Homo sapiens
gagatgaatagaagaaa

SEQ ID NO: 4991347 - DNA, 19 bp, Homo sapiens
gagatgaatagaagaaaga

SEQ ID NO: 4991348 - DNA, 18 bp, Homo sapiens
gagattggatttgctgtg

SEQ ID NO: 4991349 - DNA, 18 bp, Homo sapiens
gagcattaactaaatgct

SEQ ID NO: 4991350 - DNA, 14 bp, Homo sapiens
gaggatagaaaaag

SEQ ID NO: 4991351 - DNA, 14 bp, Homo sapiens
gagtaatgatgtaa

SEQ ID NO: 4991352 - DNA, 23 bp, Homo sapiens
gagtcttaactgtatttcagtat

SEQ ID NO: 4991353 - DNA, 18 bp, Homo sapiens
gagttacttagaatgcca

SEQ ID NO: 4991354 - DNA, 19 bp, Homo sapiens
gataataatcatgatcaca

SEQ ID NO: 4991355 - DNA, 23 bp, Homo sapiens
gatacccaacagtttatttttat

SEQ ID NO: 4991356 - DNA, 13 bp, Homo sapiens
gatagaaaaagga

SEQ ID NO: 4991357 - DNA, 17 bp, Homo sapiens
gatagaaaaaggatgga

SEQ ID NO: 4991358 - DNA, 23 bp, Homo sapiens
gatagaaaaaggatggaagaaag

SEQ ID NO: 4991359 - DNA, 22 bp, Homo sapiens
gatagctactgtagaaaggaaa

SEQ ID NO: 4991360 - DNA, 21 bp, Homo sapiens
gatatccatgagctgcactga

SEQ ID NO: 4991361 - DNA, 13 bp, Homo sapiens
gatcacatctaaa

SEQ ID NO: 4991362 - DNA, 15 bp, Homo sapiens
gatcagatgctgaat

SEQ ID NO: 4991363 - DNA, 18 bp, Homo sapiens
gatccacctgtctcagcc

SEQ ID NO: 4991364 - DNA, 22 bp, Homo sapiens
gatcccagcacctattgaatta

SEQ ID NO: 4991365 - DNA, 19 bp, Homo sapiens
gatcgagaccatcctggct

SEQ ID NO: 4991366 - DNA, 21 bp, Homo sapiens
gatctctttgatcctggaaat

SEQ ID NO: 4991367 - DNA, 15 bp, Homo sapiens
gatctgtactttgtg

SEQ ID NO: 4991368 - DNA, 23 bp, Homo sapiens
gatctgtataaaaatgtaaatta

SEQ ID NO: 4991369 - DNA, 20 bp, Homo sapiens
gatctttgtttaaatgccaa

SEQ ID NO: 4991370 - DNA, 18 bp, Homo sapiens
gatgaatagaagaaagaa

SEQ ID NO: 4991371 - DNA, 18 bp, Homo sapiens
gatgctattaagaaggca

SEQ ID NO: 4991372 - DNA, 22 bp, Homo sapiens
gatggcaactgtattaaagaaa

SEQ ID NO: 4991373 - DNA, 23 bp, Homo sapiens
gatggggtctcacagtgttgccc

SEQ ID NO: 4991374 - DNA, 14 bp, Homo sapiens
gattagacctttat

SEQ ID NO: 4991375 - DNA, 15 bp, Homo sapiens
gattggatttgctgt

SEQ ID NO: 4991376 - DNA, 13 bp, Homo sapiens
gatttgatctttg

SEQ ID NO: 4991377 - DNA, 14 bp, Homo sapiens
gatttgatctttgt

SEQ ID NO: 4991378 - DNA, 13 bp, Homo sapiens
gcaaactgcttta

SEQ ID NO: 4991379 - DNA, 21 bp, Homo sapiens
gcaaactgctttattttccct

SEQ ID NO: 4991380 - DNA, 17 bp, Homo sapiens
gcagcttcctgtctgtt

SEQ ID NO: 4991381 - DNA, 18 bp, Homo sapiens
gcagtcctgcctcagcct

SEQ ID NO: 4991382 - DNA, 14 bp, Homo sapiens
gcagtgtgtaaagt

SEQ ID NO: 4991383 - DNA, 15 bp, Homo sapiens
gcatgagattttgga

SEQ ID NO: 4991384 - DNA, 16 bp, Homo sapiens
gcattaactaaatgct

SEQ ID NO: 4991385 - DNA, 20 bp, Homo sapiens
gcattaactaaatgctcata

SEQ ID NO: 4991386 - DNA, 14 bp, Homo sapiens
gccaccacgtccag

SEQ ID NO: 4991387 - DNA, 14 bp, Homo sapiens
gccaccatggccag

SEQ ID NO: 4991388 - DNA, 16 bp, Homo sapiens
gccaccatggccagcc

SEQ ID NO: 4991389 - DNA, 22 bp, Homo sapiens
gccaggcggacaaagttcagtg

SEQ ID NO: 4991390 - DNA, 23 bp, Homo sapiens
gccaggcggacaaagttcagtgt

SEQ ID NO: 4991391 - DNA, 12 bp, Homo sapiens
gccatgcttttt

SEQ ID NO: 4991392 - DNA, 17 bp, Homo sapiens
gcccagccaaaccctgt

SEQ ID NO: 4991393 - DNA, 21 bp, Homo sapiens
gcccagccaaaccctgtctga

SEQ ID NO: 4991394 - DNA, 16 bp, Homo sapiens
gcccatttttgctaat

SEQ ID NO: 4991395 - DNA, 22 bp, Homo sapiens
gccctttcccaggtaatttaaa

SEQ ID NO: 4991396 - DNA, 17 bp, Homo sapiens
gcctcccacccccatct

SEQ ID NO: 4991397 - DNA, 19 bp, Homo sapiens
gcctcctgtgcctcccttt

SEQ ID NO: 4991398 - DNA, 20 bp, Homo sapiens
gcctgggcgacagagcaaga

SEQ ID NO: 4991399 - DNA, 19 bp, Homo sapiens
gccttatgtgttacattat

SEQ ID NO: 4991400 - DNA, 23 bp, Homo sapiens
gccttatgtgttacattattcca

SEQ ID NO: 4991401 - DNA, 16 bp, Homo sapiens
gcgatccacctgtctc

SEQ ID NO: 4991402 - DNA, 21 bp, Homo sapiens
gcgatccacctgtctcagcct

SEQ ID NO: 4991403 - DNA, 17 bp, Homo sapiens
taaaagtcattattcct

SEQ ID NO: 4991404 - DNA, 20 bp, Homo sapiens
taaaatgtagttttaaataa

SEQ ID NO: 4991405 - DNA, 24 bp, Homo sapiens
taaaattgcagtttcatgtatgta

SEQ ID NO: 4991406 - DNA, 19 bp, Homo sapiens
taaacaaaatttcacagtt

SEQ ID NO: 4991407 - DNA, 22 bp, Homo sapiens
taaacaccttatccctaacatg

SEQ ID NO: 4991408 - DNA, 12 bp, Homo sapiens
taaacatctgat

SEQ ID NO: 4991409 - DNA, 16 bp, Homo sapiens
taaacatctgatctgt

SEQ ID NO: 4991410 - DNA, 12 bp, Homo sapiens
taaagctttatc

SEQ ID NO: 4991411 - DNA, 17 bp, Homo sapiens
taaagctttatctttgt

SEQ ID NO: 4991412 - DNA, 15 bp, Homo sapiens
taaagggagaaatgc

SEQ ID NO: 4991413 - DNA, 17 bp, Homo sapiens
taaagggagaaatgcca

SEQ ID NO: 4991414 - DNA, 11 bp, Homo sapiens
taaagtgaatt

SEQ ID NO: 4991415 - DNA, 15 bp, Homo sapiens
taaataaagtttgga

SEQ ID NO: 4991416 - DNA, 13 bp, Homo sapiens
taaataaatagaa

SEQ ID NO: 4991417 - DNA, 15 bp, Homo sapiens
taaatacataaataa

SEQ ID NO: 4991418 - DNA, 21 bp, Homo sapiens
taaatcatttggttaaatcat

SEQ ID NO: 4991419 - DNA, 15 bp, Homo sapiens
taaatctggggaaga

SEQ ID NO: 4991420 - DNA, 22 bp, Homo sapiens
taaatctggggaagaggtttta

SEQ ID NO: 4991421 - DNA, 19 bp, Homo sapiens
taaatcttccaatttcctt

SEQ ID NO: 4991422 - DNA, 23 bp, Homo sapiens
taaatgagggtttctgatctgta

SEQ ID NO: 4991423 - DNA, 19 bp, Homo sapiens
taaatgccaaaatgtactt

SEQ ID NO: 4991424 - DNA, 20 bp, Homo sapiens
taaatgccaaaatgtactta

SEQ ID NO: 4991425 - DNA, 16 bp, Homo sapiens
taaatgctcatacaca

SEQ ID NO: 4991426 - DNA, 13 bp, Homo sapiens
taaatgctgaaat

SEQ ID NO: 4991427 - DNA, 14 bp, Homo sapiens
taaatgctgaaata

SEQ ID NO: 4991428 - DNA, 19 bp, Homo sapiens
taaatgctgaaataaaatg

SEQ ID NO: 4991429 - DNA, 21 bp, Homo sapiens
taaatggtttctcattaaact

SEQ ID NO: 4991430 - DNA, 12 bp, Homo sapiens
taaatgtaaagt

SEQ ID NO: 4991431 - DNA, 14 bp, Homo sapiens
taaattagtttgac

SEQ ID NO: 4991432 - DNA, 20 bp, Homo sapiens
taaattagtttgacactgct

SEQ ID NO: 4991433 - DNA, 20 bp, Homo sapiens
taacaagctcagctctgctt

SEQ ID NO: 4991434 - DNA, 16 bp, Homo sapiens
taacagagaaatagag

SEQ ID NO: 4991435 - DNA, 18 bp, Homo sapiens
taacatcactacaaaaag

SEQ ID NO: 4991436 - DNA, 22 bp, Homo sapiens
taacatcactacaaaaagaaga

SEQ ID NO: 4991437 - DNA, 22 bp, Homo sapiens
taactctgtccttacatactca

SEQ ID NO: 4991438 - DNA, 17 bp, Homo sapiens
taactgtatttcagtat

SEQ ID NO: 4991439 - DNA, 19 bp, Homo sapiens
taagaaagaaaggaaagaa

SEQ ID NO: 4991440 - DNA, 21 bp, Homo sapiens
taagaaagaaaggaaagaagg

SEQ ID NO: 4991441 - DNA, 23 bp, Homo sapiens
taagaaagaaaggaaagaaggag

SEQ ID NO: 4991442 - DNA, 20 bp, Homo sapiens
taagaaagccaccttgttac

SEQ ID NO: 4991443 - DNA, 22 bp, Homo sapiens
taagaaagccaccttgttacaa

SEQ ID NO: 4991444 - DNA, 23 bp, Homo sapiens
taagaatttgaggtctacattct

SEQ ID NO: 4991445 - DNA, 21 bp, Homo sapiens
taagagtttctaaaacagaca

SEQ ID NO: 4991446 - DNA, 14 bp, Homo sapiens
taagccttgacaca

SEQ ID NO: 4991447 - DNA, 18 bp, Homo sapiens
taagctggtgttataata

SEQ ID NO: 4991448 - DNA, 19 bp, Homo sapiens
taagggtggaaaaatgccc

SEQ ID NO: 4991449 - DNA, 15 bp, Homo sapiens
taagtctacattaaa

SEQ ID NO: 4991450 - DNA, 16 bp, Homo sapiens
taagtctacattaaac

SEQ ID NO: 4991451 - DNA, 14 bp, Homo sapiens
taagttgaaaagta

SEQ ID NO: 4991452 - DNA, 17 bp, Homo sapiens
taagttgaaaagtaaaa

SEQ ID NO: 4991453 - DNA, 20 bp, Homo sapiens
taagttgaaaagtaaaaaat

SEQ ID NO: 4991454 - DNA, 14 bp, Homo sapiens
taataatgaagtgt

SEQ ID NO: 4991455 - DNA, 17 bp, Homo sapiens
taatagcccatttctgt

SEQ ID NO: 4991456 - DNA, 19 bp, Homo sapiens
taatagtcttgcagaaaat

SEQ ID NO: 4991457 - DNA, 18 bp, Homo sapiens
taatcatgctcatgtata

SEQ ID NO: 4991458 - DNA, 17 bp, Homo sapiens
taatctatattaaatga

SEQ ID NO: 4991459 - DNA, 17 bp, Homo sapiens
taatctcctctgctcat

SEQ ID NO: 4991460 - DNA, 21 bp, Homo sapiens
taatctcctctgctcattaaa

SEQ ID NO: 4991461 - DNA, 19 bp, Homo sapiens
taatctgcctggttttatt

SEQ ID NO: 4991462 - DNA, 18 bp, Homo sapiens
taatctttaactgaactc

SEQ ID NO: 4991463 - DNA, 15 bp, Homo sapiens
taatgtacatctggc

SEQ ID NO: 4991464 - DNA, 12 bp, Homo sapiens
taattaaaaact

SEQ ID NO: 4991465 - DNA, 13 bp, Homo sapiens
taattaaaaactt

SEQ ID NO: 4991466 - DNA, 19 bp, Homo sapiens
taattaaaaactttaaaga

SEQ ID NO: 4991467 - DNA, 23 bp, Homo sapiens
taattgatcagatgctgaattga

SEQ ID NO: 4991468 - DNA, 15 bp, Homo sapiens
taatttgtcttagtt

SEQ ID NO: 4991469 - DNA, 16 bp, Homo sapiens
tacaaattttttaatt

SEQ ID NO: 4991470 - DNA, 16 bp, Homo sapiens
tacaagcttaaagctt

SEQ ID NO: 4991471 - DNA, 21 bp, Homo sapiens
tacaataaaactttgctgcca

SEQ ID NO: 4991472 - DNA, 13 bp, Homo sapiens
tacacagttaaat

SEQ ID NO: 4991473 - DNA, 16 bp, Homo sapiens
tacaggtttttttgac

SEQ ID NO: 4991474 - DNA, 15 bp, Homo sapiens
tacataaataaaaga

SEQ ID NO: 4991475 - DNA, 15 bp, Homo sapiens
taccaagtatgaagt

SEQ ID NO: 4991476 - DNA, 21 bp, Homo sapiens
taccaagtatgaagtataaat

SEQ ID NO: 4991477 - DNA, 13 bp, Homo sapiens
taccagtctgatt

SEQ ID NO: 4991478 - DNA, 16 bp, Homo sapiens
taccatagagtaatga

SEQ ID NO: 4991479 - DNA, 23 bp, Homo sapiens
tacctaaaaggaaatctcacccc

SEQ ID NO: 4991480 - DNA, 18 bp, Homo sapiens
tacctttttatatttaaa

SEQ ID NO: 4991481 - DNA, 16 bp, Homo sapiens
tactagactttgattt

SEQ ID NO: 4991482 - DNA, 14 bp, Homo sapiens
tactgaagaacagt

SEQ ID NO: 4991483 - DNA, 22 bp, Homo sapiens
tactgcagcctttgcctccccg

SEQ ID NO: 4991484 - DNA, 17 bp, Homo sapiens
tactgcttctctttgtg

SEQ ID NO: 4991485 - DNA, 15 bp, Homo sapiens
tactgtactgaagaa

SEQ ID NO: 4991486 - DNA, 12 bp, Homo sapiens
tacttaaatgag

SEQ ID NO: 4991487 - DNA, 21 bp, Homo sapiens
tacttagaatgccataaaatt

SEQ ID NO: 4991488 - DNA, 15 bp, Homo sapiens
tactttttttgttat

SEQ ID NO: 4991489 - DNA, 23 bp, Homo sapiens
tactttttttgttatagattgtc

SEQ ID NO: 4991490 - DNA, 16 bp, Homo sapiens
tagaaaaaggatggaa

SEQ ID NO: 4991491 - DNA, 18 bp, Homo sapiens
tagaaaaaggatggaaga

SEQ ID NO: 4991492 - DNA, 19 bp, Homo sapiens
tagaaaaaggatggaagaa

SEQ ID NO: 4991493 - DNA, 23 bp, Homo sapiens
tagaaaaaggatggaagaaagaa

SEQ ID NO: 4991494 - DNA, 17 bp, Homo sapiens
tagaaagacatctgcct

SEQ ID NO: 4991495 - DNA, 23 bp, Homo sapiens
tagaaagacatctgcctgtaatt

SEQ ID NO: 4991496 - DNA, 12 bp, Homo sapiens
tagaaaggaaat

SEQ ID NO: 4991497 - DNA, 19 bp, Homo sapiens
tagagcgtttggttaaagt

SEQ ID NO: 4991498 - DNA, 20 bp, Homo sapiens
tagagcgtttggttaaagta

SEQ ID NO: 4991499 - DNA, 15 bp, Homo sapiens
tagagtaatgatgta

SEQ ID NO: 4991500 - DNA, 15 bp, Homo sapiens
tagatttgaaaaact

SEQ ID NO: 4991501 - DNA, 18 bp, Homo sapiens
tagcatttatttctctgg

SEQ ID NO: 4991502 - DNA, 20 bp, Homo sapiens
tagctactgtagaaaggaaa

SEQ ID NO: 4991503 - DNA, 21 bp, Homo sapiens
taggctttatttataaaataa

SEQ ID NO: 4991504 - DNA, 18 bp, Homo sapiens
tagggtataatgtgtctg

SEQ ID NO: 4991505 - DNA, 20 bp, Homo sapiens
taggtcaagtaataaaaaga

SEQ ID NO: 4991506 - DNA, 12 bp, Homo sapiens
taggttgttacc

SEQ ID NO: 4991507 - DNA, 20 bp, Homo sapiens
taggttgttaccaagtatga

SEQ ID NO: 4991508 - DNA, 20 bp, Homo sapiens
tagtatttaactacatctgc

SEQ ID NO: 4991509 - DNA, 22 bp, Homo sapiens
tagtatttaactacatctgcct

SEQ ID NO: 4991510 - DNA, 23 bp, Homo sapiens
tagtatttaactacatctgcctc

SEQ ID NO: 4991511 - DNA, 21 bp, Homo sapiens
tagtctttttttccttccttt

SEQ ID NO: 4991512 - DNA, 17 bp, Homo sapiens
tgaaagttgcttttatt

SEQ ID NO: 4991513 - DNA, 18 bp, Homo sapiens
tgaaagttgcttttattg

SEQ ID NO: 4991514 - DNA, 11 bp, Homo sapiens
tgaaatacaac

SEQ ID NO: 4991515 - DNA, 18 bp, Homo sapiens
tgaaatacttttgagtat

SEQ ID NO: 4991516 - DNA, 19 bp, Homo sapiens
tgaaattaaagctgccttt

SEQ ID NO: 4991517 - DNA, 19 bp, Homo sapiens
tgaactctttaagttgaaa

SEQ ID NO: 4991518 - DNA, 19 bp, Homo sapiens
tgacagcctcccaccccca

SEQ ID NO: 4991519 - DNA, 13 bp, Homo sapiens
tgacattcactgg

SEQ ID NO: 4991520 - DNA, 19 bp, Homo sapiens
tgacccaacagcctctgtg

SEQ ID NO: 4991521 - DNA, 20 bp, Homo sapiens
tgacccaacagcctctgtgg

SEQ ID NO: 4991522 - DNA, 20 bp, Homo sapiens
tgagaaatcagaattggcat

SEQ ID NO: 4991523 - DNA, 15 bp, Homo sapiens
agttctgtaatgtag

SEQ ID NO: 4991524 - DNA, 14 bp, Homo sapiens
agttgttgtttgcc

SEQ ID NO: 4991525 - DNA, 17 bp, Homo sapiens
agttgttgtttgccaag

SEQ ID NO: 4991526 - DNA, 22 bp, Homo sapiens
agttgttgtttgccaagctaat

SEQ ID NO: 4991527 - DNA, 22 bp, Homo sapiens
agtttaaaacatcagaaactga

SEQ ID NO: 4991528 - DNA, 21 bp, Homo sapiens
agtttaagggtggaaaaatgc

SEQ ID NO: 4991529 - DNA, 18 bp, Homo sapiens
agtttcatgtatgtatat

SEQ ID NO: 4991530 - DNA, 13 bp, Homo sapiens
agtttgacactgc

SEQ ID NO: 4991531 - DNA, 16 bp, Homo sapiens
agttttaaaaatgcaa

SEQ ID NO: 4991532 - DNA, 16 bp, Homo sapiens
agttttaacaaattaa

SEQ ID NO: 4991533 - DNA, 15 bp, Homo sapiens
agttttactcttaaa

SEQ ID NO: 4991534 - DNA, 18 bp, Homo sapiens
agttttactcttaaatca

SEQ ID NO: 4991535 - DNA, 15 bp, Homo sapiens
agttttttactttgg

SEQ ID NO: 4991536 - DNA, 12 bp, Homo sapiens
ataaaaatgtaa

SEQ ID NO: 4991537 - DNA, 15 bp, Homo sapiens
ataaaaatgtaaatt

SEQ ID NO: 4991538 - DNA, 20 bp, Homo sapiens
ataaaattgcagtttcatgt

SEQ ID NO: 4991539 - DNA, 13 bp, Homo sapiens
ataaatagaaaga

SEQ ID NO: 4991540 - DNA, 20 bp, Homo sapiens
ataagtctacattaaacaat

SEQ ID NO: 4991541 - DNA, 15 bp, Homo sapiens
cctccttctcccttt

SEQ ID NO: 4991542 - DNA, 10 bp, Homo sapiens
cctctccctg

SEQ ID NO: 4991543 - DNA, 16 bp, Homo sapiens
cctcttatcactaaga

SEQ ID NO: 4991544 - DNA, 17 bp, Homo sapiens
cctgggcagtgagtgcc

SEQ ID NO: 4991545 - DNA, 19 bp, Homo sapiens
cctgggcagtgagtgccat

SEQ ID NO: 4991546 - DNA, 23 bp, Homo sapiens
cctgggcagtgagtgccatgctt

SEQ ID NO: 4991547 - DNA, 16 bp, Homo sapiens
cctgtctcagcctccc

SEQ ID NO: 4991548 - DNA, 17 bp, Homo sapiens
ccttatgtgttacatta

SEQ ID NO: 4991549 - DNA, 19 bp, Homo sapiens
ccttatgtgttacattatt

SEQ ID NO: 4991550 - DNA, 22 bp, Homo sapiens
ccttcctttttattcagctaga

SEQ ID NO: 4991551 - DNA, 16 bp, Homo sapiens
ccttctcctgcccttt

SEQ ID NO: 4991552 - DNA, 21 bp, Homo sapiens
ccttgagggtgcttgttccct

SEQ ID NO: 4991553 - DNA, 15 bp, Homo sapiens
cgagcagtcctgcct

SEQ ID NO: 4991554 - DNA, 17 bp, Homo sapiens
cgagcagtcctgcctca

SEQ ID NO: 4991555 - DNA, 23 bp, Homo sapiens
cgagcagtcctgcctcagcctcc

SEQ ID NO: 4991556 - DNA, 17 bp, Homo sapiens
cgatctcttattttaca

SEQ ID NO: 4991557 - DNA, 14 bp, Homo sapiens
cggtgcaacagaag

SEQ ID NO: 4991558 - DNA, 22 bp, Homo sapiens
cgtatttagactgtggccatat

SEQ ID NO: 4991559 - DNA, 18 bp, Homo sapiens
cgttttgtattgcttcct

SEQ ID NO: 4991560 - DNA, 14 bp, Homo sapiens
ctaaagagtgaatg

SEQ ID NO: 4991561 - DNA, 18 bp, Homo sapiens
ctaaagggagaaatgcca

SEQ ID NO: 4991562 - DNA, 21 bp, Homo sapiens
ctaactgactctgttattgat

SEQ ID NO: 4991563 - DNA, 18 bp, Homo sapiens
ctaagaaagaaaggaaag

SEQ ID NO: 4991564 - DNA, 22 bp, Homo sapiens
ctaagaaagaaaggaaagaagg

SEQ ID NO: 4991565 - DNA, 15 bp, Homo sapiens
ctaagactgcttcta

SEQ ID NO: 4991566 - DNA, 18 bp, Homo sapiens
ctaatatatatgtagaga

SEQ ID NO: 4991567 - DNA, 14 bp, Homo sapiens
ctaattgtatttag

SEQ ID NO: 4991568 - DNA, 14 bp, Homo sapiens
ctacaaaaagaaga

SEQ ID NO: 4991569 - DNA, 13 bp, Homo sapiens
ctacattcttggt

SEQ ID NO: 4991570 - DNA, 21 bp, Homo sapiens
ctacattcttggttgttaatt

SEQ ID NO: 4991571 - DNA, 15 bp, Homo sapiens
ctacctttttatatt

SEQ ID NO: 4991572 - DNA, 15 bp, Homo sapiens
ctactgtagaaagga

SEQ ID NO: 4991573 - DNA, 16 bp, Homo sapiens
ctactgtagaaaggaa

SEQ ID NO: 4991574 - DNA, 21 bp, Homo sapiens
ctagacttgggatctgcaaga

SEQ ID NO: 4991575 - DNA, 20 bp, Homo sapiens
ctagcatttatttctctggc

SEQ ID NO: 4991576 - DNA, 17 bp, Homo sapiens
ctagtgccaaataattg

SEQ ID NO: 4991577 - DNA, 19 bp, Homo sapiens
ctatacctgccttttaagt

SEQ ID NO: 4991578 - DNA, 22 bp, Homo sapiens
ctatagaaatgatcattgcatg

SEQ ID NO: 4991579 - DNA, 13 bp, Homo sapiens
ctatattaaatga

SEQ ID NO: 4991580 - DNA, 17 bp, Homo sapiens
ctatctatacctgcctt

SEQ ID NO: 4991581 - DNA, 23 bp, Homo sapiens
ctatttctgaaagaataggatta

SEQ ID NO: 4991582 - DNA, 15 bp, Homo sapiens
ctcactgttgaattt

SEQ ID NO: 4991583 - DNA, 18 bp, Homo sapiens
ctcatacacagttaaata

SEQ ID NO: 4991584 - DNA, 21 bp, Homo sapiens
ctcatgcaaactgctttattt

SEQ ID NO: 4991585 - DNA, 18 bp, Homo sapiens
ctcattaaactctaaaga

SEQ ID NO: 4991586 - DNA, 18 bp, Homo sapiens
ctcattaaactgattcca

SEQ ID NO: 4991587 - DNA, 18 bp, Homo sapiens
ctcattttcacagcacta

SEQ ID NO: 4991588 - DNA, 23 bp, Homo sapiens
ctccaattctgaaatacttttga

SEQ ID NO: 4991589 - DNA, 22 bp, Homo sapiens
ctcccacccccatctctccctc

SEQ ID NO: 4991590 - DNA, 14 bp, Homo sapiens
ctcccctgccattt

SEQ ID NO: 4991591 - DNA, 24 bp, Homo sapiens
ctcctctccccaatccatgcttca

SEQ ID NO: 4991592 - DNA, 17 bp, Homo sapiens
ctcctgtgcctcccttt

SEQ ID NO: 4991593 - DNA, 23 bp, Homo sapiens
ctcgagcagtcctgcctcagcct

SEQ ID NO: 4991594 - DNA, 23 bp, Homo sapiens
ctctagaaagtatagatggccaa

SEQ ID NO: 4991595 - DNA, 14 bp, Homo sapiens
ctctgctggcccag

SEQ ID NO: 4991596 - DNA, 21 bp, Homo sapiens
ctctgtttttcttctgaaata

SEQ ID NO: 4991597 - DNA, 13 bp, Homo sapiens
ctcttaaatcatt

SEQ ID NO: 4991598 - DNA, 19 bp, Homo sapiens
ctcttatcactaagaaaga

SEQ ID NO: 4991599 - DNA, 20 bp, Homo sapiens
ctcttatcactaagaaagaa

SEQ ID NO: 4991600 - DNA, 21 bp, Homo sapiens
ctcttatcactaagaaagaaa

SEQ ID NO: 4991601 - DNA, 16 bp, Homo sapiens
ctgaaagtcctgcttt

SEQ ID NO: 4991602 - DNA, 13 bp, Homo sapiens
ctgacagcctccc

SEQ ID NO: 4991603 - DNA, 14 bp, Homo sapiens
ctgatctgtacttt

SEQ ID NO: 4991604 - DNA, 17 bp, Homo sapiens
ctgatctgtactttgtg

SEQ ID NO: 4991605 - DNA, 17 bp, Homo sapiens
ctgcaagcatttttcca

SEQ ID NO: 4991606 - DNA, 18 bp, Homo sapiens
ctgcattttcaccccacc

SEQ ID NO: 4991607 - DNA, 23 bp, Homo sapiens
ctgccctttcccaggtaatttaa

SEQ ID NO: 4991608 - DNA, 19 bp, Homo sapiens
ctgcctggttttatttata

SEQ ID NO: 4991609 - DNA, 22 bp, Homo sapiens
ctgcctgtaattaaactagttt

SEQ ID NO: 4991610 - DNA, 20 bp, Homo sapiens
ctgctcattaaactgattcc

SEQ ID NO: 4991611 - DNA, 19 bp, Homo sapiens
ctgctgaaagtcctgcttt

SEQ ID NO: 4991612 - DNA, 20 bp, Homo sapiens
ctgctgaaagtcctgctttc

SEQ ID NO: 4991613 - DNA, 22 bp, Homo sapiens
ctgctggcccagccaaaccctg

SEQ ID NO: 4991614 - DNA, 24 bp, Homo sapiens
ctgctttcctatctagcatttatt

SEQ ID NO: 4991615 - DNA, 23 bp, Homo sapiens
ctggatatccatgagctgcactg

SEQ ID NO: 4991616 - DNA, 17 bp, Homo sapiens
ctggcatatctctgttc

SEQ ID NO: 4991617 - DNA, 17 bp, Homo sapiens
ctggcatcgcagcttcc

SEQ ID NO: 4991618 - DNA, 23 bp, Homo sapiens
ctggcccagccaaaccctgtctg

SEQ ID NO: 4991619 - DNA, 22 bp, Homo sapiens
ctgggcagtgagtgccatgctt

SEQ ID NO: 4991620 - DNA, 21 bp, Homo sapiens
ctggtctcaaactcctgggct

SEQ ID NO: 4991621 - DNA, 16 bp, Homo sapiens
ctggttttatttatat

SEQ ID NO: 4991622 - DNA, 21 bp, Homo sapiens
ctgtaatgtaggcacttttat

SEQ ID NO: 4991623 - DNA, 14 bp, Homo sapiens
ctgtagaaaggaaa

SEQ ID NO: 4991624 - DNA, 15 bp, Homo sapiens
ctgtagaaaggaaat

SEQ ID NO: 4991625 - DNA, 20 bp, Homo sapiens
ctgtataaaaatgtaaatta

SEQ ID NO: 4991626 - DNA, 20 bp, Homo sapiens
ctgtctgacaacctcttggt

SEQ ID NO: 4991627 - DNA, 14 bp, Homo sapiens
ctgtctgtttatat

SEQ ID NO: 4991628 - DNA, 17 bp, Homo sapiens
ctgtgactagatacaga

SEQ ID NO: 4991629 - DNA, 21 bp, Homo sapiens
ctgtgtttttttttttttccc

SEQ ID NO: 4991630 - DNA, 17 bp, Homo sapiens
ctgttactgcttctctt

SEQ ID NO: 4991631 - DNA, 20 bp, Homo sapiens
ctgttactgcttctctttgt

SEQ ID NO: 4991632 - DNA, 17 bp, Homo sapiens
ctgtttttcttctgaaa

SEQ ID NO: 4991633 - DNA, 16 bp, Homo sapiens
cttaaatcatttggtt

SEQ ID NO: 4991634 - DNA, 17 bp, Homo sapiens
cttaaatgagttactta

SEQ ID NO: 4991635 - DNA, 13 bp, Homo sapiens
cttaactgtattt

SEQ ID NO: 4991636 - DNA, 24 bp, Homo sapiens
cttaatggtaggtcaagtaataaa

SEQ ID NO: 4991637 - DNA, 18 bp, Homo sapiens
cttacaagcttaaagctt

SEQ ID NO: 4991638 - DNA, 19 bp, Homo sapiens
cttacaagcttaaagcttg

SEQ ID NO: 4991639 - DNA, 20 bp, Homo sapiens
cttacaagcttaaagcttga

SEQ ID NO: 4991640 - DNA, 18 bp, Homo sapiens
cttagtatagtagaaaga

SEQ ID NO: 4991641 - DNA, 14 bp, Homo sapiens
cttatcactaagaa

SEQ ID NO: 4991642 - DNA, 21 bp, Homo sapiens
cttatgtgttacattattcca

SEQ ID NO: 4991643 - DNA, 15 bp, Homo sapiens
cttcatttttttccc

SEQ ID NO: 4991644 - DNA, 16 bp, Homo sapiens
cttcccacttcttgga

SEQ ID NO: 4991645 - DNA, 17 bp, Homo sapiens
cttcctgtctgtttata

SEQ ID NO: 4991646 - DNA, 13 bp, Homo sapiens
atagatttgaaaa

SEQ ID NO: 4991647 - DNA, 18 bp, Homo sapiens
atagctactgtagaaagg

SEQ ID NO: 4991648 - DNA, 20 bp, Homo sapiens
atagctactgtagaaaggaa

SEQ ID NO: 4991649 - DNA, 17 bp, Homo sapiens
atagtacatcatgtaag

SEQ ID NO: 4991650 - DNA, 12 bp, Homo sapiens
atatatgctgta

SEQ ID NO: 4991651 - DNA, 15 bp, Homo sapiens
atatatgctgtattt

SEQ ID NO: 4991652 - DNA, 18 bp, Homo sapiens
atatatgctgtatttctt

SEQ ID NO: 4991653 - DNA, 15 bp, Homo sapiens
atatatgtagagaaa

SEQ ID NO: 4991654 - DNA, 17 bp, Homo sapiens
atatatgtagagaaaga

SEQ ID NO: 4991655 - DNA, 14 bp, Homo sapiens
atatcttgttatta

SEQ ID NO: 4991656 - DNA, 14 bp, Homo sapiens
atatgattggttca

SEQ ID NO: 4991657 - DNA, 20 bp, Homo sapiens
atatgctgtatttctttgta

SEQ ID NO: 4991658 - DNA, 13 bp, Homo sapiens
atatgtagagaaa

SEQ ID NO: 4991659 - DNA, 16 bp, Homo sapiens
atatgtagagaaagat

SEQ ID NO: 4991660 - DNA, 13 bp, Homo sapiens
atattaaatgagg

SEQ ID NO: 4991661 - DNA, 20 bp, Homo sapiens
atattaaatgagggtttctg

SEQ ID NO: 4991662 - DNA, 14 bp, Homo sapiens
atattcaaggcttt

SEQ ID NO: 4991663 - DNA, 16 bp, Homo sapiens
atattgaaagttgctt

SEQ ID NO: 4991664 - DNA, 19 bp, Homo sapiens
atattgaaagttgctttta

SEQ ID NO: 4991665 - DNA, 21 bp, Homo sapiens
atattgaaagttgcttttatt

SEQ ID NO: 4991666 - DNA, 22 bp, Homo sapiens
atatttaaaaaattaaaaatga

SEQ ID NO: 4991667 - DNA, 22 bp, Homo sapiens
atcacagatttgctaataatgt

SEQ ID NO: 4991668 - DNA, 18 bp, Homo sapiens
atcacatctaaagcttta

SEQ ID NO: 4991669 - DNA, 12 bp, Homo sapiens
atcactaagaaa

SEQ ID NO: 4991670 - DNA, 16 bp, Homo sapiens
atcactaagaaagaaa

SEQ ID NO: 4991671 - DNA, 17 bp, Homo sapiens
atcatgctcatgtatat

SEQ ID NO: 4991672 - DNA, 18 bp, Homo sapiens
atcatttggcttgctgtt

SEQ ID NO: 4991673 - DNA, 21 bp, Homo sapiens
atccacctgtctcagcctccc

SEQ ID NO: 4991674 - DNA, 10 bp, Homo sapiens
atccatgctt

SEQ ID NO: 4991675 - DNA, 22 bp, Homo sapiens
atcctgctgaaagtcctgcttt

SEQ ID NO: 4991676 - DNA, 20 bp, Homo sapiens
atcgcagcttcctgtctgtt

SEQ ID NO: 4991677 - DNA, 14 bp, Homo sapiens
atctaaagctttat

SEQ ID NO: 4991678 - DNA, 17 bp, Homo sapiens
atctaaagctttatctt

SEQ ID NO: 4991679 - DNA, 23 bp, Homo sapiens
atctaagtatatgtgagaaatca

SEQ ID NO: 4991680 - DNA, 12 bp, Homo sapiens
atctaataatga

SEQ ID NO: 4991681 - DNA, 16 bp, Homo sapiens
atctagcatttatttc

SEQ ID NO: 4991682 - DNA, 14 bp, Homo sapiens
atctatattaaatg

SEQ ID NO: 4991683 - DNA, 16 bp, Homo sapiens
atctatattaaatgag

SEQ ID NO: 4991684 - DNA, 23 bp, Homo sapiens
atctcaccccatcccacaccctg

SEQ ID NO: 4991685 - DNA, 14 bp, Homo sapiens
atctcctctgctca

SEQ ID NO: 4991686 - DNA, 21 bp, Homo sapiens
atctgtactttgtgtttagct

SEQ ID NO: 4991687 - DNA, 17 bp, Homo sapiens
atctgtataaaaatgta

SEQ ID NO: 4991688 - DNA, 19 bp, Homo sapiens
atctgtataaaaatgtaaa

SEQ ID NO: 4991689 - DNA, 21 bp, Homo sapiens
atctgtgaaatgctggcattt

SEQ ID NO: 4991690 - DNA, 17 bp, Homo sapiens
atctgtgtaaaatctga

SEQ ID NO: 4991691 - DNA, 19 bp, Homo sapiens
atcttgttattaatgtttc

SEQ ID NO: 4991692 - DNA, 19 bp, Homo sapiens
atctttaactgaactctga

SEQ ID NO: 4991693 - DNA, 12 bp, Homo sapiens
atctttgtgtaa

SEQ ID NO: 4991694 - DNA, 16 bp, Homo sapiens
atgaagtataaatctg

SEQ ID NO: 4991695 - DNA, 22 bp, Homo sapiens
atgagatttactgctctagaaa

SEQ ID NO: 4991696 - DNA, 18 bp, Homo sapiens
atgagttacttagaatgc

SEQ ID NO: 4991697 - DNA, 17 bp, Homo sapiens
atgatacccaacagttt

SEQ ID NO: 4991698 - DNA, 19 bp, Homo sapiens
atgatcacaactgagatca

SEQ ID NO: 4991699 - DNA, 17 bp, Homo sapiens
atgcaaactgctttatt

SEQ ID NO: 4991700 - DNA, 16 bp, Homo sapiens
atgcatatatgaaaac

SEQ ID NO: 4991701 - DNA, 19 bp, Homo sapiens
atgcatttatcaataaaag

SEQ ID NO: 4991702 - DNA, 23 bp, Homo sapiens
atgccataaaattgcagtttcat

SEQ ID NO: 4991703 - DNA, 13 bp, Homo sapiens
atgctattaagaa

SEQ ID NO: 4991704 - DNA, 16 bp, Homo sapiens
atgctattaagaaggc

SEQ ID NO: 4991705 - DNA, 17 bp, Homo sapiens
atgctattaagaaggca

SEQ ID NO: 4991706 - DNA, 12 bp, Homo sapiens
atgctcatgtat

SEQ ID NO: 4991707 - DNA, 12 bp, Homo sapiens
atgctgtatttc

SEQ ID NO: 4991708 - DNA, 13 bp, Homo sapiens
atgctgtatttct

SEQ ID NO: 4991709 - DNA, 18 bp, Homo sapiens
atgctgtatttctttgta

SEQ ID NO: 4991710 - DNA, 21 bp, Homo sapiens
atgctgtatttctttgtagaa

SEQ ID NO: 4991711 - DNA, 16 bp, Homo sapiens
atggaaagaaggaaaa

SEQ ID NO: 4991712 - DNA, 12 bp, Homo sapiens
atggaagaaaga

SEQ ID NO: 4991713 - DNA, 14 bp, Homo sapiens
atggaagaaagaag

SEQ ID NO: 4991714 - DNA, 22 bp, Homo sapiens
atggcaactgtattaaagaaaa

SEQ ID NO: 4991715 - DNA, 17 bp, Homo sapiens
atgggtggtaacaagag

SEQ ID NO: 4991716 - DNA, 22 bp, Homo sapiens
atggtagggtataatgtgtctg

SEQ ID NO: 4991717 - DNA, 17 bp, Homo sapiens
atgtaaattagtttgac

SEQ ID NO: 4991718 - DNA, 22 bp, Homo sapiens
atgtaatagtcttgcagaaaat

SEQ ID NO: 4991719 - DNA, 19 bp, Homo sapiens
atgtacatactgaaaaata

SEQ ID NO: 4991720 - DNA, 14 bp, Homo sapiens
atgtacttaaatga

SEQ ID NO: 4991721 - DNA, 20 bp, Homo sapiens
atgtagttttaaataaagtt

SEQ ID NO: 4991722 - DNA, 21 bp, Homo sapiens
atgtatataatcatgctcatg

SEQ ID NO: 4991723 - DNA, 17 bp, Homo sapiens
atgtccttcagctgact

SEQ ID NO: 4991724 - DNA, 14 bp, Homo sapiens
tgtactgaagaaca

SEQ ID NO: 4991725 - DNA, 20 bp, Homo sapiens
tgtacttaaatgagttactt

SEQ ID NO: 4991726 - DNA, 22 bp, Homo sapiens
tgtacttaaatgagttacttag

SEQ ID NO: 4991727 - DNA, 23 bp, Homo sapiens
tgtagaaaggaaatagactttgt

SEQ ID NO: 4991728 - DNA, 14 bp, Homo sapiens
tgtagaataaatgg

SEQ ID NO: 4991729 - DNA, 22 bp, Homo sapiens
tgtagaataaatggtttctcat

SEQ ID NO: 4991730 - DNA, 21 bp, Homo sapiens
tgtagttttaaataaagtttg

SEQ ID NO: 4991731 - DNA, 15 bp, Homo sapiens
tgtataaaaatgtaa

SEQ ID NO: 4991732 - DNA, 19 bp, Homo sapiens
tgtataaaaatgtaaatta

SEQ ID NO: 4991733 - DNA, 22 bp, Homo sapiens
tgtataaaaatgtaaattagtt

SEQ ID NO: 4991734 - DNA, 21 bp, Homo sapiens
tgtatataatcatgctcatgt

SEQ ID NO: 4991735 - DNA, 18 bp, Homo sapiens
tgtattatcaatgaaaat

SEQ ID NO: 4991736 - DNA, 19 bp, Homo sapiens
tgtattgagtcttaactgt

SEQ ID NO: 4991737 - DNA, 14 bp, Homo sapiens
tgtatttctttgta

SEQ ID NO: 4991738 - DNA, 19 bp, Homo sapiens
tgtcaagtctctgctggcc

SEQ ID NO: 4991739 - DNA, 13 bp, Homo sapiens
tgtccagttataa

SEQ ID NO: 4991740 - DNA, 14 bp, Homo sapiens
tgtcctttctgaac

SEQ ID NO: 4991741 - DNA, 16 bp, Homo sapiens
tgtctatttctgaaag

SEQ ID NO: 4991742 - DNA, 15 bp, Homo sapiens
tgtctcagcctccca

SEQ ID NO: 4991743 - DNA, 15 bp, Homo sapiens
tgtctcttctatgta

SEQ ID NO: 4991744 - DNA, 20 bp, Homo sapiens
tgtctgtgttgcttcaaatt

SEQ ID NO: 4991745 - DNA, 13 bp, Homo sapiens
tgtcttagttgat

SEQ ID NO: 4991746 - DNA, 21 bp, Homo sapiens
tgtcttcagaggctcatctaa

SEQ ID NO: 4991747 - DNA, 22 bp, Homo sapiens
tgtcttcagaggctcatctaac

SEQ ID NO: 4991748 - DNA, 18 bp, Homo sapiens
tgtctttttctagacttg

SEQ ID NO: 4991749 - DNA, 14 bp, Homo sapiens
tgtgaaatgctggc

SEQ ID NO: 4991750 - DNA, 15 bp, Homo sapiens
tgtgtcctttctgaa

SEQ ID NO: 4991751 - DNA, 14 bp, Homo sapiens
tgtgtctatttctg

SEQ ID NO: 4991752 - DNA, 20 bp, Homo sapiens
tgttacaaattttttaattt

SEQ ID NO: 4991753 - DNA, 13 bp, Homo sapiens
tgttacaggcttg

SEQ ID NO: 4991754 - DNA, 12 bp, Homo sapiens
tgttacattatt

SEQ ID NO: 4991755 - DNA, 14 bp, Homo sapiens
tgttacattattcc

SEQ ID NO: 4991756 - DNA, 15 bp, Homo sapiens
tgttactgcttctct

SEQ ID NO: 4991757 - DNA, 18 bp, Homo sapiens
tgttatagattgtcttaa

SEQ ID NO: 4991758 - DNA, 20 bp, Homo sapiens
tgttatagattgtcttaatg

SEQ ID NO: 4991759 - DNA, 21 bp, Homo sapiens
tgttattaatgtttcttctcc

SEQ ID NO: 4991760 - DNA, 22 bp, Homo sapiens
tgttattgatcccttctcctgc

SEQ ID NO: 4991761 - DNA, 18 bp, Homo sapiens
tgttccctctccctgttg

SEQ ID NO: 4991762 - DNA, 13 bp, Homo sapiens
tgtttaaatgcca

SEQ ID NO: 4991763 - DNA, 20 bp, Homo sapiens
tgtttagctacctttttata

SEQ ID NO: 4991764 - DNA, 14 bp, Homo sapiens
tgtttcttctccaa

SEQ ID NO: 4991765 - DNA, 16 bp, Homo sapiens
ttaaaaatgaaaatta

SEQ ID NO: 4991766 - DNA, 19 bp, Homo sapiens
ttaaaacatcagaaactga

SEQ ID NO: 4991767 - DNA, 22 bp, Homo sapiens
ttaaaatgtagttttaaataaa

SEQ ID NO: 4991768 - DNA, 23 bp, Homo sapiens
ttaaaatgtagttttaaataaag

SEQ ID NO: 4991769 - DNA, 18 bp, Homo sapiens
ttaaacaaaatttcacag

SEQ ID NO: 4991770 - DNA, 16 bp, Homo sapiens
ttaaactagtttaagg

SEQ ID NO: 4991771 - DNA, 19 bp, Homo sapiens
ttaaagcttgatttgatct

SEQ ID NO: 4991772 - DNA, 18 bp, Homo sapiens
ttaaagtaaacttgtgta

SEQ ID NO: 4991773 - DNA, 21 bp, Homo sapiens
ttaaatgagggtttctgatct

SEQ ID NO: 4991774 - DNA, 13 bp, Homo sapiens
ttaactaaatgct

SEQ ID NO: 4991775 - DNA, 14 bp, Homo sapiens
ttaactgtatttca

SEQ ID NO: 4991776 - DNA, 19 bp, Homo sapiens
ttaactgtatttcagtatt

SEQ ID NO: 4991777 - DNA, 17 bp, Homo sapiens
ttaactttgcaaaaaga

SEQ ID NO: 4991778 - DNA, 16 bp, Homo sapiens
ttaagccttgacacac

SEQ ID NO: 4991779 - DNA, 19 bp, Homo sapiens
ttaagccttgacacactgt

SEQ ID NO: 4991780 - DNA, 17 bp, Homo sapiens
ttacaagcttaaagctt

SEQ ID NO: 4991781 - DNA, 21 bp, Homo sapiens
ttactcttaaatcatttggtt

SEQ ID NO: 4991782 - DNA, 17 bp, Homo sapiens
ttactgctctagaaagt

SEQ ID NO: 4991783 - DNA, 13 bp, Homo sapiens
ttactttggttta

SEQ ID NO: 4991784 - DNA, 12 bp, Homo sapiens
ttagaatgccat

SEQ ID NO: 4991785 - DNA, 20 bp, Homo sapiens
ttagatgctattaagaaggc

SEQ ID NO: 4991786 - DNA, 19 bp, Homo sapiens
ttagtatagtagaaagaca

SEQ ID NO: 4991787 - DNA, 20 bp, Homo sapiens
ttagtatagtagaaagacat

SEQ ID NO: 4991788 - DNA, 17 bp, Homo sapiens
ttagtatctaataatga

SEQ ID NO: 4991789 - DNA, 20 bp, Homo sapiens
ttagttacgtataatgcttt

SEQ ID NO: 4991790 - DNA, 17 bp, Homo sapiens
ttagtttacaatcagcc

SEQ ID NO: 4991791 - DNA, 21 bp, Homo sapiens
ttataatcagggaaactaatt

SEQ ID NO: 4991792 - DNA, 15 bp, Homo sapiens
ttatagattgtctta

SEQ ID NO: 4991793 - DNA, 23 bp, Homo sapiens
ttatatattgaaagttgctttta

SEQ ID NO: 4991794 - DNA, 16 bp, Homo sapiens
ttatcaataaaagcct

SEQ ID NO: 4991795 - DNA, 16 bp, Homo sapiens
ttatcactaagaaaga

SEQ ID NO: 4991796 - DNA, 12 bp, Homo sapiens
ttatgtgttaca

SEQ ID NO: 4991797 - DNA, 14 bp, Homo sapiens
ttattaatgtttct

SEQ ID NO: 4991798 - DNA, 13 bp, Homo sapiens
ttatttacatttt

SEQ ID NO: 4991799 - DNA, 13 bp, Homo sapiens
ttatttataaaat

SEQ ID NO: 4991800 - DNA, 21 bp, Homo sapiens
ttatttctctggcaaactttt

SEQ ID NO: 4991801 - DNA, 13 bp, Homo sapiens
ttattttcattgt

SEQ ID NO: 4991802 - DNA, 19 bp, Homo sapiens
ttcaaggctttaaaagtca

SEQ ID NO: 4991803 - DNA, 16 bp, Homo sapiens
ttcacagttctgtaat

SEQ ID NO: 4991804 - DNA, 13 bp, Homo sapiens
ttcaccccaccct

SEQ ID NO: 4991805 - DNA, 21 bp, Homo sapiens
ttcactcatgcaaactgcttt

SEQ ID NO: 4991806 - DNA, 19 bp, Homo sapiens
ttcactggggcatgagatt

SEQ ID NO: 4991807 - DNA, 13 bp, Homo sapiens
ttcagtattttcc

SEQ ID NO: 4991808 - DNA, 21 bp, Homo sapiens
ttcagtgtcgggaattttccc

SEQ ID NO: 4991809 - DNA, 23 bp, Homo sapiens
ttcagtgtcgggaattttccccg

SEQ ID NO: 4991810 - DNA, 19 bp, Homo sapiens
ttcagtttttttttttcca

SEQ ID NO: 4991811 - DNA, 19 bp, Homo sapiens
ttcatgccaccatggccag

SEQ ID NO: 4991812 - DNA, 23 bp, Homo sapiens
ttccccactgacagcctcccacc

SEQ ID NO: 4991813 - DNA, 17 bp, Homo sapiens
ttcccctccttctccct

SEQ ID NO: 4991814 - DNA, 14 bp, Homo sapiens
ttccctctccctgt

SEQ ID NO: 4991815 - DNA, 23 bp, Homo sapiens
ttcctgattaccagtctgattat

SEQ ID NO: 4991816 - DNA, 16 bp, Homo sapiens
ttcctgtctgtttata

SEQ ID NO: 4991817 - DNA, 17 bp, Homo sapiens
ttcctgtctgtttatat

SEQ ID NO: 4991818 - DNA, 13 bp, Homo sapiens
ttccttaatagcc

SEQ ID NO: 4991819 - DNA, 15 bp, Homo sapiens
ttctatggagacttt

SEQ ID NO: 4991820 - DNA, 13 bp, Homo sapiens
ttctcattaaact

SEQ ID NO: 4991821 - DNA, 14 bp, Homo sapiens
ttctcattaaactc

SEQ ID NO: 4991822 - DNA, 21 bp, Homo sapiens
ttctccaattctgaaatactt

SEQ ID NO: 4991823 - DNA, 21 bp, Homo sapiens
ttctctaacttcaaggcccat

SEQ ID NO: 4991824 - DNA, 16 bp, Homo sapiens
ttctctggcaaacttt

SEQ ID NO: 4991825 - DNA, 23 bp, Homo sapiens
ttctctgtttttcttctgaaata

SEQ ID NO: 4991826 - DNA, 16 bp, Homo sapiens
ttctgatctgtacttt

SEQ ID NO: 4991827 - DNA, 20 bp, Homo sapiens
ttctgtagtttttaattaaa

SEQ ID NO: 4991828 - DNA, 16 bp, Homo sapiens
ttcttacaagcttaaa

SEQ ID NO: 4991829 - DNA, 19 bp, Homo sapiens
ttcttacaagcttaaagct

SEQ ID NO: 4991830 - DNA, 20 bp, Homo sapiens
ttcttacaagcttaaagctt

SEQ ID NO: 4991831 - DNA, 14 bp, Homo sapiens
ttcttggattttta

SEQ ID NO: 4991832 - DNA, 16 bp, Homo sapiens
ttcttggttgttaatt

SEQ ID NO: 4991833 - DNA, 12 bp, Homo sapiens
ttgaaaaacttt

SEQ ID NO: 4991834 - DNA, 13 bp, Homo sapiens
ttgaaaaactttt

SEQ ID NO: 4991835 - DNA, 13 bp, Homo sapiens
ttgaaaacaaaga

SEQ ID NO: 4991836 - DNA, 20 bp, Homo sapiens
ttgagtcttaactgtatttc

SEQ ID NO: 4991837 - DNA, 14 bp, Homo sapiens
ttgcaccattttca

SEQ ID NO: 4991838 - DNA, 17 bp, Homo sapiens
ttgcacctacctcacag

SEQ ID NO: 4991839 - DNA, 21 bp, Homo sapiens
ccatatatgctgtatttcttt

SEQ ID NO: 4991840 - DNA, 23 bp, Homo sapiens
ccatatatgctgtatttctttgt

SEQ ID NO: 4991841 - DNA, 12 bp, Homo sapiens
ccatcccacacc

SEQ ID NO: 4991842 - DNA, 23 bp, Homo sapiens
ccatctctccctcccctgccatt

SEQ ID NO: 4991843 - DNA, 16 bp, Homo sapiens
cccaacagcctctgtg

SEQ ID NO: 4991844 - DNA, 12 bp, Homo sapiens
cccacccccatc

SEQ ID NO: 4991845 - DNA, 16 bp, Homo sapiens
cccactgacagcctcc

SEQ ID NO: 4991846 - DNA, 13 bp, Homo sapiens
cccatcccacacc

SEQ ID NO: 4991847 - DNA, 20 bp, Homo sapiens
cccatttttatatcgatctc

SEQ ID NO: 4991848 - DNA, 17 bp, Homo sapiens
cccatttttgctaatta

SEQ ID NO: 4991849 - DNA, 22 bp, Homo sapiens
cccatttttgctaattatcaat

SEQ ID NO: 4991850 - DNA, 15 bp, Homo sapiens
ccccactgacagcct

SEQ ID NO: 4991851 - DNA, 21 bp, Homo sapiens
ccccactgacagcctcccacc

SEQ ID NO: 4991852 - DNA, 16 bp, Homo sapiens
ccccatctctccctcc

SEQ ID NO: 4991853 - DNA, 19 bp, Homo sapiens
ccccatctctccctcccct

SEQ ID NO: 4991854 - DNA, 18 bp, Homo sapiens
ccctggcatatctctgtt

SEQ ID NO: 4991855 - DNA, 23 bp, Homo sapiens
ccggctcgagcagtcctgcctca

SEQ ID NO: 4991856 - DNA, 22 bp, Homo sapiens
cctaaaaggaaatctcacccca

SEQ ID NO: 4991857 - DNA, 22 bp, Homo sapiens
cctatctagcatttatttctct

SEQ ID NO: 4991858 - DNA, 16 bp, Homo sapiens
cctcactgttgaattt

SEQ ID NO: 4991859 - DNA, 12 bp, Homo sapiens
cctcagcctccg

SEQ ID NO: 4991860 - DNA, 18 bp, Homo sapiens
cctcctgtgcctcccttt

SEQ ID NO: 4991861 - DNA, 16 bp, Homo sapiens
cctccttctccctttt

SEQ ID NO: 4991862 - DNA, 22 bp, Homo sapiens
cctctccccaatccatgcttca

SEQ ID NO: 4991863 - DNA, 13 bp, Homo sapiens
cctctccctgttg

SEQ ID NO: 4991864 - DNA, 20 bp, Homo sapiens
cctctgctcattaaactgat

SEQ ID NO: 4991865 - DNA, 19 bp, Homo sapiens
cctcttatcactaagaaag

SEQ ID NO: 4991866 - DNA, 20 bp, Homo sapiens
cctgattaccagtctgatta

SEQ ID NO: 4991867 - DNA, 17 bp, Homo sapiens
cctgcagtcacccctgc

SEQ ID NO: 4991868 - DNA, 14 bp, Homo sapiens
cctgcctcagcctc

SEQ ID NO: 4991869 - DNA, 16 bp, Homo sapiens
cctggaggatttcatc

SEQ ID NO: 4991870 - DNA, 20 bp, Homo sapiens
cctgggcttggtaagtgaat

SEQ ID NO: 4991871 - DNA, 18 bp, Homo sapiens
cctgtaatcccagcactt

SEQ ID NO: 4991872 - DNA, 13 bp, Homo sapiens
cctgtctcagcct

SEQ ID NO: 4991873 - DNA, 18 bp, Homo sapiens
cctgtgcctcccttttct

SEQ ID NO: 4991874 - DNA, 14 bp, Homo sapiens
ccttgacacactgt

SEQ ID NO: 4991875 - DNA, 19 bp, Homo sapiens
cctttttatatttaaaaaa

SEQ ID NO: 4991876 - DNA, 21 bp, Homo sapiens
cgagcagtcctgcctcagcct

SEQ ID NO: 4991877 - DNA, 18 bp, Homo sapiens
cggacaaagttcagtgtc

SEQ ID NO: 4991878 - DNA, 16 bp, Homo sapiens
cgtataatgctttctg

SEQ ID NO: 4991879 - DNA, 17 bp, Homo sapiens
cgtataatgctttctga

SEQ ID NO: 4991880 - DNA, 13 bp, Homo sapiens
cgtgatcttggct

SEQ ID NO: 4991881 - DNA, 15 bp, Homo sapiens
cgtttggttaaagta

SEQ ID NO: 4991882 - DNA, 19 bp, Homo sapiens
cgtttggttaaagtatgtc

SEQ ID NO: 4991883 - DNA, 21 bp, Homo sapiens
ctaaaacagacaataatttaa

SEQ ID NO: 4991884 - DNA, 14 bp, Homo sapiens
ctaaagctttatct

SEQ ID NO: 4991885 - DNA, 22 bp, Homo sapiens
ctaaagctttatctttgtgtaa

SEQ ID NO: 4991886 - DNA, 19 bp, Homo sapiens
ctaaagggagaaatgccag

SEQ ID NO: 4991887 - DNA, 15 bp, Homo sapiens
ctaaatgctcataca

SEQ ID NO: 4991888 - DNA, 17 bp, Homo sapiens
ctaacatggtaaaaccc

SEQ ID NO: 4991889 - DNA, 16 bp, Homo sapiens
ctaactgactctgtta

SEQ ID NO: 4991890 - DNA, 17 bp, Homo sapiens
ctaagaaagaaaggaaa

SEQ ID NO: 4991891 - DNA, 12 bp, Homo sapiens
ctaatatacttt

SEQ ID NO: 4991892 - DNA, 13 bp, Homo sapiens
ctaatatactttt

SEQ ID NO: 4991893 - DNA, 23 bp, Homo sapiens
ctaatatactttttttgttatag

SEQ ID NO: 4991894 - DNA, 19 bp, Homo sapiens
ctaatctgcctggttttat

SEQ ID NO: 4991895 - DNA, 15 bp, Homo sapiens
ctacaaaaagaagag

SEQ ID NO: 4991896 - DNA, 13 bp, Homo sapiens
ctacatctgcctc

SEQ ID NO: 4991897 - DNA, 17 bp, Homo sapiens
ctactgtagaaaggaaa

SEQ ID NO: 4991898 - DNA, 22 bp, Homo sapiens
ctactgtagaaaggaaatagac

SEQ ID NO: 4991899 - DNA, 13 bp, Homo sapiens
ctagacttgggat

SEQ ID NO: 4991900 - DNA, 15 bp, Homo sapiens
ctagcatttatttct

SEQ ID NO: 4991901 - DNA, 14 bp, Homo sapiens
ctatattaaatgag

SEQ ID NO: 4991902 - DNA, 19 bp, Homo sapiens
ctatctagcatttatttct

SEQ ID NO: 4991903 - DNA, 16 bp, Homo sapiens
ctcaatataaaaacat

SEQ ID NO: 4991904 - DNA, 17 bp, Homo sapiens
ctcacagtgttgcccag

SEQ ID NO: 4991905 - DNA, 12 bp, Homo sapiens
ctcaccccatcc

SEQ ID NO: 4991906 - DNA, 22 bp, Homo sapiens
ctcaccccatcccacaccctgg

SEQ ID NO: 4991907 - DNA, 20 bp, Homo sapiens
ctcaggcgatccacctgtct

SEQ ID NO: 4991908 - DNA, 21 bp, Homo sapiens
ctcaggcgatccacctgtctc

SEQ ID NO: 4991909 - DNA, 16 bp, Homo sapiens
ctcatgcaaactgctt

SEQ ID NO: 4991910 - DNA, 20 bp, Homo sapiens
ctccaattctgaaatacttt

SEQ ID NO: 4991911 - DNA, 21 bp, Homo sapiens
ctccacttcttgttccccact

SEQ ID NO: 4991912 - DNA, 19 bp, Homo sapiens
ctccccaatccatgcttca

SEQ ID NO: 4991913 - DNA, 18 bp, Homo sapiens
ctccccatggtagtttaa

SEQ ID NO: 4991914 - DNA, 14 bp, Homo sapiens
ctccctcccctgcc

SEQ ID NO: 4991915 - DNA, 15 bp, Homo sapiens
ctcccttttctcctc

SEQ ID NO: 4991916 - DNA, 13 bp, Homo sapiens
ctccttctccctt

SEQ ID NO: 4991917 - DNA, 17 bp, Homo sapiens
ctcgctttgttgcccag

SEQ ID NO: 4991918 - DNA, 19 bp, Homo sapiens
ctctccccaatccatgctt

SEQ ID NO: 4991919 - DNA, 13 bp, Homo sapiens
ctctccctcccct

SEQ ID NO: 4991920 - DNA, 12 bp, Homo sapiens
ctctccctgttg

SEQ ID NO: 4991921 - DNA, 19 bp, Homo sapiens
ctctgtttttcttctgaaa

SEQ ID NO: 4991922 - DNA, 20 bp, Homo sapiens
ctctgtttttcttctgaaat

SEQ ID NO: 4991923 - DNA, 14 bp, Homo sapiens
ctcttaaatcattt

SEQ ID NO: 4991924 - DNA, 17 bp, Homo sapiens
ctcttctatgtattttg

SEQ ID NO: 4991925 - DNA, 14 bp, Homo sapiens
ctctttgtgcagtg

SEQ ID NO: 4991926 - DNA, 18 bp, Homo sapiens
ctgaaagaataggattaa

SEQ ID NO: 4991927 - DNA, 19 bp, Homo sapiens
ctgaaagtcctgctttcct

SEQ ID NO: 4991928 - DNA, 21 bp, Homo sapiens
ctgaattgagaataagaattt

SEQ ID NO: 4991929 - DNA, 12 bp, Homo sapiens
ctgacagcctcc

SEQ ID NO: 4991930 - DNA, 17 bp, Homo sapiens
ctgacagcctcccaccc

SEQ ID NO: 4991931 - DNA, 20 bp, Homo sapiens
ctgacagcctcccaccccca

SEQ ID NO: 4991932 - DNA, 14 bp, Homo sapiens
ctgactctgttatt

SEQ ID NO: 4991933 - DNA, 16 bp, Homo sapiens
ctgagtgagttttact

SEQ ID NO: 4991934 - DNA, 18 bp, Homo sapiens
ctgatctgtactttgtgt

SEQ ID NO: 4991935 - DNA, 20 bp, Homo sapiens
ctgatctgtataaaaatgta

SEQ ID NO: 4991936 - DNA, 19 bp, Homo sapiens
ctgattataccatgtgtgc

SEQ ID NO: 4991937 - DNA, 20 bp, Homo sapiens
ctgcaagcacatctgcattt

SEQ ID NO: 4991938 - DNA, 18 bp, Homo sapiens
ctgcaagcatttttccat

SEQ ID NO: 4991939 - DNA, 20 bp, Homo sapiens
ctgcagcctttgcctccccg

SEQ ID NO: 4991940 - DNA, 21 bp, Homo sapiens
ctgctaaagggagaaatgcca

SEQ ID NO: 4991941 - DNA, 12 bp, Homo sapiens
ctgctcactttt

SEQ ID NO: 4991942 - DNA, 19 bp, Homo sapiens
ctgctctagaaagtataga

SEQ ID NO: 4991943 - DNA, 16 bp, Homo sapiens
ctggcatcgcagcttc

SEQ ID NO: 4991944 - DNA, 19 bp, Homo sapiens
ctggccttgaaaccacctt

SEQ ID NO: 4991945 - DNA, 14 bp, Homo sapiens
ctgggttcatttgt

SEQ ID NO: 4991946 - DNA, 15 bp, Homo sapiens
ctggtgttataatac

SEQ ID NO: 4991947 - DNA, 22 bp, Homo sapiens
ctggtgttataatacgctgctg

SEQ ID NO: 4991948 - DNA, 21 bp, Homo sapiens
ctgtaattaaactagtttaag

SEQ ID NO: 4991949 - DNA, 16 bp, Homo sapiens
ctgtactttgtgttta

SEQ ID NO: 4991950 - DNA, 20 bp, Homo sapiens
ctgtagaaaggaaatagact

SEQ ID NO: 4991951 - DNA, 16 bp, Homo sapiens
ctgtataaaaatgtaa

SEQ ID NO: 4991952 - DNA, 14 bp, Homo sapiens
ctgtattaaagaaa

SEQ ID NO: 4991953 - DNA, 15 bp, Homo sapiens
ctgtattaaagaaaa

SEQ ID NO: 4991954 - DNA, 16 bp, Homo sapiens
tatagattgtcttaat

SEQ ID NO: 4991955 - DNA, 21 bp, Homo sapiens
tatagtagaaagacatctgcc

SEQ ID NO: 4991956 - DNA, 23 bp, Homo sapiens
tatagtagaaagacatctgcctg

SEQ ID NO: 4991957 - DNA, 24 bp, Homo sapiens
tatagtagaaagacatctgcctgt

SEQ ID NO: 4991958 - DNA, 17 bp, Homo sapiens
tatataatcatgctcat

SEQ ID NO: 4991959 - DNA, 19 bp, Homo sapiens
tatatattgaaagttgctt

SEQ ID NO: 4991960 - DNA, 22 bp, Homo sapiens
tatatgaaaacaatactaaata

SEQ ID NO: 4991961 - DNA, 19 bp, Homo sapiens
tatatgctgtatttctttg

SEQ ID NO: 4991962 - DNA, 14 bp, Homo sapiens
tatatgtagagaaa

SEQ ID NO: 4991963 - DNA, 15 bp, Homo sapiens
tatatgtagagaaag

SEQ ID NO: 4991964 - DNA, 12 bp, Homo sapiens
tatattaaatga

SEQ ID NO: 4991965 - DNA, 22 bp, Homo sapiens
tatatttagttacgtataatgc

SEQ ID NO: 4991966 - DNA, 16 bp, Homo sapiens
tatcactaagaaagaa

SEQ ID NO: 4991967 - DNA, 15 bp, Homo sapiens
tatctatacctgcct

SEQ ID NO: 4991968 - DNA, 19 bp, Homo sapiens
tatctgtgaaatgctggca

SEQ ID NO: 4991969 - DNA, 15 bp, Homo sapiens
tatcttgttattaat

SEQ ID NO: 4991970 - DNA, 14 bp, Homo sapiens
tatgaagtataaat

SEQ ID NO: 4991971 - DNA, 17 bp, Homo sapiens
tatgaagtataaatctg

SEQ ID NO: 4991972 - DNA, 13 bp, Homo sapiens
tatgagatttact

SEQ ID NO: 4991973 - DNA, 13 bp, Homo sapiens
tatgataataatc

SEQ ID NO: 4991974 - DNA, 14 bp, Homo sapiens
tatgctgtatttct

SEQ ID NO: 4991975 - DNA, 19 bp, Homo sapiens
tatgctgtatttctttgta

SEQ ID NO: 4991976 - DNA, 21 bp, Homo sapiens
tatggagactttgctgttact

SEQ ID NO: 4991977 - DNA, 22 bp, Homo sapiens
tatggctatctatacctgcctt

SEQ ID NO: 4991978 - DNA, 20 bp, Homo sapiens
tatgtgagaaatcagaattg

SEQ ID NO: 4991979 - DNA, 13 bp, Homo sapiens
tattaaagaaaaa

SEQ ID NO: 4991980 - DNA, 16 bp, Homo sapiens
tattaatgtttcttct

SEQ ID NO: 4991981 - DNA, 23 bp, Homo sapiens
tattgatcccttctcctgccctt

SEQ ID NO: 4991982 - DNA, 19 bp, Homo sapiens
tattgatgcagacaaatga

SEQ ID NO: 4991983 - DNA, 14 bp, Homo sapiens
tatttaaaaaatta

SEQ ID NO: 4991984 - DNA, 14 bp, Homo sapiens
tatttagtgacaaa

SEQ ID NO: 4991985 - DNA, 21 bp, Homo sapiens
tcaaatcatgtacatttgaaa

SEQ ID NO: 4991986 - DNA, 17 bp, Homo sapiens
tcaagtaataaaaagag

SEQ ID NO: 4991987 - DNA, 17 bp, Homo sapiens
tcaagtctctgctggcc

SEQ ID NO: 4991988 - DNA, 21 bp, Homo sapiens
tcaataaaagcctttgaaaat

SEQ ID NO: 4991989 - DNA, 15 bp, Homo sapiens
tcaatataaaaacat

SEQ ID NO: 4991990 - DNA, 22 bp, Homo sapiens
tcacatctaaagctttatcttt

SEQ ID NO: 4991991 - DNA, 15 bp, Homo sapiens
tcacctctgtacaga

SEQ ID NO: 4991992 - DNA, 13 bp, Homo sapiens
tcactaagaaaga

SEQ ID NO: 4991993 - DNA, 14 bp, Homo sapiens
tcactaagaaagaa

SEQ ID NO: 4991994 - DNA, 15 bp, Homo sapiens
tcactacaaaaagaa

SEQ ID NO: 4991995 - DNA, 18 bp, Homo sapiens
tcactacaaaaagaagag

SEQ ID NO: 4991996 - DNA, 13 bp, Homo sapiens
tcactacaagctt

SEQ ID NO: 4991997 - DNA, 23 bp, Homo sapiens
tcactcatgcaaactgctttatt

SEQ ID NO: 4991998 - DNA, 20 bp, Homo sapiens
tcactggggcatgagatttt

SEQ ID NO: 4991999 - DNA, 15 bp, Homo sapiens
tcagatgctgaattg

SEQ ID NO: 4992000 - DNA, 16 bp, Homo sapiens
tcagatgctgaattga

SEQ ID NO: 4992001 - DNA, 20 bp, Homo sapiens
tcagcctccggagtagctgg

SEQ ID NO: 4992002 - DNA, 13 bp, Homo sapiens
tcagtattttcca

SEQ ID NO: 4992003 - DNA, 22 bp, Homo sapiens
tcagtattttccagccttatgt

SEQ ID NO: 4992004 - DNA, 23 bp, Homo sapiens
tcagtattttccagccttatgtg

SEQ ID NO: 4992005 - DNA, 18 bp, Homo sapiens
tcagtgtcgggaattttc

SEQ ID NO: 4992006 - DNA, 14 bp, Homo sapiens
tcataaagaaaaat

SEQ ID NO: 4992007 - DNA, 17 bp, Homo sapiens
tcatacacagttaaata

SEQ ID NO: 4992008 - DNA, 18 bp, Homo sapiens
tcatacacagttaaataa

SEQ ID NO: 4992009 - DNA, 18 bp, Homo sapiens
tcatgcaaactgctttat

SEQ ID NO: 4992010 - DNA, 19 bp, Homo sapiens
tcatgcaaactgctttatt

SEQ ID NO: 4992011 - DNA, 19 bp, Homo sapiens
tcatggtagatttttttca

SEQ ID NO: 4992012 - DNA, 20 bp, Homo sapiens
tcatggtagatttttttcat

SEQ ID NO: 4992013 - DNA, 21 bp, Homo sapiens
tcatggtagatttttttcata

SEQ ID NO: 4992014 - DNA, 16 bp, Homo sapiens
tcatgtatatttagtt

SEQ ID NO: 4992015 - DNA, 21 bp, Homo sapiens
tcatgtatgtatataatcatg

SEQ ID NO: 4992016 - DNA, 17 bp, Homo sapiens
tcatttggcttgctgtt

SEQ ID NO: 4992017 - DNA, 13 bp, Homo sapiens
tcatttggttaaa

SEQ ID NO: 4992018 - DNA, 19 bp, Homo sapiens
tccagccttatgtgttaca

SEQ ID NO: 4992019 - DNA, 18 bp, Homo sapiens
tccagctagtgccaaata

SEQ ID NO: 4992020 - DNA, 22 bp, Homo sapiens
tccaggagattggatttgctgt

SEQ ID NO: 4992021 - DNA, 21 bp, Homo sapiens
tccagtattgtatatgagttt

SEQ ID NO: 4992022 - DNA, 18 bp, Homo sapiens
tccatcccaggaggccaa

SEQ ID NO: 4992023 - DNA, 9 bp, Homo sapiens
tccatgctt

SEQ ID NO: 4992024 - DNA, 18 bp, Homo sapiens
tcccaggtaatttaaatt

SEQ ID NO: 4992025 - DNA, 17 bp, Homo sapiens
tccccaatccatgcttc

SEQ ID NO: 4992026 - DNA, 14 bp, Homo sapiens
tcccctccttctcc

SEQ ID NO: 4992027 - DNA, 13 bp, Homo sapiens
tcccttctgtagt

SEQ ID NO: 4992028 - DNA, 17 bp, Homo sapiens
tcctaatatatatgtag

SEQ ID NO: 4992029 - DNA, 18 bp, Homo sapiens
tcctgattaccagtctga

SEQ ID NO: 4992030 - DNA, 12 bp, Homo sapiens
tcctgtctgttt

SEQ ID NO: 4992031 - DNA, 12 bp, Homo sapiens
tccttctccctt

SEQ ID NO: 4992032 - DNA, 21 bp, Homo sapiens
tcgagcagtcctgcctcagcc

SEQ ID NO: 4992033 - DNA, 21 bp, Homo sapiens
tctaaagctttatctttgtgt

SEQ ID NO: 4992034 - DNA, 23 bp, Homo sapiens
tctaaagctttatctttgtgtaa

SEQ ID NO: 4992035 - DNA, 20 bp, Homo sapiens
tctacattcttggttgttaa

SEQ ID NO: 4992036 - DNA, 15 bp, Homo sapiens
tctagcatttatttc

SEQ ID NO: 4992037 - DNA, 18 bp, Homo sapiens
tctagcatttatttctct

SEQ ID NO: 4992038 - DNA, 14 bp, Homo sapiens
tctatattaaatga

SEQ ID NO: 4992039 - DNA, 20 bp, Homo sapiens
tctattaagccattgaaaga

SEQ ID NO: 4992040 - DNA, 15 bp, Homo sapiens
tctcaccccatccca

SEQ ID NO: 4992041 - DNA, 17 bp, Homo sapiens
tctcaccccatcccaca

SEQ ID NO: 4992042 - DNA, 19 bp, Homo sapiens
tctcaccccatcccacacc

SEQ ID NO: 4992043 - DNA, 19 bp, Homo sapiens
tctccaattctgaaatact

SEQ ID NO: 4992044 - DNA, 12 bp, Homo sapiens
tctccctcccct

SEQ ID NO: 4992045 - DNA, 13 bp, Homo sapiens
aaaaaacatttgt

SEQ ID NO: 4992046 - DNA, 21 bp, Homo sapiens
aaaaaatatatgacagattat

SEQ ID NO: 4992047 - DNA, 22 bp, Homo sapiens
aaaaagatttactttgtacatg

SEQ ID NO: 4992048 - DNA, 18 bp, Homo sapiens
aaaaaggaggatagaaaa

SEQ ID NO: 4992049 - DNA, 13 bp, Homo sapiens
aaaaaggatggaa

SEQ ID NO: 4992050 - DNA, 14 bp, Homo sapiens
aaaaaggatggaag

SEQ ID NO: 4992051 - DNA, 20 bp, Homo sapiens
aaaaaggatggaagaaagaa

SEQ ID NO: 4992052 - DNA, 22 bp, Homo sapiens
aaaaaggatggaagaaagaagc

SEQ ID NO: 4992053 - DNA, 14 bp, Homo sapiens
aaaactttaaagat

SEQ ID NO: 4992054 - DNA, 19 bp, Homo sapiens
aaaactttaaagataagtc

SEQ ID NO: 4992055 - DNA, 17 bp, Homo sapiens
aaaagcctttgaaaata

SEQ ID NO: 4992056 - DNA, 19 bp, Homo sapiens
aaaaggaggatagaaaaag

SEQ ID NO: 4992057 - DNA, 15 bp, Homo sapiens
aaaaggatggaagaa

SEQ ID NO: 4992058 - DNA, 16 bp, Homo sapiens
aaaagtcattattcct

SEQ ID NO: 4992059 - DNA, 23 bp, Homo sapiens
aaaatgattaatgcatttatcaa

SEQ ID NO: 4992060 - DNA, 17 bp, Homo sapiens
aaaatggaaagaaggaa

SEQ ID NO: 4992061 - DNA, 18 bp, Homo sapiens
aaaatggaaagaaggaaa

SEQ ID NO: 4992062 - DNA, 19 bp, Homo sapiens
aaaatggaaagaaggaaaa

SEQ ID NO: 4992063 - DNA, 17 bp, Homo sapiens
aaacaaaatttcacagt

SEQ ID NO: 4992064 - DNA, 15 bp, Homo sapiens
aaacagacaataatt

SEQ ID NO: 4992065 - DNA, 15 bp, Homo sapiens
aaacatcagaaactg

SEQ ID NO: 4992066 - DNA, 16 bp, Homo sapiens
aaacatcagaaactga

SEQ ID NO: 4992067 - DNA, 20 bp, Homo sapiens
aaacatgggtggtaacaaga

SEQ ID NO: 4992068 - DNA, 15 bp, Homo sapiens
aaacggtgcaacaga

SEQ ID NO: 4992069 - DNA, 18 bp, Homo sapiens
aaacggtgcaacagaagg

SEQ ID NO: 4992070 - DNA, 20 bp, Homo sapiens
aaactgcgggaatactgtct

SEQ ID NO: 4992071 - DNA, 15 bp, Homo sapiens
aaactgctttatttt

SEQ ID NO: 4992072 - DNA, 19 bp, Homo sapiens
aaacttttaggttgttacc

SEQ ID NO: 4992073 - DNA, 20 bp, Homo sapiens
aaacttttctttcttttctt

SEQ ID NO: 4992074 - DNA, 16 bp, Homo sapiens
aaagaaaatggaaaga

SEQ ID NO: 4992075 - DNA, 21 bp, Homo sapiens
aaagaaaatggaaagaaggaa

SEQ ID NO: 4992076 - DNA, 16 bp, Homo sapiens
aaagaaaggaaagaag

SEQ ID NO: 4992077 - DNA, 19 bp, Homo sapiens
aaagaaaggaaagaaggag

SEQ ID NO: 4992078 - DNA, 21 bp, Homo sapiens
aaagaagcattgaaaacaaag

SEQ ID NO: 4992079 - DNA, 16 bp, Homo sapiens
aaagacatctgcctgt

SEQ ID NO: 4992080 - DNA, 20 bp, Homo sapiens
aaagacatctgcctgtaatt

SEQ ID NO: 4992081 - DNA, 23 bp, Homo sapiens
aaagatagaatggcttctctgtt

SEQ ID NO: 4992082 - DNA, 16 bp, Homo sapiens
aaagatttactttgta

SEQ ID NO: 4992083 - DNA, 19 bp, Homo sapiens
aaagctttatctttgtgta

SEQ ID NO: 4992084 - DNA, 17 bp, Homo sapiens
aaaggaaatctcacccc

SEQ ID NO: 4992085 - DNA, 21 bp, Homo sapiens
aaaggaggatagaaaaaggat

SEQ ID NO: 4992086 - DNA, 17 bp, Homo sapiens
aaaggatggaagaaaga

SEQ ID NO: 4992087 - DNA, 19 bp, Homo sapiens
aaaggatggaagaaagaag

SEQ ID NO: 4992088 - DNA, 17 bp, Homo sapiens
aaagggagaaatgccag

SEQ ID NO: 4992089 - DNA, 12 bp, Homo sapiens
aaagtaaacttg

SEQ ID NO: 4992090 - DNA, 17 bp, Homo sapiens
aaagtaaacttgtgtat

SEQ ID NO: 4992091 - DNA, 17 bp, Homo sapiens
aaagtcattattcctgg

SEQ ID NO: 4992092 - DNA, 15 bp, Homo sapiens
aaagtcctgctttcc

SEQ ID NO: 4992093 - DNA, 12 bp, Homo sapiens
aaagttgctttt

SEQ ID NO: 4992094 - DNA, 15 bp, Homo sapiens
aaagttgcttttatt

SEQ ID NO: 4992095 - DNA, 19 bp, Homo sapiens
aaagtttttttttataatt

SEQ ID NO: 4992096 - DNA, 15 bp, Homo sapiens
aaataaatagaaaga

SEQ ID NO: 4992097 - DNA, 15 bp, Homo sapiens
aaatagaaagagttc

SEQ ID NO: 4992098 - DNA, 14 bp, Homo sapiens
aaatagactttgta

SEQ ID NO: 4992099 - DNA, 19 bp, Homo sapiens
aaatctggggaagaggttt

SEQ ID NO: 4992100 - DNA, 22 bp, Homo sapiens
aaatctggggaagaggttttat

SEQ ID NO: 4992101 - DNA, 23 bp, Homo sapiens
aaatctggggaagaggttttatt

SEQ ID NO: 4992102 - DNA, 17 bp, Homo sapiens
aaatcttccaatttcct

SEQ ID NO: 4992103 - DNA, 17 bp, Homo sapiens
aaatgaactcaatataa

SEQ ID NO: 4992104 - DNA, 16 bp, Homo sapiens
aaatgagggtttctga

SEQ ID NO: 4992105 - DNA, 18 bp, Homo sapiens
aaatgagttacttagaat

SEQ ID NO: 4992106 - DNA, 17 bp, Homo sapiens
aaatgcccatttttgct

SEQ ID NO: 4992107 - DNA, 14 bp, Homo sapiens
aaatggaaagaagg

SEQ ID NO: 4992108 - DNA, 16 bp, Homo sapiens
aaatggaaagaaggaa

SEQ ID NO: 4992109 - DNA, 18 bp, Homo sapiens
aaatggaaagaaggaaaa

SEQ ID NO: 4992110 - DNA, 21 bp, Homo sapiens
aaatgggttaatcctgaattc

SEQ ID NO: 4992111 - DNA, 16 bp, Homo sapiens
aaatgtaaagttgtct

SEQ ID NO: 4992112 - DNA, 18 bp, Homo sapiens
aaatgtaaattagtttga

SEQ ID NO: 4992113 - DNA, 19 bp, Homo sapiens
aaatgtaaattagtttgac

SEQ ID NO: 4992114 - DNA, 15 bp, Homo sapiens
aaatgtacttaaatg

SEQ ID NO: 4992115 - DNA, 16 bp, Homo sapiens
aaatgtacttaaatga

SEQ ID NO: 4992116 - DNA, 13 bp, Homo sapiens
aaattagtttgac

SEQ ID NO: 4992117 - DNA, 20 bp, Homo sapiens
aaattctgggttcatttgtg

SEQ ID NO: 4992118 - DNA, 18 bp, Homo sapiens
aaattgcagtttcatgta

SEQ ID NO: 4992119 - DNA, 18 bp, Homo sapiens
aaattggagttttaaaaa

SEQ ID NO: 4992120 - DNA, 18 bp, Homo sapiens
aaatttcacagttctgta

SEQ ID NO: 4992121 - DNA, 12 bp, Homo sapiens
aacaagagttcc

SEQ ID NO: 4992122 - DNA, 21 bp, Homo sapiens
aacaatgtgtctatttctgaa

SEQ ID NO: 4992123 - DNA, 23 bp, Homo sapiens
aacaatgtgtctatttctgaaag

SEQ ID NO: 4992124 - DNA, 15 bp, Homo sapiens
aacaattttctagat

SEQ ID NO: 4992125 - DNA, 20 bp, Homo sapiens
aacaattttctagatattat

SEQ ID NO: 4992126 - DNA, 14 bp, Homo sapiens
aacagagaaataga

SEQ ID NO: 4992127 - DNA, 21 bp, Homo sapiens
aacatcactacaaaaagaaga

SEQ ID NO: 4992128 - DNA, 19 bp, Homo sapiens
aaccagggaagctgtccct

SEQ ID NO: 4992129 - DNA, 17 bp, Homo sapiens
aacggtgcaacagaagg

SEQ ID NO: 4992130 - DNA, 22 bp, Homo sapiens
aactaggattataatgctgcct

SEQ ID NO: 4992131 - DNA, 16 bp, Homo sapiens
aactgactctgttatt

SEQ ID NO: 4992132 - DNA, 21 bp, Homo sapiens
aactgagatcaaaaaaatata

SEQ ID NO: 4992133 - DNA, 14 bp, Homo sapiens
aactgtattaaaga

SEQ ID NO: 4992134 - DNA, 10 bp, Homo sapiens
aactgtattt

SEQ ID NO: 4992135 - DNA, 22 bp, Homo sapiens
aactgtatttcagtattttcca

SEQ ID NO: 4992136 - DNA, 20 bp, Homo sapiens
aagaaaatggaaagaaggaa

SEQ ID NO: 4992137 - DNA, 11 bp, Homo sapiens
aagaaagaaag

SEQ ID NO: 4992138 - DNA, 13 bp, Homo sapiens
aagaaagaaagga

SEQ ID NO: 4992139 - DNA, 19 bp, Homo sapiens
aagaaagccaccttgttac

SEQ ID NO: 4992140 - DNA, 12 bp, Homo sapiens
aagaaaggaaag

SEQ ID NO: 4992141 - DNA, 13 bp, Homo sapiens
aagaaaggaaaga

SEQ ID NO: 4992142 - DNA, 22 bp, Homo sapiens
aagaaggagatgaatagaagaa

SEQ ID NO: 4992143 - DNA, 17 bp, Homo sapiens
aagaagttttttacttt

SEQ ID NO: 4992144 - DNA, 16 bp, Homo sapiens
aagataagtctacatt

SEQ ID NO: 4992145 - DNA, 16 bp, Homo sapiens
aagcacatctgcattt

SEQ ID NO: 4992146 - DNA, 19 bp, Homo sapiens
aagcactaagactgcttct

SEQ ID NO: 4992147 - DNA, 13 bp, Homo sapiens
aagctttatcttt

SEQ ID NO: 4992148 - DNA, 16 bp, Homo sapiens
aaggaaaaaaggagga

SEQ ID NO: 4992149 - DNA, 20 bp, Homo sapiens
aaggaaaaaaggaggataga

SEQ ID NO: 4992150 - DNA, 14 bp, Homo sapiens
aaggaaagaaggag

SEQ ID NO: 4992151 - DNA, 16 bp, Homo sapiens
aaggaggatagaaaaa

SEQ ID NO: 4992152 - DNA, 18 bp, Homo sapiens
aaggatggaagaaagaag

SEQ ID NO: 4992153 - DNA, 19 bp, Homo sapiens
aaggatggaagaaagaagc

SEQ ID NO: 4992154 - DNA, 13 bp, Homo sapiens
aagggagaaatgc

SEQ ID NO: 4992155 - DNA, 16 bp, Homo sapiens
aagtaaacttgtgtat

SEQ ID NO: 4992156 - DNA, 19 bp, Homo sapiens
aagtatatgtgagaaatca

SEQ ID NO: 4992157 - DNA, 13 bp, Homo sapiens
aagtcctgctttc

SEQ ID NO: 4992158 - DNA, 12 bp, Homo sapiens
aagtgacataat

SEQ ID NO: 4992159 - DNA, 15 bp, Homo sapiens
aataaagtttggact

SEQ ID NO: 4992160 - DNA, 14 bp, Homo sapiens
aataaatagaaaga

SEQ ID NO: 4992161 - DNA, 20 bp, Homo sapiens
aataaattggagttttaaaa

SEQ ID NO: 4992162 - DNA, 13 bp, Homo sapiens
aatacaagacaaa

SEQ ID NO: 4992163 - DNA, 17 bp, Homo sapiens
aatacaggtttttttga

SEQ ID NO: 4992164 - DNA, 17 bp, Homo sapiens
aatagactttgtatgaa

SEQ ID NO: 4992165 - DNA, 22 bp, Homo sapiens
aatagaggtgatgctgctaaag

SEQ ID NO: 4992166 - DNA, 22 bp, Homo sapiens
aatatactttttttgttataga

SEQ ID NO: 4992167 - DNA, 14 bp, Homo sapiens
aatatattttgaaa

SEQ ID NO: 4992168 - DNA, 16 bp, Homo sapiens
aatatattttgaaata

SEQ ID NO: 4992169 - DNA, 17 bp, Homo sapiens
aatattggttagtattt

SEQ ID NO: 4992170 - DNA, 11 bp, Homo sapiens
aatccatgctt

SEQ ID NO: 4992171 - DNA, 19 bp, Homo sapiens
aatctaaaaattgaactac

SEQ ID NO: 4992172 - DNA, 14 bp, Homo sapiens
aatctaagtatatg

SEQ ID NO: 4992173 - DNA, 20 bp, Homo sapiens
aatctaagtatatgtgagaa

SEQ ID NO: 4992174 - DNA, 17 bp, Homo sapiens
aatctatattaaatgag

SEQ ID NO: 4992175 - DNA, 17 bp, Homo sapiens
aatctcctctgctcatt

SEQ ID NO: 4992176 - DNA, 19 bp, Homo sapiens
aatctggggaagaggtttt

SEQ ID NO: 4992177 - DNA, 21 bp, Homo sapiens
aatcttagtatagtagaaaga

SEQ ID NO: 4992178 - DNA, 22 bp, Homo sapiens
aatcttagtatagtagaaagac

SEQ ID NO: 4992179 - DNA, 23 bp, Homo sapiens
aatctttttataaatacataaat

SEQ ID NO: 4992180 - DNA, 16 bp, Homo sapiens
aatgagggtttctgat

SEQ ID NO: 4992181 - DNA, 17 bp, Homo sapiens
aatgatacccaacagtt

SEQ ID NO: 4992182 - DNA, 17 bp, Homo sapiens
aatgatcacatctaaag

SEQ ID NO: 4992183 - DNA, 20 bp, Homo sapiens
aatgatcacatctaaagctt

SEQ ID NO: 4992184 - DNA, 21 bp, Homo sapiens
aatgatcacatctaaagcttt

SEQ ID NO: 4992185 - DNA, 19 bp, Homo sapiens
aatgccaggcggacaaagt

SEQ ID NO: 4992186 - DNA, 17 bp, Homo sapiens
aatgccataaaattgca

SEQ ID NO: 4992187 - DNA, 14 bp, Homo sapiens
aatgcccatttttg

SEQ ID NO: 4992188 - DNA, 11 bp, Homo sapiens
aatgctttctg

SEQ ID NO: 4992189 - DNA, 15 bp, Homo sapiens
aatggaaagaaggaa

SEQ ID NO: 4992190 - DNA, 19 bp, Homo sapiens
aatggcgtgaacccgggag

SEQ ID NO: 4992191 - DNA, 20 bp, Homo sapiens
aatggtttctcattaaactc

SEQ ID NO: 4992192 - DNA, 21 bp, Homo sapiens
aatgtaaagttgtcttttaaa

SEQ ID NO: 4992193 - DNA, 14 bp, Homo sapiens
aatgtaaattagtt

SEQ ID NO: 4992194 - DNA, 15 bp, Homo sapiens
aatgtaaattagttt

SEQ ID NO: 4992195 - DNA, 19 bp, Homo sapiens
aatgtaaattagtttgaca

SEQ ID NO: 4992196 - DNA, 22 bp, Homo sapiens
aatgtaaattagtttgacactg

SEQ ID NO: 4992197 - DNA, 16 bp, Homo sapiens
aatgtacttaaatgag

SEQ ID NO: 4992198 - DNA, 17 bp, Homo sapiens
aatgtacttaaatgagt

SEQ ID NO: 4992199 - DNA, 20 bp, Homo sapiens
aatgtaggcacttttatttt

SEQ ID NO: 4992200 - DNA, 23 bp, Homo sapiens
aatgtaggcacttttattttcat

SEQ ID NO: 4992201 - DNA, 18 bp, Homo sapiens
aatgtagttttaaataaa

SEQ ID NO: 4992202 - DNA, 15 bp, Homo sapiens
aattaaaaactttaa

SEQ ID NO: 4992203 - DNA, 17 bp, Homo sapiens
aattaaaaatgaaaatt

SEQ ID NO: 4992204 - DNA, 13 bp, Homo sapiens
aattaaagctgcc

SEQ ID NO: 4992205 - DNA, 19 bp, Homo sapiens
aattaccatagagtaatga

SEQ ID NO: 4992206 - DNA, 22 bp, Homo sapiens
aattaccatagagtaatgatgt

SEQ ID NO: 4992207 - DNA, 22 bp, Homo sapiens
aattacgttcttacaagcttaa

SEQ ID NO: 4992208 - DNA, 20 bp, Homo sapiens
aattaggtgtactgtactga

SEQ ID NO: 4992209 - DNA, 22 bp, Homo sapiens
aattaggtgtactgtactgaag

SEQ ID NO: 4992210 - DNA, 24 bp, Homo sapiens
aattaggtgtactgtactgaagaa

SEQ ID NO: 4992211 - DNA, 11 bp, Homo sapiens
aattctgaaat

SEQ ID NO: 4992212 - DNA, 21 bp, Homo sapiens
aattgcagtttcatgtatgta

SEQ ID NO: 4992213 - DNA, 16 bp, Homo sapiens
aattggcataatttgt

SEQ ID NO: 4992214 - DNA, 16 bp, Homo sapiens
aattggtcatggtaga

SEQ ID NO: 4992215 - DNA, 20 bp, Homo sapiens
aattggtcatggtagatttt

SEQ ID NO: 4992216 - DNA, 17 bp, Homo sapiens
aattggtctgaaaggct

SEQ ID NO: 4992217 - DNA, 15 bp, Homo sapiens
aattgtatttagtga

SEQ ID NO: 4992218 - DNA, 16 bp, Homo sapiens
aatttaaaatgtagtt

SEQ ID NO: 4992219 - DNA, 15 bp, Homo sapiens
aatttaacatcacta

SEQ ID NO: 4992220 - DNA, 20 bp, Homo sapiens
aatttagagcgtttggttaa

SEQ ID NO: 4992221 - DNA, 18 bp, Homo sapiens
aatttcacagttctgtaa

SEQ ID NO: 4992222 - DNA, 20 bp, Homo sapiens
aatttcacagttctgtaatg

SEQ ID NO: 4992223 - DNA, 11 bp, Homo sapiens
aatttccaaaa

SEQ ID NO: 4992224 - DNA, 22 bp, Homo sapiens
aatttccaaaataatctatatt

SEQ ID NO: 4992225 - DNA, 14 bp, Homo sapiens
aattttttaatttc

SEQ ID NO: 4992226 - DNA, 20 bp, Homo sapiens
acaaaaagaagagtttgtga

SEQ ID NO: 4992227 - DNA, 17 bp, Homo sapiens
acaagcttaaagcttga

SEQ ID NO: 4992228 - DNA, 18 bp, Homo sapiens
acaatactaaataaacat

SEQ ID NO: 4992229 - DNA, 19 bp, Homo sapiens
acaatcagccacattctag

SEQ ID NO: 4992230 - DNA, 14 bp, Homo sapiens
acacagttaaataa

SEQ ID NO: 4992231 - DNA, 12 bp, Homo sapiens
acagttctgtaa

SEQ ID NO: 4992232 - DNA, 15 bp, Homo sapiens
acataccagcttaga

SEQ ID NO: 4992233 - DNA, 16 bp, Homo sapiens
acatcactacaaaaag

SEQ ID NO: 4992234 - DNA, 18 bp, Homo sapiens
acatcactacaaaaagaa

SEQ ID NO: 4992235 - DNA, 20 bp, Homo sapiens
acatcactacaaaaagaaga

SEQ ID NO: 4992236 - DNA, 14 bp, Homo sapiens
acatcatgtaagat

SEQ ID NO: 4992237 - DNA, 17 bp, Homo sapiens
acatctgcctgtaatta

SEQ ID NO: 4992238 - DNA, 11 bp, Homo sapiens
acattcactgg

SEQ ID NO: 4992239 - DNA, 14 bp, Homo sapiens
acatttaaaaataa

SEQ ID NO: 4992240 - DNA, 15 bp, Homo sapiens
acatttaaaaataaa

SEQ ID NO: 4992241 - DNA, 15 bp, Homo sapiens
accatggccagccaa

SEQ ID NO: 4992242 - DNA, 12 bp, Homo sapiens
acccaacagttt

SEQ ID NO: 4992243 - DNA, 15 bp, Homo sapiens
accccatcccacacc

SEQ ID NO: 4992244 - DNA, 17 bp, Homo sapiens
accctgggcagtgagtg

SEQ ID NO: 4992245 - DNA, 22 bp, Homo sapiens
acccttcccctccttctccctt

SEQ ID NO: 4992246 - DNA, 22 bp, Homo sapiens
acctaaaaggaaatctcacccc

SEQ ID NO: 4992247 - DNA, 19 bp, Homo sapiens
acctatagtagtctgtgtt

SEQ ID NO: 4992248 - DNA, 17 bp, Homo sapiens
acctcttatcactaaga

SEQ ID NO: 4992249 - DNA, 22 bp, Homo sapiens
acctcttatcactaagaaagaa

SEQ ID NO: 4992250 - DNA, 14 bp, Homo sapiens
acctgtctcagcct

SEQ ID NO: 4992251 - DNA, 20 bp, Homo sapiens
acgaggtcaggagatcgaga

SEQ ID NO: 4992252 - DNA, 16 bp, Homo sapiens
acggtgcaacagaagg

SEQ ID NO: 4992253 - DNA, 16 bp, Homo sapiens
acgtataatgctttct

SEQ ID NO: 4992254 - DNA, 20 bp, Homo sapiens
actaactcatagattgcaaa

SEQ ID NO: 4992255 - DNA, 23 bp, Homo sapiens
actaagaaagaaaggaaagaagg

SEQ ID NO: 4992256 - DNA, 17 bp, Homo sapiens
actacaagcttttaact

SEQ ID NO: 4992257 - DNA, 12 bp, Homo sapiens
actagactttga

SEQ ID NO: 4992258 - DNA, 17 bp, Homo sapiens
actcatagattgcaaat

SEQ ID NO: 4992259 - DNA, 17 bp, Homo sapiens
actcatgcaaactgctt

SEQ ID NO: 4992260 - DNA, 20 bp, Homo sapiens
actcatgcaaactgctttat

SEQ ID NO: 4992261 - DNA, 22 bp, Homo sapiens
actcatgcaaactgctttattt

SEQ ID NO: 4992262 - DNA, 17 bp, Homo sapiens
actcattcttttttcta

SEQ ID NO: 4992263 - DNA, 14 bp, Homo sapiens
actcccttctgtag

SEQ ID NO: 4992264 - DNA, 16 bp, Homo sapiens
actcccttctgtagtt

SEQ ID NO: 4992265 - DNA, 18 bp, Homo sapiens
actctgaccacttaaaaa

SEQ ID NO: 4992266 - DNA, 15 bp, Homo sapiens
actcttaaatcattt

SEQ ID NO: 4992267 - DNA, 20 bp, Homo sapiens
actcttaaatcatttggtta

SEQ ID NO: 4992268 - DNA, 13 bp, Homo sapiens
actgaagaacagt

SEQ ID NO: 4992269 - DNA, 14 bp, Homo sapiens
actgactctgttat

SEQ ID NO: 4992270 - DNA, 18 bp, Homo sapiens
actgcaagcatttttcca

SEQ ID NO: 4992271 - DNA, 19 bp, Homo sapiens
actgcactccagcctgggc

SEQ ID NO: 4992272 - DNA, 15 bp, Homo sapiens
actgctttattttcc

SEQ ID NO: 4992273 - DNA, 20 bp, Homo sapiens
actgtagaaaggaaatagac

SEQ ID NO: 4992274 - DNA, 14 bp, Homo sapiens
actgtatttcagta

SEQ ID NO: 4992275 - DNA, 15 bp, Homo sapiens
actgtatttcagtat

SEQ ID NO: 4992276 - DNA, 21 bp, Homo sapiens
actgtatttcagtattttcca

SEQ ID NO: 4992277 - DNA, 23 bp, Homo sapiens
actgtggccatatatgctgtatt

SEQ ID NO: 4992278 - DNA, 21 bp, Homo sapiens
acttagaatgccataaaattg

SEQ ID NO: 4992279 - DNA, 13 bp, Homo sapiens
acttcaaggccca

SEQ ID NO: 4992280 - DNA, 15 bp, Homo sapiens
actttgctgttactg

SEQ ID NO: 4992281 - DNA, 21 bp, Homo sapiens
actttgctgttactgcttctc

SEQ ID NO: 4992282 - DNA, 18 bp, Homo sapiens
actttgtacatgttacag

SEQ ID NO: 4992283 - DNA, 16 bp, Homo sapiens
acttttattttcattg

SEQ ID NO: 4992284 - DNA, 15 bp, Homo sapiens
agaaaatggaaagaa

SEQ ID NO: 4992285 - DNA, 17 bp, Homo sapiens
agaaaatggaaagaagg

SEQ ID NO: 4992286 - DNA, 18 bp, Homo sapiens
agaaaatggaaagaagga

SEQ ID NO: 4992287 - DNA, 19 bp, Homo sapiens
agaaagaaaatggaaagaa

SEQ ID NO: 4992288 - DNA, 12 bp, Homo sapiens
agaaagaaagga

SEQ ID NO: 4992289 - DNA, 19 bp, Homo sapiens
agaaagaaaggaaagaagg

SEQ ID NO: 4992290 - DNA, 10 bp, Homo sapiens
agaaagaagc

SEQ ID NO: 4992291 - DNA, 13 bp, Homo sapiens
agaaagaagcatt

SEQ ID NO: 4992292 - DNA, 11 bp, Homo sapiens
agaagaaagaa

SEQ ID NO: 4992293 - DNA, 14 bp, Homo sapiens
agaagaaagaaaat

SEQ ID NO: 4992294 - DNA, 18 bp, Homo sapiens
agaagaaagaaaatggaa

SEQ ID NO: 4992295 - DNA, 23 bp, Homo sapiens
agaagcattgaaaacaaagacat

SEQ ID NO: 4992296 - DNA, 17 bp, Homo sapiens
agaaggaaaaaaggagg

SEQ ID NO: 4992297 - DNA, 20 bp, Homo sapiens
agaataaatggtttctcatt

SEQ ID NO: 4992298 - DNA, 18 bp, Homo sapiens
agaattggcataatttgt

SEQ ID NO: 4992299 - DNA, 17 bp, Homo sapiens
agacatctgcctgtaat

SEQ ID NO: 4992300 - DNA, 23 bp, Homo sapiens
agactgtggccatatatgctgta

SEQ ID NO: 4992301 - DNA, 13 bp, Homo sapiens
agactttgctgtt

SEQ ID NO: 4992302 - DNA, 16 bp, Homo sapiens
agagatgaaataattt

SEQ ID NO: 4992303 - DNA, 18 bp, Homo sapiens
agatgaatagaagaaaga

SEQ ID NO: 4992304 - DNA, 15 bp, Homo sapiens
agattggatttgctg

SEQ ID NO: 4992305 - DNA, 19 bp, Homo sapiens
agatttaagccttgacaca

SEQ ID NO: 4992306 - DNA, 21 bp, Homo sapiens
agatttaagccttgacacact

SEQ ID NO: 4992307 - DNA, 23 bp, Homo sapiens
agatttaagccttgacacactgt

SEQ ID NO: 4992308 - DNA, 17 bp, Homo sapiens
agatttgaaaaactttt

SEQ ID NO: 4992309 - DNA, 15 bp, Homo sapiens
agcaaggaatacaag

SEQ ID NO: 4992310 - DNA, 19 bp, Homo sapiens
agcagtcctgcctcagcct

SEQ ID NO: 4992311 - DNA, 17 bp, Homo sapiens
agcataactaggattat

SEQ ID NO: 4992312 - DNA, 17 bp, Homo sapiens
agcattaactaaatgct

SEQ ID NO: 4992313 - DNA, 19 bp, Homo sapiens
agcattgaaaacaaagaca

SEQ ID NO: 4992314 - DNA, 13 bp, Homo sapiens
agcatttatttct

SEQ ID NO: 4992315 - DNA, 22 bp, Homo sapiens
agcatttatttctctggcaaac

SEQ ID NO: 4992316 - DNA, 13 bp, Homo sapiens
agcatttttccat

SEQ ID NO: 4992317 - DNA, 16 bp, Homo sapiens
agccaaaccctgtctg

SEQ ID NO: 4992318 - DNA, 15 bp, Homo sapiens
agccaacttttgcat

SEQ ID NO: 4992319 - DNA, 17 bp, Homo sapiens
agccaccacgtccagct

SEQ ID NO: 4992320 - DNA, 17 bp, Homo sapiens
agcctagcgtggtggct

SEQ ID NO: 4992321 - DNA, 15 bp, Homo sapiens
agcctttgcctcccc

SEQ ID NO: 4992322 - DNA, 16 bp, Homo sapiens
agctacctttttatat

SEQ ID NO: 4992323 - DNA, 17 bp, Homo sapiens
agctactgtagaaagga

SEQ ID NO: 4992324 - DNA, 18 bp, Homo sapiens
agctagtgccaaataatt

SEQ ID NO: 4992325 - DNA, 15 bp, Homo sapiens
agctcagctctgctt

SEQ ID NO: 4992326 - DNA, 20 bp, Homo sapiens
agctctgctttatctgagtt

SEQ ID NO: 4992327 - DNA, 12 bp, Homo sapiens
agcttaaagctt

SEQ ID NO: 4992328 - DNA, 14 bp, Homo sapiens
agcttcctgtctgt

SEQ ID NO: 4992329 - DNA, 15 bp, Homo sapiens
agcttcctgtctgtt

SEQ ID NO: 4992330 - DNA, 16 bp, Homo sapiens
agcttcctgtctgttt

SEQ ID NO: 4992331 - DNA, 17 bp, Homo sapiens
agcttcctgtctgttta

SEQ ID NO: 4992332 - DNA, 18 bp, Homo sapiens
agcttcctgtctgtttat

SEQ ID NO: 4992333 - DNA, 18 bp, Homo sapiens
agcttgatttgatctttg

SEQ ID NO: 4992334 - DNA, 12 bp, Homo sapiens
agctttagaaat

SEQ ID NO: 4992335 - DNA, 19 bp, Homo sapiens
agctttatctttgtgtaat

SEQ ID NO: 4992336 - DNA, 15 bp, Homo sapiens
aggaaaaaaggagga

SEQ ID NO: 4992337 - DNA, 11 bp, Homo sapiens
aggaaagaagg

SEQ ID NO: 4992338 - DNA, 12 bp, Homo sapiens
aggaaagaagga

SEQ ID NO: 4992339 - DNA, 19 bp, Homo sapiens
aggaaagaaggagatgaat

SEQ ID NO: 4992340 - DNA, 21 bp, Homo sapiens
aggagatgaatagaagaaaga

SEQ ID NO: 4992341 - DNA, 13 bp, Homo sapiens
aggatagaaaaag

SEQ ID NO: 4992342 - DNA, 17 bp, Homo sapiens
aggcacttttattttca

SEQ ID NO: 4992343 - DNA, 18 bp, Homo sapiens
aggcacttttattttcat

SEQ ID NO: 4992344 - DNA, 19 bp, Homo sapiens
aggcggacaaagttcagtg

SEQ ID NO: 4992345 - DNA, 20 bp, Homo sapiens
aggctggagtggagtggcgt

SEQ ID NO: 4992346 - DNA, 12 bp, Homo sapiens
agggagaaatgc

SEQ ID NO: 4992347 - DNA, 14 bp, Homo sapiens
agggttatatttgg

SEQ ID NO: 4992348 - DNA, 20 bp, Homo sapiens
aggtctacattcttggttgt

SEQ ID NO: 4992349 - DNA, 24 bp, Homo sapiens
aggttagatgctattaagaaggca

SEQ ID NO: 4992350 - DNA, 21 bp, Homo sapiens
aggttcatgccaccatggcca

SEQ ID NO: 4992351 - DNA, 16 bp, Homo sapiens
agtaaatgctgaaata

SEQ ID NO: 4992352 - DNA, 22 bp, Homo sapiens
agtaataaaaagagatgaaata

SEQ ID NO: 4992353 - DNA, 19 bp, Homo sapiens
agtagtctgtgtttaaagt

SEQ ID NO: 4992354 - DNA, 20 bp, Homo sapiens
agtataatctcctctgctca

SEQ ID NO: 4992355 - DNA, 17 bp, Homo sapiens
agtattttccagcctta

SEQ ID NO: 4992356 - DNA, 14 bp, Homo sapiens
agtctatagaaatg

SEQ ID NO: 4992357 - DNA, 23 bp, Homo sapiens
agtctgattataccatgtgtgct

SEQ ID NO: 4992358 - DNA, 15 bp, Homo sapiens
agtcttaactgtatt

SEQ ID NO: 4992359 - DNA, 17 bp, Homo sapiens
agtcttaactgtatttc

SEQ ID NO: 4992360 - DNA, 18 bp, Homo sapiens
agtcttaactgtatttca

SEQ ID NO: 4992361 - DNA, 19 bp, Homo sapiens
agtcttaactgtatttcag

SEQ ID NO: 4992362 - DNA, 14 bp, Homo sapiens
agtctttttttcct

SEQ ID NO: 4992363 - DNA, 14 bp, Homo sapiens
agtgaatgaagttg

SEQ ID NO: 4992364 - DNA, 20 bp, Homo sapiens
agtgaatttttaaagacaaa

SEQ ID NO: 4992365 - DNA, 18 bp, Homo sapiens
agtgacaaaaataaaaag

SEQ ID NO: 4992366 - DNA, 24 bp, Homo sapiens
agtgatagctactgtagaaaggaa

SEQ ID NO: 4992367 - DNA, 17 bp, Homo sapiens
agttataagcgtattta

SEQ ID NO: 4992368 - DNA, 21 bp, Homo sapiens
agttctatggagactttgctg

SEQ ID NO: 4992369 - DNA, 22 bp, Homo sapiens
agttctatggagactttgctgt

SEQ ID NO: 4992370 - DNA, 23 bp, Homo sapiens
agttctatggagactttgctgtt

SEQ ID NO: 4992371 - DNA, 18 bp, Homo sapiens
agttgtcttttaaactac

SEQ ID NO: 4992372 - DNA, 19 bp, Homo sapiens
agtttcatgtatgtatata

SEQ ID NO: 4992373 - DNA, 15 bp, Homo sapiens
agttttaaataaagt

SEQ ID NO: 4992374 - DNA, 22 bp, Homo sapiens
agttttactcttaaatcatttg

SEQ ID NO: 4992375 - DNA, 23 bp, Homo sapiens
agttttactcttaaatcatttgg

SEQ ID NO: 4992376 - DNA, 19 bp, Homo sapiens
agttttttactttggttta

SEQ ID NO: 4992377 - DNA, 17 bp, Homo sapiens
agtttttttttttccag

SEQ ID NO: 4992378 - DNA, 16 bp, Homo sapiens
ataaaaagagatgaaa

SEQ ID NO: 4992379 - DNA, 19 bp, Homo sapiens
ataaaagcctttgaaaata

SEQ ID NO: 4992380 - DNA, 22 bp, Homo sapiens
ataaaattgcagtttcatgtat

SEQ ID NO: 4992381 - DNA, 12 bp, Homo sapiens
ataaaggaaata

SEQ ID NO: 4992382 - DNA, 19 bp, Homo sapiens
ataaatacataaataaaag

SEQ ID NO: 4992383 - DNA, 22 bp, Homo sapiens
ataaccatggtgattaaaatga

SEQ ID NO: 4992384 - DNA, 14 bp, Homo sapiens
ataactaggattat

SEQ ID NO: 4992385 - DNA, 13 bp, Homo sapiens
ataataatcatga

SEQ ID NO: 4992386 - DNA, 17 bp, Homo sapiens
ataatcagggaaactaa

SEQ ID NO: 4992387 - DNA, 18 bp, Homo sapiens
ataatctatattaaatga

SEQ ID NO: 4992388 - DNA, 19 bp, Homo sapiens
ataatctatattaaatgag

SEQ ID NO: 4992389 - DNA, 20 bp, Homo sapiens
ataatctatattaaatgagg

SEQ ID NO: 4992390 - DNA, 15 bp, Homo sapiens
ataatctcctctgct

SEQ ID NO: 4992391 - DNA, 14 bp, Homo sapiens
ataatgtgtctgtg

SEQ ID NO: 4992392 - DNA, 22 bp, Homo sapiens
ataatgtgtctgtgttgcttca

SEQ ID NO: 4992393 - DNA, 13 bp, Homo sapiens
ataatttgtctta

SEQ ID NO: 4992394 - DNA, 22 bp, Homo sapiens
atacccaacagtttatttttat

SEQ ID NO: 4992395 - DNA, 19 bp, Homo sapiens
atagaaaaaggatggaaga

SEQ ID NO: 4992396 - DNA, 17 bp, Homo sapiens
atagaaaatcttagtat

SEQ ID NO: 4992397 - DNA, 17 bp, Homo sapiens
atagaagaaagaaaatg

SEQ ID NO: 4992398 - DNA, 19 bp, Homo sapiens
atagctactgtagaaagga

SEQ ID NO: 4992399 - DNA, 22 bp, Homo sapiens
atagctactgtagaaaggaaat

SEQ ID NO: 4992400 - DNA, 23 bp, Homo sapiens
atataatcatgctcatgtatatt

SEQ ID NO: 4992401 - DNA, 14 bp, Homo sapiens
atatagaaaatctt

SEQ ID NO: 4992402 - DNA, 16 bp, Homo sapiens
atatatgctgtatttc

SEQ ID NO: 4992403 - DNA, 20 bp, Homo sapiens
atatattgaaagttgctttt

SEQ ID NO: 4992404 - DNA, 21 bp, Homo sapiens
atatattgaaagttgctttta

SEQ ID NO: 4992405 - DNA, 13 bp, Homo sapiens
atatcttgttatt

SEQ ID NO: 4992406 - DNA, 15 bp, Homo sapiens
atatcttgttattaa

SEQ ID NO: 4992407 - DNA, 20 bp, Homo sapiens
atatgaaaacaatactaaat

SEQ ID NO: 4992408 - DNA, 23 bp, Homo sapiens
atatgataataatcatgatcaca

SEQ ID NO: 4992409 - DNA, 21 bp, Homo sapiens
atattcaaggctttaaaagtc

SEQ ID NO: 4992410 - DNA, 14 bp, Homo sapiens
atattttgaaatat

SEQ ID NO: 4992411 - DNA, 15 bp, Homo sapiens
atattttttctcaaa

SEQ ID NO: 4992412 - DNA, 22 bp, Homo sapiens
atcaatgggatatgattggttc

SEQ ID NO: 4992413 - DNA, 15 bp, Homo sapiens
atcactacaaaaaga

SEQ ID NO: 4992414 - DNA, 17 bp, Homo sapiens
atcactacaaaaagaag

SEQ ID NO: 4992415 - DNA, 22 bp, Homo sapiens
atcagggaaactaattgtattt

SEQ ID NO: 4992416 - DNA, 13 bp, Homo sapiens
atccacctgtctc

SEQ ID NO: 4992417 - DNA, 15 bp, Homo sapiens
atccatgcttcactc

SEQ ID NO: 4992418 - DNA, 13 bp, Homo sapiens
atcgcagcttcct

SEQ ID NO: 4992419 - DNA, 20 bp, Homo sapiens
atctaaagctttatctttgt

SEQ ID NO: 4992420 - DNA, 22 bp, Homo sapiens
atctaaagctttatctttgtgt

SEQ ID NO: 4992421 - DNA, 15 bp, Homo sapiens
atctaagtatatgtg

SEQ ID NO: 4992422 - DNA, 22 bp, Homo sapiens
atctatacctgccttttaagtt

SEQ ID NO: 4992423 - DNA, 15 bp, Homo sapiens
atctatattaaatga

SEQ ID NO: 4992424 - DNA, 13 bp, Homo sapiens
atctcaccccatc

SEQ ID NO: 4992425 - DNA, 14 bp, Homo sapiens
atctcaccccatcc

SEQ ID NO: 4992426 - DNA, 16 bp, Homo sapiens
atctcctctgctcatt

SEQ ID NO: 4992427 - DNA, 15 bp, Homo sapiens
atctctccctcccct

SEQ ID NO: 4992428 - DNA, 16 bp, Homo sapiens
atctcttattttacaa

SEQ ID NO: 4992429 - DNA, 23 bp, Homo sapiens
atctgcattttcaccccaccctt

SEQ ID NO: 4992430 - DNA, 14 bp, Homo sapiens
atctgcctgtaatt

SEQ ID NO: 4992431 - DNA, 20 bp, Homo sapiens
atctgcctgtaattaaacta

SEQ ID NO: 4992432 - DNA, 12 bp, Homo sapiens
atctggttacag

SEQ ID NO: 4992433 - DNA, 13 bp, Homo sapiens
atctgtactttgt

SEQ ID NO: 4992434 - DNA, 15 bp, Homo sapiens
atctgtactttgtgt

SEQ ID NO: 4992435 - DNA, 20 bp, Homo sapiens
atcttgttattaatgtttct

SEQ ID NO: 4992436 - DNA, 17 bp, Homo sapiens
atctttaactgaactct

SEQ ID NO: 4992437 - DNA, 18 bp, Homo sapiens
atctttgtttaaatgcca

SEQ ID NO: 4992438 - DNA, 21 bp, Homo sapiens
atctttgtttaaatgccaaaa

SEQ ID NO: 4992439 - DNA, 22 bp, Homo sapiens
atgaaaatttcacttgaaatta

SEQ ID NO: 4992440 - DNA, 14 bp, Homo sapiens
atgaaataataaag

SEQ ID NO: 4992441 - DNA, 20 bp, Homo sapiens
atgaaataataaagagattt

SEQ ID NO: 4992442 - DNA, 14 bp, Homo sapiens
atgaatagaagaaa

SEQ ID NO: 4992443 - DNA, 19 bp, Homo sapiens
atgatacccaacagtttat

SEQ ID NO: 4992444 - DNA, 15 bp, Homo sapiens
atgatcacatctaaa

SEQ ID NO: 4992445 - DNA, 18 bp, Homo sapiens
atgatcacatctaaagct

SEQ ID NO: 4992446 - DNA, 13 bp, Homo sapiens
atgattaatgcat

SEQ ID NO: 4992447 - DNA, 13 bp, Homo sapiens
atgattggttcag

SEQ ID NO: 4992448 - DNA, 15 bp, Homo sapiens
atgattggttcagtt

SEQ ID NO: 4992449 - DNA, 18 bp, Homo sapiens
atgcatttatcaataaaa

SEQ ID NO: 4992450 - DNA, 17 bp, Homo sapiens
atgcccatttttgctaa

SEQ ID NO: 4992451 - DNA, 15 bp, Homo sapiens
atgctattaagaagg

SEQ ID NO: 4992452 - DNA, 17 bp, Homo sapiens
atgctgaaataaaatga

SEQ ID NO: 4992453 - DNA, 22 bp, Homo sapiens
atgctgctaaagggagaaatgc

SEQ ID NO: 4992454 - DNA, 23 bp, Homo sapiens
atgctggcatttgcacctacctc

SEQ ID NO: 4992455 - DNA, 12 bp, Homo sapiens
atggaaagaagg

SEQ ID NO: 4992456 - DNA, 15 bp, Homo sapiens
atggaaagaaggaaa

SEQ ID NO: 4992457 - DNA, 19 bp, Homo sapiens
atggaaagaaggaaaaaag

SEQ ID NO: 4992458 - DNA, 15 bp, Homo sapiens
atggagcaaatgtcc

SEQ ID NO: 4992459 - DNA, 22 bp, Homo sapiens
atggctatctatacctgccttt

SEQ ID NO: 4992460 - DNA, 20 bp, Homo sapiens
atgggatatgattggttcag

SEQ ID NO: 4992461 - DNA, 22 bp, Homo sapiens
atgggcaaaatggctagaatta

SEQ ID NO: 4992462 - DNA, 13 bp, Homo sapiens
atggtagtttaaa

SEQ ID NO: 4992463 - DNA, 19 bp, Homo sapiens
atggtagtttaaaacatca

SEQ ID NO: 4992464 - DNA, 19 bp, Homo sapiens
atgtaaggtcacatttagt

SEQ ID NO: 4992465 - DNA, 20 bp, Homo sapiens
atgtaatagtcttgcagaaa

SEQ ID NO: 4992466 - DNA, 17 bp, Homo sapiens
atgtaggcacttttatt

SEQ ID NO: 4992467 - DNA, 17 bp, Homo sapiens
atgtagttttaaataaa

SEQ ID NO: 4992468 - DNA, 15 bp, Homo sapiens
atgtttcttctccaa

SEQ ID NO: 4992469 - DNA, 17 bp, Homo sapiens
attaaaaaatcaaatca

SEQ ID NO: 4992470 - DNA, 17 bp, Homo sapiens
attaaaaactttaaaga

SEQ ID NO: 4992471 - DNA, 14 bp, Homo sapiens
attaatgcatttat

SEQ ID NO: 4992472 - DNA, 13 bp, Homo sapiens
attaccagtctga

SEQ ID NO: 4992473 - DNA, 22 bp, Homo sapiens
attaccatagagtaatgatgta

SEQ ID NO: 4992474 - DNA, 15 bp, Homo sapiens
attagtttgacactg

SEQ ID NO: 4992475 - DNA, 15 bp, Homo sapiens
attattttgtttaaa

SEQ ID NO: 4992476 - DNA, 16 bp, Homo sapiens
attcaccctgggcagt

SEQ ID NO: 4992477 - DNA, 18 bp, Homo sapiens
attcagctagaatttctg

SEQ ID NO: 4992478 - DNA, 19 bp, Homo sapiens
attccgattagacctttat

SEQ ID NO: 4992479 - DNA, 22 bp, Homo sapiens
attctgaaatacttttgagtat

SEQ ID NO: 4992480 - DNA, 19 bp, Homo sapiens
attctgcaagcacatctgc

SEQ ID NO: 4992481 - DNA, 16 bp, Homo sapiens
attgaaaacaaagaca

SEQ ID NO: 4992482 - DNA, 16 bp, Homo sapiens
attgaaagttgctttt

SEQ ID NO: 4992483 - DNA, 22 bp, Homo sapiens
attgaaagttgcttttattgca

SEQ ID NO: 4992484 - DNA, 20 bp, Homo sapiens
attgagtcttaactgtattt

SEQ ID NO: 4992485 - DNA, 22 bp, Homo sapiens
attgatcccttctcctgccctt

SEQ ID NO: 4992486 - DNA, 17 bp, Homo sapiens
attgcagtttcatgtat

SEQ ID NO: 4992487 - DNA, 15 bp, Homo sapiens
attggatttgctgtg

SEQ ID NO: 4992488 - DNA, 14 bp, Homo sapiens
attggttagtattt

SEQ ID NO: 4992489 - DNA, 20 bp, Homo sapiens
atttaaaaaattaaaaatga

SEQ ID NO: 4992490 - DNA, 16 bp, Homo sapiens
atttaactttgcaaaa

SEQ ID NO: 4992491 - DNA, 17 bp, Homo sapiens
atttaagccttgacaca

SEQ ID NO: 4992492 - DNA, 21 bp, Homo sapiens
atttaagccttgacacactgt

SEQ ID NO: 4992493 - DNA, 22 bp, Homo sapiens
atttaagccttgacacactgtg

SEQ ID NO: 4992494 - DNA, 19 bp, Homo sapiens
atttagagcgtttggttaa

SEQ ID NO: 4992495 - DNA, 20 bp, Homo sapiens
atttagagcgtttggttaaa

SEQ ID NO: 4992496 - DNA, 22 bp, Homo sapiens
atttagagcgtttggttaaagt

SEQ ID NO: 4992497 - DNA, 23 bp, Homo sapiens
atttagagcgtttggttaaagta

SEQ ID NO: 4992498 - DNA, 14 bp, Homo sapiens
atttagtaaatgct

SEQ ID NO: 4992499 - DNA, 18 bp, Homo sapiens
atttagtgacaaaaataa

SEQ ID NO: 4992500 - DNA, 22 bp, Homo sapiens
atttagtgacaaaaataaaaag

SEQ ID NO: 4992501 - DNA, 17 bp, Homo sapiens
atttatatcttgttatt

SEQ ID NO: 4992502 - DNA, 18 bp, Homo sapiens
atttatgagatttactgc

SEQ ID NO: 4992503 - DNA, 23 bp, Homo sapiens
atttatttctctggcaaactttt

SEQ ID NO: 4992504 - DNA, 13 bp, Homo sapiens
atttgatctttgt

SEQ ID NO: 4992505 - DNA, 18 bp, Homo sapiens
atttgatctttgtttaaa

SEQ ID NO: 4992506 - DNA, 17 bp, Homo sapiens
atttgcacacatttaaa

SEQ ID NO: 4992507 - DNA, 14 bp, Homo sapiens
atttgctgtgacta

SEQ ID NO: 4992508 - DNA, 22 bp, Homo sapiens
atttggaatgtacatactgaaa

SEQ ID NO: 4992509 - DNA, 22 bp, Homo sapiens
attttagggtgggtaagaaagc

SEQ ID NO: 4992510 - DNA, 14 bp, Homo sapiens
attttcattgtgat

SEQ ID NO: 4992511 - DNA, 13 bp, Homo sapiens
attttccagcctt

SEQ ID NO: 4992512 - DNA, 23 bp, Homo sapiens
attttccccgtgacattcactgg

SEQ ID NO: 4992513 - DNA, 20 bp, Homo sapiens
attttgaaatattgatgcag

SEQ ID NO: 4992514 - DNA, 16 bp, Homo sapiens
atttttccatctgtgt

SEQ ID NO: 4992515 - DNA, 14 bp, Homo sapiens
atttttttaaacaa

SEQ ID NO: 4992516 - DNA, 21 bp, Homo sapiens
caaaataatctatattaaatg

SEQ ID NO: 4992517 - DNA, 19 bp, Homo sapiens
caaaatgtacttaaatgag

SEQ ID NO: 4992518 - DNA, 21 bp, Homo sapiens
caaacatgggtggtaacaaga

SEQ ID NO: 4992519 - DNA, 21 bp, Homo sapiens
caaatgggttaatcctgaatt

SEQ ID NO: 4992520 - DNA, 13 bp, Homo sapiens
caaattttttaat

SEQ ID NO: 4992521 - DNA, 13 bp, Homo sapiens
caacaattttcta

SEQ ID NO: 4992522 - DNA, 21 bp, Homo sapiens
caaccagaaacaatgtgtcta

SEQ ID NO: 4992523 - DNA, 20 bp, Homo sapiens
caagcacatctgcattttca

SEQ ID NO: 4992524 - DNA, 18 bp, Homo sapiens
caagcatttttccatctg

SEQ ID NO: 4992525 - DNA, 13 bp, Homo sapiens
caaggaatacaag

SEQ ID NO: 4992526 - DNA, 20 bp, Homo sapiens
caagtatgaagtataaatct

SEQ ID NO: 4992527 - DNA, 18 bp, Homo sapiens
caagtctctgctggccca

SEQ ID NO: 4992528 - DNA, 19 bp, Homo sapiens
caagtctctgctggcccag

SEQ ID NO: 4992529 - DNA, 18 bp, Homo sapiens
caatatattttgaaatat

SEQ ID NO: 4992530 - DNA, 22 bp, Homo sapiens
caatgatacccaacagtttatt

SEQ ID NO: 4992531 - DNA, 21 bp, Homo sapiens
caatgatcacatctaaagctt

SEQ ID NO: 4992532 - DNA, 18 bp, Homo sapiens
caattgtgagccaccacg

SEQ ID NO: 4992533 - DNA, 23 bp, Homo sapiens
cacagtctggagtgatagctact

SEQ ID NO: 4992534 - DNA, 14 bp, Homo sapiens
cacatctaaagctt

SEQ ID NO: 4992535 - DNA, 15 bp, Homo sapiens
caccacgtccagctg

SEQ ID NO: 4992536 - DNA, 16 bp, Homo sapiens
caccatggccagccaa

SEQ ID NO: 4992537 - DNA, 12 bp, Homo sapiens
caccccatccca

SEQ ID NO: 4992538 - DNA, 21 bp, Homo sapiens
caccccatcccacaccctgga

SEQ ID NO: 4992539 - DNA, 13 bp, Homo sapiens
cacccccatctct

SEQ ID NO: 4992540 - DNA, 18 bp, Homo sapiens
cacctgtctcagcctccc

SEQ ID NO: 4992541 - DNA, 19 bp, Homo sapiens
cacctgtctcagcctccca

SEQ ID NO: 4992542 - DNA, 12 bp, Homo sapiens
cactaagaaaga

SEQ ID NO: 4992543 - DNA, 14 bp, Homo sapiens
cactaagaaagaaa

SEQ ID NO: 4992544 - DNA, 23 bp, Homo sapiens
cactaagaaagaaaggaaagaag

SEQ ID NO: 4992545 - DNA, 19 bp, Homo sapiens
cactcatgcaaactgcttt

SEQ ID NO: 4992546 - DNA, 21 bp, Homo sapiens
cactcatgcaaactgctttat

SEQ ID NO: 4992547 - DNA, 20 bp, Homo sapiens
cactgacagcctcccacccc

SEQ ID NO: 4992548 - DNA, 20 bp, Homo sapiens
cactgatcaccatgtaaggt

SEQ ID NO: 4992549 - DNA, 17 bp, Homo sapiens
cactggcatcgcagctt

SEQ ID NO: 4992550 - DNA, 21 bp, Homo sapiens
cactggcatcgcagcttcctg

SEQ ID NO: 4992551 - DNA, 23 bp, Homo sapiens
cactgtgtttttttttttttccc

SEQ ID NO: 4992552 - DNA, 13 bp, Homo sapiens
cactgttgaattt

SEQ ID NO: 4992553 - DNA, 17 bp, Homo sapiens
cactgttgaattttctc

SEQ ID NO: 4992554 - DNA, 14 bp, Homo sapiens
cacttttattttca

SEQ ID NO: 4992555 - DNA, 15 bp, Homo sapiens
cagaaacaatgtgtc

SEQ ID NO: 4992556 - DNA, 17 bp, Homo sapiens
cagaaacaatgtgtcta

SEQ ID NO: 4992557 - DNA, 14 bp, Homo sapiens
cagaattggcataa

SEQ ID NO: 4992558 - DNA, 13 bp, Homo sapiens
cagacaaatgaaa

SEQ ID NO: 4992559 - DNA, 17 bp, Homo sapiens
cagacaaatgaaataat

SEQ ID NO: 4992560 - DNA, 22 bp, Homo sapiens
cagatgctgaattgagaataag

SEQ ID NO: 4992561 - DNA, 18 bp, Homo sapiens
cagatttaagccttgaca

SEQ ID NO: 4992562 - DNA, 19 bp, Homo sapiens
cagcctcccacccccatct

SEQ ID NO: 4992563 - DNA, 20 bp, Homo sapiens
cagctagtgccaaataattg

SEQ ID NO: 4992564 - DNA, 22 bp, Homo sapiens
caggccaatatattttgaaata

SEQ ID NO: 4992565 - DNA, 19 bp, Homo sapiens
caggcgatccacctgtctc

SEQ ID NO: 4992566 - DNA, 13 bp, Homo sapiens
caggctggtctca

SEQ ID NO: 4992567 - DNA, 13 bp, Homo sapiens
cagggaaactaat

SEQ ID NO: 4992568 - DNA, 16 bp, Homo sapiens
caggtaatttaaattg

SEQ ID NO: 4992569 - DNA, 20 bp, Homo sapiens
caggtccccaattgagaatg

SEQ ID NO: 4992570 - DNA, 21 bp, Homo sapiens
cagtgagtgccatgctttttg

SEQ ID NO: 4992571 - DNA, 18 bp, Homo sapiens
cagtttcatgtatgtata

SEQ ID NO: 4992572 - DNA, 14 bp, Homo sapiens
cataatttgtctta

SEQ ID NO: 4992573 - DNA, 21 bp, Homo sapiens
cataatttgtcttagttgata

SEQ ID NO: 4992574 - DNA, 14 bp, Homo sapiens
catatatttaactt

SEQ ID NO: 4992575 - DNA, 21 bp, Homo sapiens
catatatttcacactggagtg

SEQ ID NO: 4992576 - DNA, 15 bp, Homo sapiens
catcactacaaaaag

SEQ ID NO: 4992577 - DNA, 13 bp, Homo sapiens
catcgcagcttcc

SEQ ID NO: 4992578 - DNA, 12 bp, Homo sapiens
catctctccctc

SEQ ID NO: 4992579 - DNA, 20 bp, Homo sapiens
catctctccctcccctgcca

SEQ ID NO: 4992580 - DNA, 19 bp, Homo sapiens
catctgcattttcacccca

SEQ ID NO: 4992581 - DNA, 15 bp, Homo sapiens
catctgcctgtaatt

SEQ ID NO: 4992582 - DNA, 13 bp, Homo sapiens
catcttttacatt

SEQ ID NO: 4992583 - DNA, 22 bp, Homo sapiens
catgcaaactgctttattttcc

SEQ ID NO: 4992584 - DNA, 23 bp, Homo sapiens
catgcaaactgctttattttccc

SEQ ID NO: 4992585 - DNA, 21 bp, Homo sapiens
catgccaccatggccagccaa

SEQ ID NO: 4992586 - DNA, 15 bp, Homo sapiens
catgctttttggtga

SEQ ID NO: 4992587 - DNA, 14 bp, Homo sapiens
catggtagtttaaa

SEQ ID NO: 4992588 - DNA, 15 bp, Homo sapiens
cattaactaaatgct

SEQ ID NO: 4992589 - DNA, 23 bp, Homo sapiens
cattctaggtaggggcccacttc

SEQ ID NO: 4992590 - DNA, 12 bp, Homo sapiens
cattgtgattta

SEQ ID NO: 4992591 - DNA, 11 bp, Homo sapiens
catttatcaat

SEQ ID NO: 4992592 - DNA, 12 bp, Homo sapiens
catttatttctc

SEQ ID NO: 4992593 - DNA, 16 bp, Homo sapiens
catttggttaaatcat

SEQ ID NO: 4992594 - DNA, 13 bp, Homo sapiens
ccaacagtttatt

SEQ ID NO: 4992595 - DNA, 21 bp, Homo sapiens
ccaagtatgaagtataaatct

SEQ ID NO: 4992596 - DNA, 16 bp, Homo sapiens
ccaatccatgcttcac

SEQ ID NO: 4992597 - DNA, 21 bp, Homo sapiens
ccaccatggccagccaacttt

SEQ ID NO: 4992598 - DNA, 16 bp, Homo sapiens
ccacctgtctcagcct

SEQ ID NO: 4992599 - DNA, 23 bp, Homo sapiens
ccacctgtctcagcctcccagag

SEQ ID NO: 4992600 - DNA, 19 bp, Homo sapiens
ccactgacagcctcccacc

SEQ ID NO: 4992601 - DNA, 17 bp, Homo sapiens
ccagccaaaccctgtct

SEQ ID NO: 4992602 - DNA, 18 bp, Homo sapiens
ccagccaaaccctgtctg

SEQ ID NO: 4992603 - DNA, 21 bp, Homo sapiens
ccagctagtgccaaataattg

SEQ ID NO: 4992604 - DNA, 18 bp, Homo sapiens
ccatagagtaatgatgta

SEQ ID NO: 4992605 - DNA, 14 bp, Homo sapiens
ccatatatgctgta

SEQ ID NO: 4992606 - DNA, 18 bp, Homo sapiens
ccatatatgctgtatttc

SEQ ID NO: 4992607 - DNA, 14 bp, Homo sapiens
ccatcccacaccct

SEQ ID NO: 4992608 - DNA, 16 bp, Homo sapiens
ccatgagctgcactga

SEQ ID NO: 4992609 - DNA, 21 bp, Homo sapiens
ccatgagctgcactgatcacc

SEQ ID NO: 4992610 - DNA, 19 bp, Homo sapiens
ccatggtagtttaaaacat

SEQ ID NO: 4992611 - DNA, 21 bp, Homo sapiens
ccatgtgtgctaatatacttt

SEQ ID NO: 4992612 - DNA, 14 bp, Homo sapiens
ccatttttgctaat

SEQ ID NO: 4992613 - DNA, 17 bp, Homo sapiens
cccaacagtttattttt

SEQ ID NO: 4992614 - DNA, 17 bp, Homo sapiens
cccagccaaaccctgtc

SEQ ID NO: 4992615 - DNA, 15 bp, Homo sapiens
cccatcccacaccct

SEQ ID NO: 4992616 - DNA, 18 bp, Homo sapiens
cccatctctccctcccct

SEQ ID NO: 4992617 - DNA, 16 bp, Homo sapiens
ccccatcccacaccct

SEQ ID NO: 4992618 - DNA, 12 bp, Homo sapiens
ccccatctctcc

SEQ ID NO: 4992619 - DNA, 12 bp, Homo sapiens
cccctccttctc

SEQ ID NO: 4992620 - DNA, 22 bp, Homo sapiens
cccggctcgagcagtcctgcct

SEQ ID NO: 4992621 - DNA, 23 bp, Homo sapiens
cctaaaaggaaatctcaccccat

SEQ ID NO: 4992622 - DNA, 13 bp, Homo sapiens
cctcccaccccca

SEQ ID NO: 4992623 - DNA, 20 bp, Homo sapiens
cctctccccaatccatgctt

SEQ ID NO: 4992624 - DNA, 23 bp, Homo sapiens
cctctccccaatccatgcttcac

SEQ ID NO: 4992625 - DNA, 13 bp, Homo sapiens
cctctgtacagac

SEQ ID NO: 4992626 - DNA, 22 bp, Homo sapiens
cctgattaccagtctgattata

SEQ ID NO: 4992627 - DNA, 13 bp, Homo sapiens
cctgcctcagcct

SEQ ID NO: 4992628 - DNA, 17 bp, Homo sapiens
cctgccttttaagtttg

SEQ ID NO: 4992629 - DNA, 21 bp, Homo sapiens
cctgctgaaagtcctgctttc

SEQ ID NO: 4992630 - DNA, 16 bp, Homo sapiens
cctggttttatttata

SEQ ID NO: 4992631 - DNA, 15 bp, Homo sapiens
cctgtctcagcctcc

SEQ ID NO: 4992632 - DNA, 14 bp, Homo sapiens
cctgtctgtttata

SEQ ID NO: 4992633 - DNA, 15 bp, Homo sapiens
cctgtctgtttatat

SEQ ID NO: 4992634 - DNA, 18 bp, Homo sapiens
ccttatgtgttacattat

SEQ ID NO: 4992635 - DNA, 16 bp, Homo sapiens
ccttcccctccttctc

SEQ ID NO: 4992636 - DNA, 15 bp, Homo sapiens
ccttgacacactgtg

SEQ ID NO: 4992637 - DNA, 15 bp, Homo sapiens
cgatccacctgtctc

SEQ ID NO: 4992638 - DNA, 20 bp, Homo sapiens
cgatccacctgtctcagcct

SEQ ID NO: 4992639 - DNA, 22 bp, Homo sapiens
cgatccacctgtctcagcctcc

SEQ ID NO: 4992640 - DNA, 21 bp, Homo sapiens
cgcagcttcctgtctgtttat

SEQ ID NO: 4992641 - DNA, 20 bp, Homo sapiens
cggctcgagcagtcctgcct

SEQ ID NO: 4992642 - DNA, 14 bp, Homo sapiens
cgtataatgctttc

SEQ ID NO: 4992643 - DNA, 14 bp, Homo sapiens
cgttttgtattgct

SEQ ID NO: 4992644 - DNA, 14 bp, Homo sapiens
ctaaagggagaaat

SEQ ID NO: 4992645 - DNA, 16 bp, Homo sapiens
ctaagaaagaaaggaa

SEQ ID NO: 4992646 - DNA, 21 bp, Homo sapiens
ctaagaaagaaaggaaagaag

SEQ ID NO: 4992647 - DNA, 12 bp, Homo sapiens
ctaagactgctt

SEQ ID NO: 4992648 - DNA, 21 bp, Homo sapiens
ctaagtgccaacaattttcta

SEQ ID NO: 4992649 - DNA, 11 bp, Homo sapiens
ctaatctgcct

SEQ ID NO: 4992650 - DNA, 19 bp, Homo sapiens
ctaattatcaatgggatat

SEQ ID NO: 4992651 - DNA, 22 bp, Homo sapiens
ctacaaaaagaagagtttgtga

SEQ ID NO: 4992652 - DNA, 18 bp, Homo sapiens
ctacaagcttttaacttt

SEQ ID NO: 4992653 - DNA, 20 bp, Homo sapiens
ctacattaaacaatgatcac

SEQ ID NO: 4992654 - DNA, 19 bp, Homo sapiens
ctacattcttggttgttaa

SEQ ID NO: 4992655 - DNA, 19 bp, Homo sapiens
ctacctttttatatttaaa

SEQ ID NO: 4992656 - DNA, 20 bp, Homo sapiens
ctacctttttatatttaaaa

SEQ ID NO: 4992657 - DNA, 14 bp, Homo sapiens
ctactgtagaaagg

SEQ ID NO: 4992658 - DNA, 18 bp, Homo sapiens
ctagcatttatttctctg

SEQ ID NO: 4992659 - DNA, 22 bp, Homo sapiens
ctaggctttatttataaaataa

SEQ ID NO: 4992660 - DNA, 19 bp, Homo sapiens
ctagtgccaaataattgat

SEQ ID NO: 4992661 - DNA, 13 bp, Homo sapiens
ctatacctgcctt

SEQ ID NO: 4992662 - DNA, 15 bp, Homo sapiens
ctatgtattttgtga

SEQ ID NO: 4992663 - DNA, 13 bp, Homo sapiens
ctattaagaaggc

SEQ ID NO: 4992664 - DNA, 15 bp, Homo sapiens
ctcaatataaaaaca

SEQ ID NO: 4992665 - DNA, 21 bp, Homo sapiens
ctcactgttgaattttctcta

SEQ ID NO: 4992666 - DNA, 20 bp, Homo sapiens
ctcagcctcccagagtgctg

SEQ ID NO: 4992667 - DNA, 20 bp, Homo sapiens
ctcagcctccggagtagctg

SEQ ID NO: 4992668 - DNA, 16 bp, Homo sapiens
ctcatagattgcaaat

SEQ ID NO: 4992669 - DNA, 19 bp, Homo sapiens
ctcattaaactctaaagat

SEQ ID NO: 4992670 - DNA, 18 bp, Homo sapiens
ctccaattctgaaatact

SEQ ID NO: 4992671 - DNA, 19 bp, Homo sapiens
ctccaattctgaaatactt

SEQ ID NO: 4992672 - DNA, 18 bp, Homo sapiens
ctccagtataatctcctc

SEQ ID NO: 4992673 - DNA, 18 bp, Homo sapiens
ctccctcccctgccattt

SEQ ID NO: 4992674 - DNA, 13 bp, Homo sapiens
ctcccttctgtag

SEQ ID NO: 4992675 - DNA, 21 bp, Homo sapiens
ctccctttttatatcccattt

SEQ ID NO: 4992676 - DNA, 17 bp, Homo sapiens
ctcctgccctttcccag

SEQ ID NO: 4992677 - DNA, 13 bp, Homo sapiens
ctcctgggctcag

SEQ ID NO: 4992678 - DNA, 17 bp, Homo sapiens
ctcgagcagtcctgcct

SEQ ID NO: 4992679 - DNA, 18 bp, Homo sapiens
ctctccccaatccatgct

SEQ ID NO: 4992680 - DNA, 22 bp, Homo sapiens
ctctccccaatccatgcttcac

SEQ ID NO: 4992681 - DNA, 15 bp, Homo sapiens
ctctggcaaactttt

SEQ ID NO: 4992682 - DNA, 12 bp, Homo sapiens
ctctgtacagac

SEQ ID NO: 4992683 - DNA, 18 bp, Homo sapiens
ctgaaagtcctgctttcc

SEQ ID NO: 4992684 - DNA, 10 bp, Homo sapiens
ctgaaataca

SEQ ID NO: 4992685 - DNA, 11 bp, Homo sapiens
ctgaagaacag

SEQ ID NO: 4992686 - DNA, 17 bp, Homo sapiens
ctgacccaacagcctct

SEQ ID NO: 4992687 - DNA, 18 bp, Homo sapiens
ctgacctggatatccatg

SEQ ID NO: 4992688 - DNA, 16 bp, Homo sapiens
ctgactctgttattga

SEQ ID NO: 4992689 - DNA, 18 bp, Homo sapiens
ctgattaccagtctgatt

SEQ ID NO: 4992690 - DNA, 20 bp, Homo sapiens
ctgattataccatgtgtgct

SEQ ID NO: 4992691 - DNA, 12 bp, Homo sapiens
ctgcctcagcct

SEQ ID NO: 4992692 - DNA, 21 bp, Homo sapiens
ctgccttttaagtttgaaact

SEQ ID NO: 4992693 - DNA, 15 bp, Homo sapiens
ctgctggcccagcca

SEQ ID NO: 4992694 - DNA, 16 bp, Homo sapiens
ctgctggcccagccaa

SEQ ID NO: 4992695 - DNA, 14 bp, Homo sapiens
ctgcttctctttgt

SEQ ID NO: 4992696 - DNA, 20 bp, Homo sapiens
ctggatatccatgagctgca

SEQ ID NO: 4992697 - DNA, 20 bp, Homo sapiens
ctggcaaacttttctttctt

SEQ ID NO: 4992698 - DNA, 16 bp, Homo sapiens
ctggcatatctctgtt

SEQ ID NO: 4992699 - DNA, 20 bp, Homo sapiens
ctggcatcgcagcttcctgt

SEQ ID NO: 4992700 - DNA, 17 bp, Homo sapiens
ctggcccagccaaaccc

SEQ ID NO: 4992701 - DNA, 22 bp, Homo sapiens
ctgggaccacaggttcatgcca

SEQ ID NO: 4992702 - DNA, 14 bp, Homo sapiens
ctgggcagtgagtg

SEQ ID NO: 4992703 - DNA, 17 bp, Homo sapiens
ctgggcagtgagtgcca

SEQ ID NO: 4992704 - DNA, 21 bp, Homo sapiens
ctgggcagtgagtgccatgct

SEQ ID NO: 4992705 - DNA, 19 bp, Homo sapiens
ctgggcttggtaagtgaat

SEQ ID NO: 4992706 - DNA, 20 bp, Homo sapiens
ctgtaatcccagcactttgg

SEQ ID NO: 4992707 - DNA, 19 bp, Homo sapiens
ctgtaattaaactagttta

SEQ ID NO: 4992708 - DNA, 13 bp, Homo sapiens
ctgtagaaaggaa

SEQ ID NO: 4992709 - DNA, 17 bp, Homo sapiens
ctgtagaaaggaaatag

SEQ ID NO: 4992710 - DNA, 18 bp, Homo sapiens
ctgtagtttttaattaaa

SEQ ID NO: 4992711 - DNA, 14 bp, Homo sapiens
ctgtataaaaatgt

SEQ ID NO: 4992712 - DNA, 18 bp, Homo sapiens
ctgtataaaaatgtaaat

SEQ ID NO: 4992713 - DNA, 15 bp, Homo sapiens
ctgtatttcagtatt

SEQ ID NO: 4992714 - DNA, 16 bp, Homo sapiens
ctgtatttcagtattt

SEQ ID NO: 4992715 - DNA, 21 bp, Homo sapiens
ctgtatttcagtattttccag

SEQ ID NO: 4992716 - DNA, 22 bp, Homo sapiens
ctgtatttctttgtagaataaa

SEQ ID NO: 4992717 - DNA, 12 bp, Homo sapiens
ctgtccctcact

SEQ ID NO: 4992718 - DNA, 17 bp, Homo sapiens
ctgtctcagcctcccag

SEQ ID NO: 4992719 - DNA, 17 bp, Homo sapiens
ctgtggccatatatgct

SEQ ID NO: 4992720 - DNA, 21 bp, Homo sapiens
cttaaagcttgatttgatctt

SEQ ID NO: 4992721 - DNA, 17 bp, Homo sapiens
cttaactgtatttcagt

SEQ ID NO: 4992722 - DNA, 20 bp, Homo sapiens
cttaactgtatttcagtatt

SEQ ID NO: 4992723 - DNA, 21 bp, Homo sapiens
cttaactgtatttcagtattt

SEQ ID NO: 4992724 - DNA, 23 bp, Homo sapiens
cttagttgatattcaaggcttta

SEQ ID NO: 4992725 - DNA, 16 bp, Homo sapiens
cttatcactaagaaag

SEQ ID NO: 4992726 - DNA, 19 bp, Homo sapiens
cttatcactaagaaagaaa

SEQ ID NO: 4992727 - DNA, 20 bp, Homo sapiens
cttatcactaagaaagaaag

SEQ ID NO: 4992728 - DNA, 14 bp, Homo sapiens
cttatgtgttacat

SEQ ID NO: 4992729 - DNA, 21 bp, Homo sapiens
cttcactcatgcaaactgctt

SEQ ID NO: 4992730 - DNA, 23 bp, Homo sapiens
cttcactcatgcaaactgcttta

SEQ ID NO: 4992731 - DNA, 20 bp, Homo sapiens
cttcagaggctcatctaact

SEQ ID NO: 4992732 - DNA, 15 bp, Homo sapiens
cttcctcaatgcatt

SEQ ID NO: 4992733 - DNA, 22 bp, Homo sapiens
cttcctgattaccagtctgatt

SEQ ID NO: 4992734 - DNA, 15 bp, Homo sapiens
cttcctgtctgttta

SEQ ID NO: 4992735 - DNA, 18 bp, Homo sapiens
cttctgtagtttttaatt

SEQ ID NO: 4992736 - DNA, 17 bp, Homo sapiens
cttgatttgatctttgt

SEQ ID NO: 4992737 - DNA, 22 bp, Homo sapiens
cttgtgctggtttttagatttt

SEQ ID NO: 4992738 - DNA, 21 bp, Homo sapiens
cttgttacaaattttttaatt

SEQ ID NO: 4992739 - DNA, 22 bp, Homo sapiens
cttgttacaaattttttaattt

SEQ ID NO: 4992740 - DNA, 17 bp, Homo sapiens
cttgttattaatgtttc

SEQ ID NO: 4992741 - DNA, 14 bp, Homo sapiens
cttgttccctctcc

SEQ ID NO: 4992742 - DNA, 21 bp, Homo sapiens
ctttaaaagtcattattcctg

SEQ ID NO: 4992743 - DNA, 21 bp, Homo sapiens
ctttaaagataagtctacatt

SEQ ID NO: 4992744 - DNA, 14 bp, Homo sapiens
ctttatctttgtgt

SEQ ID NO: 4992745 - DNA, 21 bp, Homo sapiens
ctttcccaggtaatttaaatt

SEQ ID NO: 4992746 - DNA, 22 bp, Homo sapiens
ctttcccaggtaatttaaattg

SEQ ID NO: 4992747 - DNA, 17 bp, Homo sapiens
ctttcctatctagcatt

SEQ ID NO: 4992748 - DNA, 20 bp, Homo sapiens
ctttctgagtgagttttact

SEQ ID NO: 4992749 - DNA, 13 bp, Homo sapiens
ctttgctgttact

SEQ ID NO: 4992750 - DNA, 17 bp, Homo sapiens
ctttgtgtaatctaagt

SEQ ID NO: 4992751 - DNA, 16 bp, Homo sapiens
ctttgtttaaatgcca

SEQ ID NO: 4992752 - DNA, 17 bp, Homo sapiens
ctttgtttaaatgccaa

SEQ ID NO: 4992753 - DNA, 22 bp, Homo sapiens
cttttattgcaccattttcaat

SEQ ID NO: 4992754 - DNA, 14 bp, Homo sapiens
cttttctttctttt

SEQ ID NO: 4992755 - DNA, 12 bp, Homo sapiens
ctttttttgtta

SEQ ID NO: 4992756 - DNA, 21 bp, Homo sapiens
gaaaaacttttaggttgttac

SEQ ID NO: 4992757 - DNA, 13 bp, Homo sapiens
gaaaaaggatgga

SEQ ID NO: 4992758 - DNA, 19 bp, Homo sapiens
gaaaaaggatggaagaaag

SEQ ID NO: 4992759 - DNA, 13 bp, Homo sapiens
gaaaagtaaaaaa

SEQ ID NO: 4992760 - DNA, 14 bp, Homo sapiens
gaaaagtaaaaaat

SEQ ID NO: 4992761 - DNA, 18 bp, Homo sapiens
gaaaatgaatgaatacct

SEQ ID NO: 4992762 - DNA, 19 bp, Homo sapiens
gaaaatggaaagaaggaaa

SEQ ID NO: 4992763 - DNA, 19 bp, Homo sapiens
gaaagaaaatggaaagaag

SEQ ID NO: 4992764 - DNA, 11 bp, Homo sapiens
gaaagaaagga

SEQ ID NO: 4992765 - DNA, 16 bp, Homo sapiens
gaaagaaaggaaagaa

SEQ ID NO: 4992766 - DNA, 18 bp, Homo sapiens
gaaagaaaggaaagaagg

SEQ ID NO: 4992767 - DNA, 19 bp, Homo sapiens
gaaagaaaggaaagaagga

SEQ ID NO: 4992768 - DNA, 11 bp, Homo sapiens
gaaagaaggaa

SEQ ID NO: 4992769 - DNA, 13 bp, Homo sapiens
gaaagaaggaaaa

SEQ ID NO: 4992770 - DNA, 13 bp, Homo sapiens
gaaaggaaataga

SEQ ID NO: 4992771 - DNA, 14 bp, Homo sapiens
gaaaggaaatagac

SEQ ID NO: 4992772 - DNA, 19 bp, Homo sapiens
gaaaggctatcctgctgaa

SEQ ID NO: 4992773 - DNA, 16 bp, Homo sapiens
gaaagtcctgctttcc

SEQ ID NO: 4992774 - DNA, 19 bp, Homo sapiens
gaaataatgtacatctggc

SEQ ID NO: 4992775 - DNA, 14 bp, Homo sapiens
gaaatagactttgt

SEQ ID NO: 4992776 - DNA, 22 bp, Homo sapiens
gaaatagaggtgatgctgctaa

SEQ ID NO: 4992777 - DNA, 12 bp, Homo sapiens
gaaatctcaccc

SEQ ID NO: 4992778 - DNA, 14 bp, Homo sapiens
gaagaaagaaaatg

SEQ ID NO: 4992779 - DNA, 22 bp, Homo sapiens
gaagaaagaaaatggaaagaag

SEQ ID NO: 4992780 - DNA, 14 bp, Homo sapiens
gaagaaagaagcat

SEQ ID NO: 4992781 - DNA, 20 bp, Homo sapiens
gaaggagatgaatagaagaa

SEQ ID NO: 4992782 - DNA, 21 bp, Homo sapiens
gaaggagatgaatagaagaaa

SEQ ID NO: 4992783 - DNA, 22 bp, Homo sapiens
gaaggagatgaatagaagaaag

SEQ ID NO: 4992784 - DNA, 14 bp, Homo sapiens
gaagttttttactt

SEQ ID NO: 4992785 - DNA, 16 bp, Homo sapiens
gaagttttttactttg

SEQ ID NO: 4992786 - DNA, 13 bp, Homo sapiens
gaatagaagaaag

SEQ ID NO: 4992787 - DNA, 16 bp, Homo sapiens
gaatagaagaaagaaa

SEQ ID NO: 4992788 - DNA, 23 bp, Homo sapiens
gaatgtacatactgaaaaataca

SEQ ID NO: 4992789 - DNA, 19 bp, Homo sapiens
gaattaccatagagtaatg

SEQ ID NO: 4992790 - DNA, 17 bp, Homo sapiens
gaattggcataatttgt

SEQ ID NO: 4992791 - DNA, 14 bp, Homo sapiens
gaatttaaaatgta

SEQ ID NO: 4992792 - DNA, 15 bp, Homo sapiens
gaatttaaaatgtag

SEQ ID NO: 4992793 - DNA, 16 bp, Homo sapiens
gaatttaaaatgtagt

SEQ ID NO: 4992794 - DNA, 18 bp, Homo sapiens
gacaaatgaaataataaa

SEQ ID NO: 4992795 - DNA, 11 bp, Homo sapiens
gacagcctccc

SEQ ID NO: 4992796 - DNA, 15 bp, Homo sapiens
gacataattgtccag

SEQ ID NO: 4992797 - DNA, 13 bp, Homo sapiens
gacatctgcctgt

SEQ ID NO: 4992798 - DNA, 16 bp, Homo sapiens
gacatctgcctgtaat

SEQ ID NO: 4992799 - DNA, 20 bp, Homo sapiens
gacatctgcctgtaattaaa

SEQ ID NO: 4992800 - DNA, 12 bp, Homo sapiens
gacattcactgg

SEQ ID NO: 4992801 - DNA, 17 bp, Homo sapiens
gaccgttttgtattgct

SEQ ID NO: 4992802 - DNA, 18 bp, Homo sapiens
gaccgttttgtattgctt

SEQ ID NO: 4992803 - DNA, 19 bp, Homo sapiens
gactgcaagcatttttcca

SEQ ID NO: 4992804 - DNA, 23 bp, Homo sapiens
gactgggtctcgctttgttgccc

SEQ ID NO: 4992805 - DNA, 17 bp, Homo sapiens
gacttgggatctgcaag

SEQ ID NO: 4992806 - DNA, 21 bp, Homo sapiens
gactttgctgttactgcttct

SEQ ID NO: 4992807 - DNA, 16 bp, Homo sapiens
gagatgaatagaagaa

SEQ ID NO: 4992808 - DNA, 15 bp, Homo sapiens
gagatttactgctct

SEQ ID NO: 4992809 - DNA, 20 bp, Homo sapiens
gagcagtcctgcctcagcct

SEQ ID NO: 4992810 - DNA, 21 bp, Homo sapiens
gagcattaactaaatgctcat

SEQ ID NO: 4992811 - DNA, 17 bp, Homo sapiens
gagcgtttggttaaagt

SEQ ID NO: 4992812 - DNA, 17 bp, Homo sapiens
gagctgcactgatcacc

SEQ ID NO: 4992813 - DNA, 20 bp, Homo sapiens
gaggcggagcttgcagtgag

SEQ ID NO: 4992814 - DNA, 18 bp, Homo sapiens
gagggtttctgatctgta

SEQ ID NO: 4992815 - DNA, 21 bp, Homo sapiens
gagggtttctgatctgtactt

SEQ ID NO: 4992816 - DNA, 18 bp, Homo sapiens
gagtgaatgtaatagtct

SEQ ID NO: 4992817 - DNA, 23 bp, Homo sapiens
gagttctatggagactttgctgt

SEQ ID NO: 4992818 - DNA, 18 bp, Homo sapiens
gagttgttgtttgccaag

SEQ ID NO: 4992819 - DNA, 18 bp, Homo sapiens
gatacccaacagtttatt

SEQ ID NO: 4992820 - DNA, 14 bp, Homo sapiens
gatagaaaaaggat

SEQ ID NO: 4992821 - DNA, 20 bp, Homo sapiens
gatagaaaaaggatggaaga

SEQ ID NO: 4992822 - DNA, 21 bp, Homo sapiens
gatagaaaaaggatggaagaa

SEQ ID NO: 4992823 - DNA, 20 bp, Homo sapiens
gatagctactgtagaaagga

SEQ ID NO: 4992824 - DNA, 21 bp, Homo sapiens
gatagctactgtagaaaggaa

SEQ ID NO: 4992825 - DNA, 18 bp, Homo sapiens
gatattatatacaacaca

SEQ ID NO: 4992826 - DNA, 18 bp, Homo sapiens
gatattcaaggctttaaa

SEQ ID NO: 4992827 - DNA, 15 bp, Homo sapiens
gatcaaaaaaatata

SEQ ID NO: 4992828 - DNA, 16 bp, Homo sapiens
gatcagatgctgaatt

SEQ ID NO: 4992829 - DNA, 18 bp, Homo sapiens
gatctgtataaaaatgta

SEQ ID NO: 4992830 - DNA, 17 bp, Homo sapiens
gatctttgtttaaatgc

SEQ ID NO: 4992831 - DNA, 18 bp, Homo sapiens
gatctttgtttaaatgcc

SEQ ID NO: 4992832 - DNA, 19 bp, Homo sapiens
gatctttgtttaaatgcca

SEQ ID NO: 4992833 - DNA, 13 bp, Homo sapiens
gatgaaataattt

SEQ ID NO: 4992834 - DNA, 16 bp, Homo sapiens
gatgctattaagaagg

SEQ ID NO: 4992835 - DNA, 13 bp, Homo sapiens
gatggaagaaaga

SEQ ID NO: 4992836 - DNA, 14 bp, Homo sapiens
gatggaagaaagaa

SEQ ID NO: 4992837 - DNA, 16 bp, Homo sapiens
gatggaagaaagaagc

SEQ ID NO: 4992838 - DNA, 17 bp, Homo sapiens
gatggaagaaagaagca

SEQ ID NO: 4992839 - DNA, 21 bp, Homo sapiens
gatggcaactgtattaaagaa

SEQ ID NO: 4992840 - DNA, 23 bp, Homo sapiens
gatggcaactgtattaaagaaaa

SEQ ID NO: 4992841 - DNA, 22 bp, Homo sapiens
gatgtaacagtgcaagattttt

SEQ ID NO: 4992842 - DNA, 18 bp, Homo sapiens
gattagacctttatccag

SEQ ID NO: 4992843 - DNA, 16 bp, Homo sapiens
gattagggaaaatgga

SEQ ID NO: 4992844 - DNA, 20 bp, Homo sapiens
gattattttatcactacaag

SEQ ID NO: 4992845 - DNA, 16 bp, Homo sapiens
gattggatttgctgtg

SEQ ID NO: 4992846 - DNA, 18 bp, Homo sapiens
gattggatttgctgtgac

SEQ ID NO: 4992847 - DNA, 14 bp, Homo sapiens
gatttgaaaaactt

SEQ ID NO: 4992848 - DNA, 16 bp, Homo sapiens
gatttgaaaaactttt

SEQ ID NO: 4992849 - DNA, 15 bp, Homo sapiens
gatttgatctttgtt

SEQ ID NO: 4992850 - DNA, 22 bp, Homo sapiens
gatttgatctttgtttaaatgc

SEQ ID NO: 4992851 - DNA, 17 bp, Homo sapiens
gattttttttttaagtg

SEQ ID NO: 4992852 - DNA, 19 bp, Homo sapiens
gattttttttttaagtgac

SEQ ID NO: 4992853 - DNA, 21 bp, Homo sapiens
gattttttttttaagtgacat

SEQ ID NO: 4992854 - DNA, 18 bp, Homo sapiens
gcaactgtattaaagaaa

SEQ ID NO: 4992855 - DNA, 13 bp, Homo sapiens
gcacatctgcatt

SEQ ID NO: 4992856 - DNA, 14 bp, Homo sapiens
gcacctattgaatt

SEQ ID NO: 4992857 - DNA, 12 bp, Homo sapiens
gcacttttattt

SEQ ID NO: 4992858 - DNA, 19 bp, Homo sapiens
gcacttttattttcattgt

SEQ ID NO: 4992859 - DNA, 18 bp, Homo sapiens
gcagcctttgcctccccg

SEQ ID NO: 4992860 - DNA, 17 bp, Homo sapiens
gcagtcctgcctcagcc

SEQ ID NO: 4992861 - DNA, 14 bp, Homo sapiens
gcagtgagtgccat

SEQ ID NO: 4992862 - DNA, 15 bp, Homo sapiens
gcataatttgtctta

SEQ ID NO: 4992863 - DNA, 18 bp, Homo sapiens
gcattaactaaatgctca

SEQ ID NO: 4992864 - DNA, 18 bp, Homo sapiens
gcattttcaccccaccct

SEQ ID NO: 4992865 - DNA, 20 bp, Homo sapiens
gccaaaatgtacttaaatga

SEQ ID NO: 4992866 - DNA, 21 bp, Homo sapiens
gccaaaatgtacttaaatgag

SEQ ID NO: 4992867 - DNA, 15 bp, Homo sapiens
gccaaaccctgtctg

SEQ ID NO: 4992868 - DNA, 17 bp, Homo sapiens
gccaagctaatctgcct

SEQ ID NO: 4992869 - DNA, 18 bp, Homo sapiens
gccaagctaatctgcctg

SEQ ID NO: 4992870 - DNA, 13 bp, Homo sapiens
gccaagtggccac

SEQ ID NO: 4992871 - DNA, 18 bp, Homo sapiens
gccaccatggccagccaa

SEQ ID NO: 4992872 - DNA, 22 bp, Homo sapiens
gccaccttgttacaaatttttt

SEQ ID NO: 4992873 - DNA, 22 bp, Homo sapiens
gccataaaattgcagtttcatg

SEQ ID NO: 4992874 - DNA, 16 bp, Homo sapiens
gcctcccttttctcct

SEQ ID NO: 4992875 - DNA, 11 bp, Homo sapiens
gccttgacaca

SEQ ID NO: 4992876 - DNA, 15 bp, Homo sapiens
gcctttgcctccccg

SEQ ID NO: 4992877 - DNA, 14 bp, Homo sapiens
gccttttaagtttg

SEQ ID NO: 4992878 - DNA, 13 bp, Homo sapiens
gctagtgccaaat

SEQ ID NO: 4992879 - DNA, 18 bp, Homo sapiens
gctagtgccaaataattg

SEQ ID NO: 4992880 - DNA, 13 bp, Homo sapiens
gctattaagaagg

SEQ ID NO: 4992881 - DNA, 10 bp, Homo sapiens
gctcagctct

SEQ ID NO: 4992882 - DNA, 14 bp, Homo sapiens
gctcagctctgctt

SEQ ID NO: 4992883 - DNA, 22 bp, Homo sapiens
gctcaggcgatccacctgtctc

SEQ ID NO: 4992884 - DNA, 19 bp, Homo sapiens
gctgaaagtcctgctttcc

SEQ ID NO: 4992885 - DNA, 14 bp, Homo sapiens
gctggcccagccaa

SEQ ID NO: 4992886 - DNA, 19 bp, Homo sapiens
gctggtttttagatttttt

SEQ ID NO: 4992887 - DNA, 13 bp, Homo sapiens
gctgttactgctt

SEQ ID NO: 4992888 - DNA, 19 bp, Homo sapiens
gcttcctgtctgtttatat

SEQ ID NO: 4992889 - DNA, 23 bp, Homo sapiens
gcttctctgtttttcttctgaaa

SEQ ID NO: 4992890 - DNA, 21 bp, Homo sapiens
gcttctctttgtgcagtgtta

SEQ ID NO: 4992891 - DNA, 20 bp, Homo sapiens
gctttaaaagtcattattcc

SEQ ID NO: 4992892 - DNA, 14 bp, Homo sapiens
gctttatctttgtg

SEQ ID NO: 4992893 - DNA, 14 bp, Homo sapiens
gctttcctatctag

SEQ ID NO: 4992894 - DNA, 22 bp, Homo sapiens
ggaaaaaaggaggatagaaaaa

SEQ ID NO: 4992895 - DNA, 12 bp, Homo sapiens
ggaaagaaggaa

SEQ ID NO: 4992896 - DNA, 13 bp, Homo sapiens
ggaaagaaggaaa

SEQ ID NO: 4992897 - DNA, 16 bp, Homo sapiens
ggaaagaaggaaaaaa

SEQ ID NO: 4992898 - DNA, 19 bp, Homo sapiens
ggaaagaaggaaaaaagga

SEQ ID NO: 4992899 - DNA, 14 bp, Homo sapiens
ggaaagaaggagat

SEQ ID NO: 4992900 - DNA, 15 bp, Homo sapiens
ggaaagaaggagatg

SEQ ID NO: 4992901 - DNA, 12 bp, Homo sapiens
ggaagaaagaag

SEQ ID NO: 4992902 - DNA, 13 bp, Homo sapiens
ggaagaaagaagc

SEQ ID NO: 4992903 - DNA, 15 bp, Homo sapiens
ggaagaggttttatt

SEQ ID NO: 4992904 - DNA, 22 bp, Homo sapiens
ggagatgaatagaagaaagaaa

SEQ ID NO: 4992905 - DNA, 20 bp, Homo sapiens
ggaggcggagcttgcagtga

SEQ ID NO: 4992906 - DNA, 12 bp, Homo sapiens
ggatagaaaaag

SEQ ID NO: 4992907 - DNA, 12 bp, Homo sapiens
ggatggaagaaa

SEQ ID NO: 4992908 - DNA, 20 bp, Homo sapiens
ggcagtgagtgccatgcttt

SEQ ID NO: 4992909 - DNA, 21 bp, Homo sapiens
ggccaaacggtgcaacagaag

SEQ ID NO: 4992910 - DNA, 15 bp, Homo sapiens
ggccatatatgctgt

SEQ ID NO: 4992911 - DNA, 21 bp, Homo sapiens
ggcggagcttgcagtgagccg

SEQ ID NO: 4992912 - DNA, 18 bp, Homo sapiens
gggtataatgtgtctgtg

SEQ ID NO: 4992913 - DNA, 12 bp, Homo sapiens
gggttataatca

SEQ ID NO: 4992914 - DNA, 13 bp, Homo sapiens
gggttataatcag

SEQ ID NO: 4992915 - DNA, 23 bp, Homo sapiens
ggtctcaaactcctgggctcagg

SEQ ID NO: 4992916 - DNA, 18 bp, Homo sapiens
ggtctcacagtgttgccc

SEQ ID NO: 4992917 - DNA, 20 bp, Homo sapiens
ggtctcgctttgttgcccag

SEQ ID NO: 4992918 - DNA, 21 bp, Homo sapiens
ggtctcgctttgttgcccagg

SEQ ID NO: 4992919 - DNA, 15 bp, Homo sapiens
ggttaaatcatttgg

SEQ ID NO: 4992920 - DNA, 18 bp, Homo sapiens
ggtttctcattaaactct

SEQ ID NO: 4992921 - DNA, 20 bp, Homo sapiens
ggtttctgatctgtactttg

SEQ ID NO: 4992922 - DNA, 15 bp, Homo sapiens
gtaaacttgtgtatt

SEQ ID NO: 4992923 - DNA, 21 bp, Homo sapiens
gtaaattagtttgacactgct

SEQ ID NO: 4992924 - DNA, 20 bp, Homo sapiens
gtaacgaatttaaaatgtag

SEQ ID NO: 4992925 - DNA, 19 bp, Homo sapiens
gtaagaaagccaccttgtt

SEQ ID NO: 4992926 - DNA, 21 bp, Homo sapiens
gtaataaaaagagatgaaata

SEQ ID NO: 4992927 - DNA, 16 bp, Homo sapiens
gtactgtactgaagaa

SEQ ID NO: 4992928 - DNA, 17 bp, Homo sapiens
gtactgtactgaagaac

SEQ ID NO: 4992929 - DNA, 12 bp, Homo sapiens
gtacttaaatga

SEQ ID NO: 4992930 - DNA, 13 bp, Homo sapiens
gtacttaaatgag

SEQ ID NO: 4992931 - DNA, 22 bp, Homo sapiens
gtactttgtgtttagctacctt

SEQ ID NO: 4992932 - DNA, 19 bp, Homo sapiens
gtagaaagacatctgcctg

SEQ ID NO: 4992933 - DNA, 21 bp, Homo sapiens
gtagaaagacatctgcctgta

SEQ ID NO: 4992934 - DNA, 16 bp, Homo sapiens
gtaggcacttttattt

SEQ ID NO: 4992935 - DNA, 14 bp, Homo sapiens
gtataaaaatgtaa

SEQ ID NO: 4992936 - DNA, 21 bp, Homo sapiens
gtataatctcctctgctcatt

SEQ ID NO: 4992937 - DNA, 14 bp, Homo sapiens
gtataatgctttct

SEQ ID NO: 4992938 - DNA, 16 bp, Homo sapiens
gtataatgtgtctgtg

SEQ ID NO: 4992939 - DNA, 19 bp, Homo sapiens
gtatatgtgagaaatcaga

SEQ ID NO: 4992940 - DNA, 18 bp, Homo sapiens
gtatatttagttacgtat

SEQ ID NO: 4992941 - DNA, 14 bp, Homo sapiens
gtatgaactcttta

SEQ ID NO: 4992942 - DNA, 13 bp, Homo sapiens
gtatgatctgtgt

SEQ ID NO: 4992943 - DNA, 19 bp, Homo sapiens
gtatgatctgtgtaaaatc

SEQ ID NO: 4992944 - DNA, 16 bp, Homo sapiens
gtatgtccttcagctg

SEQ ID NO: 4992945 - DNA, 18 bp, Homo sapiens
gtattcaccctgggcagt

SEQ ID NO: 4992946 - DNA, 18 bp, Homo sapiens
gtatttaactacatctgc

SEQ ID NO: 4992947 - DNA, 20 bp, Homo sapiens
gtatttaactacatctgcct

SEQ ID NO: 4992948 - DNA, 19 bp, Homo sapiens
gtatttagactgtggccat

SEQ ID NO: 4992949 - DNA, 21 bp, Homo sapiens
gtattttccagccttatgtgt

SEQ ID NO: 4992950 - DNA, 14 bp, Homo sapiens
gtcaagtctctgct

SEQ ID NO: 4992951 - DNA, 17 bp, Homo sapiens
gtcaagtctctgctggc

SEQ ID NO: 4992952 - DNA, 17 bp, Homo sapiens
gtccagggtaagctggt

SEQ ID NO: 4992953 - DNA, 23 bp, Homo sapiens
gtctcacagtgttgcccaggctg

SEQ ID NO: 4992954 - DNA, 16 bp, Homo sapiens
gtctcgctttgttgcc

SEQ ID NO: 4992955 - DNA, 17 bp, Homo sapiens
gtctcgctttgttgccc

SEQ ID NO: 4992956 - DNA, 15 bp, Homo sapiens
gtctctgctggccca

SEQ ID NO: 4992957 - DNA, 15 bp, Homo sapiens
gtctgtgttgcttca

SEQ ID NO: 4992958 - DNA, 20 bp, Homo sapiens
gtgagtgccatgctttttgg

SEQ ID NO: 4992959 - DNA, 21 bp, Homo sapiens
gtgagttttactcttaaatca

SEQ ID NO: 4992960 - DNA, 22 bp, Homo sapiens
gtgatcttggcttactgcagcc

SEQ ID NO: 4992961 - DNA, 14 bp, Homo sapiens
gtgctaatatactt

SEQ ID NO: 4992962 - DNA, 17 bp, Homo sapiens
gtggccatatatgctgt

SEQ ID NO: 4992963 - DNA, 21 bp, Homo sapiens
gtggccatatatgctgtattt

SEQ ID NO: 4992964 - DNA, 14 bp, Homo sapiens
gtgtcctttctgaa

SEQ ID NO: 4992965 - DNA, 22 bp, Homo sapiens
gtgtgcaactaactgactctgt

SEQ ID NO: 4992966 - DNA, 14 bp, Homo sapiens
gttaaataaataga

SEQ ID NO: 4992967 - DNA, 20 bp, Homo sapiens
gttactgcttctctttgtgc

SEQ ID NO: 4992968 - DNA, 17 bp, Homo sapiens
gttacttagaatgccat

SEQ ID NO: 4992969 - DNA, 22 bp, Homo sapiens
gttacttagaatgccataaaat

SEQ ID NO: 4992970 - DNA, 18 bp, Homo sapiens
gttagatgctattaagaa

SEQ ID NO: 4992971 - DNA, 21 bp, Homo sapiens
gttagatgctattaagaaggc

SEQ ID NO: 4992972 - DNA, 21 bp, Homo sapiens
gttcagtgtcgggaattttcc

SEQ ID NO: 4992973 - DNA, 21 bp, Homo sapiens
gttctatggagactttgctgt

SEQ ID NO: 4992974 - DNA, 21 bp, Homo sapiens
gttcttacaagcttaaagctt

SEQ ID NO: 4992975 - DNA, 21 bp, Homo sapiens
gttgatggtagggtataatgt

SEQ ID NO: 4992976 - DNA, 15 bp, Homo sapiens
gttgcttttattgca

SEQ ID NO: 4992977 - DNA, 15 bp, Homo sapiens
gttgttgtttgccaa

SEQ ID NO: 4992978 - DNA, 17 bp, Homo sapiens
gtttaagggtggaaaaa

SEQ ID NO: 4992979 - DNA, 12 bp, Homo sapiens
aaatctttttat

SEQ ID NO: 4992980 - DNA, 13 bp, Homo sapiens
aaatgagttactt

SEQ ID NO: 4992981 - DNA, 21 bp, Homo sapiens
aaatgccaaaatgtacttaaa

SEQ ID NO: 4992982 - DNA, 15 bp, Homo sapiens
aaatggaaagaagga

SEQ ID NO: 4992983 - DNA, 17 bp, Homo sapiens
aaatggaaagaaggaaa

SEQ ID NO: 4992984 - DNA, 21 bp, Homo sapiens
aaatggtttctcattaaactc

SEQ ID NO: 4992985 - DNA, 20 bp, Homo sapiens
aaatgtaaattagtttgaca

SEQ ID NO: 4992986 - DNA, 12 bp, Homo sapiens
aaattagtttga

SEQ ID NO: 4992987 - DNA, 17 bp, Homo sapiens
aaattagtttgacactg

SEQ ID NO: 4992988 - DNA, 15 bp, Homo sapiens
aaattgcagtttcat

SEQ ID NO: 4992989 - DNA, 22 bp, Homo sapiens
aaattgcagtttcatgtatgta

SEQ ID NO: 4992990 - DNA, 17 bp, Homo sapiens
aacaagagttccatccc

SEQ ID NO: 4992991 - DNA, 20 bp, Homo sapiens
aacaatgtgtctatttctga

SEQ ID NO: 4992992 - DNA, 22 bp, Homo sapiens
aacaatgtgtctatttctgaaa

SEQ ID NO: 4992993 - DNA, 12 bp, Homo sapiens
aacaattttcta

SEQ ID NO: 4992994 - DNA, 20 bp, Homo sapiens
aacagtttatttttattatt

SEQ ID NO: 4992995 - DNA, 18 bp, Homo sapiens
aacatcactacaaaaaga

SEQ ID NO: 4992996 - DNA, 23 bp, Homo sapiens
aacatcactacaaaaagaagagt

SEQ ID NO: 4992997 - DNA, 19 bp, Homo sapiens
aacatcagaaactgaattc

SEQ ID NO: 4992998 - DNA, 14 bp, Homo sapiens
aacctcttatcact

SEQ ID NO: 4992999 - DNA, 21 bp, Homo sapiens
aacctcttatcactaagaaag

SEQ ID NO: 4993000 - DNA, 18 bp, Homo sapiens
aacgaatttaaaatgtag

SEQ ID NO: 4993001 - DNA, 15 bp, Homo sapiens
aacggtgcaacagaa

SEQ ID NO: 4993002 - DNA, 22 bp, Homo sapiens
aactaaatgctcatacacagtt

SEQ ID NO: 4993003 - DNA, 17 bp, Homo sapiens
aactaattgtatttagt

SEQ ID NO: 4993004 - DNA, 14 bp, Homo sapiens
aactacatctgcct

SEQ ID NO: 4993005 - DNA, 13 bp, Homo sapiens
aactcaatataaa

SEQ ID NO: 4993006 - DNA, 15 bp, Homo sapiens
aactgtatttcagta

SEQ ID NO: 4993007 - DNA, 16 bp, Homo sapiens
aactgtatttcagtat

SEQ ID NO: 4993008 - DNA, 17 bp, Homo sapiens
aactgtatttcagtatt

SEQ ID NO: 4993009 - DNA, 17 bp, Homo sapiens
aactttaaagataagtc

SEQ ID NO: 4993010 - DNA, 18 bp, Homo sapiens
aacttttaggttgttacc

SEQ ID NO: 4993011 - DNA, 17 bp, Homo sapiens
aagaaaatggaaagaag

SEQ ID NO: 4993012 - DNA, 21 bp, Homo sapiens
aagaaaatggaaagaaggaaa

SEQ ID NO: 4993013 - DNA, 12 bp, Homo sapiens
aagaaagaagca

SEQ ID NO: 4993014 - DNA, 13 bp, Homo sapiens
aagaaagaagcat

SEQ ID NO: 4993015 - DNA, 18 bp, Homo sapiens
aagaaaggaaagaaggag

SEQ ID NO: 4993016 - DNA, 12 bp, Homo sapiens
aagaacagtact

SEQ ID NO: 4993017 - DNA, 21 bp, Homo sapiens
aagaagcattgaaaacaaaga

SEQ ID NO: 4993018 - DNA, 20 bp, Homo sapiens
aagaatttgaggtctacatt

SEQ ID NO: 4993019 - DNA, 14 bp, Homo sapiens
aagacatctgcctg

SEQ ID NO: 4993020 - DNA, 15 bp, Homo sapiens
aagagatgaaataat

SEQ ID NO: 4993021 - DNA, 23 bp, Homo sapiens
aagatggcaactgtattaaagaa

SEQ ID NO: 4993022 - DNA, 21 bp, Homo sapiens
aagcattgaaaacaaagacat

SEQ ID NO: 4993023 - DNA, 14 bp, Homo sapiens
aagccttgacacac

SEQ ID NO: 4993024 - DNA, 20 bp, Homo sapiens
aagcttgatttgatctttgt

SEQ ID NO: 4993025 - DNA, 14 bp, Homo sapiens
aagctttatctttg

SEQ ID NO: 4993026 - DNA, 16 bp, Homo sapiens
aagcttttaacttttt

SEQ ID NO: 4993027 - DNA, 22 bp, Homo sapiens
aaggaaatctcaccccatccca

SEQ ID NO: 4993028 - DNA, 19 bp, Homo sapiens
aaggagatgaatagaagaa

SEQ ID NO: 4993029 - DNA, 22 bp, Homo sapiens
aaggagatgaatagaagaaaga

SEQ ID NO: 4993030 - DNA, 15 bp, Homo sapiens
aaggaggatagaaaa

SEQ ID NO: 4993031 - DNA, 15 bp, Homo sapiens
aaggatggaagaaag

SEQ ID NO: 4993032 - DNA, 16 bp, Homo sapiens
aaggatggaagaaaga

SEQ ID NO: 4993033 - DNA, 20 bp, Homo sapiens
aaggatggaagaaagaagca

SEQ ID NO: 4993034 - DNA, 12 bp, Homo sapiens
aagtaaaaaata

SEQ ID NO: 4993035 - DNA, 16 bp, Homo sapiens
aagtctctgctggccc

SEQ ID NO: 4993036 - DNA, 21 bp, Homo sapiens
aagtctctgctggcccagcca

SEQ ID NO: 4993037 - DNA, 14 bp, Homo sapiens
aataaagagatttt

SEQ ID NO: 4993038 - DNA, 20 bp, Homo sapiens
aataaagtttggacttatct

SEQ ID NO: 4993039 - DNA, 13 bp, Homo sapiens
aataataaagaga

SEQ ID NO: 4993040 - DNA, 17 bp, Homo sapiens
aatacataaataaaaga

SEQ ID NO: 4993041 - DNA, 16 bp, Homo sapiens
aatagaaaaaaagaaa

SEQ ID NO: 4993042 - DNA, 14 bp, Homo sapiens
aatagaagaaagaa

SEQ ID NO: 4993043 - DNA, 15 bp, Homo sapiens
aatagaagaaagaaa

SEQ ID NO: 4993044 - DNA, 16 bp, Homo sapiens
aatagactttgtatga

SEQ ID NO: 4993045 - DNA, 13 bp, Homo sapiens
aataggattaatg

SEQ ID NO: 4993046 - DNA, 18 bp, Homo sapiens
aatatactttttttgtta

SEQ ID NO: 4993047 - DNA, 16 bp, Homo sapiens
aatcagggaaactaat

SEQ ID NO: 4993048 - DNA, 21 bp, Homo sapiens
aatcatgtacatttgaaaata

SEQ ID NO: 4993049 - DNA, 17 bp, Homo sapiens
aatcatttggttaaatc

SEQ ID NO: 4993050 - DNA, 14 bp, Homo sapiens
aatccatgcttcac

SEQ ID NO: 4993051 - DNA, 15 bp, Homo sapiens
aatccatgcttcact

SEQ ID NO: 4993052 - DNA, 16 bp, Homo sapiens
aatctatattaaatga

SEQ ID NO: 4993053 - DNA, 22 bp, Homo sapiens
aatctatattaaatgagggttt

SEQ ID NO: 4993054 - DNA, 22 bp, Homo sapiens
aatctcaccccatcccacaccc

SEQ ID NO: 4993055 - DNA, 18 bp, Homo sapiens
aatctggggaagaggttt

SEQ ID NO: 4993056 - DNA, 23 bp, Homo sapiens
aatcttagtatagtagaaagaca

SEQ ID NO: 4993057 - DNA, 15 bp, Homo sapiens
aatgagttacttaga

SEQ ID NO: 4993058 - DNA, 19 bp, Homo sapiens
aatgatcacatctaaagct

SEQ ID NO: 4993059 - DNA, 22 bp, Homo sapiens
aatgatcacatctaaagcttta

SEQ ID NO: 4993060 - DNA, 23 bp, Homo sapiens
aatgatcacatctaaagctttat

SEQ ID NO: 4993061 - DNA, 14 bp, Homo sapiens
aatgctgaaataaa

SEQ ID NO: 4993062 - DNA, 20 bp, Homo sapiens
aatggaaagaaggaaaaaag

SEQ ID NO: 4993063 - DNA, 14 bp, Homo sapiens
aatggcttctctgt

SEQ ID NO: 4993064 - DNA, 22 bp, Homo sapiens
aatggtttctcattaaactcta

SEQ ID NO: 4993065 - DNA, 17 bp, Homo sapiens
aatgtaaattagtttga

SEQ ID NO: 4993066 - DNA, 18 bp, Homo sapiens
aatgtaggcacttttatt

SEQ ID NO: 4993067 - DNA, 22 bp, Homo sapiens
aatgtaggcacttttattttca

SEQ ID NO: 4993068 - DNA, 19 bp, Homo sapiens
aatgtagggttatatttgg

SEQ ID NO: 4993069 - DNA, 14 bp, Homo sapiens
aatgtagttttaaa

SEQ ID NO: 4993070 - DNA, 20 bp, Homo sapiens
aatgtagttttaaataaagt

SEQ ID NO: 4993071 - DNA, 19 bp, Homo sapiens
aatgtgtctatttctgaaa

SEQ ID NO: 4993072 - DNA, 14 bp, Homo sapiens
aatgtgtctgtgtt

SEQ ID NO: 4993073 - DNA, 17 bp, Homo sapiens
aatgtgtctgtgttgct

SEQ ID NO: 4993074 - DNA, 15 bp, Homo sapiens
aattaaaaaatcaaa

SEQ ID NO: 4993075 - DNA, 16 bp, Homo sapiens
aattaaaaactttaaa

SEQ ID NO: 4993076 - DNA, 14 bp, Homo sapiens
aattaaaaatgaaa

SEQ ID NO: 4993077 - DNA, 23 bp, Homo sapiens
aattaggtgtactgtactgaaga

SEQ ID NO: 4993078 - DNA, 16 bp, Homo sapiens
aattctgaaatacttt

SEQ ID NO: 4993079 - DNA, 20 bp, Homo sapiens
aattctgggttcatttgtga

SEQ ID NO: 4993080 - DNA, 18 bp, Homo sapiens
aattgagaataagaattt

SEQ ID NO: 4993081 - DNA, 20 bp, Homo sapiens
aattgcagtttcatgtatgt

SEQ ID NO: 4993082 - DNA, 13 bp, Homo sapiens
aatttaaaatgta

SEQ ID NO: 4993083 - DNA, 14 bp, Homo sapiens
aatttaaaatgtag

SEQ ID NO: 4993084 - DNA, 18 bp, Homo sapiens
aatttaaaatgtagtttt

SEQ ID NO: 4993085 - DNA, 11 bp, Homo sapiens
aatttaaattg

SEQ ID NO: 4993086 - DNA, 12 bp, Homo sapiens
aatttcacagtt

SEQ ID NO: 4993087 - DNA, 19 bp, Homo sapiens
aatttcacagttctgtaat

SEQ ID NO: 4993088 - DNA, 18 bp, Homo sapiens
acaaaatttcacagttct

SEQ ID NO: 4993089 - DNA, 19 bp, Homo sapiens
acaaaatttcacagttctg

SEQ ID NO: 4993090 - DNA, 17 bp, Homo sapiens
acaaagacattcttccc

SEQ ID NO: 4993091 - DNA, 19 bp, Homo sapiens
acaaatgggttaatcctga

SEQ ID NO: 4993092 - DNA, 17 bp, Homo sapiens
acaaattttttaatttc

SEQ ID NO: 4993093 - DNA, 23 bp, Homo sapiens
acaaattttttaatttccaaaat

SEQ ID NO: 4993094 - DNA, 18 bp, Homo sapiens
atgtaaattagtttgaca

SEQ ID NO: 4993095 - DNA, 19 bp, Homo sapiens
atgtaaattagtttgacac

SEQ ID NO: 4993096 - DNA, 22 bp, Homo sapiens
atgtaaattagtttgacactgc

SEQ ID NO: 4993097 - DNA, 17 bp, Homo sapiens
atgtacatttgaaaata

SEQ ID NO: 4993098 - DNA, 12 bp, Homo sapiens
atgtacttaaat

SEQ ID NO: 4993099 - DNA, 15 bp, Homo sapiens
atgtacttaaatgag

SEQ ID NO: 4993100 - DNA, 19 bp, Homo sapiens
atgtgagaaatcagaattg

SEQ ID NO: 4993101 - DNA, 15 bp, Homo sapiens
atgtgttacattatt

SEQ ID NO: 4993102 - DNA, 17 bp, Homo sapiens
atgttaggtgacattga

SEQ ID NO: 4993103 - DNA, 13 bp, Homo sapiens
attaaaaacttta

SEQ ID NO: 4993104 - DNA, 14 bp, Homo sapiens
attaaaaactttaa

SEQ ID NO: 4993105 - DNA, 13 bp, Homo sapiens
attaactaaatgc

SEQ ID NO: 4993106 - DNA, 14 bp, Homo sapiens
attaagaaggcact

SEQ ID NO: 4993107 - DNA, 16 bp, Homo sapiens
attaatcataaagaaa

SEQ ID NO: 4993108 - DNA, 16 bp, Homo sapiens
attaccagtctgatta

SEQ ID NO: 4993109 - DNA, 23 bp, Homo sapiens
attagggaaaatggatatagaaa

SEQ ID NO: 4993110 - DNA, 11 bp, Homo sapiens
attagtttgac

SEQ ID NO: 4993111 - DNA, 14 bp, Homo sapiens
attagtttgacact

SEQ ID NO: 4993112 - DNA, 16 bp, Homo sapiens
attagtttgacactgc

SEQ ID NO: 4993113 - DNA, 17 bp, Homo sapiens
attagtttgacactgct

SEQ ID NO: 4993114 - DNA, 14 bp, Homo sapiens
attataccatgtgt

SEQ ID NO: 4993115 - DNA, 19 bp, Homo sapiens
attataccatgtgtgctaa

SEQ ID NO: 4993116 - DNA, 17 bp, Homo sapiens
attcagctagaatttct

SEQ ID NO: 4993117 - DNA, 19 bp, Homo sapiens
attcagctagaatttctgg

SEQ ID NO: 4993118 - DNA, 15 bp, Homo sapiens
attctgaaatacttt

SEQ ID NO: 4993119 - DNA, 17 bp, Homo sapiens
attctgagtgaaaattt

SEQ ID NO: 4993120 - DNA, 22 bp, Homo sapiens
attctgcaagcacatctgcatt

SEQ ID NO: 4993121 - DNA, 14 bp, Homo sapiens
attctggttgtaaa

SEQ ID NO: 4993122 - DNA, 19 bp, Homo sapiens
attcttggttgttaattta

SEQ ID NO: 4993123 - DNA, 14 bp, Homo sapiens
attgaaaacaaaga

SEQ ID NO: 4993124 - DNA, 21 bp, Homo sapiens
attgaaaacaaagacattctt

SEQ ID NO: 4993125 - DNA, 19 bp, Homo sapiens
attgaaagttgcttttatt

SEQ ID NO: 4993126 - DNA, 22 bp, Homo sapiens
attgaggatctctttgatcctg

SEQ ID NO: 4993127 - DNA, 16 bp, Homo sapiens
attgatcccttctcct

SEQ ID NO: 4993128 - DNA, 22 bp, Homo sapiens
attgattatgggttataatcag

SEQ ID NO: 4993129 - DNA, 15 bp, Homo sapiens
attgcaccattttca

SEQ ID NO: 4993130 - DNA, 23 bp, Homo sapiens
attgcagtttcatgtatgtatat

SEQ ID NO: 4993131 - DNA, 15 bp, Homo sapiens
attgcttcctgatta

SEQ ID NO: 4993132 - DNA, 19 bp, Homo sapiens
attggatttgctgtgacta

SEQ ID NO: 4993133 - DNA, 17 bp, Homo sapiens
attggtcatggtagatt

SEQ ID NO: 4993134 - DNA, 16 bp, Homo sapiens
attgtgagccaccacg

SEQ ID NO: 4993135 - DNA, 13 bp, Homo sapiens
atttaaaaaatta

SEQ ID NO: 4993136 - DNA, 18 bp, Homo sapiens
atttaaaaaattaaaaat

SEQ ID NO: 4993137 - DNA, 16 bp, Homo sapiens
atttaaaaataaatgt

SEQ ID NO: 4993138 - DNA, 13 bp, Homo sapiens
atttaaaatgtag

SEQ ID NO: 4993139 - DNA, 16 bp, Homo sapiens
atttaagccttgacac

SEQ ID NO: 4993140 - DNA, 14 bp, Homo sapiens
atttactttgtaca

SEQ ID NO: 4993141 - DNA, 20 bp, Homo sapiens
atttagtaaatgctgaaata

SEQ ID NO: 4993142 - DNA, 21 bp, Homo sapiens
atttagttacgtataatgctt

SEQ ID NO: 4993143 - DNA, 15 bp, Homo sapiens
atttcacttgaaatt

SEQ ID NO: 4993144 - DNA, 13 bp, Homo sapiens
atttcagtatttt

SEQ ID NO: 4993145 - DNA, 15 bp, Homo sapiens
atttcagtattttcc

SEQ ID NO: 4993146 - DNA, 18 bp, Homo sapiens
atttcagtattttccagc

SEQ ID NO: 4993147 - DNA, 18 bp, Homo sapiens
atttccaaaataatctat

SEQ ID NO: 4993148 - DNA, 16 bp, Homo sapiens
atttctctggcaaact

SEQ ID NO: 4993149 - DNA, 15 bp, Homo sapiens
atttgaaaaactttt

SEQ ID NO: 4993150 - DNA, 20 bp, Homo sapiens
atttgatctttgtttaaatg

SEQ ID NO: 4993151 - DNA, 22 bp, Homo sapiens
atttgatctttgtttaaatgcc

SEQ ID NO: 4993152 - DNA, 23 bp, Homo sapiens
atttgatctttgtttaaatgcca

SEQ ID NO: 4993153 - DNA, 13 bp, Homo sapiens
atttggcttgctg

SEQ ID NO: 4993154 - DNA, 15 bp, Homo sapiens
atttggcttgctgtt

SEQ ID NO: 4993155 - DNA, 20 bp, Homo sapiens
atttggcttgctgtttactc

SEQ ID NO: 4993156 - DNA, 15 bp, Homo sapiens
atttgtgcacactca

SEQ ID NO: 4993157 - DNA, 12 bp, Homo sapiens
attttcattgtg

SEQ ID NO: 4993158 - DNA, 13 bp, Homo sapiens
attttcattgtga

SEQ ID NO: 4993159 - DNA, 16 bp, Homo sapiens
attttcattgtgattt

SEQ ID NO: 4993160 - DNA, 19 bp, Homo sapiens
attttccagccttatgtgt

SEQ ID NO: 4993161 - DNA, 20 bp, Homo sapiens
attttccagccttatgtgtt

SEQ ID NO: 4993162 - DNA, 22 bp, Homo sapiens
attttccagccttatgtgttac

SEQ ID NO: 4993163 - DNA, 15 bp, Homo sapiens
atttttccatctgtg

SEQ ID NO: 4993164 - DNA, 16 bp, Homo sapiens
attttttttttaagtg

SEQ ID NO: 4993165 - DNA, 12 bp, Homo sapiens
caaaaagaagag

SEQ ID NO: 4993166 - DNA, 13 bp, Homo sapiens
caaaaagaagagt

SEQ ID NO: 4993167 - DNA, 12 bp, Homo sapiens
caaaaataaaaa

SEQ ID NO: 4993168 - DNA, 19 bp, Homo sapiens
caaaataatctatattaaa

SEQ ID NO: 4993169 - DNA, 18 bp, Homo sapiens
caaaatggctagaattat

SEQ ID NO: 4993170 - DNA, 17 bp, Homo sapiens
caaaatgtacttaaatg

SEQ ID NO: 4993171 - DNA, 14 bp, Homo sapiens
caaaatttcacagt

SEQ ID NO: 4993172 - DNA, 16 bp, Homo sapiens
caaaatttcacagttc

SEQ ID NO: 4993173 - DNA, 18 bp, Homo sapiens
caaaatttcacagttctg

SEQ ID NO: 4993174 - DNA, 20 bp, Homo sapiens
caaaatttcacagttctgta

SEQ ID NO: 4993175 - DNA, 22 bp, Homo sapiens
caaacatgggtggtaacaagag

SEQ ID NO: 4993176 - DNA, 23 bp, Homo sapiens
caaacggtgcaacagaagggtag

SEQ ID NO: 4993177 - DNA, 13 bp, Homo sapiens
caaactgctttat

SEQ ID NO: 4993178 - DNA, 15 bp, Homo sapiens
caaactgctttattt

SEQ ID NO: 4993179 - DNA, 14 bp, Homo sapiens
caaacttttctttc

SEQ ID NO: 4993180 - DNA, 13 bp, Homo sapiens
caaagttcagtgt

SEQ ID NO: 4993181 - DNA, 21 bp, Homo sapiens
caaatgtcctaacagagaaat

SEQ ID NO: 4993182 - DNA, 20 bp, Homo sapiens
caacagtttatttttattat

SEQ ID NO: 4993183 - DNA, 23 bp, Homo sapiens
caagattttttttttaagtgaca

SEQ ID NO: 4993184 - DNA, 17 bp, Homo sapiens
caagcacatctgcattt

SEQ ID NO: 4993185 - DNA, 16 bp, Homo sapiens
caagctaatctgcctg

SEQ ID NO: 4993186 - DNA, 21 bp, Homo sapiens
caagctaatctgcctggtttt

SEQ ID NO: 4993187 - DNA, 14 bp, Homo sapiens
caagtcctgcagtc

SEQ ID NO: 4993188 - DNA, 22 bp, Homo sapiens
caagtctctgctggcccagcca

SEQ ID NO: 4993189 - DNA, 23 bp, Homo sapiens
caataaaagcctttgaaaatact

SEQ ID NO: 4993190 - DNA, 14 bp, Homo sapiens
caatactaaataaa

SEQ ID NO: 4993191 - DNA, 20 bp, Homo sapiens
caatatgaattaggtgtact

SEQ ID NO: 4993192 - DNA, 15 bp, Homo sapiens
caatccatgcttcac

SEQ ID NO: 4993193 - DNA, 19 bp, Homo sapiens
caatgtgtctatttctgaa

SEQ ID NO: 4993194 - DNA, 21 bp, Homo sapiens
caattgtgagccaccacgtcc

SEQ ID NO: 4993195 - DNA, 19 bp, Homo sapiens
cacagtgttgcccaggctg

SEQ ID NO: 4993196 - DNA, 19 bp, Homo sapiens
cacatctaaagctttatct

SEQ ID NO: 4993197 - DNA, 23 bp, Homo sapiens
cacatctaaagctttatctttgt

SEQ ID NO: 4993198 - DNA, 21 bp, Homo sapiens
cacatttaaaaataaatgtaa

SEQ ID NO: 4993199 - DNA, 15 bp, Homo sapiens
caccccatcccacac

SEQ ID NO: 4993200 - DNA, 17 bp, Homo sapiens
cacccccatctctccct

SEQ ID NO: 4993201 - DNA, 23 bp, Homo sapiens
cacccttcccctccttctccctt

SEQ ID NO: 4993202 - DNA, 15 bp, Homo sapiens
cacctgtctcagcct

SEQ ID NO: 4993203 - DNA, 12 bp, Homo sapiens
caccttgttaca

SEQ ID NO: 4993204 - DNA, 19 bp, Homo sapiens
cactaagaaagaaaggaaa

SEQ ID NO: 4993205 - DNA, 20 bp, Homo sapiens
cactaagaaagaaaggaaag

SEQ ID NO: 4993206 - DNA, 15 bp, Homo sapiens
cactacaaaaagaag

SEQ ID NO: 4993207 - DNA, 18 bp, Homo sapiens
cactacaaaaagaagagt

SEQ ID NO: 4993208 - DNA, 18 bp, Homo sapiens
cactcattcttttttcta

SEQ ID NO: 4993209 - DNA, 13 bp, Homo sapiens
cactgacagcctc

SEQ ID NO: 4993210 - DNA, 14 bp, Homo sapiens
cactgacagcctcc

SEQ ID NO: 4993211 - DNA, 16 bp, Homo sapiens
cactgacagcctccca

SEQ ID NO: 4993212 - DNA, 17 bp, Homo sapiens
cagaagggtaggttaga

SEQ ID NO: 4993213 - DNA, 18 bp, Homo sapiens
cagaattggcataatttg

SEQ ID NO: 4993214 - DNA, 12 bp, Homo sapiens
cagatgctgaat

SEQ ID NO: 4993215 - DNA, 21 bp, Homo sapiens
cagatgctgaattgagaataa

SEQ ID NO: 4993216 - DNA, 20 bp, Homo sapiens
cagatttaagccttgacaca

SEQ ID NO: 4993217 - DNA, 14 bp, Homo sapiens
cagatttgctaata

SEQ ID NO: 4993218 - DNA, 19 bp, Homo sapiens
cagcacctattgaattacc

SEQ ID NO: 4993219 - DNA, 17 bp, Homo sapiens
cagccaaaccctgtctg

SEQ ID NO: 4993220 - DNA, 14 bp, Homo sapiens
cagcctcccacccc

SEQ ID NO: 4993221 - DNA, 18 bp, Homo sapiens
cagcctcccacccccatc

SEQ ID NO: 4993222 - DNA, 20 bp, Homo sapiens
cagccttatgtgttacatta

SEQ ID NO: 4993223 - DNA, 16 bp, Homo sapiens
cagctagaatttctgg

SEQ ID NO: 4993224 - DNA, 18 bp, Homo sapiens
cagcttcctgtctgttta

SEQ ID NO: 4993225 - DNA, 21 bp, Homo sapiens
cagcttcctgtctgtttatat

SEQ ID NO: 4993226 - DNA, 16 bp, Homo sapiens
caggcgatccacctgt

SEQ ID NO: 4993227 - DNA, 20 bp, Homo sapiens
caggcgatccacctgtctca

SEQ ID NO: 4993228 - DNA, 18 bp, Homo sapiens
cagtattttccagcctta

SEQ ID NO: 4993229 - DNA, 17 bp, Homo sapiens
cagtcctgcctcagcct

SEQ ID NO: 4993230 - DNA, 17 bp, Homo sapiens
cagtgagtgccatgctt

SEQ ID NO: 4993231 - DNA, 18 bp, Homo sapiens
cagtgagtgccatgcttt

SEQ ID NO: 4993232 - DNA, 13 bp, Homo sapiens
cagtgtgtaaagt

SEQ ID NO: 4993233 - DNA, 20 bp, Homo sapiens
cagttaaataaatagaaaga

SEQ ID NO: 4993234 - DNA, 17 bp, Homo sapiens
cagttataagcgtattt

SEQ ID NO: 4993235 - DNA, 15 bp, Homo sapiens
cagtttcatgtatgt

SEQ ID NO: 4993236 - DNA, 23 bp, Homo sapiens
cataaaattgcagtttcatgtat

SEQ ID NO: 4993237 - DNA, 17 bp, Homo sapiens
catatatgctgtatttc

SEQ ID NO: 4993238 - DNA, 19 bp, Homo sapiens
catatatgctgtatttctt

SEQ ID NO: 4993239 - DNA, 15 bp, Homo sapiens
catctaaagctttat

SEQ ID NO: 4993240 - DNA, 15 bp, Homo sapiens
catctctccctcccc

SEQ ID NO: 4993241 - DNA, 16 bp, Homo sapiens
catctctccctcccct

SEQ ID NO: 4993242 - DNA, 23 bp, Homo sapiens
catctctccctcccctgccattt

SEQ ID NO: 4993243 - DNA, 18 bp, Homo sapiens
catctgatctgtataaaa

SEQ ID NO: 4993244 - DNA, 12 bp, Homo sapiens
catgcttcactc

SEQ ID NO: 4993245 - DNA, 21 bp, Homo sapiens
catggtagatttttttcatag

SEQ ID NO: 4993246 - DNA, 18 bp, Homo sapiens
catggtagtttaaaacat

SEQ ID NO: 4993247 - DNA, 20 bp, Homo sapiens
catggtagtttaaaacatca

SEQ ID NO: 4993248 - DNA, 15 bp, Homo sapiens
catggtgattaaaat

SEQ ID NO: 4993249 - DNA, 18 bp, Homo sapiens
catgtacatttgaaaata

SEQ ID NO: 4993250 - DNA, 18 bp, Homo sapiens
cattaactaaatgctcat

SEQ ID NO: 4993251 - DNA, 16 bp, Homo sapiens
cattctaaatgaactc

SEQ ID NO: 4993252 - DNA, 17 bp, Homo sapiens
cattctaaatgaactca

SEQ ID NO: 4993253 - DNA, 17 bp, Homo sapiens
cattgaaaacaaagaca

SEQ ID NO: 4993254 - DNA, 22 bp, Homo sapiens
catttaaaaataaatgtaaagt

SEQ ID NO: 4993255 - DNA, 21 bp, Homo sapiens
catttagtaaatgctgaaata

SEQ ID NO: 4993256 - DNA, 12 bp, Homo sapiens
catttgaaaata

SEQ ID NO: 4993257 - DNA, 13 bp, Homo sapiens
catttgaaaatat

SEQ ID NO: 4993258 - DNA, 20 bp, Homo sapiens
catttggcttgctgtttact

SEQ ID NO: 4993259 - DNA, 13 bp, Homo sapiens
catttttgctaat

SEQ ID NO: 4993260 - DNA, 15 bp, Homo sapiens
catttttgctaatta

SEQ ID NO: 4993261 - DNA, 12 bp, Homo sapiens
catttttttccc

SEQ ID NO: 4993262 - DNA, 14 bp, Homo sapiens
ccaaaccctgtctg

SEQ ID NO: 4993263 - DNA, 14 bp, Homo sapiens
ccaacagcctctgt

SEQ ID NO: 4993264 - DNA, 14 bp, Homo sapiens
ccaattctgaaata

SEQ ID NO: 4993265 - DNA, 22 bp, Homo sapiens
ccacaggttcatgccaccatgg

SEQ ID NO: 4993266 - DNA, 14 bp, Homo sapiens
ccacccttcccctc

SEQ ID NO: 4993267 - DNA, 11 bp, Homo sapiens
ccacctgtctc

SEQ ID NO: 4993268 - DNA, 12 bp, Homo sapiens
ccacctgtctca

SEQ ID NO: 4993269 - DNA, 13 bp, Homo sapiens
ccaccttgttaca

SEQ ID NO: 4993270 - DNA, 20 bp, Homo sapiens
ccactggcatcgcagcttcc

SEQ ID NO: 4993271 - DNA, 20 bp, Homo sapiens
ccacttcttgttccccactg

SEQ ID NO: 4993272 - DNA, 22 bp, Homo sapiens
ccagccaacttttgcatgtttt

SEQ ID NO: 4993273 - DNA, 21 bp, Homo sapiens
ccagccttatgtgttacatta

SEQ ID NO: 4993274 - DNA, 14 bp, Homo sapiens
ccaggctggtctca

SEQ ID NO: 4993275 - DNA, 17 bp, Homo sapiens
ccagggaagctgtccct

SEQ ID NO: 4993276 - DNA, 12 bp, Homo sapiens
ccagtctgatta

SEQ ID NO: 4993277 - DNA, 13 bp, Homo sapiens
ccatgcttcactc

SEQ ID NO: 4993278 - DNA, 14 bp, Homo sapiens
ccatggtagtttaa

SEQ ID NO: 4993279 - DNA, 14 bp, Homo sapiens
ccatgtgtgctaat

SEQ ID NO: 4993280 - DNA, 18 bp, Homo sapiens
ccatttttgctaattatc

SEQ ID NO: 4993281 - DNA, 12 bp, Homo sapiens
cccaacagttta

SEQ ID NO: 4993282 - DNA, 16 bp, Homo sapiens
cccaatccatgcttca

SEQ ID NO: 4993283 - DNA, 17 bp, Homo sapiens
cccaatccatgcttcac

SEQ ID NO: 4993284 - DNA, 21 bp, Homo sapiens
cccatctctccctcccctgcc

SEQ ID NO: 4993285 - DNA, 23 bp, Homo sapiens
cccatctctccctcccctgccat

SEQ ID NO: 4993286 - DNA, 20 bp, Homo sapiens
cccatggtagtttaaaacat

SEQ ID NO: 4993287 - DNA, 13 bp, Homo sapiens
ccctacttgcagc

SEQ ID NO: 4993288 - DNA, 20 bp, Homo sapiens
ccgaggcgggtggatcacga

SEQ ID NO: 4993289 - DNA, 19 bp, Homo sapiens
cctaatatatatgtagaga

SEQ ID NO: 4993290 - DNA, 16 bp, Homo sapiens
cctatctagcatttat

SEQ ID NO: 4993291 - DNA, 23 bp, Homo sapiens
cctatctagcatttatttctctg

SEQ ID NO: 4993292 - DNA, 19 bp, Homo sapiens
cctcctgtgcctccctttt

SEQ ID NO: 4993293 - DNA, 17 bp, Homo sapiens
cctccttctcccttttt

SEQ ID NO: 4993294 - DNA, 21 bp, Homo sapiens
cctctccccaatccatgcttc

SEQ ID NO: 4993295 - DNA, 12 bp, Homo sapiens
cctctgtacaga

SEQ ID NO: 4993296 - DNA, 17 bp, Homo sapiens
cctggcatatctctgtt

SEQ ID NO: 4993297 - DNA, 15 bp, Homo sapiens
cctgggcagtgagtg

SEQ ID NO: 4993298 - DNA, 13 bp, Homo sapiens
cctggttttattt

SEQ ID NO: 4993299 - DNA, 14 bp, Homo sapiens
cctgtctcagcctc

SEQ ID NO: 4993300 - DNA, 16 bp, Homo sapiens
cgaatttaaaatgtag

SEQ ID NO: 4993301 - DNA, 13 bp, Homo sapiens
cggacaaagttca

SEQ ID NO: 4993302 - DNA, 20 bp, Homo sapiens
cggatgtgtcctttctgaac

SEQ ID NO: 4993303 - DNA, 20 bp, Homo sapiens
cggtggctcatgcctgtaat

SEQ ID NO: 4993304 - DNA, 13 bp, Homo sapiens
cgtataatgcttt

SEQ ID NO: 4993305 - DNA, 17 bp, Homo sapiens
cgtcagaagcacccagg

SEQ ID NO: 4993306 - DNA, 16 bp, Homo sapiens
cgttcttacaagctta

SEQ ID NO: 4993307 - DNA, 20 bp, Homo sapiens
cgttcttacaagcttaaagc

SEQ ID NO: 4993308 - DNA, 12 bp, Homo sapiens
ctaaagctttat

SEQ ID NO: 4993309 - DNA, 12 bp, Homo sapiens
ctaaataaacat

SEQ ID NO: 4993310 - DNA, 21 bp, Homo sapiens
ctaaccagggaagctgtccct

SEQ ID NO: 4993311 - DNA, 11 bp, Homo sapiens
ctaagaaagaa

SEQ ID NO: 4993312 - DNA, 23 bp, Homo sapiens
ctaagaaagaaaggaaagaagga

SEQ ID NO: 4993313 - DNA, 12 bp, Homo sapiens
ctaatctgcctg

SEQ ID NO: 4993314 - DNA, 12 bp, Homo sapiens
ctacattaaaca

SEQ ID NO: 4993315 - DNA, 13 bp, Homo sapiens
ctacattaaacaa

SEQ ID NO: 4993316 - DNA, 14 bp, Homo sapiens
ctacctttttatat

SEQ ID NO: 4993317 - DNA, 18 bp, Homo sapiens
ctactgtagaaaggaaat

SEQ ID NO: 4993318 - DNA, 18 bp, Homo sapiens
ctagactttgatttcctt

SEQ ID NO: 4993319 - DNA, 16 bp, Homo sapiens
ctagcatttatttctc

SEQ ID NO: 4993320 - DNA, 19 bp, Homo sapiens
ctagcatttatttctctgg

SEQ ID NO: 4993321 - DNA, 17 bp, Homo sapiens
ctaggattataatgctg

SEQ ID NO: 4993322 - DNA, 19 bp, Homo sapiens
ctaggattataatgctgcc

SEQ ID NO: 4993323 - DNA, 14 bp, Homo sapiens
ctatacctgccttt

SEQ ID NO: 4993324 - DNA, 12 bp, Homo sapiens
ctatagaaatga

SEQ ID NO: 4993325 - DNA, 15 bp, Homo sapiens
ggatggaagaaagaa

SEQ ID NO: 4993326 - DNA, 21 bp, Homo sapiens
ggcaactgtattaaagaaaaa

SEQ ID NO: 4993327 - DNA, 22 bp, Homo sapiens
ggcaactgtattaaagaaaaat

SEQ ID NO: 4993328 - DNA, 19 bp, Homo sapiens
ggccatatatgctgtattt

SEQ ID NO: 4993329 - DNA, 18 bp, Homo sapiens
ggcgatccacctgtctca

SEQ ID NO: 4993330 - DNA, 20 bp, Homo sapiens
ggcggagcttgcagtgagcc

SEQ ID NO: 4993331 - DNA, 20 bp, Homo sapiens
ggctatctatacctgccttt

SEQ ID NO: 4993332 - DNA, 20 bp, Homo sapiens
gggaattttccccgtgacat

SEQ ID NO: 4993333 - DNA, 14 bp, Homo sapiens
gggagaaatgccag

SEQ ID NO: 4993334 - DNA, 20 bp, Homo sapiens
gggaggcggagcttgcagtg

SEQ ID NO: 4993335 - DNA, 22 bp, Homo sapiens
gggagttgtcaagtctctgctg

SEQ ID NO: 4993336 - DNA, 19 bp, Homo sapiens
gggttcatttgtgatgaca

SEQ ID NO: 4993337 - DNA, 15 bp, Homo sapiens
gggttgttcacctct

SEQ ID NO: 4993338 - DNA, 23 bp, Homo sapiens
ggtcaacatcttttacattctgc

SEQ ID NO: 4993339 - DNA, 19 bp, Homo sapiens
ggtctcacagtgttgccca

SEQ ID NO: 4993340 - DNA, 19 bp, Homo sapiens
ggtctcgctttgttgccca

SEQ ID NO: 4993341 - DNA, 21 bp, Homo sapiens
ggtgcttgttccctctccctg

SEQ ID NO: 4993342 - DNA, 22 bp, Homo sapiens
ggtgtactgtactgaagaacag

SEQ ID NO: 4993343 - DNA, 21 bp, Homo sapiens
gtaaaatctgacataaaaaca

SEQ ID NO: 4993344 - DNA, 14 bp, Homo sapiens
gtaaatgctgaaat

SEQ ID NO: 4993345 - DNA, 14 bp, Homo sapiens
gtaaattctgggtt

SEQ ID NO: 4993346 - DNA, 20 bp, Homo sapiens
gtaagctggtgttataatac

SEQ ID NO: 4993347 - DNA, 15 bp, Homo sapiens
gtaagtgaatttatg

SEQ ID NO: 4993348 - DNA, 21 bp, Homo sapiens
gtaatgtagggttatatttgg

SEQ ID NO: 4993349 - DNA, 16 bp, Homo sapiens
gtacatcatgtaagat

SEQ ID NO: 4993350 - DNA, 14 bp, Homo sapiens
gtacatctggcctt

SEQ ID NO: 4993351 - DNA, 15 bp, Homo sapiens
gtactgaagaacagt

SEQ ID NO: 4993352 - DNA, 19 bp, Homo sapiens
gtacttaaatgagttactt

SEQ ID NO: 4993353 - DNA, 20 bp, Homo sapiens
gtagaaagacatctgcctgt

SEQ ID NO: 4993354 - DNA, 22 bp, Homo sapiens
gtagttttaaataaagtttgga

SEQ ID NO: 4993355 - DNA, 18 bp, Homo sapiens
gtagtttttaattaaaaa

SEQ ID NO: 4993356 - DNA, 16 bp, Homo sapiens
gtataatgctttctga

SEQ ID NO: 4993357 - DNA, 14 bp, Homo sapiens
gtataatgtgtctg

SEQ ID NO: 4993358 - DNA, 15 bp, Homo sapiens
gtatagatggccaaa

SEQ ID NO: 4993359 - DNA, 14 bp, Homo sapiens
gtatgatctgtgta

SEQ ID NO: 4993360 - DNA, 17 bp, Homo sapiens
gtatgtccttcagctga

SEQ ID NO: 4993361 - DNA, 15 bp, Homo sapiens
gtattaaagaaaaat

SEQ ID NO: 4993362 - DNA, 19 bp, Homo sapiens
gtatttcagtattttccag

SEQ ID NO: 4993363 - DNA, 12 bp, Homo sapiens
gtattttccagc

SEQ ID NO: 4993364 - DNA, 21 bp, Homo sapiens
gtcatggtagatttttttcat

SEQ ID NO: 4993365 - DNA, 13 bp, Homo sapiens
gtcctttctgaac

SEQ ID NO: 4993366 - DNA, 15 bp, Homo sapiens
gtctacattaaacaa

SEQ ID NO: 4993367 - DNA, 23 bp, Homo sapiens
gtctacattcttggttgttaatt

SEQ ID NO: 4993368 - DNA, 20 bp, Homo sapiens
gtctcaaactcctgggctca

SEQ ID NO: 4993369 - DNA, 19 bp, Homo sapiens
gtctcacagtgttgcccag

SEQ ID NO: 4993370 - DNA, 19 bp, Homo sapiens
gtctcgctttgttgcccag

SEQ ID NO: 4993371 - DNA, 23 bp, Homo sapiens
gtctcgctttgttgcccaggctg

SEQ ID NO: 4993372 - DNA, 16 bp, Homo sapiens
gtctctgctggcccag

SEQ ID NO: 4993373 - DNA, 20 bp, Homo sapiens
gtctctgctggcccagccaa

SEQ ID NO: 4993374 - DNA, 16 bp, Homo sapiens
gtctgtgtttaaagtg

SEQ ID NO: 4993375 - DNA, 16 bp, Homo sapiens
gtcttaactgtatttc

SEQ ID NO: 4993376 - DNA, 14 bp, Homo sapiens
gtgaatttatgaga

SEQ ID NO: 4993377 - DNA, 18 bp, Homo sapiens
gtgacataattgtccagt

SEQ ID NO: 4993378 - DNA, 13 bp, Homo sapiens
gtgacattcactg

SEQ ID NO: 4993379 - DNA, 21 bp, Homo sapiens
gtgatagctactgtagaaagg

SEQ ID NO: 4993380 - DNA, 23 bp, Homo sapiens
gtgatagctactgtagaaaggaa

SEQ ID NO: 4993381 - DNA, 11 bp, Homo sapiens
gtgtctgtgtt

SEQ ID NO: 4993382 - DNA, 23 bp, Homo sapiens
gtgtgcaactaactgactctgtt

SEQ ID NO: 4993383 - DNA, 13 bp, Homo sapiens
gttaaatcatttg

SEQ ID NO: 4993384 - DNA, 23 bp, Homo sapiens
gttaacctcttatcactaagaaa

SEQ ID NO: 4993385 - DNA, 19 bp, Homo sapiens
gttaccaagtatgaagtat

SEQ ID NO: 4993386 - DNA, 20 bp, Homo sapiens
gttaccaagtatgaagtata

SEQ ID NO: 4993387 - DNA, 17 bp, Homo sapiens
gttactgcttctctttg

SEQ ID NO: 4993388 - DNA, 23 bp, Homo sapiens
gttactgcttctctttgtgcagt

SEQ ID NO: 4993389 - DNA, 16 bp, Homo sapiens
gttacttagaatgcca

SEQ ID NO: 4993390 - DNA, 18 bp, Homo sapiens
gttaggtagagggagttg

SEQ ID NO: 4993391 - DNA, 21 bp, Homo sapiens
gttataatcagggaaactaat

SEQ ID NO: 4993392 - DNA, 17 bp, Homo sapiens
gttcttacaagcttaaa

SEQ ID NO: 4993393 - DNA, 18 bp, Homo sapiens
gttgaaaagtaaaaaata

SEQ ID NO: 4993394 - DNA, 23 bp, Homo sapiens
gttgatattcaaggctttaaaag

SEQ ID NO: 4993395 - DNA, 17 bp, Homo sapiens
gttgtcaagtctctgct

SEQ ID NO: 4993396 - DNA, 22 bp, Homo sapiens
gttgtcaagtctctgctggccc

SEQ ID NO: 4993397 - DNA, 13 bp, Homo sapiens
gttgttaatttag

SEQ ID NO: 4993398 - DNA, 17 bp, Homo sapiens
gtttactagactttgat

SEQ ID NO: 4993399 - DNA, 17 bp, Homo sapiens
gtttatatattgaaagt

SEQ ID NO: 4993400 - DNA, 20 bp, Homo sapiens
gtttctaaaacagacaataa

SEQ ID NO: 4993401 - DNA, 19 bp, Homo sapiens
gtttctgatctgtactttg

SEQ ID NO: 4993402 - DNA, 20 bp, Homo sapiens
gtttctgatctgtactttgt

SEQ ID NO: 4993403 - DNA, 11 bp, Homo sapiens
gtttgacactg

SEQ ID NO: 4993404 - DNA, 12 bp, Homo sapiens
gtttgacactgc

SEQ ID NO: 4993405 - DNA, 13 bp, Homo sapiens
gttttatttacat

SEQ ID NO: 4993406 - DNA, 15 bp, Homo sapiens
gtttttcttctgaaa

SEQ ID NO: 4993407 - DNA, 14 bp, Homo sapiens
taaaaacagtgcta

SEQ ID NO: 4993408 - DNA, 15 bp, Homo sapiens
taaaagcctttgaaa

SEQ ID NO: 4993409 - DNA, 15 bp, Homo sapiens
taaaatgtagtttta

SEQ ID NO: 4993410 - DNA, 16 bp, Homo sapiens
taaaatgtagttttaa

SEQ ID NO: 4993411 - DNA, 23 bp, Homo sapiens
taaaatgtagttttaaataaagt

SEQ ID NO: 4993412 - DNA, 21 bp, Homo sapiens
taaaattgcagtttcatgtat

SEQ ID NO: 4993413 - DNA, 14 bp, Homo sapiens
taaacatctgatct

SEQ ID NO: 4993414 - DNA, 17 bp, Homo sapiens
taaactagtttaagggt

SEQ ID NO: 4993415 - DNA, 14 bp, Homo sapiens
taaactctaaagat

SEQ ID NO: 4993416 - DNA, 22 bp, Homo sapiens
taaagaaaaatcagtttttgac

SEQ ID NO: 4993417 - DNA, 17 bp, Homo sapiens
taaagataagtctacat

SEQ ID NO: 4993418 - DNA, 23 bp, Homo sapiens
taaagattagggaaaatggatat

SEQ ID NO: 4993419 - DNA, 22 bp, Homo sapiens
taaagcttgatttgatctttgt

SEQ ID NO: 4993420 - DNA, 23 bp, Homo sapiens
taaagcttgatttgatctttgtt

SEQ ID NO: 4993421 - DNA, 16 bp, Homo sapiens
taaagctttatctttg

SEQ ID NO: 4993422 - DNA, 21 bp, Homo sapiens
taaagctttatctttgtgtaa

SEQ ID NO: 4993423 - DNA, 17 bp, Homo sapiens
taaagttgtcttttaaa

SEQ ID NO: 4993424 - DNA, 19 bp, Homo sapiens
taaagtttggacttatcta

SEQ ID NO: 4993425 - DNA, 21 bp, Homo sapiens
taaagtttggacttatctata

SEQ ID NO: 4993426 - DNA, 16 bp, Homo sapiens
taaataaatagaaaga

SEQ ID NO: 4993427 - DNA, 15 bp, Homo sapiens
taaatcatttggtta

SEQ ID NO: 4993428 - DNA, 13 bp, Homo sapiens
taaattagtttga

SEQ ID NO: 4993429 - DNA, 17 bp, Homo sapiens
taaattagtttgacact

SEQ ID NO: 4993430 - DNA, 18 bp, Homo sapiens
taaattagtttgacactg

SEQ ID NO: 4993431 - DNA, 16 bp, Homo sapiens
taaattggtcatggta

SEQ ID NO: 4993432 - DNA, 19 bp, Homo sapiens
taacatcactacaaaaaga

SEQ ID NO: 4993433 - DNA, 21 bp, Homo sapiens
taacatcactacaaaaagaag

SEQ ID NO: 4993434 - DNA, 20 bp, Homo sapiens
taacatgggcaaaatggcta

SEQ ID NO: 4993435 - DNA, 22 bp, Homo sapiens
taacctcttatcactaagaaag

SEQ ID NO: 4993436 - DNA, 13 bp, Homo sapiens
taactaaatgctc

SEQ ID NO: 4993437 - DNA, 14 bp, Homo sapiens
taactaaatgctca

SEQ ID NO: 4993438 - DNA, 15 bp, Homo sapiens
taactaaatgctcat

SEQ ID NO: 4993439 - DNA, 18 bp, Homo sapiens
taactgtatttcagtatt

SEQ ID NO: 4993440 - DNA, 21 bp, Homo sapiens
taagaaagccaccttgttaca

SEQ ID NO: 4993441 - DNA, 17 bp, Homo sapiens
taagggtggaaaaatgc

SEQ ID NO: 4993442 - DNA, 16 bp, Homo sapiens
taataaattggagttt

SEQ ID NO: 4993443 - DNA, 21 bp, Homo sapiens
taatatatatgtagagaaaga

SEQ ID NO: 4993444 - DNA, 15 bp, Homo sapiens
taatcatgctcatgt

SEQ ID NO: 4993445 - DNA, 21 bp, Homo sapiens
taatcatgctcatgtatattt

SEQ ID NO: 4993446 - DNA, 20 bp, Homo sapiens
taatctaagtatatgtgaga

SEQ ID NO: 4993447 - DNA, 22 bp, Homo sapiens
taatctcctctgctcattaaac

SEQ ID NO: 4993448 - DNA, 16 bp, Homo sapiens
taatctgcctggtttt

SEQ ID NO: 4993449 - DNA, 14 bp, Homo sapiens
taatgatgtaacag

SEQ ID NO: 4993450 - DNA, 13 bp, Homo sapiens
taatgctttctga

SEQ ID NO: 4993451 - DNA, 16 bp, Homo sapiens
taatgctttctgagtg

SEQ ID NO: 4993452 - DNA, 22 bp, Homo sapiens
taatgtagggttatatttggga

SEQ ID NO: 4993453 - DNA, 14 bp, Homo sapiens
taattaaaaacttt

SEQ ID NO: 4993454 - DNA, 20 bp, Homo sapiens
taattaaaaactttaaagat

SEQ ID NO: 4993455 - DNA, 18 bp, Homo sapiens
taattaaactagtttaag

SEQ ID NO: 4993456 - DNA, 21 bp, Homo sapiens
taattgatcagatgctgaatt

SEQ ID NO: 4993457 - DNA, 13 bp, Homo sapiens
tacaaaaagaaga

SEQ ID NO: 4993458 - DNA, 15 bp, Homo sapiens
tacaaaaagaagagt

SEQ ID NO: 4993459 - DNA, 20 bp, Homo sapiens
tacaaattttttaatttcca

SEQ ID NO: 4993460 - DNA, 23 bp, Homo sapiens
tacaaccagaaacaatgtgtcta

SEQ ID NO: 4993461 - DNA, 17 bp, Homo sapiens
tacacagttaaataaat

SEQ ID NO: 4993462 - DNA, 17 bp, Homo sapiens
tacatcatgtaagatgg

SEQ ID NO: 4993463 - DNA, 14 bp, Homo sapiens
tacatttgaaaata

SEQ ID NO: 4993464 - DNA, 16 bp, Homo sapiens
taccaagtatgaagta

SEQ ID NO: 4993465 - DNA, 16 bp, Homo sapiens
taccatgtgtgctaat

SEQ ID NO: 4993466 - DNA, 17 bp, Homo sapiens
tacccaacagtttattt

SEQ ID NO: 4993467 - DNA, 22 bp, Homo sapiens
tacctaaaaggaaatctcaccc

SEQ ID NO: 4993468 - DNA, 14 bp, Homo sapiens
tacctttttatatt

SEQ ID NO: 4993469 - DNA, 17 bp, Homo sapiens
tacgtataatgctttct

SEQ ID NO: 4993470 - DNA, 18 bp, Homo sapiens
tacgtataatgctttctg

SEQ ID NO: 4993471 - DNA, 14 bp, Homo sapiens
tactaaataaacat

SEQ ID NO: 4993472 - DNA, 15 bp, Homo sapiens
tactgaagaacagta

SEQ ID NO: 4993473 - DNA, 20 bp, Homo sapiens
tactgcagcctttgcctccc

SEQ ID NO: 4993474 - DNA, 15 bp, Homo sapiens
tactgtagaaaggaa

SEQ ID NO: 4993475 - DNA, 17 bp, Homo sapiens
tacttagaatgccataa

SEQ ID NO: 4993476 - DNA, 11 bp, Homo sapiens
tagaaaaagga

SEQ ID NO: 4993477 - DNA, 13 bp, Homo sapiens
tagaaaaaggatg

SEQ ID NO: 4993478 - DNA, 22 bp, Homo sapiens
tagaaaaaggatggaagaaaga

SEQ ID NO: 4993479 - DNA, 15 bp, Homo sapiens
tagaaaatcttagta

SEQ ID NO: 4993480 - DNA, 18 bp, Homo sapiens
tagaaagacatctgcctg

SEQ ID NO: 4993481 - DNA, 16 bp, Homo sapiens
tagaaagagttctatg

SEQ ID NO: 4993482 - DNA, 21 bp, Homo sapiens
tagaaaggaaatagactttgt

SEQ ID NO: 4993483 - DNA, 22 bp, Homo sapiens
tagaaagtatagatggccaaag

SEQ ID NO: 4993484 - DNA, 11 bp, Homo sapiens
tagaagaaaga

SEQ ID NO: 4993485 - DNA, 12 bp, Homo sapiens
tagaagaaagaa

SEQ ID NO: 4993486 - DNA, 13 bp, Homo sapiens
tagaagaaagaaa

SEQ ID NO: 4993487 - DNA, 14 bp, Homo sapiens
tagaagaaagaaaa

SEQ ID NO: 4993488 - DNA, 15 bp, Homo sapiens
tagaagaaagaaaat

SEQ ID NO: 4993489 - DNA, 15 bp, Homo sapiens
tagaataaatggttt

SEQ ID NO: 4993490 - DNA, 15 bp, Homo sapiens
tagactttgtatgaa

SEQ ID NO: 4993491 - DNA, 14 bp, Homo sapiens
tagagtaatgatgt

SEQ ID NO: 4993492 - DNA, 19 bp, Homo sapiens
tagatgctattaagaaggc

SEQ ID NO: 4993493 - DNA, 13 bp, Homo sapiens
tagatttgaaaaa

SEQ ID NO: 4993494 - DNA, 17 bp, Homo sapiens
tagatttgaaaaacttt

SEQ ID NO: 4993495 - DNA, 12 bp, Homo sapiens
tagcatttattt

SEQ ID NO: 4993496 - DNA, 19 bp, Homo sapiens
tagctacctttttatattt

SEQ ID NO: 4993497 - DNA, 21 bp, Homo sapiens
taggcacttttattttcattg

SEQ ID NO: 4993498 - DNA, 20 bp, Homo sapiens
tagggaaaatggatatagaa

SEQ ID NO: 4993499 - DNA, 13 bp, Homo sapiens
tagggtataatgt

SEQ ID NO: 4993500 - DNA, 19 bp, Homo sapiens
tagggtgggtaagaaagcc

SEQ ID NO: 4993501 - DNA, 13 bp, Homo sapiens
tagggttatattt

SEQ ID NO: 4993502 - DNA, 15 bp, Homo sapiens
taggtcaagtaataa

SEQ ID NO: 4993503 - DNA, 19 bp, Homo sapiens
taggtcaagtaataaaaag

SEQ ID NO: 4993504 - DNA, 13 bp, Homo sapiens
tagtaaatgctga

SEQ ID NO: 4993505 - DNA, 23 bp, Homo sapiens
tagtatagtagaaagacatctgc

SEQ ID NO: 4993506 - DNA, 15 bp, Homo sapiens
tagtatctaataatg

SEQ ID NO: 4993507 - DNA, 18 bp, Homo sapiens
tagtatttaactacatct

SEQ ID NO: 4993508 - DNA, 16 bp, Homo sapiens
tagtgacaaaaataaa

SEQ ID NO: 4993509 - DNA, 13 bp, Homo sapiens
tagttttaaataa

SEQ ID NO: 4993510 - DNA, 14 bp, Homo sapiens
tagttttaaataaa

SEQ ID NO: 4993511 - DNA, 16 bp, Homo sapiens
tagtttttaattaaaa

SEQ ID NO: 4993512 - DNA, 22 bp, Homo sapiens
tagtttttaattaaaaacttta

SEQ ID NO: 4993513 - DNA, 18 bp, Homo sapiens
tataaaaatgtaaattag

SEQ ID NO: 4993514 - DNA, 21 bp, Homo sapiens
tataaatacataaataaaaga

SEQ ID NO: 4993515 - DNA, 13 bp, Homo sapiens
tataatcagggaa

SEQ ID NO: 4993516 - DNA, 18 bp, Homo sapiens
tataatctcctctgctca

SEQ ID NO: 4993517 - DNA, 19 bp, Homo sapiens
tataatctcctctgctcat

SEQ ID NO: 4993518 - DNA, 21 bp, Homo sapiens
tataccatgtgtgctaatata

SEQ ID NO: 4993519 - DNA, 18 bp, Homo sapiens
tatacctgccttttaagt

SEQ ID NO: 4993520 - DNA, 17 bp, Homo sapiens
tatactttttttgttat

SEQ ID NO: 4993521 - DNA, 17 bp, Homo sapiens
tatagaaaatcttagta

SEQ ID NO: 4993522 - DNA, 13 bp, Homo sapiens
tatagtagaaaga

SEQ ID NO: 4993523 - DNA, 16 bp, Homo sapiens
tatataaggtaatgta

SEQ ID NO: 4993524 - DNA, 16 bp, Homo sapiens
tatataatcatgctca

SEQ ID NO: 4993525 - DNA, 15 bp, Homo sapiens
tatatatgtagagaa

SEQ ID NO: 4993526 - DNA, 18 bp, Homo sapiens
tatatatgtagagaaaga

SEQ ID NO: 4993527 - DNA, 12 bp, Homo sapiens
tatatgctgtat

SEQ ID NO: 4993528 - DNA, 16 bp, Homo sapiens
tatatgctgtatttct

SEQ ID NO: 4993529 - DNA, 23 bp, Homo sapiens
tatatgctgtatttctttgtaga

SEQ ID NO: 4993530 - DNA, 14 bp, Homo sapiens
tatatgtgagaaat

SEQ ID NO: 4993531 - DNA, 13 bp, Homo sapiens
tatattaaatgag

SEQ ID NO: 4993532 - DNA, 16 bp, Homo sapiens
tatatttagttacgta

SEQ ID NO: 4993533 - DNA, 15 bp, Homo sapiens
tatattttgaaatat

SEQ ID NO: 4993534 - DNA, 17 bp, Homo sapiens
tatcactaagaaagaaa

SEQ ID NO: 4993535 - DNA, 20 bp, Homo sapiens
tatctagcatttatttctct

SEQ ID NO: 4993536 - DNA, 16 bp, Homo sapiens
tatctatacctgcctt

SEQ ID NO: 4993537 - DNA, 21 bp, Homo sapiens
tatcttgttattaatgtttct

SEQ ID NO: 4993538 - DNA, 18 bp, Homo sapiens
tatctttgtgtaatctaa

SEQ ID NO: 4993539 - DNA, 21 bp, Homo sapiens
tatgaaaacaatactaaataa

SEQ ID NO: 4993540 - DNA, 14 bp, Homo sapiens
tatgagatttactg

SEQ ID NO: 4993541 - DNA, 16 bp, Homo sapiens
tatgagatttactgct

SEQ ID NO: 4993542 - DNA, 19 bp, Homo sapiens
tatgattggttcagttttt

SEQ ID NO: 4993543 - DNA, 15 bp, Homo sapiens
tatgcatttttcttt

SEQ ID NO: 4993544 - DNA, 15 bp, Homo sapiens
tatgtagagaaagat

SEQ ID NO: 4993545 - DNA, 18 bp, Homo sapiens
tatgtatataatcatgct

SEQ ID NO: 4993546 - DNA, 16 bp, Homo sapiens
tatgtccttcagctga

SEQ ID NO: 4993547 - DNA, 21 bp, Homo sapiens
tattcaaggctttaaaagtca

SEQ ID NO: 4993548 - DNA, 20 bp, Homo sapiens
tattcagctagaatttctgg

SEQ ID NO: 4993549 - DNA, 17 bp, Homo sapiens
tattgaaagttgctttt

SEQ ID NO: 4993550 - DNA, 21 bp, Homo sapiens
tattgagtcttaactgtattt

SEQ ID NO: 4993551 - DNA, 23 bp, Homo sapiens
tattgagtcttaactgtatttca

SEQ ID NO: 4993552 - DNA, 18 bp, Homo sapiens
tattgatcccttctcctg

SEQ ID NO: 4993553 - DNA, 16 bp, Homo sapiens
tatttaaaaaattaaa

SEQ ID NO: 4993554 - DNA, 21 bp, Homo sapiens
ttaaaatgtagttttaaataa

SEQ ID NO: 4993555 - DNA, 17 bp, Homo sapiens
ttaaacaaaatttcaca

SEQ ID NO: 4993556 - DNA, 21 bp, Homo sapiens
ttaaacaaaatttcacagttc

SEQ ID NO: 4993557 - DNA, 14 bp, Homo sapiens
ttaaacaatgatca

SEQ ID NO: 4993558 - DNA, 22 bp, Homo sapiens
ttaaagataagtctacattaaa

SEQ ID NO: 4993559 - DNA, 13 bp, Homo sapiens
ttaaagtaaactt

SEQ ID NO: 4993560 - DNA, 14 bp, Homo sapiens
ttaaagtaaacttg

SEQ ID NO: 4993561 - DNA, 16 bp, Homo sapiens
ttaaataaagtttgga

SEQ ID NO: 4993562 - DNA, 19 bp, Homo sapiens
ttaaatcatttggttaaat

SEQ ID NO: 4993563 - DNA, 20 bp, Homo sapiens
ttaacatcactacaaaaaga

SEQ ID NO: 4993564 - DNA, 14 bp, Homo sapiens
ttaagccttgacac

SEQ ID NO: 4993565 - DNA, 15 bp, Homo sapiens
ttaagccttgacaca

SEQ ID NO: 4993566 - DNA, 19 bp, Homo sapiens
ttaagggtggaaaaatgcc

SEQ ID NO: 4993567 - DNA, 13 bp, Homo sapiens
ttaattaaaaact

SEQ ID NO: 4993568 - DNA, 20 bp, Homo sapiens
ttaatttagagcgtttggtt

SEQ ID NO: 4993569 - DNA, 18 bp, Homo sapiens
ttacaagcttaaagcttg

SEQ ID NO: 4993570 - DNA, 19 bp, Homo sapiens
ttacattattccaatgata

SEQ ID NO: 4993571 - DNA, 22 bp, Homo sapiens
ttacctaaaagctacagaacca

SEQ ID NO: 4993572 - DNA, 20 bp, Homo sapiens
ttactcccttctgtagtttt

SEQ ID NO: 4993573 - DNA, 22 bp, Homo sapiens
ttactcttaaatcatttggtta

SEQ ID NO: 4993574 - DNA, 21 bp, Homo sapiens
ttagaatgccataaaattgca

SEQ ID NO: 4993575 - DNA, 15 bp, Homo sapiens
ttagacctttatcca

SEQ ID NO: 4993576 - DNA, 15 bp, Homo sapiens
ttagactgtggccat

SEQ ID NO: 4993577 - DNA, 20 bp, Homo sapiens
ttagctacctttttatattt

SEQ ID NO: 4993578 - DNA, 21 bp, Homo sapiens
ttagttgatattcaaggcttt

SEQ ID NO: 4993579 - DNA, 13 bp, Homo sapiens
ttagtttgacact

SEQ ID NO: 4993580 - DNA, 19 bp, Homo sapiens
ttataccatgtgtgctaat

SEQ ID NO: 4993581 - DNA, 18 bp, Homo sapiens
ttatatataaggtaatgt

SEQ ID NO: 4993582 - DNA, 17 bp, Homo sapiens
ttatcactaagaaagaa

SEQ ID NO: 4993583 - DNA, 18 bp, Homo sapiens
ttatcactaagaaagaaa

SEQ ID NO: 4993584 - DNA, 17 bp, Homo sapiens
ttatcactacaagcttt

SEQ ID NO: 4993585 - DNA, 15 bp, Homo sapiens
ttattaatgtttctt

SEQ ID NO: 4993586 - DNA, 19 bp, Homo sapiens
ttatttctctggcaaactt

SEQ ID NO: 4993587 - DNA, 15 bp, Homo sapiens
ttattttcattgtga

SEQ ID NO: 4993588 - DNA, 13 bp, Homo sapiens
ttcaaaaaaacat

SEQ ID NO: 4993589 - DNA, 16 bp, Homo sapiens
ttcaaattggtctgaa

SEQ ID NO: 4993590 - DNA, 15 bp, Homo sapiens
ttcacagttctgtaa

SEQ ID NO: 4993591 - DNA, 20 bp, Homo sapiens
ttcacagttctgtaatgtag

SEQ ID NO: 4993592 - DNA, 15 bp, Homo sapiens
ttcaccctgggcagt

SEQ ID NO: 4993593 - DNA, 16 bp, Homo sapiens
ttcacctctgtacaga

SEQ ID NO: 4993594 - DNA, 14 bp, Homo sapiens
ttcagtattttcca

SEQ ID NO: 4993595 - DNA, 18 bp, Homo sapiens
ttcagtattttccagcct

SEQ ID NO: 4993596 - DNA, 21 bp, Homo sapiens
ttcatagatttgaaaaacttt

SEQ ID NO: 4993597 - DNA, 17 bp, Homo sapiens
ttcatgctgaggtgatt

SEQ ID NO: 4993598 - DNA, 23 bp, Homo sapiens
ttccaaaataatctatattaaat

SEQ ID NO: 4993599 - DNA, 19 bp, Homo sapiens
ttccagagttgttgtttgc

SEQ ID NO: 4993600 - DNA, 20 bp, Homo sapiens
ttccagagttgttgtttgcc

SEQ ID NO: 4993601 - DNA, 21 bp, Homo sapiens
ttccagccttatgtgttacat

SEQ ID NO: 4993602 - DNA, 21 bp, Homo sapiens
ttccccactgacagcctccca

SEQ ID NO: 4993603 - DNA, 14 bp, Homo sapiens
ttccctacttgcag

SEQ ID NO: 4993604 - DNA, 22 bp, Homo sapiens
ttcctgattaccagtctgatta

SEQ ID NO: 4993605 - DNA, 13 bp, Homo sapiens
ttcctgtctgttt

SEQ ID NO: 4993606 - DNA, 19 bp, Homo sapiens
ttcctttaaatggtaagag

SEQ ID NO: 4993607 - DNA, 17 bp, Homo sapiens
ttctctggcaaactttt

SEQ ID NO: 4993608 - DNA, 15 bp, Homo sapiens
ttctctttgtgcagt

SEQ ID NO: 4993609 - DNA, 16 bp, Homo sapiens
ttctgaaatacttttg

SEQ ID NO: 4993610 - DNA, 14 bp, Homo sapiens
ttctgatctgtact

SEQ ID NO: 4993611 - DNA, 22 bp, Homo sapiens
ttctgcaagcacatctgcattt

SEQ ID NO: 4993612 - DNA, 14 bp, Homo sapiens
ttctgtagttttta

SEQ ID NO: 4993613 - DNA, 20 bp, Homo sapiens
ttctttgtagaataaatggt

SEQ ID NO: 4993614 - DNA, 15 bp, Homo sapiens
ttgaaaacaaagaca

SEQ ID NO: 4993615 - DNA, 13 bp, Homo sapiens
ttgactatttctt

SEQ ID NO: 4993616 - DNA, 22 bp, Homo sapiens
ttgatcagatgctgaattgaga

SEQ ID NO: 4993617 - DNA, 12 bp, Homo sapiens
ttgatctttgtt

SEQ ID NO: 4993618 - DNA, 18 bp, Homo sapiens
ttgatctttgtttaaatg

SEQ ID NO: 4993619 - DNA, 12 bp, Homo sapiens
ttgattatgggt

SEQ ID NO: 4993620 - DNA, 21 bp, Homo sapiens
ttgcagtttcatgtatgtata

SEQ ID NO: 4993621 - DNA, 12 bp, Homo sapiens
ttgctaataatg

SEQ ID NO: 4993622 - DNA, 20 bp, Homo sapiens
ttgcttagtatctaataatg

SEQ ID NO: 4993623 - DNA, 23 bp, Homo sapiens
ttgcttagtatctaataatgaag

SEQ ID NO: 4993624 - DNA, 22 bp, Homo sapiens
ttggacgtttactagactttga

SEQ ID NO: 4993625 - DNA, 15 bp, Homo sapiens
ttggcttgctgttta

SEQ ID NO: 4993626 - DNA, 22 bp, Homo sapiens
ttggtaacgaatttaaaatgta

SEQ ID NO: 4993627 - DNA, 14 bp, Homo sapiens
ttggttcagttttt

SEQ ID NO: 4993628 - DNA, 15 bp, Homo sapiens
ttgtattgcttcctg

SEQ ID NO: 4993629 - DNA, 18 bp, Homo sapiens
ttgtgcagtgttagtatt

SEQ ID NO: 4993630 - DNA, 14 bp, Homo sapiens
ttgtgtaatctaag

SEQ ID NO: 4993631 - DNA, 17 bp, Homo sapiens
ttgttatagattgtctt

SEQ ID NO: 4993632 - DNA, 14 bp, Homo sapiens
ttgttattaatgtt

SEQ ID NO: 4993633 - DNA, 18 bp, Homo sapiens
ttgttattaatgtttctt

SEQ ID NO: 4993634 - DNA, 17 bp, Homo sapiens
ttgtttaaaaatgcagt

SEQ ID NO: 4993635 - DNA, 20 bp, Homo sapiens
tttaaaacatcagaaactga

SEQ ID NO: 4993636 - DNA, 12 bp, Homo sapiens
tttaaaatgtag

SEQ ID NO: 4993637 - DNA, 13 bp, Homo sapiens
tttaaatgccaaa

SEQ ID NO: 4993638 - DNA, 18 bp, Homo sapiens
tttaaatggtaagagttt

SEQ ID NO: 4993639 - DNA, 22 bp, Homo sapiens
tttaacatcactacaaaaagaa

SEQ ID NO: 4993640 - DNA, 12 bp, Homo sapiens
tttaagtgacat

SEQ ID NO: 4993641 - DNA, 23 bp, Homo sapiens
tttaagtgacataattgtccagt

SEQ ID NO: 4993642 - DNA, 21 bp, Homo sapiens
tttaatttccaaaataatcta

SEQ ID NO: 4993643 - DNA, 21 bp, Homo sapiens
tttactgctctagaaagtata

SEQ ID NO: 4993644 - DNA, 19 bp, Homo sapiens
tttagagcgtttggttaaa

SEQ ID NO: 4993645 - DNA, 12 bp, Homo sapiens
tttagctacctt

SEQ ID NO: 4993646 - DNA, 17 bp, Homo sapiens
tttatatcccattttta

SEQ ID NO: 4993647 - DNA, 17 bp, Homo sapiens
tttatgagatttactgc

SEQ ID NO: 4993648 - DNA, 18 bp, Homo sapiens
tttattcagctagaattt

SEQ ID NO: 4993649 - DNA, 14 bp, Homo sapiens
tttatttatatctt

SEQ ID NO: 4993650 - DNA, 13 bp, Homo sapiens
tttatttctctgg

SEQ ID NO: 4993651 - DNA, 21 bp, Homo sapiens
tttatttctctggcaaacttt

SEQ ID NO: 4993652 - DNA, 21 bp, Homo sapiens
tttcaatttggagcattaact

SEQ ID NO: 4993653 - DNA, 19 bp, Homo sapiens
tttcacagttctgtaatgt

SEQ ID NO: 4993654 - DNA, 22 bp, Homo sapiens
tttcaccccacccttcccctcc

SEQ ID NO: 4993655 - DNA, 23 bp, Homo sapiens
tttcatagatttgaaaaactttt

SEQ ID NO: 4993656 - DNA, 13 bp, Homo sapiens
tttcattgtgatt

SEQ ID NO: 4993657 - DNA, 13 bp, Homo sapiens
tttccccattgtg

SEQ ID NO: 4993658 - DNA, 23 bp, Homo sapiens
tttcctatctagcatttatttct

SEQ ID NO: 4993659 - DNA, 13 bp, Homo sapiens
tttctcattaaac

SEQ ID NO: 4993660 - DNA, 21 bp, Homo sapiens
tttctccccatggtagtttaa

SEQ ID NO: 4993661 - DNA, 13 bp, Homo sapiens
tttctcctctccc

SEQ ID NO: 4993662 - DNA, 22 bp, Homo sapiens
tttctctaacttcaaggcccat

SEQ ID NO: 4993663 - DNA, 11 bp, Homo sapiens
tttctgatctg

SEQ ID NO: 4993664 - DNA, 16 bp, Homo sapiens
tttgaaactaactcat

SEQ ID NO: 4993665 - DNA, 15 bp, Homo sapiens
tttgaggtctacatt

SEQ ID NO: 4993666 - DNA, 13 bp, Homo sapiens
tttgatctttgtt

SEQ ID NO: 4993667 - DNA, 20 bp, Homo sapiens
tttgatctttgtttaaatgc

SEQ ID NO: 4993668 - DNA, 21 bp, Homo sapiens
tttgatctttgtttaaatgcc

SEQ ID NO: 4993669 - DNA, 18 bp, Homo sapiens
aagttgaaaagtaaaaaa

SEQ ID NO: 4993670 - DNA, 19 bp, Homo sapiens
aagtttttatatcttttct

SEQ ID NO: 4993671 - DNA, 16 bp, Homo sapiens
aagttttttactttgg

SEQ ID NO: 4993672 - DNA, 17 bp, Homo sapiens
aataaaagcctttgaaa

SEQ ID NO: 4993673 - DNA, 13 bp, Homo sapiens
aataaaggaaata

SEQ ID NO: 4993674 - DNA, 19 bp, Homo sapiens
aataaattggagttttaaa

SEQ ID NO: 4993675 - DNA, 13 bp, Homo sapiens
aataatctatatt

SEQ ID NO: 4993676 - DNA, 14 bp, Homo sapiens
aataatctatatta

SEQ ID NO: 4993677 - DNA, 15 bp, Homo sapiens
aatactaaataaaca

SEQ ID NO: 4993678 - DNA, 22 bp, Homo sapiens
aatagaagaaagaaaatggaaa

SEQ ID NO: 4993679 - DNA, 12 bp, Homo sapiens
aatataaaaaca

SEQ ID NO: 4993680 - DNA, 11 bp, Homo sapiens
aatatactttt

SEQ ID NO: 4993681 - DNA, 16 bp, Homo sapiens
aatatactttttttgt

SEQ ID NO: 4993682 - DNA, 20 bp, Homo sapiens
aatatttgcacacatttaaa

SEQ ID NO: 4993683 - DNA, 17 bp, Homo sapiens
aatcagaattggcataa

SEQ ID NO: 4993684 - DNA, 12 bp, Homo sapiens
aatcatgctcat

SEQ ID NO: 4993685 - DNA, 19 bp, Homo sapiens
aatcatgctcatgtatatt

SEQ ID NO: 4993686 - DNA, 14 bp, Homo sapiens
aatcatttggttaa

SEQ ID NO: 4993687 - DNA, 18 bp, Homo sapiens
aatcttagtatagtagaa

SEQ ID NO: 4993688 - DNA, 19 bp, Homo sapiens
aatcttagtatagtagaaa

SEQ ID NO: 4993689 - DNA, 17 bp, Homo sapiens
aatctttaactgaactc

SEQ ID NO: 4993690 - DNA, 20 bp, Homo sapiens
aatgaaaatttcacttgaaa

SEQ ID NO: 4993691 - DNA, 21 bp, Homo sapiens
aatgaaataatgtacatctgg

SEQ ID NO: 4993692 - DNA, 23 bp, Homo sapiens
aatgagggtttctgatctgtact

SEQ ID NO: 4993693 - DNA, 16 bp, Homo sapiens
aatgattaatcataaa

SEQ ID NO: 4993694 - DNA, 14 bp, Homo sapiens
aatgcatatatgaa

SEQ ID NO: 4993695 - DNA, 17 bp, Homo sapiens
aatgccaaaatgtactt

SEQ ID NO: 4993696 - DNA, 18 bp, Homo sapiens
aatgccaaaatgtactta

SEQ ID NO: 4993697 - DNA, 13 bp, Homo sapiens
aatgctgaaataa

SEQ ID NO: 4993698 - DNA, 12 bp, Homo sapiens
aatggaaagaag

SEQ ID NO: 4993699 - DNA, 13 bp, Homo sapiens
aatggaaagaagg

SEQ ID NO: 4993700 - DNA, 14 bp, Homo sapiens
aatggaaagaagga

SEQ ID NO: 4993701 - DNA, 16 bp, Homo sapiens
aatggaaagaaggaaa

SEQ ID NO: 4993702 - DNA, 17 bp, Homo sapiens
aatggaaagaaggaaaa

SEQ ID NO: 4993703 - DNA, 23 bp, Homo sapiens
aatggaaagaaggaaaaaaggag

SEQ ID NO: 4993704 - DNA, 21 bp, Homo sapiens
aatgtaaattagtttgacact

SEQ ID NO: 4993705 - DNA, 14 bp, Homo sapiens
aatgtacttaaatg

SEQ ID NO: 4993706 - DNA, 22 bp, Homo sapiens
aatgtacttaaatgagttactt

SEQ ID NO: 4993707 - DNA, 17 bp, Homo sapiens
aatgtagggttatattt

SEQ ID NO: 4993708 - DNA, 22 bp, Homo sapiens
aatgtagttttaaataaagttt

SEQ ID NO: 4993709 - DNA, 17 bp, Homo sapiens
aatgtgtctatttctga

SEQ ID NO: 4993710 - DNA, 18 bp, Homo sapiens
aatgtgtctgtgttgctt

SEQ ID NO: 4993711 - DNA, 16 bp, Homo sapiens
aattaaactagtttaa

SEQ ID NO: 4993712 - DNA, 23 bp, Homo sapiens
aattacgttcttacaagcttaaa

SEQ ID NO: 4993713 - DNA, 15 bp, Homo sapiens
aattagtttgacact

SEQ ID NO: 4993714 - DNA, 17 bp, Homo sapiens
aattagtttgacactgc

SEQ ID NO: 4993715 - DNA, 17 bp, Homo sapiens
aattcagctttagaaat

SEQ ID NO: 4993716 - DNA, 21 bp, Homo sapiens
aattctgggttcatttgtgat

SEQ ID NO: 4993717 - DNA, 18 bp, Homo sapiens
aattgcagtttcatgtat

SEQ ID NO: 4993718 - DNA, 14 bp, Homo sapiens
aattggcataattt

SEQ ID NO: 4993719 - DNA, 13 bp, Homo sapiens
aatttagagcgtt

SEQ ID NO: 4993720 - DNA, 14 bp, Homo sapiens
aatttcacagttct

SEQ ID NO: 4993721 - DNA, 14 bp, Homo sapiens
aatttcacttgaaa

SEQ ID NO: 4993722 - DNA, 18 bp, Homo sapiens
aatttcacttgaaattaa

SEQ ID NO: 4993723 - DNA, 14 bp, Homo sapiens
aatttccaaaataa

SEQ ID NO: 4993724 - DNA, 18 bp, Homo sapiens
aatttccaaaataatcta

SEQ ID NO: 4993725 - DNA, 22 bp, Homo sapiens
aatttctgagaacagtgcacaa

SEQ ID NO: 4993726 - DNA, 15 bp, Homo sapiens
aatttggagcattaa

SEQ ID NO: 4993727 - DNA, 15 bp, Homo sapiens
acaaaatttcacagt

SEQ ID NO: 4993728 - DNA, 22 bp, Homo sapiens
acaaaatttcacagttctgtaa

SEQ ID NO: 4993729 - DNA, 14 bp, Homo sapiens
acaaagttcagtgt

SEQ ID NO: 4993730 - DNA, 23 bp, Homo sapiens
acaaattccgattagacctttat

SEQ ID NO: 4993731 - DNA, 17 bp, Homo sapiens
acaagattattttatca

SEQ ID NO: 4993732 - DNA, 15 bp, Homo sapiens
acaatactaaataaa

SEQ ID NO: 4993733 - DNA, 17 bp, Homo sapiens
acaatactaaataaaca

SEQ ID NO: 4993734 - DNA, 22 bp, Homo sapiens
acaatgtgtctatttctgaaag

SEQ ID NO: 4993735 - DNA, 23 bp, Homo sapiens
acacagttaaataaatagaaaga

SEQ ID NO: 4993736 - DNA, 15 bp, Homo sapiens
acacatttaaaaata

SEQ ID NO: 4993737 - DNA, 22 bp, Homo sapiens
acagaccatctgtatgttaggt

SEQ ID NO: 4993738 - DNA, 20 bp, Homo sapiens
acagatggagcaaatgtcct

SEQ ID NO: 4993739 - DNA, 15 bp, Homo sapiens
acagcctcccacccc

SEQ ID NO: 4993740 - DNA, 16 bp, Homo sapiens
acagcctcccaccccc

SEQ ID NO: 4993741 - DNA, 19 bp, Homo sapiens
acagtactccacaaacatg

SEQ ID NO: 4993742 - DNA, 15 bp, Homo sapiens
acagtgctattctga

SEQ ID NO: 4993743 - DNA, 13 bp, Homo sapiens
acagttctgtaat

SEQ ID NO: 4993744 - DNA, 15 bp, Homo sapiens
acataaataaaagaa

SEQ ID NO: 4993745 - DNA, 21 bp, Homo sapiens
acatcatgtaagatggcaact

SEQ ID NO: 4993746 - DNA, 13 bp, Homo sapiens
acatctaaagctt

SEQ ID NO: 4993747 - DNA, 15 bp, Homo sapiens
acatctaaagcttta

SEQ ID NO: 4993748 - DNA, 20 bp, Homo sapiens
acatctaaagctttatcttt

SEQ ID NO: 4993749 - DNA, 18 bp, Homo sapiens
acattaaacaatgatcac

SEQ ID NO: 4993750 - DNA, 22 bp, Homo sapiens
acattcttggttgttaatttag

SEQ ID NO: 4993751 - DNA, 13 bp, Homo sapiens
acatttgaaaata

SEQ ID NO: 4993752 - DNA, 17 bp, Homo sapiens
accaccttttattacat

SEQ ID NO: 4993753 - DNA, 22 bp, Homo sapiens
accacttaaaaaaaaatctaaa

SEQ ID NO: 4993754 - DNA, 15 bp, Homo sapiens
accattttcaatttg

SEQ ID NO: 4993755 - DNA, 15 bp, Homo sapiens
acccaacagtttatt

SEQ ID NO: 4993756 - DNA, 23 bp, Homo sapiens
acccaacagtttatttttattat

SEQ ID NO: 4993757 - DNA, 23 bp, Homo sapiens
acccaggtccccaattgagaatg

SEQ ID NO: 4993758 - DNA, 14 bp, Homo sapiens
accgttttgtattg

SEQ ID NO: 4993759 - DNA, 21 bp, Homo sapiens
acctaaaaggaaatctcaccc

SEQ ID NO: 4993760 - DNA, 21 bp, Homo sapiens
acctcttatcactaagaaaga

SEQ ID NO: 4993761 - DNA, 23 bp, Homo sapiens
acctcttatcactaagaaagaaa

SEQ ID NO: 4993762 - DNA, 23 bp, Homo sapiens
acgaatttaaaatgtagttttaa

SEQ ID NO: 4993763 - DNA, 12 bp, Homo sapiens
actaaaaataga

SEQ ID NO: 4993764 - DNA, 12 bp, Homo sapiens
actaagaaagaa

SEQ ID NO: 4993765 - DNA, 24 bp, Homo sapiens
actaagaaagaaaggaaagaagga

SEQ ID NO: 4993766 - DNA, 15 bp, Homo sapiens
actacaaaaagaaga

SEQ ID NO: 4993767 - DNA, 18 bp, Homo sapiens
actaggattataatgctg

SEQ ID NO: 4993768 - DNA, 23 bp, Homo sapiens
actcggatgtgtcctttctgaac

SEQ ID NO: 4993769 - DNA, 15 bp, Homo sapiens
actgactctgttatt

SEQ ID NO: 4993770 - DNA, 19 bp, Homo sapiens
actgcaagcatttttccat

SEQ ID NO: 4993771 - DNA, 15 bp, Homo sapiens
actgctctagaaagt

SEQ ID NO: 4993772 - DNA, 13 bp, Homo sapiens
actggagtgaatg

SEQ ID NO: 4993773 - DNA, 15 bp, Homo sapiens
actgtagaaaggaaa

SEQ ID NO: 4993774 - DNA, 17 bp, Homo sapiens
actgtagaaaggaaata

SEQ ID NO: 4993775 - DNA, 15 bp, Homo sapiens
actgtattaaagaaa

SEQ ID NO: 4993776 - DNA, 16 bp, Homo sapiens
actgtattaaagaaaa

SEQ ID NO: 4993777 - DNA, 20 bp, Homo sapiens
actgtatttcagtattttcc

SEQ ID NO: 4993778 - DNA, 22 bp, Homo sapiens
actgtatttcagtattttccag

SEQ ID NO: 4993779 - DNA, 13 bp, Homo sapiens
acttagaatgcca

SEQ ID NO: 4993780 - DNA, 15 bp, Homo sapiens
acttagaatgccata

SEQ ID NO: 4993781 - DNA, 17 bp, Homo sapiens
acttagaatgccataaa

SEQ ID NO: 4993782 - DNA, 20 bp, Homo sapiens
acttgcagcgccaagtggcc

SEQ ID NO: 4993783 - DNA, 16 bp, Homo sapiens
actttgctgttactgc

SEQ ID NO: 4993784 - DNA, 20 bp, Homo sapiens
gagcattaactaaatgctca

SEQ ID NO: 4993785 - DNA, 13 bp, Homo sapiens
gagggtttctgat

SEQ ID NO: 4993786 - DNA, 21 bp, Homo sapiens
gagtcttaactgtatttcagt

SEQ ID NO: 4993787 - DNA, 20 bp, Homo sapiens
gagttctatggagactttgc

SEQ ID NO: 4993788 - DNA, 16 bp, Homo sapiens
gatacccaacagttta

SEQ ID NO: 4993789 - DNA, 20 bp, Homo sapiens
gatcagatgctgaattgaga

SEQ ID NO: 4993790 - DNA, 14 bp, Homo sapiens
gatccacctgtctc

SEQ ID NO: 4993791 - DNA, 19 bp, Homo sapiens
gatccacctgtctcagcct

SEQ ID NO: 4993792 - DNA, 16 bp, Homo sapiens
gatctgtactttgtgt

SEQ ID NO: 4993793 - DNA, 17 bp, Homo sapiens
gatctgtactttgtgtt

SEQ ID NO: 4993794 - DNA, 19 bp, Homo sapiens
gatctgtataaaaatgtaa

SEQ ID NO: 4993795 - DNA, 14 bp, Homo sapiens
gatctgtgtaaaat

SEQ ID NO: 4993796 - DNA, 15 bp, Homo sapiens
gatgaatagaagaaa

SEQ ID NO: 4993797 - DNA, 20 bp, Homo sapiens
gatgaatagaagaaagaaaa

SEQ ID NO: 4993798 - DNA, 18 bp, Homo sapiens
gatgtgtcctttctgaac

SEQ ID NO: 4993799 - DNA, 16 bp, Homo sapiens
gattaccagtctgatt

SEQ ID NO: 4993800 - DNA, 18 bp, Homo sapiens
gatttaagccttgacaca

SEQ ID NO: 4993801 - DNA, 22 bp, Homo sapiens
gatttaagccttgacacactgt

SEQ ID NO: 4993802 - DNA, 13 bp, Homo sapiens
gatttgaaaaact

SEQ ID NO: 4993803 - DNA, 15 bp, Homo sapiens
gatttgaaaaacttt

SEQ ID NO: 4993804 - DNA, 14 bp, Homo sapiens
gcaaactgctttat

SEQ ID NO: 4993805 - DNA, 21 bp, Homo sapiens
gcaactgtattaaagaaaaat

SEQ ID NO: 4993806 - DNA, 21 bp, Homo sapiens
gcacatctgcattttcacccc

SEQ ID NO: 4993807 - DNA, 22 bp, Homo sapiens
gcaccattttcaatttggagca

SEQ ID NO: 4993808 - DNA, 16 bp, Homo sapiens
gcactacttgcttata

SEQ ID NO: 4993809 - DNA, 18 bp, Homo sapiens
gcacttttattttcattg

SEQ ID NO: 4993810 - DNA, 17 bp, Homo sapiens
gcagcctttgcctcccc

SEQ ID NO: 4993811 - DNA, 16 bp, Homo sapiens
gcataactaggattat

SEQ ID NO: 4993812 - DNA, 16 bp, Homo sapiens
atgtgtcctttctgaa

SEQ ID NO: 4993813 - DNA, 23 bp, Homo sapiens
atgtgtctgtgttgcttcaaatt

SEQ ID NO: 4993814 - DNA, 14 bp, Homo sapiens
attaactaaatgct

SEQ ID NO: 4993815 - DNA, 15 bp, Homo sapiens
attaactaaatgctc

SEQ ID NO: 4993816 - DNA, 19 bp, Homo sapiens
attaccatagagtaatgat

SEQ ID NO: 4993817 - DNA, 20 bp, Homo sapiens
attataccatgtgtgctaat

SEQ ID NO: 4993818 - DNA, 17 bp, Homo sapiens
attatcaatgaaaattt

SEQ ID NO: 4993819 - DNA, 20 bp, Homo sapiens
attatcttagtctatagaaa

SEQ ID NO: 4993820 - DNA, 20 bp, Homo sapiens
attcaaggctttaaaagtca

SEQ ID NO: 4993821 - DNA, 23 bp, Homo sapiens
attccaatgatacccaacagttt

SEQ ID NO: 4993822 - DNA, 16 bp, Homo sapiens
attctaaatgaactca

SEQ ID NO: 4993823 - DNA, 14 bp, Homo sapiens
attctgaaatactt

SEQ ID NO: 4993824 - DNA, 16 bp, Homo sapiens
attctgaaatactttt

SEQ ID NO: 4993825 - DNA, 21 bp, Homo sapiens
attctgaaatacttttgagta

SEQ ID NO: 4993826 - DNA, 16 bp, Homo sapiens
attctggttgtaaatc

SEQ ID NO: 4993827 - DNA, 14 bp, Homo sapiens
attgaaagttgctt

SEQ ID NO: 4993828 - DNA, 18 bp, Homo sapiens
attgagaataagaatttg

SEQ ID NO: 4993829 - DNA, 15 bp, Homo sapiens
attgagtcttaactg

SEQ ID NO: 4993830 - DNA, 18 bp, Homo sapiens
attgagtcttaactgtat

SEQ ID NO: 4993831 - DNA, 16 bp, Homo sapiens
attgcagtttcatgta

SEQ ID NO: 4993832 - DNA, 18 bp, Homo sapiens
attggtgtaaatcttttt

SEQ ID NO: 4993833 - DNA, 18 bp, Homo sapiens
attgtatttagtgacaaa

SEQ ID NO: 4993834 - DNA, 17 bp, Homo sapiens
atttaaaaaattaaaaa

SEQ ID NO: 4993835 - DNA, 14 bp, Homo sapiens
atttaaattggtca

SEQ ID NO: 4993836 - DNA, 23 bp, Homo sapiens
atttaacatcactacaaaaagaa

SEQ ID NO: 4993837 - DNA, 13 bp, Homo sapiens
atttactgctcta

SEQ ID NO: 4993838 - DNA, 19 bp, Homo sapiens
atttactgctctagaaagt

SEQ ID NO: 4993839 - DNA, 13 bp, Homo sapiens
atttatatcttgt

SEQ ID NO: 4993840 - DNA, 15 bp, Homo sapiens
atttatatcttgtta

SEQ ID NO: 4993841 - DNA, 23 bp, Homo sapiens
atttatatcttgttattaatgtt

SEQ ID NO: 4993842 - DNA, 14 bp, Homo sapiens
atttatttctctgg

SEQ ID NO: 4993843 - DNA, 16 bp, Homo sapiens
atttcacttgaaatta

SEQ ID NO: 4993844 - DNA, 21 bp, Homo sapiens
atttcacttgaaattaaagct

SEQ ID NO: 4993845 - DNA, 17 bp, Homo sapiens
atttcagtattttccag

SEQ ID NO: 4993846 - DNA, 19 bp, Homo sapiens
atttctctggcaaactttt

SEQ ID NO: 4993847 - DNA, 18 bp, Homo sapiens
tctccctcccctgccatt

SEQ ID NO: 4993848 - DNA, 12 bp, Homo sapiens
tctctgctggcc

SEQ ID NO: 4993849 - DNA, 14 bp, Homo sapiens
tctctgctggccca

SEQ ID NO: 4993850 - DNA, 15 bp, Homo sapiens
tctctttgtgcagtg

SEQ ID NO: 4993851 - DNA, 22 bp, Homo sapiens
tctgaaatacaaccagaaacaa

SEQ ID NO: 4993852 - DNA, 18 bp, Homo sapiens
tctgagaacagtgcacaa

SEQ ID NO: 4993853 - DNA, 18 bp, Homo sapiens
tctgagtgagttttactc

SEQ ID NO: 4993854 - DNA, 22 bp, Homo sapiens
tctgattataccatgtgtgcta

SEQ ID NO: 4993855 - DNA, 20 bp, Homo sapiens
tctgcaagcacatctgcatt

SEQ ID NO: 4993856 - DNA, 17 bp, Homo sapiens
tctgcattttcacccca

SEQ ID NO: 4993857 - DNA, 12 bp, Homo sapiens
tctgctggccca

SEQ ID NO: 4993858 - DNA, 20 bp, Homo sapiens
tctggcaaacttttctttct

SEQ ID NO: 4993859 - DNA, 17 bp, Homo sapiens
tctgtataaaaatgtaa

SEQ ID NO: 4993860 - DNA, 22 bp, Homo sapiens
tctgtataaaaatgtaaattag

SEQ ID NO: 4993861 - DNA, 15 bp, Homo sapiens
tctgtgtttaaagtg

SEQ ID NO: 4993862 - DNA, 18 bp, Homo sapiens
tcttaaatcatttggtta

SEQ ID NO: 4993863 - DNA, 14 bp, Homo sapiens
tcttaactgtattt

SEQ ID NO: 4993864 - DNA, 16 bp, Homo sapiens
tcttaactgtatttca

SEQ ID NO: 4993865 - DNA, 17 bp, Homo sapiens
tcttaactgtatttcag

SEQ ID NO: 4993866 - DNA, 23 bp, Homo sapiens
tcttaactgtatttcagtatttt

SEQ ID NO: 4993867 - DNA, 14 bp, Homo sapiens
tcttacaagcttaa

SEQ ID NO: 4993868 - DNA, 19 bp, Homo sapiens
tcttacaagcttaaagctt

SEQ ID NO: 4993869 - DNA, 18 bp, Homo sapiens
tagttacgtataatgctt

SEQ ID NO: 4993870 - DNA, 12 bp, Homo sapiens
tagtttgacact

SEQ ID NO: 4993871 - DNA, 13 bp, Homo sapiens
tataaaaatgtaa

SEQ ID NO: 4993872 - DNA, 14 bp, Homo sapiens
tataaaataaacac

SEQ ID NO: 4993873 - DNA, 17 bp, Homo sapiens
tataagcgtatttagac

SEQ ID NO: 4993874 - DNA, 14 bp, Homo sapiens
tataatcagggaaa

SEQ ID NO: 4993875 - DNA, 15 bp, Homo sapiens
tataatcatgctcat

SEQ ID NO: 4993876 - DNA, 17 bp, Homo sapiens
ttggagcattaactaaa

SEQ ID NO: 4993877 - DNA, 24 bp, Homo sapiens
ttggagcattaactaaatgctcat

SEQ ID NO: 4993878 - DNA, 16 bp, Homo sapiens
ttggcataatttgtct

SEQ ID NO: 4993879 - DNA, 13 bp, Homo sapiens
ttggcttgctgtt

SEQ ID NO: 4993880 - DNA, 17 bp, Homo sapiens
ttggtaacgaatttaaa

SEQ ID NO: 4993881 - DNA, 15 bp, Homo sapiens
ttggttcagtttttt

SEQ ID NO: 4993882 - DNA, 12 bp, Homo sapiens
ttgtattgcttc

SEQ ID NO: 4993883 - DNA, 20 bp, Homo sapiens
ttgtcaagtctctgctggcc

SEQ ID NO: 4993884 - DNA, 18 bp, Homo sapiens
ttgtctttttctagactt

SEQ ID NO: 4993885 - DNA, 22 bp, Homo sapiens
ttgtgtattgagtcttaactgt

SEQ ID NO: 4993886 - DNA, 23 bp, Homo sapiens
ttgtgtttagctacctttttata

SEQ ID NO: 4993887 - DNA, 20 bp, Homo sapiens
ttgttcacctctgtacagac

SEQ ID NO: 4993888 - DNA, 14 bp, Homo sapiens
ttgttccctctccc

SEQ ID NO: 4993889 - DNA, 16 bp, Homo sapiens
ttgtttaaatgccaaa

SEQ ID NO: 4993890 - DNA, 22 bp, Homo sapiens
tttaaaaaattaaaaatgaaaa

SEQ ID NO: 4993891 - DNA, 18 bp, Homo sapiens
tttaaaagtcattattcc

SEQ ID NO: 4993892 - DNA, 20 bp, Homo sapiens
tttaaacaaaatttcacagt

SEQ ID NO: 4993893 - DNA, 13 bp, Homo sapiens
tttaaagtaaact

SEQ ID NO: 4993894 - DNA, 18 bp, Homo sapiens
tttaaagtaaacttgtgt

SEQ ID NO: 4993895 - DNA, 21 bp, Homo sapiens
gtttatatattgaaagttgct

SEQ ID NO: 4993896 - DNA, 15 bp, Homo sapiens
gtttcatgtatgtat

SEQ ID NO: 4993897 - DNA, 17 bp, Homo sapiens
gtttctcattaaactct

SEQ ID NO: 4993898 - DNA, 21 bp, Homo sapiens
gttttactcttaaatcatttg

SEQ ID NO: 4993899 - DNA, 23 bp, Homo sapiens
gttttatttatatcttgttatta

SEQ ID NO: 4993900 - DNA, 19 bp, Homo sapiens
gtttttaattaaaaacttt

SEQ ID NO: 4993901 - DNA, 23 bp, Homo sapiens
gttttttactttggtttagtctt

SEQ ID NO: 4993902 - DNA, 18 bp, Homo sapiens
taaaaaattaaaaatgaa

SEQ ID NO: 4993903 - DNA, 18 bp, Homo sapiens
taaaaatgtaaattagtt

SEQ ID NO: 4993904 - DNA, 15 bp, Homo sapiens
taaaacatcagaaac

SEQ ID NO: 4993905 - DNA, 14 bp, Homo sapiens
taaaactttgctgc

SEQ ID NO: 4993906 - DNA, 12 bp, Homo sapiens
taaaatgtagtt

SEQ ID NO: 4993907 - DNA, 17 bp, Homo sapiens
taaaatgtagttttaaa

SEQ ID NO: 4993908 - DNA, 17 bp, Homo sapiens
taaaattgcagtttcat

SEQ ID NO: 4993909 - DNA, 19 bp, Homo sapiens
taaaattgcagtttcatgt

SEQ ID NO: 4993910 - DNA, 20 bp, Homo sapiens
taaaattgcagtttcatgta

SEQ ID NO: 4993911 - DNA, 22 bp, Homo sapiens
taaaattgcagtttcatgtatg

SEQ ID NO: 4993912 - DNA, 23 bp, Homo sapiens
taaaattgcagtttcatgtatgt

SEQ ID NO: 4993913 - DNA, 18 bp, Homo sapiens
taaacaaaatttcacagt

SEQ ID NO: 4993914 - DNA, 13 bp, Homo sapiens
taaacttgtgtat

SEQ ID NO: 4993915 - DNA, 14 bp, Homo sapiens
taaacttgtgtatt

SEQ ID NO: 4993916 - DNA, 15 bp, Homo sapiens
taaagctttatcttt

SEQ ID NO: 4993917 - DNA, 18 bp, Homo sapiens
taaagctttatctttgtg

SEQ ID NO: 4993918 - DNA, 19 bp, Homo sapiens
taaagctttatctttgtgt

SEQ ID NO: 4993919 - DNA, 17 bp, Homo sapiens
taaataaacatctgatc

SEQ ID NO: 4993920 - DNA, 21 bp, Homo sapiens
taaatagaaagagttctatgg

SEQ ID NO: 4993921 - DNA, 18 bp, Homo sapiens
taaatgagggtttctgat

SEQ ID NO: 4993922 - DNA, 15 bp, Homo sapiens
taaatgagttactta

SEQ ID NO: 4993923 - DNA, 16 bp, Homo sapiens
taaattggagttttaa

SEQ ID NO: 4993924 - DNA, 20 bp, Homo sapiens
taacatcactacaaaaagaa

SEQ ID NO: 4993925 - DNA, 19 bp, Homo sapiens
taacctcttatcactaaga

SEQ ID NO: 4993926 - DNA, 18 bp, Homo sapiens
taacgaatttaaaatgta

SEQ ID NO: 4993927 - DNA, 19 bp, Homo sapiens
taacgaatttaaaatgtag

SEQ ID NO: 4993928 - DNA, 12 bp, Homo sapiens
taactaaatgct

SEQ ID NO: 4993929 - DNA, 16 bp, Homo sapiens
taactaaatgctcata

SEQ ID NO: 4993930 - DNA, 15 bp, Homo sapiens
taactacatctgcct

SEQ ID NO: 4993931 - DNA, 16 bp, Homo sapiens
taactgactctgttat

SEQ ID NO: 4993932 - DNA, 17 bp, Homo sapiens
taactgactctgttatt

SEQ ID NO: 4993933 - DNA, 11 bp, Homo sapiens
taagaaagaaa

SEQ ID NO: 4993934 - DNA, 14 bp, Homo sapiens
taagaaagaaagga

SEQ ID NO: 4993935 - DNA, 15 bp, Homo sapiens
taagaaagaaaggaa

SEQ ID NO: 4993936 - DNA, 16 bp, Homo sapiens
taagaaagaaaggaaa

SEQ ID NO: 4993937 - DNA, 20 bp, Homo sapiens
taagaaagaaaggaaagaag

SEQ ID NO: 4993938 - DNA, 22 bp, Homo sapiens
taagaaagaaaggaaagaagga

SEQ ID NO: 4993939 - DNA, 18 bp, Homo sapiens
taagggtggaaaaatgcc

SEQ ID NO: 4993940 - DNA, 20 bp, Homo sapiens
taagggttagtttacaatca

SEQ ID NO: 4993941 - DNA, 14 bp, Homo sapiens
taatctatattaaa

SEQ ID NO: 4993942 - DNA, 18 bp, Homo sapiens
taatctatattaaatgag

SEQ ID NO: 4993943 - DNA, 11 bp, Homo sapiens
taatctgcctg

SEQ ID NO: 4993944 - DNA, 18 bp, Homo sapiens
taatgatgtaacagtgca

SEQ ID NO: 4993945 - DNA, 13 bp, Homo sapiens
taatgtgtctgtg

SEQ ID NO: 4993946 - DNA, 14 bp, Homo sapiens
taatgtgtctgtgt

SEQ ID NO: 4993947 - DNA, 15 bp, Homo sapiens
taatgtgtctgtgtt

SEQ ID NO: 4993948 - DNA, 15 bp, Homo sapiens
taattaaaaacttta

SEQ ID NO: 4993949 - DNA, 17 bp, Homo sapiens
taattaaaaactttaaa

SEQ ID NO: 4993950 - DNA, 20 bp, Homo sapiens
taatttagagcgtttggtta

SEQ ID NO: 4993951 - DNA, 17 bp, Homo sapiens
taatttgtcttagttga

SEQ ID NO: 4993952 - DNA, 12 bp, Homo sapiens
tacaaaaagaag

SEQ ID NO: 4993953 - DNA, 14 bp, Homo sapiens
tacaaaaagaagag

SEQ ID NO: 4993954 - DNA, 17 bp, Homo sapiens
tacaagcttaaagcttg

SEQ ID NO: 4993955 - DNA, 20 bp, Homo sapiens
tacaagcttaaagcttgatt

SEQ ID NO: 4993956 - DNA, 18 bp, Homo sapiens
tacatcacagatttgcta

SEQ ID NO: 4993957 - DNA, 16 bp, Homo sapiens
tacatgttacaggctt

SEQ ID NO: 4993958 - DNA, 15 bp, Homo sapiens
tacattaaacaatga

SEQ ID NO: 4993959 - DNA, 15 bp, Homo sapiens
tacattattccaatg

SEQ ID NO: 4993960 - DNA, 17 bp, Homo sapiens
taccatgtgtgctaata

SEQ ID NO: 4993961 - DNA, 17 bp, Homo sapiens
tacctgccttttaagtt

SEQ ID NO: 4993962 - DNA, 13 bp, Homo sapiens
tactagactttga

SEQ ID NO: 4993963 - DNA, 21 bp, Homo sapiens
tactagactttgatttcctta

SEQ ID NO: 4993964 - DNA, 21 bp, Homo sapiens
tactcttaaatcatttggtta

SEQ ID NO: 4993965 - DNA, 14 bp, Homo sapiens
tactgcttctcttt

SEQ ID NO: 4993966 - DNA, 16 bp, Homo sapiens
tactgcttctctttgt

SEQ ID NO: 4993967 - DNA, 21 bp, Homo sapiens
tactgcttctctttgtgcagt

SEQ ID NO: 4993968 - DNA, 14 bp, Homo sapiens
tactgtagaaagga

SEQ ID NO: 4993969 - DNA, 16 bp, Homo sapiens
tactgtagaaaggaaa

SEQ ID NO: 4993970 - DNA, 22 bp, Homo sapiens
tacttagaatgccataaaattg

SEQ ID NO: 4993971 - DNA, 16 bp, Homo sapiens
tactttgtgtttagct

SEQ ID NO: 4993972 - DNA, 20 bp, Homo sapiens
tagaaaaaggatggaagaaa

SEQ ID NO: 4993973 - DNA, 21 bp, Homo sapiens
tagaaaaaggatggaagaaag

SEQ ID NO: 4993974 - DNA, 16 bp, Homo sapiens
tagaacttgaccccct

SEQ ID NO: 4993975 - DNA, 17 bp, Homo sapiens
tagaataaatggtttct

SEQ ID NO: 4993976 - DNA, 14 bp, Homo sapiens
tagactttgtatga

SEQ ID NO: 4993977 - DNA, 16 bp, Homo sapiens
tagagtaatgatgtaa

SEQ ID NO: 4993978 - DNA, 16 bp, Homo sapiens
tagatgctattaagaa

SEQ ID NO: 4993979 - DNA, 20 bp, Homo sapiens
tagatgctattaagaaggca

SEQ ID NO: 4993980 - DNA, 15 bp, Homo sapiens
tagattgtcttaatg

SEQ ID NO: 4993981 - DNA, 22 bp, Homo sapiens
tagcatttatttctctggcaaa

SEQ ID NO: 4993982 - DNA, 18 bp, Homo sapiens
tagcccatttctgttaac

SEQ ID NO: 4993983 - DNA, 18 bp, Homo sapiens
tagctactgtagaaagga

SEQ ID NO: 4993984 - DNA, 14 bp, Homo sapiens
taggattataatgc

SEQ ID NO: 4993985 - DNA, 20 bp, Homo sapiens
taggctttatttataaaata

SEQ ID NO: 4993986 - DNA, 17 bp, Homo sapiens
tagggttatatttggga

SEQ ID NO: 4993987 - DNA, 22 bp, Homo sapiens
taggttgttaccaagtatgaag

SEQ ID NO: 4993988 - DNA, 17 bp, Homo sapiens
tagtacatcatgtaaga

SEQ ID NO: 4993989 - DNA, 20 bp, Homo sapiens
tagtagaaagacatctgcct

SEQ ID NO: 4993990 - DNA, 21 bp, Homo sapiens
tagtagaaagacatctgcctg

SEQ ID NO: 4993991 - DNA, 22 bp, Homo sapiens
tagtagaaagacatctgcctgt

SEQ ID NO: 4993992 - DNA, 16 bp, Homo sapiens
tagtatagtagaaaga

SEQ ID NO: 4993993 - DNA, 15 bp, Homo sapiens
tagtctttttttcct

SEQ ID NO: 4993994 - DNA, 15 bp, Homo sapiens
tagttacgtataatg

SEQ ID NO: 4993995 - DNA, 21 bp, Homo sapiens
tagttttaaataaagtttgga

SEQ ID NO: 4993996 - DNA, 15 bp, Homo sapiens
tataaaaatgtaaat

SEQ ID NO: 4993997 - DNA, 22 bp, Homo sapiens
tataaatctggggaagaggttt

SEQ ID NO: 4993998 - DNA, 14 bp, Homo sapiens
tataaggtaatgta

SEQ ID NO: 4993999 - DNA, 15 bp, Homo sapiens
tataaggtaatgtag

SEQ ID NO: 4994000 - DNA, 18 bp, Homo sapiens
tataatcagggaaactaa

SEQ ID NO: 4994001 - DNA, 20 bp, Homo sapiens
tataatcagggaaactaatt

SEQ ID NO: 4994002 - DNA, 12 bp, Homo sapiens
tataatgctttc

SEQ ID NO: 4994003 - DNA, 14 bp, Homo sapiens
tataatgtgtctgt

SEQ ID NO: 4994004 - DNA, 18 bp, Homo sapiens
tataccatgtgtgctaat

SEQ ID NO: 4994005 - DNA, 19 bp, Homo sapiens
tatacctgccttttaagtt

SEQ ID NO: 4994006 - DNA, 20 bp, Homo sapiens
tatactttttttgttataga

SEQ ID NO: 4994007 - DNA, 13 bp, Homo sapiens
tatagaaaatctt

SEQ ID NO: 4994008 - DNA, 14 bp, Homo sapiens
tatagatggccaaa

SEQ ID NO: 4994009 - DNA, 14 bp, Homo sapiens
tatagattgtctta

SEQ ID NO: 4994010 - DNA, 13 bp, Homo sapiens
tgtctcagcctcc

SEQ ID NO: 4994011 - DNA, 14 bp, Homo sapiens
tgtctcagcctccc

SEQ ID NO: 4994012 - DNA, 21 bp, Homo sapiens
tgtgcctcccttttctcctct

SEQ ID NO: 4994013 - DNA, 20 bp, Homo sapiens
tgtggccatatatgctgtat

SEQ ID NO: 4994014 - DNA, 20 bp, Homo sapiens
tgtgtattgagtcttaactg

SEQ ID NO: 4994015 - DNA, 17 bp, Homo sapiens
tgtgtctatttctgaaa

SEQ ID NO: 4994016 - DNA, 15 bp, Homo sapiens
tgtgtctgtgttgct

SEQ ID NO: 4994017 - DNA, 18 bp, Homo sapiens
tgtgtgcaactaactgac

SEQ ID NO: 4994018 - DNA, 14 bp, Homo sapiens
tgtgttacattatt

SEQ ID NO: 4994019 - DNA, 15 bp, Homo sapiens
tgtgttacattattc

SEQ ID NO: 4994020 - DNA, 16 bp, Homo sapiens
tgttatagattgtctt

SEQ ID NO: 4994021 - DNA, 15 bp, Homo sapiens
tgttattaatgtttc

SEQ ID NO: 4994022 - DNA, 22 bp, Homo sapiens
tgttccccactgacagcctccc

SEQ ID NO: 4994023 - DNA, 15 bp, Homo sapiens
tgtttaaatgccaaa

SEQ ID NO: 4994024 - DNA, 16 bp, Homo sapiens
tgtttaaatgccaaaa

SEQ ID NO: 4994025 - DNA, 17 bp, Homo sapiens
tgtttaaatgccaaaat

SEQ ID NO: 4994026 - DNA, 12 bp, Homo sapiens
tgtttcttctcc

SEQ ID NO: 4994027 - DNA, 16 bp, Homo sapiens
tgttttcaaaaaaaca

SEQ ID NO: 4994028 - DNA, 14 bp, Homo sapiens
ttaaaaaattaaaa

SEQ ID NO: 4994029 - DNA, 18 bp, Homo sapiens
ttaaaaactttaaagata

SEQ ID NO: 4994030 - DNA, 15 bp, Homo sapiens
ttaaacaaaatttca

SEQ ID NO: 4994031 - DNA, 18 bp, Homo sapiens
ttaaagataagtctacat

SEQ ID NO: 4994032 - DNA, 15 bp, Homo sapiens
ttaaatgagttactt

SEQ ID NO: 4994033 - DNA, 13 bp, Homo sapiens
ttaaatgccaaaa

SEQ ID NO: 4994034 - DNA, 20 bp, Homo sapiens
ttaaatgccaaaatgtactt

SEQ ID NO: 4994035 - DNA, 21 bp, Homo sapiens
ttaacatcactacaaaaagaa

SEQ ID NO: 4994036 - DNA, 14 bp, Homo sapiens
ttaactaaatgctc

SEQ ID NO: 4994037 - DNA, 23 bp, Homo sapiens
ttaattatcttagtctatagaaa

SEQ ID NO: 4994038 - DNA, 16 bp, Homo sapiens
ttaattcagctttaga

SEQ ID NO: 4994039 - DNA, 21 bp, Homo sapiens
ttaatttagagcgtttggtta

SEQ ID NO: 4994040 - DNA, 16 bp, Homo sapiens
ttacaagcttaaagct

SEQ ID NO: 4994041 - DNA, 21 bp, Homo sapiens
ttacaataaaactttgctgcc

SEQ ID NO: 4994042 - DNA, 12 bp, Homo sapiens
ttacattattcc

SEQ ID NO: 4994043 - DNA, 14 bp, Homo sapiens
ttaccagtctgatt

SEQ ID NO: 4994044 - DNA, 15 bp, Homo sapiens
ttaccagtctgatta

SEQ ID NO: 4994045 - DNA, 20 bp, Homo sapiens
ttacctaaaagctacagaac

SEQ ID NO: 4994046 - DNA, 16 bp, Homo sapiens
ttacgtataatgcttt

SEQ ID NO: 4994047 - DNA, 14 bp, Homo sapiens
ttactagactttga

SEQ ID NO: 4994048 - DNA, 14 bp, Homo sapiens
ttacttagaatgcc

SEQ ID NO: 4994049 - DNA, 23 bp, Homo sapiens
ttacttagaatgccataaaattg

SEQ ID NO: 4994050 - DNA, 18 bp, Homo sapiens
ttactttggtttagtctt

SEQ ID NO: 4994051 - DNA, 22 bp, Homo sapiens
ttagactgtggccatatatgct

SEQ ID NO: 4994052 - DNA, 14 bp, Homo sapiens
ttaggttgttacca

SEQ ID NO: 4994053 - DNA, 15 bp, Homo sapiens
ttagtatagtagaaa

SEQ ID NO: 4994054 - DNA, 17 bp, Homo sapiens
ttataaaataaacacct

SEQ ID NO: 4994055 - DNA, 14 bp, Homo sapiens
ttataagcgtattt

SEQ ID NO: 4994056 - DNA, 21 bp, Homo sapiens
ttatatattgaaagttgcttt

SEQ ID NO: 4994057 - DNA, 14 bp, Homo sapiens
ttatgagatttact

SEQ ID NO: 4994058 - DNA, 14 bp, Homo sapiens
ttatgctcagggtc

SEQ ID NO: 4994059 - DNA, 13 bp, Homo sapiens
ttatgtgttacat

SEQ ID NO: 4994060 - DNA, 17 bp, Homo sapiens
ttattcagctagaattt

SEQ ID NO: 4994061 - DNA, 16 bp, Homo sapiens
ttatttatatcttgtt

SEQ ID NO: 4994062 - DNA, 14 bp, Homo sapiens
ttcaccccaccctt

SEQ ID NO: 4994063 - DNA, 14 bp, Homo sapiens
ttcaccctgggcag

SEQ ID NO: 4994064 - DNA, 18 bp, Homo sapiens
ttcacctctgtacagacc

SEQ ID NO: 4994065 - DNA, 16 bp, Homo sapiens
ttcagtattttccagc

SEQ ID NO: 4994066 - DNA, 22 bp, Homo sapiens
ttcatgccaccatggccagcca

SEQ ID NO: 4994067 - DNA, 17 bp, Homo sapiens
ttcatgtatgtatataa

SEQ ID NO: 4994068 - DNA, 16 bp, Homo sapiens
ttcatttctagagaaa

SEQ ID NO: 4994069 - DNA, 20 bp, Homo sapiens
ttccaaaataatctatatta

SEQ ID NO: 4994070 - DNA, 17 bp, Homo sapiens
ttccagccttatgtgtt

SEQ ID NO: 4994071 - DNA, 18 bp, Homo sapiens
ttccagccttatgtgtta

SEQ ID NO: 4994072 - DNA, 18 bp, Homo sapiens
ttcccaggtaatttaaat

SEQ ID NO: 4994073 - DNA, 19 bp, Homo sapiens
ttcccaggtaatttaaatt

SEQ ID NO: 4994074 - DNA, 20 bp, Homo sapiens
ttcccaggtaatttaaattg

SEQ ID NO: 4994075 - DNA, 17 bp, Homo sapiens
ttccccactgacagcct

SEQ ID NO: 4994076 - DNA, 18 bp, Homo sapiens
ttcccctccttctccctt

SEQ ID NO: 4994077 - DNA, 21 bp, Homo sapiens
ttcctgattaccagtctgatt

SEQ ID NO: 4994078 - DNA, 19 bp, Homo sapiens
ttctcctgccctttcccag

SEQ ID NO: 4994079 - DNA, 12 bp, Homo sapiens
ttctctttgtgc

SEQ ID NO: 4994080 - DNA, 14 bp, Homo sapiens
ttctgaaatacttt

SEQ ID NO: 4994081 - DNA, 20 bp, Homo sapiens
ttcttcccacttcttggatt

SEQ ID NO: 4994082 - DNA, 15 bp, Homo sapiens
ttcttggttgttaat

SEQ ID NO: 4994083 - DNA, 14 bp, Homo sapiens
ttcttttttaaagt

SEQ ID NO: 4994084 - DNA, 19 bp, Homo sapiens
ttcttttttaaagtaaact

SEQ ID NO: 4994085 - DNA, 16 bp, Homo sapiens
ttgaaaagtaaaaaat

SEQ ID NO: 4994086 - DNA, 19 bp, Homo sapiens
ttgaaaccaccttttatta

SEQ ID NO: 4994087 - DNA, 15 bp, Homo sapiens
ttgaaagttgctttt

SEQ ID NO: 4994088 - DNA, 19 bp, Homo sapiens
ttgagaataagaatttgag

SEQ ID NO: 4994089 - DNA, 23 bp, Homo sapiens
ttgagtcttaactgtatttcagt

SEQ ID NO: 4994090 - DNA, 17 bp, Homo sapiens
ttgatcagatgctgaat

SEQ ID NO: 4994091 - DNA, 21 bp, Homo sapiens
ttgatcccttctcctgccctt

SEQ ID NO: 4994092 - DNA, 16 bp, Homo sapiens
ttgatctttgtttaaa

SEQ ID NO: 4994093 - DNA, 19 bp, Homo sapiens
ttgatctttgtttaaatgc

SEQ ID NO: 4994094 - DNA, 21 bp, Homo sapiens
ttgatctttgtttaaatgcca

SEQ ID NO: 4994095 - DNA, 22 bp, Homo sapiens
ttgatctttgtttaaatgccaa

SEQ ID NO: 4994096 - DNA, 18 bp, Homo sapiens
ttgcccaggctggtctca

SEQ ID NO: 4994097 - DNA, 16 bp, Homo sapiens
ttgctgtgactagata

SEQ ID NO: 4994098 - DNA, 14 bp, Homo sapiens
ttgctgtttactcc

SEQ ID NO: 4994099 - DNA, 18 bp, Homo sapiens
ttgcttcaaattggtctg

SEQ ID NO: 4994100 - DNA, 23 bp, Homo sapiens
ttggagcattaactaaatgctca

SEQ ID NO: 4994101 - DNA, 13 bp, Homo sapiens
ttggatttgctgt

SEQ ID NO: 4994102 - DNA, 17 bp, Homo sapiens
ttggcataatttgtctt

SEQ ID NO: 4994103 - DNA, 17 bp, Homo sapiens
ttggcttactgcagcct

SEQ ID NO: 4994104 - DNA, 19 bp, Homo sapiens
ttggtcatggtagattttt

SEQ ID NO: 4994105 - DNA, 22 bp, Homo sapiens
ttgtagaataaatggtttctca

SEQ ID NO: 4994106 - DNA, 17 bp, Homo sapiens
ttgtatgaactctttaa

SEQ ID NO: 4994107 - DNA, 15 bp, Homo sapiens
ttgtattatcaatga

SEQ ID NO: 4994108 - DNA, 21 bp, Homo sapiens
ttgtgtaatctaagtatatgt

SEQ ID NO: 4994109 - DNA, 11 bp, Homo sapiens
ttgtgtattga

SEQ ID NO: 4994110 - DNA, 18 bp, Homo sapiens
ttgtgtttagctaccttt

SEQ ID NO: 4994111 - DNA, 14 bp, Homo sapiens
ttgttgcagtgatt

SEQ ID NO: 4994112 - DNA, 12 bp, Homo sapiens
tttaaaaaatta

SEQ ID NO: 4994113 - DNA, 20 bp, Homo sapiens
tttaaaaaattaaaaatgaa

SEQ ID NO: 4994114 - DNA, 16 bp, Homo sapiens
tttaaaatgtagtttt

SEQ ID NO: 4994115 - DNA, 21 bp, Homo sapiens
tttaaaatgtagttttaaata

SEQ ID NO: 4994116 - DNA, 16 bp, Homo sapiens
tttaaacaaaatttca

SEQ ID NO: 4994117 - DNA, 13 bp, Homo sapiens
tttaaataaagtt

SEQ ID NO: 4994118 - DNA, 16 bp, Homo sapiens
tttaaataaagtttgg

SEQ ID NO: 4994119 - DNA, 12 bp, Homo sapiens
tttaaatgccaa

SEQ ID NO: 4994120 - DNA, 17 bp, Homo sapiens
tttaactacatctgcct

SEQ ID NO: 4994121 - DNA, 14 bp, Homo sapiens
tttaagccttgaca

SEQ ID NO: 4994122 - DNA, 19 bp, Homo sapiens
tttaagccttgacacactg

SEQ ID NO: 4994123 - DNA, 20 bp, Homo sapiens
tttaagccttgacacactgt

SEQ ID NO: 4994124 - DNA, 15 bp, Homo sapiens
tttacattttagggt

SEQ ID NO: 4994125 - DNA, 20 bp, Homo sapiens
tttaaagtaaacttgtgtat

SEQ ID NO: 4994126 - DNA, 15 bp, Homo sapiens
tttaaataaagtttg

SEQ ID NO: 4994127 - DNA, 17 bp, Homo sapiens
tttaaataaagtttgga

SEQ ID NO: 4994128 - DNA, 18 bp, Homo sapiens
tttaaatgccaaaatgta

SEQ ID NO: 4994129 - DNA, 20 bp, Homo sapiens
tttaaattggtcatggtaga

SEQ ID NO: 4994130 - DNA, 21 bp, Homo sapiens
tttaagccttgacacactgtg

SEQ ID NO: 4994131 - DNA, 21 bp, Homo sapiens
tttaagtgacataattgtcca

SEQ ID NO: 4994132 - DNA, 13 bp, Homo sapiens
tttaagtttgaaa

SEQ ID NO: 4994133 - DNA, 19 bp, Homo sapiens
tttaattaaaaactttaaa

SEQ ID NO: 4994134 - DNA, 23 bp, Homo sapiens
tttaattaaaaactttaaagata

SEQ ID NO: 4994135 - DNA, 21 bp, Homo sapiens
tttacaatcagccacattcta

SEQ ID NO: 4994136 - DNA, 23 bp, Homo sapiens
tttagactgtggccatatatgct

SEQ ID NO: 4994137 - DNA, 18 bp, Homo sapiens
tttagggtgggtaagaaa

SEQ ID NO: 4994138 - DNA, 19 bp, Homo sapiens
tttagttacgtataatgct

SEQ ID NO: 4994139 - DNA, 21 bp, Homo sapiens
tttagttacgtataatgcttt

SEQ ID NO: 4994140 - DNA, 17 bp, Homo sapiens
tttataaatacataaat

SEQ ID NO: 4994141 - DNA, 14 bp, Homo sapiens
tttatatataaggt

SEQ ID NO: 4994142 - DNA, 21 bp, Homo sapiens
tttatatattgaaagttgctt

SEQ ID NO: 4994143 - DNA, 12 bp, Homo sapiens
tttatatttaaa

SEQ ID NO: 4994144 - DNA, 21 bp, Homo sapiens
tttatatttaaaaaattaaaa

SEQ ID NO: 4994145 - DNA, 15 bp, Homo sapiens
tttatctttgtgtaa

SEQ ID NO: 4994146 - DNA, 13 bp, Homo sapiens
tttcacagttctg

SEQ ID NO: 4994147 - DNA, 15 bp, Homo sapiens
tttcagtattttcca

SEQ ID NO: 4994148 - DNA, 20 bp, Homo sapiens
tttcatagatttgaaaaact

SEQ ID NO: 4994149 - DNA, 16 bp, Homo sapiens
tttcatctcttgtata

SEQ ID NO: 4994150 - DNA, 14 bp, Homo sapiens
tttcatgtatgtat

SEQ ID NO: 4994151 - DNA, 18 bp, Homo sapiens
tttccagagttgttgttt

SEQ ID NO: 4994152 - DNA, 23 bp, Homo sapiens
tttctgagtgagttttactctta

SEQ ID NO: 4994153 - DNA, 19 bp, Homo sapiens
tttctgatctgtactttgt

SEQ ID NO: 4994154 - DNA, 18 bp, Homo sapiens
tttcttttttaaagtaaa

SEQ ID NO: 4994155 - DNA, 17 bp, Homo sapiens
tttgagtatggctatct

SEQ ID NO: 4994156 - DNA, 10 bp, Homo sapiens
tttgctgcca

SEQ ID NO: 4994157 - DNA, 16 bp, Homo sapiens
tttgctgttactgctt

SEQ ID NO: 4994158 - DNA, 21 bp, Homo sapiens
tttggaagaagttttttactt

SEQ ID NO: 4994159 - DNA, 14 bp, Homo sapiens
tttggcttgctgtt

SEQ ID NO: 4994160 - DNA, 20 bp, Homo sapiens
tttggtaacgaatttaaaat

SEQ ID NO: 4994161 - DNA, 23 bp, Homo sapiens
tttggtaacgaatttaaaatgta

SEQ ID NO: 4994162 - DNA, 16 bp, Homo sapiens
tttgtattgcttcctg

SEQ ID NO: 4994163 - DNA, 13 bp, Homo sapiens
tttgttatagatt

SEQ ID NO: 4994164 - DNA, 20 bp, Homo sapiens
tttgttatagattgtcttaa

SEQ ID NO: 4994165 - DNA, 9 bp, Homo sapiens
ttttaaagt

SEQ ID NO: 4994166 - DNA, 14 bp, Homo sapiens
ttttaaagtaaact

SEQ ID NO: 4994167 - DNA, 17 bp, Homo sapiens
ttttaaagtaaacttgt

SEQ ID NO: 4994168 - DNA, 19 bp, Homo sapiens
ttttaaagtaaacttgtgt

SEQ ID NO: 4994169 - DNA, 15 bp, Homo sapiens
ttttaattaaaaact

SEQ ID NO: 4994170 - DNA, 12 bp, Homo sapiens
ttttaatttcca

SEQ ID NO: 4994171 - DNA, 16 bp, Homo sapiens
ttttaggttgttacca

SEQ ID NO: 4994172 - DNA, 22 bp, Homo sapiens
ttttcatagatttgaaaaactt

SEQ ID NO: 4994173 - DNA, 21 bp, Homo sapiens
ttttccagccttatgtgttac

SEQ ID NO: 4994174 - DNA, 17 bp, Homo sapiens
ttttccatctgtgtgca

SEQ ID NO: 4994175 - DNA, 20 bp, Homo sapiens
ttttccttcctttttattca

SEQ ID NO: 4994176 - DNA, 22 bp, Homo sapiens
ttttcttttttaaagtaaactt

SEQ ID NO: 4994177 - DNA, 22 bp, Homo sapiens
ttttggaagaagttttttactt

SEQ ID NO: 4994178 - DNA, 19 bp, Homo sapiens
tttttaaagtaaacttgtg

SEQ ID NO: 4994179 - DNA, 23 bp, Homo sapiens
ttttttaaacaaaatttcacagt

SEQ ID NO: 4994180 - DNA, 16 bp, Homo sapiens
cttctccaattctgaa

SEQ ID NO: 4994181 - DNA, 12 bp, Homo sapiens
cttctctttgtg

SEQ ID NO: 4994182 - DNA, 15 bp, Homo sapiens
cttctctttgtgcag

SEQ ID NO: 4994183 - DNA, 11 bp, Homo sapiens
cttctgaaata

SEQ ID NO: 4994184 - DNA, 12 bp, Homo sapiens
cttctgaaatac

SEQ ID NO: 4994185 - DNA, 18 bp, Homo sapiens
taaaacatcagaaactga

SEQ ID NO: 4994186 - DNA, 16 bp, Homo sapiens
taaaactttgctgcca

SEQ ID NO: 4994187 - DNA, 18 bp, Homo sapiens
tgagactgggtctcgctt

SEQ ID NO: 4994188 - DNA, 16 bp, Homo sapiens
tgagatttactgctct

SEQ ID NO: 4994189 - DNA, 14 bp, Homo sapiens
tgagtcttaactgt

SEQ ID NO: 4994190 - DNA, 18 bp, Homo sapiens
tgagtcttaactgtattt

SEQ ID NO: 4994191 - DNA, 23 bp, Homo sapiens
tgagtcttaactgtatttcagta

SEQ ID NO: 4994192 - DNA, 15 bp, Homo sapiens
tgagtgagttttact

SEQ ID NO: 4994193 - DNA, 15 bp, Homo sapiens
tgatatgataataat

SEQ ID NO: 4994194 - DNA, 17 bp, Homo sapiens
tgatcacatctaaagct

SEQ ID NO: 4994195 - DNA, 20 bp, Homo sapiens
tgatcacatctaaagcttta

SEQ ID NO: 4994196 - DNA, 18 bp, Homo sapiens
tgatcccttctcctgccc

SEQ ID NO: 4994197 - DNA, 13 bp, Homo sapiens
tgatctgtacttt

SEQ ID NO: 4994198 - DNA, 19 bp, Homo sapiens
tgatctgtataaaaatgta

SEQ ID NO: 4994199 - DNA, 15 bp, Homo sapiens
tgatctttgtttaaa

SEQ ID NO: 4994200 - DNA, 21 bp, Homo sapiens
tgatctttgtttaaatgccaa

SEQ ID NO: 4994201 - DNA, 16 bp, Homo sapiens
tgattaccagtctgat

SEQ ID NO: 4994202 - DNA, 15 bp, Homo sapiens
tgattataccatgtg

SEQ ID NO: 4994203 - DNA, 22 bp, Homo sapiens
tgattataccatgtgtgctaat

SEQ ID NO: 4994204 - DNA, 15 bp, Homo sapiens
tgattggttcagttt

SEQ ID NO: 4994205 - DNA, 17 bp, Homo sapiens
tgattggttcagttttt

SEQ ID NO: 4994206 - DNA, 17 bp, Homo sapiens
tgcaaactgctttattt

SEQ ID NO: 4994207 - DNA, 22 bp, Homo sapiens
tgcaaatattggttagtattta

SEQ ID NO: 4994208 - DNA, 22 bp, Homo sapiens
tgcaactaactgactctgttat

SEQ ID NO: 4994209 - DNA, 23 bp, Homo sapiens
tgcaactaactgactctgttatt

SEQ ID NO: 4994210 - DNA, 22 bp, Homo sapiens
tgcaagattttttttttaagtg

SEQ ID NO: 4994211 - DNA, 22 bp, Homo sapiens
tgcaagcatttttccatctgtg

SEQ ID NO: 4994212 - DNA, 23 bp, Homo sapiens
tgcaagcatttttccatctgtgt

SEQ ID NO: 4994213 - DNA, 19 bp, Homo sapiens
tgcactccagcctgggcga

SEQ ID NO: 4994214 - DNA, 15 bp, Homo sapiens
tgcagtgttagtatt

SEQ ID NO: 4994215 - DNA, 19 bp, Homo sapiens
tgccatgctttttggtgag

SEQ ID NO: 4994216 - DNA, 14 bp, Homo sapiens
tgcctcagcctccg

SEQ ID NO: 4994217 - DNA, 18 bp, Homo sapiens
tgcctccccggctcgagc

SEQ ID NO: 4994218 - DNA, 15 bp, Homo sapiens
tgcctggttttattt

SEQ ID NO: 4994219 - DNA, 19 bp, Homo sapiens
tgcctgtaatcccagcact

SEQ ID NO: 4994220 - DNA, 22 bp, Homo sapiens
tgcctgtaattaaactagttta

SEQ ID NO: 4994221 - DNA, 17 bp, Homo sapiens
tgccttttaagtttgaa

SEQ ID NO: 4994222 - DNA, 21 bp, Homo sapiens
tgctaatatactttttttgtt

SEQ ID NO: 4994223 - DNA, 22 bp, Homo sapiens
tgctcatacacagttaaataaa

SEQ ID NO: 4994224 - DNA, 23 bp, Homo sapiens
tgctcattaaactgattccagga

SEQ ID NO: 4994225 - DNA, 13 bp, Homo sapiens
tgctctagaaagt

SEQ ID NO: 4994226 - DNA, 21 bp, Homo sapiens
tgctgaaagtcctgctttcct

SEQ ID NO: 4994227 - DNA, 16 bp, Homo sapiens
tgctgaattgagaata

SEQ ID NO: 4994228 - DNA, 22 bp, Homo sapiens
tgctgacccaacagcctctgtg

SEQ ID NO: 4994229 - DNA, 23 bp, Homo sapiens
tgctgctaaagggagaaatgcca

SEQ ID NO: 4994230 - DNA, 13 bp, Homo sapiens
tgcttcctgatta

SEQ ID NO: 4994231 - DNA, 13 bp, Homo sapiens
tgcttctctttgt

SEQ ID NO: 4994232 - DNA, 17 bp, Homo sapiens
tgcttctctttgtgcag

SEQ ID NO: 4994233 - DNA, 14 bp, Homo sapiens
tggaaagaaggaaa

SEQ ID NO: 4994234 - DNA, 16 bp, Homo sapiens
tggaaagaaggaaaaa

SEQ ID NO: 4994235 - DNA, 20 bp, Homo sapiens
tggaaagaaggaaaaaagga

SEQ ID NO: 4994236 - DNA, 24 bp, Homo sapiens
tggaaagaaggaaaaaaggaggat

SEQ ID NO: 4994237 - DNA, 15 bp, Homo sapiens
tggaagaaagaagca

SEQ ID NO: 4994238 - DNA, 20 bp, Homo sapiens
tggagcattaactaaatgct

SEQ ID NO: 4994239 - DNA, 13 bp, Homo sapiens
tggatatagaaaa

SEQ ID NO: 4994240 - DNA, 17 bp, Homo sapiens
tggatatagaaaatctt

SEQ ID NO: 4994241 - DNA, 12 bp, Homo sapiens
tggatttgctgt

SEQ ID NO: 4994242 - DNA, 19 bp, Homo sapiens
tggcaactgtattaaagaa

SEQ ID NO: 4994243 - DNA, 21 bp, Homo sapiens
tggcaactgtattaaagaaaa

SEQ ID NO: 4994244 - DNA, 17 bp, Homo sapiens
tggcataatttgtctta

SEQ ID NO: 4994245 - DNA, 19 bp, Homo sapiens
tggcatcgcagcttcctgt

SEQ ID NO: 4994246 - DNA, 21 bp, Homo sapiens
tggccagccaacttttgcatg

SEQ ID NO: 4994247 - DNA, 18 bp, Homo sapiens
tggccatatatgctgtat

SEQ ID NO: 4994248 - DNA, 22 bp, Homo sapiens
tggcccagccaaaccctgtctg

SEQ ID NO: 4994249 - DNA, 18 bp, Homo sapiens
tggccttgaaaccacctt

SEQ ID NO: 4994250 - DNA, 20 bp, Homo sapiens
tggctatctatacctgcctt

SEQ ID NO: 4994251 - DNA, 14 bp, Homo sapiens
tggcttgctgttta

SEQ ID NO: 4994252 - DNA, 14 bp, Homo sapiens
tgggatctgcaaga

SEQ ID NO: 4994253 - DNA, 23 bp, Homo sapiens
tggggtctcacagtgttgcccag

SEQ ID NO: 4994254 - DNA, 13 bp, Homo sapiens
tgggtaagaaagc

SEQ ID NO: 4994255 - DNA, 17 bp, Homo sapiens
tggtaacgaatttaaaa

SEQ ID NO: 4994256 - DNA, 20 bp, Homo sapiens
tggtaacgaatttaaaatgt

SEQ ID NO: 4994257 - DNA, 21 bp, Homo sapiens
tggtaacgaatttaaaatgta

SEQ ID NO: 4994258 - DNA, 24 bp, Homo sapiens
tggtaacgaatttaaaatgtagtt

SEQ ID NO: 4994259 - DNA, 19 bp, Homo sapiens
tggtagggtataatgtgtc

SEQ ID NO: 4994260 - DNA, 22 bp, Homo sapiens
tggtagggtataatgtgtctgt

SEQ ID NO: 4994261 - DNA, 23 bp, Homo sapiens
tggtcctaatatatatgtagaga

SEQ ID NO: 4994262 - DNA, 14 bp, Homo sapiens
tggtttagtctttt

SEQ ID NO: 4994263 - DNA, 22 bp, Homo sapiens
tggtttcaggacccctgcattt

SEQ ID NO: 4994264 - DNA, 16 bp, Homo sapiens
tgtaaattagtttgac

SEQ ID NO: 4994265 - DNA, 18 bp, Homo sapiens
tgtaaattagtttgacac

SEQ ID NO: 4994266 - DNA, 15 bp, Homo sapiens
tgtaagatggcaact

SEQ ID NO: 4994267 - DNA, 18 bp, Homo sapiens
tgtaatctaagtatatgt

SEQ ID NO: 4994268 - DNA, 24 bp, Homo sapiens
tgtaatctaagtatatgtgagaaa

SEQ ID NO: 4994269 - DNA, 20 bp, Homo sapiens
tgtaatgtaggcacttttat

SEQ ID NO: 4994270 - DNA, 19 bp, Homo sapiens
tgtaattaaactagtttaa

SEQ ID NO: 4994271 - DNA, 15 bp, Homo sapiens
tgtactgaagaacag

SEQ ID NO: 4994272 - DNA, 16 bp, Homo sapiens
tgtactgtactgaaga

SEQ ID NO: 4994273 - DNA, 21 bp, Homo sapiens
tgtacttaaatgagttactta

SEQ ID NO: 4994274 - DNA, 17 bp, Homo sapiens
tgtaggcacttttattt

SEQ ID NO: 4994275 - DNA, 16 bp, Homo sapiens
tgtagttttaaataaa

SEQ ID NO: 4994276 - DNA, 17 bp, Homo sapiens
tgtagtttttaattaaa

SEQ ID NO: 4994277 - DNA, 14 bp, Homo sapiens
tgtataaaaatgta

SEQ ID NO: 4994278 - DNA, 16 bp, Homo sapiens
tgtattaaagaaaaat

SEQ ID NO: 4994279 - DNA, 15 bp, Homo sapiens
tgtattgagtcttaa

SEQ ID NO: 4994280 - DNA, 20 bp, Homo sapiens
tgtattgagtcttaactgta

SEQ ID NO: 4994281 - DNA, 22 bp, Homo sapiens
tgtattgagtcttaactgtatt

SEQ ID NO: 4994282 - DNA, 15 bp, Homo sapiens
tgtattgcttcctga

SEQ ID NO: 4994283 - DNA, 14 bp, Homo sapiens
tgtatttagtgaca

SEQ ID NO: 4994284 - DNA, 19 bp, Homo sapiens
tgtatttcagtattttcca

SEQ ID NO: 4994285 - DNA, 17 bp, Homo sapiens
tgtcaagtctctgctgg

SEQ ID NO: 4994286 - DNA, 13 bp, Homo sapiens
tgtctatttctga

SEQ ID NO: 4994287 - DNA, 14 bp, Homo sapiens
tgtctgtgttgctt

SEQ ID NO: 4994288 - DNA, 14 bp, Homo sapiens
ccatctctccctcc

SEQ ID NO: 4994289 - DNA, 17 bp, Homo sapiens
ccatctctccctcccct

SEQ ID NO: 4994290 - DNA, 12 bp, Homo sapiens
cccacaccctgg

SEQ ID NO: 4994291 - DNA, 16 bp, Homo sapiens
cccaggctggtctcaa

SEQ ID NO: 4994292 - DNA, 13 bp, Homo sapiens
cccatctctccct

SEQ ID NO: 4994293 - DNA, 15 bp, Homo sapiens
ccccaatccatgctt

SEQ ID NO: 4994294 - DNA, 11 bp, Homo sapiens
ccctctccctg

SEQ ID NO: 4994295 - DNA, 16 bp, Homo sapiens
ccctgggcagtgagtg

SEQ ID NO: 4994296 - DNA, 23 bp, Homo sapiens
cctccccggctcgagcagtcctg

SEQ ID NO: 4994297 - DNA, 14 bp, Homo sapiens
cctcccctgccatt

SEQ ID NO: 4994298 - DNA, 22 bp, Homo sapiens
atttaacatcactacaaaaaga

SEQ ID NO: 4994299 - DNA, 15 bp, Homo sapiens
atttaagccttgaca

SEQ ID NO: 4994300 - DNA, 18 bp, Homo sapiens
atttagagcgtttggtta

SEQ ID NO: 4994301 - DNA, 18 bp, Homo sapiens
atttatatcttgttatta

SEQ ID NO: 4994302 - DNA, 12 bp, Homo sapiens
atttatgagatt

SEQ ID NO: 4994303 - DNA, 17 bp, Homo sapiens
atttatgagatttactg

SEQ ID NO: 4994304 - DNA, 13 bp, Homo sapiens
atttatttctctg

SEQ ID NO: 4994305 - DNA, 12 bp, Homo sapiens
atttcacactgg

SEQ ID NO: 4994306 - DNA, 10 bp, Homo sapiens
atttcacagt

SEQ ID NO: 4994307 - DNA, 16 bp, Homo sapiens
atttcacagttctgta

SEQ ID NO: 4994308 - DNA, 17 bp, Homo sapiens
atttcacagttctgtaa

SEQ ID NO: 4994309 - DNA, 17 bp, Homo sapiens
atttcacttgaaattaa

SEQ ID NO: 4994310 - DNA, 17 bp, Homo sapiens
atttccaaaataatcta

SEQ ID NO: 4994311 - DNA, 22 bp, Homo sapiens
atttccaaaataatctatatta

SEQ ID NO: 4994312 - DNA, 21 bp, Homo sapiens
atttctccccatggtagttta

SEQ ID NO: 4994313 - DNA, 22 bp, Homo sapiens
atttctttgtagaataaatggt

SEQ ID NO: 4994314 - DNA, 14 bp, Homo sapiens
atttgatctttgtt

SEQ ID NO: 4994315 - DNA, 23 bp, Homo sapiens
atttggagcattaactaaatgct

SEQ ID NO: 4994316 - DNA, 19 bp, Homo sapiens
atttggcttgctgtttact

SEQ ID NO: 4994317 - DNA, 15 bp, Homo sapiens
attttcacagcacta

SEQ ID NO: 4994318 - DNA, 16 bp, Homo sapiens
attttcaccccaccct

SEQ ID NO: 4994319 - DNA, 18 bp, Homo sapiens
attttcatatatttaact

SEQ ID NO: 4994320 - DNA, 15 bp, Homo sapiens
attttcattgtgatt

SEQ ID NO: 4994321 - DNA, 15 bp, Homo sapiens
attttccagccttat

SEQ ID NO: 4994322 - DNA, 22 bp, Homo sapiens
attttggaagaagttttttact

SEQ ID NO: 4994323 - DNA, 15 bp, Homo sapiens
caaaaagaagagttt

SEQ ID NO: 4994324 - DNA, 20 bp, Homo sapiens
caaaataatctatattaaat

SEQ ID NO: 4994325 - DNA, 18 bp, Homo sapiens
caaaatgtacttaaatga

SEQ ID NO: 4994326 - DNA, 17 bp, Homo sapiens
caaacggtgcaacagaa

SEQ ID NO: 4994327 - DNA, 18 bp, Homo sapiens
caaacggtgcaacagaag

SEQ ID NO: 4994328 - DNA, 18 bp, Homo sapiens
caaactgctttattttcc

SEQ ID NO: 4994329 - DNA, 19 bp, Homo sapiens
caaaggaccgttttgtatt

SEQ ID NO: 4994330 - DNA, 15 bp, Homo sapiens
caacagcctctgtgg

SEQ ID NO: 4994331 - DNA, 18 bp, Homo sapiens
caactgtattaaagaaaa

SEQ ID NO: 4994332 - DNA, 19 bp, Homo sapiens
caactgtattaaagaaaaa

SEQ ID NO: 4994333 - DNA, 21 bp, Homo sapiens
caagattttttttttaagtga

SEQ ID NO: 4994334 - DNA, 17 bp, Homo sapiens
caagcttttaacttttt

SEQ ID NO: 4994335 - DNA, 23 bp, Homo sapiens
caagtctctgctggcccagccaa

SEQ ID NO: 4994336 - DNA, 15 bp, Homo sapiens
caataaaggaaatat

SEQ ID NO: 4994337 - DNA, 16 bp, Homo sapiens
caatccatgcttcact

SEQ ID NO: 4994338 - DNA, 20 bp, Homo sapiens
caatgatacccaacagttta

SEQ ID NO: 4994339 - DNA, 23 bp, Homo sapiens
caatgatacccaacagtttattt

SEQ ID NO: 4994340 - DNA, 19 bp, Homo sapiens
caatgatcacatctaaagc

SEQ ID NO: 4994341 - DNA, 19 bp, Homo sapiens
caatgcatatatgaaaaca

SEQ ID NO: 4994342 - DNA, 18 bp, Homo sapiens
caattctgaaatactttt

SEQ ID NO: 4994343 - DNA, 20 bp, Homo sapiens
caatttggagcattaactaa

SEQ ID NO: 4994344 - DNA, 14 bp, Homo sapiens
cacagtgttgccca

SEQ ID NO: 4994345 - DNA, 22 bp, Homo sapiens
cacagttaaataaatagaaaga

SEQ ID NO: 4994346 - DNA, 13 bp, Homo sapiens
cacatctgcattt

SEQ ID NO: 4994347 - DNA, 21 bp, Homo sapiens
cacatctgcattttcacccca

SEQ ID NO: 4994348 - DNA, 12 bp, Homo sapiens
caccatggccag

SEQ ID NO: 4994349 - DNA, 21 bp, Homo sapiens
caccctggaggatttcatctc

SEQ ID NO: 4994350 - DNA, 22 bp, Homo sapiens
caccctgggcagtgagtgccat

SEQ ID NO: 4994351 - DNA, 14 bp, Homo sapiens
cacccttcccctcc

SEQ ID NO: 4994352 - DNA, 22 bp, Homo sapiens
cacccttcccctccttctccct

SEQ ID NO: 4994353 - DNA, 15 bp, Homo sapiens
cacctattgaattac

SEQ ID NO: 4994354 - DNA, 13 bp, Homo sapiens
cactaagaaagaa

SEQ ID NO: 4994355 - DNA, 15 bp, Homo sapiens
cactaagaaagaaag

SEQ ID NO: 4994356 - DNA, 17 bp, Homo sapiens
cactaagaaagaaagga

SEQ ID NO: 4994357 - DNA, 13 bp, Homo sapiens
cactacaaaaaga

SEQ ID NO: 4994358 - DNA, 14 bp, Homo sapiens
cactacaaaaagaa

SEQ ID NO: 4994359 - DNA, 17 bp, Homo sapiens
cactacaaaaagaagag

SEQ ID NO: 4994360 - DNA, 17 bp, Homo sapiens
cactgacagcctcccac

SEQ ID NO: 4994361 - DNA, 20 bp, Homo sapiens
cactggcatcgcagcttcct

SEQ ID NO: 4994362 - DNA, 23 bp, Homo sapiens
cagaattggcataatttgtctta

SEQ ID NO: 4994363 - DNA, 21 bp, Homo sapiens
cagagttgttgtttgccaagc

SEQ ID NO: 4994364 - DNA, 18 bp, Homo sapiens
cagatggagcaaatgtcc

SEQ ID NO: 4994365 - DNA, 23 bp, Homo sapiens
cagatttaagccttgacacactg

SEQ ID NO: 4994366 - DNA, 16 bp, Homo sapiens
cagcctcccaccccca

SEQ ID NO: 4994367 - DNA, 15 bp, Homo sapiens
cagccttatgtgtta

SEQ ID NO: 4994368 - DNA, 18 bp, Homo sapiens
cagccttatgtgttacat

SEQ ID NO: 4994369 - DNA, 15 bp, Homo sapiens
cagctagaatttctg

SEQ ID NO: 4994370 - DNA, 12 bp, Homo sapiens
caggacccctgc

SEQ ID NO: 4994371 - DNA, 21 bp, Homo sapiens
caggagattggatttgctgtg

SEQ ID NO: 4994372 - DNA, 22 bp, Homo sapiens
cagggtaagctggtgttataat

SEQ ID NO: 4994373 - DNA, 22 bp, Homo sapiens
cagtgctattctgagtgaaaat

SEQ ID NO: 4994374 - DNA, 14 bp, Homo sapiens
cagtgttagtattc

SEQ ID NO: 4994375 - DNA, 17 bp, Homo sapiens
cagtgttagtattcacc

SEQ ID NO: 4994376 - DNA, 21 bp, Homo sapiens
cataaaattgcagtttcatgt

SEQ ID NO: 4994377 - DNA, 13 bp, Homo sapiens
cataaataaaaga

SEQ ID NO: 4994378 - DNA, 20 bp, Homo sapiens
catcactacaaaaagaagag

SEQ ID NO: 4994379 - DNA, 19 bp, Homo sapiens
catcatgattaagatgatt

SEQ ID NO: 4994380 - DNA, 15 bp, Homo sapiens
catcatgtaagatgg

SEQ ID NO: 4994381 - DNA, 14 bp, Homo sapiens
catcccacaccctg

SEQ ID NO: 4994382 - DNA, 14 bp, Homo sapiens
catcgcagcttcct

SEQ ID NO: 4994383 - DNA, 15 bp, Homo sapiens
catcgcagcttcctg

SEQ ID NO: 4994384 - DNA, 13 bp, Homo sapiens
catctaaagcttt

SEQ ID NO: 4994385 - DNA, 17 bp, Homo sapiens
catctaaagctttatct

SEQ ID NO: 4994386 - DNA, 20 bp, Homo sapiens
catctgatctgtataaaaat

SEQ ID NO: 4994387 - DNA, 23 bp, Homo sapiens
catctgatctgtataaaaatgta

SEQ ID NO: 4994388 - DNA, 16 bp, Homo sapiens
catctgcctgtaatta

SEQ ID NO: 4994389 - DNA, 20 bp, Homo sapiens
catgatcacaactgagatca

SEQ ID NO: 4994390 - DNA, 15 bp, Homo sapiens
catgcaaactgcttt

SEQ ID NO: 4994391 - DNA, 16 bp, Homo sapiens
catgcaaactgcttta

SEQ ID NO: 4994392 - DNA, 18 bp, Homo sapiens
catgggtggtaacaagag

SEQ ID NO: 4994393 - DNA, 15 bp, Homo sapiens
catggtagtttaaaa

SEQ ID NO: 4994394 - DNA, 16 bp, Homo sapiens
catggtagtttaaaac

SEQ ID NO: 4994395 - DNA, 17 bp, Homo sapiens
catggtagtttaaaaca

SEQ ID NO: 4994396 - DNA, 15 bp, Homo sapiens
catgtaagatggcaa

SEQ ID NO: 4994397 - DNA, 22 bp, Homo sapiens
catgtataggtatgatctgtgt

SEQ ID NO: 4994398 - DNA, 17 bp, Homo sapiens
cattaactaaatgctca

SEQ ID NO: 4994399 - DNA, 18 bp, Homo sapiens
cattgaaaacaaagacat

SEQ ID NO: 4994400 - DNA, 15 bp, Homo sapiens
catttggcttgctgt

SEQ ID NO: 4994401 - DNA, 16 bp, Homo sapiens
catttggcttgctgtt

SEQ ID NO: 4994402 - DNA, 22 bp, Homo sapiens
cattttcacagcactacttgct

SEQ ID NO: 4994403 - DNA, 23 bp, Homo sapiens
ccaaaataatctatattaaatga

SEQ ID NO: 4994404 - DNA, 15 bp, Homo sapiens
ccaacagcctctgtg

SEQ ID NO: 4994405 - DNA, 21 bp, Homo sapiens
ccaatgatacccaacagttta

SEQ ID NO: 4994406 - DNA, 16 bp, Homo sapiens
ccaccatggccagcca

SEQ ID NO: 4994407 - DNA, 17 bp, Homo sapiens
ccaccatggccagccaa

SEQ ID NO: 4994408 - DNA, 15 bp, Homo sapiens
ccacctgtctcagcc

SEQ ID NO: 4994409 - DNA, 18 bp, Homo sapiens
ccacctgtctcagcctcc

SEQ ID NO: 4994410 - DNA, 19 bp, Homo sapiens
ccacttcttgttccccact

SEQ ID NO: 4994411 - DNA, 15 bp, Homo sapiens
ccatatatgctgtat

SEQ ID NO: 4994412 - DNA, 19 bp, Homo sapiens
ccatatatgctgtatttct

SEQ ID NO: 4994413 - DNA, 16 bp, Homo sapiens
ccatcccacaccctgg

SEQ ID NO: 4994414 - DNA, 14 bp, Homo sapiens
ataatcatgctcat

SEQ ID NO: 4994415 - DNA, 15 bp, Homo sapiens
ataatctatattaaa

SEQ ID NO: 4994416 - DNA, 17 bp, Homo sapiens
ataatctatattaaatg

SEQ ID NO: 4994417 - DNA, 12 bp, Homo sapiens
ataatgctttct

SEQ ID NO: 4994418 - DNA, 15 bp, Homo sapiens
ataatgtgtctgtgt

SEQ ID NO: 4994419 - DNA, 17 bp, Homo sapiens
atacccaacagtttatt

SEQ ID NO: 4994420 - DNA, 14 bp, Homo sapiens
atactaaataaaca

SEQ ID NO: 4994421 - DNA, 15 bp, Homo sapiens
atactgaaaaataca

SEQ ID NO: 4994422 - DNA, 22 bp, Homo sapiens
atacttttgagtatggctatct

SEQ ID NO: 4994423 - DNA, 18 bp, Homo sapiens
atagaaaaaaagaaatta

SEQ ID NO: 4994424 - DNA, 23 bp, Homo sapiens
atagaaaaaggatggaagaaaga

SEQ ID NO: 4994425 - DNA, 15 bp, Homo sapiens
atagaaagagttcta

SEQ ID NO: 4994426 - DNA, 13 bp, Homo sapiens
atagaagaaagaa

SEQ ID NO: 4994427 - DNA, 23 bp, Homo sapiens
atagaagaaagaaaatggaaaga

SEQ ID NO: 4994428 - DNA, 18 bp, Homo sapiens
atagaggtgatgctgcta

SEQ ID NO: 4994429 - DNA, 14 bp, Homo sapiens
atagattgtcttaa

SEQ ID NO: 4994430 - DNA, 17 bp, Homo sapiens
atagtagaaagacatct

SEQ ID NO: 4994431 - DNA, 16 bp, Homo sapiens
atataatcatgctcat

SEQ ID NO: 4994432 - DNA, 13 bp, Homo sapiens
atatatgctgtat

SEQ ID NO: 4994433 - DNA, 18 bp, Homo sapiens
atatatgtagagaaagat

SEQ ID NO: 4994434 - DNA, 19 bp, Homo sapiens
atatattttgaaatattga

SEQ ID NO: 4994435 - DNA, 21 bp, Homo sapiens
atatcttgttattaatgtttc

SEQ ID NO: 4994436 - DNA, 14 bp, Homo sapiens
atatgaaaacaata

SEQ ID NO: 4994437 - DNA, 13 bp, Homo sapiens
atatgctgtattt

SEQ ID NO: 4994438 - DNA, 19 bp, Homo sapiens
atatgctgtatttctttgt

SEQ ID NO: 4994439 - DNA, 15 bp, Homo sapiens
atattcaaggcttta

SEQ ID NO: 4994440 - DNA, 23 bp, Homo sapiens
atatttagttacgtataatgctt

SEQ ID NO: 4994441 - DNA, 13 bp, Homo sapiens
atattttgaaata

SEQ ID NO: 4994442 - DNA, 16 bp, Homo sapiens
atcacatctaaagctt

SEQ ID NO: 4994443 - DNA, 11 bp, Homo sapiens
atcactaagaa

SEQ ID NO: 4994444 - DNA, 13 bp, Homo sapiens
atcactaagaaag

SEQ ID NO: 4994445 - DNA, 14 bp, Homo sapiens
atcactaagaaaga

SEQ ID NO: 4994446 - DNA, 21 bp, Homo sapiens
atcactaagaaagaaaggaaa

SEQ ID NO: 4994447 - DNA, 22 bp, Homo sapiens
atcactaagaaagaaaggaaag

SEQ ID NO: 4994448 - DNA, 18 bp, Homo sapiens
atcactacaaaaagaaga

SEQ ID NO: 4994449 - DNA, 21 bp, Homo sapiens
atcagatgctgaattgagaat

SEQ ID NO: 4994450 - DNA, 15 bp, Homo sapiens
atcagccacattcta

SEQ ID NO: 4994451 - DNA, 15 bp, Homo sapiens
atcatgctcatgtat

SEQ ID NO: 4994452 - DNA, 17 bp, Homo sapiens
atcatttggttaaatca

SEQ ID NO: 4994453 - DNA, 14 bp, Homo sapiens
atccatgcttcact

SEQ ID NO: 4994454 - DNA, 19 bp, Homo sapiens
atctaaagctttatctttg

SEQ ID NO: 4994455 - DNA, 14 bp, Homo sapiens
atctatacctgcct

SEQ ID NO: 4994456 - DNA, 15 bp, Homo sapiens
atctcctctgctcat

SEQ ID NO: 4994457 - DNA, 11 bp, Homo sapiens
atctctccctc

SEQ ID NO: 4994458 - DNA, 14 bp, Homo sapiens
atctctccctcccc

SEQ ID NO: 4994459 - DNA, 23 bp, Homo sapiens
atctctccctcccctgccatttt

SEQ ID NO: 4994460 - DNA, 23 bp, Homo sapiens
atctgcctcctgtgcctcccttt

SEQ ID NO: 4994461 - DNA, 18 bp, Homo sapiens
atctgtataaaaatgtaa

SEQ ID NO: 4994462 - DNA, 14 bp, Homo sapiens
atctgtgtaaaatc

SEQ ID NO: 4994463 - DNA, 16 bp, Homo sapiens
atctttgtttaaatgc

SEQ ID NO: 4994464 - DNA, 11 bp, Homo sapiens
atcttttacat

SEQ ID NO: 4994465 - DNA, 18 bp, Homo sapiens
atgaactcaatataaaaa

SEQ ID NO: 4994466 - DNA, 15 bp, Homo sapiens
atgaagtataaatct

SEQ ID NO: 4994467 - DNA, 13 bp, Homo sapiens
atgaatagaagaa

SEQ ID NO: 4994468 - DNA, 17 bp, Homo sapiens
atgaatagaagaaagaa

SEQ ID NO: 4994469 - DNA, 18 bp, Homo sapiens
atgaatagaagaaagaaa

SEQ ID NO: 4994470 - DNA, 19 bp, Homo sapiens
atgaatagaagaaagaaaa

SEQ ID NO: 4994471 - DNA, 23 bp, Homo sapiens
atgagcaaggaatacaagacaaa

SEQ ID NO: 4994472 - DNA, 14 bp, Homo sapiens
atgagttttaacaa

SEQ ID NO: 4994473 - DNA, 16 bp, Homo sapiens
atgatacccaacagtt

SEQ ID NO: 4994474 - DNA, 19 bp, Homo sapiens
atgatcacatctaaagctt

SEQ ID NO: 4994475 - DNA, 14 bp, Homo sapiens
atgattaatgcatt

SEQ ID NO: 4994476 - DNA, 16 bp, Homo sapiens
atgattggttcagttt

SEQ ID NO: 4994477 - DNA, 14 bp, Homo sapiens
atgcaaactgcttt

SEQ ID NO: 4994478 - DNA, 16 bp, Homo sapiens
atgcaaactgctttat

SEQ ID NO: 4994479 - DNA, 19 bp, Homo sapiens
atgccaggcggacaaagtt

SEQ ID NO: 4994480 - DNA, 14 bp, Homo sapiens
atgctattaagaag

SEQ ID NO: 4994481 - DNA, 17 bp, Homo sapiens
atgctgtatttctttgt

SEQ ID NO: 4994482 - DNA, 22 bp, Homo sapiens
atgctgtatttctttgtagaat

SEQ ID NO: 4994483 - DNA, 14 bp, Homo sapiens
atggaaagaaggaa

SEQ ID NO: 4994484 - DNA, 13 bp, Homo sapiens
atggaagaaagaa

SEQ ID NO: 4994485 - DNA, 15 bp, Homo sapiens
atggaagaaagaagc

SEQ ID NO: 4994486 - DNA, 15 bp, Homo sapiens
atggcttctctgttt

SEQ ID NO: 4994487 - DNA, 22 bp, Homo sapiens
atgggttataatcagggaaact

SEQ ID NO: 4994488 - DNA, 18 bp, Homo sapiens
atggtagggtataatgtg

SEQ ID NO: 4994489 - DNA, 13 bp, Homo sapiens
atgtaaattagtt

SEQ ID NO: 4994490 - DNA, 13 bp, Homo sapiens
atgtacatactga

SEQ ID NO: 4994491 - DNA, 16 bp, Homo sapiens
atgtattttgtgaata

SEQ ID NO: 4994492 - DNA, 12 bp, Homo sapiens
atgtgagaaatc

SEQ ID NO: 4994493 - DNA, 19 bp, Homo sapiens
atgtgtctgtgttgcttca

SEQ ID NO: 4994494 - DNA, 20 bp, Homo sapiens
atgtgtctgtgttgcttcaa

SEQ ID NO: 4994495 - DNA, 15 bp, Homo sapiens
attaaactgattcca

SEQ ID NO: 4994496 - DNA, 13 bp, Homo sapiens
attaaagaaaaat

SEQ ID NO: 4994497 - DNA, 22 bp, Homo sapiens
attacgttcttacaagcttaaa

SEQ ID NO: 4994498 - DNA, 18 bp, Homo sapiens
attataccatgtgtgcta

SEQ ID NO: 4994499 - DNA, 23 bp, Homo sapiens
attccgattagacctttatccag

SEQ ID NO: 4994500 - DNA, 17 bp, Homo sapiens
attctggacagatttaa

SEQ ID NO: 4994501 - DNA, 19 bp, Homo sapiens
attctgggttcatttgtga

SEQ ID NO: 4994502 - DNA, 17 bp, Homo sapiens
attctggttgtaaatct

SEQ ID NO: 4994503 - DNA, 13 bp, Homo sapiens
attcttggttgtt

SEQ ID NO: 4994504 - DNA, 15 bp, Homo sapiens
attgaaagttgcttt

SEQ ID NO: 4994505 - DNA, 17 bp, Homo sapiens
attgagaataagaattt

SEQ ID NO: 4994506 - DNA, 19 bp, Homo sapiens
attgagtcttaactgtatt

SEQ ID NO: 4994507 - DNA, 12 bp, Homo sapiens
attgcaaatatt

SEQ ID NO: 4994508 - DNA, 19 bp, Homo sapiens
attgcaccattttcaattt

SEQ ID NO: 4994509 - DNA, 13 bp, Homo sapiens
attgcagtttcat

SEQ ID NO: 4994510 - DNA, 18 bp, Homo sapiens
attgcctaaaatttctga

SEQ ID NO: 4994511 - DNA, 22 bp, Homo sapiens
attgcctaaaatttctgagaac

SEQ ID NO: 4994512 - DNA, 15 bp, Homo sapiens
attggttagtattta

SEQ ID NO: 4994513 - DNA, 14 bp, Homo sapiens
atttaaaatgtagt

SEQ ID NO: 4994514 - DNA, 17 bp, Homo sapiens
aactgctttattttccc

SEQ ID NO: 4994515 - DNA, 18 bp, Homo sapiens
aactgctttattttccct

SEQ ID NO: 4994516 - DNA, 18 bp, Homo sapiens
aactgtattaaagaaaaa

SEQ ID NO: 4994517 - DNA, 12 bp, Homo sapiens
aactgtatttca

SEQ ID NO: 4994518 - DNA, 14 bp, Homo sapiens
aactgtatttcagt

SEQ ID NO: 4994519 - DNA, 12 bp, Homo sapiens
aagaaagaaagg

SEQ ID NO: 4994520 - DNA, 14 bp, Homo sapiens
aagaaagaaaggaa

SEQ ID NO: 4994521 - DNA, 15 bp, Homo sapiens
aagaaagaaaggaaa

SEQ ID NO: 4994522 - DNA, 16 bp, Homo sapiens
aagaaagaaaggaaag

SEQ ID NO: 4994523 - DNA, 15 bp, Homo sapiens
aagaaaggaaagaag

SEQ ID NO: 4994524 - DNA, 16 bp, Homo sapiens
aagaaaggaaagaagg

SEQ ID NO: 4994525 - DNA, 13 bp, Homo sapiens
aagaaggaaaaaa

SEQ ID NO: 4994526 - DNA, 16 bp, Homo sapiens
aagaaggaaaaaagga

SEQ ID NO: 4994527 - DNA, 14 bp, Homo sapiens
aagaaggagatgaa

SEQ ID NO: 4994528 - DNA, 23 bp, Homo sapiens
aagaagttttttactttggttta

SEQ ID NO: 4994529 - DNA, 13 bp, Homo sapiens
aagacatctgcct

SEQ ID NO: 4994530 - DNA, 20 bp, Homo sapiens
aagacatctgcctgtaatta

SEQ ID NO: 4994531 - DNA, 12 bp, Homo sapiens
aagacttgtttt

SEQ ID NO: 4994532 - DNA, 17 bp, Homo sapiens
aagagatgaaataattt

SEQ ID NO: 4994533 - DNA, 20 bp, Homo sapiens
aagagttctatggagacttt

SEQ ID NO: 4994534 - DNA, 14 bp, Homo sapiens
aagagtttgtgact

SEQ ID NO: 4994535 - DNA, 23 bp, Homo sapiens
aagattttttttttaagtgacat

SEQ ID NO: 4994536 - DNA, 20 bp, Homo sapiens
aagcatttttccatctgtgt

SEQ ID NO: 4994537 - DNA, 13 bp, Homo sapiens
aagccttgacaca

SEQ ID NO: 4994538 - DNA, 22 bp, Homo sapiens
aagcttgatttgatctttgttt

SEQ ID NO: 4994539 - DNA, 16 bp, Homo sapiens
aagctttatctttgtg

SEQ ID NO: 4994540 - DNA, 14 bp, Homo sapiens
aagcttttaacttt

SEQ ID NO: 4994541 - DNA, 13 bp, Homo sapiens
aaggaaagaagga

SEQ ID NO: 4994542 - DNA, 15 bp, Homo sapiens
aaggaaagaaggaga

SEQ ID NO: 4994543 - DNA, 16 bp, Homo sapiens
aaggaaatagactttg

SEQ ID NO: 4994544 - DNA, 16 bp, Homo sapiens
aaggaaatctcacccc

SEQ ID NO: 4994545 - DNA, 14 bp, Homo sapiens
aaggatggaagaaa

SEQ ID NO: 4994546 - DNA, 21 bp, Homo sapiens
aaggctttaaaagtcattatt

SEQ ID NO: 4994547 - DNA, 15 bp, Homo sapiens
aagggagaaatgcca

SEQ ID NO: 4994548 - DNA, 21 bp, Homo sapiens
aaggtaatgtagggttatatt

SEQ ID NO: 4994549 - DNA, 14 bp, Homo sapiens
aagtaataaaaaga

SEQ ID NO: 4994550 - DNA, 21 bp, Homo sapiens
aagtaatctttaactgaactc

SEQ ID NO: 4994551 - DNA, 15 bp, Homo sapiens
aagtatatgtgagaa

SEQ ID NO: 4994552 - DNA, 19 bp, Homo sapiens
aagtattctacctaaatct

SEQ ID NO: 4994553 - DNA, 15 bp, Homo sapiens
aagtctctgctggcc

SEQ ID NO: 4994554 - DNA, 15 bp, Homo sapiens
aagtgaatttttaaa

SEQ ID NO: 4994555 - DNA, 23 bp, Homo sapiens
aagtgggttcgggaggtctctat

SEQ ID NO: 4994556 - DNA, 13 bp, Homo sapiens
aagttgaaaagta

SEQ ID NO: 4994557 - DNA, 16 bp, Homo sapiens
aagttgaaaagtaaaa

SEQ ID NO: 4994558 - DNA, 20 bp, Homo sapiens
actttgctgttactgcttct

SEQ ID NO: 4994559 - DNA, 22 bp, Homo sapiens
actttgctgttactgcttctct

SEQ ID NO: 4994560 - DNA, 18 bp, Homo sapiens
acttttaggttgttacca

SEQ ID NO: 4994561 - DNA, 22 bp, Homo sapiens
acttttattttcattgtgattt

SEQ ID NO: 4994562 - DNA, 16 bp, Homo sapiens
acttttctttcttttc

SEQ ID NO: 4994563 - DNA, 21 bp, Homo sapiens
acttttgagtatggctatcta

SEQ ID NO: 4994564 - DNA, 15 bp, Homo sapiens
actttttttgttata

SEQ ID NO: 4994565 - DNA, 16 bp, Homo sapiens
agaaaaaaagaaatta

SEQ ID NO: 4994566 - DNA, 19 bp, Homo sapiens
agaaaatggaaagaaggaa

SEQ ID NO: 4994567 - DNA, 23 bp, Homo sapiens
agaaagaaaatggaaagaaggaa

SEQ ID NO: 4994568 - DNA, 15 bp, Homo sapiens
agaaagaaaggaaag

SEQ ID NO: 4994569 - DNA, 20 bp, Homo sapiens
agaaagaaaggaaagaagga

SEQ ID NO: 4994570 - DNA, 16 bp, Homo sapiens
agaaagccaccttgtt

SEQ ID NO: 4994571 - DNA, 13 bp, Homo sapiens
agaaaggaaagaa

SEQ ID NO: 4994572 - DNA, 14 bp, Homo sapiens
agaaaggaaagaag

SEQ ID NO: 4994573 - DNA, 15 bp, Homo sapiens
agaaaggaaagaagg

SEQ ID NO: 4994574 - DNA, 16 bp, Homo sapiens
agaaaggaaagaagga

SEQ ID NO: 4994575 - DNA, 17 bp, Homo sapiens
agaaaggaaagaaggag

SEQ ID NO: 4994576 - DNA, 11 bp, Homo sapiens
agaaaggaaat

SEQ ID NO: 4994577 - DNA, 13 bp, Homo sapiens
agaaatcagaatt

SEQ ID NO: 4994578 - DNA, 19 bp, Homo sapiens
agaagaaagaaaatggaaa

SEQ ID NO: 4994579 - DNA, 21 bp, Homo sapiens
agaagagtttgtgactattct

SEQ ID NO: 4994580 - DNA, 17 bp, Homo sapiens
agaagcattgaaaacaa

SEQ ID NO: 4994581 - DNA, 20 bp, Homo sapiens
agaagcattgaaaacaaaga

SEQ ID NO: 4994582 - DNA, 21 bp, Homo sapiens
agaagcattgaaaacaaagac

SEQ ID NO: 4994583 - DNA, 10 bp, Homo sapiens
agaaggaaaa

SEQ ID NO: 4994584 - DNA, 22 bp, Homo sapiens
agaaggaaaaaaggaggataga

SEQ ID NO: 4994585 - DNA, 14 bp, Homo sapiens
agaaggagatgaat

SEQ ID NO: 4994586 - DNA, 22 bp, Homo sapiens
agaaggagatgaatagaagaaa

SEQ ID NO: 4994587 - DNA, 23 bp, Homo sapiens
agaaggagatgaatagaagaaag

SEQ ID NO: 4994588 - DNA, 17 bp, Homo sapiens
agaagttttttactttg

SEQ ID NO: 4994589 - DNA, 16 bp, Homo sapiens
agaataggattaatga

SEQ ID NO: 4994590 - DNA, 17 bp, Homo sapiens
agaattggcataatttg

SEQ ID NO: 4994591 - DNA, 16 bp, Homo sapiens
agacaaatgaaataat

SEQ ID NO: 4994592 - DNA, 13 bp, Homo sapiens
agacatctgcctg

SEQ ID NO: 4994593 - DNA, 14 bp, Homo sapiens
agacatctgcctgt

SEQ ID NO: 4994594 - DNA, 14 bp, Homo sapiens
agactcaaaacact

SEQ ID NO: 4994595 - DNA, 22 bp, Homo sapiens
agactttgctgttactgcttct

SEQ ID NO: 4994596 - DNA, 21 bp, Homo sapiens
agatacagatggagcaaatgt

SEQ ID NO: 4994597 - DNA, 12 bp, Homo sapiens
agatgaaataat

SEQ ID NO: 4994598 - DNA, 17 bp, Homo sapiens
agatgaatagaagaaag

SEQ ID NO: 4994599 - DNA, 22 bp, Homo sapiens
agatgaatagaagaaagaaaat

SEQ ID NO: 4994600 - DNA, 15 bp, Homo sapiens
agatgctattaagaa

SEQ ID NO: 4994601 - DNA, 16 bp, Homo sapiens
agattggatttgctgt

SEQ ID NO: 4994602 - DNA, 22 bp, Homo sapiens
agatttttttcatagatttgaa

SEQ ID NO: 4994603 - DNA, 22 bp, Homo sapiens
agattttttttttaagtgacat

SEQ ID NO: 4994604 - DNA, 16 bp, Homo sapiens
agcacatctgcatttt

SEQ ID NO: 4994605 - DNA, 19 bp, Homo sapiens
agcattaactaaatgctca

SEQ ID NO: 4994606 - DNA, 19 bp, Homo sapiens
agcattctaaatgaactca

SEQ ID NO: 4994607 - DNA, 15 bp, Homo sapiens
agcatttatttctct

SEQ ID NO: 4994608 - DNA, 16 bp, Homo sapiens
agcatttatttctctg

SEQ ID NO: 4994609 - DNA, 15 bp, Homo sapiens
agccaaaccctgtct

SEQ ID NO: 4994610 - DNA, 16 bp, Homo sapiens
agccttatgtgttaca

SEQ ID NO: 4994611 - DNA, 17 bp, Homo sapiens
agccttatgtgttacat

SEQ ID NO: 4994612 - DNA, 14 bp, Homo sapiens
agctaatctgcctg

SEQ ID NO: 4994613 - DNA, 22 bp, Homo sapiens
agctaatctgcctggttttatt

SEQ ID NO: 4994614 - DNA, 13 bp, Homo sapiens
agctagaatttct

SEQ ID NO: 4994615 - DNA, 13 bp, Homo sapiens
agctagtgccaaa

SEQ ID NO: 4994616 - DNA, 19 bp, Homo sapiens
agctagtgccaaataattg

SEQ ID NO: 4994617 - DNA, 21 bp, Homo sapiens
agctagtgccaaataattgat

SEQ ID NO: 4994618 - DNA, 17 bp, Homo sapiens
agctggtgttataatac

SEQ ID NO: 4994619 - DNA, 19 bp, Homo sapiens
agcttgatttgatctttgt

SEQ ID NO: 4994620 - DNA, 13 bp, Homo sapiens
agctttatctttg

SEQ ID NO: 4994621 - DNA, 15 bp, Homo sapiens
agctttatctttgtg

SEQ ID NO: 4994622 - DNA, 19 bp, Homo sapiens
aggaaaaaaggaggataga

SEQ ID NO: 4994623 - DNA, 13 bp, Homo sapiens
aggaaagaaggag

SEQ ID NO: 4994624 - DNA, 16 bp, Homo sapiens
aggagatgaatagaag

SEQ ID NO: 4994625 - DNA, 22 bp, Homo sapiens
aggagatgaatagaagaaagaa

SEQ ID NO: 4994626 - DNA, 20 bp, Homo sapiens
aggagattggatttgctgtg

SEQ ID NO: 4994627 - DNA, 16 bp, Homo sapiens
aggatagaaaaaggat

SEQ ID NO: 4994628 - DNA, 20 bp, Homo sapiens
aggcacttttattttcattg

SEQ ID NO: 4994629 - DNA, 23 bp, Homo sapiens
aggcgatccacctgtctcagcct

SEQ ID NO: 4994630 - DNA, 13 bp, Homo sapiens
aggctttaaaagt

SEQ ID NO: 4994631 - DNA, 20 bp, Homo sapiens
aggctttatttataaaataa

SEQ ID NO: 4994632 - DNA, 22 bp, Homo sapiens
aggttagatgctattaagaagg

SEQ ID NO: 4994633 - DNA, 18 bp, Homo sapiens
agtaaacttgtgtattga

SEQ ID NO: 4994634 - DNA, 15 bp, Homo sapiens
agtatagatggccaa

SEQ ID NO: 4994635 - DNA, 21 bp, Homo sapiens
agtcacccctgcctaaagata

SEQ ID NO: 4994636 - DNA, 13 bp, Homo sapiens
agtcctgctttcc

SEQ ID NO: 4994637 - DNA, 16 bp, Homo sapiens
agtcctgctttcctat

SEQ ID NO: 4994638 - DNA, 17 bp, Homo sapiens
agtctctgctggcccag

SEQ ID NO: 4994639 - DNA, 15 bp, Homo sapiens
agtctgattatacca

SEQ ID NO: 4994640 - DNA, 16 bp, Homo sapiens
agtcttaactgtattt

SEQ ID NO: 4994641 - DNA, 17 bp, Homo sapiens
agtgaatttatgagatt

SEQ ID NO: 4994642 - DNA, 18 bp, Homo sapiens
agtgaatttatgagattt

SEQ ID NO: 4994643 - DNA, 15 bp, Homo sapiens
agtgacaaaaataaa

SEQ ID NO: 4994644 - DNA, 20 bp, Homo sapiens
agtgagttttactcttaaat

SEQ ID NO: 4994645 - DNA, 22 bp, Homo sapiens
agttaaataaatagaaagagtt

SEQ ID NO: 4994646 - DNA, 17 bp, Homo sapiens
agttacgtataatgctt

SEQ ID NO: 4994647 - DNA, 21 bp, Homo sapiens
agttacgtataatgctttctg

SEQ ID NO: 4994648 - DNA, 17 bp, Homo sapiens
agttagagtgagtgctg

SEQ ID NO: 4994649 - DNA, 18 bp, Homo sapiens
agttataagcgtatttag

SEQ ID NO: 4994650 - DNA, 20 bp, Homo sapiens
agttgaaaagtaaaaaatat

SEQ ID NO: 4994651 - DNA, 17 bp, Homo sapiens
agttgatattcaaggct

SEQ ID NO: 4994652 - DNA, 20 bp, Homo sapiens
agttttactcttaaatcatt

SEQ ID NO: 4994653 - DNA, 20 bp, Homo sapiens
ataactaggattataatgct

SEQ ID NO: 4994654 - DNA, 18 bp, Homo sapiens
ataagcgtatttagactg

SEQ ID NO: 4994655 - DNA, 14 bp, Homo sapiens
ataaggtaatgtag

SEQ ID NO: 4994656 - DNA, 22 bp, Homo sapiens
ataatcagggaaactaattgta

SEQ ID NO: 4994657 - DNA, 18 bp, Homo sapiens
ataatcatgctcatgtat

SEQ ID NO: 4994658 - DNA, 13 bp, Homo sapiens
ataatctatatta

SEQ ID NO: 4994659 - DNA, 18 bp, Homo sapiens
ataatctcctctgctcat

SEQ ID NO: 4994660 - DNA, 15 bp, Homo sapiens
ataatgctttctgag

SEQ ID NO: 4994661 - DNA, 21 bp, Homo sapiens
atacaaatgggttaatcctga

SEQ ID NO: 4994662 - DNA, 16 bp, Homo sapiens
atacaaccagaaacaa

SEQ ID NO: 4994663 - DNA, 18 bp, Homo sapiens
atacacagttaaataaat

SEQ ID NO: 4994664 - DNA, 20 bp, Homo sapiens
atacacagttaaataaatag

SEQ ID NO: 4994665 - DNA, 18 bp, Homo sapiens
ataccagcttagatttta

SEQ ID NO: 4994666 - DNA, 13 bp, Homo sapiens
atacccaacagtt

SEQ ID NO: 4994667 - DNA, 17 bp, Homo sapiens
atactaaataaacatct

SEQ ID NO: 4994668 - DNA, 22 bp, Homo sapiens
atagaaaaaggatggaagaaag

SEQ ID NO: 4994669 - DNA, 14 bp, Homo sapiens
atagattgcaaata

SEQ ID NO: 4994670 - DNA, 21 bp, Homo sapiens
atagattgcaaatattggtta

SEQ ID NO: 4994671 - DNA, 16 bp, Homo sapiens
atagattgtcttaatg

SEQ ID NO: 4994672 - DNA, 15 bp, Homo sapiens
atttctttgtagaat

SEQ ID NO: 4994673 - DNA, 17 bp, Homo sapiens
atttctttgtagaataa

SEQ ID NO: 4994674 - DNA, 21 bp, Homo sapiens
atttgaggtctacattcttgg

SEQ ID NO: 4994675 - DNA, 17 bp, Homo sapiens
atttgatctttgtttaa

SEQ ID NO: 4994676 - DNA, 21 bp, Homo sapiens
atttgatctttgtttaaatgc

SEQ ID NO: 4994677 - DNA, 20 bp, Homo sapiens
atttggaatgtacatactga

SEQ ID NO: 4994678 - DNA, 21 bp, Homo sapiens
atttggagcattaactaaatg

SEQ ID NO: 4994679 - DNA, 14 bp, Homo sapiens
atttggttaaatca

SEQ ID NO: 4994680 - DNA, 22 bp, Homo sapiens
attttagttttgtattatcaat

SEQ ID NO: 4994681 - DNA, 15 bp, Homo sapiens
attttcaccccaccc

SEQ ID NO: 4994682 - DNA, 20 bp, Homo sapiens
attttcatatatttaacttt

SEQ ID NO: 4994683 - DNA, 17 bp, Homo sapiens
attttccagccttatgt

SEQ ID NO: 4994684 - DNA, 21 bp, Homo sapiens
attttccagccttatgtgtta

SEQ ID NO: 4994685 - DNA, 19 bp, Homo sapiens
attttgggttttgggtctt

SEQ ID NO: 4994686 - DNA, 21 bp, Homo sapiens
atttttttaaacaaaatttca

SEQ ID NO: 4994687 - DNA, 15 bp, Homo sapiens
caaaaaaacatttgt

SEQ ID NO: 4994688 - DNA, 11 bp, Homo sapiens
caaaaagaaga

SEQ ID NO: 4994689 - DNA, 23 bp, Homo sapiens
caaaacactcattcttttttcta

SEQ ID NO: 4994690 - DNA, 16 bp, Homo sapiens
caaaatgtacttaaat

SEQ ID NO: 4994691 - DNA, 14 bp, Homo sapiens
caaactgctttatt

SEQ ID NO: 4994692 - DNA, 23 bp, Homo sapiens
caaattccgattagacctttatc

SEQ ID NO: 4994693 - DNA, 15 bp, Homo sapiens
caactgtattaaaga

SEQ ID NO: 4994694 - DNA, 20 bp, Homo sapiens
caactgtattaaagaaaaat

SEQ ID NO: 4994695 - DNA, 14 bp, Homo sapiens
caagcatttttcca

SEQ ID NO: 4994696 - DNA, 14 bp, Homo sapiens
caagcttaaagctt

SEQ ID NO: 4994697 - DNA, 14 bp, Homo sapiens
caagcttttaactt

SEQ ID NO: 4994698 - DNA, 21 bp, Homo sapiens
caagtatgaagtataaatctg

SEQ ID NO: 4994699 - DNA, 13 bp, Homo sapiens
caatactaaataa

SEQ ID NO: 4994700 - DNA, 22 bp, Homo sapiens
caatgcatatatgaaaacaata

SEQ ID NO: 4994701 - DNA, 20 bp, Homo sapiens
caatgtgtctatttctgaaa

SEQ ID NO: 4994702 - DNA, 21 bp, Homo sapiens
caatgtgtctatttctgaaag

SEQ ID NO: 4994703 - DNA, 22 bp, Homo sapiens
caatttggagcattaactaaat

SEQ ID NO: 4994704 - DNA, 19 bp, Homo sapiens
cacaggttcatgccaccat

SEQ ID NO: 4994705 - DNA, 18 bp, Homo sapiens
cacatctaaagctttatc

SEQ ID NO: 4994706 - DNA, 22 bp, Homo sapiens
caccaagacttgttttatgctc

SEQ ID NO: 4994707 - DNA, 14 bp, Homo sapiens
caccccacccttcc

SEQ ID NO: 4994708 - DNA, 13 bp, Homo sapiens
cacccttcccctc

SEQ ID NO: 4994709 - DNA, 13 bp, Homo sapiens
cacctctgtacag

SEQ ID NO: 4994710 - DNA, 17 bp, Homo sapiens
cacctgtctcagcctcc

SEQ ID NO: 4994711 - DNA, 13 bp, Homo sapiens
caccttgttacaa

SEQ ID NO: 4994712 - DNA, 18 bp, Homo sapiens
cactaagaaagaaaggaa

SEQ ID NO: 4994713 - DNA, 17 bp, Homo sapiens
cactaagactgcttcta

SEQ ID NO: 4994714 - DNA, 16 bp, Homo sapiens
cactacaaaaagaaga

SEQ ID NO: 4994715 - DNA, 20 bp, Homo sapiens
cactcatgcaaactgcttta

SEQ ID NO: 4994716 - DNA, 22 bp, Homo sapiens
cactcatgcaaactgctttatt

SEQ ID NO: 4994717 - DNA, 15 bp, Homo sapiens
cactgacagcctccc

SEQ ID NO: 4994718 - DNA, 22 bp, Homo sapiens
cactggcatcgcagcttcctgt

SEQ ID NO: 4994719 - DNA, 18 bp, Homo sapiens
cacttcttgttccccact

SEQ ID NO: 4994720 - DNA, 13 bp, Homo sapiens
cagaaaatgaatg

SEQ ID NO: 4994721 - DNA, 15 bp, Homo sapiens
cagacaaatgaaata

SEQ ID NO: 4994722 - DNA, 20 bp, Homo sapiens
cagagcaagactccgtctca

SEQ ID NO: 4994723 - DNA, 20 bp, Homo sapiens
cagcaaactgcgggaatact

SEQ ID NO: 4994724 - DNA, 17 bp, Homo sapiens
cagcataactaggatta

SEQ ID NO: 4994725 - DNA, 15 bp, Homo sapiens
cagccaaaccctgtc

SEQ ID NO: 4994726 - DNA, 16 bp, Homo sapiens
cagccaaaccctgtct

SEQ ID NO: 4994727 - DNA, 17 bp, Homo sapiens
cagcctttgcctccccg

SEQ ID NO: 4994728 - DNA, 14 bp, Homo sapiens
cagcgccaagtggc

SEQ ID NO: 4994729 - DNA, 17 bp, Homo sapiens
cagcgccaagtggccac

SEQ ID NO: 4994730 - DNA, 15 bp, Homo sapiens
cagctagtgccaaat

SEQ ID NO: 4994731 - DNA, 19 bp, Homo sapiens
cagctgactccagtataat

SEQ ID NO: 4994732 - DNA, 20 bp, Homo sapiens
cagcttcctgtctgtttata

SEQ ID NO: 4994733 - DNA, 15 bp, Homo sapiens
caggagattggattt

SEQ ID NO: 4994734 - DNA, 22 bp, Homo sapiens
cagtataatctcctctgctcat

SEQ ID NO: 4994735 - DNA, 11 bp, Homo sapiens
cagtattttcc

SEQ ID NO: 4994736 - DNA, 12 bp, Homo sapiens
cagtattttcca

SEQ ID NO: 4994737 - DNA, 19 bp, Homo sapiens
cagtcctgcctcagcctcc

SEQ ID NO: 4994738 - DNA, 21 bp, Homo sapiens
cagtctgattataccatgtgt

SEQ ID NO: 4994739 - DNA, 13 bp, Homo sapiens
cagtgagtgccat

SEQ ID NO: 4994740 - DNA, 17 bp, Homo sapiens
cagtgctattctgagtg

SEQ ID NO: 4994741 - DNA, 19 bp, Homo sapiens
cagtgtcgggaattttccc

SEQ ID NO: 4994742 - DNA, 15 bp, Homo sapiens
cagtgtgtaaagtaa

SEQ ID NO: 4994743 - DNA, 15 bp, Homo sapiens
cagttataagcgtat

SEQ ID NO: 4994744 - DNA, 17 bp, Homo sapiens
cataaaattgcagtttc

SEQ ID NO: 4994745 - DNA, 13 bp, Homo sapiens
cataaagaaaaat

SEQ ID NO: 4994746 - DNA, 14 bp, Homo sapiens
cataaataaaagaa

SEQ ID NO: 4994747 - DNA, 23 bp, Homo sapiens
catactcaatgcatatatgaaaa

SEQ ID NO: 4994748 - DNA, 14 bp, Homo sapiens
catatatgctgtat

SEQ ID NO: 4994749 - DNA, 15 bp, Homo sapiens
catatatgctgtatt

SEQ ID NO: 4994750 - DNA, 16 bp, Homo sapiens
catatatgctgtattt

SEQ ID NO: 4994751 - DNA, 18 bp, Homo sapiens
catatatgctgtatttct

SEQ ID NO: 4994752 - DNA, 20 bp, Homo sapiens
catatatgctgtatttcttt

SEQ ID NO: 4994753 - DNA, 17 bp, Homo sapiens
catcactacaaaaagaa

SEQ ID NO: 4994754 - DNA, 23 bp, Homo sapiens
catcagaaactgaattctggaca

SEQ ID NO: 4994755 - DNA, 18 bp, Homo sapiens
catcgcagcttcctgtct

SEQ ID NO: 4994756 - DNA, 12 bp, Homo sapiens
catctaaagctt

SEQ ID NO: 4994757 - DNA, 18 bp, Homo sapiens
catctaaagctttatctt

SEQ ID NO: 4994758 - DNA, 19 bp, Homo sapiens
catctaaagctttatcttt

SEQ ID NO: 4994759 - DNA, 23 bp, Homo sapiens
catctaaagctttatctttgtgt

SEQ ID NO: 4994760 - DNA, 20 bp, Homo sapiens
catctgcattttcaccccac

SEQ ID NO: 4994761 - DNA, 17 bp, Homo sapiens
catgctcatgtatattt

SEQ ID NO: 4994762 - DNA, 20 bp, Homo sapiens
catgctcatgtatatttagt

SEQ ID NO: 4994763 - DNA, 18 bp, Homo sapiens
cattaaactctaaagatt

SEQ ID NO: 4994764 - DNA, 16 bp, Homo sapiens
cattcttggttgttaa

SEQ ID NO: 4994765 - DNA, 18 bp, Homo sapiens
cattcttggttgttaatt

SEQ ID NO: 4994766 - DNA, 19 bp, Homo sapiens
cattcttggttgttaattt

SEQ ID NO: 4994767 - DNA, 14 bp, Homo sapiens
catttggcttgctg

SEQ ID NO: 4994768 - DNA, 17 bp, Homo sapiens
catttggttaaatcatt

SEQ ID NO: 4994769 - DNA, 16 bp, Homo sapiens
cattttcaccccaccc

SEQ ID NO: 4994770 - DNA, 17 bp, Homo sapiens
cattttcaccccaccct

SEQ ID NO: 4994771 - DNA, 19 bp, Homo sapiens
catttttgctaattatcaa

SEQ ID NO: 4994772 - DNA, 19 bp, Homo sapiens
ccaaacggtgcaacagaag

SEQ ID NO: 4994773 - DNA, 16 bp, Homo sapiens
ccaacagcctctgtgg

SEQ ID NO: 4994774 - DNA, 16 bp, Homo sapiens
ccaacagtttattttt

SEQ ID NO: 4994775 - DNA, 17 bp, Homo sapiens
ccaagctaatctgcctg

SEQ ID NO: 4994776 - DNA, 17 bp, Homo sapiens
ccaccaagacttgtttt

SEQ ID NO: 4994777 - DNA, 20 bp, Homo sapiens
ccacctgtctcagcctccca

SEQ ID NO: 4994778 - DNA, 15 bp, Homo sapiens
ccactgacagcctcc

SEQ ID NO: 4994779 - DNA, 16 bp, Homo sapiens
ccactgacagcctccc

SEQ ID NO: 4994780 - DNA, 17 bp, Homo sapiens
ccactgacagcctccca

SEQ ID NO: 4994781 - DNA, 16 bp, Homo sapiens
ccactggcatcgcagc

SEQ ID NO: 4994782 - DNA, 22 bp, Homo sapiens
ccactggcatcgcagcttcctg

SEQ ID NO: 4994783 - DNA, 19 bp, Homo sapiens
ccagccaaaccctgtctga

SEQ ID NO: 4994784 - DNA, 14 bp, Homo sapiens
ccagccttatgtgt

SEQ ID NO: 4994785 - DNA, 22 bp, Homo sapiens
ccaggagattggatttgctgtg

SEQ ID NO: 4994786 - DNA, 17 bp, Homo sapiens
ccatagagtaatgatgt

SEQ ID NO: 4994787 - DNA, 23 bp, Homo sapiens
gcatatatgaaaacaatactaaa

SEQ ID NO: 4994788 - DNA, 16 bp, Homo sapiens
gcatttttccatctgt

SEQ ID NO: 4994789 - DNA, 19 bp, Homo sapiens
gcatttttccatctgtgtg

SEQ ID NO: 4994790 - DNA, 23 bp, Homo sapiens
gccaaaggaccgttttgtattgc

SEQ ID NO: 4994791 - DNA, 15 bp, Homo sapiens
gccaccacgtccagc

SEQ ID NO: 4994792 - DNA, 16 bp, Homo sapiens
gccaccacgtccagct

SEQ ID NO: 4994793 - DNA, 14 bp, Homo sapiens
gccaccttgttaca

SEQ ID NO: 4994794 - DNA, 14 bp, Homo sapiens
gccatatatgctgt

SEQ ID NO: 4994795 - DNA, 16 bp, Homo sapiens
gccatgctttttggtg

SEQ ID NO: 4994796 - DNA, 15 bp, Homo sapiens
gcctcccttttctcc

SEQ ID NO: 4994797 - DNA, 20 bp, Homo sapiens
gcctgtaatcccagcacttt

SEQ ID NO: 4994798 - DNA, 16 bp, Homo sapiens
gccttatgtgttacat

SEQ ID NO: 4994799 - DNA, 14 bp, Homo sapiens
gctaatctgcctgg

SEQ ID NO: 4994800 - DNA, 15 bp, Homo sapiens
gctacctttttatat

SEQ ID NO: 4994801 - DNA, 15 bp, Homo sapiens
gctactgtagaaagg

SEQ ID NO: 4994802 - DNA, 16 bp, Homo sapiens
gctactgtagaaagga

SEQ ID NO: 4994803 - DNA, 18 bp, Homo sapiens
gctactgtagaaaggaaa

SEQ ID NO: 4994804 - DNA, 15 bp, Homo sapiens
gctatcctgctgaaa

SEQ ID NO: 4994805 - DNA, 21 bp, Homo sapiens
gctcgagcagtcctgcctcag

SEQ ID NO: 4994806 - DNA, 16 bp, Homo sapiens
gctgaaagtcctgctt

SEQ ID NO: 4994807 - DNA, 14 bp, Homo sapiens
gctgaattgagaat

SEQ ID NO: 4994808 - DNA, 13 bp, Homo sapiens
gctggaagggtca

SEQ ID NO: 4994809 - DNA, 16 bp, Homo sapiens
gctggcatttgcacct

SEQ ID NO: 4994810 - DNA, 16 bp, Homo sapiens
gctggtttttagattt

SEQ ID NO: 4994811 - DNA, 13 bp, Homo sapiens
gctgtccctcact

SEQ ID NO: 4994812 - DNA, 20 bp, Homo sapiens
gctgtttactcccttctgta

SEQ ID NO: 4994813 - DNA, 21 bp, Homo sapiens
gcttcactcatgcaaactgct

SEQ ID NO: 4994814 - DNA, 24 bp, Homo sapiens
gcttcctgtctgtttatatattga

SEQ ID NO: 4994815 - DNA, 18 bp, Homo sapiens
gcttgatttgatctttgt

SEQ ID NO: 4994816 - DNA, 18 bp, Homo sapiens
gctttaaaagtcattatt

SEQ ID NO: 4994817 - DNA, 13 bp, Homo sapiens
gctttatctttgt

SEQ ID NO: 4994818 - DNA, 15 bp, Homo sapiens
gctttatctttgtgt

SEQ ID NO: 4994819 - DNA, 15 bp, Homo sapiens
ggaaaaaaggaggat

SEQ ID NO: 4994820 - DNA, 14 bp, Homo sapiens
ggaaagaaggaaaa

SEQ ID NO: 4994821 - DNA, 12 bp, Homo sapiens
ggaaagaaggag

SEQ ID NO: 4994822 - DNA, 11 bp, Homo sapiens
ggaaatagact

SEQ ID NO: 4994823 - DNA, 23 bp, Homo sapiens
ggacagatttaagccttgacaca

SEQ ID NO: 4994824 - DNA, 22 bp, Homo sapiens
ggagactttgctgttactgctt

SEQ ID NO: 4994825 - DNA, 19 bp, Homo sapiens
ggagatgaatagaagaaag

SEQ ID NO: 4994826 - DNA, 20 bp, Homo sapiens
ggagtgatagctactgtaga

SEQ ID NO: 4994827 - DNA, 16 bp, Homo sapiens
ggatatgattggttca

SEQ ID NO: 4994828 - DNA, 14 bp, Homo sapiens
ggatggaagaaaga

SEQ ID NO: 4994829 - DNA, 15 bp, Homo sapiens
ggattaatgatcata

SEQ ID NO: 4994830 - DNA, 17 bp, Homo sapiens
ggattttcatatattta

SEQ ID NO: 4994831 - DNA, 19 bp, Homo sapiens
ggcaactgtattaaagaaa

SEQ ID NO: 4994832 - DNA, 19 bp, Homo sapiens
ggcagtgagtgccatgctt

SEQ ID NO: 4994833 - DNA, 19 bp, Homo sapiens
ggccaaacggtgcaacaga

SEQ ID NO: 4994834 - DNA, 20 bp, Homo sapiens
ggccatatatgctgtatttc

SEQ ID NO: 4994835 - DNA, 22 bp, Homo sapiens
ggccatatatgctgtatttctt

SEQ ID NO: 4994836 - DNA, 24 bp, Homo sapiens
ggcccatatctgtgaaatgctggc

SEQ ID NO: 4994837 - DNA, 20 bp, Homo sapiens
ggcgacagagcaagactccg

SEQ ID NO: 4994838 - DNA, 22 bp, Homo sapiens
ggcgatccacctgtctcagcct

SEQ ID NO: 4994839 - DNA, 20 bp, Homo sapiens
ggcgggtggatcacgaggtc

SEQ ID NO: 4994840 - DNA, 21 bp, Homo sapiens
ggctcgagcagtcctgcctca

SEQ ID NO: 4994841 - DNA, 11 bp, Homo sapiens
ggcttgctgtt

SEQ ID NO: 4994842 - DNA, 21 bp, Homo sapiens
ggcttgctgtttactcccttc

SEQ ID NO: 4994843 - DNA, 19 bp, Homo sapiens
gggaaactaattgtattta

SEQ ID NO: 4994844 - DNA, 16 bp, Homo sapiens
gggcagtgagtgccat

SEQ ID NO: 4994845 - DNA, 14 bp, Homo sapiens
ggtaagtgaattta

SEQ ID NO: 4994846 - DNA, 20 bp, Homo sapiens
ggtaatttaaattggtcatg

SEQ ID NO: 4994847 - DNA, 17 bp, Homo sapiens
ggtataatgtgtctgtg

SEQ ID NO: 4994848 - DNA, 21 bp, Homo sapiens
ggtctcaaactcctgggctca

SEQ ID NO: 4994849 - DNA, 20 bp, Homo sapiens
ggtctcacagtgttgcccag

SEQ ID NO: 4994850 - DNA, 21 bp, Homo sapiens
ggtctcacagtgttgcccagg

SEQ ID NO: 4994851 - DNA, 19 bp, Homo sapiens
ggtgtactgtactgaagaa

SEQ ID NO: 4994852 - DNA, 22 bp, Homo sapiens
ggtttctgatctgtactttgtg

SEQ ID NO: 4994853 - DNA, 15 bp, Homo sapiens
gtaaattagtttgac

SEQ ID NO: 4994854 - DNA, 20 bp, Homo sapiens
gtaaattagtttgacactgc

SEQ ID NO: 4994855 - DNA, 18 bp, Homo sapiens
gtaatagtcttgcagaaa

SEQ ID NO: 4994856 - DNA, 18 bp, Homo sapiens
gtacatactgaaaaatac

SEQ ID NO: 4994857 - DNA, 19 bp, Homo sapiens
gtacatcatgtaagatggc

SEQ ID NO: 4994858 - DNA, 14 bp, Homo sapiens
gtactgaagaacag

SEQ ID NO: 4994859 - DNA, 14 bp, Homo sapiens
gtacttaaatgagt

SEQ ID NO: 4994860 - DNA, 18 bp, Homo sapiens
gtagaaagacatctgcct

SEQ ID NO: 4994861 - DNA, 12 bp, Homo sapiens
gtagaaaggaaa

SEQ ID NO: 4994862 - DNA, 13 bp, Homo sapiens
gtagaaaggaaat

SEQ ID NO: 4994863 - DNA, 16 bp, Homo sapiens
gtaggttagatgctat

SEQ ID NO: 4994864 - DNA, 15 bp, Homo sapiens
gtagttttaaataaa

SEQ ID NO: 4994865 - DNA, 14 bp, Homo sapiens
gtataatctcctct

SEQ ID NO: 4994866 - DNA, 19 bp, Homo sapiens
gtataatctcctctgctca

SEQ ID NO: 4994867 - DNA, 15 bp, Homo sapiens
gtataatgtgtctgt

SEQ ID NO: 4994868 - DNA, 15 bp, Homo sapiens
gtatatgagttttaa

SEQ ID NO: 4994869 - DNA, 23 bp, Homo sapiens
gtatgtatataatcatgctcatg

SEQ ID NO: 4994870 - DNA, 13 bp, Homo sapiens
gtattgcttcctg

SEQ ID NO: 4994871 - DNA, 22 bp, Homo sapiens
gtatttaactacatctgcctcg

SEQ ID NO: 4994872 - DNA, 21 bp, Homo sapiens
gtatttagtgacaaaaataaa

SEQ ID NO: 4994873 - DNA, 14 bp, Homo sapiens
gtatttcagtattt

SEQ ID NO: 4994874 - DNA, 21 bp, Homo sapiens
gtatttctttgtagaataaat

SEQ ID NO: 4994875 - DNA, 13 bp, Homo sapiens
gtattttccagcc

SEQ ID NO: 4994876 - DNA, 23 bp, Homo sapiens
gtattttccagccttatgtgtta

SEQ ID NO: 4994877 - DNA, 15 bp, Homo sapiens
gtcaagtaataaaaa

SEQ ID NO: 4994878 - DNA, 21 bp, Homo sapiens
gtcaagtctctgctggcccag

SEQ ID NO: 4994879 - DNA, 19 bp, Homo sapiens
gtcacccctgcctaaagat

SEQ ID NO: 4994880 - DNA, 20 bp, Homo sapiens
gtccagttataagcgtattt

SEQ ID NO: 4994881 - DNA, 15 bp, Homo sapiens
gtcccggggctccac

SEQ ID NO: 4994882 - DNA, 15 bp, Homo sapiens
gtcctgcctcagcct

SEQ ID NO: 4994883 - DNA, 14 bp, Homo sapiens
gtctacattaaaca

SEQ ID NO: 4994884 - DNA, 14 bp, Homo sapiens
gtctatttctgaaa

SEQ ID NO: 4994885 - DNA, 16 bp, Homo sapiens
gtctcaaactcctggg

SEQ ID NO: 4994886 - DNA, 19 bp, Homo sapiens
gtcttaactgtatttcagt

SEQ ID NO: 4994887 - DNA, 17 bp, Homo sapiens
gtgacaaaaataaaaag

SEQ ID NO: 4994888 - DNA, 13 bp, Homo sapiens
gtgactattctca

SEQ ID NO: 4994889 - DNA, 22 bp, Homo sapiens
gtgactattctcatctctgttt

SEQ ID NO: 4994890 - DNA, 22 bp, Homo sapiens
gtgatagctactgtagaaagga

SEQ ID NO: 4994891 - DNA, 20 bp, Homo sapiens
gtgcttgttccctctccctg

SEQ ID NO: 4994892 - DNA, 19 bp, Homo sapiens
gtgtaatctaagtatatgt

SEQ ID NO: 4994893 - DNA, 13 bp, Homo sapiens
gtgtactgtactg

SEQ ID NO: 4994894 - DNA, 20 bp, Homo sapiens
gtgtattgagtcttaactgt

SEQ ID NO: 4994895 - DNA, 16 bp, Homo sapiens
gtgttacattattcca

SEQ ID NO: 4994896 - DNA, 14 bp, Homo sapiens
gttaaatcatttgg

SEQ ID NO: 4994897 - DNA, 20 bp, Homo sapiens
gttcagtttttttttttcca

SEQ ID NO: 4994898 - DNA, 21 bp, Homo sapiens
gttcagtttttttttttccag

SEQ ID NO: 4994899 - DNA, 16 bp, Homo sapiens
gttcatgccaccatgg

SEQ ID NO: 4994900 - DNA, 13 bp, Homo sapiens
gttggcctgcact

SEQ ID NO: 4994901 - DNA, 13 bp, Homo sapiens
gttggtagtttct

SEQ ID NO: 4994902 - DNA, 19 bp, Homo sapiens
tcttagtatagtagaaaga

SEQ ID NO: 4994903 - DNA, 14 bp, Homo sapiens
tcttatcactaaga

SEQ ID NO: 4994904 - DNA, 15 bp, Homo sapiens
tcttatcactaagaa

SEQ ID NO: 4994905 - DNA, 19 bp, Homo sapiens
tcttatcactaagaaagaa

SEQ ID NO: 4994906 - DNA, 20 bp, Homo sapiens
tcttgttattaatgtttctt

SEQ ID NO: 4994907 - DNA, 19 bp, Homo sapiens
tctttgtagaataaatggt

SEQ ID NO: 4994908 - DNA, 13 bp, Homo sapiens
tctttgtgtaatc

SEQ ID NO: 4994909 - DNA, 15 bp, Homo sapiens
tctttgtgtaatcta

SEQ ID NO: 4994910 - DNA, 15 bp, Homo sapiens
tctttttctagactt

SEQ ID NO: 4994911 - DNA, 20 bp, Homo sapiens
tcttttttaaagtaaacttg

SEQ ID NO: 4994912 - DNA, 17 bp, Homo sapiens
tctttttttccttcctt

SEQ ID NO: 4994913 - DNA, 12 bp, Homo sapiens
tgaaaaatacag

SEQ ID NO: 4994914 - DNA, 13 bp, Homo sapiens
tgaaaacaaagac

SEQ ID NO: 4994915 - DNA, 22 bp, Homo sapiens
tgaaaatactttggataataaa

SEQ ID NO: 4994916 - DNA, 19 bp, Homo sapiens
tgaaaattacgttcttaca

SEQ ID NO: 4994917 - DNA, 21 bp, Homo sapiens
tgaaaatttcacttgaaatta

SEQ ID NO: 4994918 - DNA, 16 bp, Homo sapiens
tgaaagaataggatta

SEQ ID NO: 4994919 - DNA, 21 bp, Homo sapiens
tgaaaggctatcctgctgaaa

SEQ ID NO: 4994920 - DNA, 14 bp, Homo sapiens
tgaaagttgctttt

SEQ ID NO: 4994921 - DNA, 21 bp, Homo sapiens
tgaaataaaatgattaatgca

SEQ ID NO: 4994922 - DNA, 11 bp, Homo sapiens
tgaaataattt

SEQ ID NO: 4994923 - DNA, 20 bp, Homo sapiens
tgaaatacaaccagaaacaa

SEQ ID NO: 4994924 - DNA, 13 bp, Homo sapiens
tgaagtataaatc

SEQ ID NO: 4994925 - DNA, 14 bp, Homo sapiens
tgaagtataaatct

SEQ ID NO: 4994926 - DNA, 12 bp, Homo sapiens
tgaatagaagaa

SEQ ID NO: 4994927 - DNA, 15 bp, Homo sapiens
tgaatagaagaaaga

SEQ ID NO: 4994928 - DNA, 16 bp, Homo sapiens
tgaatagaagaaagaa

SEQ ID NO: 4994929 - DNA, 20 bp, Homo sapiens
tgaatagaagaaagaaaatg

SEQ ID NO: 4994930 - DNA, 13 bp, Homo sapiens
tgaattatatggc

SEQ ID NO: 4994931 - DNA, 16 bp, Homo sapiens
tgaatttttaaagaca

SEQ ID NO: 4994932 - DNA, 20 bp, Homo sapiens
tgacataattgtccagttat

SEQ ID NO: 4994933 - DNA, 16 bp, Homo sapiens
tgacccaacagcctct

SEQ ID NO: 4994934 - DNA, 17 bp, Homo sapiens
tgagaacagtgcacaag

SEQ ID NO: 4994935 - DNA, 22 bp, Homo sapiens
tgagattttggaagaagttttt

SEQ ID NO: 4994936 - DNA, 12 bp, Homo sapiens
tgagccaccacg

SEQ ID NO: 4994937 - DNA, 14 bp, Homo sapiens
tgagggtttctgat

SEQ ID NO: 4994938 - DNA, 21 bp, Homo sapiens
tgagtcttaactgtatttcag

SEQ ID NO: 4994939 - DNA, 14 bp, Homo sapiens
tgagtgccatgctt

SEQ ID NO: 4994940 - DNA, 17 bp, Homo sapiens
tgagtgccatgcttttt

SEQ ID NO: 4994941 - DNA, 17 bp, Homo sapiens
tgagttacttagaatgc

SEQ ID NO: 4994942 - DNA, 18 bp, Homo sapiens
tgagttacttagaatgcc

SEQ ID NO: 4994943 - DNA, 15 bp, Homo sapiens
tgatacccaacagtt

SEQ ID NO: 4994944 - DNA, 16 bp, Homo sapiens
tgatacccaacagttt

SEQ ID NO: 4994945 - DNA, 17 bp, Homo sapiens
tgatacccaacagttta

SEQ ID NO: 4994946 - DNA, 20 bp, Homo sapiens
tgatacccaacagtttattt

SEQ ID NO: 4994947 - DNA, 19 bp, Homo sapiens
tgatagctactgtagaaag

SEQ ID NO: 4994948 - DNA, 22 bp, Homo sapiens
tgatagctactgtagaaaggaa

SEQ ID NO: 4994949 - DNA, 22 bp, Homo sapiens
tgatattcaaggctttaaaagt

SEQ ID NO: 4994950 - DNA, 18 bp, Homo sapiens
tgatcacatctaaagctt

SEQ ID NO: 4994951 - DNA, 17 bp, Homo sapiens
tgatcctggaaatggtt

SEQ ID NO: 4994952 - DNA, 14 bp, Homo sapiens
tgatctgtactttg

SEQ ID NO: 4994953 - DNA, 17 bp, Homo sapiens
tgatctgtactttgtgt

SEQ ID NO: 4994954 - DNA, 20 bp, Homo sapiens
tgatctgtactttgtgttta

SEQ ID NO: 4994955 - DNA, 17 bp, Homo sapiens
tgatctttgtttaaatg

SEQ ID NO: 4994956 - DNA, 19 bp, Homo sapiens
tgatgacataagtcagcaa

SEQ ID NO: 4994957 - DNA, 19 bp, Homo sapiens
tgattataccatgtgtgct

SEQ ID NO: 4994958 - DNA, 16 bp, Homo sapiens
tgcaaactgctttatt

SEQ ID NO: 4994959 - DNA, 14 bp, Homo sapiens
tgcaccattttcaa

SEQ ID NO: 4994960 - DNA, 19 bp, Homo sapiens
tgcagtttcatgtatgtat

SEQ ID NO: 4994961 - DNA, 17 bp, Homo sapiens
tgcattttcaccccacc

SEQ ID NO: 4994962 - DNA, 19 bp, Homo sapiens
tgccaagctaatctgcctg

SEQ ID NO: 4994963 - DNA, 18 bp, Homo sapiens
tgccaccatggccagcca

SEQ ID NO: 4994964 - DNA, 23 bp, Homo sapiens
tgccaggcggacaaagttcagtg

SEQ ID NO: 4994965 - DNA, 17 bp, Homo sapiens
tgccataaaattgcagt

SEQ ID NO: 4994966 - DNA, 13 bp, Homo sapiens
tgccatgcttttt

SEQ ID NO: 4994967 - DNA, 15 bp, Homo sapiens
tgcctgtaattaaac

SEQ ID NO: 4994968 - DNA, 20 bp, Homo sapiens
tgctaaagggagaaatgcca

SEQ ID NO: 4994969 - DNA, 13 bp, Homo sapiens
tgctattaagaag

SEQ ID NO: 4994970 - DNA, 15 bp, Homo sapiens
tgctattctgagtga

SEQ ID NO: 4994971 - DNA, 19 bp, Homo sapiens
tgctcatacacagttaaat

SEQ ID NO: 4994972 - DNA, 19 bp, Homo sapiens
tgctcatgtatatttagtt

SEQ ID NO: 4994973 - DNA, 15 bp, Homo sapiens
tgctcattaaactga

SEQ ID NO: 4994974 - DNA, 18 bp, Homo sapiens
tgctgaaagtcctgcttt

SEQ ID NO: 4994975 - DNA, 23 bp, Homo sapiens
tgctgacccaacagcctctgtgg

SEQ ID NO: 4994976 - DNA, 13 bp, Homo sapiens
tgctgtatttctt

SEQ ID NO: 4994977 - DNA, 22 bp, Homo sapiens
tgctgttactgcttctctttgt

SEQ ID NO: 4994978 - DNA, 21 bp, Homo sapiens
tgctgtttactcccttctgta

SEQ ID NO: 4994979 - DNA, 20 bp, Homo sapiens
tgcttcactcatgcaaactg

SEQ ID NO: 4994980 - DNA, 22 bp, Homo sapiens
tgcttcactcatgcaaactgct

SEQ ID NO: 4994981 - DNA, 14 bp, Homo sapiens
tgcttctctttgtg

SEQ ID NO: 4994982 - DNA, 19 bp, Homo sapiens
tgcttgttccctctccctg

SEQ ID NO: 4994983 - DNA, 15 bp, Homo sapiens
tgctttattttccct

SEQ ID NO: 4994984 - DNA, 15 bp, Homo sapiens
tgctttcctatctag

SEQ ID NO: 4994985 - DNA, 13 bp, Homo sapiens
tgctttttggtga

SEQ ID NO: 4994986 - DNA, 15 bp, Homo sapiens
tggaaaaatgcccat

SEQ ID NO: 4994987 - DNA, 13 bp, Homo sapiens
tggaaagaaggaa

SEQ ID NO: 4994988 - DNA, 18 bp, Homo sapiens
tggaaagaaggaaaaaag

SEQ ID NO: 4994989 - DNA, 19 bp, Homo sapiens
tggaaagaaggaaaaaagg

SEQ ID NO: 4994990 - DNA, 21 bp, Homo sapiens
tggaaagaaggaaaaaaggag

SEQ ID NO: 4994991 - DNA, 11 bp, Homo sapiens
tggaagaaaga

SEQ ID NO: 4994992 - DNA, 13 bp, Homo sapiens
tggaagaaagaag

SEQ ID NO: 4994993 - DNA, 18 bp, Homo sapiens
tggaagaagttttttact

SEQ ID NO: 4994994 - DNA, 14 bp, Homo sapiens
tggagtgatagcta

SEQ ID NO: 4994995 - DNA, 20 bp, Homo sapiens
tggcaactgtattaaagaaa

SEQ ID NO: 4994996 - DNA, 23 bp, Homo sapiens
tggcaactgtattaaagaaaaat

SEQ ID NO: 4994997 - DNA, 22 bp, Homo sapiens
tggccaaaggaccgttttgtat

SEQ ID NO: 4994998 - DNA, 20 bp, Homo sapiens
tggccatatatgctgtattt

SEQ ID NO: 4994999 - DNA, 12 bp, Homo sapiens
tggcttgctgtt

SEQ ID NO: 4995000 - DNA, 17 bp, Homo sapiens
tggggaagaggttttat

SEQ ID NO: 4995001 - DNA, 20 bp, Homo sapiens
tggggaagaggttttattta

SEQ ID NO: 4995002 - DNA, 19 bp, Homo sapiens
tggggagtaggacatacca

SEQ ID NO: 4995003 - DNA, 22 bp, Homo sapiens
tgggtctcgctttgttgcccag

SEQ ID NO: 4995004 - DNA, 15 bp, Homo sapiens
tggtaacgaatttaa

SEQ ID NO: 4995005 - DNA, 19 bp, Homo sapiens
tggtaacgaatttaaaatg

SEQ ID NO: 4995006 - DNA, 22 bp, Homo sapiens
tggtcatggtagatttttttca

SEQ ID NO: 4995007 - DNA, 14 bp, Homo sapiens
tgtaaattagtttg

SEQ ID NO: 4995008 - DNA, 15 bp, Homo sapiens
tgtaaattagtttga

SEQ ID NO: 4995009 - DNA, 17 bp, Homo sapiens
tgtaaattagtttgaca

SEQ ID NO: 4995010 - DNA, 19 bp, Homo sapiens
tgtaaattagtttgacact

SEQ ID NO: 4995011 - DNA, 21 bp, Homo sapiens
tgtaaattagtttgacactgc

SEQ ID NO: 4995012 - DNA, 21 bp, Homo sapiens
tgtaatctaagtatatgtgag

SEQ ID NO: 4995013 - DNA, 21 bp, Homo sapiens
tgtaatgtaggcacttttatt

SEQ ID NO: 4995014 - DNA, 22 bp, Homo sapiens
tgtaattaaactagtttaaggg

SEQ ID NO: 4995015 - DNA, 14 bp, Homo sapiens
tgtacatttgaaaa

SEQ ID NO: 4995016 - DNA, 18 bp, Homo sapiens
tgtacatttgaaaatatt

SEQ ID NO: 4995017 - DNA, 21 bp, Homo sapiens
aaaaacttttaggttgttacc

SEQ ID NO: 4995018 - DNA, 22 bp, Homo sapiens
aaaaatgcccatttttgctaat

SEQ ID NO: 4995019 - DNA, 22 bp, Homo sapiens
aaaaatgtaaattagtttgaca

SEQ ID NO: 4995020 - DNA, 14 bp, Homo sapiens
aaaacaatactaaa

SEQ ID NO: 4995021 - DNA, 13 bp, Homo sapiens
aaaacatttgtca

SEQ ID NO: 4995022 - DNA, 15 bp, Homo sapiens
aaaagaagagtttgt

SEQ ID NO: 4995023 - DNA, 13 bp, Homo sapiens
aaaagagtgaatg

SEQ ID NO: 4995024 - DNA, 14 bp, Homo sapiens
aaaagcctttgaaa

SEQ ID NO: 4995025 - DNA, 23 bp, Homo sapiens
aaaaggatggaagaaagaagcat

SEQ ID NO: 4995026 - DNA, 13 bp, Homo sapiens
aaaagtaaaaaat

SEQ ID NO: 4995027 - DNA, 22 bp, Homo sapiens
aaaataatctatattaaatgag

SEQ ID NO: 4995028 - DNA, 13 bp, Homo sapiens
aaaatgaaaatta

SEQ ID NO: 4995029 - DNA, 14 bp, Homo sapiens
aaaatggaaagaag

SEQ ID NO: 4995030 - DNA, 16 bp, Homo sapiens
aaaatggaaagaagga

SEQ ID NO: 4995031 - DNA, 19 bp, Homo sapiens
aaaatgtaaattagtttga

SEQ ID NO: 4995032 - DNA, 23 bp, Homo sapiens
aaaatgtaaattagtttgacact

SEQ ID NO: 4995033 - DNA, 14 bp, Homo sapiens
aaaatgtacttaaa

SEQ ID NO: 4995034 - DNA, 20 bp, Homo sapiens
aaaatgtagttttaaataaa

SEQ ID NO: 4995035 - DNA, 14 bp, Homo sapiens
aaaatttcacagtt

SEQ ID NO: 4995036 - DNA, 13 bp, Homo sapiens
aaacaaagacatt

SEQ ID NO: 4995037 - DNA, 21 bp, Homo sapiens
aaacatgggtggtaacaagag

SEQ ID NO: 4995038 - DNA, 14 bp, Homo sapiens
aaacatttgtcagt

SEQ ID NO: 4995039 - DNA, 12 bp, Homo sapiens
aaactgctttat

SEQ ID NO: 4995040 - DNA, 13 bp, Homo sapiens
aaactgctttatt

SEQ ID NO: 4995041 - DNA, 14 bp, Homo sapiens
aaactgctttattt

SEQ ID NO: 4995042 - DNA, 19 bp, Homo sapiens
aaagaaaatggaaagaagg

SEQ ID NO: 4995043 - DNA, 23 bp, Homo sapiens
aaagaaaatggaaagaaggaaaa

SEQ ID NO: 4995044 - DNA, 13 bp, Homo sapiens
aaagaaaggaaag

SEQ ID NO: 4995045 - DNA, 15 bp, Homo sapiens
aaagaaaggaaagaa

SEQ ID NO: 4995046 - DNA, 14 bp, Homo sapiens
aaagaaattagcct

SEQ ID NO: 4995047 - DNA, 14 bp, Homo sapiens
aaagacattcttcc

SEQ ID NO: 4995048 - DNA, 21 bp, Homo sapiens
aaagcttgatttgatctttgt

SEQ ID NO: 4995049 - DNA, 22 bp, Homo sapiens
aaagcttgatttgatctttgtt

SEQ ID NO: 4995050 - DNA, 14 bp, Homo sapiens
aaagctttatcttt

SEQ ID NO: 4995051 - DNA, 15 bp, Homo sapiens
aaagctttatctttg

SEQ ID NO: 4995052 - DNA, 16 bp, Homo sapiens
aaagctttatctttgt

SEQ ID NO: 4995053 - DNA, 22 bp, Homo sapiens
aaaggaccgttttgtattgctt

SEQ ID NO: 4995054 - DNA, 15 bp, Homo sapiens
aaaggaggatagaaa

SEQ ID NO: 4995055 - DNA, 17 bp, Homo sapiens
aaaggaggatagaaaaa

SEQ ID NO: 4995056 - DNA, 15 bp, Homo sapiens
aaaggatggaagaaa

SEQ ID NO: 4995057 - DNA, 16 bp, Homo sapiens
aaagggagaaatgcca

SEQ ID NO: 4995058 - DNA, 12 bp, Homo sapiens
aaagtcattatt

SEQ ID NO: 4995059 - DNA, 15 bp, Homo sapiens
aaagtcattattcct

SEQ ID NO: 4995060 - DNA, 14 bp, Homo sapiens
aaagttgcttttat

SEQ ID NO: 4995061 - DNA, 23 bp, Homo sapiens
aaataattgatcagatgctgaat

SEQ ID NO: 4995062 - DNA, 20 bp, Homo sapiens
aaatcatttggcttgctgtt

SEQ ID NO: 4995063 - DNA, 21 bp, Homo sapiens
aaatcatttggcttgctgttt

SEQ ID NO: 4995064 - DNA, 18 bp, Homo sapiens
aaatctggggaagaggtt

SEQ ID NO: 4995065 - DNA, 23 bp, Homo sapiens
aaatcttagtatagtagaaagac

SEQ ID NO: 4995066 - DNA, 19 bp, Homo sapiens
aggctatcctgctgaaagt

SEQ ID NO: 4995067 - DNA, 15 bp, Homo sapiens
aggctcatctaactc

SEQ ID NO: 4995068 - DNA, 21 bp, Homo sapiens
aggctttatttataaaataaa

SEQ ID NO: 4995069 - DNA, 21 bp, Homo sapiens
agggaaaatggatatagaaaa

SEQ ID NO: 4995070 - DNA, 18 bp, Homo sapiens
agggtaggttagatgcta

SEQ ID NO: 4995071 - DNA, 17 bp, Homo sapiens
agggtggaaaaatgccc

SEQ ID NO: 4995072 - DNA, 21 bp, Homo sapiens
aggtaatgtagggttatattt

SEQ ID NO: 4995073 - DNA, 13 bp, Homo sapiens
aggtgatgctgct

SEQ ID NO: 4995074 - DNA, 23 bp, Homo sapiens
aggtgtactgtactgaagaacag

SEQ ID NO: 4995075 - DNA, 15 bp, Homo sapiens
agtaaacttgtgtat

SEQ ID NO: 4995076 - DNA, 22 bp, Homo sapiens
agtaatgatgtaacagtgcaag

SEQ ID NO: 4995077 - DNA, 17 bp, Homo sapiens
agtactccacaaacatg

SEQ ID NO: 4995078 - DNA, 16 bp, Homo sapiens
agtagaaagacatctg

SEQ ID NO: 4995079 - DNA, 20 bp, Homo sapiens
agtagaaagacatctgcctg

SEQ ID NO: 4995080 - DNA, 22 bp, Homo sapiens
agtagaaagacatctgcctgta

SEQ ID NO: 4995081 - DNA, 15 bp, Homo sapiens
agtataatctcctct

SEQ ID NO: 4995082 - DNA, 14 bp, Homo sapiens
agtatgtccttcag

SEQ ID NO: 4995083 - DNA, 18 bp, Homo sapiens
agtatgtccttcagctga

SEQ ID NO: 4995084 - DNA, 21 bp, Homo sapiens
agtattttccagccttatgtg

SEQ ID NO: 4995085 - DNA, 19 bp, Homo sapiens
agtcctgctttcctatcta

SEQ ID NO: 4995086 - DNA, 21 bp, Homo sapiens
agtctgattataccatgtgtg

SEQ ID NO: 4995087 - DNA, 22 bp, Homo sapiens
agtctgattataccatgtgtgc

SEQ ID NO: 4995088 - DNA, 21 bp, Homo sapiens
agtgaaaatttttttgatgtg

SEQ ID NO: 4995089 - DNA, 15 bp, Homo sapiens
agtgaatgtaatagt

SEQ ID NO: 4995090 - DNA, 18 bp, Homo sapiens
agtgaatttttaaagaca

SEQ ID NO: 4995091 - DNA, 18 bp, Homo sapiens
agtgagtgccatgctttt

SEQ ID NO: 4995092 - DNA, 22 bp, Homo sapiens
agtgagttttactcttaaatca

SEQ ID NO: 4995093 - DNA, 23 bp, Homo sapiens
agtgagttttactcttaaatcat

SEQ ID NO: 4995094 - DNA, 14 bp, Homo sapiens
agtgccaaataatt

SEQ ID NO: 4995095 - DNA, 18 bp, Homo sapiens
agtgccaacaattttcta

SEQ ID NO: 4995096 - DNA, 13 bp, Homo sapiens
agtgccatgcttt

SEQ ID NO: 4995097 - DNA, 17 bp, Homo sapiens
agtgtcgggaattttcc

SEQ ID NO: 4995098 - DNA, 22 bp, Homo sapiens
agttacgtataatgctttctga

SEQ ID NO: 4995099 - DNA, 15 bp, Homo sapiens
agttacttagaatgc

SEQ ID NO: 4995100 - DNA, 18 bp, Homo sapiens
agttctatggagactttg

SEQ ID NO: 4995101 - DNA, 17 bp, Homo sapiens
agttgaaaagtaaaaaa

SEQ ID NO: 4995102 - DNA, 19 bp, Homo sapiens
agttgtcaagtctctgctg

SEQ ID NO: 4995103 - DNA, 23 bp, Homo sapiens
agtttaagggtggaaaaatgccc

SEQ ID NO: 4995104 - DNA, 16 bp, Homo sapiens
agtttcatgtatgtat

SEQ ID NO: 4995105 - DNA, 13 bp, Homo sapiens
agttttaaataaa

SEQ ID NO: 4995106 - DNA, 19 bp, Homo sapiens
agttttactcttaaatcat

SEQ ID NO: 4995107 - DNA, 21 bp, Homo sapiens
agtttttaattaaaaacttta

SEQ ID NO: 4995108 - DNA, 20 bp, Homo sapiens
agtttttttttataattcag

SEQ ID NO: 4995109 - DNA, 16 bp, Homo sapiens
agtttttttttttcca

SEQ ID NO: 4995110 - DNA, 17 bp, Homo sapiens
ataaaactttgctgcca

SEQ ID NO: 4995111 - DNA, 17 bp, Homo sapiens
ataaataaaagaaaaat

SEQ ID NO: 4995112 - DNA, 13 bp, Homo sapiens
ataatgctttctg

SEQ ID NO: 4995113 - DNA, 20 bp, Homo sapiens
ataatgtgtctgtgttgctt

SEQ ID NO: 4995114 - DNA, 23 bp, Homo sapiens
ataatgtgtctgtgttgcttcaa

SEQ ID NO: 4995115 - DNA, 15 bp, Homo sapiens
ataatttgtcttagt

SEQ ID NO: 4995116 - DNA, 17 bp, Homo sapiens
atacacagttaaataaa

SEQ ID NO: 4995117 - DNA, 19 bp, Homo sapiens
atacagatggagcaaatgt

SEQ ID NO: 4995118 - DNA, 13 bp, Homo sapiens
atacctgcctttt

SEQ ID NO: 4995119 - DNA, 12 bp, Homo sapiens
atactaaataaa

SEQ ID NO: 4995120 - DNA, 13 bp, Homo sapiens
atagaaaaaggat

SEQ ID NO: 4995121 - DNA, 14 bp, Homo sapiens
atagaaaaaggatg

SEQ ID NO: 4995122 - DNA, 12 bp, Homo sapiens
atagaagaaaga

SEQ ID NO: 4995123 - DNA, 14 bp, Homo sapiens
atagaagaaagaaa

SEQ ID NO: 4995124 - DNA, 17 bp, Homo sapiens
atagagtaatgatgtaa

SEQ ID NO: 4995125 - DNA, 19 bp, Homo sapiens
atagatttgaaaaactttt

SEQ ID NO: 4995126 - DNA, 21 bp, Homo sapiens
atagctactgtagaaaggaaa

SEQ ID NO: 4995127 - DNA, 14 bp, Homo sapiens
ataggtatgatctg

SEQ ID NO: 4995128 - DNA, 23 bp, Homo sapiens
atagtagaaagacatctgcctgt

SEQ ID NO: 4995129 - DNA, 23 bp, Homo sapiens
atagtagtctgtgtttaaagtga

SEQ ID NO: 4995130 - DNA, 22 bp, Homo sapiens
atatatgctgtatttctttgta

SEQ ID NO: 4995131 - DNA, 15 bp, Homo sapiens
atatattttgaaata

SEQ ID NO: 4995132 - DNA, 20 bp, Homo sapiens
atatccatgagctgcactga

SEQ ID NO: 4995133 - DNA, 14 bp, Homo sapiens
atatgctgtatttc

SEQ ID NO: 4995134 - DNA, 21 bp, Homo sapiens
atatggcctgacaatatgaat

SEQ ID NO: 4995135 - DNA, 14 bp, Homo sapiens
atatgtgagaaatc

SEQ ID NO: 4995136 - DNA, 22 bp, Homo sapiens
atattaaatgagggtttctgat

SEQ ID NO: 4995137 - DNA, 17 bp, Homo sapiens
atatttaaaaaattaaa

SEQ ID NO: 4995138 - DNA, 22 bp, Homo sapiens
atatttagttacgtataatgct

SEQ ID NO: 4995139 - DNA, 20 bp, Homo sapiens
atcacatctaaagctttatc

SEQ ID NO: 4995140 - DNA, 15 bp, Homo sapiens
atcactaagaaagaa

SEQ ID NO: 4995141 - DNA, 18 bp, Homo sapiens
atcactaagaaagaaagg

SEQ ID NO: 4995142 - DNA, 20 bp, Homo sapiens
atcactaagaaagaaaggaa

SEQ ID NO: 4995143 - DNA, 16 bp, Homo sapiens
atcactacaaaaagaa

SEQ ID NO: 4995144 - DNA, 19 bp, Homo sapiens
atcactacaaaaagaagag

SEQ ID NO: 4995145 - DNA, 20 bp, Homo sapiens
atcactacaaaaagaagagt

SEQ ID NO: 4995146 - DNA, 17 bp, Homo sapiens
atcatgatcacaactga

SEQ ID NO: 4995147 - DNA, 15 bp, Homo sapiens
atcatgtacatttga

SEQ ID NO: 4995148 - DNA, 18 bp, Homo sapiens
atccacctgtctcagcct

SEQ ID NO: 4995149 - DNA, 18 bp, Homo sapiens
atccagctagtgccaaat

SEQ ID NO: 4995150 - DNA, 13 bp, Homo sapiens
atccatgcttcac

SEQ ID NO: 4995151 - DNA, 14 bp, Homo sapiens
atcccacaccctgg

SEQ ID NO: 4995152 - DNA, 17 bp, Homo sapiens
atcccttctcctgccct

SEQ ID NO: 4995153 - DNA, 21 bp, Homo sapiens
atctaaagctttatctttgtg

SEQ ID NO: 4995154 - DNA, 13 bp, Homo sapiens
atctaataatgaa

SEQ ID NO: 4995155 - DNA, 16 bp, Homo sapiens
atctcaccccatccca

SEQ ID NO: 4995156 - DNA, 22 bp, Homo sapiens
atctcaccccatcccacaccct

SEQ ID NO: 4995157 - DNA, 21 bp, Homo sapiens
atctcctctgctcattaaact

SEQ ID NO: 4995158 - DNA, 19 bp, Homo sapiens
atctcttattttacaataa

SEQ ID NO: 4995159 - DNA, 19 bp, Homo sapiens
atctgcattttcaccccac

SEQ ID NO: 4995160 - DNA, 22 bp, Homo sapiens
atctgcattttcaccccaccct

SEQ ID NO: 4995161 - DNA, 11 bp, Homo sapiens
atctgtacttt

SEQ ID NO: 4995162 - DNA, 18 bp, Homo sapiens
atctgtactttgtgttta

SEQ ID NO: 4995163 - DNA, 17 bp, Homo sapiens
atctgtatgttaggtga

SEQ ID NO: 4995164 - DNA, 15 bp, Homo sapiens
atgaatacctttgtt

SEQ ID NO: 4995165 - DNA, 16 bp, Homo sapiens
atgaatagaagaaaga

SEQ ID NO: 4995166 - DNA, 19 bp, Homo sapiens
atgagattttggaagaagt

SEQ ID NO: 4995167 - DNA, 15 bp, Homo sapiens
atgcaaactgcttta

SEQ ID NO: 4995168 - DNA, 21 bp, Homo sapiens
atgcaaactgctttattttcc

SEQ ID NO: 4995169 - DNA, 22 bp, Homo sapiens
atgcaaactgctttattttccc

SEQ ID NO: 4995170 - DNA, 17 bp, Homo sapiens
atgcattgactatttct

SEQ ID NO: 4995171 - DNA, 13 bp, Homo sapiens
atgctcatgtata

SEQ ID NO: 4995172 - DNA, 20 bp, Homo sapiens
atgctgcctcattttcacag

SEQ ID NO: 4995173 - DNA, 14 bp, Homo sapiens
atgctgtatttctt

SEQ ID NO: 4995174 - DNA, 13 bp, Homo sapiens
atggaaagaagga

SEQ ID NO: 4995175 - DNA, 16 bp, Homo sapiens
atggaagaaagaagca

SEQ ID NO: 4995176 - DNA, 17 bp, Homo sapiens
atggaagaaagaagcat

SEQ ID NO: 4995177 - DNA, 17 bp, Homo sapiens
atggagactttgctgtt

SEQ ID NO: 4995178 - DNA, 18 bp, Homo sapiens
atggatatagaaaatctt

SEQ ID NO: 4995179 - DNA, 14 bp, Homo sapiens
atggctagaattat

SEQ ID NO: 4995180 - DNA, 16 bp, Homo sapiens
gaaaattacgttctta

SEQ ID NO: 4995181 - DNA, 18 bp, Homo sapiens
gaaagaaaatggaaagaa

SEQ ID NO: 4995182 - DNA, 13 bp, Homo sapiens
gaaagaaaggaaa

SEQ ID NO: 4995183 - DNA, 21 bp, Homo sapiens
gaaagaagcattgaaaacaaa

SEQ ID NO: 4995184 - DNA, 21 bp, Homo sapiens
gaaagaaggagatgaatagaa

SEQ ID NO: 4995185 - DNA, 23 bp, Homo sapiens
gaaagaaggagatgaatagaaga

SEQ ID NO: 4995186 - DNA, 15 bp, Homo sapiens
gaaagacatctgcct

SEQ ID NO: 4995187 - DNA, 19 bp, Homo sapiens
gaaagtatagatggccaaa

SEQ ID NO: 4995188 - DNA, 13 bp, Homo sapiens
gaactcaatataa

SEQ ID NO: 4995189 - DNA, 13 bp, Homo sapiens
gaagaaagaaaat

SEQ ID NO: 4995190 - DNA, 16 bp, Homo sapiens
gaagaaagaaaatgga

SEQ ID NO: 4995191 - DNA, 22 bp, Homo sapiens
gaagaggttttatttacatttt

SEQ ID NO: 4995192 - DNA, 16 bp, Homo sapiens
gaagcattgaaaacaa

SEQ ID NO: 4995193 - DNA, 21 bp, Homo sapiens
gaagcattgaaaacaaagaca

SEQ ID NO: 4995194 - DNA, 17 bp, Homo sapiens
gaaggagatgaatagaa

SEQ ID NO: 4995195 - DNA, 19 bp, Homo sapiens
gaaggagatgaatagaaga

SEQ ID NO: 4995196 - DNA, 15 bp, Homo sapiens
gaataaatggtttct

SEQ ID NO: 4995197 - DNA, 14 bp, Homo sapiens
gaatagaagaaaga

SEQ ID NO: 4995198 - DNA, 17 bp, Homo sapiens
gaatagaagaaagaaaa

SEQ ID NO: 4995199 - DNA, 17 bp, Homo sapiens
gaatgaagttgtacttc

SEQ ID NO: 4995200 - DNA, 21 bp, Homo sapiens
gaatgattaatcataaagaaa

SEQ ID NO: 4995201 - DNA, 14 bp, Homo sapiens
gaatgccataaaat

SEQ ID NO: 4995202 - DNA, 19 bp, Homo sapiens
gaatgtacatactgaaaaa

SEQ ID NO: 4995203 - DNA, 21 bp, Homo sapiens
gaatttatgagatttactgct

SEQ ID NO: 4995204 - DNA, 12 bp, Homo sapiens
gacctttatcca

SEQ ID NO: 4995205 - DNA, 23 bp, Homo sapiens
gactgtggccatatatgctgtat

SEQ ID NO: 4995206 - DNA, 23 bp, Homo sapiens
gactttgatttccttaatagccc

SEQ ID NO: 4995207 - DNA, 13 bp, Homo sapiens
gactttgctgtta

SEQ ID NO: 4995208 - DNA, 13 bp, Homo sapiens
gactttgtatgaa

SEQ ID NO: 4995209 - DNA, 20 bp, Homo sapiens
gagaatggcgtgaacccggg

SEQ ID NO: 4995210 - DNA, 14 bp, Homo sapiens
gagactttgctgtt

SEQ ID NO: 4995211 - DNA, 20 bp, Homo sapiens
gagactttgctgttactgct

SEQ ID NO: 4995212 - DNA, 21 bp, Homo sapiens
gagatgaatagaagaaagaaa

SEQ ID NO: 4995213 - DNA, 16 bp, Homo sapiens
gagcagtcctgcctca

SEQ ID NO: 4995214 - DNA, 15 bp, Homo sapiens
gaggatagaaaaagg

SEQ ID NO: 4995215 - DNA, 16 bp, Homo sapiens
gaggatagaaaaagga

SEQ ID NO: 4995216 - DNA, 21 bp, Homo sapiens
gaggatagaaaaaggatggaa

SEQ ID NO: 4995217 - DNA, 19 bp, Homo sapiens
gaggcggagcttgcagtga

SEQ ID NO: 4995218 - DNA, 13 bp, Homo sapiens
gagtaatgatgta

SEQ ID NO: 4995219 - DNA, 18 bp, Homo sapiens
gagtcttaactgtatttc

SEQ ID NO: 4995220 - DNA, 22 bp, Homo sapiens
gagtcttaactgtatttcagta

SEQ ID NO: 4995221 - DNA, 15 bp, Homo sapiens
gagtgatagctactg

SEQ ID NO: 4995222 - DNA, 22 bp, Homo sapiens
gagttacttagaatgccataaa

SEQ ID NO: 4995223 - DNA, 16 bp, Homo sapiens
gatagaaaaaggatgg

SEQ ID NO: 4995224 - DNA, 17 bp, Homo sapiens
gatagctactgtagaaa

SEQ ID NO: 4995225 - DNA, 23 bp, Homo sapiens
gatagctactgtagaaaggaaat

SEQ ID NO: 4995226 - DNA, 12 bp, Homo sapiens
gatatagaaaat

SEQ ID NO: 4995227 - DNA, 17 bp, Homo sapiens
gatcacatctaaagctt

SEQ ID NO: 4995228 - DNA, 23 bp, Homo sapiens
gatcagatgctgaattgagaata

SEQ ID NO: 4995229 - DNA, 17 bp, Homo sapiens
gatctgtataaaaatgt

SEQ ID NO: 4995230 - DNA, 19 bp, Homo sapiens
gatcttggcttactgcagc

SEQ ID NO: 4995231 - DNA, 13 bp, Homo sapiens
gatctttgtttaa

SEQ ID NO: 4995232 - DNA, 14 bp, Homo sapiens
gatgaatagaagaa

SEQ ID NO: 4995233 - DNA, 17 bp, Homo sapiens
gatgaatagaagaaaga

SEQ ID NO: 4995234 - DNA, 19 bp, Homo sapiens
gattaccagtctgattata

SEQ ID NO: 4995235 - DNA, 20 bp, Homo sapiens
gattagggaaaatggatata

SEQ ID NO: 4995236 - DNA, 22 bp, Homo sapiens
gattgcaaatattggttagtat

SEQ ID NO: 4995237 - DNA, 23 bp, Homo sapiens
gatttaagccttgacacactgtg

SEQ ID NO: 4995238 - DNA, 14 bp, Homo sapiens
gatttatatataag

SEQ ID NO: 4995239 - DNA, 18 bp, Homo sapiens
gatttgaaaaacttttag

SEQ ID NO: 4995240 - DNA, 21 bp, Homo sapiens
gatttgctaataatgttcacg

SEQ ID NO: 4995241 - DNA, 19 bp, Homo sapiens
gcaactgtattaaagaaaa

SEQ ID NO: 4995242 - DNA, 20 bp, Homo sapiens
gcaactgtattaaagaaaaa

SEQ ID NO: 4995243 - DNA, 14 bp, Homo sapiens
gcaagcacatctgc

SEQ ID NO: 4995244 - DNA, 16 bp, Homo sapiens
gcacacatttaaaaat

SEQ ID NO: 4995245 - DNA, 22 bp, Homo sapiens
gcagtttcatgtatgtatataa

SEQ ID NO: 4995246 - DNA, 15 bp, Homo sapiens
gcattaactaaatgc

SEQ ID NO: 4995247 - DNA, 17 bp, Homo sapiens
gcattaactaaatgctc

SEQ ID NO: 4995248 - DNA, 15 bp, Homo sapiens
gcatttatttctctg

SEQ ID NO: 4995249 - DNA, 15 bp, Homo sapiens
gccaaaatgtactta

SEQ ID NO: 4995250 - DNA, 23 bp, Homo sapiens
gccaagtggccactggcatcgca

SEQ ID NO: 4995251 - DNA, 20 bp, Homo sapiens
gccaattgcctaaaatttct

SEQ ID NO: 4995252 - DNA, 17 bp, Homo sapiens
gccaccatggccagcca

SEQ ID NO: 4995253 - DNA, 20 bp, Homo sapiens
gccactggcatcgcagcttc

SEQ ID NO: 4995254 - DNA, 16 bp, Homo sapiens
gccatatatgctgtat

SEQ ID NO: 4995255 - DNA, 18 bp, Homo sapiens
gccatatatgctgtattt

SEQ ID NO: 4995256 - DNA, 17 bp, Homo sapiens
gccatgctttttggtga

SEQ ID NO: 4995257 - DNA, 20 bp, Homo sapiens
gcccagccaaaccctgtctg

SEQ ID NO: 4995258 - DNA, 14 bp, Homo sapiens
gcccatttttgcta

SEQ ID NO: 4995259 - DNA, 12 bp, Homo sapiens
gcctcccacccc

SEQ ID NO: 4995260 - DNA, 18 bp, Homo sapiens
gcctcccttttctcctct

SEQ ID NO: 4995261 - DNA, 13 bp, Homo sapiens
gccttatgtgtta

SEQ ID NO: 4995262 - DNA, 17 bp, Homo sapiens
gcgatccacctgtctca

SEQ ID NO: 4995263 - DNA, 13 bp, Homo sapiens
gctaatatacttt

SEQ ID NO: 4995264 - DNA, 14 bp, Homo sapiens
gctaatatactttt

SEQ ID NO: 4995265 - DNA, 20 bp, Homo sapiens
gctaatctgcctggttttat

SEQ ID NO: 4995266 - DNA, 23 bp, Homo sapiens
gctaatctgcctggttttattta

SEQ ID NO: 4995267 - DNA, 15 bp, Homo sapiens
gctagaatttctggt

SEQ ID NO: 4995268 - DNA, 17 bp, Homo sapiens
gctatcctgctgaaagt

SEQ ID NO: 4995269 - DNA, 19 bp, Homo sapiens
gctcaggcgatccacctgt

SEQ ID NO: 4995270 - DNA, 15 bp, Homo sapiens
gctcatgtatattta

SEQ ID NO: 4995271 - DNA, 12 bp, Homo sapiens
gctctagaaagt

SEQ ID NO: 4995272 - DNA, 17 bp, Homo sapiens
gctgaaagtcctgcttt

SEQ ID NO: 4995273 - DNA, 16 bp, Homo sapiens
gctgtatttctttgta

SEQ ID NO: 4995274 - DNA, 22 bp, Homo sapiens
gctgtatttctttgtagaataa

SEQ ID NO: 4995275 - DNA, 15 bp, Homo sapiens
gctgttactgcttct

SEQ ID NO: 4995276 - DNA, 17 bp, Homo sapiens
gctgttactgcttctct

SEQ ID NO: 4995277 - DNA, 21 bp, Homo sapiens
gctgtttactcccttctgtag

SEQ ID NO: 4995278 - DNA, 21 bp, Homo sapiens
gcttcaaattggtctgaaagg

SEQ ID NO: 4995279 - DNA, 22 bp, Homo sapiens
gcttctctgtttttcttctgaa

SEQ ID NO: 4995280 - DNA, 18 bp, Homo sapiens
gcttgttccctctccctg

SEQ ID NO: 4995281 - DNA, 21 bp, Homo sapiens
gctttaaaagtcattattcct

SEQ ID NO: 4995282 - DNA, 18 bp, Homo sapiens
gctttatttataaaataa

SEQ ID NO: 4995283 - DNA, 18 bp, Homo sapiens
gctttcctatctagcatt

SEQ ID NO: 4995284 - DNA, 21 bp, Homo sapiens
gcttttattgcaccattttca

SEQ ID NO: 4995285 - DNA, 15 bp, Homo sapiens
ggaaatatgcactgc

SEQ ID NO: 4995286 - DNA, 18 bp, Homo sapiens
ggaaatctcaccccatcc

SEQ ID NO: 4995287 - DNA, 14 bp, Homo sapiens
ggaagaaagaagca

SEQ ID NO: 4995288 - DNA, 19 bp, Homo sapiens
ggaagaagttttttacttt

SEQ ID NO: 4995289 - DNA, 16 bp, Homo sapiens
ggagatgaatagaaga

SEQ ID NO: 4995290 - DNA, 18 bp, Homo sapiens
ggagatgaatagaagaaa

SEQ ID NO: 4995291 - DNA, 21 bp, Homo sapiens
ggagatgaatagaagaaagaa

SEQ ID NO: 4995292 - DNA, 15 bp, Homo sapiens
ggatagaaaaaggat

SEQ ID NO: 4995293 - DNA, 22 bp, Homo sapiens
ggatatccatgagctgcactga

SEQ ID NO: 4995294 - DNA, 18 bp, Homo sapiens
tgaaaacaaagacattct

SEQ ID NO: 4995295 - DNA, 12 bp, Homo sapiens
tgaaaagtaaaa

SEQ ID NO: 4995296 - DNA, 14 bp, Homo sapiens
tgaaaagtaaaaaa

SEQ ID NO: 4995297 - DNA, 12 bp, Homo sapiens
tgaaagttgctt

SEQ ID NO: 4995298 - DNA, 13 bp, Homo sapiens
tgaaagttgcttt

SEQ ID NO: 4995299 - DNA, 16 bp, Homo sapiens
tgaaagttgcttttat

SEQ ID NO: 4995300 - DNA, 20 bp, Homo sapiens
tgaaagttgcttttattgca

SEQ ID NO: 4995301 - DNA, 19 bp, Homo sapiens
tgaactcaatataaaaaca

SEQ ID NO: 4995302 - DNA, 15 bp, Homo sapiens
tgaatttatgagatt

SEQ ID NO: 4995303 - DNA, 15 bp, Homo sapiens
tgacataattgtcca

SEQ ID NO: 4995304 - DNA, 21 bp, Homo sapiens
tgactgcaagcatttttccat

SEQ ID NO: 4995305 - DNA, 18 bp, Homo sapiens
tgagaatgtcttgcttga

SEQ ID NO: 4995306 - DNA, 21 bp, Homo sapiens
tgagatcaaaaaaatatatga

SEQ ID NO: 4995307 - DNA, 13 bp, Homo sapiens
tgagtcttaactg

SEQ ID NO: 4995308 - DNA, 20 bp, Homo sapiens
tgagtcttaactgtatttca

SEQ ID NO: 4995309 - DNA, 12 bp, Homo sapiens
tgagtgccatgc

SEQ ID NO: 4995310 - DNA, 15 bp, Homo sapiens
tgagtgccatgcttt

SEQ ID NO: 4995311 - DNA, 22 bp, Homo sapiens
tgagttacttagaatgccataa

SEQ ID NO: 4995312 - DNA, 16 bp, Homo sapiens
tgatagctactgtaga

SEQ ID NO: 4995313 - DNA, 21 bp, Homo sapiens
tgatagctactgtagaaagga

SEQ ID NO: 4995314 - DNA, 16 bp, Homo sapiens
tgatattcaaggcttt

SEQ ID NO: 4995315 - DNA, 18 bp, Homo sapiens
tgatattcaaggctttaa

SEQ ID NO: 4995316 - DNA, 19 bp, Homo sapiens
tgatcacatctaaagcttt

SEQ ID NO: 4995317 - DNA, 16 bp, Homo sapiens
tgatcagatgctgaat

SEQ ID NO: 4995318 - DNA, 18 bp, Homo sapiens
tgatctgtgtaaaatctg

SEQ ID NO: 4995319 - DNA, 21 bp, Homo sapiens
tgatcttggcttactgcagcc

SEQ ID NO: 4995320 - DNA, 14 bp, Homo sapiens
tgatctttgtttaa

SEQ ID NO: 4995321 - DNA, 20 bp, Homo sapiens
tgatctttgtttaaatgcca

SEQ ID NO: 4995322 - DNA, 23 bp, Homo sapiens
tgatctttgtttaaatgccaaaa

SEQ ID NO: 4995323 - DNA, 14 bp, Homo sapiens
tgattaaaatgagt

SEQ ID NO: 4995324 - DNA, 15 bp, Homo sapiens
tgattaaaatgagtt

SEQ ID NO: 4995325 - DNA, 16 bp, Homo sapiens
tgattaaaatgagttt

SEQ ID NO: 4995326 - DNA, 12 bp, Homo sapiens
tgattaatgcat

SEQ ID NO: 4995327 - DNA, 15 bp, Homo sapiens
tgatttgatctttgt

SEQ ID NO: 4995328 - DNA, 18 bp, Homo sapiens
tgatttgatctttgttta

SEQ ID NO: 4995329 - DNA, 21 bp, Homo sapiens
tgcaaactgctttattttccc

SEQ ID NO: 4995330 - DNA, 19 bp, Homo sapiens
tgcaactaactgactctgt

SEQ ID NO: 4995331 - DNA, 24 bp, Homo sapiens
tgcaactaactgactctgttattg

SEQ ID NO: 4995332 - DNA, 21 bp, Homo sapiens
tgcaagattttttttttaagt

SEQ ID NO: 4995333 - DNA, 23 bp, Homo sapiens
tgcaagattttttttttaagtga

SEQ ID NO: 4995334 - DNA, 15 bp, Homo sapiens
tgcaccattttcaat

SEQ ID NO: 4995335 - DNA, 21 bp, Homo sapiens
tgcactgctcacttttttgaa

SEQ ID NO: 4995336 - DNA, 22 bp, Homo sapiens
tgcagcaccactagcttgtgct

SEQ ID NO: 4995337 - DNA, 14 bp, Homo sapiens
tgcagtttcatgta

SEQ ID NO: 4995338 - DNA, 17 bp, Homo sapiens
tgcagtttcatgtatgt

SEQ ID NO: 4995339 - DNA, 14 bp, Homo sapiens
tgcatttaccaaaa

SEQ ID NO: 4995340 - DNA, 21 bp, Homo sapiens
tgccataaaattgcagtttca

SEQ ID NO: 4995341 - DNA, 17 bp, Homo sapiens
tgcccatttttgctaat

SEQ ID NO: 4995342 - DNA, 20 bp, Homo sapiens
tgcctcattttcacagcact

SEQ ID NO: 4995343 - DNA, 17 bp, Homo sapiens
tgcctggttttatttat

SEQ ID NO: 4995344 - DNA, 13 bp, Homo sapiens
tgccttttaagtt

SEQ ID NO: 4995345 - DNA, 15 bp, Homo sapiens
tgccttttaagtttg

SEQ ID NO: 4995346 - DNA, 15 bp, Homo sapiens
tgctattaagaaggc

SEQ ID NO: 4995347 - DNA, 16 bp, Homo sapiens
tgctcattaaactgat

SEQ ID NO: 4995348 - DNA, 16 bp, Homo sapiens
tgctgtatttctttgt

SEQ ID NO: 4995349 - DNA, 15 bp, Homo sapiens
tgctgttactgcttc

SEQ ID NO: 4995350 - DNA, 22 bp, Homo sapiens
tgctgtttactcccttctgtag

SEQ ID NO: 4995351 - DNA, 23 bp, Homo sapiens
tgcttagtatctaataatgaagt

SEQ ID NO: 4995352 - DNA, 21 bp, Homo sapiens
tgcttcactcatgcaaactgc

SEQ ID NO: 4995353 - DNA, 23 bp, Homo sapiens
tgcttcactcatgcaaactgctt

SEQ ID NO: 4995354 - DNA, 23 bp, Homo sapiens
tgcttcctgattaccagtctgat

SEQ ID NO: 4995355 - DNA, 15 bp, Homo sapiens
tgcttctctttgtgc

SEQ ID NO: 4995356 - DNA, 16 bp, Homo sapiens
tgcttctctttgtgca

SEQ ID NO: 4995357 - DNA, 11 bp, Homo sapiens
tggaaagaagg

SEQ ID NO: 4995358 - DNA, 12 bp, Homo sapiens
tggaaagaagga

SEQ ID NO: 4995359 - DNA, 17 bp, Homo sapiens
tggaaagaaggaaaaaa

SEQ ID NO: 4995360 - DNA, 12 bp, Homo sapiens
tggaagaaagaa

SEQ ID NO: 4995361 - DNA, 14 bp, Homo sapiens
tggaagaaagaagc

SEQ ID NO: 4995362 - DNA, 22 bp, Homo sapiens
tggaagaagttttttactttgg

SEQ ID NO: 4995363 - DNA, 13 bp, Homo sapiens
tggacagatttaa

SEQ ID NO: 4995364 - DNA, 16 bp, Homo sapiens
tggagactttgctgtt

SEQ ID NO: 4995365 - DNA, 16 bp, Homo sapiens
tggagtgaatgaagtt

SEQ ID NO: 4995366 - DNA, 16 bp, Homo sapiens
tggagtgatagctact

SEQ ID NO: 4995367 - DNA, 22 bp, Homo sapiens
tggcaactgtattaaagaaaaa

SEQ ID NO: 4995368 - DNA, 17 bp, Homo sapiens
tggccatatatgctgta

SEQ ID NO: 4995369 - DNA, 21 bp, Homo sapiens
tggccatatatgctgtatttc

SEQ ID NO: 4995370 - DNA, 13 bp, Homo sapiens
tggcttctctgtt

SEQ ID NO: 4995371 - DNA, 20 bp, Homo sapiens
tgggtctcgctttgttgccc

SEQ ID NO: 4995372 - DNA, 16 bp, Homo sapiens
tgggtggtaacaagag

SEQ ID NO: 4995373 - DNA, 18 bp, Homo sapiens
tggtaagtgaatttatga

SEQ ID NO: 4995374 - DNA, 17 bp, Homo sapiens
tggtagatttttttcat

SEQ ID NO: 4995375 - DNA, 13 bp, Homo sapiens
tggtagtttaaaa

SEQ ID NO: 4995376 - DNA, 14 bp, Homo sapiens
tggtagtttaaaac

SEQ ID NO: 4995377 - DNA, 20 bp, Homo sapiens
tggtgattaaaatgagttta

SEQ ID NO: 4995378 - DNA, 23 bp, Homo sapiens
tggttcagtttttttttttccag

SEQ ID NO: 4995379 - DNA, 13 bp, Homo sapiens
tgtacttaaatga

SEQ ID NO: 4995380 - DNA, 19 bp, Homo sapiens
tgtacttaaatgagttact

SEQ ID NO: 4995381 - DNA, 14 bp, Homo sapiens
tgtagaaaggaaat

SEQ ID NO: 4995382 - DNA, 21 bp, Homo sapiens
tgtagaataaatggtttctca

SEQ ID NO: 4995383 - DNA, 21 bp, Homo sapiens
tgtaggcacttttattttcat

SEQ ID NO: 4995384 - DNA, 16 bp, Homo sapiens
tgtataaaaatgtaaa

SEQ ID NO: 4995385 - DNA, 23 bp, Homo sapiens
tgtatataatcatgctcatgtat

SEQ ID NO: 4995386 - DNA, 21 bp, Homo sapiens
tgtatgaactctttaagttga

SEQ ID NO: 4995387 - DNA, 13 bp, Homo sapiens
tgtattaaagaaa

SEQ ID NO: 4995388 - DNA, 15 bp, Homo sapiens
tgtattaaagaaaaa

SEQ ID NO: 4995389 - DNA, 14 bp, Homo sapiens
tgtatttcagtatt

SEQ ID NO: 4995390 - DNA, 16 bp, Homo sapiens
tgtcaagtctctgctg

SEQ ID NO: 4995391 - DNA, 21 bp, Homo sapiens
tgtccctcactgttgaatttt

SEQ ID NO: 4995392 - DNA, 22 bp, Homo sapiens
tgtctgtttatatattgaaagt

SEQ ID NO: 4995393 - DNA, 16 bp, Homo sapiens
tgtcttgcttgattga

SEQ ID NO: 4995394 - DNA, 21 bp, Homo sapiens
tgtgcacactcaagtcctgca

SEQ ID NO: 4995395 - DNA, 18 bp, Homo sapiens
tgtgcagtgttagtattc

SEQ ID NO: 4995396 - DNA, 16 bp, Homo sapiens
tgtggccatatatgct

SEQ ID NO: 4995397 - DNA, 23 bp, Homo sapiens
tgtggccatatatgctgtatttc

SEQ ID NO: 4995398 - DNA, 12 bp, Homo sapiens
tgttactgcttc

SEQ ID NO: 4995399 - DNA, 19 bp, Homo sapiens
tgttactgcttctctttgt

SEQ ID NO: 4995400 - DNA, 17 bp, Homo sapiens
tgttatagattgtctta

SEQ ID NO: 4995401 - DNA, 17 bp, Homo sapiens
tgttattaatgtttctt

SEQ ID NO: 4995402 - DNA, 11 bp, Homo sapiens
tgttgtttgcc

SEQ ID NO: 4995403 - DNA, 22 bp, Homo sapiens
tgtttcttctccaattctgaaa

SEQ ID NO: 4995404 - DNA, 17 bp, Homo sapiens
tgtttttcttctgaaat

SEQ ID NO: 4995405 - DNA, 16 bp, Homo sapiens
ttaaaaactttaaaga

SEQ ID NO: 4995406 - DNA, 14 bp, Homo sapiens
ttaaaaatgaaaat

SEQ ID NO: 4995407 - DNA, 13 bp, Homo sapiens
ttaaaatgtagtt

SEQ ID NO: 4995408 - DNA, 17 bp, Homo sapiens
ttaaaatgtagttttaa

SEQ ID NO: 4995409 - DNA, 19 bp, Homo sapiens
tatatatgtagagaaagat

SEQ ID NO: 4995410 - DNA, 15 bp, Homo sapiens
tatatattgaaagtt

SEQ ID NO: 4995411 - DNA, 21 bp, Homo sapiens
tatatattgaaagttgctttt

SEQ ID NO: 4995412 - DNA, 14 bp, Homo sapiens
tatatgctgtattt

SEQ ID NO: 4995413 - DNA, 13 bp, Homo sapiens
tatatgtgagaaa

SEQ ID NO: 4995414 - DNA, 23 bp, Homo sapiens
tatatgtggtttggatgtgtgct

SEQ ID NO: 4995415 - DNA, 23 bp, Homo sapiens
tatattgaaagttgcttttattg

SEQ ID NO: 4995416 - DNA, 13 bp, Homo sapiens
tatatttaacttt

SEQ ID NO: 4995417 - DNA, 23 bp, Homo sapiens
tatatttcacactggagtgaatg

SEQ ID NO: 4995418 - DNA, 18 bp, Homo sapiens
tatatttgggagtgactg

SEQ ID NO: 4995419 - DNA, 12 bp, Homo sapiens
tatcactaagaa

SEQ ID NO: 4995420 - DNA, 15 bp, Homo sapiens
tatcactaagaaaga

SEQ ID NO: 4995421 - DNA, 18 bp, Homo sapiens
tatccagctagtgccaaa

SEQ ID NO: 4995422 - DNA, 13 bp, Homo sapiens
tatcctgctgaaa

SEQ ID NO: 4995423 - DNA, 21 bp, Homo sapiens
tatcctgctgaaagtcctgct

SEQ ID NO: 4995424 - DNA, 22 bp, Homo sapiens
tatcctgctgaaagtcctgctt

SEQ ID NO: 4995425 - DNA, 19 bp, Homo sapiens
tatctaataatgaagtgtt

SEQ ID NO: 4995426 - DNA, 21 bp, Homo sapiens
tatctagcatttatttctctg

SEQ ID NO: 4995427 - DNA, 17 bp, Homo sapiens
tatcttgttattaatgt

SEQ ID NO: 4995428 - DNA, 22 bp, Homo sapiens
tatgaaaacaatactaaataaa

SEQ ID NO: 4995429 - DNA, 20 bp, Homo sapiens
tatgaactctttaagttgaa

SEQ ID NO: 4995430 - DNA, 16 bp, Homo sapiens
tatgataataatcatg

SEQ ID NO: 4995431 - DNA, 17 bp, Homo sapiens
tatgattggttcagttt

SEQ ID NO: 4995432 - DNA, 18 bp, Homo sapiens
tatgattggttcagtttt

SEQ ID NO: 4995433 - DNA, 16 bp, Homo sapiens
tatgctgtatttcttt

SEQ ID NO: 4995434 - DNA, 17 bp, Homo sapiens
tatgctgtatttctttg

SEQ ID NO: 4995435 - DNA, 18 bp, Homo sapiens
tatgctgtatttctttgt

SEQ ID NO: 4995436 - DNA, 23 bp, Homo sapiens
tatgctgtatttctttgtagaat

SEQ ID NO: 4995437 - DNA, 15 bp, Homo sapiens
tatggagactttgct

SEQ ID NO: 4995438 - DNA, 17 bp, Homo sapiens
tatggagactttgctgt

SEQ ID NO: 4995439 - DNA, 19 bp, Homo sapiens
tatggctatctatacctgc

SEQ ID NO: 4995440 - DNA, 13 bp, Homo sapiens
tatgtgttacatt

SEQ ID NO: 4995441 - DNA, 16 bp, Homo sapiens
tattaaatgagggttt

SEQ ID NO: 4995442 - DNA, 12 bp, Homo sapiens
tattaagaaggc

SEQ ID NO: 4995443 - DNA, 18 bp, Homo sapiens
tattatttttttaaacaa

SEQ ID NO: 4995444 - DNA, 14 bp, Homo sapiens
tattcagctagaat

SEQ ID NO: 4995445 - DNA, 17 bp, Homo sapiens
tatttaaaaaattaaaa

SEQ ID NO: 4995446 - DNA, 21 bp, Homo sapiens
tatttaaaaaattaaaaatga

SEQ ID NO: 4995447 - DNA, 13 bp, Homo sapiens
tatttagttacgt

SEQ ID NO: 4995448 - DNA, 23 bp, Homo sapiens
tatttagttacgtataatgcttt

SEQ ID NO: 4995449 - DNA, 13 bp, Homo sapiens
tatttatatcttg

SEQ ID NO: 4995450 - DNA, 16 bp, Homo sapiens
tatttctctggcaaac

SEQ ID NO: 4995451 - DNA, 19 bp, Homo sapiens
tatttctctggcaaacttt

SEQ ID NO: 4995452 - DNA, 21 bp, Homo sapiens
tattttatcactacaagcttt

SEQ ID NO: 4995453 - DNA, 20 bp, Homo sapiens
tattttccagccttatgtgt

SEQ ID NO: 4995454 - DNA, 20 bp, Homo sapiens
tattttccctacttgcagcg

SEQ ID NO: 4995455 - DNA, 12 bp, Homo sapiens
tattttgaaata

SEQ ID NO: 4995456 - DNA, 16 bp, Homo sapiens
tcaaggctttaaaagt

SEQ ID NO: 4995457 - DNA, 20 bp, Homo sapiens
tcaataaaagcctttgaaaa

SEQ ID NO: 4995458 - DNA, 15 bp, Homo sapiens
tcaataaaggaaata

SEQ ID NO: 4995459 - DNA, 23 bp, Homo sapiens
tcaatttggagcattaactaaat

SEQ ID NO: 4995460 - DNA, 15 bp, Homo sapiens
tcacagttctgtaat

SEQ ID NO: 4995461 - DNA, 14 bp, Homo sapiens
tcacatctaaagct

SEQ ID NO: 4995462 - DNA, 20 bp, Homo sapiens
tcacatctaaagctttatct

SEQ ID NO: 4995463 - DNA, 12 bp, Homo sapiens
tcaccccaccct

SEQ ID NO: 4995464 - DNA, 13 bp, Homo sapiens
tcaccccatccca

SEQ ID NO: 4995465 - DNA, 14 bp, Homo sapiens
tcaccctgggcagt

SEQ ID NO: 4995466 - DNA, 18 bp, Homo sapiens
tcactaagaaagaaagga

SEQ ID NO: 4995467 - DNA, 19 bp, Homo sapiens
tcactcatgcaaactgctt

SEQ ID NO: 4995468 - DNA, 20 bp, Homo sapiens
tcactcatgcaaactgcttt

SEQ ID NO: 4995469 - DNA, 16 bp, Homo sapiens
tcacttttttgaagga

SEQ ID NO: 4995470 - DNA, 20 bp, Homo sapiens
tcagaattggcataatttgt

SEQ ID NO: 4995471 - DNA, 19 bp, Homo sapiens
tcagctctgctttatctga

SEQ ID NO: 4995472 - DNA, 23 bp, Homo sapiens
tcagctttagaaattaataccac

SEQ ID NO: 4995473 - DNA, 20 bp, Homo sapiens
tcaggcgatccacctgtctc

SEQ ID NO: 4995474 - DNA, 21 bp, Homo sapiens
tcaggcgatccacctgtctca

SEQ ID NO: 4995475 - DNA, 19 bp, Homo sapiens
tcagggaaactaattgtat

SEQ ID NO: 4995476 - DNA, 19 bp, Homo sapiens
tcagtattttccagcctta

SEQ ID NO: 4995477 - DNA, 18 bp, Homo sapiens
tcagtttttttttttcca

SEQ ID NO: 4995478 - DNA, 13 bp, Homo sapiens
tcatacacagtta

SEQ ID NO: 4995479 - DNA, 16 bp, Homo sapiens
tcatggtttataaaaa

SEQ ID NO: 4995480 - DNA, 13 bp, Homo sapiens
tcattaaactcta

SEQ ID NO: 4995481 - DNA, 22 bp, Homo sapiens
tccaaaataatctatattaaat

SEQ ID NO: 4995482 - DNA, 21 bp, Homo sapiens
tccaatgatacccaacagttt

SEQ ID NO: 4995483 - DNA, 19 bp, Homo sapiens
tccaattctgaaatacttt

SEQ ID NO: 4995484 - DNA, 16 bp, Homo sapiens
tccacctgtctcagcc

SEQ ID NO: 4995485 - DNA, 23 bp, Homo sapiens
tccagctagtgccaaataattga

SEQ ID NO: 4995486 - DNA, 14 bp, Homo sapiens
tccatgcttcactc

SEQ ID NO: 4995487 - DNA, 13 bp, Homo sapiens
tcccacaccctgg

SEQ ID NO: 4995488 - DNA, 20 bp, Homo sapiens
tcccacccccatctctccct

SEQ ID NO: 4995489 - DNA, 22 bp, Homo sapiens
tcccacttcttggatttttaaa

SEQ ID NO: 4995490 - DNA, 15 bp, Homo sapiens
tcccagagtgctggg

SEQ ID NO: 4995491 - DNA, 16 bp, Homo sapiens
tccccaatccatgctt

SEQ ID NO: 4995492 - DNA, 16 bp, Homo sapiens
tccccactgacagcct

SEQ ID NO: 4995493 - DNA, 19 bp, Homo sapiens
tccccactgacagcctccc

SEQ ID NO: 4995494 - DNA, 19 bp, Homo sapiens
tccccatggtagtttaaaa

SEQ ID NO: 4995495 - DNA, 13 bp, Homo sapiens
tcccctgccattt

SEQ ID NO: 4995496 - DNA, 15 bp, Homo sapiens
tccctacttgcagcg

SEQ ID NO: 4995497 - DNA, 16 bp, Homo sapiens
tccctcccctgccatt

SEQ ID NO: 4995498 - DNA, 15 bp, Homo sapiens
tcccttctcctgccc

SEQ ID NO: 4995499 - DNA, 14 bp, Homo sapiens
tcccttttctcctc

SEQ ID NO: 4995500 - DNA, 16 bp, Homo sapiens
tcctgcctcagcctcc

SEQ ID NO: 4995501 - DNA, 13 bp, Homo sapiens
tcctgtctgttta

SEQ ID NO: 4995502 - DNA, 21 bp, Homo sapiens
tcctttaaatggtaagagttt

SEQ ID NO: 4995503 - DNA, 13 bp, Homo sapiens
tcctttttattca

SEQ ID NO: 4995504 - DNA, 17 bp, Homo sapiens
tcgagcagtcctgcctc

SEQ ID NO: 4995505 - DNA, 20 bp, Homo sapiens
tcggatgtgtcctttctgaa

SEQ ID NO: 4995506 - DNA, 13 bp, Homo sapiens
tctaaagctttat

SEQ ID NO: 4995507 - DNA, 15 bp, Homo sapiens
tctaaagctttatct

SEQ ID NO: 4995508 - DNA, 20 bp, Homo sapiens
tctaactctgtccttacata

SEQ ID NO: 4995509 - DNA, 14 bp, Homo sapiens
tctacattaaacaa

SEQ ID NO: 4995510 - DNA, 14 bp, Homo sapiens
tctatacctgcctt

SEQ ID NO: 4995511 - DNA, 20 bp, Homo sapiens
tctatggagactttgctgtt

SEQ ID NO: 4995512 - DNA, 18 bp, Homo sapiens
tctattaagccattgaaa

SEQ ID NO: 4995513 - DNA, 12 bp, Homo sapiens
tctatttctgaa

SEQ ID NO: 4995514 - DNA, 21 bp, Homo sapiens
tctcaccccatcccacaccct

SEQ ID NO: 4995515 - DNA, 15 bp, Homo sapiens
tctctgctggcccag

SEQ ID NO: 4995516 - DNA, 21 bp, Homo sapiens
tctgaaaggctatcctgctga

SEQ ID NO: 4995517 - DNA, 17 bp, Homo sapiens
tctgatctgtactttgt

SEQ ID NO: 4995518 - DNA, 21 bp, Homo sapiens
tctgcattttcaccccaccct

SEQ ID NO: 4995519 - DNA, 17 bp, Homo sapiens
tctgcctggttttattt

SEQ ID NO: 4995520 - DNA, 14 bp, Homo sapiens
tctgctggcccagc

SEQ ID NO: 4995521 - DNA, 18 bp, Homo sapiens
tctggagtgatagctact

SEQ ID NO: 4995522 - DNA, 19 bp, Homo sapiens
tctggcaaacttttctttc

SEQ ID NO: 4995523 - DNA, 14 bp, Homo sapiens
tctgtataaaaatg

SEQ ID NO: 4995524 - DNA, 18 bp, Homo sapiens
tctgtatgttaggtgaca

SEQ ID NO: 4995525 - DNA, 17 bp, Homo sapiens
tctgtgaaatgctggca

SEQ ID NO: 4995526 - DNA, 18 bp, Homo sapiens
tctgtttttcttctgaaa

SEQ ID NO: 4995527 - DNA, 19 bp, Homo sapiens
tctgtttttcttctgaaat

SEQ ID NO: 4995528 - DNA, 21 bp, Homo sapiens
tctgtttttcttctgaaatac

SEQ ID NO: 4995529 - DNA, 15 bp, Homo sapiens
tcttaactgtatttc

SEQ ID NO: 4995530 - DNA, 18 bp, Homo sapiens
tcttaactgtatttcagt

SEQ ID NO: 4995531 - DNA, 18 bp, Homo sapiens
tcttatcactaagaaaga

SEQ ID NO: 4995532 - DNA, 23 bp, Homo sapiens
tcttctccaattctgaaatactt

SEQ ID NO: 4995533 - DNA, 18 bp, Homo sapiens
tcttgttattaatgtttc

SEQ ID NO: 4995534 - DNA, 15 bp, Homo sapiens
tctttgtgcagtgtt

SEQ ID NO: 4995535 - DNA, 13 bp, Homo sapiens
tcttttttaaagt

SEQ ID NO: 4995536 - DNA, 12 bp, Homo sapiens
tgaaaaactttt

SEQ ID NO: 4995537 - DNA, 20 bp, Homo sapiens
tgaaaacaatactaaataaa

SEQ ID NO: 4995538 - DNA, 23 bp, Homo sapiens
tgaaagaataggattaatgatca

SEQ ID NO: 4995539 - DNA, 17 bp, Homo sapiens
tgaaagtcctgctttcc

SEQ ID NO: 4995540 - DNA, 19 bp, Homo sapiens
tgaaagttgcttttattgc

SEQ ID NO: 4995541 - DNA, 16 bp, Homo sapiens
tgaaatgctggcattt

SEQ ID NO: 4995542 - DNA, 13 bp, Homo sapiens
tgaacccttgctt

SEQ ID NO: 4995543 - DNA, 15 bp, Homo sapiens
tgaacccttgcttgc

SEQ ID NO: 4995544 - DNA, 13 bp, Homo sapiens
tgaatagaagaaa

SEQ ID NO: 4995545 - DNA, 14 bp, Homo sapiens
tgaatagaagaaag

SEQ ID NO: 4995546 - DNA, 17 bp, Homo sapiens
tgaatagaagaaagaaa

SEQ ID NO: 4995547 - DNA, 18 bp, Homo sapiens
tgaattaccatagagtaa

SEQ ID NO: 4995548 - DNA, 23 bp, Homo sapiens
tgaattaccatagagtaatgatg

SEQ ID NO: 4995549 - DNA, 13 bp, Homo sapiens
tgaattgagaata

SEQ ID NO: 4995550 - DNA, 20 bp, Homo sapiens
tgaatttatgagatttactg

SEQ ID NO: 4995551 - DNA, 11 bp, Homo sapiens
tgacagcctcc

SEQ ID NO: 4995552 - DNA, 12 bp, Homo sapiens
tgacagcctccc

SEQ ID NO: 4995553 - DNA, 17 bp, Homo sapiens
tgacagcctcccacccc

SEQ ID NO: 4995554 - DNA, 22 bp, Homo sapiens
tgacagcctcccacccccatct

SEQ ID NO: 4995555 - DNA, 18 bp, Homo sapiens
tgactccagtataatctc

SEQ ID NO: 4995556 - DNA, 23 bp, Homo sapiens
tgagatcaaaaaaatatatgaca

SEQ ID NO: 4995557 - DNA, 21 bp, Homo sapiens
tgagatttactgctctagaaa

SEQ ID NO: 4995558 - DNA, 21 bp, Homo sapiens
tgagggtgcttgttccctctc

SEQ ID NO: 4995559 - DNA, 21 bp, Homo sapiens
tgagggtttctgatctgtact

SEQ ID NO: 4995560 - DNA, 17 bp, Homo sapiens
tgagtcttaactgtatt

SEQ ID NO: 4995561 - DNA, 16 bp, Homo sapiens
tgagtgccatgctttt

SEQ ID NO: 4995562 - DNA, 19 bp, Homo sapiens
tgagttacttagaatgcca

SEQ ID NO: 4995563 - DNA, 19 bp, Homo sapiens
tgagttttactcttaaatc

SEQ ID NO: 4995564 - DNA, 21 bp, Homo sapiens
tgatcacatctaaagctttat

SEQ ID NO: 4995565 - DNA, 17 bp, Homo sapiens
tgatcagatgctgaatt

SEQ ID NO: 4995566 - DNA, 18 bp, Homo sapiens
tgatcatacaaatgggtt

SEQ ID NO: 4995567 - DNA, 19 bp, Homo sapiens
tgatcccttctcctgccct

SEQ ID NO: 4995568 - DNA, 15 bp, Homo sapiens
tgatctgtactttgt

SEQ ID NO: 4995569 - DNA, 16 bp, Homo sapiens
tgatctgtactttgtg

SEQ ID NO: 4995570 - DNA, 14 bp, Homo sapiens
tgatctgtataaaa

SEQ ID NO: 4995571 - DNA, 18 bp, Homo sapiens
tgatctttgtttaaatgc

SEQ ID NO: 4995572 - DNA, 19 bp, Homo sapiens
tgatctttgtttaaatgcc

SEQ ID NO: 4995573 - DNA, 22 bp, Homo sapiens
tgatctttgtttaaatgccaaa

SEQ ID NO: 4995574 - DNA, 23 bp, Homo sapiens
tgatgcagacaaatgaaataata

SEQ ID NO: 4995575 - DNA, 14 bp, Homo sapiens
tgattaatgcattt

SEQ ID NO: 4995576 - DNA, 19 bp, Homo sapiens
tgattaccagtctgattat

SEQ ID NO: 4995577 - DNA, 15 bp, Homo sapiens
tgcaaactgctttat

SEQ ID NO: 4995578 - DNA, 19 bp, Homo sapiens
tgcaaatattggttagtat

SEQ ID NO: 4995579 - DNA, 20 bp, Homo sapiens
tgcaactaactgactctgtt

SEQ ID NO: 4995580 - DNA, 15 bp, Homo sapiens
tgcactgctcacttt

SEQ ID NO: 4995581 - DNA, 23 bp, Homo sapiens
tgcagcctttgcctccccggctc

SEQ ID NO: 4995582 - DNA, 15 bp, Homo sapiens
tgcagtttcatgtat

SEQ ID NO: 4995583 - DNA, 18 bp, Homo sapiens
tgcagtttcatgtatgta

SEQ ID NO: 4995584 - DNA, 18 bp, Homo sapiens
tgccaagctaatctgcct

SEQ ID NO: 4995585 - DNA, 17 bp, Homo sapiens
tgcccaggctggtctca

SEQ ID NO: 4995586 - DNA, 17 bp, Homo sapiens
tgcctcctgtgcctccc

SEQ ID NO: 4995587 - DNA, 16 bp, Homo sapiens
tgcctcggctcacaaa

SEQ ID NO: 4995588 - DNA, 20 bp, Homo sapiens
tgccttttaagtttgaaact

SEQ ID NO: 4995589 - DNA, 18 bp, Homo sapiens
tgctaaagggagaaatgc

SEQ ID NO: 4995590 - DNA, 22 bp, Homo sapiens
tgctaatatactttttttgtta

SEQ ID NO: 4995591 - DNA, 16 bp, Homo sapiens
tgctcagggtcaattt

SEQ ID NO: 4995592 - DNA, 20 bp, Homo sapiens
tgctcagggtcaatttcttt

SEQ ID NO: 4995593 - DNA, 22 bp, Homo sapiens
tgctgaattgagaataagaatt

SEQ ID NO: 4995594 - DNA, 17 bp, Homo sapiens
tgctgacccaacagcct

SEQ ID NO: 4995595 - DNA, 16 bp, Homo sapiens
tgctggtttttagatt

SEQ ID NO: 4995596 - DNA, 17 bp, Homo sapiens
tgctgtatttctttgta

SEQ ID NO: 4995597 - DNA, 19 bp, Homo sapiens
tgctgttactgcttctctt

SEQ ID NO: 4995598 - DNA, 18 bp, Homo sapiens
tgcttctctttgtgcagt

SEQ ID NO: 4995599 - DNA, 16 bp, Homo sapiens
tgcttgttccctctcc

SEQ ID NO: 4995600 - DNA, 13 bp, Homo sapiens
tggaaaaatgccc

SEQ ID NO: 4995601 - DNA, 10 bp, Homo sapiens
tggaaagaag

SEQ ID NO: 4995602 - DNA, 15 bp, Homo sapiens
tggaaagaaggaaaa

SEQ ID NO: 4995603 - DNA, 15 bp, Homo sapiens
tggaagaagtttttt

SEQ ID NO: 4995604 - DNA, 23 bp, Homo sapiens
tggagcattaactaaatgctcat

SEQ ID NO: 4995605 - DNA, 15 bp, Homo sapiens
tggcaaacttttctt

SEQ ID NO: 4995606 - DNA, 15 bp, Homo sapiens
tggcatatctctgtt

SEQ ID NO: 4995607 - DNA, 16 bp, Homo sapiens
tggcatatctctgttc

SEQ ID NO: 4995608 - DNA, 16 bp, Homo sapiens
tggcatcgcagcttcc

SEQ ID NO: 4995609 - DNA, 23 bp, Homo sapiens
tggccatatatgctgtatttctt

SEQ ID NO: 4995610 - DNA, 21 bp, Homo sapiens
tggctatctatacctgccttt

SEQ ID NO: 4995611 - DNA, 13 bp, Homo sapiens
tggcttgctgttt

SEQ ID NO: 4995612 - DNA, 23 bp, Homo sapiens
tggggaagaggttttatttacat

SEQ ID NO: 4995613 - DNA, 21 bp, Homo sapiens
tggggtctcacagtgttgccc

SEQ ID NO: 4995614 - DNA, 22 bp, Homo sapiens
tgggtaagaaagccaccttgtt

SEQ ID NO: 4995615 - DNA, 22 bp, Homo sapiens
tggtaacgaatttaaaatgtag

SEQ ID NO: 4995616 - DNA, 12 bp, Homo sapiens
tggtagtttaaa

SEQ ID NO: 4995617 - DNA, 13 bp, Homo sapiens
tggtgggttgatg

SEQ ID NO: 4995618 - DNA, 17 bp, Homo sapiens
tggttagtatttaacta

SEQ ID NO: 4995619 - DNA, 17 bp, Homo sapiens
tggtttctcattaaact

SEQ ID NO: 4995620 - DNA, 20 bp, Homo sapiens
tgtaaattagtttgacactg

SEQ ID NO: 4995621 - DNA, 16 bp, Homo sapiens
tgtaatcccagcactt

SEQ ID NO: 4995622 - DNA, 20 bp, Homo sapiens
tgtaatctaagtatatgtga

SEQ ID NO: 4995623 - DNA, 15 bp, Homo sapiens
tgtaattaaactagt

SEQ ID NO: 4995624 - DNA, 14 bp, Homo sapiens
tgtacatctggcct

SEQ ID NO: 4995625 - DNA, 17 bp, Homo sapiens
tgtactgtactgaagaa

SEQ ID NO: 4995626 - DNA, 14 bp, Homo sapiens
tgtacttaaatgag

SEQ ID NO: 4995627 - DNA, 15 bp, Homo sapiens
tgtagaataaatggt

SEQ ID NO: 4995628 - DNA, 22 bp, Homo sapiens
tgtaggcacttttattttcatt

SEQ ID NO: 4995629 - DNA, 15 bp, Homo sapiens
tgtagttttaaataa

SEQ ID NO: 4995630 - DNA, 22 bp, Homo sapiens
tgtagtttttaattaaaaactt

SEQ ID NO: 4995631 - DNA, 21 bp, Homo sapiens
tgtataggtatgatctgtgta

SEQ ID NO: 4995632 - DNA, 16 bp, Homo sapiens
tgtatgaactctttaa

SEQ ID NO: 4995633 - DNA, 14 bp, Homo sapiens
tgtattgcttcctg

SEQ ID NO: 4995634 - DNA, 13 bp, Homo sapiens
tgtatttcagtat

SEQ ID NO: 4995635 - DNA, 15 bp, Homo sapiens
tgtatttcagtattt

SEQ ID NO: 4995636 - DNA, 20 bp, Homo sapiens
tgtatttcagtattttccag

SEQ ID NO: 4995637 - DNA, 18 bp, Homo sapiens
tgtcaagtctctgctggc

SEQ ID NO: 4995638 - DNA, 13 bp, Homo sapiens
tttactcttaaat

SEQ ID NO: 4995639 - DNA, 15 bp, Homo sapiens
tttactcttaaatca

SEQ ID NO: 4995640 - DNA, 20 bp, Homo sapiens
tttagctacctttttatatt

SEQ ID NO: 4995641 - DNA, 22 bp, Homo sapiens
tttagttacgtataatgctttc

SEQ ID NO: 4995642 - DNA, 14 bp, Homo sapiens
tttcaaaaaaacat

SEQ ID NO: 4995643 - DNA, 17 bp, Homo sapiens
tttcattgtgatttata

SEQ ID NO: 4995644 - DNA, 20 bp, Homo sapiens
tttcattgtgatttatatat

SEQ ID NO: 4995645 - DNA, 19 bp, Homo sapiens
tttccaaaataatctatat

SEQ ID NO: 4995646 - DNA, 22 bp, Homo sapiens
tttccaaaataatctatattaa

SEQ ID NO: 4995647 - DNA, 17 bp, Homo sapiens
tttccagccttatgtgt

SEQ ID NO: 4995648 - DNA, 21 bp, Homo sapiens
tttcctatctagcatttattt

SEQ ID NO: 4995649 - DNA, 20 bp, Homo sapiens
tttcctttaaatggtaagag

SEQ ID NO: 4995650 - DNA, 21 bp, Homo sapiens
tttctgagtgagttttactct

SEQ ID NO: 4995651 - DNA, 15 bp, Homo sapiens
tttctgttaacctct

SEQ ID NO: 4995652 - DNA, 15 bp, Homo sapiens
tttcttttttaaagt

SEQ ID NO: 4995653 - DNA, 24 bp, Homo sapiens
tttgaaaaacttttaggttgttac

SEQ ID NO: 4995654 - DNA, 21 bp, Homo sapiens
tttgaaactaactcatagatt

SEQ ID NO: 4995655 - DNA, 22 bp, Homo sapiens
tttgatctttgtttaaatgcca

SEQ ID NO: 4995656 - DNA, 20 bp, Homo sapiens
tttgccaagctaatctgcct

SEQ ID NO: 4995657 - DNA, 17 bp, Homo sapiens
tttgctgttactgcttc

SEQ ID NO: 4995658 - DNA, 18 bp, Homo sapiens
tttggaagaagtttttta

SEQ ID NO: 4995659 - DNA, 22 bp, Homo sapiens
tttggtaacgaatttaaaatgt

SEQ ID NO: 4995660 - DNA, 18 bp, Homo sapiens
tttgtagaataaatggtt

SEQ ID NO: 4995661 - DNA, 15 bp, Homo sapiens
tttgtatgaactctt

SEQ ID NO: 4995662 - DNA, 22 bp, Homo sapiens
tttgtttaaatgccaaaatgta

SEQ ID NO: 4995663 - DNA, 23 bp, Homo sapiens
ttttaaacaaaatttcacagttc

SEQ ID NO: 4995664 - DNA, 23 bp, Homo sapiens
ttttaagtgacataattgtccag

SEQ ID NO: 4995665 - DNA, 20 bp, Homo sapiens
ttttattcagctagaatttc

SEQ ID NO: 4995666 - DNA, 14 bp, Homo sapiens
ttttcatagatttg

SEQ ID NO: 4995667 - DNA, 16 bp, Homo sapiens
ttttcatagatttgaa

SEQ ID NO: 4995668 - DNA, 14 bp, Homo sapiens
ttttcttctgaaat

SEQ ID NO: 4995669 - DNA, 13 bp, Homo sapiens
ttttgatgtgctt

SEQ ID NO: 4995670 - DNA, 16 bp, Homo sapiens
tttttaaagtaaactt

SEQ ID NO: 4995671 - DNA, 12 bp, Homo sapiens
ttttttaagtga

SEQ ID NO: 4995672 - DNA, 16 bp, Homo sapiens
ttttttccagagttgt

SEQ ID NO: 4995673 - DNA, 14 bp, Homo sapiens
acaataatttaaca

SEQ ID NO: 4995674 - DNA, 19 bp, Homo sapiens
acaatgtgtctatttctga

SEQ ID NO: 4995675 - DNA, 21 bp, Homo sapiens
acaatgtgtctatttctgaaa

SEQ ID NO: 4995676 - DNA, 19 bp, Homo sapiens
acagatttaagccttgaca

SEQ ID NO: 4995677 - DNA, 23 bp, Homo sapiens
acagatttaagccttgacacact

SEQ ID NO: 4995678 - DNA, 24 bp, Homo sapiens
acagatttaagccttgacacactg

SEQ ID NO: 4995679 - DNA, 13 bp, Homo sapiens
acagttaaataaa

SEQ ID NO: 4995680 - DNA, 16 bp, Homo sapiens
acagttctgtaatgta

SEQ ID NO: 4995681 - DNA, 15 bp, Homo sapiens
acagtttatttttat

SEQ ID NO: 4995682 - DNA, 17 bp, Homo sapiens
acatcactacaaaaaga

SEQ ID NO: 4995683 - DNA, 22 bp, Homo sapiens
acatcactacaaaaagaagagt

SEQ ID NO: 4995684 - DNA, 20 bp, Homo sapiens
acatcatgtaagatggcaac

SEQ ID NO: 4995685 - DNA, 14 bp, Homo sapiens
acatctaaagcttt

SEQ ID NO: 4995686 - DNA, 16 bp, Homo sapiens
acatctaaagctttat

SEQ ID NO: 4995687 - DNA, 17 bp, Homo sapiens
acatctaaagctttatc

SEQ ID NO: 4995688 - DNA, 15 bp, Homo sapiens
acatctgatctgtat

SEQ ID NO: 4995689 - DNA, 21 bp, Homo sapiens
acatctgcctgtaattaaact

SEQ ID NO: 4995690 - DNA, 22 bp, Homo sapiens
acatctgcctgtaattaaacta

SEQ ID NO: 4995691 - DNA, 23 bp, Homo sapiens
acatctgcctgtaattaaactag

SEQ ID NO: 4995692 - DNA, 19 bp, Homo sapiens
acattcttggttgttaatt

SEQ ID NO: 4995693 - DNA, 23 bp, Homo sapiens
acattcttggttgttaatttaga

SEQ ID NO: 4995694 - DNA, 21 bp, Homo sapiens
acatttagtaaatgctgaaat

SEQ ID NO: 4995695 - DNA, 22 bp, Homo sapiens
acatttagtaaatgctgaaata

SEQ ID NO: 4995696 - DNA, 22 bp, Homo sapiens
accacaggttcatgccaccatg

SEQ ID NO: 4995697 - DNA, 14 bp, Homo sapiens
accacgtccagctg

SEQ ID NO: 4995698 - DNA, 13 bp, Homo sapiens
acccaacagttta

SEQ ID NO: 4995699 - DNA, 13 bp, Homo sapiens
accccacccttcc

SEQ ID NO: 4995700 - DNA, 17 bp, Homo sapiens
acccccatctctccctc

SEQ ID NO: 4995701 - DNA, 16 bp, Homo sapiens
acctgccttttaagtt

SEQ ID NO: 4995702 - DNA, 18 bp, Homo sapiens
acctgccttttaagtttg

SEQ ID NO: 4995703 - DNA, 15 bp, Homo sapiens
acctttttatattta

SEQ ID NO: 4995704 - DNA, 19 bp, Homo sapiens
acgttcttacaagcttaaa

SEQ ID NO: 4995705 - DNA, 18 bp, Homo sapiens
actaaataaacatctgat

SEQ ID NO: 4995706 - DNA, 21 bp, Homo sapiens
actaaatgctcatacacagtt

SEQ ID NO: 4995707 - DNA, 23 bp, Homo sapiens
actaaccagggaagctgtccctc

SEQ ID NO: 4995708 - DNA, 16 bp, Homo sapiens
actaagaaagaaagga

SEQ ID NO: 4995709 - DNA, 11 bp, Homo sapiens
actacaaaaag

SEQ ID NO: 4995710 - DNA, 16 bp, Homo sapiens
actacaaaaagaagag

SEQ ID NO: 4995711 - DNA, 13 bp, Homo sapiens
actacatctgcct

SEQ ID NO: 4995712 - DNA, 21 bp, Homo sapiens
actcggatgtgtcctttctga

SEQ ID NO: 4995713 - DNA, 21 bp, Homo sapiens
actctgttattgatcccttct

SEQ ID NO: 4995714 - DNA, 20 bp, Homo sapiens
actctttaagttgaaaagta

SEQ ID NO: 4995715 - DNA, 23 bp, Homo sapiens
actctttaagttgaaaagtaaaa

SEQ ID NO: 4995716 - DNA, 16 bp, Homo sapiens
actgcttctctttgtg

SEQ ID NO: 4995717 - DNA, 21 bp, Homo sapiens
actgcttctctttgtgcagtg

SEQ ID NO: 4995718 - DNA, 20 bp, Homo sapiens
actgctttattttccctact

SEQ ID NO: 4995719 - DNA, 18 bp, Homo sapiens
actgtattaaagaaaaat

SEQ ID NO: 4995720 - DNA, 17 bp, Homo sapiens
actgtatttcagtattt

SEQ ID NO: 4995721 - DNA, 20 bp, Homo sapiens
actgtggccatatatgctgt

SEQ ID NO: 4995722 - DNA, 14 bp, Homo sapiens
acttagaatgccat

SEQ ID NO: 4995723 - DNA, 17 bp, Homo sapiens
acttgttttatgctcag

SEQ ID NO: 4995724 - DNA, 13 bp, Homo sapiens
agaaaaaggatgg

SEQ ID NO: 4995725 - DNA, 22 bp, Homo sapiens
agaaaaaggatggaagaaagaa

SEQ ID NO: 4995726 - DNA, 20 bp, Homo sapiens
agaaaatggaaagaaggaaa

SEQ ID NO: 4995727 - DNA, 17 bp, Homo sapiens
agaaagaaaggaaagaa

SEQ ID NO: 4995728 - DNA, 12 bp, Homo sapiens
agaaagaagcat

SEQ ID NO: 4995729 - DNA, 19 bp, Homo sapiens
agaaagccaccttgttaca

SEQ ID NO: 4995730 - DNA, 18 bp, Homo sapiens
agaaaggaaagaaggaga

SEQ ID NO: 4995731 - DNA, 16 bp, Homo sapiens
agaaggaaaaaaggag

SEQ ID NO: 4995732 - DNA, 15 bp, Homo sapiens
agaagttttttactt

SEQ ID NO: 4995733 - DNA, 20 bp, Homo sapiens
agaagttttttactttggtt

SEQ ID NO: 4995734 - DNA, 13 bp, Homo sapiens
agaataggattaa

SEQ ID NO: 4995735 - DNA, 22 bp, Homo sapiens
agaatgccataaaattgcagtt

SEQ ID NO: 4995736 - DNA, 19 bp, Homo sapiens
agaccatctgtatgttagg

SEQ ID NO: 4995737 - DNA, 13 bp, Homo sapiens
agacctttatcca

SEQ ID NO: 4995738 - DNA, 20 bp, Homo sapiens
agactttgctgttactgctt

SEQ ID NO: 4995739 - DNA, 15 bp, Homo sapiens
agagatgaaataatt

SEQ ID NO: 4995740 - DNA, 17 bp, Homo sapiens
agaggttttatttacat

SEQ ID NO: 4995741 - DNA, 18 bp, Homo sapiens
agagtgcattgtgagggt

SEQ ID NO: 4995742 - DNA, 19 bp, Homo sapiens
agagttgttgtttgccaag

SEQ ID NO: 4995743 - DNA, 21 bp, Homo sapiens
agataagtctacattaaacaa

SEQ ID NO: 4995744 - DNA, 19 bp, Homo sapiens
agatattatatacaacaca

SEQ ID NO: 4995745 - DNA, 15 bp, Homo sapiens
agatgaatagaagaa

SEQ ID NO: 4995746 - DNA, 19 bp, Homo sapiens
agatgaatagaagaaagaa

SEQ ID NO: 4995747 - DNA, 15 bp, Homo sapiens
agatggagcaaatgt

SEQ ID NO: 4995748 - DNA, 17 bp, Homo sapiens
agattagggaaaatgga

SEQ ID NO: 4995749 - DNA, 15 bp, Homo sapiens
agatttaagccttga

SEQ ID NO: 4995750 - DNA, 17 bp, Homo sapiens
agatttaagccttgaca

SEQ ID NO: 4995751 - DNA, 20 bp, Homo sapiens
agatttaagccttgacacac

SEQ ID NO: 4995752 - DNA, 21 bp, Homo sapiens
agatttactgctctagaaagt

SEQ ID NO: 4995753 - DNA, 21 bp, Homo sapiens
agatttttttcatagatttga

SEQ ID NO: 4995754 - DNA, 15 bp, Homo sapiens
agcacatctgcattt

SEQ ID NO: 4995755 - DNA, 23 bp, Homo sapiens
agcacatctgcattttcacccca

SEQ ID NO: 4995756 - DNA, 21 bp, Homo sapiens
agcattaactaaatgctcata

SEQ ID NO: 4995757 - DNA, 18 bp, Homo sapiens
agcatttttccatctgtg

SEQ ID NO: 4995758 - DNA, 14 bp, Homo sapiens
agccaaaccctgtc

SEQ ID NO: 4995759 - DNA, 17 bp, Homo sapiens
agcccagttgttgcagt

SEQ ID NO: 4995760 - DNA, 22 bp, Homo sapiens
agcccatttctgttaacctctt

SEQ ID NO: 4995761 - DNA, 23 bp, Homo sapiens
agcctccggagtagctgggacca

SEQ ID NO: 4995762 - DNA, 14 bp, Homo sapiens
agccttatgtgtta

SEQ ID NO: 4995763 - DNA, 23 bp, Homo sapiens
agctaatctgcctggttttattt

SEQ ID NO: 4995764 - DNA, 18 bp, Homo sapiens
agctactgtagaaaggaa

SEQ ID NO: 4995765 - DNA, 20 bp, Homo sapiens
agctactgtagaaaggaaat

SEQ ID NO: 4995766 - DNA, 14 bp, Homo sapiens
agctagaatttctg

SEQ ID NO: 4995767 - DNA, 14 bp, Homo sapiens
agctagtgccaaat

SEQ ID NO: 4995768 - DNA, 20 bp, Homo sapiens
agctagtgccaaataattga

SEQ ID NO: 4995769 - DNA, 22 bp, Homo sapiens
agctgactccagtataatctcc

SEQ ID NO: 4995770 - DNA, 15 bp, Homo sapiens
agcttaaagcttgat

SEQ ID NO: 4995771 - DNA, 17 bp, Homo sapiens
agcttgatttgatcttt

SEQ ID NO: 4995772 - DNA, 16 bp, Homo sapiens
agctttatctttgtgt

SEQ ID NO: 4995773 - DNA, 17 bp, Homo sapiens
agctttatctttgtgta

SEQ ID NO: 4995774 - DNA, 23 bp, Homo sapiens
agctttatctttgtgtaatctaa

SEQ ID NO: 4995775 - DNA, 15 bp, Homo sapiens
aggaaagaaggagat

SEQ ID NO: 4995776 - DNA, 14 bp, Homo sapiens
aggaaatctcaccc

SEQ ID NO: 4995777 - DNA, 16 bp, Homo sapiens
aggaaatctcacccca

SEQ ID NO: 4995778 - DNA, 23 bp, Homo sapiens
aggaccgttttgtattgcttcct

SEQ ID NO: 4995779 - DNA, 19 bp, Homo sapiens
aggagatgaatagaagaaa

SEQ ID NO: 4995780 - DNA, 19 bp, Homo sapiens
aggaggatagaaaaaggat

SEQ ID NO: 4995781 - DNA, 14 bp, Homo sapiens
aggatagaaaaagg

SEQ ID NO: 4995782 - DNA, 19 bp, Homo sapiens
aggatagaaaaaggatgga

SEQ ID NO: 4995783 - DNA, 14 bp, Homo sapiens
aggatggaagaaag

SEQ ID NO: 4995784 - DNA, 15 bp, Homo sapiens
aggatggaagaaaga

SEQ ID NO: 4995785 - DNA, 16 bp, Homo sapiens
aggatggaagaaagaa

SEQ ID NO: 4995786 - DNA, 13 bp, Homo sapiens
aggctatcctgct

SEQ ID NO: 4995787 - DNA, 19 bp, Homo sapiens
ctatattaaatgagggttt

SEQ ID NO: 4995788 - DNA, 14 bp, Homo sapiens
ctatcctgctgaaa

SEQ ID NO: 4995789 - DNA, 17 bp, Homo sapiens
ctatctagcatttattt

SEQ ID NO: 4995790 - DNA, 18 bp, Homo sapiens
ctatctatacctgccttt

SEQ ID NO: 4995791 - DNA, 19 bp, Homo sapiens
ctatctatacctgcctttt

SEQ ID NO: 4995792 - DNA, 17 bp, Homo sapiens
ctatggagactttgctg

SEQ ID NO: 4995793 - DNA, 18 bp, Homo sapiens
ctatggagactttgctgt

SEQ ID NO: 4995794 - DNA, 19 bp, Homo sapiens
ctatggagactttgctgtt

SEQ ID NO: 4995795 - DNA, 23 bp, Homo sapiens
ctatggagactttgctgttactg

SEQ ID NO: 4995796 - DNA, 13 bp, Homo sapiens
ctatttctgaaag

SEQ ID NO: 4995797 - DNA, 21 bp, Homo sapiens
ctcacagtgttgcccaggctg

SEQ ID NO: 4995798 - DNA, 19 bp, Homo sapiens
ctcaccccatcccacaccc

SEQ ID NO: 4995799 - DNA, 21 bp, Homo sapiens
ctcaccccatcccacaccctg

SEQ ID NO: 4995800 - DNA, 13 bp, Homo sapiens
ctcagcctcccag

SEQ ID NO: 4995801 - DNA, 17 bp, Homo sapiens
ctcatgcaaactgcttt

SEQ ID NO: 4995802 - DNA, 18 bp, Homo sapiens
ctcatgcaaactgcttta

SEQ ID NO: 4995803 - DNA, 19 bp, Homo sapiens
ctcatgcaaactgctttat

SEQ ID NO: 4995804 - DNA, 20 bp, Homo sapiens
ctcattaaactctaaagatt

SEQ ID NO: 4995805 - DNA, 15 bp, Homo sapiens
ctcccacccccatct

SEQ ID NO: 4995806 - DNA, 19 bp, Homo sapiens
ctcccacccccatctctcc

SEQ ID NO: 4995807 - DNA, 20 bp, Homo sapiens
ctcccacccccatctctccc

SEQ ID NO: 4995808 - DNA, 14 bp, Homo sapiens
ctccccggctcgag

SEQ ID NO: 4995809 - DNA, 15 bp, Homo sapiens
ctccctcccctgcca

SEQ ID NO: 4995810 - DNA, 14 bp, Homo sapiens
ctccctttttatat

SEQ ID NO: 4995811 - DNA, 17 bp, Homo sapiens
ctctccctcccctgcca

SEQ ID NO: 4995812 - DNA, 18 bp, Homo sapiens
ctctgctggcccagccaa

SEQ ID NO: 4995813 - DNA, 15 bp, Homo sapiens
ctcttaaatcatttg

SEQ ID NO: 4995814 - DNA, 15 bp, Homo sapiens
ctcttattttacaat

SEQ ID NO: 4995815 - DNA, 14 bp, Homo sapiens
ctgaaatacaacca

SEQ ID NO: 4995816 - DNA, 16 bp, Homo sapiens
ctgaattgagaataag

SEQ ID NO: 4995817 - DNA, 14 bp, Homo sapiens
ctgacagcctccca

SEQ ID NO: 4995818 - DNA, 13 bp, Homo sapiens
ctgatctgtactt

SEQ ID NO: 4995819 - DNA, 16 bp, Homo sapiens
ctgatctgtactttgt

SEQ ID NO: 4995820 - DNA, 21 bp, Homo sapiens
ctgatctgtactttgtgttta

SEQ ID NO: 4995821 - DNA, 21 bp, Homo sapiens
ctgatctgtataaaaatgtaa

SEQ ID NO: 4995822 - DNA, 20 bp, Homo sapiens
ctgcaagcatttttccatct

SEQ ID NO: 4995823 - DNA, 18 bp, Homo sapiens
ctgcagcctttgcctccc

SEQ ID NO: 4995824 - DNA, 17 bp, Homo sapiens
ctgcattttcaccccac

SEQ ID NO: 4995825 - DNA, 21 bp, Homo sapiens
ctgcctcattttcacagcact

SEQ ID NO: 4995826 - DNA, 15 bp, Homo sapiens
ctgcctggttttatt

SEQ ID NO: 4995827 - DNA, 15 bp, Homo sapiens
ctgcctgtaattaaa

SEQ ID NO: 4995828 - DNA, 17 bp, Homo sapiens
ctgctgaaagtcctgct

SEQ ID NO: 4995829 - DNA, 22 bp, Homo sapiens
ctggcatcgcagcttcctgtct

SEQ ID NO: 4995830 - DNA, 13 bp, Homo sapiens
ctggcccagccaa

SEQ ID NO: 4995831 - DNA, 20 bp, Homo sapiens
ctggcccagccaaaccctgt

SEQ ID NO: 4995832 - DNA, 18 bp, Homo sapiens
ctgggcagtgagtgccat

SEQ ID NO: 4995833 - DNA, 22 bp, Homo sapiens
ctgggtctcgctttgttgccca

SEQ ID NO: 4995834 - DNA, 16 bp, Homo sapiens
ctgggttcatttgtga

SEQ ID NO: 4995835 - DNA, 16 bp, Homo sapiens
ctgtaatcccagcact

SEQ ID NO: 4995836 - DNA, 17 bp, Homo sapiens
ctgtaatcccagcactt

SEQ ID NO: 4995837 - DNA, 16 bp, Homo sapiens
ctgtactgaagaacag

SEQ ID NO: 4995838 - DNA, 13 bp, Homo sapiens
ctgtactttgtgt

SEQ ID NO: 4995839 - DNA, 18 bp, Homo sapiens
ctgtagaaaggaaataga

SEQ ID NO: 4995840 - DNA, 15 bp, Homo sapiens
ctgtataaaaatgta

SEQ ID NO: 4995841 - DNA, 13 bp, Homo sapiens
ctgtatttcagta

SEQ ID NO: 4995842 - DNA, 20 bp, Homo sapiens
ctgtatttcagtattttcca

SEQ ID NO: 4995843 - DNA, 17 bp, Homo sapiens
ctgtatttctttgtaga

SEQ ID NO: 4995844 - DNA, 14 bp, Homo sapiens
ctgtctcagcctcc

SEQ ID NO: 4995845 - DNA, 15 bp, Homo sapiens
ctgtctcagcctccc

SEQ ID NO: 4995846 - DNA, 16 bp, Homo sapiens
ctgtgaaatgctggca

SEQ ID NO: 4995847 - DNA, 23 bp, Homo sapiens
ctgtggccatatatgctgtattt

SEQ ID NO: 4995848 - DNA, 12 bp, Homo sapiens
ctgtgtaaaatc

SEQ ID NO: 4995849 - DNA, 21 bp, Homo sapiens
ctgtgtgcaactaactgactc

SEQ ID NO: 4995850 - DNA, 13 bp, Homo sapiens
ctgttactgcttc

SEQ ID NO: 4995851 - DNA, 23 bp, Homo sapiens
ctgttcagttagagtgagtgctg

SEQ ID NO: 4995852 - DNA, 19 bp, Homo sapiens
ctgtttatatattgaaagt

SEQ ID NO: 4995853 - DNA, 19 bp, Homo sapiens
ctgtttttcttctgaaata

SEQ ID NO: 4995854 - DNA, 21 bp, Homo sapiens
ctgtttttcttctgaaataca

SEQ ID NO: 4995855 - DNA, 14 bp, Homo sapiens
cttaaagcttgatt

SEQ ID NO: 4995856 - DNA, 17 bp, Homo sapiens
cttaaagcttgatttga

SEQ ID NO: 4995857 - DNA, 19 bp, Homo sapiens
cttaaatgagttacttaga

SEQ ID NO: 4995858 - DNA, 14 bp, Homo sapiens
cttaactgtatttc

SEQ ID NO: 4995859 - DNA, 15 bp, Homo sapiens
cttagttgatattca

SEQ ID NO: 4995860 - DNA, 17 bp, Homo sapiens
cttatcactaagaaaga

SEQ ID NO: 4995861 - DNA, 18 bp, Homo sapiens
cttatcactaagaaagaa

SEQ ID NO: 4995862 - DNA, 15 bp, Homo sapiens
cttatgtgttacatt

SEQ ID NO: 4995863 - DNA, 17 bp, Homo sapiens
cttatgtgttacattat

SEQ ID NO: 4995864 - DNA, 21 bp, Homo sapiens
cttcagaggctcatctaactc

SEQ ID NO: 4995865 - DNA, 13 bp, Homo sapiens
cttcagctgactc

SEQ ID NO: 4995866 - DNA, 19 bp, Homo sapiens
cttcctgattaccagtctg

SEQ ID NO: 4995867 - DNA, 14 bp, Homo sapiens
cttcctgtctgttt

SEQ ID NO: 4995868 - DNA, 16 bp, Homo sapiens
cttcctgtctgtttat

SEQ ID NO: 4995869 - DNA, 18 bp, Homo sapiens
cttctccaattctgaaat

SEQ ID NO: 4995870 - DNA, 23 bp, Homo sapiens
cttctctgtttttcttctgaaat

SEQ ID NO: 4995871 - DNA, 15 bp, Homo sapiens
cttctgaaatacaac

SEQ ID NO: 4995872 - DNA, 17 bp, Homo sapiens
cttcttacagaagtatt

SEQ ID NO: 4995873 - DNA, 14 bp, Homo sapiens
cttgcagaaaatga

SEQ ID NO: 4995874 - DNA, 15 bp, Homo sapiens
cttggttgttaattt

SEQ ID NO: 4995875 - DNA, 12 bp, Homo sapiens
cttgttattaat

SEQ ID NO: 4995876 - DNA, 21 bp, Homo sapiens
cttgttccccactgacagcct

SEQ ID NO: 4995877 - DNA, 19 bp, Homo sapiens
ctttaaaagtcattattcc

SEQ ID NO: 4995878 - DNA, 14 bp, Homo sapiens
ctttaaagataagt

SEQ ID NO: 4995879 - DNA, 15 bp, Homo sapiens
ctttatctttgtgta

SEQ ID NO: 4995880 - DNA, 19 bp, Homo sapiens
ctttcccaggtaatttaaa

SEQ ID NO: 4995881 - DNA, 19 bp, Homo sapiens
ctttcctatctagcattta

SEQ ID NO: 4995882 - DNA, 23 bp, Homo sapiens
ctttctgagtgagttttactctt

SEQ ID NO: 4995883 - DNA, 17 bp, Homo sapiens
ctttgagactgggtctc

SEQ ID NO: 4995884 - DNA, 14 bp, Homo sapiens
ctttgctgttactg

SEQ ID NO: 4995885 - DNA, 18 bp, Homo sapiens
ctttgtagaataaatggt

SEQ ID NO: 4995886 - DNA, 13 bp, Homo sapiens
ctttgtgtaatct

SEQ ID NO: 4995887 - DNA, 18 bp, Homo sapiens
ctttgtgtaatctaagta

SEQ ID NO: 4995888 - DNA, 14 bp, Homo sapiens
ctttgtgtttagct

SEQ ID NO: 4995889 - DNA, 22 bp, Homo sapiens
ctttgttcaataaaggaaatat

SEQ ID NO: 4995890 - DNA, 16 bp, Homo sapiens
ctttgttgcccaggct

SEQ ID NO: 4995891 - DNA, 21 bp, Homo sapiens
cttttgagtatggctatctat

SEQ ID NO: 4995892 - DNA, 21 bp, Homo sapiens
ctttttaagttattgtacaag

SEQ ID NO: 4995893 - DNA, 13 bp, Homo sapiens
cttttttaaagta

SEQ ID NO: 4995894 - DNA, 21 bp, Homo sapiens
ctttttttccttcctttttat

SEQ ID NO: 4995895 - DNA, 20 bp, Homo sapiens
gaaaaatgcccatttttgct

SEQ ID NO: 4995896 - DNA, 14 bp, Homo sapiens
gaaaacaaagacat

SEQ ID NO: 4995897 - DNA, 22 bp, Homo sapiens
gaaaatatttgcacacatttaa

SEQ ID NO: 4995898 - DNA, 14 bp, Homo sapiens
gaaaatggaaagaa

SEQ ID NO: 4995899 - DNA, 15 bp, Homo sapiens
gaaaatggaaagaag

SEQ ID NO: 4995900 - DNA, 16 bp, Homo sapiens
gaaaatggaaagaagg

SEQ ID NO: 4995901 - DNA, 21 bp, Homo sapiens
gaaaatggaaagaaggaaaaa

SEQ ID NO: 4995902 - DNA, 21 bp, Homo sapiens
tatttaactttgcaaaaagat

SEQ ID NO: 4995903 - DNA, 19 bp, Homo sapiens
tatttagactgtggccata

SEQ ID NO: 4995904 - DNA, 21 bp, Homo sapiens
tatttagactgtggccatata

SEQ ID NO: 4995905 - DNA, 19 bp, Homo sapiens
tatttagttacgtataatg

SEQ ID NO: 4995906 - DNA, 22 bp, Homo sapiens
tatttagttacgtataatgctt

SEQ ID NO: 4995907 - DNA, 18 bp, Homo sapiens
tatttcagtattttccag

SEQ ID NO: 4995908 - DNA, 20 bp, Homo sapiens
tatttctctggcaaactttt

SEQ ID NO: 4995909 - DNA, 12 bp, Homo sapiens
tatttctgaaag

SEQ ID NO: 4995910 - DNA, 16 bp, Homo sapiens
tatttctttgtagaat

SEQ ID NO: 4995911 - DNA, 17 bp, Homo sapiens
tatttctttgtagaata

SEQ ID NO: 4995912 - DNA, 13 bp, Homo sapiens
tattttgtgaata

SEQ ID NO: 4995913 - DNA, 14 bp, Homo sapiens
tcaagtctctgctg

SEQ ID NO: 4995914 - DNA, 16 bp, Homo sapiens
tcaagtctctgctggc

SEQ ID NO: 4995915 - DNA, 18 bp, Homo sapiens
tcaataaaagcctttgaa

SEQ ID NO: 4995916 - DNA, 22 bp, Homo sapiens
tcaataaaagcctttgaaaata

SEQ ID NO: 4995917 - DNA, 20 bp, Homo sapiens
tcaatttggagcattaacta

SEQ ID NO: 4995918 - DNA, 20 bp, Homo sapiens
tcacaaattccgattagacc

SEQ ID NO: 4995919 - DNA, 15 bp, Homo sapiens
tcacatctaaagctt

SEQ ID NO: 4995920 - DNA, 16 bp, Homo sapiens
tcacatctaaagcttt

SEQ ID NO: 4995921 - DNA, 17 bp, Homo sapiens
tcacatctaaagcttta

SEQ ID NO: 4995922 - DNA, 19 bp, Homo sapiens
tcacatctaaagctttatc

SEQ ID NO: 4995923 - DNA, 13 bp, Homo sapiens
tcaccccaccctt

SEQ ID NO: 4995924 - DNA, 12 bp, Homo sapiens
tcaccccatccc

SEQ ID NO: 4995925 - DNA, 19 bp, Homo sapiens
tcaccccatcccacaccct

SEQ ID NO: 4995926 - DNA, 15 bp, Homo sapiens
tcactaagaaagaaa

SEQ ID NO: 4995927 - DNA, 16 bp, Homo sapiens
tcactaagaaagaaag

SEQ ID NO: 4995928 - DNA, 19 bp, Homo sapiens
tcactaagaaagaaaggaa

SEQ ID NO: 4995929 - DNA, 21 bp, Homo sapiens
tcactaagaaagaaaggaaag

SEQ ID NO: 4995930 - DNA, 16 bp, Homo sapiens
tcactacaaaaagaag

SEQ ID NO: 4995931 - DNA, 21 bp, Homo sapiens
tcactcatgcaaactgcttta

SEQ ID NO: 4995932 - DNA, 22 bp, Homo sapiens
tcactcatgcaaactgctttat

SEQ ID NO: 4995933 - DNA, 19 bp, Homo sapiens
tcagaattggcataatttg

SEQ ID NO: 4995934 - DNA, 21 bp, Homo sapiens
tcagctttagaaattaatacc

SEQ ID NO: 4995935 - DNA, 15 bp, Homo sapiens
tcagtattttccagc

SEQ ID NO: 4995936 - DNA, 19 bp, Homo sapiens
tcagtttttttttttccag

SEQ ID NO: 4995937 - DNA, 13 bp, Homo sapiens
tcataaagaaaaa

SEQ ID NO: 4995938 - DNA, 15 bp, Homo sapiens
tcatagattgcaaat

SEQ ID NO: 4995939 - DNA, 19 bp, Homo sapiens
tcatagatttgaaaaactt

SEQ ID NO: 4995940 - DNA, 17 bp, Homo sapiens
tcatgcaaactgcttta

SEQ ID NO: 4995941 - DNA, 22 bp, Homo sapiens
tcatgccaccatggccagccaa

SEQ ID NO: 4995942 - DNA, 14 bp, Homo sapiens
tcatggtagatttt

SEQ ID NO: 4995943 - DNA, 16 bp, Homo sapiens
tcatgtaagatggcaa

SEQ ID NO: 4995944 - DNA, 16 bp, Homo sapiens
tcatgtacatttgaaa

SEQ ID NO: 4995945 - DNA, 15 bp, Homo sapiens
tcatgtatgtatata

SEQ ID NO: 4995946 - DNA, 16 bp, Homo sapiens
tcatgtatgtatataa

SEQ ID NO: 4995947 - DNA, 15 bp, Homo sapiens
tcattaaactgattc

SEQ ID NO: 4995948 - DNA, 16 bp, Homo sapiens
tcatttctagagaaaa

SEQ ID NO: 4995949 - DNA, 16 bp, Homo sapiens
tcatttggcttgctgt

SEQ ID NO: 4995950 - DNA, 19 bp, Homo sapiens
tcatttggcttgctgttta

SEQ ID NO: 4995951 - DNA, 21 bp, Homo sapiens
tccaaaataatctatattaaa

SEQ ID NO: 4995952 - DNA, 15 bp, Homo sapiens
tccaattctgaaata

SEQ ID NO: 4995953 - DNA, 20 bp, Homo sapiens
tccaattctgaaatactttt

SEQ ID NO: 4995954 - DNA, 13 bp, Homo sapiens
tccacctgtctca

SEQ ID NO: 4995955 - DNA, 17 bp, Homo sapiens
tccacctgtctcagcct

SEQ ID NO: 4995956 - DNA, 20 bp, Homo sapiens
tccacctgtctcagcctccc

SEQ ID NO: 4995957 - DNA, 20 bp, Homo sapiens
tccagccttatgtgttacat

SEQ ID NO: 4995958 - DNA, 23 bp, Homo sapiens
tccaggagattggatttgctgtg

SEQ ID NO: 4995959 - DNA, 19 bp, Homo sapiens
tcccagcacctattgaatt

SEQ ID NO: 4995960 - DNA, 20 bp, Homo sapiens
tcccagcacctattgaatta

SEQ ID NO: 4995961 - DNA, 17 bp, Homo sapiens
tcccaggtaatttaaat

SEQ ID NO: 4995962 - DNA, 19 bp, Homo sapiens
tcccaggtaatttaaattg

SEQ ID NO: 4995963 - DNA, 19 bp, Homo sapiens
tccccaatccatgcttcac

SEQ ID NO: 4995964 - DNA, 16 bp, Homo sapiens
tccccatggtagttta

SEQ ID NO: 4995965 - DNA, 14 bp, Homo sapiens
tcccggggctccac

SEQ ID NO: 4995966 - DNA, 20 bp, Homo sapiens
tccctttttatatcccattt

SEQ ID NO: 4995967 - DNA, 15 bp, Homo sapiens
tccggagtagctggg

SEQ ID NO: 4995968 - DNA, 15 bp, Homo sapiens
tcctatctagcattt

SEQ ID NO: 4995969 - DNA, 23 bp, Homo sapiens
tcctatctagcatttatttctct

SEQ ID NO: 4995970 - DNA, 21 bp, Homo sapiens
tcctgctgaaagtcctgcttt

SEQ ID NO: 4995971 - DNA, 22 bp, Homo sapiens
tcctgctgaaagtcctgctttc

SEQ ID NO: 4995972 - DNA, 12 bp, Homo sapiens
tcctgggctcag

SEQ ID NO: 4995973 - DNA, 20 bp, Homo sapiens
tccttcagctgactccagta

SEQ ID NO: 4995974 - DNA, 16 bp, Homo sapiens
tccttcctttttattc

SEQ ID NO: 4995975 - DNA, 22 bp, Homo sapiens
tcgagcagtcctgcctcagcct

SEQ ID NO: 4995976 - DNA, 14 bp, Homo sapiens
tcgggaattttccc

SEQ ID NO: 4995977 - DNA, 15 bp, Homo sapiens
tctaagtatatgtga

SEQ ID NO: 4995978 - DNA, 16 bp, Homo sapiens
tctagcatttatttct

SEQ ID NO: 4995979 - DNA, 19 bp, Homo sapiens
tctagcatttatttctctg

SEQ ID NO: 4995980 - DNA, 15 bp, Homo sapiens
tctatacctgccttt

SEQ ID NO: 4995981 - DNA, 18 bp, Homo sapiens
tctatggagactttgctg

SEQ ID NO: 4995982 - DNA, 14 bp, Homo sapiens
tctatttctgaaag

SEQ ID NO: 4995983 - DNA, 15 bp, Homo sapiens
tctccaattctgaaa

SEQ ID NO: 4995984 - DNA, 20 bp, Homo sapiens
tctccaattctgaaatactt

SEQ ID NO: 4995985 - DNA, 18 bp, Homo sapiens
tctccccaatccatgctt

SEQ ID NO: 4995986 - DNA, 21 bp, Homo sapiens
tctccccaatccatgcttcac

SEQ ID NO: 4995987 - DNA, 14 bp, Homo sapiens
tctcctctgctcat

SEQ ID NO: 4995988 - DNA, 19 bp, Homo sapiens
tctcctctgctcattaaac

SEQ ID NO: 4995989 - DNA, 21 bp, Homo sapiens
tctcctctgctcattaaactg

SEQ ID NO: 4995990 - DNA, 18 bp, Homo sapiens
tctcctgccctttcccag

SEQ ID NO: 4995991 - DNA, 15 bp, Homo sapiens
tctctactaaaaata

SEQ ID NO: 4995992 - DNA, 16 bp, Homo sapiens
tctctgctggcccagc

SEQ ID NO: 4995993 - DNA, 19 bp, Homo sapiens
tctctgctggcccagccaa

SEQ ID NO: 4995994 - DNA, 18 bp, Homo sapiens
tctctggcaaacttttct

SEQ ID NO: 4995995 - DNA, 21 bp, Homo sapiens
tctgaaatacaaccagaaaca

SEQ ID NO: 4995996 - DNA, 22 bp, Homo sapiens
tctgatctgtactttgtgttta

SEQ ID NO: 4995997 - DNA, 22 bp, Homo sapiens
tctgatctgtataaaaatgtaa

SEQ ID NO: 4995998 - DNA, 21 bp, Homo sapiens
tctgattataccatgtgtgct

SEQ ID NO: 4995999 - DNA, 21 bp, Homo sapiens
tctgcctggttttatttatat

SEQ ID NO: 4996000 - DNA, 20 bp, Homo sapiens
tctgctggcccagccaaacc

SEQ ID NO: 4996001 - DNA, 18 bp, Homo sapiens
tctggcaaacttttcttt

SEQ ID NO: 4996002 - DNA, 20 bp, Homo sapiens
tctggggaagaggttttatt

SEQ ID NO: 4996003 - DNA, 21 bp, Homo sapiens
tctggggaagaggttttattt

SEQ ID NO: 4996004 - DNA, 12 bp, Homo sapiens
tctgtgttgctt

SEQ ID NO: 4996005 - DNA, 13 bp, Homo sapiens
tcttaaatcattt

SEQ ID NO: 4996006 - DNA, 19 bp, Homo sapiens
tcttcagaggctcatctaa

SEQ ID NO: 4996007 - DNA, 11 bp, Homo sapiens
tcttctgaaat

SEQ ID NO: 4996008 - DNA, 14 bp, Homo sapiens
tcttgagaatgatt

SEQ ID NO: 4996009 - DNA, 19 bp, Homo sapiens
tcttggcttactgcagcct

SEQ ID NO: 4996010 - DNA, 24 bp, Homo sapiens
tctttcttttcttttttaaagtaa

SEQ ID NO: 4996011 - DNA, 16 bp, Homo sapiens
tctttgtagaataaat

SEQ ID NO: 4996012 - DNA, 20 bp, Homo sapiens
tctttgtagaataaatggtt

SEQ ID NO: 4996013 - DNA, 16 bp, Homo sapiens
tctttgtttaaatgcc

SEQ ID NO: 4996014 - DNA, 17 bp, Homo sapiens
tctttgtttaaatgcca

SEQ ID NO: 4996015 - DNA, 14 bp, Homo sapiens
tcttttacattctg

SEQ ID NO: 4996016 - DNA, 16 bp, Homo sapiens
tttgccaagctaatct

SEQ ID NO: 4996017 - DNA, 13 bp, Homo sapiens
tttgctgttactg

SEQ ID NO: 4996018 - DNA, 15 bp, Homo sapiens
tttggacttatctat

SEQ ID NO: 4996019 - DNA, 11 bp, Homo sapiens
tttggatgtgt

SEQ ID NO: 4996020 - DNA, 17 bp, Homo sapiens
ttttaaacaaaatttca

SEQ ID NO: 4996021 - DNA, 19 bp, Homo sapiens
ttttaaacaaaatttcaca

SEQ ID NO: 4996022 - DNA, 17 bp, Homo sapiens
ttttaattaaaaacttt

SEQ ID NO: 4996023 - DNA, 19 bp, Homo sapiens
ttttaattaaaaactttaa

SEQ ID NO: 4996024 - DNA, 11 bp, Homo sapiens
ttttactttgg

SEQ ID NO: 4996025 - DNA, 15 bp, Homo sapiens
ttttactttggttta

SEQ ID NO: 4996026 - DNA, 22 bp, Homo sapiens
ttttactttggtttagtctttt

SEQ ID NO: 4996027 - DNA, 15 bp, Homo sapiens
ttttaggttgttacc

SEQ ID NO: 4996028 - DNA, 15 bp, Homo sapiens
ttttattttcattgt

SEQ ID NO: 4996029 - DNA, 13 bp, Homo sapiens
ttttcaatttgga

SEQ ID NO: 4996030 - DNA, 13 bp, Homo sapiens
ttttcaccccacc

SEQ ID NO: 4996031 - DNA, 17 bp, Homo sapiens
ttttccagccttatgtg

SEQ ID NO: 4996032 - DNA, 19 bp, Homo sapiens
ttttccagccttatgtgtt

SEQ ID NO: 4996033 - DNA, 22 bp, Homo sapiens
ttttccccgtgacattcactgg

SEQ ID NO: 4996034 - DNA, 19 bp, Homo sapiens
ttttccttcctttttattc

SEQ ID NO: 4996035 - DNA, 17 bp, Homo sapiens
tttttaattaaaaactt

SEQ ID NO: 4996036 - DNA, 12 bp, Homo sapiens
tttttgctaatt

SEQ ID NO: 4996037 - DNA, 12 bp, Homo sapiens
ttttttactttg

SEQ ID NO: 4996038 - DNA, 12 bp, Homo sapiens
ttttttttaagt

SEQ ID NO: 4996039 - DNA, 14 bp, Homo sapiens
aaaaacatttgtca

SEQ ID NO: 4996040 - DNA, 20 bp, Homo sapiens
aaaaacttttaggttgttac

SEQ ID NO: 4996041 - DNA, 12 bp, Homo sapiens
aaaaagaagagt

SEQ ID NO: 4996042 - DNA, 22 bp, Homo sapiens
aaaaatcaaatcatgtacattt

SEQ ID NO: 4996043 - DNA, 13 bp, Homo sapiens
aaaacaaagacat

SEQ ID NO: 4996044 - DNA, 14 bp, Homo sapiens
aaaacagacaataa

SEQ ID NO: 4996045 - DNA, 18 bp, Homo sapiens
aaaagagtgaatgtaata

SEQ ID NO: 4996046 - DNA, 18 bp, Homo sapiens
aaaaggatggaagaaaga

SEQ ID NO: 4996047 - DNA, 19 bp, Homo sapiens
aaaaggatggaagaaagaa

SEQ ID NO: 4996048 - DNA, 21 bp, Homo sapiens
aaaataatctatattaaatga

SEQ ID NO: 4996049 - DNA, 19 bp, Homo sapiens
aaaatcagtttttgactga

SEQ ID NO: 4996050 - DNA, 16 bp, Homo sapiens
aaaatgtaaattagtt

SEQ ID NO: 4996051 - DNA, 21 bp, Homo sapiens
aaaatgtaaattagtttgaca

SEQ ID NO: 4996052 - DNA, 18 bp, Homo sapiens
aaaatgtacttaaatgag

SEQ ID NO: 4996053 - DNA, 18 bp, Homo sapiens
aaaatgtagttttaaata

SEQ ID NO: 4996054 - DNA, 15 bp, Homo sapiens
aaacaaagacattct

SEQ ID NO: 4996055 - DNA, 17 bp, Homo sapiens
aaacatctgatctgtat

SEQ ID NO: 4996056 - DNA, 17 bp, Homo sapiens
aaacggtgcaacagaag

SEQ ID NO: 4996057 - DNA, 20 bp, Homo sapiens
aaacggtgcaacagaagggt

SEQ ID NO: 4996058 - DNA, 21 bp, Homo sapiens
aaactagtttaagggtggaaa

SEQ ID NO: 4996059 - DNA, 13 bp, Homo sapiens
aaacttgtgtatt

SEQ ID NO: 4996060 - DNA, 18 bp, Homo sapiens
aaagaaaaatccggaaaa

SEQ ID NO: 4996061 - DNA, 20 bp, Homo sapiens
aaagaaaatggaaagaagga

SEQ ID NO: 4996062 - DNA, 14 bp, Homo sapiens
aaagaaaggaaaga

SEQ ID NO: 4996063 - DNA, 15 bp, Homo sapiens
aaagaaattagccta

SEQ ID NO: 4996064 - DNA, 14 bp, Homo sapiens
aaagacatctgcct

SEQ ID NO: 4996065 - DNA, 19 bp, Homo sapiens
aaagcttgatttgatcttt

SEQ ID NO: 4996066 - DNA, 20 bp, Homo sapiens
aaagcttgatttgatctttg

SEQ ID NO: 4996067 - DNA, 15 bp, Homo sapiens
aaaggaaagaaggag

SEQ ID NO: 4996068 - DNA, 18 bp, Homo sapiens
aaaggaggatagaaaaag

SEQ ID NO: 4996069 - DNA, 13 bp, Homo sapiens
aaaggatggaaga

SEQ ID NO: 4996070 - DNA, 14 bp, Homo sapiens
aaataaagtttgga

SEQ ID NO: 4996071 - DNA, 13 bp, Homo sapiens
aaatatgcactgc

SEQ ID NO: 4996072 - DNA, 19 bp, Homo sapiens
aaatcatttggttaaatca

SEQ ID NO: 4996073 - DNA, 17 bp, Homo sapiens
aaatctcaccccatccc

SEQ ID NO: 4996074 - DNA, 23 bp, Homo sapiens
aaatctgacataaaaacagtgct

SEQ ID NO: 4996075 - DNA, 19 bp, Homo sapiens
aaatgaaaattacgttctt

SEQ ID NO: 4996076 - DNA, 15 bp, Homo sapiens
aaatgaaataataaa

SEQ ID NO: 4996077 - DNA, 11 bp, Homo sapiens
aaatgccaaaa

SEQ ID NO: 4996078 - DNA, 20 bp, Homo sapiens
aaatgcccatttttgctaat

SEQ ID NO: 4996079 - DNA, 18 bp, Homo sapiens
aaatgctgaaataaaatg

SEQ ID NO: 4996080 - DNA, 20 bp, Homo sapiens
aaatggaaagaaggaaaaaa

SEQ ID NO: 4996081 - DNA, 21 bp, Homo sapiens
aaatgtaaagttgtcttttaa

SEQ ID NO: 4996082 - DNA, 15 bp, Homo sapiens
aaattaataccacta

SEQ ID NO: 4996083 - DNA, 19 bp, Homo sapiens
aaattagtttgacactgct

SEQ ID NO: 4996084 - DNA, 21 bp, Homo sapiens
aaattccgattagacctttat

SEQ ID NO: 4996085 - DNA, 19 bp, Homo sapiens
aaattgcagtttcatgtat

SEQ ID NO: 4996086 - DNA, 15 bp, Homo sapiens
aaattggtctgaaag

SEQ ID NO: 4996087 - DNA, 20 bp, Homo sapiens
aaatttcacttgaaattaaa

SEQ ID NO: 4996088 - DNA, 13 bp, Homo sapiens
aacaaaatttcac

SEQ ID NO: 4996089 - DNA, 16 bp, Homo sapiens
aacaatactaaataaa

SEQ ID NO: 4996090 - DNA, 16 bp, Homo sapiens
aacagtgctattctga

SEQ ID NO: 4996091 - DNA, 20 bp, Homo sapiens
aacatcactacaaaaagaag

SEQ ID NO: 4996092 - DNA, 18 bp, Homo sapiens
aaccagggaagctgtccc

SEQ ID NO: 4996093 - DNA, 15 bp, Homo sapiens
aacctcttatcacta

SEQ ID NO: 4996094 - DNA, 20 bp, Homo sapiens
aactaactgactctgttatt

SEQ ID NO: 4996095 - DNA, 15 bp, Homo sapiens
aactacatctgcctc

SEQ ID NO: 4996096 - DNA, 16 bp, Homo sapiens
aactaggattataatg

SEQ ID NO: 4996097 - DNA, 22 bp, Homo sapiens
aactgaattctggacagattta

SEQ ID NO: 4996098 - DNA, 22 bp, Homo sapiens
aactgcgggaatactgtctctt

SEQ ID NO: 4996099 - DNA, 16 bp, Homo sapiens
gttggtcggtgggttg

SEQ ID NO: 4996100 - DNA, 20 bp, Homo sapiens
gttgtacttcatttctagag

SEQ ID NO: 4996101 - DNA, 14 bp, Homo sapiens
gtttaaatgccaaa

SEQ ID NO: 4996102 - DNA, 13 bp, Homo sapiens
gtttactcccttc

SEQ ID NO: 4996103 - DNA, 20 bp, Homo sapiens
gtttactcccttctgtagtt

SEQ ID NO: 4996104 - DNA, 23 bp, Homo sapiens
gtttatatattgaaagttgcttt

SEQ ID NO: 4996105 - DNA, 19 bp, Homo sapiens
gtttcatgtatgtatataa

SEQ ID NO: 4996106 - DNA, 14 bp, Homo sapiens
gtttctcattaaac

SEQ ID NO: 4996107 - DNA, 22 bp, Homo sapiens
gtttctgatctgtactttgtgt

SEQ ID NO: 4996108 - DNA, 10 bp, Homo sapiens
gtttgacact

SEQ ID NO: 4996109 - DNA, 17 bp, Homo sapiens
gtttgccaagctaatct

SEQ ID NO: 4996110 - DNA, 15 bp, Homo sapiens
gttttaaataaagtt

SEQ ID NO: 4996111 - DNA, 15 bp, Homo sapiens
gttttatttacattt

SEQ ID NO: 4996112 - DNA, 13 bp, Homo sapiens
gttttatttatat

SEQ ID NO: 4996113 - DNA, 15 bp, Homo sapiens
gttttcaaaaaaaca

SEQ ID NO: 4996114 - DNA, 15 bp, Homo sapiens
gttttgtattgcttc

SEQ ID NO: 4996115 - DNA, 11 bp, Homo sapiens
taaaaatgtaa

SEQ ID NO: 4996116 - DNA, 20 bp, Homo sapiens
taaaacagacaataatttaa

SEQ ID NO: 4996117 - DNA, 20 bp, Homo sapiens
taaaacatcagaaactgaat

SEQ ID NO: 4996118 - DNA, 15 bp, Homo sapiens
taaaactttgctgcc

SEQ ID NO: 4996119 - DNA, 21 bp, Homo sapiens
taaaaggaaatctcaccccat

SEQ ID NO: 4996120 - DNA, 18 bp, Homo sapiens
taaaagtcattattcctg

SEQ ID NO: 4996121 - DNA, 21 bp, Homo sapiens
taaaatgtagttttaaataaa

SEQ ID NO: 4996122 - DNA, 18 bp, Homo sapiens
taaaattgcagtttcatg

SEQ ID NO: 4996123 - DNA, 15 bp, Homo sapiens
taaagattagggaaa

SEQ ID NO: 4996124 - DNA, 20 bp, Homo sapiens
taaagattagggaaaatgga

SEQ ID NO: 4996125 - DNA, 13 bp, Homo sapiens
taaagcttgattt

SEQ ID NO: 4996126 - DNA, 18 bp, Homo sapiens
taaagcttgatttgatct

SEQ ID NO: 4996127 - DNA, 16 bp, Homo sapiens
taaagtaaacttgtgt

SEQ ID NO: 4996128 - DNA, 21 bp, Homo sapiens
taaagtgaatttttaaagaca

SEQ ID NO: 4996129 - DNA, 13 bp, Homo sapiens
taaagtttggact

SEQ ID NO: 4996130 - DNA, 13 bp, Homo sapiens
taaataaaagaaa

SEQ ID NO: 4996131 - DNA, 22 bp, Homo sapiens
taaataaaagaaaaatatgcat

SEQ ID NO: 4996132 - DNA, 15 bp, Homo sapiens
taaataaacatctga

SEQ ID NO: 4996133 - DNA, 22 bp, Homo sapiens
taaataaacatctgatctgtat

SEQ ID NO: 4996134 - DNA, 16 bp, Homo sapiens
taaataaagtttggac

SEQ ID NO: 4996135 - DNA, 20 bp, Homo sapiens
taaatgagggtttctgatct

SEQ ID NO: 4996136 - DNA, 16 bp, Homo sapiens
taaatgccaaaatgta

SEQ ID NO: 4996137 - DNA, 15 bp, Homo sapiens
taaatgctgaaataa

SEQ ID NO: 4996138 - DNA, 15 bp, Homo sapiens
taaattagtttgaca

SEQ ID NO: 4996139 - DNA, 21 bp, Homo sapiens
taaattggagttttaaaaatg

SEQ ID NO: 4996140 - DNA, 15 bp, Homo sapiens
taaattggtcatggt

SEQ ID NO: 4996141 - DNA, 13 bp, Homo sapiens
taacagagaaata

SEQ ID NO: 4996142 - DNA, 21 bp, Homo sapiens
taaccatggtgattaaaatga

SEQ ID NO: 4996143 - DNA, 16 bp, Homo sapiens
taactacatctgcctc

SEQ ID NO: 4996144 - DNA, 15 bp, Homo sapiens
taactgactctgtta

SEQ ID NO: 4996145 - DNA, 19 bp, Homo sapiens
taactgactctgttattga

SEQ ID NO: 4996146 - DNA, 16 bp, Homo sapiens
taactgtatttcagta

SEQ ID NO: 4996147 - DNA, 13 bp, Homo sapiens
taactttgcaaaa

SEQ ID NO: 4996148 - DNA, 16 bp, Homo sapiens
taactttgcaaaaaga

SEQ ID NO: 4996149 - DNA, 17 bp, Homo sapiens
taagaaagaaaggaaag

SEQ ID NO: 4996150 - DNA, 20 bp, Homo sapiens
taagaatttgaggtctacat

SEQ ID NO: 4996151 - DNA, 10 bp, Homo sapiens
taagtgacat

SEQ ID NO: 4996152 - DNA, 21 bp, Homo sapiens
taatagtcttgcagaaaatga

SEQ ID NO: 4996153 - DNA, 16 bp, Homo sapiens
taatcagggaaactaa

SEQ ID NO: 4996154 - DNA, 18 bp, Homo sapiens
taatcagggaaactaatt

SEQ ID NO: 4996155 - DNA, 17 bp, Homo sapiens
taatcatgctcatgtat

SEQ ID NO: 4996156 - DNA, 19 bp, Homo sapiens
taatcatgctcatgtatat

SEQ ID NO: 4996157 - DNA, 13 bp, Homo sapiens
taatcctgaattc

SEQ ID NO: 4996158 - DNA, 12 bp, Homo sapiens
taatctatatta

SEQ ID NO: 4996159 - DNA, 15 bp, Homo sapiens
taatctatattaaat

SEQ ID NO: 4996160 - DNA, 16 bp, Homo sapiens
taatctatattaaatg

SEQ ID NO: 4996161 - DNA, 12 bp, Homo sapiens
taatctgcctgg

SEQ ID NO: 4996162 - DNA, 17 bp, Homo sapiens
taatgtagggttatatt

SEQ ID NO: 4996163 - DNA, 17 bp, Homo sapiens
taattaaactagtttaa

SEQ ID NO: 4996164 - DNA, 13 bp, Homo sapiens
taattgtatttag

SEQ ID NO: 4996165 - DNA, 14 bp, Homo sapiens
taatttagagcgtt

SEQ ID NO: 4996166 - DNA, 22 bp, Homo sapiens
tacaaccagaaacaatgtgtct

SEQ ID NO: 4996167 - DNA, 18 bp, Homo sapiens
tacaagcttttaactttt

SEQ ID NO: 4996168 - DNA, 16 bp, Homo sapiens
tacagaccatctgtat

SEQ ID NO: 4996169 - DNA, 20 bp, Homo sapiens
tacagatggagcaaatgtcc

SEQ ID NO: 4996170 - DNA, 13 bp, Homo sapiens
tacattaaacaat

SEQ ID NO: 4996171 - DNA, 19 bp, Homo sapiens
tacattcttggttgttaat

SEQ ID NO: 4996172 - DNA, 17 bp, Homo sapiens
taccaagtatgaagtat

SEQ ID NO: 4996173 - DNA, 22 bp, Homo sapiens
taccagtctgattataccatgt

SEQ ID NO: 4996174 - DNA, 18 bp, Homo sapiens
taccatagagtaatgatg

SEQ ID NO: 4996175 - DNA, 19 bp, Homo sapiens
tacctaaaaggaaatctca

SEQ ID NO: 4996176 - DNA, 15 bp, Homo sapiens
tacctgccttttaag

SEQ ID NO: 4996177 - DNA, 16 bp, Homo sapiens
tacctgccttttaagt

SEQ ID NO: 4996178 - DNA, 19 bp, Homo sapiens
tacctgccttttaagtttg

SEQ ID NO: 4996179 - DNA, 20 bp, Homo sapiens
tacctgccttttaagtttga

SEQ ID NO: 4996180 - DNA, 17 bp, Homo sapiens
tactaaaaatagaaaaa

SEQ ID NO: 4996181 - DNA, 15 bp, Homo sapiens
tactcccttctgtag

SEQ ID NO: 4996182 - DNA, 23 bp, Homo sapiens
tactcggatgtgtcctttctgaa

SEQ ID NO: 4996183 - DNA, 22 bp, Homo sapiens
tactcttaaatcatttggttaa

SEQ ID NO: 4996184 - DNA, 21 bp, Homo sapiens
tactgaagaacagtactccac

SEQ ID NO: 4996185 - DNA, 16 bp, Homo sapiens
tactgctctagaaagt

SEQ ID NO: 4996186 - DNA, 18 bp, Homo sapiens
tactgcttctctttgtgc

SEQ ID NO: 4996187 - DNA, 17 bp, Homo sapiens
tactgtagaaaggaaat

SEQ ID NO: 4996188 - DNA, 16 bp, Homo sapiens
tacttagaatgccata

SEQ ID NO: 4996189 - DNA, 20 bp, Homo sapiens
tacttagaatgccataaaat

SEQ ID NO: 4996190 - DNA, 13 bp, Homo sapiens
tacttttgagtat

SEQ ID NO: 4996191 - DNA, 22 bp, Homo sapiens
tacttttgagtatggctatcta

SEQ ID NO: 4996192 - DNA, 19 bp, Homo sapiens
tagaaagacatctgcctgt

SEQ ID NO: 4996193 - DNA, 14 bp, Homo sapiens
tagaaagagttcta

SEQ ID NO: 4996194 - DNA, 16 bp, Homo sapiens
tagaagaaagaaaatg

SEQ ID NO: 4996195 - DNA, 14 bp, Homo sapiens
tagaataaatggtt

SEQ ID NO: 4996196 - DNA, 19 bp, Homo sapiens
tagaatggcttctctgttt

SEQ ID NO: 4996197 - DNA, 20 bp, Homo sapiens
tagattgcaaatattggtta

SEQ ID NO: 4996198 - DNA, 18 bp, Homo sapiens
tagcagtgtgtaaagtaa

SEQ ID NO: 4996199 - DNA, 19 bp, Homo sapiens
tagctactgtagaaaggaa

SEQ ID NO: 4996200 - DNA, 21 bp, Homo sapiens
tagctactgtagaaaggaaat

SEQ ID NO: 4996201 - DNA, 22 bp, Homo sapiens
taggcacttttattttcattgt

SEQ ID NO: 4996202 - DNA, 17 bp, Homo sapiens
tagtatctaataatgaa

SEQ ID NO: 4996203 - DNA, 16 bp, Homo sapiens
tagtgccaaataattg

SEQ ID NO: 4996204 - DNA, 22 bp, Homo sapiens
tagttacgtataatgctttctg

SEQ ID NO: 4996205 - DNA, 18 bp, Homo sapiens
tagtttaagggtggaaaa

SEQ ID NO: 4996206 - DNA, 13 bp, Homo sapiens
tagtttgacactg

SEQ ID NO: 4996207 - DNA, 14 bp, Homo sapiens
tataagcgtattta

SEQ ID NO: 4996208 - DNA, 20 bp, Homo sapiens
tataagcgtatttagactgt

SEQ ID NO: 4996209 - DNA, 17 bp, Homo sapiens
tataatcatgctcatgt

SEQ ID NO: 4996210 - DNA, 23 bp, Homo sapiens
tataatcatgctcatgtatattt

SEQ ID NO: 4996211 - DNA, 17 bp, Homo sapiens
tataattcagtctgctt

SEQ ID NO: 4996212 - DNA, 13 bp, Homo sapiens
tatacctgccttt

SEQ ID NO: 4996213 - DNA, 22 bp, Homo sapiens
tatactttttttgttatagatt

SEQ ID NO: 4996214 - DNA, 21 bp, Homo sapiens
ttgccaagctaatctgcctgg

SEQ ID NO: 4996215 - DNA, 15 bp, Homo sapiens
ttgctgttactgctt

SEQ ID NO: 4996216 - DNA, 20 bp, Homo sapiens
ttggaagaagttttttactt

SEQ ID NO: 4996217 - DNA, 14 bp, Homo sapiens
ttggatttgctgtg

SEQ ID NO: 4996218 - DNA, 18 bp, Homo sapiens
ttggatttgctgtgacta

SEQ ID NO: 4996219 - DNA, 23 bp, Homo sapiens
ttggtaacgaatttaaaatgtag

SEQ ID NO: 4996220 - DNA, 20 bp, Homo sapiens
ttggttgtctttttctagac

SEQ ID NO: 4996221 - DNA, 18 bp, Homo sapiens
ttgtagaataaatggttt

SEQ ID NO: 4996222 - DNA, 19 bp, Homo sapiens
ttgtagaataaatggtttc

SEQ ID NO: 4996223 - DNA, 18 bp, Homo sapiens
ttgtgagccaccacgtcc

SEQ ID NO: 4996224 - DNA, 13 bp, Homo sapiens
ttgtttaaatgcc

SEQ ID NO: 4996225 - DNA, 13 bp, Homo sapiens
tttaaaatgtagt

SEQ ID NO: 4996226 - DNA, 14 bp, Homo sapiens
tttaaagtaaactt

SEQ ID NO: 4996227 - DNA, 15 bp, Homo sapiens
tttaaagtaaacttg

SEQ ID NO: 4996228 - DNA, 16 bp, Homo sapiens
tttaaagtaaacttgt

SEQ ID NO: 4996229 - DNA, 21 bp, Homo sapiens
tttaacatcactacaaaaaga

SEQ ID NO: 4996230 - DNA, 16 bp, Homo sapiens
tttaagccttgacaca

SEQ ID NO: 4996231 - DNA, 16 bp, Homo sapiens
tttaaggtttttactg

SEQ ID NO: 4996232 - DNA, 16 bp, Homo sapiens
tttaagttgaaaagta

SEQ ID NO: 4996233 - DNA, 16 bp, Homo sapiens
tttaattaaaaacttt

SEQ ID NO: 4996234 - DNA, 14 bp, Homo sapiens
tttaatttccaaaa

SEQ ID NO: 4996235 - DNA, 16 bp, Homo sapiens
tttactgctctagaaa

SEQ ID NO: 4996236 - DNA, 19 bp, Homo sapiens
tttagctacctttttatat

SEQ ID NO: 4996237 - DNA, 14 bp, Homo sapiens
tttagggtgggtaa

SEQ ID NO: 4996238 - DNA, 15 bp, Homo sapiens
tttaggttgttacca

SEQ ID NO: 4996239 - DNA, 23 bp, Homo sapiens
tttagtctttttttccttccttt

SEQ ID NO: 4996240 - DNA, 16 bp, Homo sapiens
tttagttacgtataat

SEQ ID NO: 4996241 - DNA, 14 bp, Homo sapiens
tttatatattgaaa

SEQ ID NO: 4996242 - DNA, 13 bp, Homo sapiens
tttatatcttgtt

SEQ ID NO: 4996243 - DNA, 13 bp, Homo sapiens
tttatctttgtgt

SEQ ID NO: 4996244 - DNA, 16 bp, Homo sapiens
tttatgagatttactg

SEQ ID NO: 4996245 - DNA, 20 bp, Homo sapiens
tttattcagctagaatttct

SEQ ID NO: 4996246 - DNA, 23 bp, Homo sapiens
tttattcagctagaatttctggt

SEQ ID NO: 4996247 - DNA, 14 bp, Homo sapiens
tttcatggtttata

SEQ ID NO: 4996248 - DNA, 18 bp, Homo sapiens
tttcattgtgatttatat

SEQ ID NO: 4996249 - DNA, 22 bp, Homo sapiens
tttcattgtgatttatatataa

SEQ ID NO: 4996250 - DNA, 21 bp, Homo sapiens
tttctaaaacagacaataatt

SEQ ID NO: 4996251 - DNA, 16 bp, Homo sapiens
tttctctggcaaactt

SEQ ID NO: 4996252 - DNA, 18 bp, Homo sapiens
tttctttgtagaataaat

SEQ ID NO: 4996253 - DNA, 21 bp, Homo sapiens
tttcttttttaaagtaaactt

SEQ ID NO: 4996254 - DNA, 19 bp, Homo sapiens
tttgaggtctacattcttg

SEQ ID NO: 4996255 - DNA, 16 bp, Homo sapiens
tttgatctttgtttaa

SEQ ID NO: 4996256 - DNA, 22 bp, Homo sapiens
tttggagcattaactaaatgct

SEQ ID NO: 4996257 - DNA, 13 bp, Homo sapiens
tttggttaaagta

SEQ ID NO: 4996258 - DNA, 16 bp, Homo sapiens
tttgtagaataaatgg

SEQ ID NO: 4996259 - DNA, 17 bp, Homo sapiens
tttgtagaataaatggt

SEQ ID NO: 4996260 - DNA, 22 bp, Homo sapiens
tttgtattgcttcctgattacc

SEQ ID NO: 4996261 - DNA, 20 bp, Homo sapiens
ttttaaacaaaatttcacag

SEQ ID NO: 4996262 - DNA, 21 bp, Homo sapiens
ttttaaacaaaatttcacagt

SEQ ID NO: 4996263 - DNA, 22 bp, Homo sapiens
ttttaaagtaaacttgtgtatt

SEQ ID NO: 4996264 - DNA, 22 bp, Homo sapiens
ttttaagtgacataattgtcca

SEQ ID NO: 4996265 - DNA, 16 bp, Homo sapiens
ttttaagtttgaaact

SEQ ID NO: 4996266 - DNA, 12 bp, Homo sapiens
ttttactttggt

SEQ ID NO: 4996267 - DNA, 21 bp, Homo sapiens
ttttatatttaaaaaattaaa

SEQ ID NO: 4996268 - DNA, 11 bp, Homo sapiens
ttttatttaca

SEQ ID NO: 4996269 - DNA, 13 bp, Homo sapiens
ttttatttacatt

SEQ ID NO: 4996270 - DNA, 14 bp, Homo sapiens
ttttcacagcacta

SEQ ID NO: 4996271 - DNA, 20 bp, Homo sapiens
ttttcaccccacccttcccc

SEQ ID NO: 4996272 - DNA, 22 bp, Homo sapiens
tttttaaagtaaacttgtgtat

SEQ ID NO: 4996273 - DNA, 19 bp, Homo sapiens
tttttaagttattgtacaa

SEQ ID NO: 4996274 - DNA, 13 bp, Homo sapiens
tttttaattaaaa

SEQ ID NO: 4996275 - DNA, 10 bp, Homo sapiens
tttttattca

SEQ ID NO: 4996276 - DNA, 13 bp, Homo sapiens
tttttccatctgt

SEQ ID NO: 4996277 - DNA, 13 bp, Homo sapiens
tttttgttttcaa

SEQ ID NO: 4996278 - DNA, 12 bp, Homo sapiens
ttttttaaagta

SEQ ID NO: 4996279 - DNA, 17 bp, Homo sapiens
ctgtattaaagaaaaat

SEQ ID NO: 4996280 - DNA, 18 bp, Homo sapiens
ctgtatttcagtattttc

SEQ ID NO: 4996281 - DNA, 19 bp, Homo sapiens
ctgtatttcagtattttcc

SEQ ID NO: 4996282 - DNA, 15 bp, Homo sapiens
ctgtatttctttgta

SEQ ID NO: 4996283 - DNA, 13 bp, Homo sapiens
ctgtccctcactg

SEQ ID NO: 4996284 - DNA, 12 bp, Homo sapiens
ctgtctcagcct

SEQ ID NO: 4996285 - DNA, 16 bp, Homo sapiens
ctgtctcagcctccca

SEQ ID NO: 4996286 - DNA, 16 bp, Homo sapiens
ctgtctcttctatgta

SEQ ID NO: 4996287 - DNA, 14 bp, Homo sapiens
ctgtgttgcttcaa

SEQ ID NO: 4996288 - DNA, 23 bp, Homo sapiens
ctgttactgcttctctttgtgca

SEQ ID NO: 4996289 - DNA, 18 bp, Homo sapiens
ctgtttactcccttctgt

SEQ ID NO: 4996290 - DNA, 20 bp, Homo sapiens
ctgtttactcccttctgtag

SEQ ID NO: 4996291 - DNA, 22 bp, Homo sapiens
ctgtttactcccttctgtagtt

SEQ ID NO: 4996292 - DNA, 18 bp, Homo sapiens
ctgtttttcttctgaaat

SEQ ID NO: 4996293 - DNA, 15 bp, Homo sapiens
cttaaagcttgattt

SEQ ID NO: 4996294 - DNA, 22 bp, Homo sapiens
cttaaatcatttggttaaatca

SEQ ID NO: 4996295 - DNA, 15 bp, Homo sapiens
cttaactgtatttca

SEQ ID NO: 4996296 - DNA, 18 bp, Homo sapiens
cttaactgtatttcagta

SEQ ID NO: 4996297 - DNA, 17 bp, Homo sapiens
cttacaagcttaaagct

SEQ ID NO: 4996298 - DNA, 13 bp, Homo sapiens
cttagaatgccat

SEQ ID NO: 4996299 - DNA, 22 bp, Homo sapiens
cttagttgatattcaaggcttt

SEQ ID NO: 4996300 - DNA, 13 bp, Homo sapiens
cttatgtgttaca

SEQ ID NO: 4996301 - DNA, 17 bp, Homo sapiens
cttcagaggctcatcta

SEQ ID NO: 4996302 - DNA, 22 bp, Homo sapiens
cttctctgtttttcttctgaaa

SEQ ID NO: 4996303 - DNA, 13 bp, Homo sapiens
cttcttggatttt

SEQ ID NO: 4996304 - DNA, 13 bp, Homo sapiens
cttgacacactgt

SEQ ID NO: 4996305 - DNA, 22 bp, Homo sapiens
cttgatttgatctttgtttaaa

SEQ ID NO: 4996306 - DNA, 20 bp, Homo sapiens
cttgcagcgccaagtggcca

SEQ ID NO: 4996307 - DNA, 20 bp, Homo sapiens
cttgctgtttactcccttct

SEQ ID NO: 4996308 - DNA, 17 bp, Homo sapiens
cttggtaagtgaattta

SEQ ID NO: 4996309 - DNA, 19 bp, Homo sapiens
cttggtaagtgaatttatg

SEQ ID NO: 4996310 - DNA, 17 bp, Homo sapiens
cttggttgttaatttag

SEQ ID NO: 4996311 - DNA, 22 bp, Homo sapiens
cttgttattaatgtttcttctc

SEQ ID NO: 4996312 - DNA, 20 bp, Homo sapiens
ctttaaaagtcattattcct

SEQ ID NO: 4996313 - DNA, 17 bp, Homo sapiens
ctttatttataaaataa

SEQ ID NO: 4996314 - DNA, 12 bp, Homo sapiens
ctttattttccc

SEQ ID NO: 4996315 - DNA, 19 bp, Homo sapiens
ctttctgagtgagttttac

SEQ ID NO: 4996316 - DNA, 12 bp, Homo sapiens
ctttgaaaatac

SEQ ID NO: 4996317 - DNA, 11 bp, Homo sapiens
ctttgctgcca

SEQ ID NO: 4996318 - DNA, 21 bp, Homo sapiens
ctttgctgttactgcttctct

SEQ ID NO: 4996319 - DNA, 19 bp, Homo sapiens
ctttgtacatgttacaggc

SEQ ID NO: 4996320 - DNA, 15 bp, Homo sapiens
ctttgttcaataaag

SEQ ID NO: 4996321 - DNA, 21 bp, Homo sapiens
cttttaagtttgaaactaact

SEQ ID NO: 4996322 - DNA, 18 bp, Homo sapiens
cttttcttttttaaagta

SEQ ID NO: 4996323 - DNA, 14 bp, Homo sapiens
ctttttaagttatt

SEQ ID NO: 4996324 - DNA, 20 bp, Homo sapiens
ctttttatatttaaaaaatt

SEQ ID NO: 4996325 - DNA, 12 bp, Homo sapiens
cttttttaaagt

SEQ ID NO: 4996326 - DNA, 21 bp, Homo sapiens
gaaaaaggatggaagaaagaa

SEQ ID NO: 4996327 - DNA, 19 bp, Homo sapiens
gaaaacaatactaaataaa

SEQ ID NO: 4996328 - DNA, 18 bp, Homo sapiens
gaaaatggaaagaaggaa

SEQ ID NO: 4996329 - DNA, 19 bp, Homo sapiens
gaaaatggatatagaaaat

SEQ ID NO: 4996330 - DNA, 23 bp, Homo sapiens
gaaacaatgtgtctatttctgaa

SEQ ID NO: 4996331 - DNA, 14 bp, Homo sapiens
gaaagaaaatggaa

SEQ ID NO: 4996332 - DNA, 20 bp, Homo sapiens
gaaagaaaatggaaagaagg

SEQ ID NO: 4996333 - DNA, 22 bp, Homo sapiens
gaaagaaaatggaaagaaggaa

SEQ ID NO: 4996334 - DNA, 17 bp, Homo sapiens
gaaagaaaggaaagaag

SEQ ID NO: 4996335 - DNA, 20 bp, Homo sapiens
gaaagaagcattgaaaacaa

SEQ ID NO: 4996336 - DNA, 12 bp, Homo sapiens
gaaagaaggaaa

SEQ ID NO: 4996337 - DNA, 14 bp, Homo sapiens
gaaagaaggaaaaa

SEQ ID NO: 4996338 - DNA, 11 bp, Homo sapiens
gaaagaaggag

SEQ ID NO: 4996339 - DNA, 13 bp, Homo sapiens
gaaagacatctgc

SEQ ID NO: 4996340 - DNA, 21 bp, Homo sapiens
gaaagacatctgcctgtaatt

SEQ ID NO: 4996341 - DNA, 15 bp, Homo sapiens
gaaagccaccttgtt

SEQ ID NO: 4996342 - DNA, 17 bp, Homo sapiens
gaaagccaccttgttac

SEQ ID NO: 4996343 - DNA, 15 bp, Homo sapiens
gaaaggaaagaagga

SEQ ID NO: 4996344 - DNA, 16 bp, Homo sapiens
gaaaggaaagaaggag

SEQ ID NO: 4996345 - DNA, 15 bp, Homo sapiens
gaaaggaaatagact

SEQ ID NO: 4996346 - DNA, 19 bp, Homo sapiens
gaaagttgcttttattgca

SEQ ID NO: 4996347 - DNA, 22 bp, Homo sapiens
gaaattaaagctgccttttgtt

SEQ ID NO: 4996348 - DNA, 12 bp, Homo sapiens
gaagaagttttt

SEQ ID NO: 4996349 - DNA, 12 bp, Homo sapiens
gaatagaagaaa

SEQ ID NO: 4996350 - DNA, 18 bp, Homo sapiens
gaattaccatagagtaat

SEQ ID NO: 4996351 - DNA, 22 bp, Homo sapiens
gaattaccatagagtaatgatg

SEQ ID NO: 4996352 - DNA, 17 bp, Homo sapiens
gaattctggttgtaaat

SEQ ID NO: 4996353 - DNA, 19 bp, Homo sapiens
gaattgagaataagaattt

SEQ ID NO: 4996354 - DNA, 15 bp, Homo sapiens
gaattggcataattt

SEQ ID NO: 4996355 - DNA, 21 bp, Homo sapiens
gaatttaaaatgtagttttaa

SEQ ID NO: 4996356 - DNA, 17 bp, Homo sapiens
gacaaagcattctaaat

SEQ ID NO: 4996357 - DNA, 13 bp, Homo sapiens
gactctgttattg

SEQ ID NO: 4996358 - DNA, 20 bp, Homo sapiens
gactgcaagcatttttccat

SEQ ID NO: 4996359 - DNA, 12 bp, Homo sapiens
gactttgctgtt

SEQ ID NO: 4996360 - DNA, 18 bp, Homo sapiens
gagatcaaaaaaatatat

SEQ ID NO: 4996361 - DNA, 15 bp, Homo sapiens
gagatgaatagaaga

SEQ ID NO: 4996362 - DNA, 18 bp, Homo sapiens
gagatgaatagaagaaag

SEQ ID NO: 4996363 - DNA, 17 bp, Homo sapiens
gagattggatttgctgt

SEQ ID NO: 4996364 - DNA, 18 bp, Homo sapiens
tataatcatgctcatgta

SEQ ID NO: 4996365 - DNA, 20 bp, Homo sapiens
tataatcatgctcatgtata

SEQ ID NO: 4996366 - DNA, 13 bp, Homo sapiens
tataatgctttct

SEQ ID NO: 4996367 - DNA, 16 bp, Homo sapiens
tataatgctttctgag

SEQ ID NO: 4996368 - DNA, 16 bp, Homo sapiens
tataatgtgtctgtgt

SEQ ID NO: 4996369 - DNA, 17 bp, Homo sapiens
tatataaggtaatgtag

SEQ ID NO: 4996370 - DNA, 20 bp, Homo sapiens
tatataatcatgctcatgta

SEQ ID NO: 4996371 - DNA, 17 bp, Homo sapiens
tatattgaaagttgctt

SEQ ID NO: 4996372 - DNA, 19 bp, Homo sapiens
tatatttaaaaaattaaaa

SEQ ID NO: 4996373 - DNA, 23 bp, Homo sapiens
tatcactaagaaagaaaggaaag

SEQ ID NO: 4996374 - DNA, 19 bp, Homo sapiens
tatccagctagtgccaaat

SEQ ID NO: 4996375 - DNA, 16 bp, Homo sapiens
tatcgatctcttattt

SEQ ID NO: 4996376 - DNA, 23 bp, Homo sapiens
tatctatacctgccttttaagtt

SEQ ID NO: 4996377 - DNA, 15 bp, Homo sapiens
tatgaactctttaag

SEQ ID NO: 4996378 - DNA, 16 bp, Homo sapiens
tatgaagtataaatct

SEQ ID NO: 4996379 - DNA, 19 bp, Homo sapiens
tatggagactttgctgtta

SEQ ID NO: 4996380 - DNA, 19 bp, Homo sapiens
tatgtgagaaatcagaatt

SEQ ID NO: 4996381 - DNA, 16 bp, Homo sapiens
tatgtgttacattatt

SEQ ID NO: 4996382 - DNA, 12 bp, Homo sapiens
tattaaagaaaa

SEQ ID NO: 4996383 - DNA, 14 bp, Homo sapiens
tattaaagaaaaat

SEQ ID NO: 4996384 - DNA, 16 bp, Homo sapiens
tattaagccattgaaa

SEQ ID NO: 4996385 - DNA, 19 bp, Homo sapiens
tattatttttttaaacaaa

SEQ ID NO: 4996386 - DNA, 19 bp, Homo sapiens
tattcagctagaatttctg

SEQ ID NO: 4996387 - DNA, 13 bp, Homo sapiens
tatttaactacat

SEQ ID NO: 4996388 - DNA, 18 bp, Homo sapiens
tatttaactacatctgcc

SEQ ID NO: 4996389 - DNA, 17 bp, Homo sapiens
tatttcagtattttcca

SEQ ID NO: 4996390 - DNA, 22 bp, Homo sapiens
tatttcagtattttccagcctt

SEQ ID NO: 4996391 - DNA, 15 bp, Homo sapiens
tatttctctggcaaa

SEQ ID NO: 4996392 - DNA, 13 bp, Homo sapiens
tatttctttgtag

SEQ ID NO: 4996393 - DNA, 14 bp, Homo sapiens
tattttcattgtga

SEQ ID NO: 4996394 - DNA, 18 bp, Homo sapiens
tattttccagccttatgt

SEQ ID NO: 4996395 - DNA, 12 bp, Homo sapiens
tatttttattat

SEQ ID NO: 4996396 - DNA, 18 bp, Homo sapiens
tatttttttaaacaaaat

SEQ ID NO: 4996397 - DNA, 22 bp, Homo sapiens
tatttttttaaacaaaatttca

SEQ ID NO: 4996398 - DNA, 15 bp, Homo sapiens
tcaacatcttttaca

SEQ ID NO: 4996399 - DNA, 19 bp, Homo sapiens
tcaagtctctgctggccca

SEQ ID NO: 4996400 - DNA, 14 bp, Homo sapiens
tcaatataaaaaca

SEQ ID NO: 4996401 - DNA, 12 bp, Homo sapiens
tcaatttggagc

SEQ ID NO: 4996402 - DNA, 23 bp, Homo sapiens
tcacaaattccgattagaccttt

SEQ ID NO: 4996403 - DNA, 17 bp, Homo sapiens
tcacagtgttgcccagg

SEQ ID NO: 4996404 - DNA, 12 bp, Homo sapiens
tcacagttctgt

SEQ ID NO: 4996405 - DNA, 14 bp, Homo sapiens
tcacagttctgtaa

SEQ ID NO: 4996406 - DNA, 14 bp, Homo sapiens
tcactacaaaaaga

SEQ ID NO: 4996407 - DNA, 17 bp, Homo sapiens
tcactacaaaaagaaga

SEQ ID NO: 4996408 - DNA, 22 bp, Homo sapiens
tcagaaactgaattctggacag

SEQ ID NO: 4996409 - DNA, 22 bp, Homo sapiens
tcagaattggcataatttgtct

SEQ ID NO: 4996410 - DNA, 17 bp, Homo sapiens
tcagctagaatttctgg

SEQ ID NO: 4996411 - DNA, 14 bp, Homo sapiens
tcagtattttccag

SEQ ID NO: 4996412 - DNA, 20 bp, Homo sapiens
tcatagatttgaaaaacttt

SEQ ID NO: 4996413 - DNA, 19 bp, Homo sapiens
tcatgccaccatggccagc

SEQ ID NO: 4996414 - DNA, 19 bp, Homo sapiens
tcattaaactctaaagatt

SEQ ID NO: 4996415 - DNA, 17 bp, Homo sapiens
tcattaaactgattcca

SEQ ID NO: 4996416 - DNA, 15 bp, Homo sapiens
tcatttctagagaaa

SEQ ID NO: 4996417 - DNA, 21 bp, Homo sapiens
tcatttggcttgctgtttact

SEQ ID NO: 4996418 - DNA, 16 bp, Homo sapiens
tcatttggttaaatca

SEQ ID NO: 4996419 - DNA, 20 bp, Homo sapiens
tccaaaataatctatattaa

SEQ ID NO: 4996420 - DNA, 22 bp, Homo sapiens
tccaatgatacccaacagttta

SEQ ID NO: 4996421 - DNA, 18 bp, Homo sapiens
tccccaatccatgcttca

SEQ ID NO: 4996422 - DNA, 13 bp, Homo sapiens
tccccggctcgag

SEQ ID NO: 4996423 - DNA, 18 bp, Homo sapiens
tcccctccttctcccttt

SEQ ID NO: 4996424 - DNA, 12 bp, Homo sapiens
tccctctccctg

SEQ ID NO: 4996425 - DNA, 18 bp, Homo sapiens
tccctgttggtcggtggg

SEQ ID NO: 4996426 - DNA, 19 bp, Homo sapiens
tcccttctgtagtttttaa

SEQ ID NO: 4996427 - DNA, 14 bp, Homo sapiens
tcctgcctcagcct

SEQ ID NO: 4996428 - DNA, 17 bp, Homo sapiens
tcctgcctcagcctccg

SEQ ID NO: 4996429 - DNA, 13 bp, Homo sapiens
tcctgggctcagg

SEQ ID NO: 4996430 - DNA, 19 bp, Homo sapiens
tcctgggcttggtaagtga

SEQ ID NO: 4996431 - DNA, 14 bp, Homo sapiens
tcggctcacaaatt

SEQ ID NO: 4996432 - DNA, 19 bp, Homo sapiens
tctaaagctttatctttgt

SEQ ID NO: 4996433 - DNA, 15 bp, Homo sapiens
tctacattcttggtt

SEQ ID NO: 4996434 - DNA, 21 bp, Homo sapiens
tctacattcttggttgttaat

SEQ ID NO: 4996435 - DNA, 18 bp, Homo sapiens
tctagaacttgaccccct

SEQ ID NO: 4996436 - DNA, 20 bp, Homo sapiens
tctaggtaggggcccacttc

SEQ ID NO: 4996437 - DNA, 15 bp, Homo sapiens
tctatattaaatgag

SEQ ID NO: 4996438 - DNA, 14 bp, Homo sapiens
tctatggagacttt

SEQ ID NO: 4996439 - DNA, 17 bp, Homo sapiens
tctatggagactttgct

SEQ ID NO: 4996440 - DNA, 19 bp, Homo sapiens
tctatggagactttgctgt

SEQ ID NO: 4996441 - DNA, 15 bp, Homo sapiens
tctatttctgaaaga

SEQ ID NO: 4996442 - DNA, 11 bp, Homo sapiens
tctcagcctcc

SEQ ID NO: 4996443 - DNA, 12 bp, Homo sapiens
tctcagcctccc

SEQ ID NO: 4996444 - DNA, 13 bp, Homo sapiens
tctcagcctccca

SEQ ID NO: 4996445 - DNA, 16 bp, Homo sapiens
tctccaattctgaaat

SEQ ID NO: 4996446 - DNA, 22 bp, Homo sapiens
tctccccaatccatgcttcact

SEQ ID NO: 4996447 - DNA, 13 bp, Homo sapiens
tctcgctaaagag

SEQ ID NO: 4996448 - DNA, 22 bp, Homo sapiens
tctctaacttcaaggcccatat

SEQ ID NO: 4996449 - DNA, 14 bp, Homo sapiens
tctctccctcccct

SEQ ID NO: 4996450 - DNA, 21 bp, Homo sapiens
tctctccctcccctgccattt

SEQ ID NO: 4996451 - DNA, 15 bp, Homo sapiens
tctctggcaaacttt

SEQ ID NO: 4996452 - DNA, 13 bp, Homo sapiens
tctgagtgagttt

SEQ ID NO: 4996453 - DNA, 18 bp, Homo sapiens
tctgatctgtactttgtg

SEQ ID NO: 4996454 - DNA, 19 bp, Homo sapiens
tctgatctgtactttgtgt

SEQ ID NO: 4996455 - DNA, 16 bp, Homo sapiens
tctgctcattaaactg

SEQ ID NO: 4996456 - DNA, 14 bp, Homo sapiens
tctgtactttgtgt

SEQ ID NO: 4996457 - DNA, 15 bp, Homo sapiens
tctgtataaaaatgt

SEQ ID NO: 4996458 - DNA, 16 bp, Homo sapiens
tctgtataaaaatgta

SEQ ID NO: 4996459 - DNA, 20 bp, Homo sapiens
tctgtgaaatgctggcattt

SEQ ID NO: 4996460 - DNA, 13 bp, Homo sapiens
tctgtgttgcttc

SEQ ID NO: 4996461 - DNA, 15 bp, Homo sapiens
tcttaaatcatttgg

SEQ ID NO: 4996462 - DNA, 13 bp, Homo sapiens
tcttaactgtatt

SEQ ID NO: 4996463 - DNA, 16 bp, Homo sapiens
tcttctccaattctga

SEQ ID NO: 4996464 - DNA, 20 bp, Homo sapiens
tcttctccaattctgaaata

SEQ ID NO: 4996465 - DNA, 15 bp, Homo sapiens
tctttgtttaaatgc

SEQ ID NO: 4996466 - DNA, 20 bp, Homo sapiens
tcttttttgatatgataata

SEQ ID NO: 4996467 - DNA, 15 bp, Homo sapiens
tgaaaacaaagacat

SEQ ID NO: 4996468 - DNA, 19 bp, Homo sapiens
tgaaaacaatactaaataa

SEQ ID NO: 4996469 - DNA, 17 bp, Homo sapiens
tgaaaggctatcctgct

SEQ ID NO: 4996470 - DNA, 22 bp, Homo sapiens
gcgtatttagactgtggccata

SEQ ID NO: 4996471 - DNA, 20 bp, Homo sapiens
gctaaagggagaaatgccag

SEQ ID NO: 4996472 - DNA, 20 bp, Homo sapiens
gctaacatggtaaaaccccg

SEQ ID NO: 4996473 - DNA, 13 bp, Homo sapiens
gctaatctgcctg

SEQ ID NO: 4996474 - DNA, 13 bp, Homo sapiens
gctacctttttat

SEQ ID NO: 4996475 - DNA, 17 bp, Homo sapiens
gctactgtagaaaggaa

SEQ ID NO: 4996476 - DNA, 13 bp, Homo sapiens
gctatcctgctga

SEQ ID NO: 4996477 - DNA, 20 bp, Homo sapiens
gctatcctgctgaaagtcct

SEQ ID NO: 4996478 - DNA, 17 bp, Homo sapiens
gctatctatacctgcct

SEQ ID NO: 4996479 - DNA, 15 bp, Homo sapiens
gctattaagaaggca

SEQ ID NO: 4996480 - DNA, 14 bp, Homo sapiens
gctcacaaattccg

SEQ ID NO: 4996481 - DNA, 24 bp, Homo sapiens
gctcaggcgatccacctgtctcag

SEQ ID NO: 4996482 - DNA, 19 bp, Homo sapiens
gctcattaaactgattcca

SEQ ID NO: 4996483 - DNA, 17 bp, Homo sapiens
gctcgagcagtcctgcc

SEQ ID NO: 4996484 - DNA, 20 bp, Homo sapiens
gctcgagcagtcctgcctca

SEQ ID NO: 4996485 - DNA, 20 bp, Homo sapiens
gctgttactgcttctctttg

SEQ ID NO: 4996486 - DNA, 22 bp, Homo sapiens
gctgttactgcttctctttgtg

SEQ ID NO: 4996487 - DNA, 23 bp, Homo sapiens
gctgtttactcccttctgtagtt

SEQ ID NO: 4996488 - DNA, 11 bp, Homo sapiens
gcttaaagctt

SEQ ID NO: 4996489 - DNA, 16 bp, Homo sapiens
gcttcactcatgcaaa

SEQ ID NO: 4996490 - DNA, 22 bp, Homo sapiens
gcttcactcatgcaaactgctt

SEQ ID NO: 4996491 - DNA, 23 bp, Homo sapiens
gcttcactcatgcaaactgcttt

SEQ ID NO: 4996492 - DNA, 15 bp, Homo sapiens
gcttcctgtctgttt

SEQ ID NO: 4996493 - DNA, 14 bp, Homo sapiens
gcttctctttgtgc

SEQ ID NO: 4996494 - DNA, 23 bp, Homo sapiens
gcttgatttgatctttgtttaaa

SEQ ID NO: 4996495 - DNA, 23 bp, Homo sapiens
gctttaattcagctttagaaatt

SEQ ID NO: 4996496 - DNA, 17 bp, Homo sapiens
gctttatctttgtgtaa

SEQ ID NO: 4996497 - DNA, 14 bp, Homo sapiens
gcttttattgcacc

SEQ ID NO: 4996498 - DNA, 22 bp, Homo sapiens
gcttttattgcaccattttcaa

SEQ ID NO: 4996499 - DNA, 23 bp, Homo sapiens
ggaaaaaaggaggatagaaaaag

SEQ ID NO: 4996500 - DNA, 13 bp, Homo sapiens
ggaaagaaggaga

SEQ ID NO: 4996501 - DNA, 13 bp, Homo sapiens
ggagaaatgccag

SEQ ID NO: 4996502 - DNA, 23 bp, Homo sapiens
ggagactttgctgttactgcttc

SEQ ID NO: 4996503 - DNA, 14 bp, Homo sapiens
ggagatgaatagaa

SEQ ID NO: 4996504 - DNA, 20 bp, Homo sapiens
ggagatgaatagaagaaaga

SEQ ID NO: 4996505 - DNA, 14 bp, Homo sapiens
ggaggatagaaaaa

SEQ ID NO: 4996506 - DNA, 22 bp, Homo sapiens
ggagttgtcaagtctctgctgg

SEQ ID NO: 4996507 - DNA, 13 bp, Homo sapiens
ggatggaagaaag

SEQ ID NO: 4996508 - DNA, 20 bp, Homo sapiens
ggcaactgtattaaagaaaa

SEQ ID NO: 4996509 - DNA, 17 bp, Homo sapiens
ggcgatccacctgtctc

SEQ ID NO: 4996510 - DNA, 16 bp, Homo sapiens
ggctatcctgctgaaa

SEQ ID NO: 4996511 - DNA, 19 bp, Homo sapiens
ggctggagtggagtggcgt

SEQ ID NO: 4996512 - DNA, 20 bp, Homo sapiens
gggcagtgagtgccatgctt

SEQ ID NO: 4996513 - DNA, 23 bp, Homo sapiens
ggtaagaaagccaccttgttaca

SEQ ID NO: 4996514 - DNA, 22 bp, Homo sapiens
ggtcctaatatatatgtagaga

SEQ ID NO: 4996515 - DNA, 18 bp, Homo sapiens
ggtgtactgtactgaaga

SEQ ID NO: 4996516 - DNA, 23 bp, Homo sapiens
ggtgtactgtactgaagaacagt

SEQ ID NO: 4996517 - DNA, 17 bp, Homo sapiens
gtaaagttgtcttttaa

SEQ ID NO: 4996518 - DNA, 14 bp, Homo sapiens
gtaaattagtttga

SEQ ID NO: 4996519 - DNA, 17 bp, Homo sapiens
gtaacagtgcaagattt

SEQ ID NO: 4996520 - DNA, 14 bp, Homo sapiens
gtaataaaaagaga

SEQ ID NO: 4996521 - DNA, 20 bp, Homo sapiens
gtaatgtagggttatatttg

SEQ ID NO: 4996522 - DNA, 19 bp, Homo sapiens
gtacatactgaaaaataca

SEQ ID NO: 4996523 - DNA, 22 bp, Homo sapiens
gtagaaagacatctgcctgtaa

SEQ ID NO: 4996524 - DNA, 14 bp, Homo sapiens
gtagaaaggaaata

SEQ ID NO: 4996525 - DNA, 16 bp, Homo sapiens
gtagaaaggaaataga

SEQ ID NO: 4996526 - DNA, 21 bp, Homo sapiens
gtataatgtgtctgtgttgct

SEQ ID NO: 4996527 - DNA, 14 bp, Homo sapiens
gtatagtagaaaga

SEQ ID NO: 4996528 - DNA, 17 bp, Homo sapiens
gtatataatcatgctca

SEQ ID NO: 4996529 - DNA, 15 bp, Homo sapiens
gtatgtatataatca

SEQ ID NO: 4996530 - DNA, 12 bp, Homo sapiens
gtattaaagaaa

SEQ ID NO: 4996531 - DNA, 21 bp, Homo sapiens
gtattgagtcttaactgtatt

SEQ ID NO: 4996532 - DNA, 21 bp, Homo sapiens
gtatttaactacatctgcctc

SEQ ID NO: 4996533 - DNA, 19 bp, Homo sapiens
gtatttctttgtagaataa

SEQ ID NO: 4996534 - DNA, 16 bp, Homo sapiens
gtcatggtagattttt

SEQ ID NO: 4996535 - DNA, 17 bp, Homo sapiens
gtcctgcctcagcctcc

SEQ ID NO: 4996536 - DNA, 15 bp, Homo sapiens
gtcctgctttcctat

SEQ ID NO: 4996537 - DNA, 13 bp, Homo sapiens
gtctcagcctccc

SEQ ID NO: 4996538 - DNA, 13 bp, Homo sapiens
gtctctgctggcc

SEQ ID NO: 4996539 - DNA, 17 bp, Homo sapiens
gtctctgctggcccagc

SEQ ID NO: 4996540 - DNA, 22 bp, Homo sapiens
gtctgaaaggctatcctgctga

SEQ ID NO: 4996541 - DNA, 16 bp, Homo sapiens
gtctgtgttgcttcaa

SEQ ID NO: 4996542 - DNA, 15 bp, Homo sapiens
gtcttagttgatatt

SEQ ID NO: 4996543 - DNA, 22 bp, Homo sapiens
gtgactgcaagcatttttccat

SEQ ID NO: 4996544 - DNA, 15 bp, Homo sapiens
gtgagtgccatgctt

SEQ ID NO: 4996545 - DNA, 19 bp, Homo sapiens
gtgatagctactgtagaaa

SEQ ID NO: 4996546 - DNA, 23 bp, Homo sapiens
gtggaaaaatgcccatttttgct

SEQ ID NO: 4996547 - DNA, 22 bp, Homo sapiens
gtgtattgagtcttaactgtat

SEQ ID NO: 4996548 - DNA, 15 bp, Homo sapiens
gtgtctatttctgaa

SEQ ID NO: 4996549 - DNA, 13 bp, Homo sapiens
gtgtgtaaagtaa

SEQ ID NO: 4996550 - DNA, 22 bp, Homo sapiens
gtgttataatacgctgctgatc

SEQ ID NO: 4996551 - DNA, 20 bp, Homo sapiens
gtgttgcccaggctggtctc

SEQ ID NO: 4996552 - DNA, 18 bp, Homo sapiens
gttaaataaatagaaaga

SEQ ID NO: 4996553 - DNA, 17 bp, Homo sapiens
gttacgtataatgcttt

SEQ ID NO: 4996554 - DNA, 20 bp, Homo sapiens
gttagatgctattaagaagg

SEQ ID NO: 4996555 - DNA, 21 bp, Homo sapiens
gttaggtagagggagttgtca

SEQ ID NO: 4996556 - DNA, 20 bp, Homo sapiens
gttataatcagggaaactaa

SEQ ID NO: 4996557 - DNA, 17 bp, Homo sapiens
gttatagattgtcttaa

SEQ ID NO: 4996558 - DNA, 16 bp, Homo sapiens
gttattaatgtttctt

SEQ ID NO: 4996559 - DNA, 15 bp, Homo sapiens
gttcacctctgtaca

SEQ ID NO: 4996560 - DNA, 15 bp, Homo sapiens
gttccctctccctgt

SEQ ID NO: 4996561 - DNA, 17 bp, Homo sapiens
gttccctctccctgttg

SEQ ID NO: 4996562 - DNA, 23 bp, Homo sapiens
gttgtacttcatttctagagaaa

SEQ ID NO: 4996563 - DNA, 21 bp, Homo sapiens
gtttaaagtgaatttttaaag

SEQ ID NO: 4996564 - DNA, 23 bp, Homo sapiens
gtttaaagtgaatttttaaagac

SEQ ID NO: 4996565 - DNA, 15 bp, Homo sapiens
gtttaaatgccaaaa

SEQ ID NO: 4996566 - DNA, 19 bp, Homo sapiens
gtttaaatgccaaaatgta

SEQ ID NO: 4996567 - DNA, 21 bp, Homo sapiens
gtttaagggtggaaaaatgcc

SEQ ID NO: 4996568 - DNA, 21 bp, Homo sapiens
gtttacctaaaagctacagaa

SEQ ID NO: 4996569 - DNA, 17 bp, Homo sapiens
gtttactcccttctgta

SEQ ID NO: 4996570 - DNA, 21 bp, Homo sapiens
gtttctgatctgtactttgtg

SEQ ID NO: 4996571 - DNA, 23 bp, Homo sapiens
gtttctgatctgtactttgtgtt

SEQ ID NO: 4996572 - DNA, 23 bp, Homo sapiens
gtttggtaacgaatttaaaatgt

SEQ ID NO: 4996573 - DNA, 12 bp, Homo sapiens
gttttaaataaa

SEQ ID NO: 4996574 - DNA, 24 bp, Homo sapiens
gttttatttatatcttgttattaa

SEQ ID NO: 4996575 - DNA, 16 bp, Homo sapiens
gtttttcttctgaaat

SEQ ID NO: 4996576 - DNA, 13 bp, Homo sapiens
gttttttactttg

SEQ ID NO: 4996577 - DNA, 17 bp, Homo sapiens
gtttttttttttccaga

SEQ ID NO: 4996578 - DNA, 15 bp, Homo sapiens
taaaaactttaaaga

SEQ ID NO: 4996579 - DNA, 23 bp, Homo sapiens
taaaaatagaaaaaaagaaatta

SEQ ID NO: 4996580 - DNA, 21 bp, Homo sapiens
taaaaatgtaaattagtttga

SEQ ID NO: 4996581 - DNA, 15 bp, Homo sapiens
taaaacagacaataa

SEQ ID NO: 4996582 - DNA, 18 bp, Homo sapiens
taaaacagacaataattt

SEQ ID NO: 4996583 - DNA, 16 bp, Homo sapiens
tgtttatatattgaaa

SEQ ID NO: 4996584 - DNA, 19 bp, Homo sapiens
tgtttggtaacgaatttaa

SEQ ID NO: 4996585 - DNA, 15 bp, Homo sapiens
ttaaaaaattaaaaa

SEQ ID NO: 4996586 - DNA, 12 bp, Homo sapiens
ttaaaaacttta

SEQ ID NO: 4996587 - DNA, 19 bp, Homo sapiens
ttaaacaaaatttcacagt

SEQ ID NO: 4996588 - DNA, 21 bp, Homo sapiens
ttaaaccacagtctggagtga

SEQ ID NO: 4996589 - DNA, 14 bp, Homo sapiens
ttaaactagtttaa

SEQ ID NO: 4996590 - DNA, 14 bp, Homo sapiens
ttaaagacaaagca

SEQ ID NO: 4996591 - DNA, 14 bp, Homo sapiens
ttaaagcttgattt

SEQ ID NO: 4996592 - DNA, 20 bp, Homo sapiens
ttaaagcttgatttgatctt

SEQ ID NO: 4996593 - DNA, 19 bp, Homo sapiens
ttaaagtaaacttgtgtat

SEQ ID NO: 4996594 - DNA, 20 bp, Homo sapiens
ttaaagtaaacttgtgtatt

SEQ ID NO: 4996595 - DNA, 17 bp, Homo sapiens
ttaaataaatagaaaga

SEQ ID NO: 4996596 - DNA, 12 bp, Homo sapiens
ttaaatcatttg

SEQ ID NO: 4996597 - DNA, 22 bp, Homo sapiens
ttaaatcatttggttaaatcat

SEQ ID NO: 4996598 - DNA, 12 bp, Homo sapiens
ttaaatgccaaa

SEQ ID NO: 4996599 - DNA, 18 bp, Homo sapiens
ttaaatgccaaaatgtac

SEQ ID NO: 4996600 - DNA, 21 bp, Homo sapiens
ttaaatgccaaaatgtactta

SEQ ID NO: 4996601 - DNA, 22 bp, Homo sapiens
ttaaatgccaaaatgtacttaa

SEQ ID NO: 4996602 - DNA, 23 bp, Homo sapiens
ttaacatcactacaaaaagaaga

SEQ ID NO: 4996603 - DNA, 16 bp, Homo sapiens
ttaactaaatgctcat

SEQ ID NO: 4996604 - DNA, 17 bp, Homo sapiens
ttaactacatctgcctc

SEQ ID NO: 4996605 - DNA, 12 bp, Homo sapiens
ttaactgtattt

SEQ ID NO: 4996606 - DNA, 16 bp, Homo sapiens
ttaatagcccatttct

SEQ ID NO: 4996607 - DNA, 15 bp, Homo sapiens
ttaatcataaagaaa

SEQ ID NO: 4996608 - DNA, 22 bp, Homo sapiens
ttaatgcatttatcaataaaag

SEQ ID NO: 4996609 - DNA, 14 bp, Homo sapiens
ttaattaaaaactt

SEQ ID NO: 4996610 - DNA, 23 bp, Homo sapiens
ttaattaaaaactttaaagataa

SEQ ID NO: 4996611 - DNA, 21 bp, Homo sapiens
ttacaagcttaaagcttgatt

SEQ ID NO: 4996612 - DNA, 22 bp, Homo sapiens
ttaccaagtatgaagtataaat

SEQ ID NO: 4996613 - DNA, 13 bp, Homo sapiens
ttacgtataatgc

SEQ ID NO: 4996614 - DNA, 16 bp, Homo sapiens
ttactcccttctgtag

SEQ ID NO: 4996615 - DNA, 17 bp, Homo sapiens
ttactcccttctgtagt

SEQ ID NO: 4996616 - DNA, 21 bp, Homo sapiens
ttactcccttctgtagttttt

SEQ ID NO: 4996617 - DNA, 22 bp, Homo sapiens
ttactgcagcctttgcctcccc

SEQ ID NO: 4996618 - DNA, 18 bp, Homo sapiens
ttactgcttctctttgtg

SEQ ID NO: 4996619 - DNA, 17 bp, Homo sapiens
ttagaatgccataaaat

SEQ ID NO: 4996620 - DNA, 21 bp, Homo sapiens
ttagatgctattaagaaggca

SEQ ID NO: 4996621 - DNA, 22 bp, Homo sapiens
ttagggaaaatggatatagaaa

SEQ ID NO: 4996622 - DNA, 15 bp, Homo sapiens
ttagggtgggtaaga

SEQ ID NO: 4996623 - DNA, 13 bp, Homo sapiens
ttaggttgttacc

SEQ ID NO: 4996624 - DNA, 18 bp, Homo sapiens
ttagttacgtataatgct

SEQ ID NO: 4996625 - DNA, 20 bp, Homo sapiens
ttataagcgtatttagactg

SEQ ID NO: 4996626 - DNA, 14 bp, Homo sapiens
ttatagattgtctt

SEQ ID NO: 4996627 - DNA, 17 bp, Homo sapiens
ttatagattgtcttaat

SEQ ID NO: 4996628 - DNA, 15 bp, Homo sapiens
ttatatattgaaagt

SEQ ID NO: 4996629 - DNA, 19 bp, Homo sapiens
ttatattgacaacaaatca

SEQ ID NO: 4996630 - DNA, 19 bp, Homo sapiens
ttatccagctagtgccaaa

SEQ ID NO: 4996631 - DNA, 19 bp, Homo sapiens
ttatcttagtctatagaaa

SEQ ID NO: 4996632 - DNA, 23 bp, Homo sapiens
ttatgggttataatcagggaaac

SEQ ID NO: 4996633 - DNA, 20 bp, Homo sapiens
ttatgtgttacattattcca

SEQ ID NO: 4996634 - DNA, 16 bp, Homo sapiens
ttattcagctagaatt

SEQ ID NO: 4996635 - DNA, 19 bp, Homo sapiens
ttattcagctagaatttct

SEQ ID NO: 4996636 - DNA, 21 bp, Homo sapiens
ttattcagctagaatttctgg

SEQ ID NO: 4996637 - DNA, 23 bp, Homo sapiens
ttattgcaccattttcaatttgg

SEQ ID NO: 4996638 - DNA, 17 bp, Homo sapiens
ttcaaattggtctgaaa

SEQ ID NO: 4996639 - DNA, 21 bp, Homo sapiens
ttcaaattggtctgaaaggct

SEQ ID NO: 4996640 - DNA, 13 bp, Homo sapiens
ttcaaggctttaa

SEQ ID NO: 4996641 - DNA, 22 bp, Homo sapiens
ttcaatttggagcattaactaa

SEQ ID NO: 4996642 - DNA, 20 bp, Homo sapiens
ttcactcatgcaaactgctt

SEQ ID NO: 4996643 - DNA, 21 bp, Homo sapiens
ttcactggggcatgagatttt

SEQ ID NO: 4996644 - DNA, 19 bp, Homo sapiens
ttcacttgaaattaaagct

SEQ ID NO: 4996645 - DNA, 17 bp, Homo sapiens
ttcagaggctcatctaa

SEQ ID NO: 4996646 - DNA, 19 bp, Homo sapiens
ttcagaggctcatctaact

SEQ ID NO: 4996647 - DNA, 14 bp, Homo sapiens
ttcagctagaattt

SEQ ID NO: 4996648 - DNA, 18 bp, Homo sapiens
ttcagctagaatttctgg

SEQ ID NO: 4996649 - DNA, 17 bp, Homo sapiens
ttcagctttagaaatta

SEQ ID NO: 4996650 - DNA, 15 bp, Homo sapiens
ttcagtattttccag

SEQ ID NO: 4996651 - DNA, 20 bp, Homo sapiens
ttcagtttttttttttccag

SEQ ID NO: 4996652 - DNA, 14 bp, Homo sapiens
ttcattgtgattta

SEQ ID NO: 4996653 - DNA, 19 bp, Homo sapiens
ttccaaaataatctatatt

SEQ ID NO: 4996654 - DNA, 15 bp, Homo sapiens
ttccagagttgttgt

SEQ ID NO: 4996655 - DNA, 16 bp, Homo sapiens
ttccagccttatgtgt

SEQ ID NO: 4996656 - DNA, 22 bp, Homo sapiens
ttccagccttatgtgttacatt

SEQ ID NO: 4996657 - DNA, 22 bp, Homo sapiens
ttcccaggtaatttaaattggt

SEQ ID NO: 4996658 - DNA, 15 bp, Homo sapiens
ttcctgtctgtttat

SEQ ID NO: 4996659 - DNA, 21 bp, Homo sapiens
ttctatggagactttgctgtt

SEQ ID NO: 4996660 - DNA, 11 bp, Homo sapiens
ttctcctgccc

SEQ ID NO: 4996661 - DNA, 16 bp, Homo sapiens
ttctgaaatacaacca

SEQ ID NO: 4996662 - DNA, 21 bp, Homo sapiens
ttctgcaagcacatctgcatt

SEQ ID NO: 4996663 - DNA, 14 bp, Homo sapiens
ttctggtgggttga

SEQ ID NO: 4996664 - DNA, 21 bp, Homo sapiens
ttctgtagtttttaattaaaa

SEQ ID NO: 4996665 - DNA, 17 bp, Homo sapiens
ttctttgagactgggtc

SEQ ID NO: 4996666 - DNA, 21 bp, Homo sapiens
ttctttgtagaataaatggtt

SEQ ID NO: 4996667 - DNA, 15 bp, Homo sapiens
ttgaaagagaagcac

SEQ ID NO: 4996668 - DNA, 17 bp, Homo sapiens
ttgagaataagaatttg

SEQ ID NO: 4996669 - DNA, 15 bp, Homo sapiens
ttgatctttgtttaa

SEQ ID NO: 4996670 - DNA, 20 bp, Homo sapiens
ttgatctttgtttaaatgcc

SEQ ID NO: 4996671 - DNA, 11 bp, Homo sapiens
ttgatgtgctt

SEQ ID NO: 4996672 - DNA, 20 bp, Homo sapiens
ttgatgtgcttacataacca

SEQ ID NO: 4996673 - DNA, 20 bp, Homo sapiens
ttgatttgatctttgtttaa

SEQ ID NO: 4996674 - DNA, 19 bp, Homo sapiens
ttgccaagctaatctgcct

SEQ ID NO: 4996675 - DNA, 18 bp, Homo sapiens
ttgcctaaaatttctgag

SEQ ID NO: 4996676 - DNA, 14 bp, Homo sapiens
ttgctgttactgct

SEQ ID NO: 4996677 - DNA, 13 bp, Homo sapiens
ttgcttatattga

SEQ ID NO: 4996678 - DNA, 15 bp, Homo sapiens
ttgcttcaaattggt

SEQ ID NO: 4996679 - DNA, 22 bp, Homo sapiens
ttggaagaagttttttactttg

SEQ ID NO: 4996680 - DNA, 18 bp, Homo sapiens
aaaaataaaaacataaaa

SEQ ID NO: 4996681 - DNA, 17 bp, Homo sapiens
aaaaccagagggcagtc

SEQ ID NO: 4996682 - DNA, 17 bp, Homo sapiens
aaaataaaaacataaaa

SEQ ID NO: 4996683 - DNA, 16 bp, Homo sapiens
aaaatctgtggtggtc

SEQ ID NO: 4996684 - DNA, 18 bp, Homo sapiens
aaaatgcaacaacatgta

SEQ ID NO: 4996685 - DNA, 19 bp, Homo sapiens
aaacttgtgtatgatccaa

SEQ ID NO: 4996686 - DNA, 15 bp, Homo sapiens
aaagatggagaggca

SEQ ID NO: 4996687 - DNA, 13 bp, Homo sapiens
aaagatgtcccac

SEQ ID NO: 4996688 - DNA, 17 bp, Homo sapiens
aaagatgtcccacaggg

SEQ ID NO: 4996689 - DNA, 20 bp, Homo sapiens
aaagatgtcccacagggacc

SEQ ID NO: 4996690 - DNA, 13 bp, Homo sapiens
aaagccctcagat

SEQ ID NO: 4996691 - DNA, 16 bp, Homo sapiens
aaagccctcagatccc

SEQ ID NO: 4996692 - DNA, 22 bp, Homo sapiens
aaagccctcagatcccagggta

SEQ ID NO: 4996693 - DNA, 23 bp, Homo sapiens
aaagccctcagatcccagggtac

SEQ ID NO: 4996694 - DNA, 22 bp, Homo sapiens
aaagctgctgggccagtggcac

SEQ ID NO: 4996695 - DNA, 11 bp, Homo sapiens
aaataaatgtg

SEQ ID NO: 4996696 - DNA, 16 bp, Homo sapiens
aaatatacaaacatgt

SEQ ID NO: 4996697 - DNA, 20 bp, Homo sapiens
aaatatacaaacatgtggca

SEQ ID NO: 4996698 - DNA, 13 bp, Homo sapiens
aaatatagtagca

SEQ ID NO: 4996699 - DNA, 16 bp, Homo sapiens
aaatgatcttttcaag

SEQ ID NO: 4996700 - DNA, 14 bp, Homo sapiens
aaatgggttttact

SEQ ID NO: 4996701 - DNA, 12 bp, Homo sapiens
aaatgtgtaaat

SEQ ID NO: 4996702 - DNA, 21 bp, Homo sapiens
aaattaacactgcttgtgttt

SEQ ID NO: 4996703 - DNA, 15 bp, Homo sapiens
aacaccactttgtct

SEQ ID NO: 4996704 - DNA, 14 bp, Homo sapiens
aacactgcttgtgt

SEQ ID NO: 4996705 - DNA, 18 bp, Homo sapiens
aacagcaggaggcacagc

SEQ ID NO: 4996706 - DNA, 22 bp, Homo sapiens
aacagcttcatgttcccaaaat

SEQ ID NO: 4996707 - DNA, 13 bp, Homo sapiens
aaccagagggcag

SEQ ID NO: 4996708 - DNA, 14 bp, Homo sapiens
aaccagtcctgctg

SEQ ID NO: 4996709 - DNA, 17 bp, Homo sapiens
aaccagtcctgctgcct

SEQ ID NO: 4996710 - DNA, 16 bp, Homo sapiens
aaccatgggctcaggg

SEQ ID NO: 4996711 - DNA, 19 bp, Homo sapiens
aaccatgggctcagggcca

SEQ ID NO: 4996712 - DNA, 16 bp, Homo sapiens
aacccaaataaatgtg

SEQ ID NO: 4996713 - DNA, 22 bp, Homo sapiens
aacccaaattacgtgtactaca

SEQ ID NO: 4996714 - DNA, 15 bp, Homo sapiens
aacctttagctgtga

SEQ ID NO: 4996715 - DNA, 22 bp, Homo sapiens
aactaccgttcccaaattggtg

SEQ ID NO: 4996716 - DNA, 12 bp, Homo sapiens
aactcaatattt

SEQ ID NO: 4996717 - DNA, 13 bp, Homo sapiens
aactcaatatttt

SEQ ID NO: 4996718 - DNA, 14 bp, Homo sapiens
aactcaatattttc

SEQ ID NO: 4996719 - DNA, 11 bp, Homo sapiens
aactgccacct

SEQ ID NO: 4996720 - DNA, 21 bp, Homo sapiens
aagactctccactgacctggt

SEQ ID NO: 4996721 - DNA, 18 bp, Homo sapiens
aagagctgaggcaattct

SEQ ID NO: 4996722 - DNA, 16 bp, Homo sapiens
aagatcgaatttttca

SEQ ID NO: 4996723 - DNA, 24 bp, Homo sapiens
aagatggcactgtccagggcccat

SEQ ID NO: 4996724 - DNA, 20 bp, Homo sapiens
aagatgtcccacagggacca

SEQ ID NO: 4996725 - DNA, 18 bp, Homo sapiens
aagcaagatcgctgtgct

SEQ ID NO: 4996726 - DNA, 16 bp, Homo sapiens
aagcaatcactgggcc

SEQ ID NO: 4996727 - DNA, 19 bp, Homo sapiens
aagcaatcactgggcccag

SEQ ID NO: 4996728 - DNA, 20 bp, Homo sapiens
aagcaatcactgggcccaga

SEQ ID NO: 4996729 - DNA, 23 bp, Homo sapiens
aagcaatcactgggcccagagga

SEQ ID NO: 4996730 - DNA, 18 bp, Homo sapiens
aagccctcagatcccagg

SEQ ID NO: 4996731 - DNA, 19 bp, Homo sapiens
aagccctcagatcccaggg

SEQ ID NO: 4996732 - DNA, 17 bp, Homo sapiens
aagctcaggttccctgc

SEQ ID NO: 4996733 - DNA, 20 bp, Homo sapiens
aagctgcaaaaggcctgtga

SEQ ID NO: 4996734 - DNA, 20 bp, Homo sapiens
aagctgctgggccagtggca

SEQ ID NO: 4996735 - DNA, 23 bp, Homo sapiens
aagctgctgggccagtggcactc

SEQ ID NO: 4996736 - DNA, 16 bp, Homo sapiens
aaggaaaagattcctg

SEQ ID NO: 4996737 - DNA, 22 bp, Homo sapiens
aaggaagccacagctggtggta

SEQ ID NO: 4996738 - DNA, 22 bp, Homo sapiens
aaggatatttactacttttgca

SEQ ID NO: 4996739 - DNA, 17 bp, Homo sapiens
aaggcacaggtgtaaat

SEQ ID NO: 4996740 - DNA, 20 bp, Homo sapiens
aaggcagggagcgagggaga

SEQ ID NO: 4996741 - DNA, 14 bp, Homo sapiens
aagggtatgagctg

SEQ ID NO: 4996742 - DNA, 16 bp, Homo sapiens
aaggtttctgaaaatt

SEQ ID NO: 4996743 - DNA, 18 bp, Homo sapiens
aagtagctgctaccttct

SEQ ID NO: 4996744 - DNA, 12 bp, Homo sapiens
aataaaagtcag

SEQ ID NO: 4996745 - DNA, 12 bp, Homo sapiens
aataaactctct

SEQ ID NO: 4996746 - DNA, 18 bp, Homo sapiens
aataaagccttcaaactc

SEQ ID NO: 4996747 - DNA, 21 bp, Homo sapiens
aatacaccaggtagaacacaa

SEQ ID NO: 4996748 - DNA, 13 bp, Homo sapiens
aatacctcttgga

SEQ ID NO: 4996749 - DNA, 19 bp, Homo sapiens
aatagcacccatatctgtg

SEQ ID NO: 4996750 - DNA, 16 bp, Homo sapiens
aatagctgtgtatctg

SEQ ID NO: 4996751 - DNA, 15 bp, Homo sapiens
aatatggacaaagaa

SEQ ID NO: 4996752 - DNA, 14 bp, Homo sapiens
aatcactgggccca

SEQ ID NO: 4996753 - DNA, 12 bp, Homo sapiens
aatctgaactct

SEQ ID NO: 4996754 - DNA, 22 bp, Homo sapiens
aatctgaactctaagcagaaga

SEQ ID NO: 4996755 - DNA, 20 bp, Homo sapiens
aatgccatgactgctcaggc

SEQ ID NO: 4996756 - DNA, 15 bp, Homo sapiens
aatgctgccatgccc

SEQ ID NO: 4996757 - DNA, 23 bp, Homo sapiens
aatggctgtgccccacctgttgt

SEQ ID NO: 4996758 - DNA, 17 bp, Homo sapiens
aatggtttgaatataaa

SEQ ID NO: 4996759 - DNA, 19 bp, Homo sapiens
aatggtttgcaaggaagcc

SEQ ID NO: 4996760 - DNA, 22 bp, Homo sapiens
aattaagttagggaatggcaca

SEQ ID NO: 4996761 - DNA, 21 bp, Homo sapiens
aatttgatagtattgtgcata

SEQ ID NO: 4996762 - DNA, 15 bp, Homo sapiens
acaaaataaagctgt

SEQ ID NO: 4996763 - DNA, 22 bp, Homo sapiens
acaacatgtataatatttttaa

SEQ ID NO: 4996764 - DNA, 22 bp, Homo sapiens
acaagacccaagtagctgctac

SEQ ID NO: 4996765 - DNA, 21 bp, Homo sapiens
acaatgctgccatgcccacca

SEQ ID NO: 4996766 - DNA, 13 bp, Homo sapiens
acacacactggct

SEQ ID NO: 4996767 - DNA, 19 bp, Homo sapiens
agacattttcctcacaccc

SEQ ID NO: 4996768 - DNA, 23 bp, Homo sapiens
agacattttcctcacacccacct

SEQ ID NO: 4996769 - DNA, 16 bp, Homo sapiens
agaccctgcccacccc

SEQ ID NO: 4996770 - DNA, 19 bp, Homo sapiens
agaccctgcccaccccatc

SEQ ID NO: 4996771 - DNA, 22 bp, Homo sapiens
agaccctgcccaccccatccct

SEQ ID NO: 4996772 - DNA, 16 bp, Homo sapiens
agacccttctggtgcc

SEQ ID NO: 4996773 - DNA, 17 bp, Homo sapiens
agactatattgtacaca

SEQ ID NO: 4996774 - DNA, 17 bp, Homo sapiens
agactctccactgacct

SEQ ID NO: 4996775 - DNA, 17 bp, Homo sapiens
agacttctctttcttat

SEQ ID NO: 4996776 - DNA, 13 bp, Homo sapiens
agagatacagagg

SEQ ID NO: 4996777 - DNA, 13 bp, Homo sapiens
agagctgccctct

SEQ ID NO: 4996778 - DNA, 15 bp, Homo sapiens
agagctgccctctcc

SEQ ID NO: 4996779 - DNA, 22 bp, Homo sapiens
agagctgccctctcctgggcag

SEQ ID NO: 4996780 - DNA, 15 bp, Homo sapiens
agagcttccactgtc

SEQ ID NO: 4996781 - DNA, 17 bp, Homo sapiens
agaggcatgggggccca

SEQ ID NO: 4996782 - DNA, 15 bp, Homo sapiens
agaggggcctcatct

SEQ ID NO: 4996783 - DNA, 13 bp, Homo sapiens
agagtccaggcct

SEQ ID NO: 4996784 - DNA, 15 bp, Homo sapiens
agagtccaggcctgg

SEQ ID NO: 4996785 - DNA, 17 bp, Homo sapiens
agagtggagcccagggt

SEQ ID NO: 4996786 - DNA, 23 bp, Homo sapiens
agatagaatttggcccagagagg

SEQ ID NO: 4996787 - DNA, 12 bp, Homo sapiens
agatcccagggt

SEQ ID NO: 4996788 - DNA, 23 bp, Homo sapiens
agatcccagggtacactcttctc

SEQ ID NO: 4996789 - DNA, 14 bp, Homo sapiens
agatggagaggcat

SEQ ID NO: 4996790 - DNA, 22 bp, Homo sapiens
agatggcactgtccagggccca

SEQ ID NO: 4996791 - DNA, 13 bp, Homo sapiens
agatgtcccacag

SEQ ID NO: 4996792 - DNA, 14 bp, Homo sapiens
agatgtcccacagg

SEQ ID NO: 4996793 - DNA, 19 bp, Homo sapiens
agatgtcccacagggacca

SEQ ID NO: 4996794 - DNA, 13 bp, Homo sapiens
agattcctgtcct

SEQ ID NO: 4996795 - DNA, 14 bp, Homo sapiens
agattcctgtcctt

SEQ ID NO: 4996796 - DNA, 15 bp, Homo sapiens
agcaagatcgctgtg

SEQ ID NO: 4996797 - DNA, 14 bp, Homo sapiens
agcaatcactgggc

SEQ ID NO: 4996798 - DNA, 19 bp, Homo sapiens
agcaatcactgggcccaga

SEQ ID NO: 4996799 - DNA, 21 bp, Homo sapiens
agcaatcactgggcccagagg

SEQ ID NO: 4996800 - DNA, 22 bp, Homo sapiens
agcacatcactgagaagatggc

SEQ ID NO: 4996801 - DNA, 19 bp, Homo sapiens
agcacccatatctgtgtgc

SEQ ID NO: 4996802 - DNA, 15 bp, Homo sapiens
agcagaagactctcc

SEQ ID NO: 4996803 - DNA, 16 bp, Homo sapiens
agcagaagactctcca

SEQ ID NO: 4996804 - DNA, 14 bp, Homo sapiens
agcaggaggcacag

SEQ ID NO: 4996805 - DNA, 18 bp, Homo sapiens
agcaggaggcacagcagt

SEQ ID NO: 4996806 - DNA, 20 bp, Homo sapiens
agcagtcacaggcccaggaa

SEQ ID NO: 4996807 - DNA, 23 bp, Homo sapiens
agcagtcacaggcccaggaaggc

SEQ ID NO: 4996808 - DNA, 20 bp, Homo sapiens
agcagttcagagctgccctc

SEQ ID NO: 4996809 - DNA, 23 bp, Homo sapiens
agccaaggccctgagttggcagt

SEQ ID NO: 4996810 - DNA, 18 bp, Homo sapiens
agccatcatgtgcctgga

SEQ ID NO: 4996811 - DNA, 20 bp, Homo sapiens
agccatcatgtgcctggaaa

SEQ ID NO: 4996812 - DNA, 21 bp, Homo sapiens
agcccacggggcaaagctgct

SEQ ID NO: 4996813 - DNA, 22 bp, Homo sapiens
agcccacggggcaaagctgctg

SEQ ID NO: 4996814 - DNA, 17 bp, Homo sapiens
agcccagggtgctggga

SEQ ID NO: 4996815 - DNA, 18 bp, Homo sapiens
agccccactgccctccag

SEQ ID NO: 4996816 - DNA, 23 bp, Homo sapiens
agccccactgccctccagggcca

SEQ ID NO: 4996817 - DNA, 14 bp, Homo sapiens
agccctcagatccc

SEQ ID NO: 4996818 - DNA, 20 bp, Homo sapiens
agccctcagatcccagggta

SEQ ID NO: 4996819 - DNA, 16 bp, Homo sapiens
agccctccccacctgc

SEQ ID NO: 4996820 - DNA, 17 bp, Homo sapiens
agcgtggggaggggctg

SEQ ID NO: 4996821 - DNA, 14 bp, Homo sapiens
agctaaggccagct

SEQ ID NO: 4996822 - DNA, 14 bp, Homo sapiens
agctagagcttcca

SEQ ID NO: 4996823 - DNA, 20 bp, Homo sapiens
agctagagcttccactgtca

SEQ ID NO: 4996824 - DNA, 14 bp, Homo sapiens
agctctttgagata

SEQ ID NO: 4996825 - DNA, 23 bp, Homo sapiens
agctctttgagataatacattcc

SEQ ID NO: 4996826 - DNA, 22 bp, Homo sapiens
agctgatccttcaactctgtga

SEQ ID NO: 4996827 - DNA, 21 bp, Homo sapiens
agctgcaaaaggcctgtgatc

SEQ ID NO: 4996828 - DNA, 20 bp, Homo sapiens
agctgccctctcctgggcag

SEQ ID NO: 4996829 - DNA, 19 bp, Homo sapiens
agctgcctcccctcctctg

SEQ ID NO: 4996830 - DNA, 23 bp, Homo sapiens
agctgcctcccctcctctgcttg

SEQ ID NO: 4996831 - DNA, 14 bp, Homo sapiens
agctgctaccttct

SEQ ID NO: 4996832 - DNA, 15 bp, Homo sapiens
agctgctaccttctt

SEQ ID NO: 4996833 - DNA, 13 bp, Homo sapiens
agctgctgggcca

SEQ ID NO: 4996834 - DNA, 14 bp, Homo sapiens
agctgctgggccag

SEQ ID NO: 4996835 - DNA, 20 bp, Homo sapiens
agctgctgggccagtggcac

SEQ ID NO: 4996836 - DNA, 13 bp, Homo sapiens
agctggcaagctg

SEQ ID NO: 4996837 - DNA, 15 bp, Homo sapiens
agctgtgaatggctg

SEQ ID NO: 4996838 - DNA, 13 bp, Homo sapiens
agctgtgtatctg

SEQ ID NO: 4996839 - DNA, 19 bp, Homo sapiens
agctgttccacttctctag

SEQ ID NO: 4996840 - DNA, 17 bp, Homo sapiens
agctgttctcattcctg

SEQ ID NO: 4996841 - DNA, 15 bp, Homo sapiens
aggaaagatgtccca

SEQ ID NO: 4996842 - DNA, 22 bp, Homo sapiens
aggaagcaagatcgctgtgcta

SEQ ID NO: 4996843 - DNA, 15 bp, Homo sapiens
aggaaggcggcaggc

SEQ ID NO: 4996844 - DNA, 18 bp, Homo sapiens
aggactaatccaatacct

SEQ ID NO: 4996845 - DNA, 19 bp, Homo sapiens
aggactctagaagctcagg

SEQ ID NO: 4996846 - DNA, 20 bp, Homo sapiens
aggactctagaagctcaggt

SEQ ID NO: 4996847 - DNA, 13 bp, Homo sapiens
aggagacagacac

SEQ ID NO: 4996848 - DNA, 14 bp, Homo sapiens
aggagacccacagg

SEQ ID NO: 4996849 - DNA, 16 bp, Homo sapiens
aggagaggagacagac

SEQ ID NO: 4996850 - DNA, 22 bp, Homo sapiens
aggagatccagggcaaggccat

SEQ ID NO: 4996851 - DNA, 19 bp, Homo sapiens
aggagcccacggggcaaag

SEQ ID NO: 4996852 - DNA, 20 bp, Homo sapiens
aggagcccacggggcaaagc

SEQ ID NO: 4996853 - DNA, 19 bp, Homo sapiens
aggaggagtgggacagaca

SEQ ID NO: 4996854 - DNA, 23 bp, Homo sapiens
aggaggagtgggacagacagcag

SEQ ID NO: 4996855 - DNA, 16 bp, Homo sapiens
aggagtgggacagaca

SEQ ID NO: 4996856 - DNA, 21 bp, Homo sapiens
aggatgccttatctcttctca

SEQ ID NO: 4996857 - DNA, 14 bp, Homo sapiens
aggattcaggcctc

SEQ ID NO: 4996858 - DNA, 20 bp, Homo sapiens
aggattcaggcctctgagga

SEQ ID NO: 4996859 - DNA, 11 bp, Homo sapiens
aggcacagcag

SEQ ID NO: 4996860 - DNA, 22 bp, Homo sapiens
aggcacagcagtttcaccatct

SEQ ID NO: 4996861 - DNA, 24 bp, Homo sapiens
aggcaccatctgccaatgccatga

SEQ ID NO: 4996862 - DNA, 19 bp, Homo sapiens
aggcatggatgaataaatg

SEQ ID NO: 4996863 - DNA, 16 bp, Homo sapiens
aggcatgggggcccaa

SEQ ID NO: 4996864 - DNA, 13 bp, Homo sapiens
aggcctcacctcc

SEQ ID NO: 4996865 - DNA, 16 bp, Homo sapiens
aggcctcacctcccag

SEQ ID NO: 4996866 - DNA, 22 bp, Homo sapiens
aggcctcacctcccagggctac

SEQ ID NO: 4996867 - DNA, 19 bp, Homo sapiens
aggcctctactaggtctgc

SEQ ID NO: 4996868 - DNA, 12 bp, Homo sapiens
aggcctctgagg

SEQ ID NO: 4996869 - DNA, 14 bp, Homo sapiens
aggcctctgaggag

SEQ ID NO: 4996870 - DNA, 18 bp, Homo sapiens
aggcctctgaggagccca

SEQ ID NO: 4996871 - DNA, 19 bp, Homo sapiens
aggcctctgaggagcccac

SEQ ID NO: 4996872 - DNA, 16 bp, Homo sapiens
aggcctgtgatccagg

SEQ ID NO: 4996873 - DNA, 17 bp, Homo sapiens
aggcctgtgatccagga

SEQ ID NO: 4996874 - DNA, 19 bp, Homo sapiens
aggcgtcaacgtgcatttt

SEQ ID NO: 4996875 - DNA, 14 bp, Homo sapiens
aggctaagctgccg

SEQ ID NO: 4996876 - DNA, 13 bp, Homo sapiens
aggctccagacag

SEQ ID NO: 4996877 - DNA, 18 bp, Homo sapiens
aggctccagacaggagga

SEQ ID NO: 4996878 - DNA, 19 bp, Homo sapiens
aggctccagacaggaggag

SEQ ID NO: 4996879 - DNA, 23 bp, Homo sapiens
agggaccacatccaccccagccc

SEQ ID NO: 4996880 - DNA, 21 bp, Homo sapiens
agggagaagactatattgtac

SEQ ID NO: 4996881 - DNA, 16 bp, Homo sapiens
agggagcgagggagaa

SEQ ID NO: 4996882 - DNA, 14 bp, Homo sapiens
agggatgctcattc

SEQ ID NO: 4996883 - DNA, 19 bp, Homo sapiens
agggcagtctagtcctggg

SEQ ID NO: 4996884 - DNA, 18 bp, Homo sapiens
agggccaggattcaggcc

SEQ ID NO: 4996885 - DNA, 19 bp, Homo sapiens
agggccaggattcaggcct

SEQ ID NO: 4996886 - DNA, 20 bp, Homo sapiens
agggccaggattcaggcctc

SEQ ID NO: 4996887 - DNA, 22 bp, Homo sapiens
agggccaggtcctcacagcagt

SEQ ID NO: 4996888 - DNA, 14 bp, Homo sapiens
agggctacacagac

SEQ ID NO: 4996889 - DNA, 15 bp, Homo sapiens
agggctacacagacc

SEQ ID NO: 4996890 - DNA, 11 bp, Homo sapiens
agggctcagag

SEQ ID NO: 4996891 - DNA, 12 bp, Homo sapiens
agggctcagagg

SEQ ID NO: 4996892 - DNA, 13 bp, Homo sapiens
agggctcagaggg

SEQ ID NO: 4996893 - DNA, 19 bp, Homo sapiens
aagaaggcagcaggtggca

SEQ ID NO: 4996894 - DNA, 18 bp, Homo sapiens
aagacaccgttcattcag

SEQ ID NO: 4996895 - DNA, 18 bp, Homo sapiens
aagactctccactgacct

SEQ ID NO: 4996896 - DNA, 20 bp, Homo sapiens
aagactctccactgacctgg

SEQ ID NO: 4996897 - DNA, 14 bp, Homo sapiens
aagatcgctgtgct

SEQ ID NO: 4996898 - DNA, 16 bp, Homo sapiens
aagatggcactgtcca

SEQ ID NO: 4996899 - DNA, 22 bp, Homo sapiens
aagatggcactgtccagggccc

SEQ ID NO: 4996900 - DNA, 12 bp, Homo sapiens
aagatgtcccac

SEQ ID NO: 4996901 - DNA, 21 bp, Homo sapiens
aagatgtcccacagggaccac

SEQ ID NO: 4996902 - DNA, 14 bp, Homo sapiens
aagcaatcactggg

SEQ ID NO: 4996903 - DNA, 21 bp, Homo sapiens
aagcagacattttcctcacac

SEQ ID NO: 4996904 - DNA, 15 bp, Homo sapiens
aagccctcagatccc

SEQ ID NO: 4996905 - DNA, 20 bp, Homo sapiens
aagccctcagatcccagggt

SEQ ID NO: 4996906 - DNA, 18 bp, Homo sapiens
aagctgcaaaaggcctgt

SEQ ID NO: 4996907 - DNA, 15 bp, Homo sapiens
aagctgctgggccag

SEQ ID NO: 4996908 - DNA, 22 bp, Homo sapiens
aaggactaatccaatacctctt

SEQ ID NO: 4996909 - DNA, 13 bp, Homo sapiens
aaggccagctaga

SEQ ID NO: 4996910 - DNA, 18 bp, Homo sapiens
aaggcctgtgatccagga

SEQ ID NO: 4996911 - DNA, 14 bp, Homo sapiens
aaggcggcaggcag

SEQ ID NO: 4996912 - DNA, 17 bp, Homo sapiens
aaggcggcaggcagaga

SEQ ID NO: 4996913 - DNA, 16 bp, Homo sapiens
aagggtatgagctgga

SEQ ID NO: 4996914 - DNA, 23 bp, Homo sapiens
aaggtttgatgccaaagcagaca

SEQ ID NO: 4996915 - DNA, 17 bp, Homo sapiens
aagtagctgctaccttc

SEQ ID NO: 4996916 - DNA, 13 bp, Homo sapiens
aagtgcagcatgg

SEQ ID NO: 4996917 - DNA, 19 bp, Homo sapiens
aagttcaatctgtttttca

SEQ ID NO: 4996918 - DNA, 20 bp, Homo sapiens
aataaaagtcagagctcagg

SEQ ID NO: 4996919 - DNA, 11 bp, Homo sapiens
aataaactctc

SEQ ID NO: 4996920 - DNA, 21 bp, Homo sapiens
agaagaaggcagcaggtggca

SEQ ID NO: 4996921 - DNA, 14 bp, Homo sapiens
agaagatggcactg

SEQ ID NO: 4996922 - DNA, 18 bp, Homo sapiens
agaagatggcactgtcca

SEQ ID NO: 4996923 - DNA, 20 bp, Homo sapiens
agaagatggcactgtccagg

SEQ ID NO: 4996924 - DNA, 23 bp, Homo sapiens
agaagctcaggttccctgccaca

SEQ ID NO: 4996925 - DNA, 16 bp, Homo sapiens
agaaggaaaaggcagg

SEQ ID NO: 4996926 - DNA, 19 bp, Homo sapiens
agaaggggacagcgccacc

SEQ ID NO: 4996927 - DNA, 21 bp, Homo sapiens
agaagtactgcccttttgtgt

SEQ ID NO: 4996928 - DNA, 14 bp, Homo sapiens
agaatatggacaaa

SEQ ID NO: 4996929 - DNA, 14 bp, Homo sapiens
agaatttggcccag

SEQ ID NO: 4996930 - DNA, 17 bp, Homo sapiens
agacacacactggctcc

SEQ ID NO: 4996931 - DNA, 17 bp, Homo sapiens
agacaccgttcattcag

SEQ ID NO: 4996932 - DNA, 17 bp, Homo sapiens
agacagaaaaaaataaa

SEQ ID NO: 4996933 - DNA, 21 bp, Homo sapiens
agacagacacacactggctcc

SEQ ID NO: 4996934 - DNA, 14 bp, Homo sapiens
agacagcagctgga

SEQ ID NO: 4996935 - DNA, 16 bp, Homo sapiens
agacagcagctggact

SEQ ID NO: 4996936 - DNA, 15 bp, Homo sapiens
agacaggaggagtgg

SEQ ID NO: 4996937 - DNA, 19 bp, Homo sapiens
agacaggaggagtgggaca

SEQ ID NO: 4996938 - DNA, 13 bp, Homo sapiens
agacattttcctc

SEQ ID NO: 4996939 - DNA, 15 bp, Homo sapiens
agaccctgcccaccc

SEQ ID NO: 4996940 - DNA, 18 bp, Homo sapiens
agaccctgcccaccccat

SEQ ID NO: 4996941 - DNA, 20 bp, Homo sapiens
agactctccactgacctggt

SEQ ID NO: 4996942 - DNA, 17 bp, Homo sapiens
agactgttaaatgaaac

SEQ ID NO: 4996943 - DNA, 15 bp, Homo sapiens
agacttctctttctt

SEQ ID NO: 4996944 - DNA, 23 bp, Homo sapiens
agagagtgctgagaaggacacct

SEQ ID NO: 4996945 - DNA, 14 bp, Homo sapiens
agagctgccctctc

SEQ ID NO: 4996946 - DNA, 18 bp, Homo sapiens
agagctgccctctcctgg

SEQ ID NO: 4996947 - DNA, 19 bp, Homo sapiens
agagctgccctctcctggg

SEQ ID NO: 4996948 - DNA, 20 bp, Homo sapiens
agaggatgtggcaggggcag

SEQ ID NO: 4996949 - DNA, 23 bp, Homo sapiens
agaggatgtggcaggggcagtgg

SEQ ID NO: 4996950 - DNA, 21 bp, Homo sapiens
agaggcatgggggcccaaagg

SEQ ID NO: 4996951 - DNA, 13 bp, Homo sapiens
agataatccctgt

SEQ ID NO: 4996952 - DNA, 21 bp, Homo sapiens
agatagaatttggcccagaga

SEQ ID NO: 4996953 - DNA, 15 bp, Homo sapiens
agatcccagggtaca

SEQ ID NO: 4996954 - DNA, 17 bp, Homo sapiens
agatcctcttctcaaag

SEQ ID NO: 4996955 - DNA, 20 bp, Homo sapiens
agatcctcttctcaaagctg

SEQ ID NO: 4996956 - DNA, 21 bp, Homo sapiens
agatcctcttctcaaagctgg

SEQ ID NO: 4996957 - DNA, 16 bp, Homo sapiens
agatggagaggcatgg

SEQ ID NO: 4996958 - DNA, 14 bp, Homo sapiens
agatggcactgtcc

SEQ ID NO: 4996959 - DNA, 15 bp, Homo sapiens
agatggcactgtcca

SEQ ID NO: 4996960 - DNA, 18 bp, Homo sapiens
agatggcactgtccaggg

SEQ ID NO: 4996961 - DNA, 21 bp, Homo sapiens
agatggcactgtccagggccc

SEQ ID NO: 4996962 - DNA, 21 bp, Homo sapiens
agatgtcccacagggaccaca

SEQ ID NO: 4996963 - DNA, 16 bp, Homo sapiens
agcaatcactgggccc

SEQ ID NO: 4996964 - DNA, 17 bp, Homo sapiens
agcaatcactgggccca

SEQ ID NO: 4996965 - DNA, 20 bp, Homo sapiens
agcaatcactgggcccagag

SEQ ID NO: 4996966 - DNA, 16 bp, Homo sapiens
agcagtcacaggccca

SEQ ID NO: 4996967 - DNA, 22 bp, Homo sapiens
agcagtttcaccatctttgagg

SEQ ID NO: 4996968 - DNA, 17 bp, Homo sapiens
agcatcacttgggatta

SEQ ID NO: 4996969 - DNA, 23 bp, Homo sapiens
agcatggaggaaaatctgaactc

SEQ ID NO: 4996970 - DNA, 19 bp, Homo sapiens
agcattatgatgtgggtca

SEQ ID NO: 4996971 - DNA, 13 bp, Homo sapiens
agccacagctggt

SEQ ID NO: 4996972 - DNA, 22 bp, Homo sapiens
agccagagttgttctcaggggt

SEQ ID NO: 4996973 - DNA, 20 bp, Homo sapiens
agccagcagttcagagctgc

SEQ ID NO: 4996974 - DNA, 14 bp, Homo sapiens
agcccaaagaagga

SEQ ID NO: 4996975 - DNA, 11 bp, Homo sapiens
agcccagggtg

SEQ ID NO: 4996976 - DNA, 13 bp, Homo sapiens
agcccagggtgct

SEQ ID NO: 4996977 - DNA, 21 bp, Homo sapiens
agcccagggtgctgggatggc

SEQ ID NO: 4996978 - DNA, 12 bp, Homo sapiens
agccccactgcc

SEQ ID NO: 4996979 - DNA, 14 bp, Homo sapiens
agccccactgccct

SEQ ID NO: 4996980 - DNA, 20 bp, Homo sapiens
agccccactgccctccaggg

SEQ ID NO: 4996981 - DNA, 17 bp, Homo sapiens
agcccgtgccctaccac

SEQ ID NO: 4996982 - DNA, 17 bp, Homo sapiens
agccctcagatcccagg

SEQ ID NO: 4996983 - DNA, 22 bp, Homo sapiens
agccctccccacctgctcacca

SEQ ID NO: 4996984 - DNA, 15 bp, Homo sapiens
agcgtggggaggggc

SEQ ID NO: 4996985 - DNA, 23 bp, Homo sapiens
agctaataaaagtcagagctcag

SEQ ID NO: 4996986 - DNA, 24 bp, Homo sapiens
agctaataaaagtcagagctcagg

SEQ ID NO: 4996987 - DNA, 18 bp, Homo sapiens
agctcaggttccctgcca

SEQ ID NO: 4996988 - DNA, 21 bp, Homo sapiens
agctcaggtttctggacaaga

SEQ ID NO: 4996989 - DNA, 13 bp, Homo sapiens
agctccagttcga

SEQ ID NO: 4996990 - DNA, 21 bp, Homo sapiens
agctgatccttcaactctgtg

SEQ ID NO: 4996991 - DNA, 16 bp, Homo sapiens
agctgcaaaaggcctg

SEQ ID NO: 4996992 - DNA, 17 bp, Homo sapiens
agctgcaaaaggcctgt

SEQ ID NO: 4996993 - DNA, 17 bp, Homo sapiens
agctgccaaaatcgtag

SEQ ID NO: 4996994 - DNA, 13 bp, Homo sapiens
agctgccctctcc

SEQ ID NO: 4996995 - DNA, 19 bp, Homo sapiens
agctgccctctcctgggca

SEQ ID NO: 4996996 - DNA, 21 bp, Homo sapiens
agctgccctctcctgggcagc

SEQ ID NO: 4996997 - DNA, 15 bp, Homo sapiens
agctgcctcccctcc

SEQ ID NO: 4996998 - DNA, 18 bp, Homo sapiens
agctgcctcccctcctct

SEQ ID NO: 4996999 - DNA, 18 bp, Homo sapiens
agctgctaccttctttgg

SEQ ID NO: 4997000 - DNA, 16 bp, Homo sapiens
agctgctgggccagtg

SEQ ID NO: 4997001 - DNA, 23 bp, Homo sapiens
agctggagcccgtgccctaccac

SEQ ID NO: 4997002 - DNA, 18 bp, Homo sapiens
agctggagctaaggccag

SEQ ID NO: 4997003 - DNA, 19 bp, Homo sapiens
agctggagctaaggccagc

SEQ ID NO: 4997004 - DNA, 15 bp, Homo sapiens
agctggcaagctgca

SEQ ID NO: 4997005 - DNA, 20 bp, Homo sapiens
agctgtgaatggctgtgccc

SEQ ID NO: 4997006 - DNA, 22 bp, Homo sapiens
agctgttctcattcctgttctt

SEQ ID NO: 4997007 - DNA, 20 bp, Homo sapiens
agcttccactgtcagccctc

SEQ ID NO: 4997008 - DNA, 23 bp, Homo sapiens
agcttggaaactggatgaggtca

SEQ ID NO: 4997009 - DNA, 22 bp, Homo sapiens
catgtggttaatgccatggaca

SEQ ID NO: 4997010 - DNA, 14 bp, Homo sapiens
catgttcagggatg

SEQ ID NO: 4997011 - DNA, 22 bp, Homo sapiens
cattatgatgtgggtcaaggaa

SEQ ID NO: 4997012 - DNA, 18 bp, Homo sapiens
cattccatgactctgcct

SEQ ID NO: 4997013 - DNA, 15 bp, Homo sapiens
cattccctccaccca

SEQ ID NO: 4997014 - DNA, 22 bp, Homo sapiens
cattccctccacccacttgcct

SEQ ID NO: 4997015 - DNA, 21 bp, Homo sapiens
cattccgaggggctcagttct

SEQ ID NO: 4997016 - DNA, 14 bp, Homo sapiens
cattcctgttcttt

SEQ ID NO: 4997017 - DNA, 20 bp, Homo sapiens
catttctagcgcatggcctg

SEQ ID NO: 4997018 - DNA, 17 bp, Homo sapiens
ccaaaaccagagggcag

SEQ ID NO: 4997019 - DNA, 15 bp, Homo sapiens
ccaaactaccgttcc

SEQ ID NO: 4997020 - DNA, 15 bp, Homo sapiens
ccaaagtccaggcta

SEQ ID NO: 4997021 - DNA, 15 bp, Homo sapiens
ccaaataaatgtgta

SEQ ID NO: 4997022 - DNA, 19 bp, Homo sapiens
ccaaataaatgtgtaaatg

SEQ ID NO: 4997023 - DNA, 16 bp, Homo sapiens
ccaacatctccctccc

SEQ ID NO: 4997024 - DNA, 22 bp, Homo sapiens
ccaagagctgaggcaattctaa

SEQ ID NO: 4997025 - DNA, 21 bp, Homo sapiens
ccaagctgttccacttctcta

SEQ ID NO: 4997026 - DNA, 11 bp, Homo sapiens
ccaattcttac

SEQ ID NO: 4997027 - DNA, 19 bp, Homo sapiens
ccaattcttacaaacatgt

SEQ ID NO: 4997028 - DNA, 22 bp, Homo sapiens
ccacagggaccacatccacccc

SEQ ID NO: 4997029 - DNA, 14 bp, Homo sapiens
ccacccacttgcct

SEQ ID NO: 4997030 - DNA, 11 bp, Homo sapiens
ccaccccagcc

SEQ ID NO: 4997031 - DNA, 16 bp, Homo sapiens
ccaccccatccctggc

SEQ ID NO: 4997032 - DNA, 16 bp, Homo sapiens
ccaccccttggcactg

SEQ ID NO: 4997033 - DNA, 19 bp, Homo sapiens
ccacctccctgcaataaaa

SEQ ID NO: 4997034 - DNA, 17 bp, Homo sapiens
ccacctcttgtcagtgc

SEQ ID NO: 4997035 - DNA, 12 bp, Homo sapiens
ccacctgctgct

SEQ ID NO: 4997036 - DNA, 14 bp, Homo sapiens
ccacctgctgctgt

SEQ ID NO: 4997037 - DNA, 20 bp, Homo sapiens
ccacggggcaaagctgctgg

SEQ ID NO: 4997038 - DNA, 15 bp, Homo sapiens
ccacgttaagtccaa

SEQ ID NO: 4997039 - DNA, 13 bp, Homo sapiens
ccactaagtagaa

SEQ ID NO: 4997040 - DNA, 16 bp, Homo sapiens
ccactgacctggttgt

SEQ ID NO: 4997041 - DNA, 20 bp, Homo sapiens
ccactgccctccagggccag

SEQ ID NO: 4997042 - DNA, 21 bp, Homo sapiens
ccactgccctccagggccagg

SEQ ID NO: 4997043 - DNA, 22 bp, Homo sapiens
ccactgccctccagggccagga

SEQ ID NO: 4997044 - DNA, 15 bp, Homo sapiens
ccactgtcagccctc

SEQ ID NO: 4997045 - DNA, 16 bp, Homo sapiens
ccacttcctgccccaa

SEQ ID NO: 4997046 - DNA, 19 bp, Homo sapiens
ccacttctctactctggaa

SEQ ID NO: 4997047 - DNA, 21 bp, Homo sapiens
ccacttctctactctggaagt

SEQ ID NO: 4997048 - DNA, 12 bp, Homo sapiens
ccacttgcctgt

SEQ ID NO: 4997049 - DNA, 24 bp, Homo sapiens
ccacttgcctgtcaccccagtcac

SEQ ID NO: 4997050 - DNA, 16 bp, Homo sapiens
ccagactacttgggag

SEQ ID NO: 4997051 - DNA, 19 bp, Homo sapiens
ccagacttctctttcttat

SEQ ID NO: 4997052 - DNA, 18 bp, Homo sapiens
ccagaggagaggagacag

SEQ ID NO: 4997053 - DNA, 16 bp, Homo sapiens
ccagagggcagtctag

SEQ ID NO: 4997054 - DNA, 21 bp, Homo sapiens
ccagagggcagtctagtcctg

SEQ ID NO: 4997055 - DNA, 17 bp, Homo sapiens
ccagagttgttctcagg

SEQ ID NO: 4997056 - DNA, 23 bp, Homo sapiens
ccagagttgttctcaggggtgct

SEQ ID NO: 4997057 - DNA, 21 bp, Homo sapiens
ccagcagttcagagctgccct

SEQ ID NO: 4997058 - DNA, 22 bp, Homo sapiens
ccagcagttcagagctgccctc

SEQ ID NO: 4997059 - DNA, 22 bp, Homo sapiens
ccagccagcagttcagagctgc

SEQ ID NO: 4997060 - DNA, 16 bp, Homo sapiens
ccagccccactgccct

SEQ ID NO: 4997061 - DNA, 21 bp, Homo sapiens
ccagccccactgccctccagg

SEQ ID NO: 4997062 - DNA, 22 bp, Homo sapiens
ccagccccactgccctccaggg

SEQ ID NO: 4997063 - DNA, 14 bp, Homo sapiens
ccagctaggaagca

SEQ ID NO: 4997064 - DNA, 16 bp, Homo sapiens
ccaggaaagatgtccc

SEQ ID NO: 4997065 - DNA, 19 bp, Homo sapiens
ccaggaaggcggcaggcag

SEQ ID NO: 4997066 - DNA, 21 bp, Homo sapiens
ccaggattcaggcctctgagg

SEQ ID NO: 4997067 - DNA, 22 bp, Homo sapiens
ccaggattcaggcctctgagga

SEQ ID NO: 4997068 - DNA, 19 bp, Homo sapiens
ccaggcctctactaggtct

SEQ ID NO: 4997069 - DNA, 19 bp, Homo sapiens
ccaggcctgggtcacgctc

SEQ ID NO: 4997070 - DNA, 20 bp, Homo sapiens
ccaggcctgggtcacgctca

SEQ ID NO: 4997071 - DNA, 19 bp, Homo sapiens
ccaggctaattagaggatg

SEQ ID NO: 4997072 - DNA, 16 bp, Homo sapiens
ccagggccaggattca

SEQ ID NO: 4997073 - DNA, 13 bp, Homo sapiens
ccagggcccatgt

SEQ ID NO: 4997074 - DNA, 17 bp, Homo sapiens
ccagggctacacagacc

SEQ ID NO: 4997075 - DNA, 17 bp, Homo sapiens
ccaggtcctcacagcag

SEQ ID NO: 4997076 - DNA, 18 bp, Homo sapiens
ccaggtcctcacagcagt

SEQ ID NO: 4997077 - DNA, 21 bp, Homo sapiens
ccaggtcctcacagcagtcac

SEQ ID NO: 4997078 - DNA, 23 bp, Homo sapiens
ccaggtcctcacagcagtcacag

SEQ ID NO: 4997079 - DNA, 19 bp, Homo sapiens
ccaggttgcctcaacagca

SEQ ID NO: 4997080 - DNA, 22 bp, Homo sapiens
ccaggttgcctcaacagcagga

SEQ ID NO: 4997081 - DNA, 23 bp, Homo sapiens
ccagtcctgctgcctggagtcag

SEQ ID NO: 4997082 - DNA, 22 bp, Homo sapiens
ccagttcctttcaatggtttgc

SEQ ID NO: 4997083 - DNA, 13 bp, Homo sapiens
ccatatctgtgtg

SEQ ID NO: 4997084 - DNA, 15 bp, Homo sapiens
ccatatctgtgtgcc

SEQ ID NO: 4997085 - DNA, 16 bp, Homo sapiens
ccatatctgtgtgccc

SEQ ID NO: 4997086 - DNA, 18 bp, Homo sapiens
ccatcatgtgcctggaaa

SEQ ID NO: 4997087 - DNA, 13 bp, Homo sapiens
ccatccctccctc

SEQ ID NO: 4997088 - DNA, 22 bp, Homo sapiens
ccatccctggctgacctgctgt

SEQ ID NO: 4997089 - DNA, 23 bp, Homo sapiens
ccatcgggtgtaggtgaaaggca

SEQ ID NO: 4997090 - DNA, 22 bp, Homo sapiens
ccatgaaaatgcaacaacatgt

SEQ ID NO: 4997091 - DNA, 15 bp, Homo sapiens
ccatgactgctcagg

SEQ ID NO: 4997092 - DNA, 13 bp, Homo sapiens
ccatgcccaccat

SEQ ID NO: 4997093 - DNA, 16 bp, Homo sapiens
ccatgggagagtccag

SEQ ID NO: 4997094 - DNA, 13 bp, Homo sapiens
ccatgggctcagg

SEQ ID NO: 4997095 - DNA, 14 bp, Homo sapiens
ccatgggctcaggg

SEQ ID NO: 4997096 - DNA, 15 bp, Homo sapiens
ccatgggctcagggc

SEQ ID NO: 4997097 - DNA, 12 bp, Homo sapiens
cccaaagaagga

SEQ ID NO: 4997098 - DNA, 13 bp, Homo sapiens
cccaaagtccagg

SEQ ID NO: 4997099 - DNA, 15 bp, Homo sapiens
cccaaagtccaggct

SEQ ID NO: 4997100 - DNA, 19 bp, Homo sapiens
cccaaataaatgtgtaaat

SEQ ID NO: 4997101 - DNA, 22 bp, Homo sapiens
cccaagtagctgctaccttctt

SEQ ID NO: 4997102 - DNA, 21 bp, Homo sapiens
cccacggggcaaagctgctgg

SEQ ID NO: 4997103 - DNA, 22 bp, Homo sapiens
cccacggggcaaagctgctggg

SEQ ID NO: 4997104 - DNA, 20 bp, Homo sapiens
cccactgccctccagggcca

SEQ ID NO: 4997105 - DNA, 16 bp, Homo sapiens
cccagaggagaggaga

SEQ ID NO: 4997106 - DNA, 22 bp, Homo sapiens
cccagaggagaggagacagaca

SEQ ID NO: 4997107 - DNA, 17 bp, Homo sapiens
cccagccagcagttcag

SEQ ID NO: 4997108 - DNA, 15 bp, Homo sapiens
cccagccccactgcc

SEQ ID NO: 4997109 - DNA, 15 bp, Homo sapiens
cccagccctccccac

SEQ ID NO: 4997110 - DNA, 19 bp, Homo sapiens
cccaggaaggcggcaggca

SEQ ID NO: 4997111 - DNA, 15 bp, Homo sapiens
cccagggaagttttg

SEQ ID NO: 4997112 - DNA, 16 bp, Homo sapiens
cccagggctacacaga

SEQ ID NO: 4997113 - DNA, 17 bp, Homo sapiens
cccagggctacacagac

SEQ ID NO: 4997114 - DNA, 18 bp, Homo sapiens
cccagggctacacagacc

SEQ ID NO: 4997115 - DNA, 22 bp, Homo sapiens
cccagggctacacagaccctgc

SEQ ID NO: 4997116 - DNA, 22 bp, Homo sapiens
ccccaacatctccctcccacat

SEQ ID NO: 4997117 - DNA, 10 bp, Homo sapiens
ccccacctgt

SEQ ID NO: 4997118 - DNA, 22 bp, Homo sapiens
ccccacctgttgtcctgaactg

SEQ ID NO: 4997119 - DNA, 13 bp, Homo sapiens
ccccactgccctc

SEQ ID NO: 4997120 - DNA, 19 bp, Homo sapiens
ccccacttctctactctgg

SEQ ID NO: 4997121 - DNA, 21 bp, Homo sapiens
ccccacttctctactctggaa

SEQ ID NO: 4997122 - DNA, 19 bp, Homo sapiens
ccccagacttctctttctt

SEQ ID NO: 4997123 - DNA, 15 bp, Homo sapiens
ccccagccccactgc

SEQ ID NO: 4997124 - DNA, 24 bp, Homo sapiens
ccccagccccactgccctccaggg

SEQ ID NO: 4997125 - DNA, 15 bp, Homo sapiens
ccccatccctggctg

SEQ ID NO: 4997126 - DNA, 14 bp, Homo sapiens
cccccctgtgcctg

SEQ ID NO: 4997127 - DNA, 17 bp, Homo sapiens
ccccctgtgcctgctgg

SEQ ID NO: 4997128 - DNA, 20 bp, Homo sapiens
ccccctgtgcctgctgggca

SEQ ID NO: 4997129 - DNA, 13 bp, Homo sapiens
cccctcctctgct

SEQ ID NO: 4997130 - DNA, 15 bp, Homo sapiens
cccctgtgcctgctg

SEQ ID NO: 4997131 - DNA, 17 bp, Homo sapiens
cccctgtgcctgctggg

SEQ ID NO: 4997132 - DNA, 23 bp, Homo sapiens
cccctgtgcctgctgggcactgg

SEQ ID NO: 4997133 - DNA, 15 bp, Homo sapiens
ccctattctgccatg

SEQ ID NO: 4997134 - DNA, 18 bp, Homo sapiens
ccctattctgccatggga

SEQ ID NO: 4997135 - DNA, 20 bp, Homo sapiens
ccctcactgtcagtcccact

SEQ ID NO: 4997136 - DNA, 15 bp, Homo sapiens
ccctccacctccctg

SEQ ID NO: 4997137 - DNA, 14 bp, Homo sapiens
aggctccagacagg

SEQ ID NO: 4997138 - DNA, 15 bp, Homo sapiens
aggctccagacagga

SEQ ID NO: 4997139 - DNA, 16 bp, Homo sapiens
aggctccagacaggag

SEQ ID NO: 4997140 - DNA, 17 bp, Homo sapiens
aggctccagacaggagg

SEQ ID NO: 4997141 - DNA, 11 bp, Homo sapiens
aggctctccaa

SEQ ID NO: 4997142 - DNA, 18 bp, Homo sapiens
aggctgccaggcaccatc

SEQ ID NO: 4997143 - DNA, 17 bp, Homo sapiens
agggaccacatccaccc

SEQ ID NO: 4997144 - DNA, 20 bp, Homo sapiens
agggaccacatccaccccag

SEQ ID NO: 4997145 - DNA, 22 bp, Homo sapiens
agggaccacatccaccccagcc

SEQ ID NO: 4997146 - DNA, 14 bp, Homo sapiens
agggccaggattca

SEQ ID NO: 4997147 - DNA, 21 bp, Homo sapiens
agggccaggattcaggcctct

SEQ ID NO: 4997148 - DNA, 19 bp, Homo sapiens
agggccaggtcctcacagc

SEQ ID NO: 4997149 - DNA, 19 bp, Homo sapiens
agggcccatgtagctggca

SEQ ID NO: 4997150 - DNA, 19 bp, Homo sapiens
agggctacacagaccctgc

SEQ ID NO: 4997151 - DNA, 17 bp, Homo sapiens
aggggcagtggcctgga

SEQ ID NO: 4997152 - DNA, 18 bp, Homo sapiens
aggggtgctggggcagag

SEQ ID NO: 4997153 - DNA, 13 bp, Homo sapiens
aggtcctcacagc

SEQ ID NO: 4997154 - DNA, 16 bp, Homo sapiens
aggtcctcacagcagt

SEQ ID NO: 4997155 - DNA, 21 bp, Homo sapiens
aggtcctcacagcagtcacag

SEQ ID NO: 4997156 - DNA, 23 bp, Homo sapiens
aggtcctcacagcagtcacaggc

SEQ ID NO: 4997157 - DNA, 17 bp, Homo sapiens
aggtctagaaggccagg

SEQ ID NO: 4997158 - DNA, 20 bp, Homo sapiens
aggtctagaaggccaggcct

SEQ ID NO: 4997159 - DNA, 21 bp, Homo sapiens
aggtctagaaggccaggcctc

SEQ ID NO: 4997160 - DNA, 14 bp, Homo sapiens
aggtctgctcctga

SEQ ID NO: 4997161 - DNA, 14 bp, Homo sapiens
aggtgctgccaccc

SEQ ID NO: 4997162 - DNA, 15 bp, Homo sapiens
aggtgctgccacccc

SEQ ID NO: 4997163 - DNA, 21 bp, Homo sapiens
aggtgctgccaccccttggca

SEQ ID NO: 4997164 - DNA, 11 bp, Homo sapiens
aggtgtaaata

SEQ ID NO: 4997165 - DNA, 19 bp, Homo sapiens
aggttgcagtgagctgaga

SEQ ID NO: 4997166 - DNA, 20 bp, Homo sapiens
aggttgcagtgagctgagat

SEQ ID NO: 4997167 - DNA, 20 bp, Homo sapiens
aggttgcctcaacagcagga

SEQ ID NO: 4997168 - DNA, 14 bp, Homo sapiens
aggtttctgaaaat

SEQ ID NO: 4997169 - DNA, 14 bp, Homo sapiens
agtacatggagctc

SEQ ID NO: 4997170 - DNA, 15 bp, Homo sapiens
agtacatggagctca

SEQ ID NO: 4997171 - DNA, 17 bp, Homo sapiens
agtacatggagctcagg

SEQ ID NO: 4997172 - DNA, 21 bp, Homo sapiens
agtagaaagacagagctggga

SEQ ID NO: 4997173 - DNA, 14 bp, Homo sapiens
agtagccagagttg

SEQ ID NO: 4997174 - DNA, 18 bp, Homo sapiens
agtagctgctaccttctt

SEQ ID NO: 4997175 - DNA, 16 bp, Homo sapiens
agtattttatctgtgt

SEQ ID NO: 4997176 - DNA, 14 bp, Homo sapiens
agtcacaggcccag

SEQ ID NO: 4997177 - DNA, 23 bp, Homo sapiens
agtcacctaagcaatcactgggc

SEQ ID NO: 4997178 - DNA, 14 bp, Homo sapiens
agtcagagctcagg

SEQ ID NO: 4997179 - DNA, 15 bp, Homo sapiens
agtcagtagccagag

SEQ ID NO: 4997180 - DNA, 16 bp, Homo sapiens
agtcagtagccagagt

SEQ ID NO: 4997181 - DNA, 18 bp, Homo sapiens
agtcagtagccagagttg

SEQ ID NO: 4997182 - DNA, 17 bp, Homo sapiens
agtccaggcctgggtca

SEQ ID NO: 4997183 - DNA, 22 bp, Homo sapiens
agtccaggctaattagaggatg

SEQ ID NO: 4997184 - DNA, 21 bp, Homo sapiens
agtccatatttcaatttccaa

SEQ ID NO: 4997185 - DNA, 12 bp, Homo sapiens
agtcccactgca

SEQ ID NO: 4997186 - DNA, 12 bp, Homo sapiens
agtcctgatcct

SEQ ID NO: 4997187 - DNA, 21 bp, Homo sapiens
agtcctgatcctaaccctggg

SEQ ID NO: 4997188 - DNA, 11 bp, Homo sapiens
agtcctgctgc

SEQ ID NO: 4997189 - DNA, 14 bp, Homo sapiens
agtcctgctgcctg

SEQ ID NO: 4997190 - DNA, 12 bp, Homo sapiens
agtcctggaagc

SEQ ID NO: 4997191 - DNA, 22 bp, Homo sapiens
agtcctgggggtaaagccctca

SEQ ID NO: 4997192 - DNA, 16 bp, Homo sapiens
agtctgagtaaaatct

SEQ ID NO: 4997193 - DNA, 14 bp, Homo sapiens
agtgaaagcatcac

SEQ ID NO: 4997194 - DNA, 17 bp, Homo sapiens
agtgcagcatggaggaa

SEQ ID NO: 4997195 - DNA, 12 bp, Homo sapiens
agtggagcccag

SEQ ID NO: 4997196 - DNA, 14 bp, Homo sapiens
agtggagcccaggg

SEQ ID NO: 4997197 - DNA, 17 bp, Homo sapiens
agtggagcccagggtgc

SEQ ID NO: 4997198 - DNA, 14 bp, Homo sapiens
agtggcactctgtg

SEQ ID NO: 4997199 - DNA, 18 bp, Homo sapiens
agttcagagctgccctct

SEQ ID NO: 4997200 - DNA, 21 bp, Homo sapiens
agttcagagctgccctctcct

SEQ ID NO: 4997201 - DNA, 22 bp, Homo sapiens
agttcagagctgccctctcctg

SEQ ID NO: 4997202 - DNA, 23 bp, Homo sapiens
agttcagagctgccctctcctgg

SEQ ID NO: 4997203 - DNA, 19 bp, Homo sapiens
agttctgccttatctaaat

SEQ ID NO: 4997204 - DNA, 22 bp, Homo sapiens
agttgacttgacagaacactgt

SEQ ID NO: 4997205 - DNA, 15 bp, Homo sapiens
ataaacttgtgtatg

SEQ ID NO: 4997206 - DNA, 20 bp, Homo sapiens
ataatatttttaattaaata

SEQ ID NO: 4997207 - DNA, 19 bp, Homo sapiens
cagggaccacatccacccc

SEQ ID NO: 4997208 - DNA, 21 bp, Homo sapiens
cagggaccacatccaccccag

SEQ ID NO: 4997209 - DNA, 21 bp, Homo sapiens
cagggatgctcattccatgac

SEQ ID NO: 4997210 - DNA, 15 bp, Homo sapiens
cagggccaggtcctc

SEQ ID NO: 4997211 - DNA, 19 bp, Homo sapiens
cagggccaggtcctcacag

SEQ ID NO: 4997212 - DNA, 21 bp, Homo sapiens
cagggccaggtcctcacagca

SEQ ID NO: 4997213 - DNA, 19 bp, Homo sapiens
cagggctacacagaccctg

SEQ ID NO: 4997214 - DNA, 13 bp, Homo sapiens
caggggcagtggc

SEQ ID NO: 4997215 - DNA, 14 bp, Homo sapiens
caggggcagtggcc

SEQ ID NO: 4997216 - DNA, 16 bp, Homo sapiens
caggggcagtggcctg

SEQ ID NO: 4997217 - DNA, 17 bp, Homo sapiens
caggggtgctggggcag

SEQ ID NO: 4997218 - DNA, 22 bp, Homo sapiens
caggggtgctggggcagagtgg

SEQ ID NO: 4997219 - DNA, 19 bp, Homo sapiens
caggtagaacacaaggtca

SEQ ID NO: 4997220 - DNA, 20 bp, Homo sapiens
caggtatgaccttctaggaa

SEQ ID NO: 4997221 - DNA, 21 bp, Homo sapiens
caggtcctcacagcagtcaca

SEQ ID NO: 4997222 - DNA, 22 bp, Homo sapiens
caggtcctcacagcagtcacag

SEQ ID NO: 4997223 - DNA, 19 bp, Homo sapiens
caggtctagaaggccaggc

SEQ ID NO: 4997224 - DNA, 22 bp, Homo sapiens
caggtctagaaggccaggcctc

SEQ ID NO: 4997225 - DNA, 14 bp, Homo sapiens
caggtttctggaca

SEQ ID NO: 4997226 - DNA, 18 bp, Homo sapiens
caggtttctggacaagaa

SEQ ID NO: 4997227 - DNA, 14 bp, Homo sapiens
cagtaagtcttttt

SEQ ID NO: 4997228 - DNA, 18 bp, Homo sapiens
cagtcacaggcccaggaa

SEQ ID NO: 4997229 - DNA, 17 bp, Homo sapiens
cagtcacctaagcaatc

SEQ ID NO: 4997230 - DNA, 15 bp, Homo sapiens
cagtcccactgcacc

SEQ ID NO: 4997231 - DNA, 13 bp, Homo sapiens
cagtcctgctgcc

SEQ ID NO: 4997232 - DNA, 17 bp, Homo sapiens
cagtcctgctgcctgga

SEQ ID NO: 4997233 - DNA, 21 bp, Homo sapiens
cagtcctgctgcctggagtca

SEQ ID NO: 4997234 - DNA, 23 bp, Homo sapiens
cagtcctggaagccggccggctg

SEQ ID NO: 4997235 - DNA, 14 bp, Homo sapiens
cagtctagtcctgg

SEQ ID NO: 4997236 - DNA, 16 bp, Homo sapiens
cagtgcctgatgggag

SEQ ID NO: 4997237 - DNA, 19 bp, Homo sapiens
cagtgcttgattgcgtgga

SEQ ID NO: 4997238 - DNA, 16 bp, Homo sapiens
cagtggcctggatgca

SEQ ID NO: 4997239 - DNA, 18 bp, Homo sapiens
cagttcagagctgccctc

SEQ ID NO: 4997240 - DNA, 19 bp, Homo sapiens
cagttcagagctgccctct

SEQ ID NO: 4997241 - DNA, 12 bp, Homo sapiens
catagcagctgc

SEQ ID NO: 4997242 - DNA, 22 bp, Homo sapiens
cataggttcacaccattttgtt

SEQ ID NO: 4997243 - DNA, 22 bp, Homo sapiens
catatctgtgtgccctagggct

SEQ ID NO: 4997244 - DNA, 23 bp, Homo sapiens
catatctgtgtgccctagggctc

SEQ ID NO: 4997245 - DNA, 11 bp, Homo sapiens
catatgaaaaa

SEQ ID NO: 4997246 - DNA, 22 bp, Homo sapiens
catcactgagaagatggcactg

SEQ ID NO: 4997247 - DNA, 16 bp, Homo sapiens
catcatgtgcctggaa

SEQ ID NO: 4997248 - DNA, 13 bp, Homo sapiens
catccaccccagc

SEQ ID NO: 4997249 - DNA, 19 bp, Homo sapiens
catccaccccagccccact

SEQ ID NO: 4997250 - DNA, 12 bp, Homo sapiens
catccctccctc

SEQ ID NO: 4997251 - DNA, 20 bp, Homo sapiens
catccctccctccacctccc

SEQ ID NO: 4997252 - DNA, 12 bp, Homo sapiens
catccctggctg

SEQ ID NO: 4997253 - DNA, 13 bp, Homo sapiens
catccctggctga

SEQ ID NO: 4997254 - DNA, 17 bp, Homo sapiens
catccctggctgacctg

SEQ ID NO: 4997255 - DNA, 18 bp, Homo sapiens
catccctggctgacctgc

SEQ ID NO: 4997256 - DNA, 21 bp, Homo sapiens
catccctggctgacctgctgt

SEQ ID NO: 4997257 - DNA, 22 bp, Homo sapiens
catcgggtgtaggtgaaaggca

SEQ ID NO: 4997258 - DNA, 22 bp, Homo sapiens
catctgccaatgccatgactgc

SEQ ID NO: 4997259 - DNA, 17 bp, Homo sapiens
catcttccccagccctc

SEQ ID NO: 4997260 - DNA, 20 bp, Homo sapiens
catgactgctcaggcctcac

SEQ ID NO: 4997261 - DNA, 12 bp, Homo sapiens
catgatcacaca

SEQ ID NO: 4997262 - DNA, 14 bp, Homo sapiens
catgatcacacagc

SEQ ID NO: 4997263 - DNA, 15 bp, Homo sapiens
catgatcacacagct

SEQ ID NO: 4997264 - DNA, 13 bp, Homo sapiens
catggagctcagg

SEQ ID NO: 4997265 - DNA, 14 bp, Homo sapiens
catgggagagtcca

SEQ ID NO: 4997266 - DNA, 19 bp, Homo sapiens
catgggagagtccaggcct

SEQ ID NO: 4997267 - DNA, 12 bp, Homo sapiens
catgggctcagg

SEQ ID NO: 4997268 - DNA, 16 bp, Homo sapiens
catgggctcagggcca

SEQ ID NO: 4997269 - DNA, 18 bp, Homo sapiens
catgggctcagggccagg

SEQ ID NO: 4997270 - DNA, 19 bp, Homo sapiens
catgggctcagggccaggt

SEQ ID NO: 4997271 - DNA, 20 bp, Homo sapiens
catgtataatatttttaatt

SEQ ID NO: 4997272 - DNA, 16 bp, Homo sapiens
catgtgcctctgtcct

SEQ ID NO: 4997273 - DNA, 13 bp, Homo sapiens
catgtgcctggaa

SEQ ID NO: 4997274 - DNA, 17 bp, Homo sapiens
catgtggttaatgccat

SEQ ID NO: 4997275 - DNA, 21 bp, Homo sapiens
tgtggcaggggcagtggcctg

SEQ ID NO: 4997276 - DNA, 22 bp, Homo sapiens
tgtgggaaaatggcagaaagat

SEQ ID NO: 4997277 - DNA, 15 bp, Homo sapiens
tgtggttaatgccat

SEQ ID NO: 4997278 - DNA, 19 bp, Homo sapiens
tgtgtgccctagggctcag

SEQ ID NO: 4997279 - DNA, 22 bp, Homo sapiens
tgttccacttctctagagaaca

SEQ ID NO: 4997280 - DNA, 22 bp, Homo sapiens
tgttctcaggggtgctggggca

SEQ ID NO: 4997281 - DNA, 18 bp, Homo sapiens
tgttctcattcctgttct

SEQ ID NO: 4997282 - DNA, 19 bp, Homo sapiens
tgttctcattcctgttctt

SEQ ID NO: 4997283 - DNA, 14 bp, Homo sapiens
ttaaagcaaaggag

SEQ ID NO: 4997284 - DNA, 19 bp, Homo sapiens
ttaacactgcttgtgtttt

SEQ ID NO: 4997285 - DNA, 21 bp, Homo sapiens
ttaagtccaaggagaagaaga

SEQ ID NO: 4997286 - DNA, 16 bp, Homo sapiens
ttaatatggggatgca

SEQ ID NO: 4997287 - DNA, 12 bp, Homo sapiens
ttacaaacatgt

SEQ ID NO: 4997288 - DNA, 16 bp, Homo sapiens
ttagcacatcactgag

SEQ ID NO: 4997289 - DNA, 16 bp, Homo sapiens
ttatagccgaaatgat

SEQ ID NO: 4997290 - DNA, 20 bp, Homo sapiens
ttatgatgtgggtcaaggaa

SEQ ID NO: 4997291 - DNA, 21 bp, Homo sapiens
ttatgatgtgggtcaaggaat

SEQ ID NO: 4997292 - DNA, 15 bp, Homo sapiens
ttatgccttttattt

SEQ ID NO: 4997293 - DNA, 17 bp, Homo sapiens
ttatggagtgtcaccag

SEQ ID NO: 4997294 - DNA, 13 bp, Homo sapiens
ttcaactctgtga

SEQ ID NO: 4997295 - DNA, 15 bp, Homo sapiens
ttcaactctgtgagg

SEQ ID NO: 4997296 - DNA, 17 bp, Homo sapiens
ttcaagttaaattttat

SEQ ID NO: 4997297 - DNA, 23 bp, Homo sapiens
ttcaatggtttgcaaggaagcca

SEQ ID NO: 4997298 - DNA, 19 bp, Homo sapiens
ttcaatttccaagagctga

SEQ ID NO: 4997299 - DNA, 16 bp, Homo sapiens
ttcaccatctttgagg

SEQ ID NO: 4997300 - DNA, 13 bp, Homo sapiens
ttcagagctgccc

SEQ ID NO: 4997301 - DNA, 19 bp, Homo sapiens
ttcagagctgccctctcct

SEQ ID NO: 4997302 - DNA, 20 bp, Homo sapiens
ttcagagctgccctctcctg

SEQ ID NO: 4997303 - DNA, 21 bp, Homo sapiens
ttcagagctgccctctcctgg

SEQ ID NO: 4997304 - DNA, 15 bp, Homo sapiens
ttcaggcctctgagg

SEQ ID NO: 4997305 - DNA, 13 bp, Homo sapiens
ttccaagagctga

SEQ ID NO: 4997306 - DNA, 17 bp, Homo sapiens
ttccacttcctgcccca

SEQ ID NO: 4997307 - DNA, 14 bp, Homo sapiens
ttccatgactctgc

SEQ ID NO: 4997308 - DNA, 19 bp, Homo sapiens
ttcctcacacccacctgct

SEQ ID NO: 4997309 - DNA, 17 bp, Homo sapiens
ttccttttcttgtctct

SEQ ID NO: 4997310 - DNA, 20 bp, Homo sapiens
ttcgatgggcccaattctta

SEQ ID NO: 4997311 - DNA, 18 bp, Homo sapiens
ttctcaggggtgctgggg

SEQ ID NO: 4997312 - DNA, 12 bp, Homo sapiens
ttctcattcctg

SEQ ID NO: 4997313 - DNA, 12 bp, Homo sapiens
ttctctgcctcc

SEQ ID NO: 4997314 - DNA, 19 bp, Homo sapiens
ttctctttcttattttgta

SEQ ID NO: 4997315 - DNA, 23 bp, Homo sapiens
ttctctttcttattttgtaataa

SEQ ID NO: 4997316 - DNA, 19 bp, Homo sapiens
ttctgaatttcattctctt

SEQ ID NO: 4997317 - DNA, 17 bp, Homo sapiens
ttcttaaacaaatgtat

SEQ ID NO: 4997318 - DNA, 15 bp, Homo sapiens
ttgaaggtgctgcca

SEQ ID NO: 4997319 - DNA, 15 bp, Homo sapiens
ttgaatataaacact

SEQ ID NO: 4997320 - DNA, 16 bp, Homo sapiens
ttgaatataaacacta

SEQ ID NO: 4997321 - DNA, 17 bp, Homo sapiens
ttgacagaacactgtct

SEQ ID NO: 4997322 - DNA, 20 bp, Homo sapiens
ttgacttgacagaacactgt

SEQ ID NO: 4997323 - DNA, 21 bp, Homo sapiens
ttgacttgacagaacactgtc

SEQ ID NO: 4997324 - DNA, 17 bp, Homo sapiens
ttgatgccaaagcagac

SEQ ID NO: 4997325 - DNA, 19 bp, Homo sapiens
ttgatgccaaagcagacat

SEQ ID NO: 4997326 - DNA, 23 bp, Homo sapiens
ttgcagatagaatttggcccaga

SEQ ID NO: 4997327 - DNA, 17 bp, Homo sapiens
ttgcatagcagctgcta

SEQ ID NO: 4997328 - DNA, 19 bp, Homo sapiens
ttgcatagcagctgctact

SEQ ID NO: 4997329 - DNA, 17 bp, Homo sapiens
ttgccatccctccctcc

SEQ ID NO: 4997330 - DNA, 21 bp, Homo sapiens
ttgcgtggaattgtgctgagt

SEQ ID NO: 4997331 - DNA, 21 bp, Homo sapiens
ttgctcaccaagctgttccac

SEQ ID NO: 4997332 - DNA, 12 bp, Homo sapiens
ttggcccagaga

SEQ ID NO: 4997333 - DNA, 14 bp, Homo sapiens
ttggcccagagagg

SEQ ID NO: 4997334 - DNA, 13 bp, Homo sapiens
ttgggtctgtgtc

SEQ ID NO: 4997335 - DNA, 11 bp, Homo sapiens
ttgtctctgag

SEQ ID NO: 4997336 - DNA, 15 bp, Homo sapiens
ttgtgtatgatccaa

SEQ ID NO: 4997337 - DNA, 19 bp, Homo sapiens
ttgttaatggtttgaatat

SEQ ID NO: 4997338 - DNA, 12 bp, Homo sapiens
ttgttctcaggg

SEQ ID NO: 4997339 - DNA, 14 bp, Homo sapiens
tttcaatttccaag

SEQ ID NO: 4997340 - DNA, 23 bp, Homo sapiens
tttcctcacacccacctgctgct

SEQ ID NO: 4997341 - DNA, 19 bp, Homo sapiens
tttctgaaaattaacactg

SEQ ID NO: 4997342 - DNA, 17 bp, Homo sapiens
tttcttacacaagagct

SEQ ID NO: 4997343 - DNA, 18 bp, Homo sapiens
tttcttacacaagagctg

SEQ ID NO: 4997344 - DNA, 17 bp, Homo sapiens
tttcttgtctctgaggc

SEQ ID NO: 4997345 - DNA, 15 bp, Homo sapiens
tttgatgccaaagca

SEQ ID NO: 4997346 - DNA, 13 bp, Homo sapiens
tttgtaataaact

SEQ ID NO: 4997347 - DNA, 15 bp, Homo sapiens
tttgtaataaactct

SEQ ID NO: 4997348 - DNA, 18 bp, Homo sapiens
tttgtctctgagaacaga

SEQ ID NO: 4997349 - DNA, 13 bp, Homo sapiens
tttgtttgtgcat

SEQ ID NO: 4997350 - DNA, 19 bp, Homo sapiens
ttttatgccttttatttct

SEQ ID NO: 4997351 - DNA, 22 bp, Homo sapiens
ttttcctcacacccacctgctg

SEQ ID NO: 4997352 - DNA, 17 bp, Homo sapiens
ttttcttgtctctgagg

SEQ ID NO: 4997353 - DNA, 14 bp, Homo sapiens
ttttgtaataaact

SEQ ID NO: 4997354 - DNA, 19 bp, Homo sapiens
taaccatgggctcagggcc

SEQ ID NO: 4997355 - DNA, 19 bp, Homo sapiens
taaccctgggctccctgga

SEQ ID NO: 4997356 - DNA, 14 bp, Homo sapiens
taactcaatatttt

SEQ ID NO: 4997357 - DNA, 22 bp, Homo sapiens
taactcaatattttccatgaaa

SEQ ID NO: 4997358 - DNA, 17 bp, Homo sapiens
taagcaatcactgggcc

SEQ ID NO: 4997359 - DNA, 21 bp, Homo sapiens
taagcaatcactgggcccaga

SEQ ID NO: 4997360 - DNA, 14 bp, Homo sapiens
taaggccagctaga

SEQ ID NO: 4997361 - DNA, 18 bp, Homo sapiens
taagtgatttttttgtcc

SEQ ID NO: 4997362 - DNA, 15 bp, Homo sapiens
taataaactctctag

SEQ ID NO: 4997363 - DNA, 15 bp, Homo sapiens
taatatttttaatta

SEQ ID NO: 4997364 - DNA, 22 bp, Homo sapiens
taatttgatagtattgtgcata

SEQ ID NO: 4997365 - DNA, 21 bp, Homo sapiens
tacgactcttttccaaacaca

SEQ ID NO: 4997366 - DNA, 20 bp, Homo sapiens
tactacttttgcatgaaaat

SEQ ID NO: 4997367 - DNA, 18 bp, Homo sapiens
tactaggtctgctcctga

SEQ ID NO: 4997368 - DNA, 22 bp, Homo sapiens
tagaagctcaggttccctgcca

SEQ ID NO: 4997369 - DNA, 16 bp, Homo sapiens
tagaatttggcccaga

SEQ ID NO: 4997370 - DNA, 17 bp, Homo sapiens
tagaatttggcccagag

SEQ ID NO: 4997371 - DNA, 17 bp, Homo sapiens
tagagctttcaagtaca

SEQ ID NO: 4997372 - DNA, 14 bp, Homo sapiens
tagaggatgtggca

SEQ ID NO: 4997373 - DNA, 16 bp, Homo sapiens
tagcacatcactgaga

SEQ ID NO: 4997374 - DNA, 19 bp, Homo sapiens
tagcacccatatctgtgtg

SEQ ID NO: 4997375 - DNA, 21 bp, Homo sapiens
tagcagctgctactagctctt

SEQ ID NO: 4997376 - DNA, 20 bp, Homo sapiens
tagccagagttgttctcagg

SEQ ID NO: 4997377 - DNA, 21 bp, Homo sapiens
tagccagagttgttctcaggg

SEQ ID NO: 4997378 - DNA, 15 bp, Homo sapiens
tagctgctaccttct

SEQ ID NO: 4997379 - DNA, 15 bp, Homo sapiens
tagctggcaagctgc

SEQ ID NO: 4997380 - DNA, 22 bp, Homo sapiens
tagctgtgtatctgtttttcca

SEQ ID NO: 4997381 - DNA, 14 bp, Homo sapiens
taggtgtgccaaac

SEQ ID NO: 4997382 - DNA, 22 bp, Homo sapiens
taggtttctctgcctccaggtt

SEQ ID NO: 4997383 - DNA, 19 bp, Homo sapiens
tagtacatggagctcaggt

SEQ ID NO: 4997384 - DNA, 15 bp, Homo sapiens
tatatacatatatat

SEQ ID NO: 4997385 - DNA, 16 bp, Homo sapiens
tatctaaatcaccaga

SEQ ID NO: 4997386 - DNA, 23 bp, Homo sapiens
tatctgtgtgccctagggctcag

SEQ ID NO: 4997387 - DNA, 14 bp, Homo sapiens
tatgagctggagct

SEQ ID NO: 4997388 - DNA, 20 bp, Homo sapiens
tatgagctggagctaaggcc

SEQ ID NO: 4997389 - DNA, 13 bp, Homo sapiens
tatggcagtgtct

SEQ ID NO: 4997390 - DNA, 21 bp, Homo sapiens
tattagttaggtgtgccaaac

SEQ ID NO: 4997391 - DNA, 21 bp, Homo sapiens
tattctcttaatttttcttaa

SEQ ID NO: 4997392 - DNA, 22 bp, Homo sapiens
tattctgccatgggagagtcca

SEQ ID NO: 4997393 - DNA, 20 bp, Homo sapiens
tatttgttaatggtttgaat

SEQ ID NO: 4997394 - DNA, 15 bp, Homo sapiens
tattttatctgtgtt

SEQ ID NO: 4997395 - DNA, 12 bp, Homo sapiens
tattttgtaata

SEQ ID NO: 4997396 - DNA, 17 bp, Homo sapiens
tattttgtaataaactc

SEQ ID NO: 4997397 - DNA, 18 bp, Homo sapiens
tattttgtaataaactct

SEQ ID NO: 4997398 - DNA, 19 bp, Homo sapiens
tattttgtaataaactctc

SEQ ID NO: 4997399 - DNA, 17 bp, Homo sapiens
tatttttatttgtttgt

SEQ ID NO: 4997400 - DNA, 13 bp, Homo sapiens
tcaaactgggtat

SEQ ID NO: 4997401 - DNA, 18 bp, Homo sapiens
tcaaagggcccacagtga

SEQ ID NO: 4997402 - DNA, 17 bp, Homo sapiens
tcaaatgctaaatgcaa

SEQ ID NO: 4997403 - DNA, 19 bp, Homo sapiens
tcaacagcaggaggcacag

SEQ ID NO: 4997404 - DNA, 12 bp, Homo sapiens
tcaactctgtga

SEQ ID NO: 4997405 - DNA, 18 bp, Homo sapiens
tcaatattttccatgaaa

SEQ ID NO: 4997406 - DNA, 16 bp, Homo sapiens
tcaatctgtttttcat

SEQ ID NO: 4997407 - DNA, 18 bp, Homo sapiens
tcaatgtggtgatgaaat

SEQ ID NO: 4997408 - DNA, 19 bp, Homo sapiens
tcacacccacctgctgctg

SEQ ID NO: 4997409 - DNA, 22 bp, Homo sapiens
tcacagcagtcacaggcccagg

SEQ ID NO: 4997410 - DNA, 20 bp, Homo sapiens
tcaccaattccacttcctgc

SEQ ID NO: 4997411 - DNA, 20 bp, Homo sapiens
tcaccatctttgaggtgagg

SEQ ID NO: 4997412 - DNA, 20 bp, Homo sapiens
tcacctaagcaatcactggg

SEQ ID NO: 4997413 - DNA, 17 bp, Homo sapiens
tcacctcccagggctac

SEQ ID NO: 4997414 - DNA, 15 bp, Homo sapiens
tcactgggcccagag

SEQ ID NO: 4997415 - DNA, 22 bp, Homo sapiens
tcactgtcagtcccactgcacc

SEQ ID NO: 4997416 - DNA, 20 bp, Homo sapiens
tcacttgtaggtttctctgc

SEQ ID NO: 4997417 - DNA, 23 bp, Homo sapiens
tcacttgtaggtttctctgcctc

SEQ ID NO: 4997418 - DNA, 17 bp, Homo sapiens
tcagaaagtgcagcatg

SEQ ID NO: 4997419 - DNA, 19 bp, Homo sapiens
tcagaatatggacaaagaa

SEQ ID NO: 4997420 - DNA, 12 bp, Homo sapiens
tcagagctgccc

SEQ ID NO: 4997421 - DNA, 14 bp, Homo sapiens
tcagagctgccctc

SEQ ID NO: 4997422 - DNA, 16 bp, Homo sapiens
tcagagctgccctctc

SEQ ID NO: 4997423 - DNA, 17 bp, Homo sapiens
tcagagctgccctctcc

SEQ ID NO: 4997424 - DNA, 19 bp, Homo sapiens
tcagagctgccctctcctg

SEQ ID NO: 4997425 - DNA, 23 bp, Homo sapiens
tcagagctgccctctcctgggca

SEQ ID NO: 4997426 - DNA, 12 bp, Homo sapiens
tcagatcccagg

SEQ ID NO: 4997427 - DNA, 14 bp, Homo sapiens
tcagatcccagggt

SEQ ID NO: 4997428 - DNA, 12 bp, Homo sapiens
tcaggacactaa

SEQ ID NO: 4997429 - DNA, 20 bp, Homo sapiens
tcaggcctcacctcccaggg

SEQ ID NO: 4997430 - DNA, 23 bp, Homo sapiens
tcaggcctcacctcccagggcta

SEQ ID NO: 4997431 - DNA, 14 bp, Homo sapiens
tcaggcctctgagg

SEQ ID NO: 4997432 - DNA, 15 bp, Homo sapiens
tcagggccaggtcct

SEQ ID NO: 4997433 - DNA, 19 bp, Homo sapiens
tcagggccaggtcctcaca

SEQ ID NO: 4997434 - DNA, 14 bp, Homo sapiens
tcaggggtgctggg

SEQ ID NO: 4997435 - DNA, 20 bp, Homo sapiens
tcaggggtgctggggcagag

SEQ ID NO: 4997436 - DNA, 17 bp, Homo sapiens
tcaggttccctgccaca

SEQ ID NO: 4997437 - DNA, 14 bp, Homo sapiens
tcagtagccagagt

SEQ ID NO: 4997438 - DNA, 15 bp, Homo sapiens
tcagtcccactgcac

SEQ ID NO: 4997439 - DNA, 12 bp, Homo sapiens
tcagttctgcct

SEQ ID NO: 4997440 - DNA, 17 bp, Homo sapiens
tcagttctgccttatct

SEQ ID NO: 4997441 - DNA, 13 bp, Homo sapiens
tcatacacagaaa

SEQ ID NO: 4997442 - DNA, 11 bp, Homo sapiens
tcatatgaaaa

SEQ ID NO: 4997443 - DNA, 21 bp, Homo sapiens
tcatatgaaaaaaatgcattt

SEQ ID NO: 4997444 - DNA, 22 bp, Homo sapiens
tcatcttccccagccctcccca

SEQ ID NO: 4997445 - DNA, 23 bp, Homo sapiens
tcatgtaaattttgtatgaaaaa

SEQ ID NO: 4997446 - DNA, 14 bp, Homo sapiens
tcattcctgttctt

SEQ ID NO: 4997447 - DNA, 18 bp, Homo sapiens
tcattcctgttctttctt

SEQ ID NO: 4997448 - DNA, 22 bp, Homo sapiens
tccaccccagccccactgccct

SEQ ID NO: 4997449 - DNA, 12 bp, Homo sapiens
tccacctccctg

SEQ ID NO: 4997450 - DNA, 16 bp, Homo sapiens
tccacctccctgcaat

SEQ ID NO: 4997451 - DNA, 17 bp, Homo sapiens
tccacctccctgcaata

SEQ ID NO: 4997452 - DNA, 23 bp, Homo sapiens
tccacctccctgcaataaaatgg

SEQ ID NO: 4997453 - DNA, 12 bp, Homo sapiens
tccactgacctg

SEQ ID NO: 4997454 - DNA, 20 bp, Homo sapiens
tccacttctctagagaacat

SEQ ID NO: 4997455 - DNA, 21 bp, Homo sapiens
tccagctatttttatttgttt

SEQ ID NO: 4997456 - DNA, 19 bp, Homo sapiens
tccaggaaagatgtcccac

SEQ ID NO: 4997457 - DNA, 15 bp, Homo sapiens
tccaggcctgggtca

SEQ ID NO: 4997458 - DNA, 23 bp, Homo sapiens
tccaggtctagaaggccaggcct

SEQ ID NO: 4997459 - DNA, 17 bp, Homo sapiens
tccaggttgcctcaaca

SEQ ID NO: 4997460 - DNA, 21 bp, Homo sapiens
tccaggttgcctcaacagcag

SEQ ID NO: 4997461 - DNA, 23 bp, Homo sapiens
tccaggttgcctcaacagcagga

SEQ ID NO: 4997462 - DNA, 15 bp, Homo sapiens
tccatgaaaatgcaa

SEQ ID NO: 4997463 - DNA, 16 bp, Homo sapiens
tccatgatcacacagc

SEQ ID NO: 4997464 - DNA, 21 bp, Homo sapiens
tccatgcaccctcatacacag

SEQ ID NO: 4997465 - DNA, 23 bp, Homo sapiens
tcccacacaagacccaagtagct

SEQ ID NO: 4997466 - DNA, 14 bp, Homo sapiens
tcccacagggacca

SEQ ID NO: 4997467 - DNA, 15 bp, Homo sapiens
tcccacagggaccac

SEQ ID NO: 4997468 - DNA, 13 bp, Homo sapiens
tcccactgcaccc

SEQ ID NO: 4997469 - DNA, 18 bp, Homo sapiens
tcccactgcacccccctg

SEQ ID NO: 4997470 - DNA, 20 bp, Homo sapiens
tcccactttcttctaccaga

SEQ ID NO: 4997471 - DNA, 17 bp, Homo sapiens
tcccagccagcagttca

SEQ ID NO: 4997472 - DNA, 19 bp, Homo sapiens
tcccagggctacacagacc

SEQ ID NO: 4997473 - DNA, 20 bp, Homo sapiens
gggcaaagctgctgggccag

SEQ ID NO: 4997474 - DNA, 22 bp, Homo sapiens
gggcaaagctgctgggccagtg

SEQ ID NO: 4997475 - DNA, 23 bp, Homo sapiens
gggcaaagctgctgggccagtgg

SEQ ID NO: 4997476 - DNA, 19 bp, Homo sapiens
gggcagagtggagcccagg

SEQ ID NO: 4997477 - DNA, 23 bp, Homo sapiens
gggcagctgcctcccctcctctg

SEQ ID NO: 4997478 - DNA, 15 bp, Homo sapiens
gggcccaaaggggag

SEQ ID NO: 4997479 - DNA, 11 bp, Homo sapiens
gggcccagagg

SEQ ID NO: 4997480 - DNA, 14 bp, Homo sapiens
gggcccagaggaga

SEQ ID NO: 4997481 - DNA, 15 bp, Homo sapiens
gggcccagaggagag

SEQ ID NO: 4997482 - DNA, 12 bp, Homo sapiens
gggctacacaga

SEQ ID NO: 4997483 - DNA, 11 bp, Homo sapiens
gggctcagagg

SEQ ID NO: 4997484 - DNA, 14 bp, Homo sapiens
gggctcagggccag

SEQ ID NO: 4997485 - DNA, 19 bp, Homo sapiens
gggctcagggccaggtcct

SEQ ID NO: 4997486 - DNA, 11 bp, Homo sapiens
gggctccctgg

SEQ ID NO: 4997487 - DNA, 14 bp, Homo sapiens
gggctccctggagg

SEQ ID NO: 4997488 - DNA, 16 bp, Homo sapiens
gggctccctggaggac

SEQ ID NO: 4997489 - DNA, 21 bp, Homo sapiens
ggggcagagtggagcccaggg

SEQ ID NO: 4997490 - DNA, 21 bp, Homo sapiens
ggggctgaggataccccaaag

SEQ ID NO: 4997491 - DNA, 16 bp, Homo sapiens
gggtacactcttctcc

SEQ ID NO: 4997492 - DNA, 12 bp, Homo sapiens
gggtcaaggaat

SEQ ID NO: 4997493 - DNA, 13 bp, Homo sapiens
gggtgccccagct

SEQ ID NO: 4997494 - DNA, 15 bp, Homo sapiens
ggtcaccatgaaact

SEQ ID NO: 4997495 - DNA, 18 bp, Homo sapiens
ggtcacgctcaaggaagg

SEQ ID NO: 4997496 - DNA, 16 bp, Homo sapiens
ggtctagaaggccagg

SEQ ID NO: 4997497 - DNA, 16 bp, Homo sapiens
ggtgccagatcctctt

SEQ ID NO: 4997498 - DNA, 12 bp, Homo sapiens
ggtgccccagct

SEQ ID NO: 4997499 - DNA, 12 bp, Homo sapiens
ggtgctgccacc

SEQ ID NO: 4997500 - DNA, 16 bp, Homo sapiens
ggtgctggggcagagt

SEQ ID NO: 4997501 - DNA, 18 bp, Homo sapiens
ggtggggtgccccagcta

SEQ ID NO: 4997502 - DNA, 19 bp, Homo sapiens
ggtggtggcagctgggcag

SEQ ID NO: 4997503 - DNA, 15 bp, Homo sapiens
ggtgtgccaaactac

SEQ ID NO: 4997504 - DNA, 18 bp, Homo sapiens
ggttgcctcaacagcagg

SEQ ID NO: 4997505 - DNA, 15 bp, Homo sapiens
ggttgtccaggtcta

SEQ ID NO: 4997506 - DNA, 22 bp, Homo sapiens
gtaaagccctcagatcccaggg

SEQ ID NO: 4997507 - DNA, 18 bp, Homo sapiens
gtaaattttgtatgaaaa

SEQ ID NO: 4997508 - DNA, 13 bp, Homo sapiens
gtaataaactctc

SEQ ID NO: 4997509 - DNA, 15 bp, Homo sapiens
gtaataaactctcta

SEQ ID NO: 4997510 - DNA, 20 bp, Homo sapiens
gtacactcttctccattccc

SEQ ID NO: 4997511 - DNA, 16 bp, Homo sapiens
gtacatggagctcagg

SEQ ID NO: 4997512 - DNA, 18 bp, Homo sapiens
gtagaaagacagagctgg

SEQ ID NO: 4997513 - DNA, 21 bp, Homo sapiens
gtagaaagacagagctgggat

SEQ ID NO: 4997514 - DNA, 21 bp, Homo sapiens
gtagccagagttgttctcagg

SEQ ID NO: 4997515 - DNA, 14 bp, Homo sapiens
gtagctggcaagct

SEQ ID NO: 4997516 - DNA, 13 bp, Homo sapiens
gtaggctccagac

SEQ ID NO: 4997517 - DNA, 14 bp, Homo sapiens
gtaggctccagaca

SEQ ID NO: 4997518 - DNA, 16 bp, Homo sapiens
gtaggtttctctgcct

SEQ ID NO: 4997519 - DNA, 12 bp, Homo sapiens
gtataatatttt

SEQ ID NO: 4997520 - DNA, 15 bp, Homo sapiens
gtataatatttttaa

SEQ ID NO: 4997521 - DNA, 14 bp, Homo sapiens
gtatgagctggagc

SEQ ID NO: 4997522 - DNA, 14 bp, Homo sapiens
gtatttgttaatgg

SEQ ID NO: 4997523 - DNA, 15 bp, Homo sapiens
gtcacaggcccagga

SEQ ID NO: 4997524 - DNA, 16 bp, Homo sapiens
gtcacaggcccaggaa

SEQ ID NO: 4997525 - DNA, 13 bp, Homo sapiens
gtcaccccagtca

SEQ ID NO: 4997526 - DNA, 13 bp, Homo sapiens
gtcacgctcaagg

SEQ ID NO: 4997527 - DNA, 19 bp, Homo sapiens
gtcactgtttattttttta

SEQ ID NO: 4997528 - DNA, 22 bp, Homo sapiens
gtcacttgtaggtttctctgcc

SEQ ID NO: 4997529 - DNA, 23 bp, Homo sapiens
gtcagccctcactgtcagtccca

SEQ ID NO: 4997530 - DNA, 14 bp, Homo sapiens
gtcagtcccactgc

SEQ ID NO: 4997531 - DNA, 15 bp, Homo sapiens
gtccaggcctgggtc

SEQ ID NO: 4997532 - DNA, 21 bp, Homo sapiens
gtccagggcccatgtagctgg

SEQ ID NO: 4997533 - DNA, 17 bp, Homo sapiens
gtccaggtctagaaggc

SEQ ID NO: 4997534 - DNA, 13 bp, Homo sapiens
gtcccactgcacc

SEQ ID NO: 4997535 - DNA, 20 bp, Homo sapiens
gtcccagccagcagttcaga

SEQ ID NO: 4997536 - DNA, 15 bp, Homo sapiens
gtccctattctgcca

SEQ ID NO: 4997537 - DNA, 22 bp, Homo sapiens
gtccctattctgccatgggaga

SEQ ID NO: 4997538 - DNA, 20 bp, Homo sapiens
gtcctcacagcagtcacagg

SEQ ID NO: 4997539 - DNA, 20 bp, Homo sapiens
gtcctgatcctaaccctggg

SEQ ID NO: 4997540 - DNA, 21 bp, Homo sapiens
gtcctgatcctaaccctgggc

SEQ ID NO: 4997541 - DNA, 17 bp, Homo sapiens
gtccttttagcacatca

SEQ ID NO: 4997542 - DNA, 19 bp, Homo sapiens
gtccttttagcacatcact

SEQ ID NO: 4997543 - DNA, 21 bp, Homo sapiens
gtccttttagcacatcactga

SEQ ID NO: 4997544 - DNA, 23 bp, Homo sapiens
gtccttttagcacatcactgaga

SEQ ID NO: 4997545 - DNA, 17 bp, Homo sapiens
gtctagaaggccaggcc

SEQ ID NO: 4997546 - DNA, 12 bp, Homo sapiens
gtctctgagaac

SEQ ID NO: 4997547 - DNA, 21 bp, Homo sapiens
gtctgaccaaaaccagagggc

SEQ ID NO: 4997548 - DNA, 21 bp, Homo sapiens
gtcttggccgactcagggacc

SEQ ID NO: 4997549 - DNA, 22 bp, Homo sapiens
gtgagggtggggtgccccagct

SEQ ID NO: 4997550 - DNA, 17 bp, Homo sapiens
gtgccctagggctcaga

SEQ ID NO: 4997551 - DNA, 21 bp, Homo sapiens
gtgcctgatgggagtaggctc

SEQ ID NO: 4997552 - DNA, 11 bp, Homo sapiens
gtgcctgctgg

SEQ ID NO: 4997553 - DNA, 13 bp, Homo sapiens
gtgcctgctgggc

SEQ ID NO: 4997554 - DNA, 15 bp, Homo sapiens
gtgcctgctgggcac

SEQ ID NO: 4997555 - DNA, 17 bp, Homo sapiens
gtgcctgctgggcactg

SEQ ID NO: 4997556 - DNA, 22 bp, Homo sapiens
gtgctgccaccccttggcactg

SEQ ID NO: 4997557 - DNA, 13 bp, Homo sapiens
gtgctggggcaga

SEQ ID NO: 4997558 - DNA, 16 bp, Homo sapiens
gtgctggggcagagtg

SEQ ID NO: 4997559 - DNA, 13 bp, Homo sapiens
gtggaactgccac

SEQ ID NO: 4997560 - DNA, 17 bp, Homo sapiens
gtggaggttgcagtgag

SEQ ID NO: 4997561 - DNA, 22 bp, Homo sapiens
gtggaggttgcagtgagctgag

SEQ ID NO: 4997562 - DNA, 14 bp, Homo sapiens
gtggcactctgtgt

SEQ ID NO: 4997563 - DNA, 14 bp, Homo sapiens
gtgggacagacagc

SEQ ID NO: 4997564 - DNA, 23 bp, Homo sapiens
gtggttaatgccatggacagaag

SEQ ID NO: 4997565 - DNA, 17 bp, Homo sapiens
gtgtaaatgtggacaca

SEQ ID NO: 4997566 - DNA, 13 bp, Homo sapiens
gtgtgccctaggg

SEQ ID NO: 4997567 - DNA, 20 bp, Homo sapiens
gtgtgccctagggctcagag

SEQ ID NO: 4997568 - DNA, 21 bp, Homo sapiens
gtgttggctctgctggtcact

SEQ ID NO: 4997569 - DNA, 15 bp, Homo sapiens
gttcagagctgccct

SEQ ID NO: 4997570 - DNA, 15 bp, Homo sapiens
gttccacttctctag

SEQ ID NO: 4997571 - DNA, 19 bp, Homo sapiens
gttctcattcctgttcttt

SEQ ID NO: 4997572 - DNA, 21 bp, Homo sapiens
gttgcctcaacagcaggaggc

SEQ ID NO: 4997573 - DNA, 11 bp, Homo sapiens
gttgtccaggt

SEQ ID NO: 4997574 - DNA, 14 bp, Homo sapiens
gttgttctcagggg

SEQ ID NO: 4997575 - DNA, 12 bp, Homo sapiens
gtttctctgcct

SEQ ID NO: 4997576 - DNA, 20 bp, Homo sapiens
gtttctgaaaattaacactg

SEQ ID NO: 4997577 - DNA, 21 bp, Homo sapiens
gtttctgaaaattaacactgc

SEQ ID NO: 4997578 - DNA, 22 bp, Homo sapiens
gtttctggacaagaagagtcct

SEQ ID NO: 4997579 - DNA, 13 bp, Homo sapiens
gtttgaatataaa

SEQ ID NO: 4997580 - DNA, 19 bp, Homo sapiens
gtttgaatataaacactat

SEQ ID NO: 4997581 - DNA, 14 bp, Homo sapiens
gtttgcaaggaagc

SEQ ID NO: 4997582 - DNA, 22 bp, Homo sapiens
gtttgcaaggaagccacagctg

SEQ ID NO: 4997583 - DNA, 19 bp, Homo sapiens
gttttgtggaggagctcag

SEQ ID NO: 4997584 - DNA, 20 bp, Homo sapiens
taaaatatacaaacatgtgg

SEQ ID NO: 4997585 - DNA, 14 bp, Homo sapiens
taaacccaaataaa

SEQ ID NO: 4997586 - DNA, 17 bp, Homo sapiens
taaacccaaataaatgt

SEQ ID NO: 4997587 - DNA, 20 bp, Homo sapiens
gcctctactaggtctgctcc

SEQ ID NO: 4997588 - DNA, 21 bp, Homo sapiens
gcctctactaggtctgctcct

SEQ ID NO: 4997589 - DNA, 18 bp, Homo sapiens
gcctggatgcacagtgcc

SEQ ID NO: 4997590 - DNA, 20 bp, Homo sapiens
gcctggatgcacagtgcctg

SEQ ID NO: 4997591 - DNA, 16 bp, Homo sapiens
gccttagaactttgca

SEQ ID NO: 4997592 - DNA, 16 bp, Homo sapiens
gccttttatttcttaa

SEQ ID NO: 4997593 - DNA, 16 bp, Homo sapiens
gcgtggggaggggctg

SEQ ID NO: 4997594 - DNA, 12 bp, Homo sapiens
gctaaatgcaaa

SEQ ID NO: 4997595 - DNA, 20 bp, Homo sapiens
gctaaatgcaaacactgtgt

SEQ ID NO: 4997596 - DNA, 16 bp, Homo sapiens
gctaaggccagctaga

SEQ ID NO: 4997597 - DNA, 16 bp, Homo sapiens
gctaataaaagtcaga

SEQ ID NO: 4997598 - DNA, 20 bp, Homo sapiens
gctaataaaagtcagagctc

SEQ ID NO: 4997599 - DNA, 14 bp, Homo sapiens
gctacacagaccct

SEQ ID NO: 4997600 - DNA, 19 bp, Homo sapiens
gctacacagaccctgccca

SEQ ID NO: 4997601 - DNA, 14 bp, Homo sapiens
gctaggaagcaaga

SEQ ID NO: 4997602 - DNA, 22 bp, Homo sapiens
gctaggtctgaccaaaaccaga

SEQ ID NO: 4997603 - DNA, 11 bp, Homo sapiens
gctcagggcca

SEQ ID NO: 4997604 - DNA, 13 bp, Homo sapiens
gctcagggccagg

SEQ ID NO: 4997605 - DNA, 16 bp, Homo sapiens
gctcagggccaggtcc

SEQ ID NO: 4997606 - DNA, 19 bp, Homo sapiens
gctcagggccaggtcctca

SEQ ID NO: 4997607 - DNA, 15 bp, Homo sapiens
gctcagttctgcctt

SEQ ID NO: 4997608 - DNA, 16 bp, Homo sapiens
gctcattccatgactc

SEQ ID NO: 4997609 - DNA, 16 bp, Homo sapiens
gctccagacaggagga

SEQ ID NO: 4997610 - DNA, 13 bp, Homo sapiens
gctcccacagaac

SEQ ID NO: 4997611 - DNA, 19 bp, Homo sapiens
gctcccacagaacacagca

SEQ ID NO: 4997612 - DNA, 20 bp, Homo sapiens
gctcctgaaccagtcctgct

SEQ ID NO: 4997613 - DNA, 22 bp, Homo sapiens
gctcctgaaccagtcctgctgc

SEQ ID NO: 4997614 - DNA, 21 bp, Homo sapiens
gctcctggacctaaagggtat

SEQ ID NO: 4997615 - DNA, 20 bp, Homo sapiens
gctcttctgttctcaaatgc

SEQ ID NO: 4997616 - DNA, 23 bp, Homo sapiens
gctcttctgttctcaaatgctaa

SEQ ID NO: 4997617 - DNA, 14 bp, Homo sapiens
gctgacctgctgtg

SEQ ID NO: 4997618 - DNA, 16 bp, Homo sapiens
gctgagaaggacacct

SEQ ID NO: 4997619 - DNA, 19 bp, Homo sapiens
gctgaggataccccaaagt

SEQ ID NO: 4997620 - DNA, 15 bp, Homo sapiens
gctgaggcaattcta

SEQ ID NO: 4997621 - DNA, 15 bp, Homo sapiens
gctgcaaaaggcctg

SEQ ID NO: 4997622 - DNA, 20 bp, Homo sapiens
gctgccaccccttggcactg

SEQ ID NO: 4997623 - DNA, 16 bp, Homo sapiens
gctgccatgcccacca

SEQ ID NO: 4997624 - DNA, 16 bp, Homo sapiens
gctgccctctcctggg

SEQ ID NO: 4997625 - DNA, 20 bp, Homo sapiens
gctgccctctcctgggcagc

SEQ ID NO: 4997626 - DNA, 22 bp, Homo sapiens
gctgccctctcctgggcagctg

SEQ ID NO: 4997627 - DNA, 23 bp, Homo sapiens
gctgccctctcctgggcagctgc

SEQ ID NO: 4997628 - DNA, 22 bp, Homo sapiens
gctgcctcccctcctctgcttg

SEQ ID NO: 4997629 - DNA, 12 bp, Homo sapiens
gctgcctggagt

SEQ ID NO: 4997630 - DNA, 17 bp, Homo sapiens
gctgctgggccagtggc

SEQ ID NO: 4997631 - DNA, 18 bp, Homo sapiens
gctgctgggccagtggca

SEQ ID NO: 4997632 - DNA, 20 bp, Homo sapiens
gctggagctaaggccagcta

SEQ ID NO: 4997633 - DNA, 16 bp, Homo sapiens
gctggcaagctgcaaa

SEQ ID NO: 4997634 - DNA, 14 bp, Homo sapiens
gctgggccagtggc

SEQ ID NO: 4997635 - DNA, 17 bp, Homo sapiens
gctgggccagtggcact

SEQ ID NO: 4997636 - DNA, 13 bp, Homo sapiens
gctggggcagagt

SEQ ID NO: 4997637 - DNA, 14 bp, Homo sapiens
gctggggcagagtg

SEQ ID NO: 4997638 - DNA, 16 bp, Homo sapiens
gctgtaaacagctctg

SEQ ID NO: 4997639 - DNA, 17 bp, Homo sapiens
gctgttccacttctcta

SEQ ID NO: 4997640 - DNA, 13 bp, Homo sapiens
gcttccactgtca

SEQ ID NO: 4997641 - DNA, 14 bp, Homo sapiens
ggaaagatgtccca

SEQ ID NO: 4997642 - DNA, 20 bp, Homo sapiens
ggaaattaaaccctgcccca

SEQ ID NO: 4997643 - DNA, 13 bp, Homo sapiens
ggaacctcaaact

SEQ ID NO: 4997644 - DNA, 14 bp, Homo sapiens
ggaaggcggcaggc

SEQ ID NO: 4997645 - DNA, 19 bp, Homo sapiens
ggaaggcggcaggcagaga

SEQ ID NO: 4997646 - DNA, 21 bp, Homo sapiens
ggaaggcggcaggcagagaag

SEQ ID NO: 4997647 - DNA, 15 bp, Homo sapiens
ggaagtttctgggtg

SEQ ID NO: 4997648 - DNA, 12 bp, Homo sapiens
ggacaagaagag

SEQ ID NO: 4997649 - DNA, 14 bp, Homo sapiens
ggacagaagaaggc

SEQ ID NO: 4997650 - DNA, 13 bp, Homo sapiens
ggacagacagcag

SEQ ID NO: 4997651 - DNA, 16 bp, Homo sapiens
ggaccacatccacccc

SEQ ID NO: 4997652 - DNA, 18 bp, Homo sapiens
ggaccacatccaccccag

SEQ ID NO: 4997653 - DNA, 18 bp, Homo sapiens
ggactctagaagctcagg

SEQ ID NO: 4997654 - DNA, 19 bp, Homo sapiens
ggactctagaagctcaggt

SEQ ID NO: 4997655 - DNA, 11 bp, Homo sapiens
ggagacagaca

SEQ ID NO: 4997656 - DNA, 16 bp, Homo sapiens
ggagaggagacagaca

SEQ ID NO: 4997657 - DNA, 17 bp, Homo sapiens
ggagaggagacagacac

SEQ ID NO: 4997658 - DNA, 18 bp, Homo sapiens
ggagaggagacagacaca

SEQ ID NO: 4997659 - DNA, 18 bp, Homo sapiens
ggagcccacggggcaaag

SEQ ID NO: 4997660 - DNA, 15 bp, Homo sapiens
ggagctaaggccagc

SEQ ID NO: 4997661 - DNA, 22 bp, Homo sapiens
ggaggagtgggacagacagcag

SEQ ID NO: 4997662 - DNA, 12 bp, Homo sapiens
ggaggcacagca

SEQ ID NO: 4997663 - DNA, 13 bp, Homo sapiens
ggaggcacagcag

SEQ ID NO: 4997664 - DNA, 14 bp, Homo sapiens
ggagtgggacagac

SEQ ID NO: 4997665 - DNA, 17 bp, Homo sapiens
ggagtgggacagacagc

SEQ ID NO: 4997666 - DNA, 23 bp, Homo sapiens
ggagtgggacagacagcagctgg

SEQ ID NO: 4997667 - DNA, 18 bp, Homo sapiens
ggataccaatattctatt

SEQ ID NO: 4997668 - DNA, 23 bp, Homo sapiens
ggatcaagaaggggacagcgcca

SEQ ID NO: 4997669 - DNA, 16 bp, Homo sapiens
ggatgcacagtgcctg

SEQ ID NO: 4997670 - DNA, 13 bp, Homo sapiens
ggatgcagcatta

SEQ ID NO: 4997671 - DNA, 23 bp, Homo sapiens
ggatgtttctgtcacatcagctc

SEQ ID NO: 4997672 - DNA, 16 bp, Homo sapiens
ggcaaagctgctgggc

SEQ ID NO: 4997673 - DNA, 18 bp, Homo sapiens
ggcaaagctgctgggcca

SEQ ID NO: 4997674 - DNA, 19 bp, Homo sapiens
ggcaaagctgctgggccag

SEQ ID NO: 4997675 - DNA, 17 bp, Homo sapiens
ggcaagctgcaaaaggc

SEQ ID NO: 4997676 - DNA, 20 bp, Homo sapiens
ggcacagcagtttcaccatc

SEQ ID NO: 4997677 - DNA, 18 bp, Homo sapiens
ggcacaggtgtaaatata

SEQ ID NO: 4997678 - DNA, 15 bp, Homo sapiens
ggcactgggcactag

SEQ ID NO: 4997679 - DNA, 20 bp, Homo sapiens
ggcactgtggaactgccacc

SEQ ID NO: 4997680 - DNA, 23 bp, Homo sapiens
ggcagaaagatggagaggcatgg

SEQ ID NO: 4997681 - DNA, 19 bp, Homo sapiens
ggcagagtggagcccaggg

SEQ ID NO: 4997682 - DNA, 18 bp, Homo sapiens
ggcagctgcctcccctcc

SEQ ID NO: 4997683 - DNA, 11 bp, Homo sapiens
ggcaggggcag

SEQ ID NO: 4997684 - DNA, 19 bp, Homo sapiens
ggcaggggcagtggcctgg

SEQ ID NO: 4997685 - DNA, 13 bp, Homo sapiens
ggcatgttcaggg

SEQ ID NO: 4997686 - DNA, 23 bp, Homo sapiens
ggccagatgcacatccctggaag

SEQ ID NO: 4997687 - DNA, 22 bp, Homo sapiens
ggccagctagagcttccactgt

SEQ ID NO: 4997688 - DNA, 17 bp, Homo sapiens
ggccaggattcaggcct

SEQ ID NO: 4997689 - DNA, 17 bp, Homo sapiens
ggccagtggcactctgt

SEQ ID NO: 4997690 - DNA, 22 bp, Homo sapiens
ggcccatgtagctggcaagctg

SEQ ID NO: 4997691 - DNA, 17 bp, Homo sapiens
ggcctcacctcccaggg

SEQ ID NO: 4997692 - DNA, 18 bp, Homo sapiens
ggcctcacctcccagggc

SEQ ID NO: 4997693 - DNA, 20 bp, Homo sapiens
ggcctcacctcccagggcta

SEQ ID NO: 4997694 - DNA, 21 bp, Homo sapiens
ggcctcacctcccagggctac

SEQ ID NO: 4997695 - DNA, 16 bp, Homo sapiens
gatcttttcaagttaa

SEQ ID NO: 4997696 - DNA, 14 bp, Homo sapiens
gatgcacagtgcct

SEQ ID NO: 4997697 - DNA, 16 bp, Homo sapiens
gatgcacatccctgga

SEQ ID NO: 4997698 - DNA, 14 bp, Homo sapiens
gatgccaaagcaga

SEQ ID NO: 4997699 - DNA, 15 bp, Homo sapiens
gatgccaaagcagac

SEQ ID NO: 4997700 - DNA, 19 bp, Homo sapiens
gatgccaaagcagacattt

SEQ ID NO: 4997701 - DNA, 20 bp, Homo sapiens
gatgccttatctcttctcac

SEQ ID NO: 4997702 - DNA, 16 bp, Homo sapiens
gatggcactgtccagg

SEQ ID NO: 4997703 - DNA, 19 bp, Homo sapiens
gatggcactgtccagggcc

SEQ ID NO: 4997704 - DNA, 20 bp, Homo sapiens
gatggcactgtccagggccc

SEQ ID NO: 4997705 - DNA, 16 bp, Homo sapiens
gatgggcccaattctt

SEQ ID NO: 4997706 - DNA, 14 bp, Homo sapiens
gatgtcccacaggg

SEQ ID NO: 4997707 - DNA, 23 bp, Homo sapiens
gatgtggcaggggcagtggcctg

SEQ ID NO: 4997708 - DNA, 17 bp, Homo sapiens
gatgtgggtcaaggaat

SEQ ID NO: 4997709 - DNA, 17 bp, Homo sapiens
gattcaggcctctgagg

SEQ ID NO: 4997710 - DNA, 18 bp, Homo sapiens
gattcaggcctctgagga

SEQ ID NO: 4997711 - DNA, 18 bp, Homo sapiens
gattgctgataataaatt

SEQ ID NO: 4997712 - DNA, 14 bp, Homo sapiens
gcaaagctgctggg

SEQ ID NO: 4997713 - DNA, 17 bp, Homo sapiens
gcaaagctgctgggcca

SEQ ID NO: 4997714 - DNA, 20 bp, Homo sapiens
gcaaagctgctgggccagtg

SEQ ID NO: 4997715 - DNA, 21 bp, Homo sapiens
gcaaagctgctgggccagtgg

SEQ ID NO: 4997716 - DNA, 16 bp, Homo sapiens
gcaaatccgaaatcag

SEQ ID NO: 4997717 - DNA, 16 bp, Homo sapiens
gcaatcactgggccca

SEQ ID NO: 4997718 - DNA, 17 bp, Homo sapiens
gcaatcactgggcccag

SEQ ID NO: 4997719 - DNA, 19 bp, Homo sapiens
gcaatcactgggcccagag

SEQ ID NO: 4997720 - DNA, 14 bp, Homo sapiens
gcacaggtgtaaat

SEQ ID NO: 4997721 - DNA, 14 bp, Homo sapiens
gcacagtgcctgat

SEQ ID NO: 4997722 - DNA, 21 bp, Homo sapiens
gcacatcactgagaagatggc

SEQ ID NO: 4997723 - DNA, 24 bp, Homo sapiens
gcacccatatctgtgtgccctagg

SEQ ID NO: 4997724 - DNA, 13 bp, Homo sapiens
gcacccccctgtg

SEQ ID NO: 4997725 - DNA, 21 bp, Homo sapiens
gcacccccctgtgcctgctgg

SEQ ID NO: 4997726 - DNA, 16 bp, Homo sapiens
gcactagctagatgct

SEQ ID NO: 4997727 - DNA, 19 bp, Homo sapiens
gcactcctcggtactccca

SEQ ID NO: 4997728 - DNA, 14 bp, Homo sapiens
gcactgtccagggc

SEQ ID NO: 4997729 - DNA, 17 bp, Homo sapiens
gcactgtccagggccca

SEQ ID NO: 4997730 - DNA, 19 bp, Homo sapiens
gcactgtccagggcccatg

SEQ ID NO: 4997731 - DNA, 18 bp, Homo sapiens
gcactgtggaactgccac

SEQ ID NO: 4997732 - DNA, 19 bp, Homo sapiens
gcactgtggaactgccacc

SEQ ID NO: 4997733 - DNA, 22 bp, Homo sapiens
gcagaaaatcttttactagtgt

SEQ ID NO: 4997734 - DNA, 21 bp, Homo sapiens
gcagaaaggaaaagattcctg

SEQ ID NO: 4997735 - DNA, 21 bp, Homo sapiens
gcagacattttcctcacaccc

SEQ ID NO: 4997736 - DNA, 19 bp, Homo sapiens
gcagagaagtggagtgact

SEQ ID NO: 4997737 - DNA, 19 bp, Homo sapiens
gcagagtggagcccagggt

SEQ ID NO: 4997738 - DNA, 19 bp, Homo sapiens
gcagatagaatttggccca

SEQ ID NO: 4997739 - DNA, 22 bp, Homo sapiens
gcagatagaatttggcccagag

SEQ ID NO: 4997740 - DNA, 16 bp, Homo sapiens
gcagctgcctcccctc

SEQ ID NO: 4997741 - DNA, 17 bp, Homo sapiens
gcagctgcctcccctcc

SEQ ID NO: 4997742 - DNA, 22 bp, Homo sapiens
gcaggaatgctgacaatgctgc

SEQ ID NO: 4997743 - DNA, 13 bp, Homo sapiens
gcaggacgactgt

SEQ ID NO: 4997744 - DNA, 15 bp, Homo sapiens
gcaggaggcacagca

SEQ ID NO: 4997745 - DNA, 13 bp, Homo sapiens
gcaggggcagtgg

SEQ ID NO: 4997746 - DNA, 14 bp, Homo sapiens
gcaggggcagtggc

SEQ ID NO: 4997747 - DNA, 18 bp, Homo sapiens
gcaggggcagtggcctgg

SEQ ID NO: 4997748 - DNA, 17 bp, Homo sapiens
gcaggtctcctctggga

SEQ ID NO: 4997749 - DNA, 15 bp, Homo sapiens
gcagtcacaggccca

SEQ ID NO: 4997750 - DNA, 14 bp, Homo sapiens
gcagtctagtcctg

SEQ ID NO: 4997751 - DNA, 15 bp, Homo sapiens
gcagtctagtcctgg

SEQ ID NO: 4997752 - DNA, 16 bp, Homo sapiens
gcagtctagtcctggg

SEQ ID NO: 4997753 - DNA, 17 bp, Homo sapiens
gcagtggcctggatgca

SEQ ID NO: 4997754 - DNA, 16 bp, Homo sapiens
gcagttcagagctgcc

SEQ ID NO: 4997755 - DNA, 19 bp, Homo sapiens
gcagttcagagctgccctc

SEQ ID NO: 4997756 - DNA, 15 bp, Homo sapiens
gcatagcagctgcta

SEQ ID NO: 4997757 - DNA, 17 bp, Homo sapiens
gcatgggggcccaaagg

SEQ ID NO: 4997758 - DNA, 18 bp, Homo sapiens
gcatgggggcccaaaggg

SEQ ID NO: 4997759 - DNA, 14 bp, Homo sapiens
gcattttcccagat

SEQ ID NO: 4997760 - DNA, 13 bp, Homo sapiens
gccaaagcagaca

SEQ ID NO: 4997761 - DNA, 20 bp, Homo sapiens
gccaatgccatgactgctca

SEQ ID NO: 4997762 - DNA, 13 bp, Homo sapiens
gccaccccttggc

SEQ ID NO: 4997763 - DNA, 17 bp, Homo sapiens
gccaccccttggcactg

SEQ ID NO: 4997764 - DNA, 18 bp, Homo sapiens
gccagagttgttctcagg

SEQ ID NO: 4997765 - DNA, 23 bp, Homo sapiens
gccagcagttcagagctgccctc

SEQ ID NO: 4997766 - DNA, 23 bp, Homo sapiens
gccagctagagcttccactgtca

SEQ ID NO: 4997767 - DNA, 18 bp, Homo sapiens
gccaggcaccatctgcca

SEQ ID NO: 4997768 - DNA, 23 bp, Homo sapiens
gccaggcaccatctgccaatgcc

SEQ ID NO: 4997769 - DNA, 19 bp, Homo sapiens
gccagtgatgctaaaggtt

SEQ ID NO: 4997770 - DNA, 20 bp, Homo sapiens
gccagtgatgctaaaggttg

SEQ ID NO: 4997771 - DNA, 14 bp, Homo sapiens
gccagtggcactct

SEQ ID NO: 4997772 - DNA, 18 bp, Homo sapiens
gccatcatgtgcctggaa

SEQ ID NO: 4997773 - DNA, 13 bp, Homo sapiens
gccatccctccct

SEQ ID NO: 4997774 - DNA, 16 bp, Homo sapiens
gccatccctccctcca

SEQ ID NO: 4997775 - DNA, 23 bp, Homo sapiens
gccatccctccctccacctccct

SEQ ID NO: 4997776 - DNA, 18 bp, Homo sapiens
gccatggacagaagaagg

SEQ ID NO: 4997777 - DNA, 15 bp, Homo sapiens
gccatgggagagtcc

SEQ ID NO: 4997778 - DNA, 17 bp, Homo sapiens
gccatgggagagtccag

SEQ ID NO: 4997779 - DNA, 18 bp, Homo sapiens
gccatgggagagtccagg

SEQ ID NO: 4997780 - DNA, 22 bp, Homo sapiens
gcccaattcttacaaacatgtg

SEQ ID NO: 4997781 - DNA, 15 bp, Homo sapiens
gcccaccccatccct

SEQ ID NO: 4997782 - DNA, 16 bp, Homo sapiens
gcccacggggcaaagc

SEQ ID NO: 4997783 - DNA, 16 bp, Homo sapiens
gcccagaggagaggag

SEQ ID NO: 4997784 - DNA, 21 bp, Homo sapiens
gcccagaggagaggagacaga

SEQ ID NO: 4997785 - DNA, 22 bp, Homo sapiens
gcccagaggagaggagacagac

SEQ ID NO: 4997786 - DNA, 20 bp, Homo sapiens
gcccaggaaggcggcaggca

SEQ ID NO: 4997787 - DNA, 21 bp, Homo sapiens
gcccaggaaggcggcaggcag

SEQ ID NO: 4997788 - DNA, 23 bp, Homo sapiens
gcccaggaaggcggcaggcagag

SEQ ID NO: 4997789 - DNA, 14 bp, Homo sapiens
gcccagggtgctgg

SEQ ID NO: 4997790 - DNA, 16 bp, Homo sapiens
gcccagggtgctggga

SEQ ID NO: 4997791 - DNA, 22 bp, Homo sapiens
gccccactgccctccagggcca

SEQ ID NO: 4997792 - DNA, 13 bp, Homo sapiens
gccccagctagga

SEQ ID NO: 4997793 - DNA, 19 bp, Homo sapiens
gcccgtgccctaccacaca

SEQ ID NO: 4997794 - DNA, 17 bp, Homo sapiens
gccctagggctcagagg

SEQ ID NO: 4997795 - DNA, 18 bp, Homo sapiens
gccctagggctcagaggg

SEQ ID NO: 4997796 - DNA, 22 bp, Homo sapiens
gccctcactgtcagtcccactg

SEQ ID NO: 4997797 - DNA, 12 bp, Homo sapiens
cctgctgcctgg

SEQ ID NO: 4997798 - DNA, 13 bp, Homo sapiens
cctgctgggcact

SEQ ID NO: 4997799 - DNA, 16 bp, Homo sapiens
cctgctgtggatgtcc

SEQ ID NO: 4997800 - DNA, 15 bp, Homo sapiens
cctggaggactctag

SEQ ID NO: 4997801 - DNA, 16 bp, Homo sapiens
cctggagtcagtagcc

SEQ ID NO: 4997802 - DNA, 19 bp, Homo sapiens
cctggagtcagtagccaga

SEQ ID NO: 4997803 - DNA, 18 bp, Homo sapiens
cctggatgcacagtgcct

SEQ ID NO: 4997804 - DNA, 19 bp, Homo sapiens
cctggatgcacagtgcctg

SEQ ID NO: 4997805 - DNA, 20 bp, Homo sapiens
cctggatgcacagtgcctga

SEQ ID NO: 4997806 - DNA, 17 bp, Homo sapiens
cctggctgacctgctgt

SEQ ID NO: 4997807 - DNA, 13 bp, Homo sapiens
cctgggcagctgc

SEQ ID NO: 4997808 - DNA, 15 bp, Homo sapiens
cctgggcagctgcct

SEQ ID NO: 4997809 - DNA, 18 bp, Homo sapiens
cctgggtcacgctcaagg

SEQ ID NO: 4997810 - DNA, 17 bp, Homo sapiens
cctggttgtccaggtct

SEQ ID NO: 4997811 - DNA, 11 bp, Homo sapiens
cctgtgcctgc

SEQ ID NO: 4997812 - DNA, 14 bp, Homo sapiens
cctgtgcctgctgg

SEQ ID NO: 4997813 - DNA, 22 bp, Homo sapiens
cctgttgtcctgaactgtgagt

SEQ ID NO: 4997814 - DNA, 17 bp, Homo sapiens
ccttcctcagtcctgga

SEQ ID NO: 4997815 - DNA, 18 bp, Homo sapiens
ccttcctcagtcctggaa

SEQ ID NO: 4997816 - DNA, 14 bp, Homo sapiens
ccttctaggaagct

SEQ ID NO: 4997817 - DNA, 23 bp, Homo sapiens
ccttgctcaccaagctgttccac

SEQ ID NO: 4997818 - DNA, 12 bp, Homo sapiens
cctttagctgtg

SEQ ID NO: 4997819 - DNA, 17 bp, Homo sapiens
cgaatttttcagatgat

SEQ ID NO: 4997820 - DNA, 11 bp, Homo sapiens
cgactcaggga

SEQ ID NO: 4997821 - DNA, 13 bp, Homo sapiens
cgactcagggacc

SEQ ID NO: 4997822 - DNA, 23 bp, Homo sapiens
cgctacaaaataaagctgttctc

SEQ ID NO: 4997823 - DNA, 15 bp, Homo sapiens
cgggagcctctcctt

SEQ ID NO: 4997824 - DNA, 17 bp, Homo sapiens
cggggcaaagctgctgg

SEQ ID NO: 4997825 - DNA, 17 bp, Homo sapiens
cgtcaacgtgcatttta

SEQ ID NO: 4997826 - DNA, 20 bp, Homo sapiens
cgtgctcttctgttctcaaa

SEQ ID NO: 4997827 - DNA, 19 bp, Homo sapiens
cgtggggaggggctgagga

SEQ ID NO: 4997828 - DNA, 14 bp, Homo sapiens
ctaaacccaaataa

SEQ ID NO: 4997829 - DNA, 12 bp, Homo sapiens
ctaaagacagaa

SEQ ID NO: 4997830 - DNA, 16 bp, Homo sapiens
ctaaccatgggctcag

SEQ ID NO: 4997831 - DNA, 19 bp, Homo sapiens
ctaaccctgggctccctgg

SEQ ID NO: 4997832 - DNA, 20 bp, Homo sapiens
ctaagcagaagactctccac

SEQ ID NO: 4997833 - DNA, 14 bp, Homo sapiens
ctaattagaggatg

SEQ ID NO: 4997834 - DNA, 21 bp, Homo sapiens
ctaattagaggatgtggcagg

SEQ ID NO: 4997835 - DNA, 18 bp, Homo sapiens
ctacacagaccctgccca

SEQ ID NO: 4997836 - DNA, 13 bp, Homo sapiens
ctaccaaatataa

SEQ ID NO: 4997837 - DNA, 16 bp, Homo sapiens
ctaccaaatataaact

SEQ ID NO: 4997838 - DNA, 18 bp, Homo sapiens
ctaccaaatataaacttg

SEQ ID NO: 4997839 - DNA, 15 bp, Homo sapiens
ctaccacacatctgt

SEQ ID NO: 4997840 - DNA, 14 bp, Homo sapiens
ctaccttctttggc

SEQ ID NO: 4997841 - DNA, 15 bp, Homo sapiens
ctactaggtctgctc

SEQ ID NO: 4997842 - DNA, 14 bp, Homo sapiens
ctagaagctcaggt

SEQ ID NO: 4997843 - DNA, 17 bp, Homo sapiens
ctagaagctcaggttcc

SEQ ID NO: 4997844 - DNA, 18 bp, Homo sapiens
ctagctagatgctttagg

SEQ ID NO: 4997845 - DNA, 15 bp, Homo sapiens
ctagggctcagaggg

SEQ ID NO: 4997846 - DNA, 13 bp, Homo sapiens
ctaggtctgacca

SEQ ID NO: 4997847 - DNA, 15 bp, Homo sapiens
ctaggtctgctcctg

SEQ ID NO: 4997848 - DNA, 20 bp, Homo sapiens
ctaggtctgctcctgaacca

SEQ ID NO: 4997849 - DNA, 23 bp, Homo sapiens
ctagtcctgggggtaaagccctc

SEQ ID NO: 4997850 - DNA, 21 bp, Homo sapiens
ctatgacctcgccctccacaa

SEQ ID NO: 4997851 - DNA, 18 bp, Homo sapiens
ctatttgagttggccaag

SEQ ID NO: 4997852 - DNA, 19 bp, Homo sapiens
ctatttgagttggccaaga

SEQ ID NO: 4997853 - DNA, 16 bp, Homo sapiens
ctcaaatgctaaatgc

SEQ ID NO: 4997854 - DNA, 16 bp, Homo sapiens
ctcaacagcaggaggc

SEQ ID NO: 4997855 - DNA, 17 bp, Homo sapiens
ctcaacagcaggaggca

SEQ ID NO: 4997856 - DNA, 19 bp, Homo sapiens
ctcaacagcaggaggcaca

SEQ ID NO: 4997857 - DNA, 22 bp, Homo sapiens
ctcaacagcaggaggcacagca

SEQ ID NO: 4997858 - DNA, 11 bp, Homo sapiens
ctcaatatttt

SEQ ID NO: 4997859 - DNA, 22 bp, Homo sapiens
ctcaatattttccatgaaaatg

SEQ ID NO: 4997860 - DNA, 17 bp, Homo sapiens
ctcacacccacctgctg

SEQ ID NO: 4997861 - DNA, 19 bp, Homo sapiens
ctcacacccacctgctgct

SEQ ID NO: 4997862 - DNA, 13 bp, Homo sapiens
ctcacctcccagg

SEQ ID NO: 4997863 - DNA, 15 bp, Homo sapiens
ctcacctcccagggc

SEQ ID NO: 4997864 - DNA, 18 bp, Homo sapiens
ctcacctcccagggctac

SEQ ID NO: 4997865 - DNA, 19 bp, Homo sapiens
ctcacctcccagggctaca

SEQ ID NO: 4997866 - DNA, 20 bp, Homo sapiens
ctcactgtcagtcccactgc

SEQ ID NO: 4997867 - DNA, 20 bp, Homo sapiens
ctcagaaagtgcagcatgga

SEQ ID NO: 4997868 - DNA, 23 bp, Homo sapiens
ctcagaaagtgcagcatggagga

SEQ ID NO: 4997869 - DNA, 17 bp, Homo sapiens
ctcagaggggcctcatc

SEQ ID NO: 4997870 - DNA, 19 bp, Homo sapiens
ctcagaggggcctcatctt

SEQ ID NO: 4997871 - DNA, 12 bp, Homo sapiens
ctcagatcccag

SEQ ID NO: 4997872 - DNA, 15 bp, Homo sapiens
ctcagatcccagggt

SEQ ID NO: 4997873 - DNA, 18 bp, Homo sapiens
ctcagatcccagggtaca

SEQ ID NO: 4997874 - DNA, 13 bp, Homo sapiens
ctcaggcctcacc

SEQ ID NO: 4997875 - DNA, 14 bp, Homo sapiens
ctcaggcctcacct

SEQ ID NO: 4997876 - DNA, 15 bp, Homo sapiens
ctcaggcctcacctc

SEQ ID NO: 4997877 - DNA, 21 bp, Homo sapiens
ctcaggcctcacctcccaggg

SEQ ID NO: 4997878 - DNA, 23 bp, Homo sapiens
ctcaggcctcacctcccagggct

SEQ ID NO: 4997879 - DNA, 14 bp, Homo sapiens
ctcagggccaggtc

SEQ ID NO: 4997880 - DNA, 16 bp, Homo sapiens
ctcaggggtgctgggg

SEQ ID NO: 4997881 - DNA, 18 bp, Homo sapiens
ctcaggggtgctggggca

SEQ ID NO: 4997882 - DNA, 21 bp, Homo sapiens
ctcaggggtgctggggcagag

SEQ ID NO: 4997883 - DNA, 13 bp, Homo sapiens
ctcaggttccctg

SEQ ID NO: 4997884 - DNA, 14 bp, Homo sapiens
ctcaggttccctgc

SEQ ID NO: 4997885 - DNA, 17 bp, Homo sapiens
aaaagtcagagctcagg

SEQ ID NO: 4997886 - DNA, 17 bp, Homo sapiens
aaaatatacaaacatgt

SEQ ID NO: 4997887 - DNA, 14 bp, Homo sapiens
aaaatggcagaaag

SEQ ID NO: 4997888 - DNA, 13 bp, Homo sapiens
aaacactgtgtat

SEQ ID NO: 4997889 - DNA, 24 bp, Homo sapiens
aaacataaaatatacaaacatgtg

SEQ ID NO: 4997890 - DNA, 17 bp, Homo sapiens
aaacccaaataaatgtg

SEQ ID NO: 4997891 - DNA, 23 bp, Homo sapiens
aaacccaaataaatgtgtaaatg

SEQ ID NO: 4997892 - DNA, 22 bp, Homo sapiens
aaacctttagctgtgaatggct

SEQ ID NO: 4997893 - DNA, 12 bp, Homo sapiens
aaagatgtccca

SEQ ID NO: 4997894 - DNA, 16 bp, Homo sapiens
aaagatgtcccacagg

SEQ ID NO: 4997895 - DNA, 16 bp, Homo sapiens
aaagcatcacttggga

SEQ ID NO: 4997896 - DNA, 19 bp, Homo sapiens
aaagctgttctcattcctg

SEQ ID NO: 4997897 - DNA, 17 bp, Homo sapiens
aaaggaaaagattcctg

SEQ ID NO: 4997898 - DNA, 23 bp, Homo sapiens
aaaggcctgtgatccaggaaaga

SEQ ID NO: 4997899 - DNA, 23 bp, Homo sapiens
aaagtccaggctaattagaggat

SEQ ID NO: 4997900 - DNA, 20 bp, Homo sapiens
aaatataaacttgtgtatga

SEQ ID NO: 4997901 - DNA, 14 bp, Homo sapiens
aaatatacaaacat

SEQ ID NO: 4997902 - DNA, 15 bp, Homo sapiens
aaatgcaaacactgt

SEQ ID NO: 4997903 - DNA, 20 bp, Homo sapiens
aaatgcaaacactgtgtatt

SEQ ID NO: 4997904 - DNA, 16 bp, Homo sapiens
aaatgcaacaacatgt

SEQ ID NO: 4997905 - DNA, 15 bp, Homo sapiens
aaatgggttttactg

SEQ ID NO: 4997906 - DNA, 13 bp, Homo sapiens
aaattaacactgc

SEQ ID NO: 4997907 - DNA, 21 bp, Homo sapiens
aaattcacatcctcagaaagt

SEQ ID NO: 4997908 - DNA, 14 bp, Homo sapiens
aaattggtgtttct

SEQ ID NO: 4997909 - DNA, 18 bp, Homo sapiens
aacacagcaattcctcag

SEQ ID NO: 4997910 - DNA, 18 bp, Homo sapiens
aacaccactttgtctctg

SEQ ID NO: 4997911 - DNA, 14 bp, Homo sapiens
aacactatatggca

SEQ ID NO: 4997912 - DNA, 16 bp, Homo sapiens
aacactgtcttgaaga

SEQ ID NO: 4997913 - DNA, 14 bp, Homo sapiens
aacactgtgtattt

SEQ ID NO: 4997914 - DNA, 14 bp, Homo sapiens
aaccagagggcagt

SEQ ID NO: 4997915 - DNA, 19 bp, Homo sapiens
aaccagtcctgctgcctgg

SEQ ID NO: 4997916 - DNA, 20 bp, Homo sapiens
aaccagtcctgctgcctgga

SEQ ID NO: 4997917 - DNA, 20 bp, Homo sapiens
aaccatgggctcagggccag

SEQ ID NO: 4997918 - DNA, 19 bp, Homo sapiens
aaccctgggctccctggag

SEQ ID NO: 4997919 - DNA, 11 bp, Homo sapiens
aacctcaaact

SEQ ID NO: 4997920 - DNA, 20 bp, Homo sapiens
aactcaatattttccatgaa

SEQ ID NO: 4997921 - DNA, 21 bp, Homo sapiens
aactcaatattttccatgaaa

SEQ ID NO: 4997922 - DNA, 18 bp, Homo sapiens
agctgctgggccagtggc

SEQ ID NO: 4997923 - DNA, 19 bp, Homo sapiens
agctgctgggccagtggca

SEQ ID NO: 4997924 - DNA, 21 bp, Homo sapiens
agctgctgggccagtggcact

SEQ ID NO: 4997925 - DNA, 23 bp, Homo sapiens
agctgggcaggtctcctctggga

SEQ ID NO: 4997926 - DNA, 22 bp, Homo sapiens
agctgtgaatggctgtgcccca

SEQ ID NO: 4997927 - DNA, 14 bp, Homo sapiens
agctgtgtatctgt

SEQ ID NO: 4997928 - DNA, 15 bp, Homo sapiens
agctgttctcattcc

SEQ ID NO: 4997929 - DNA, 21 bp, Homo sapiens
agctgttctcattcctgttct

SEQ ID NO: 4997930 - DNA, 23 bp, Homo sapiens
agctgttctcattcctgttcttt

SEQ ID NO: 4997931 - DNA, 21 bp, Homo sapiens
agcttccactgtcagccctca

SEQ ID NO: 4997932 - DNA, 15 bp, Homo sapiens
aggaaaagattcctg

SEQ ID NO: 4997933 - DNA, 16 bp, Homo sapiens
aggaaagatgtcccac

SEQ ID NO: 4997934 - DNA, 21 bp, Homo sapiens
aggaagcaagatcgctgtgct

SEQ ID NO: 4997935 - DNA, 18 bp, Homo sapiens
aggaaggcggcaggcaga

SEQ ID NO: 4997936 - DNA, 21 bp, Homo sapiens
aggaaggcggcaggcagagaa

SEQ ID NO: 4997937 - DNA, 17 bp, Homo sapiens
aggacactgcagaacag

SEQ ID NO: 4997938 - DNA, 17 bp, Homo sapiens
aggactctagaagctca

SEQ ID NO: 4997939 - DNA, 17 bp, Homo sapiens
aggagaggagacagaca

SEQ ID NO: 4997940 - DNA, 13 bp, Homo sapiens
aggagcccacggg

SEQ ID NO: 4997941 - DNA, 13 bp, Homo sapiens
aggagtgggacag

SEQ ID NO: 4997942 - DNA, 18 bp, Homo sapiens
aggagtgggacagacagc

SEQ ID NO: 4997943 - DNA, 16 bp, Homo sapiens
aggataccccaaagtc

SEQ ID NO: 4997944 - DNA, 22 bp, Homo sapiens
aggataccccaaagtccaggct

SEQ ID NO: 4997945 - DNA, 23 bp, Homo sapiens
aggatgaggaacctcaaactggg

SEQ ID NO: 4997946 - DNA, 15 bp, Homo sapiens
aggatgccttatctc

SEQ ID NO: 4997947 - DNA, 17 bp, Homo sapiens
aggatgtggcaggggca

SEQ ID NO: 4997948 - DNA, 20 bp, Homo sapiens
aggatgtggcaggggcagtg

SEQ ID NO: 4997949 - DNA, 22 bp, Homo sapiens
aggatgtggcaggggcagtggc

SEQ ID NO: 4997950 - DNA, 13 bp, Homo sapiens
aggattcaggcct

SEQ ID NO: 4997951 - DNA, 12 bp, Homo sapiens
aggcacagcagt

SEQ ID NO: 4997952 - DNA, 17 bp, Homo sapiens
aggcacaggtgtaaata

SEQ ID NO: 4997953 - DNA, 16 bp, Homo sapiens
aggcagagaagtggag

SEQ ID NO: 4997954 - DNA, 23 bp, Homo sapiens
aggcatctttctgaatttcattc

SEQ ID NO: 4997955 - DNA, 20 bp, Homo sapiens
aggcatgggggcccaaaggg

SEQ ID NO: 4997956 - DNA, 14 bp, Homo sapiens
aggcatgttcaggg

SEQ ID NO: 4997957 - DNA, 15 bp, Homo sapiens
aggccagctagagct

SEQ ID NO: 4997958 - DNA, 16 bp, Homo sapiens
aggccagctagagctt

SEQ ID NO: 4997959 - DNA, 14 bp, Homo sapiens
aggcctcacctccc

SEQ ID NO: 4997960 - DNA, 17 bp, Homo sapiens
aggcctcacctcccagg

SEQ ID NO: 4997961 - DNA, 17 bp, Homo sapiens
aggcctctactaggtct

SEQ ID NO: 4997962 - DNA, 17 bp, Homo sapiens
aggcctgggtcacgctc

SEQ ID NO: 4997963 - DNA, 15 bp, Homo sapiens
aggcggcaggcagag

SEQ ID NO: 4997964 - DNA, 16 bp, Homo sapiens
aggcggcaggcagaga

SEQ ID NO: 4997965 - DNA, 18 bp, Homo sapiens
aggcggcaggcagagaag

SEQ ID NO: 4997966 - DNA, 17 bp, Homo sapiens
aggctaattagaggatg

SEQ ID NO: 4997967 - DNA, 23 bp, Homo sapiens
aggctaattagaggatgtggcag

SEQ ID NO: 4997968 - DNA, 15 bp, Homo sapiens
agggaatggcacagc

SEQ ID NO: 4997969 - DNA, 19 bp, Homo sapiens
agggaccacatccacccca

SEQ ID NO: 4997970 - DNA, 21 bp, Homo sapiens
agggaccacatccaccccagc

SEQ ID NO: 4997971 - DNA, 20 bp, Homo sapiens
agggccaggtcctcacagca

SEQ ID NO: 4997972 - DNA, 16 bp, Homo sapiens
agggcccatgtagctg

SEQ ID NO: 4997973 - DNA, 22 bp, Homo sapiens
agggctacacagaccctgccca

SEQ ID NO: 4997974 - DNA, 17 bp, Homo sapiens
agggctcagaggggcct

SEQ ID NO: 4997975 - DNA, 15 bp, Homo sapiens
aggggcagtggcctg

SEQ ID NO: 4997976 - DNA, 19 bp, Homo sapiens
aggggtgctggggcagagt

SEQ ID NO: 4997977 - DNA, 20 bp, Homo sapiens
agggtggggtgccccagcta

SEQ ID NO: 4997978 - DNA, 20 bp, Homo sapiens
aggtatgaccttctaggaag

SEQ ID NO: 4997979 - DNA, 22 bp, Homo sapiens
aggtatgaccttctaggaagct

SEQ ID NO: 4997980 - DNA, 23 bp, Homo sapiens
aggtatgaccttctaggaagctc

SEQ ID NO: 4997981 - DNA, 18 bp, Homo sapiens
aggtcctcacagcagtca

SEQ ID NO: 4997982 - DNA, 22 bp, Homo sapiens
aggtctgaccaaaaccagaggg

SEQ ID NO: 4997983 - DNA, 21 bp, Homo sapiens
aggtcttggccgactcaggga

SEQ ID NO: 4997984 - DNA, 23 bp, Homo sapiens
aggtcttggccgactcagggacc

SEQ ID NO: 4997985 - DNA, 22 bp, Homo sapiens
aggtgagggtggggtgccccag

SEQ ID NO: 4997986 - DNA, 11 bp, Homo sapiens
aggtgctgcca

SEQ ID NO: 4997987 - DNA, 12 bp, Homo sapiens
aggtgctgccac

SEQ ID NO: 4997988 - DNA, 20 bp, Homo sapiens
aggtggaggttgcagtgagc

SEQ ID NO: 4997989 - DNA, 14 bp, Homo sapiens
aggttccctgccac

SEQ ID NO: 4997990 - DNA, 14 bp, Homo sapiens
aggttgcttcagct

SEQ ID NO: 4997991 - DNA, 15 bp, Homo sapiens
aggtttctctgcctc

SEQ ID NO: 4997992 - DNA, 19 bp, Homo sapiens
aggtttctctgcctccagg

SEQ ID NO: 4997993 - DNA, 16 bp, Homo sapiens
agtacatggagctcag

SEQ ID NO: 4997994 - DNA, 21 bp, Homo sapiens
agtacatggagctcaggtttc

SEQ ID NO: 4997995 - DNA, 20 bp, Homo sapiens
agtagccagagttgttctca

SEQ ID NO: 4997996 - DNA, 22 bp, Homo sapiens
agtagctgctaccttctttggc

SEQ ID NO: 4997997 - DNA, 17 bp, Homo sapiens
agtaggctccagacagg

SEQ ID NO: 4997998 - DNA, 17 bp, Homo sapiens
agtcacaggcccaggaa

SEQ ID NO: 4997999 - DNA, 15 bp, Homo sapiens
agtcacctaagcaat

SEQ ID NO: 4998000 - DNA, 13 bp, Homo sapiens
agtcagagctcag

SEQ ID NO: 4998001 - DNA, 13 bp, Homo sapiens
agtcatgtgcctc

SEQ ID NO: 4998002 - DNA, 20 bp, Homo sapiens
agtcatgtgcctctgtcctt

SEQ ID NO: 4998003 - DNA, 15 bp, Homo sapiens
agtcccactgcaccc

SEQ ID NO: 4998004 - DNA, 23 bp, Homo sapiens
agtcccactgcacccccctgtgc

SEQ ID NO: 4998005 - DNA, 13 bp, Homo sapiens
agtcctgctgcct

SEQ ID NO: 4998006 - DNA, 21 bp, Homo sapiens
agtcctgctgcctggagtcag

SEQ ID NO: 4998007 - DNA, 15 bp, Homo sapiens
agtgcagcatggagg

SEQ ID NO: 4998008 - DNA, 18 bp, Homo sapiens
agtgctgagaaggacacc

SEQ ID NO: 4998009 - DNA, 13 bp, Homo sapiens
agtggagcccagg

SEQ ID NO: 4998010 - DNA, 16 bp, Homo sapiens
agtggagcccagggtg

SEQ ID NO: 4998011 - DNA, 15 bp, Homo sapiens
agtggcctggatgca

SEQ ID NO: 4998012 - DNA, 23 bp, Homo sapiens
agtggcctggatgcacagtgcct

SEQ ID NO: 4998013 - DNA, 14 bp, Homo sapiens
agtgggacagacag

SEQ ID NO: 4998014 - DNA, 18 bp, Homo sapiens
agtgggacagacagcagc

SEQ ID NO: 4998015 - DNA, 21 bp, Homo sapiens
agtgggacagacagcagctgg

SEQ ID NO: 4998016 - DNA, 20 bp, Homo sapiens
agtgtcaccagctgccaaaa

SEQ ID NO: 4998017 - DNA, 15 bp, Homo sapiens
agttcagagctgccc

SEQ ID NO: 4998018 - DNA, 21 bp, Homo sapiens
agttcgatgggcccaattctt

SEQ ID NO: 4998019 - DNA, 17 bp, Homo sapiens
agttgttctcaggggtg

SEQ ID NO: 4998020 - DNA, 18 bp, Homo sapiens
agtttcaccatctttgag

SEQ ID NO: 4998021 - DNA, 19 bp, Homo sapiens
ataaaatatacaaacatgt

SEQ ID NO: 4998022 - DNA, 12 bp, Homo sapiens
ataaagaaaaac

SEQ ID NO: 4998023 - DNA, 21 bp, Homo sapiens
ataaatgtgtaaatgtggaca

SEQ ID NO: 4998024 - DNA, 23 bp, Homo sapiens
ataaattcacatcctcagaaagt

SEQ ID NO: 4998025 - DNA, 20 bp, Homo sapiens
atacaaacctttagctgtga

SEQ ID NO: 4998026 - DNA, 20 bp, Homo sapiens
ataccccaaagtccaggcta

SEQ ID NO: 4998027 - DNA, 15 bp, Homo sapiens
atagaatttggccca

SEQ ID NO: 4998028 - DNA, 14 bp, Homo sapiens
atagcagctgctac

SEQ ID NO: 4998029 - DNA, 16 bp, Homo sapiens
atagctgtgtatctgt

SEQ ID NO: 4998030 - DNA, 13 bp, Homo sapiens
atataaacttgtg

SEQ ID NO: 4998031 - DNA, 16 bp, Homo sapiens
atataaacttgtgtat

SEQ ID NO: 4998032 - DNA, 14 bp, Homo sapiens
atatacaaacatgt

SEQ ID NO: 4998033 - DNA, 15 bp, Homo sapiens
atatctgtgtgccct

SEQ ID NO: 4998034 - DNA, 16 bp, Homo sapiens
atattttccatgaaaa

SEQ ID NO: 4998035 - DNA, 18 bp, Homo sapiens
atattttccatgaaaatg

SEQ ID NO: 4998036 - DNA, 15 bp, Homo sapiens
atatttttaattaaa

SEQ ID NO: 4998037 - DNA, 24 bp, Homo sapiens
atcacacagctaataaaagtcaga

SEQ ID NO: 4998038 - DNA, 13 bp, Homo sapiens
atcactgagaaga

SEQ ID NO: 4998039 - DNA, 19 bp, Homo sapiens
atcactgggcccagaggag

SEQ ID NO: 4998040 - DNA, 22 bp, Homo sapiens
atcactgggcccagaggagagg

SEQ ID NO: 4998041 - DNA, 11 bp, Homo sapiens
atccaccccag

SEQ ID NO: 4998042 - DNA, 16 bp, Homo sapiens
atccaggaaagatgtc

SEQ ID NO: 4998043 - DNA, 11 bp, Homo sapiens
actctggaagt

SEQ ID NO: 4998044 - DNA, 18 bp, Homo sapiens
actcttctccattccctc

SEQ ID NO: 4998045 - DNA, 19 bp, Homo sapiens
actgagaagatggcactgt

SEQ ID NO: 4998046 - DNA, 20 bp, Homo sapiens
actgcacccccctgtgcctg

SEQ ID NO: 4998047 - DNA, 13 bp, Homo sapiens
actgcactccagt

SEQ ID NO: 4998048 - DNA, 15 bp, Homo sapiens
actgcaggaatgctg

SEQ ID NO: 4998049 - DNA, 13 bp, Homo sapiens
actgccctccagg

SEQ ID NO: 4998050 - DNA, 17 bp, Homo sapiens
actgccctccagggcca

SEQ ID NO: 4998051 - DNA, 20 bp, Homo sapiens
actgccctccagggccagga

SEQ ID NO: 4998052 - DNA, 16 bp, Homo sapiens
actgcttgtgttttta

SEQ ID NO: 4998053 - DNA, 18 bp, Homo sapiens
actgggcactagctagat

SEQ ID NO: 4998054 - DNA, 18 bp, Homo sapiens
actgtcagccctcactgt

SEQ ID NO: 4998055 - DNA, 22 bp, Homo sapiens
actgtcagtcccactgcacccc

SEQ ID NO: 4998056 - DNA, 12 bp, Homo sapiens
actgtccagggc

SEQ ID NO: 4998057 - DNA, 13 bp, Homo sapiens
actgtccagggcc

SEQ ID NO: 4998058 - DNA, 15 bp, Homo sapiens
actgtccagggccca

SEQ ID NO: 4998059 - DNA, 16 bp, Homo sapiens
actgtccagggcccat

SEQ ID NO: 4998060 - DNA, 23 bp, Homo sapiens
actgtccagggcccatgtagctg

SEQ ID NO: 4998061 - DNA, 18 bp, Homo sapiens
actgtgagtcctgatcct

SEQ ID NO: 4998062 - DNA, 20 bp, Homo sapiens
actgtgagtcctgatcctaa

SEQ ID NO: 4998063 - DNA, 16 bp, Homo sapiens
actgtggaactgccac

SEQ ID NO: 4998064 - DNA, 14 bp, Homo sapiens
acttctctttctta

SEQ ID NO: 4998065 - DNA, 19 bp, Homo sapiens
acttgaaggtttgatgcca

SEQ ID NO: 4998066 - DNA, 17 bp, Homo sapiens
acttgcctgtcacccca

SEQ ID NO: 4998067 - DNA, 18 bp, Homo sapiens
acttgcctgtcaccccag

SEQ ID NO: 4998068 - DNA, 19 bp, Homo sapiens
acttgtaggtttctctgcc

SEQ ID NO: 4998069 - DNA, 20 bp, Homo sapiens
acttgtaggtttctctgcct

SEQ ID NO: 4998070 - DNA, 17 bp, Homo sapiens
acttgtgtatgatccaa

SEQ ID NO: 4998071 - DNA, 21 bp, Homo sapiens
actttccttttcttgtctctg

SEQ ID NO: 4998072 - DNA, 22 bp, Homo sapiens
actttccttttcttgtctctga

SEQ ID NO: 4998073 - DNA, 13 bp, Homo sapiens
actttgtctctga

SEQ ID NO: 4998074 - DNA, 15 bp, Homo sapiens
agaaagatggagagg

SEQ ID NO: 4998075 - DNA, 15 bp, Homo sapiens
agaaagtgcagcatg

SEQ ID NO: 4998076 - DNA, 19 bp, Homo sapiens
agaaagtgcagcatggagg

SEQ ID NO: 4998077 - DNA, 16 bp, Homo sapiens
agaacacaaggtcatt

SEQ ID NO: 4998078 - DNA, 20 bp, Homo sapiens
agaactttgcatagcagctg

SEQ ID NO: 4998079 - DNA, 22 bp, Homo sapiens
agaagagagtccatatttcaat

SEQ ID NO: 4998080 - DNA, 23 bp, Homo sapiens
agaagatggcactgtccagggcc

SEQ ID NO: 4998081 - DNA, 22 bp, Homo sapiens
agaagctcaggttccctgccac

SEQ ID NO: 4998082 - DNA, 12 bp, Homo sapiens
agaaggccaggc

SEQ ID NO: 4998083 - DNA, 14 bp, Homo sapiens
agaaggccaggcct

SEQ ID NO: 4998084 - DNA, 15 bp, Homo sapiens
agaataaagaaaaac

SEQ ID NO: 4998085 - DNA, 23 bp, Homo sapiens
agaattgtgcgacttcacaaaat

SEQ ID NO: 4998086 - DNA, 12 bp, Homo sapiens
agacagagctgg

SEQ ID NO: 4998087 - DNA, 13 bp, Homo sapiens
agaccctgcccac

SEQ ID NO: 4998088 - DNA, 17 bp, Homo sapiens
agaccctgcccacccca

SEQ ID NO: 4998089 - DNA, 17 bp, Homo sapiens
agacgttaccaattatg

SEQ ID NO: 4998090 - DNA, 12 bp, Homo sapiens
agactctccact

SEQ ID NO: 4998091 - DNA, 22 bp, Homo sapiens
agactggtttatccacccacaa

SEQ ID NO: 4998092 - DNA, 20 bp, Homo sapiens
agacttctctttcttatttt

SEQ ID NO: 4998093 - DNA, 11 bp, Homo sapiens
agagctgaggc

SEQ ID NO: 4998094 - DNA, 17 bp, Homo sapiens
agagctgccctctcctg

SEQ ID NO: 4998095 - DNA, 13 bp, Homo sapiens
agaggagacagac

SEQ ID NO: 4998096 - DNA, 12 bp, Homo sapiens
agagtgctgaga

SEQ ID NO: 4998097 - DNA, 22 bp, Homo sapiens
agagtgctgagaaggacacctc

SEQ ID NO: 4998098 - DNA, 14 bp, Homo sapiens
agagtggagcccag

SEQ ID NO: 4998099 - DNA, 16 bp, Homo sapiens
agagtggagcccaggg

SEQ ID NO: 4998100 - DNA, 18 bp, Homo sapiens
agagtggagcccagggtg

SEQ ID NO: 4998101 - DNA, 19 bp, Homo sapiens
agagttgttctcaggggtg

SEQ ID NO: 4998102 - DNA, 16 bp, Homo sapiens
agataatacattccga

SEQ ID NO: 4998103 - DNA, 12 bp, Homo sapiens
agatcctcttct

SEQ ID NO: 4998104 - DNA, 14 bp, Homo sapiens
agatcctcttctca

SEQ ID NO: 4998105 - DNA, 17 bp, Homo sapiens
agatggcactgtccagg

SEQ ID NO: 4998106 - DNA, 20 bp, Homo sapiens
agatggcactgtccagggcc

SEQ ID NO: 4998107 - DNA, 22 bp, Homo sapiens
agattttgataatatatacaaa

SEQ ID NO: 4998108 - DNA, 17 bp, Homo sapiens
agcaagatcgctgtgct

SEQ ID NO: 4998109 - DNA, 23 bp, Homo sapiens
agcaagatcgctgtgctaggtct

SEQ ID NO: 4998110 - DNA, 18 bp, Homo sapiens
agcaatcactgggcccag

SEQ ID NO: 4998111 - DNA, 19 bp, Homo sapiens
agcacagtctgatgacaca

SEQ ID NO: 4998112 - DNA, 21 bp, Homo sapiens
agcacatcactgagaagatgg

SEQ ID NO: 4998113 - DNA, 23 bp, Homo sapiens
agcacatcactgagaagatggca

SEQ ID NO: 4998114 - DNA, 17 bp, Homo sapiens
agcacccatatctgtgt

SEQ ID NO: 4998115 - DNA, 21 bp, Homo sapiens
agcacccatatctgtgtgccc

SEQ ID NO: 4998116 - DNA, 22 bp, Homo sapiens
agcacccatatctgtgtgccct

SEQ ID NO: 4998117 - DNA, 16 bp, Homo sapiens
agcagacattttcctc

SEQ ID NO: 4998118 - DNA, 11 bp, Homo sapiens
agcagctgcta

SEQ ID NO: 4998119 - DNA, 13 bp, Homo sapiens
agcaggaggcaca

SEQ ID NO: 4998120 - DNA, 17 bp, Homo sapiens
agcaggaggcacagcag

SEQ ID NO: 4998121 - DNA, 14 bp, Homo sapiens
agcagtcacaggcc

SEQ ID NO: 4998122 - DNA, 18 bp, Homo sapiens
agcagtcacaggcccagg

SEQ ID NO: 4998123 - DNA, 19 bp, Homo sapiens
agcagtcacaggcccagga

SEQ ID NO: 4998124 - DNA, 16 bp, Homo sapiens
agcagttcagagctgc

SEQ ID NO: 4998125 - DNA, 18 bp, Homo sapiens
agcagttcagagctgccc

SEQ ID NO: 4998126 - DNA, 15 bp, Homo sapiens
agcagtttcaccatc

SEQ ID NO: 4998127 - DNA, 20 bp, Homo sapiens
agccagagttgttctcaggg

SEQ ID NO: 4998128 - DNA, 14 bp, Homo sapiens
agccagcagttcag

SEQ ID NO: 4998129 - DNA, 17 bp, Homo sapiens
agccagcagttcagagc

SEQ ID NO: 4998130 - DNA, 21 bp, Homo sapiens
agccagcagttcagagctgcc

SEQ ID NO: 4998131 - DNA, 19 bp, Homo sapiens
agccatcatgtgcctggaa

SEQ ID NO: 4998132 - DNA, 13 bp, Homo sapiens
agcccaaagaagg

SEQ ID NO: 4998133 - DNA, 16 bp, Homo sapiens
agcccaaagaaggaaa

SEQ ID NO: 4998134 - DNA, 15 bp, Homo sapiens
agcccacggggcaaa

SEQ ID NO: 4998135 - DNA, 23 bp, Homo sapiens
agcccacggggcaaagctgctgg

SEQ ID NO: 4998136 - DNA, 16 bp, Homo sapiens
agcccagggtgctggg

SEQ ID NO: 4998137 - DNA, 13 bp, Homo sapiens
agccccactgccc

SEQ ID NO: 4998138 - DNA, 15 bp, Homo sapiens
agccccactgccctc

SEQ ID NO: 4998139 - DNA, 19 bp, Homo sapiens
agccccactgccctccagg

SEQ ID NO: 4998140 - DNA, 21 bp, Homo sapiens
agccccactgccctccagggc

SEQ ID NO: 4998141 - DNA, 13 bp, Homo sapiens
agccctcactgtc

SEQ ID NO: 4998142 - DNA, 11 bp, Homo sapiens
agccctcagat

SEQ ID NO: 4998143 - DNA, 16 bp, Homo sapiens
agccctcagatcccag

SEQ ID NO: 4998144 - DNA, 18 bp, Homo sapiens
agccctcagatcccaggg

SEQ ID NO: 4998145 - DNA, 21 bp, Homo sapiens
agccctcagatcccagggtac

SEQ ID NO: 4998146 - DNA, 15 bp, Homo sapiens
agccctccccacctg

SEQ ID NO: 4998147 - DNA, 18 bp, Homo sapiens
agccctccccacctgctc

SEQ ID NO: 4998148 - DNA, 18 bp, Homo sapiens
agcctctccttgcctggt

SEQ ID NO: 4998149 - DNA, 19 bp, Homo sapiens
agcctctccttgcctggtg

SEQ ID NO: 4998150 - DNA, 20 bp, Homo sapiens
agcgtggggaggggctgagg

SEQ ID NO: 4998151 - DNA, 22 bp, Homo sapiens
agcgtggggaggggctgaggat

SEQ ID NO: 4998152 - DNA, 13 bp, Homo sapiens
agctaaggccagc

SEQ ID NO: 4998153 - DNA, 16 bp, Homo sapiens
agctaaggccagctag

SEQ ID NO: 4998154 - DNA, 13 bp, Homo sapiens
agctcaggttccc

SEQ ID NO: 4998155 - DNA, 16 bp, Homo sapiens
agctcaggttccctgc

SEQ ID NO: 4998156 - DNA, 21 bp, Homo sapiens
agctcaggttccctgccacac

SEQ ID NO: 4998157 - DNA, 15 bp, Homo sapiens
agctctgatgagaga

SEQ ID NO: 4998158 - DNA, 17 bp, Homo sapiens
agctgaggcaattctaa

SEQ ID NO: 4998159 - DNA, 23 bp, Homo sapiens
agctgatccttcaactctgtgag

SEQ ID NO: 4998160 - DNA, 23 bp, Homo sapiens
tcagctaagccccctactgagaa

SEQ ID NO: 4998161 - DNA, 18 bp, Homo sapiens
tcagctccactttcagtg

SEQ ID NO: 4998162 - DNA, 13 bp, Homo sapiens
tcaggcctcacct

SEQ ID NO: 4998163 - DNA, 18 bp, Homo sapiens
tcaggcctcacctcccag

SEQ ID NO: 4998164 - DNA, 19 bp, Homo sapiens
tcaggcctcacctcccagg

SEQ ID NO: 4998165 - DNA, 12 bp, Homo sapiens
tcagtcctggaa

SEQ ID NO: 4998166 - DNA, 12 bp, Homo sapiens
tcatatgaaaaa

SEQ ID NO: 4998167 - DNA, 15 bp, Homo sapiens
tcattcctgttcttt

SEQ ID NO: 4998168 - DNA, 20 bp, Homo sapiens
tcattctcttgaaggtgctg

SEQ ID NO: 4998169 - DNA, 20 bp, Homo sapiens
tcatttgctaactagcttgg

SEQ ID NO: 4998170 - DNA, 21 bp, Homo sapiens
tccaagtattttatctgtgtt

SEQ ID NO: 4998171 - DNA, 22 bp, Homo sapiens
tccaagtattttatctgtgttg

SEQ ID NO: 4998172 - DNA, 16 bp, Homo sapiens
tccaatacctcttgga

SEQ ID NO: 4998173 - DNA, 15 bp, Homo sapiens
tccacccacttgcct

SEQ ID NO: 4998174 - DNA, 19 bp, Homo sapiens
tccaccccagccccactgc

SEQ ID NO: 4998175 - DNA, 13 bp, Homo sapiens
tccacctccctgc

SEQ ID NO: 4998176 - DNA, 17 bp, Homo sapiens
tccactgtcagccctca

SEQ ID NO: 4998177 - DNA, 23 bp, Homo sapiens
tccactgtcagccctcactgtca

SEQ ID NO: 4998178 - DNA, 16 bp, Homo sapiens
tccacttcctgcccca

SEQ ID NO: 4998179 - DNA, 14 bp, Homo sapiens
tccacttctctaga

SEQ ID NO: 4998180 - DNA, 17 bp, Homo sapiens
tccacttctctagagaa

SEQ ID NO: 4998181 - DNA, 14 bp, Homo sapiens
tccagacaggagga

SEQ ID NO: 4998182 - DNA, 17 bp, Homo sapiens
tccagacaggaggagtg

SEQ ID NO: 4998183 - DNA, 23 bp, Homo sapiens
tccagacaggaggagtgggacag

SEQ ID NO: 4998184 - DNA, 10 bp, Homo sapiens
tccagggcca

SEQ ID NO: 4998185 - DNA, 12 bp, Homo sapiens
tccagggccagg

SEQ ID NO: 4998186 - DNA, 17 bp, Homo sapiens
tccagggccaggattca

SEQ ID NO: 4998187 - DNA, 23 bp, Homo sapiens
tccagggccaggattcaggcctc

SEQ ID NO: 4998188 - DNA, 14 bp, Homo sapiens
tccaggttgcctca

SEQ ID NO: 4998189 - DNA, 19 bp, Homo sapiens
tccaggttgcctcaacagc

SEQ ID NO: 4998190 - DNA, 22 bp, Homo sapiens
tccaggttgcctcaacagcagg

SEQ ID NO: 4998191 - DNA, 22 bp, Homo sapiens
tcccaaattggtgtttctgaat

SEQ ID NO: 4998192 - DNA, 17 bp, Homo sapiens
tcccacacaagacccaa

SEQ ID NO: 4998193 - DNA, 12 bp, Homo sapiens
tcccactttctt

SEQ ID NO: 4998194 - DNA, 17 bp, Homo sapiens
tcccagggctacacaga

SEQ ID NO: 4998195 - DNA, 22 bp, Homo sapiens
tcccagggctacacagaccctg

SEQ ID NO: 4998196 - DNA, 14 bp, Homo sapiens
tccccacctgctca

SEQ ID NO: 4998197 - DNA, 20 bp, Homo sapiens
tccccagacttctctttctt

SEQ ID NO: 4998198 - DNA, 22 bp, Homo sapiens
tccccagccctccccacctgct

SEQ ID NO: 4998199 - DNA, 17 bp, Homo sapiens
tccctattctgccatgg

SEQ ID NO: 4998200 - DNA, 22 bp, Homo sapiens
tccctattctgccatgggagag

SEQ ID NO: 4998201 - DNA, 19 bp, Homo sapiens
tccctccacctccctgcaa

SEQ ID NO: 4998202 - DNA, 15 bp, Homo sapiens
tccctccctccacct

SEQ ID NO: 4998203 - DNA, 16 bp, Homo sapiens
tccctccctccacctc

SEQ ID NO: 4998204 - DNA, 15 bp, Homo sapiens
tccctggctgacctg

SEQ ID NO: 4998205 - DNA, 20 bp, Homo sapiens
tccctggctgacctgctgtg

SEQ ID NO: 4998206 - DNA, 21 bp, Homo sapiens
tccctggctgacctgctgtgg

SEQ ID NO: 4998207 - DNA, 18 bp, Homo sapiens
tcctcacacccacctgct

SEQ ID NO: 4998208 - DNA, 22 bp, Homo sapiens
tcctcacacccacctgctgctg

SEQ ID NO: 4998209 - DNA, 20 bp, Homo sapiens
tcctcagaaagtgcagcatg

SEQ ID NO: 4998210 - DNA, 17 bp, Homo sapiens
tcctcggtactcccata

SEQ ID NO: 4998211 - DNA, 16 bp, Homo sapiens
tcctctgcttgccatc

SEQ ID NO: 4998212 - DNA, 21 bp, Homo sapiens
tcctcttctcaaagctgggat

SEQ ID NO: 4998213 - DNA, 14 bp, Homo sapiens
tcctgaaccagtcc

SEQ ID NO: 4998214 - DNA, 19 bp, Homo sapiens
tcctgccccaactgcagga

SEQ ID NO: 4998215 - DNA, 13 bp, Homo sapiens
tcctgctgcctgg

SEQ ID NO: 4998216 - DNA, 14 bp, Homo sapiens
tcctgctgcctgga

SEQ ID NO: 4998217 - DNA, 17 bp, Homo sapiens
tcctgctgcctggagtc

SEQ ID NO: 4998218 - DNA, 13 bp, Homo sapiens
tcctgggcagctg

SEQ ID NO: 4998219 - DNA, 15 bp, Homo sapiens
tcctgggcagctgcc

SEQ ID NO: 4998220 - DNA, 16 bp, Homo sapiens
tcctgggcagctgcct

SEQ ID NO: 4998221 - DNA, 18 bp, Homo sapiens
tccttaattcactcccac

SEQ ID NO: 4998222 - DNA, 16 bp, Homo sapiens
tccttcaactctgtga

SEQ ID NO: 4998223 - DNA, 18 bp, Homo sapiens
tccttcaactctgtgagg

SEQ ID NO: 4998224 - DNA, 21 bp, Homo sapiens
tccttttagcacatcactgag

SEQ ID NO: 4998225 - DNA, 18 bp, Homo sapiens
tccttttcttgtctctga

SEQ ID NO: 4998226 - DNA, 16 bp, Homo sapiens
tcgctgtgctaggtct

SEQ ID NO: 4998227 - DNA, 13 bp, Homo sapiens
tctagaagctcag

SEQ ID NO: 4998228 - DNA, 17 bp, Homo sapiens
tctattttgcagataga

SEQ ID NO: 4998229 - DNA, 15 bp, Homo sapiens
tctcaaagctgggat

SEQ ID NO: 4998230 - DNA, 17 bp, Homo sapiens
tctcaggggtgctgggg

SEQ ID NO: 4998231 - DNA, 17 bp, Homo sapiens
tctccactgacctggtt

SEQ ID NO: 4998232 - DNA, 21 bp, Homo sapiens
tctccattccctccacccact

SEQ ID NO: 4998233 - DNA, 12 bp, Homo sapiens
tctctagagaac

SEQ ID NO: 4998234 - DNA, 16 bp, Homo sapiens
tctcttgaaggtgctg

SEQ ID NO: 4998235 - DNA, 20 bp, Homo sapiens
tctcttgaaggtgctgccac

SEQ ID NO: 4998236 - DNA, 21 bp, Homo sapiens
tctctttcttattttgtaata

SEQ ID NO: 4998237 - DNA, 18 bp, Homo sapiens
tctgaaaattaacactgc

SEQ ID NO: 4998238 - DNA, 19 bp, Homo sapiens
tctgaaaattaacactgct

SEQ ID NO: 4998239 - DNA, 17 bp, Homo sapiens
tctgaactctaagcaga

SEQ ID NO: 4998240 - DNA, 20 bp, Homo sapiens
tctgaatttcattctcttga

SEQ ID NO: 4998241 - DNA, 18 bp, Homo sapiens
tctgaccaaaaccagagg

SEQ ID NO: 4998242 - DNA, 13 bp, Homo sapiens
tctgaggctctcc

SEQ ID NO: 4998243 - DNA, 14 bp, Homo sapiens
tctgccaatgccat

SEQ ID NO: 4998244 - DNA, 15 bp, Homo sapiens
tctgccaatgccatg

SEQ ID NO: 4998245 - DNA, 20 bp, Homo sapiens
tctgccatgggagagtccag

SEQ ID NO: 4998246 - DNA, 17 bp, Homo sapiens
atccaggaaagatgtcc

SEQ ID NO: 4998247 - DNA, 22 bp, Homo sapiens
atccaggaaagatgtcccacag

SEQ ID NO: 4998248 - DNA, 21 bp, Homo sapiens
atccatgatcacacagctaat

SEQ ID NO: 4998249 - DNA, 23 bp, Homo sapiens
atcccagggtacactcttctcca

SEQ ID NO: 4998250 - DNA, 11 bp, Homo sapiens
atccctccctc

SEQ ID NO: 4998251 - DNA, 16 bp, Homo sapiens
atccctccctccacct

SEQ ID NO: 4998252 - DNA, 18 bp, Homo sapiens
atccctccctccacctcc

SEQ ID NO: 4998253 - DNA, 20 bp, Homo sapiens
atccctccctccacctccct

SEQ ID NO: 4998254 - DNA, 23 bp, Homo sapiens
atccctccctccacctccctgca

SEQ ID NO: 4998255 - DNA, 16 bp, Homo sapiens
atcctaaccctgggct

SEQ ID NO: 4998256 - DNA, 17 bp, Homo sapiens
atcctaaccctgggctc

SEQ ID NO: 4998257 - DNA, 23 bp, Homo sapiens
atcctaaccctgggctccctgga

SEQ ID NO: 4998258 - DNA, 20 bp, Homo sapiens
atcctcttctcaaagctggg

SEQ ID NO: 4998259 - DNA, 15 bp, Homo sapiens
atccttcaactctgt

SEQ ID NO: 4998260 - DNA, 16 bp, Homo sapiens
atccttcaactctgtg

SEQ ID NO: 4998261 - DNA, 18 bp, Homo sapiens
atccttcaactctgtgag

SEQ ID NO: 4998262 - DNA, 12 bp, Homo sapiens
atcgctgtgcta

SEQ ID NO: 4998263 - DNA, 15 bp, Homo sapiens
atctaaatcaccaga

SEQ ID NO: 4998264 - DNA, 19 bp, Homo sapiens
atctgccaatgccatgact

SEQ ID NO: 4998265 - DNA, 14 bp, Homo sapiens
atctgtgtgcccta

SEQ ID NO: 4998266 - DNA, 18 bp, Homo sapiens
atctgtgtgccctagggc

SEQ ID NO: 4998267 - DNA, 20 bp, Homo sapiens
atctgtgtgccctagggctc

SEQ ID NO: 4998268 - DNA, 20 bp, Homo sapiens
atgaaaatgcaacaacatgt

SEQ ID NO: 4998269 - DNA, 22 bp, Homo sapiens
atgaagactgttaaatgaaacc

SEQ ID NO: 4998270 - DNA, 17 bp, Homo sapiens
atgaaggtttctgaaaa

SEQ ID NO: 4998271 - DNA, 19 bp, Homo sapiens
atgaaggtttctgaaaatt

SEQ ID NO: 4998272 - DNA, 17 bp, Homo sapiens
atgacacatttggcagt

SEQ ID NO: 4998273 - DNA, 17 bp, Homo sapiens
atgaccttctaggaagc

SEQ ID NO: 4998274 - DNA, 13 bp, Homo sapiens
atgactgctcagg

SEQ ID NO: 4998275 - DNA, 21 bp, Homo sapiens
atgactgctcaggcctcacct

SEQ ID NO: 4998276 - DNA, 13 bp, Homo sapiens
atgagctggagct

SEQ ID NO: 4998277 - DNA, 15 bp, Homo sapiens
atgatcacacagcta

SEQ ID NO: 4998278 - DNA, 13 bp, Homo sapiens
atgcaaacactgt

SEQ ID NO: 4998279 - DNA, 16 bp, Homo sapiens
atgcaaacactgtgta

SEQ ID NO: 4998280 - DNA, 14 bp, Homo sapiens
atgcaacaacatgt

SEQ ID NO: 4998281 - DNA, 13 bp, Homo sapiens
atgcacagtgcct

SEQ ID NO: 4998282 - DNA, 14 bp, Homo sapiens
atgcacagtgcctg

SEQ ID NO: 4998283 - DNA, 14 bp, Homo sapiens
atgcacatccctgg

SEQ ID NO: 4998284 - DNA, 12 bp, Homo sapiens
atgccaaagcag

SEQ ID NO: 4998285 - DNA, 14 bp, Homo sapiens
atgccaaagcagac

SEQ ID NO: 4998286 - DNA, 15 bp, Homo sapiens
atgccaaagcagaca

SEQ ID NO: 4998287 - DNA, 14 bp, Homo sapiens
atgccatgactgct

SEQ ID NO: 4998288 - DNA, 22 bp, Homo sapiens
atgccatgactgctcaggcctc

SEQ ID NO: 4998289 - DNA, 18 bp, Homo sapiens
atgccatggacagaagaa

SEQ ID NO: 4998290 - DNA, 17 bp, Homo sapiens
atgccttatctcttctc

SEQ ID NO: 4998291 - DNA, 13 bp, Homo sapiens
atgctgccatgcc

SEQ ID NO: 4998292 - DNA, 17 bp, Homo sapiens
atgctgccatgcccacc

SEQ ID NO: 4998293 - DNA, 18 bp, Homo sapiens
atgctgccatgcccacca

SEQ ID NO: 4998294 - DNA, 15 bp, Homo sapiens
atgctttccaaaacc

SEQ ID NO: 4998295 - DNA, 13 bp, Homo sapiens
atggagaggcatg

SEQ ID NO: 4998296 - DNA, 22 bp, Homo sapiens
atggagaggcatgggggcccaa

SEQ ID NO: 4998297 - DNA, 21 bp, Homo sapiens
atggagtgtcaccagctgcca

SEQ ID NO: 4998298 - DNA, 23 bp, Homo sapiens
atggcacagcccaaagaaggaaa

SEQ ID NO: 4998299 - DNA, 15 bp, Homo sapiens
atggcactgtccagg

SEQ ID NO: 4998300 - DNA, 12 bp, Homo sapiens
atggcagaaaga

SEQ ID NO: 4998301 - DNA, 15 bp, Homo sapiens
atggcagtgtctttc

SEQ ID NO: 4998302 - DNA, 18 bp, Homo sapiens
atggctgtgccccacctg

SEQ ID NO: 4998303 - DNA, 18 bp, Homo sapiens
atgggagagtccaggcct

SEQ ID NO: 4998304 - DNA, 23 bp, Homo sapiens
atgggagtaggctccagacagga

SEQ ID NO: 4998305 - DNA, 13 bp, Homo sapiens
atgggctcagggc

SEQ ID NO: 4998306 - DNA, 22 bp, Homo sapiens
atggtttgaatataaacactat

SEQ ID NO: 4998307 - DNA, 18 bp, Homo sapiens
atggtttgcaaggaagcc

SEQ ID NO: 4998308 - DNA, 12 bp, Homo sapiens
atgtagctggca

SEQ ID NO: 4998309 - DNA, 23 bp, Homo sapiens
atgtataatatttttaattaaat

SEQ ID NO: 4998310 - DNA, 18 bp, Homo sapiens
atgtcccacagggaccac

SEQ ID NO: 4998311 - DNA, 19 bp, Homo sapiens
atgtggcaggggcagtggc

SEQ ID NO: 4998312 - DNA, 11 bp, Homo sapiens
atgtgtaaatg

SEQ ID NO: 4998313 - DNA, 18 bp, Homo sapiens
attaggcatgttcaggga

SEQ ID NO: 4998314 - DNA, 21 bp, Homo sapiens
attatgatgtgggtcaaggaa

SEQ ID NO: 4998315 - DNA, 12 bp, Homo sapiens
attcactcccac

SEQ ID NO: 4998316 - DNA, 14 bp, Homo sapiens
attcaggcctctga

SEQ ID NO: 4998317 - DNA, 17 bp, Homo sapiens
attcaggcctctgagga

SEQ ID NO: 4998318 - DNA, 12 bp, Homo sapiens
attccacttcct

SEQ ID NO: 4998319 - DNA, 17 bp, Homo sapiens
attccacttcctgcccc

SEQ ID NO: 4998320 - DNA, 18 bp, Homo sapiens
attccacttcctgcccca

SEQ ID NO: 4998321 - DNA, 21 bp, Homo sapiens
attccacttcctgccccaact

SEQ ID NO: 4998322 - DNA, 17 bp, Homo sapiens
attccatgactctgcct

SEQ ID NO: 4998323 - DNA, 14 bp, Homo sapiens
attccctccaccca

SEQ ID NO: 4998324 - DNA, 21 bp, Homo sapiens
attctgccatgggagagtcca

SEQ ID NO: 4998325 - DNA, 21 bp, Homo sapiens
attcttacaaacatgtggtta

SEQ ID NO: 4998326 - DNA, 16 bp, Homo sapiens
attgcatatatacata

SEQ ID NO: 4998327 - DNA, 19 bp, Homo sapiens
attgtacacaccttatatt

SEQ ID NO: 4998328 - DNA, 15 bp, Homo sapiens
atttactacttttgc

SEQ ID NO: 4998329 - DNA, 23 bp, Homo sapiens
atttatcatctcgaccacttttc

SEQ ID NO: 4998330 - DNA, 21 bp, Homo sapiens
atttcaatttccaagagctga

SEQ ID NO: 4998331 - DNA, 15 bp, Homo sapiens
atttccaagagctga

SEQ ID NO: 4998332 - DNA, 16 bp, Homo sapiens
atttccaagagctgag

SEQ ID NO: 4998333 - DNA, 20 bp, Homo sapiens
atttgatagtattgtgcata

SEQ ID NO: 4998334 - DNA, 12 bp, Homo sapiens
atttggcccaga

SEQ ID NO: 4998335 - DNA, 11 bp, Homo sapiens
attttgtaata

SEQ ID NO: 4998336 - DNA, 13 bp, Homo sapiens
attttgtaataaa

SEQ ID NO: 4998337 - DNA, 15 bp, Homo sapiens
attttgtaataaact

SEQ ID NO: 4998338 - DNA, 13 bp, Homo sapiens
caaaaccagaggg

SEQ ID NO: 4998339 - DNA, 16 bp, Homo sapiens
caaaaccagagggcag

SEQ ID NO: 4998340 - DNA, 18 bp, Homo sapiens
caaaataaagctgttctc

SEQ ID NO: 4998341 - DNA, 14 bp, Homo sapiens
caaagaaggcacag

SEQ ID NO: 4998342 - DNA, 21 bp, Homo sapiens
caaagaaggcacaggtgtaaa

SEQ ID NO: 4998343 - DNA, 22 bp, Homo sapiens
caaagaaggcacaggtgtaaat

SEQ ID NO: 4998344 - DNA, 18 bp, Homo sapiens
caaagctgctgggccagt

SEQ ID NO: 4998345 - DNA, 23 bp, Homo sapiens
caaagctgctgggccagtggcac

SEQ ID NO: 4998346 - DNA, 14 bp, Homo sapiens
caaataaatgtgta

SEQ ID NO: 4998347 - DNA, 17 bp, Homo sapiens
caaataaatgtgtaaat

SEQ ID NO: 4998348 - DNA, 15 bp, Homo sapiens
caaatccgaaatcag

SEQ ID NO: 4998349 - DNA, 16 bp, Homo sapiens
caaatgctaaatgcaa

SEQ ID NO: 4998350 - DNA, 13 bp, Homo sapiens
caacatgtataat

SEQ ID NO: 4998351 - DNA, 18 bp, Homo sapiens
caacatgtataatatttt

SEQ ID NO: 4998352 - DNA, 19 bp, Homo sapiens
caacatgtataatattttt

SEQ ID NO: 4998353 - DNA, 13 bp, Homo sapiens
caactctgtgagg

SEQ ID NO: 4998354 - DNA, 11 bp, Homo sapiens
caactgcagga

SEQ ID NO: 4998355 - DNA, 23 bp, Homo sapiens
caagaaataaattcacatcctca

SEQ ID NO: 4998356 - DNA, 15 bp, Homo sapiens
caagatcgctgtgct

SEQ ID NO: 4998357 - DNA, 17 bp, Homo sapiens
caagattttctactttt

SEQ ID NO: 4998358 - DNA, 20 bp, Homo sapiens
caagctgcaaaaggcctgtg

SEQ ID NO: 4998359 - DNA, 14 bp, Homo sapiens
caaggaaggatgcc

SEQ ID NO: 4998360 - DNA, 20 bp, Homo sapiens
caagtacatggctagctttt

SEQ ID NO: 4998361 - DNA, 20 bp, Homo sapiens
caagtagctgctaccttctt

SEQ ID NO: 4998362 - DNA, 20 bp, Homo sapiens
caagtattttatctgtgttg

SEQ ID NO: 4998363 - DNA, 13 bp, Homo sapiens
caatattttccat

SEQ ID NO: 4998364 - DNA, 20 bp, Homo sapiens
caatattttccatgaaaatg

SEQ ID NO: 4998365 - DNA, 15 bp, Homo sapiens
caatcactgggccca

SEQ ID NO: 4998366 - DNA, 19 bp, Homo sapiens
caatcactgggcccagagg

SEQ ID NO: 4998367 - DNA, 11 bp, Homo sapiens
caatgctgcca

SEQ ID NO: 4998368 - DNA, 17 bp, Homo sapiens
caatgctgccatgccca

SEQ ID NO: 4998369 - DNA, 16 bp, Homo sapiens
caatggtttgcaagga

SEQ ID NO: 4998370 - DNA, 19 bp, Homo sapiens
caatggtttgcaaggaagc

SEQ ID NO: 4998371 - DNA, 13 bp, Homo sapiens
caattgtcttttt

SEQ ID NO: 4998372 - DNA, 12 bp, Homo sapiens
caatttaaagca

SEQ ID NO: 4998373 - DNA, 22 bp, Homo sapiens
ggagagtccaggcctgggtcac

SEQ ID NO: 4998374 - DNA, 15 bp, Homo sapiens
ggagcccacggggca

SEQ ID NO: 4998375 - DNA, 14 bp, Homo sapiens
ggagcccagggtgc

SEQ ID NO: 4998376 - DNA, 23 bp, Homo sapiens
ggagcccgtgccctaccacacat

SEQ ID NO: 4998377 - DNA, 20 bp, Homo sapiens
ggagcgtggggaggggctga

SEQ ID NO: 4998378 - DNA, 23 bp, Homo sapiens
ggaggaaaatctgaactctaagc

SEQ ID NO: 4998379 - DNA, 15 bp, Homo sapiens
ggaggagtgggacag

SEQ ID NO: 4998380 - DNA, 19 bp, Homo sapiens
ggaggagtgggacagacag

SEQ ID NO: 4998381 - DNA, 14 bp, Homo sapiens
ggaggggctgagga

SEQ ID NO: 4998382 - DNA, 22 bp, Homo sapiens
ggaggtcttggccgactcaggg

SEQ ID NO: 4998383 - DNA, 21 bp, Homo sapiens
ggagtaggctccagacaggag

SEQ ID NO: 4998384 - DNA, 20 bp, Homo sapiens
ggagtcagtagccagagttg

SEQ ID NO: 4998385 - DNA, 22 bp, Homo sapiens
ggataccccaaagtccaggcta

SEQ ID NO: 4998386 - DNA, 15 bp, Homo sapiens
ggatgcacagtgcct

SEQ ID NO: 4998387 - DNA, 20 bp, Homo sapiens
ggatggctatattaggcatg

SEQ ID NO: 4998388 - DNA, 21 bp, Homo sapiens
ggatgtggcaggggcagtggc

SEQ ID NO: 4998389 - DNA, 14 bp, Homo sapiens
ggcaaagctgctgg

SEQ ID NO: 4998390 - DNA, 12 bp, Homo sapiens
ggcactgtccag

SEQ ID NO: 4998391 - DNA, 17 bp, Homo sapiens
ggcactgtccagggccc

SEQ ID NO: 4998392 - DNA, 18 bp, Homo sapiens
ggcactgtccagggccca

SEQ ID NO: 4998393 - DNA, 21 bp, Homo sapiens
ggcactgtccagggcccatgt

SEQ ID NO: 4998394 - DNA, 14 bp, Homo sapiens
ggcagaaagatgga

SEQ ID NO: 4998395 - DNA, 19 bp, Homo sapiens
ggcagaaagatggagaggc

SEQ ID NO: 4998396 - DNA, 20 bp, Homo sapiens
ggcagagaagtggagtgact

SEQ ID NO: 4998397 - DNA, 16 bp, Homo sapiens
ggcagagtggagccca

SEQ ID NO: 4998398 - DNA, 21 bp, Homo sapiens
ggcagctgcctcccctcctct

SEQ ID NO: 4998399 - DNA, 13 bp, Homo sapiens
ggcaggcagagaa

SEQ ID NO: 4998400 - DNA, 16 bp, Homo sapiens
ggcaggggcagtggcc

SEQ ID NO: 4998401 - DNA, 12 bp, Homo sapiens
ggcagtggcctg

SEQ ID NO: 4998402 - DNA, 14 bp, Homo sapiens
ggcagtggcctgga

SEQ ID NO: 4998403 - DNA, 17 bp, Homo sapiens
ggcagtggcctggatgc

SEQ ID NO: 4998404 - DNA, 15 bp, Homo sapiens
ggcatgggggcccaa

SEQ ID NO: 4998405 - DNA, 17 bp, Homo sapiens
ggcatgggggcccaaag

SEQ ID NO: 4998406 - DNA, 21 bp, Homo sapiens
ggccagatgcacatccctgga

SEQ ID NO: 4998407 - DNA, 21 bp, Homo sapiens
ggccaggattcaggcctctga

SEQ ID NO: 4998408 - DNA, 15 bp, Homo sapiens
ggccaggtcctcaca

SEQ ID NO: 4998409 - DNA, 18 bp, Homo sapiens
ggccaggtcctcacagca

SEQ ID NO: 4998410 - DNA, 21 bp, Homo sapiens
ggccaggtcctcacagcagtc

SEQ ID NO: 4998411 - DNA, 22 bp, Homo sapiens
ggccaggtcctcacagcagtca

SEQ ID NO: 4998412 - DNA, 12 bp, Homo sapiens
ggccagtggcac

SEQ ID NO: 4998413 - DNA, 18 bp, Homo sapiens
ggccagtggcactctgtg

SEQ ID NO: 4998414 - DNA, 19 bp, Homo sapiens
ggccagtggcactctgtgt

SEQ ID NO: 4998415 - DNA, 23 bp, Homo sapiens
ggcccaggaaggcggcaggcaga

SEQ ID NO: 4998416 - DNA, 16 bp, Homo sapiens
ggcctcacctcccagg

SEQ ID NO: 4998417 - DNA, 19 bp, Homo sapiens
ggcctcatcttccccagcc

SEQ ID NO: 4998418 - DNA, 17 bp, Homo sapiens
ggcctctactaggtctg

SEQ ID NO: 4998419 - DNA, 16 bp, Homo sapiens
ggcctggatgcacagt

SEQ ID NO: 4998420 - DNA, 21 bp, Homo sapiens
ggcctgggtcacgctcaagga

SEQ ID NO: 4998421 - DNA, 17 bp, Homo sapiens
ggcggcaggcagagaag

SEQ ID NO: 4998422 - DNA, 20 bp, Homo sapiens
ggctcagaggggcctcatct

SEQ ID NO: 4998423 - DNA, 21 bp, Homo sapiens
ggctcagggccaggtcctcac

SEQ ID NO: 4998424 - DNA, 15 bp, Homo sapiens
ggctcagttctgcct

SEQ ID NO: 4998425 - DNA, 11 bp, Homo sapiens
ggctccctgga

SEQ ID NO: 4998426 - DNA, 13 bp, Homo sapiens
ggctccctggagg

SEQ ID NO: 4998427 - DNA, 14 bp, Homo sapiens
ggctccctggagga

SEQ ID NO: 4998428 - DNA, 15 bp, Homo sapiens
ggctccctggaggac

SEQ ID NO: 4998429 - DNA, 17 bp, Homo sapiens
ggctgacctgctgtgga

SEQ ID NO: 4998430 - DNA, 17 bp, Homo sapiens
ggctgccaggcaccatc

SEQ ID NO: 4998431 - DNA, 12 bp, Homo sapiens
ggctgtgcccca

SEQ ID NO: 4998432 - DNA, 13 bp, Homo sapiens
ggctgtgccccac

SEQ ID NO: 4998433 - DNA, 15 bp, Homo sapiens
ggctgtgccccacct

SEQ ID NO: 4998434 - DNA, 16 bp, Homo sapiens
ggctgtgccccacctg

SEQ ID NO: 4998435 - DNA, 18 bp, Homo sapiens
ggctttgccattaaaatg

SEQ ID NO: 4998436 - DNA, 14 bp, Homo sapiens
gggacagacagcag

SEQ ID NO: 4998437 - DNA, 17 bp, Homo sapiens
gggacagacagcagctg

SEQ ID NO: 4998438 - DNA, 20 bp, Homo sapiens
gggacagacagcagctggac

SEQ ID NO: 4998439 - DNA, 19 bp, Homo sapiens
gggaccacatccaccccag

SEQ ID NO: 4998440 - DNA, 13 bp, Homo sapiens
gggagagtccagg

SEQ ID NO: 4998441 - DNA, 16 bp, Homo sapiens
gggagagtccaggcct

SEQ ID NO: 4998442 - DNA, 12 bp, Homo sapiens
gggcactgggca

SEQ ID NO: 4998443 - DNA, 15 bp, Homo sapiens
gggcactgggcacta

SEQ ID NO: 4998444 - DNA, 17 bp, Homo sapiens
gggcagagtggagccca

SEQ ID NO: 4998445 - DNA, 13 bp, Homo sapiens
gggcagctgcctc

SEQ ID NO: 4998446 - DNA, 14 bp, Homo sapiens
gggcagctgcctcc

SEQ ID NO: 4998447 - DNA, 20 bp, Homo sapiens
gggcagctgcctcccctcct

SEQ ID NO: 4998448 - DNA, 15 bp, Homo sapiens
gggcagtggcctgga

SEQ ID NO: 4998449 - DNA, 18 bp, Homo sapiens
gggcagtggcctggatgc

SEQ ID NO: 4998450 - DNA, 18 bp, Homo sapiens
gggccaggattcaggcct

SEQ ID NO: 4998451 - DNA, 19 bp, Homo sapiens
gggccaggattcaggcctc

SEQ ID NO: 4998452 - DNA, 17 bp, Homo sapiens
gggccaggtcctcacag

SEQ ID NO: 4998453 - DNA, 19 bp, Homo sapiens
gggccaggtcctcacagca

SEQ ID NO: 4998454 - DNA, 21 bp, Homo sapiens
gggccaggtcctcacagcagt

SEQ ID NO: 4998455 - DNA, 20 bp, Homo sapiens
gggcctcatcttccccagcc

SEQ ID NO: 4998456 - DNA, 21 bp, Homo sapiens
gggcctcatcttccccagccc

SEQ ID NO: 4998457 - DNA, 16 bp, Homo sapiens
gggctcagaggggcct

SEQ ID NO: 4998458 - DNA, 20 bp, Homo sapiens
gggctcagcagccagaggag

SEQ ID NO: 4998459 - DNA, 13 bp, Homo sapiens
gggctcagggcca

SEQ ID NO: 4998460 - DNA, 16 bp, Homo sapiens
gggctcagggccaggt

SEQ ID NO: 4998461 - DNA, 12 bp, Homo sapiens
gggctccctgga

SEQ ID NO: 4998462 - DNA, 22 bp, Homo sapiens
gggctccctggaggactctaga

SEQ ID NO: 4998463 - DNA, 15 bp, Homo sapiens
ggggaattcatctct

SEQ ID NO: 4998464 - DNA, 16 bp, Homo sapiens
ggggcaaagctgctgg

SEQ ID NO: 4998465 - DNA, 14 bp, Homo sapiens
ggggcagagtggag

SEQ ID NO: 4998466 - DNA, 20 bp, Homo sapiens
ggggcagtggcctggatgca

SEQ ID NO: 4998467 - DNA, 21 bp, Homo sapiens
ggggcagtggcctggatgcac

SEQ ID NO: 4998468 - DNA, 17 bp, Homo sapiens
ggggcccaaaggggagc

SEQ ID NO: 4998469 - DNA, 18 bp, Homo sapiens
gggggcccaaaggggagc

SEQ ID NO: 4998470 - DNA, 23 bp, Homo sapiens
gggtaaagccctcagatcccagg

SEQ ID NO: 4998471 - DNA, 18 bp, Homo sapiens
gggtgccccagctaggaa

SEQ ID NO: 4998472 - DNA, 23 bp, Homo sapiens
ggtaaagccctcagatcccaggg

SEQ ID NO: 4998473 - DNA, 21 bp, Homo sapiens
ggtacactcttctccattccc

SEQ ID NO: 4998474 - DNA, 21 bp, Homo sapiens
ggtatgaccttctaggaagct

SEQ ID NO: 4998475 - DNA, 14 bp, Homo sapiens
ggtcaccatgaaac

SEQ ID NO: 4998476 - DNA, 17 bp, Homo sapiens
ggtcactggagtagttg

SEQ ID NO: 4998477 - DNA, 15 bp, Homo sapiens
ggtcctcacagcagt

SEQ ID NO: 4998478 - DNA, 16 bp, Homo sapiens
ggtcctcacagcagtc

SEQ ID NO: 4998479 - DNA, 10 bp, Homo sapiens
ggtccttcaa

SEQ ID NO: 4998480 - DNA, 19 bp, Homo sapiens
ggtcggcaagagtgagact

SEQ ID NO: 4998481 - DNA, 18 bp, Homo sapiens
ggtctagaaggccaggcc

SEQ ID NO: 4998482 - DNA, 23 bp, Homo sapiens
ggtctgaccaaaaccagagggca

SEQ ID NO: 4998483 - DNA, 23 bp, Homo sapiens
ggtgccccagctaggaagcaaga

SEQ ID NO: 4998484 - DNA, 23 bp, Homo sapiens
ggtgctgccaccccttggcactg

SEQ ID NO: 4998485 - DNA, 15 bp, Homo sapiens
ggtggaacaagcaca

SEQ ID NO: 4998486 - DNA, 19 bp, Homo sapiens
ggtggaggttgcagtgagc

SEQ ID NO: 4998487 - DNA, 19 bp, Homo sapiens
ggttgcctcaacagcagga

SEQ ID NO: 4998488 - DNA, 13 bp, Homo sapiens
ggtttctgaaaat

SEQ ID NO: 4998489 - DNA, 22 bp, Homo sapiens
ggtttgatgccaaagcagacat

SEQ ID NO: 4998490 - DNA, 14 bp, Homo sapiens
ggtttgcaaggaag

SEQ ID NO: 4998491 - DNA, 15 bp, Homo sapiens
gtaaatgtggacaca

SEQ ID NO: 4998492 - DNA, 12 bp, Homo sapiens
gtaagtcttttt

SEQ ID NO: 4998493 - DNA, 12 bp, Homo sapiens
gtacatggagct

SEQ ID NO: 4998494 - DNA, 17 bp, Homo sapiens
gtacatggagctcaggt

SEQ ID NO: 4998495 - DNA, 15 bp, Homo sapiens
gtactacaatttaaa

SEQ ID NO: 4998496 - DNA, 23 bp, Homo sapiens
gtagcagaaaggaaaagattcct

SEQ ID NO: 4998497 - DNA, 22 bp, Homo sapiens
gtagcaggatgaggaacctcaa

SEQ ID NO: 4998498 - DNA, 10 bp, Homo sapiens
gtagctgcta

SEQ ID NO: 4998499 - DNA, 13 bp, Homo sapiens
aaaaccagagggc

SEQ ID NO: 4998500 - DNA, 20 bp, Homo sapiens
aaaaggcctgtgatccagga

SEQ ID NO: 4998501 - DNA, 17 bp, Homo sapiens
aaaataaagctgttctc

SEQ ID NO: 4998502 - DNA, 14 bp, Homo sapiens
aaaattaacactgc

SEQ ID NO: 4998503 - DNA, 14 bp, Homo sapiens
aaagacagagctgg

SEQ ID NO: 4998504 - DNA, 21 bp, Homo sapiens
aaagatgtcccacagggacca

SEQ ID NO: 4998505 - DNA, 21 bp, Homo sapiens
aaagccctcagatcccagggt

SEQ ID NO: 4998506 - DNA, 11 bp, Homo sapiens
aaagctgctgg

SEQ ID NO: 4998507 - DNA, 17 bp, Homo sapiens
aaagctgctgggccagt

SEQ ID NO: 4998508 - DNA, 16 bp, Homo sapiens
aaaggcatctttctga

SEQ ID NO: 4998509 - DNA, 20 bp, Homo sapiens
aaagggtatgagctggagct

SEQ ID NO: 4998510 - DNA, 12 bp, Homo sapiens
aaagtcagagct

SEQ ID NO: 4998511 - DNA, 12 bp, Homo sapiens
aaataaagctgt

SEQ ID NO: 4998512 - DNA, 15 bp, Homo sapiens
aaataaatgtgtaaa

SEQ ID NO: 4998513 - DNA, 11 bp, Homo sapiens
aaatataaact

SEQ ID NO: 4998514 - DNA, 16 bp, Homo sapiens
aaatgcaaacactgtg

SEQ ID NO: 4998515 - DNA, 17 bp, Homo sapiens
aaatgcaaacactgtgt

SEQ ID NO: 4998516 - DNA, 21 bp, Homo sapiens
aaatgcaaacactgtgtattt

SEQ ID NO: 4998517 - DNA, 18 bp, Homo sapiens
aaatgctaaatgcaaaca

SEQ ID NO: 4998518 - DNA, 13 bp, Homo sapiens
aaatggcagaaag

SEQ ID NO: 4998519 - DNA, 19 bp, Homo sapiens
aaatgtgtaaatgtggaca

SEQ ID NO: 4998520 - DNA, 18 bp, Homo sapiens
aacactatatggcagtgt

SEQ ID NO: 4998521 - DNA, 20 bp, Homo sapiens
aacactatatggcagtgtct

SEQ ID NO: 4998522 - DNA, 14 bp, Homo sapiens
aacagcaggaggca

SEQ ID NO: 4998523 - DNA, 15 bp, Homo sapiens
aacagcttcatgttc

SEQ ID NO: 4998524 - DNA, 15 bp, Homo sapiens
aacataaaatataca

SEQ ID NO: 4998525 - DNA, 13 bp, Homo sapiens
aaccagtcctgct

SEQ ID NO: 4998526 - DNA, 15 bp, Homo sapiens
aaccagtcctgctgc

SEQ ID NO: 4998527 - DNA, 17 bp, Homo sapiens
aaccatgggctcagggc

SEQ ID NO: 4998528 - DNA, 22 bp, Homo sapiens
aacccaaataaatgtgtaaatg

SEQ ID NO: 4998529 - DNA, 10 bp, Homo sapiens
aactgcagga

SEQ ID NO: 4998530 - DNA, 17 bp, Homo sapiens
aactgcaggaatgctga

SEQ ID NO: 4998531 - DNA, 23 bp, Homo sapiens
aactgccaccttgggtctgtgtc

SEQ ID NO: 4998532 - DNA, 19 bp, Homo sapiens
aactggtcaccatgaaact

SEQ ID NO: 4998533 - DNA, 21 bp, Homo sapiens
aagaaggcacaggtgtaaata

SEQ ID NO: 4998534 - DNA, 23 bp, Homo sapiens
aagacaatggcttactccaggag

SEQ ID NO: 4998535 - DNA, 15 bp, Homo sapiens
aagacagagctggga

SEQ ID NO: 4998536 - DNA, 16 bp, Homo sapiens
aagacagagctgggat

SEQ ID NO: 4998537 - DNA, 17 bp, Homo sapiens
aagactctccactgacc

SEQ ID NO: 4998538 - DNA, 14 bp, Homo sapiens
aagagatacagagg

SEQ ID NO: 4998539 - DNA, 11 bp, Homo sapiens
aagagctgagg

SEQ ID NO: 4998540 - DNA, 15 bp, Homo sapiens
aagatcgctgtgcta

SEQ ID NO: 4998541 - DNA, 15 bp, Homo sapiens
aagatggagaggcat

SEQ ID NO: 4998542 - DNA, 19 bp, Homo sapiens
aagatggcactgtccaggg

SEQ ID NO: 4998543 - DNA, 17 bp, Homo sapiens
aagattcctgtccttca

SEQ ID NO: 4998544 - DNA, 17 bp, Homo sapiens
aagcaatcactgggccc

SEQ ID NO: 4998545 - DNA, 21 bp, Homo sapiens
aagcaatcactgggcccagag

SEQ ID NO: 4998546 - DNA, 20 bp, Homo sapiens
aagcacagtctgatgacaca

SEQ ID NO: 4998547 - DNA, 14 bp, Homo sapiens
aagcagaagactct

SEQ ID NO: 4998548 - DNA, 18 bp, Homo sapiens
aagctcaggttccctgcc

SEQ ID NO: 4998549 - DNA, 14 bp, Homo sapiens
aagctgctgggcca

SEQ ID NO: 4998550 - DNA, 16 bp, Homo sapiens
aagctgctgggccagt

SEQ ID NO: 4998551 - DNA, 21 bp, Homo sapiens
aagctgctgggccagtggcac

SEQ ID NO: 4998552 - DNA, 18 bp, Homo sapiens
aagctgttctcattcctg

SEQ ID NO: 4998553 - DNA, 17 bp, Homo sapiens
aagggtatgagctggag

SEQ ID NO: 4998554 - DNA, 16 bp, Homo sapiens
aaggtgctgccacccc

SEQ ID NO: 4998555 - DNA, 17 bp, Homo sapiens
aaggttgtattgcatat

SEQ ID NO: 4998556 - DNA, 20 bp, Homo sapiens
aaggtttgatgccaaagcag

SEQ ID NO: 4998557 - DNA, 18 bp, Homo sapiens
aagtattttatctgtgtt

SEQ ID NO: 4998558 - DNA, 12 bp, Homo sapiens
aagtcagagctc

SEQ ID NO: 4998559 - DNA, 15 bp, Homo sapiens
aagtcagagctcagg

SEQ ID NO: 4998560 - DNA, 14 bp, Homo sapiens
aagttaaattttat

SEQ ID NO: 4998561 - DNA, 19 bp, Homo sapiens
aataaaatgggttttactg

SEQ ID NO: 4998562 - DNA, 12 bp, Homo sapiens
aataaagaaaaa

SEQ ID NO: 4998563 - DNA, 13 bp, Homo sapiens
aataaagaaaaac

SEQ ID NO: 4998564 - DNA, 13 bp, Homo sapiens
aataaatgtgtaa

SEQ ID NO: 4998565 - DNA, 17 bp, Homo sapiens
aataaatgtgtaaatgt

SEQ ID NO: 4998566 - DNA, 18 bp, Homo sapiens
aataaatgtgtaaatgtg

SEQ ID NO: 4998567 - DNA, 21 bp, Homo sapiens
aataaattcacatcctcagaa

SEQ ID NO: 4998568 - DNA, 17 bp, Homo sapiens
aatagcacccatatctg

SEQ ID NO: 4998569 - DNA, 13 bp, Homo sapiens
aatataaacacta

SEQ ID NO: 4998570 - DNA, 12 bp, Homo sapiens
aatataaacttg

SEQ ID NO: 4998571 - DNA, 17 bp, Homo sapiens
aatataaacttgtgtat

SEQ ID NO: 4998572 - DNA, 16 bp, Homo sapiens
aatatacaaacatgtg

SEQ ID NO: 4998573 - DNA, 15 bp, Homo sapiens
aatatatacaaacct

SEQ ID NO: 4998574 - DNA, 16 bp, Homo sapiens
aatcactgggcccaga

SEQ ID NO: 4998575 - DNA, 18 bp, Homo sapiens
aatcactgggcccagagg

SEQ ID NO: 4998576 - DNA, 18 bp, Homo sapiens
aatgcaaacactgtgtat

SEQ ID NO: 4998577 - DNA, 15 bp, Homo sapiens
aatgcaacaacatgt

SEQ ID NO: 4998578 - DNA, 16 bp, Homo sapiens
aatgccatgactgctc

SEQ ID NO: 4998579 - DNA, 17 bp, Homo sapiens
aatgccatgactgctca

SEQ ID NO: 4998580 - DNA, 19 bp, Homo sapiens
aatgccatgactgctcagg

SEQ ID NO: 4998581 - DNA, 21 bp, Homo sapiens
aatgccatgactgctcaggcc

SEQ ID NO: 4998582 - DNA, 14 bp, Homo sapiens
aatgctaaatgcaa

SEQ ID NO: 4998583 - DNA, 18 bp, Homo sapiens
aatgctgacaatgctgcc

SEQ ID NO: 4998584 - DNA, 18 bp, Homo sapiens
aatggcagaaagatggag

SEQ ID NO: 4998585 - DNA, 13 bp, Homo sapiens
aatggctgtgccc

SEQ ID NO: 4998586 - DNA, 14 bp, Homo sapiens
aatggctgtgcccc

SEQ ID NO: 4998587 - DNA, 14 bp, Homo sapiens
aatggtttgaatat

SEQ ID NO: 4998588 - DNA, 17 bp, Homo sapiens
aatggtttgcaaggaag

SEQ ID NO: 4998589 - DNA, 18 bp, Homo sapiens
aatggtttgcaaggaagc

SEQ ID NO: 4998590 - DNA, 12 bp, Homo sapiens
aatgtgtaaatg

SEQ ID NO: 4998591 - DNA, 20 bp, Homo sapiens
aattagaggatgtggcaggg

SEQ ID NO: 4998592 - DNA, 23 bp, Homo sapiens
aattcactcccacacccaagaag

SEQ ID NO: 4998593 - DNA, 17 bp, Homo sapiens
aattcttacaaacatgt

SEQ ID NO: 4998594 - DNA, 21 bp, Homo sapiens
aattgtgcgacttcacaaaat

SEQ ID NO: 4998595 - DNA, 14 bp, Homo sapiens
aatttggcccagag

SEQ ID NO: 4998596 - DNA, 11 bp, Homo sapiens
acaaaatgcaa

SEQ ID NO: 4998597 - DNA, 16 bp, Homo sapiens
acaaagaaggcacagg

SEQ ID NO: 4998598 - DNA, 18 bp, Homo sapiens
acaagacccaagtagctg

SEQ ID NO: 4998599 - DNA, 20 bp, Homo sapiens
acaagcatttcccccaggga

SEQ ID NO: 4998600 - DNA, 12 bp, Homo sapiens
acaatgctgcca

SEQ ID NO: 4998601 - DNA, 16 bp, Homo sapiens
acaatgctgccatgcc

SEQ ID NO: 4998602 - DNA, 15 bp, Homo sapiens
aggcctcacctccca

SEQ ID NO: 4998603 - DNA, 20 bp, Homo sapiens
aggcctcacctcccagggct

SEQ ID NO: 4998604 - DNA, 21 bp, Homo sapiens
aggcctcacctcccagggcta

SEQ ID NO: 4998605 - DNA, 21 bp, Homo sapiens
aggcctctactaggtctgctc

SEQ ID NO: 4998606 - DNA, 13 bp, Homo sapiens
aggcctctgagga

SEQ ID NO: 4998607 - DNA, 16 bp, Homo sapiens
aggcctctgaggagcc

SEQ ID NO: 4998608 - DNA, 21 bp, Homo sapiens
aggcctgggtcacgctcaagg

SEQ ID NO: 4998609 - DNA, 22 bp, Homo sapiens
aggcctgggtcacgctcaagga

SEQ ID NO: 4998610 - DNA, 14 bp, Homo sapiens
aggcggcaggcaga

SEQ ID NO: 4998611 - DNA, 20 bp, Homo sapiens
aggctaattagaggatgtgg

SEQ ID NO: 4998612 - DNA, 16 bp, Homo sapiens
aggctgccaggcacca

SEQ ID NO: 4998613 - DNA, 19 bp, Homo sapiens
aggctgccaggcaccatct

SEQ ID NO: 4998614 - DNA, 13 bp, Homo sapiens
agggaagttttgt

SEQ ID NO: 4998615 - DNA, 18 bp, Homo sapiens
agggaccacatccacccc

SEQ ID NO: 4998616 - DNA, 13 bp, Homo sapiens
agggccaggtcct

SEQ ID NO: 4998617 - DNA, 21 bp, Homo sapiens
agggccaggtcctcacagcag

SEQ ID NO: 4998618 - DNA, 20 bp, Homo sapiens
agggcccatgtagctggcaa

SEQ ID NO: 4998619 - DNA, 16 bp, Homo sapiens
agggctacacagaccc

SEQ ID NO: 4998620 - DNA, 23 bp, Homo sapiens
agggctacacagaccctgcccac

SEQ ID NO: 4998621 - DNA, 23 bp, Homo sapiens
agggctcagaggggcctcatctt

SEQ ID NO: 4998622 - DNA, 16 bp, Homo sapiens
aggggagcgtggggag

SEQ ID NO: 4998623 - DNA, 15 bp, Homo sapiens
aggggtgctggggca

SEQ ID NO: 4998624 - DNA, 20 bp, Homo sapiens
aggggtgctggggcagagtg

SEQ ID NO: 4998625 - DNA, 14 bp, Homo sapiens
agggtatgagctgg

SEQ ID NO: 4998626 - DNA, 15 bp, Homo sapiens
agggtatgagctgga

SEQ ID NO: 4998627 - DNA, 18 bp, Homo sapiens
agggtatgagctggagct

SEQ ID NO: 4998628 - DNA, 19 bp, Homo sapiens
agggtatgagctggagcta

SEQ ID NO: 4998629 - DNA, 17 bp, Homo sapiens
agggtggggtgccccag

SEQ ID NO: 4998630 - DNA, 15 bp, Homo sapiens
aggtcctcacagcag

SEQ ID NO: 4998631 - DNA, 16 bp, Homo sapiens
aggtctagaaggccag

SEQ ID NO: 4998632 - DNA, 23 bp, Homo sapiens
aggtctgaccaaaaccagagggc

SEQ ID NO: 4998633 - DNA, 18 bp, Homo sapiens
aggtctgctcctgaacca

SEQ ID NO: 4998634 - DNA, 14 bp, Homo sapiens
aggtcttggccgac

SEQ ID NO: 4998635 - DNA, 19 bp, Homo sapiens
aggtcttggccgactcagg

SEQ ID NO: 4998636 - DNA, 19 bp, Homo sapiens
aggtgaacaccactttgtc

SEQ ID NO: 4998637 - DNA, 23 bp, Homo sapiens
aggtgaacaccactttgtctctg

SEQ ID NO: 4998638 - DNA, 21 bp, Homo sapiens
aggtgagggtggggtgcccca

SEQ ID NO: 4998639 - DNA, 13 bp, Homo sapiens
aggtgctgccacc

SEQ ID NO: 4998640 - DNA, 13 bp, Homo sapiens
aggtgtgccaaac

SEQ ID NO: 4998641 - DNA, 18 bp, Homo sapiens
aggttgcctcaacagcag

SEQ ID NO: 4998642 - DNA, 20 bp, Homo sapiens
aggtttctggacaagaagag

SEQ ID NO: 4998643 - DNA, 20 bp, Homo sapiens
agtagaaagacagagctggg

SEQ ID NO: 4998644 - DNA, 23 bp, Homo sapiens
agtagccagagttgttctcaggg

SEQ ID NO: 4998645 - DNA, 17 bp, Homo sapiens
agtagctgctaccttct

SEQ ID NO: 4998646 - DNA, 22 bp, Homo sapiens
agtaggctccagacaggaggag

SEQ ID NO: 4998647 - DNA, 15 bp, Homo sapiens
agtcacaggcccagg

SEQ ID NO: 4998648 - DNA, 16 bp, Homo sapiens
agtcacaggcccagga

SEQ ID NO: 4998649 - DNA, 14 bp, Homo sapiens
agtcagtagccaga

SEQ ID NO: 4998650 - DNA, 17 bp, Homo sapiens
agtccaaggagaagaag

SEQ ID NO: 4998651 - DNA, 14 bp, Homo sapiens
agtcccactgcacc

SEQ ID NO: 4998652 - DNA, 18 bp, Homo sapiens
agtcccactgcacccccc

SEQ ID NO: 4998653 - DNA, 22 bp, Homo sapiens
agtcctgatcctaaccctgggc

SEQ ID NO: 4998654 - DNA, 17 bp, Homo sapiens
agtcctgctgcctggag

SEQ ID NO: 4998655 - DNA, 22 bp, Homo sapiens
agtcctgctgcctggagtcagt

SEQ ID NO: 4998656 - DNA, 15 bp, Homo sapiens
agtggagcccagggt

SEQ ID NO: 4998657 - DNA, 18 bp, Homo sapiens
agtggagcccagggtgct

SEQ ID NO: 4998658 - DNA, 20 bp, Homo sapiens
agtggagcccagggtgctgg

SEQ ID NO: 4998659 - DNA, 21 bp, Homo sapiens
agtggcctggatgcacagtgc

SEQ ID NO: 4998660 - DNA, 13 bp, Homo sapiens
agtgggacagaca

SEQ ID NO: 4998661 - DNA, 17 bp, Homo sapiens
agtgggacagacagcag

SEQ ID NO: 4998662 - DNA, 22 bp, Homo sapiens
agtgggacagacagcagctgga

SEQ ID NO: 4998663 - DNA, 14 bp, Homo sapiens
agttaggtgtgcca

SEQ ID NO: 4998664 - DNA, 16 bp, Homo sapiens
agttcagagctgccct

SEQ ID NO: 4998665 - DNA, 19 bp, Homo sapiens
agttcagagctgccctctc

SEQ ID NO: 4998666 - DNA, 20 bp, Homo sapiens
agttcagagctgccctctcc

SEQ ID NO: 4998667 - DNA, 20 bp, Homo sapiens
agttgctactcttcagaata

SEQ ID NO: 4998668 - DNA, 20 bp, Homo sapiens
agtttcaccatctttgaggt

SEQ ID NO: 4998669 - DNA, 16 bp, Homo sapiens
ataaaagtcagagctc

SEQ ID NO: 4998670 - DNA, 21 bp, Homo sapiens
ataaagctgttctcattcctg

SEQ ID NO: 4998671 - DNA, 14 bp, Homo sapiens
ataaatgtgtaaat

SEQ ID NO: 4998672 - DNA, 19 bp, Homo sapiens
ataaatgtgtaaatgtgga

SEQ ID NO: 4998673 - DNA, 14 bp, Homo sapiens
ataatatttttaat

SEQ ID NO: 4998674 - DNA, 16 bp, Homo sapiens
ataccccaaagtccag

SEQ ID NO: 4998675 - DNA, 16 bp, Homo sapiens
atagaatttggcccag

SEQ ID NO: 4998676 - DNA, 18 bp, Homo sapiens
atagaatttggcccagag

SEQ ID NO: 4998677 - DNA, 13 bp, Homo sapiens
atataaacactat

SEQ ID NO: 4998678 - DNA, 15 bp, Homo sapiens
atataaacactatat

SEQ ID NO: 4998679 - DNA, 15 bp, Homo sapiens
atatacaaacatgtg

SEQ ID NO: 4998680 - DNA, 14 bp, Homo sapiens
atatatacatatat

SEQ ID NO: 4998681 - DNA, 20 bp, Homo sapiens
atatggggatgcagcattat

SEQ ID NO: 4998682 - DNA, 22 bp, Homo sapiens
atattaggcatgttcagggatg

SEQ ID NO: 4998683 - DNA, 18 bp, Homo sapiens
atcagctccactttcagt

SEQ ID NO: 4998684 - DNA, 23 bp, Homo sapiens
atccaccccagccccactgccct

SEQ ID NO: 4998685 - DNA, 18 bp, Homo sapiens
atcccagggtacactctt

SEQ ID NO: 4998686 - DNA, 17 bp, Homo sapiens
atccctccctccacctc

SEQ ID NO: 4998687 - DNA, 21 bp, Homo sapiens
atccctccctccacctccctg

SEQ ID NO: 4998688 - DNA, 15 bp, Homo sapiens
atccgaaatcagcag

SEQ ID NO: 4998689 - DNA, 22 bp, Homo sapiens
atcctcagaaagtgcagcatgg

SEQ ID NO: 4998690 - DNA, 21 bp, Homo sapiens
atcctcttctcaaagctggga

SEQ ID NO: 4998691 - DNA, 13 bp, Homo sapiens
atcctgctaagtt

SEQ ID NO: 4998692 - DNA, 14 bp, Homo sapiens
atctccctcccaca

SEQ ID NO: 4998693 - DNA, 17 bp, Homo sapiens
atctctctttaatataa

SEQ ID NO: 4998694 - DNA, 20 bp, Homo sapiens
atctcttctcactttccttt

SEQ ID NO: 4998695 - DNA, 18 bp, Homo sapiens
atctgaactctaagcaga

SEQ ID NO: 4998696 - DNA, 14 bp, Homo sapiens
atctgccaatgcca

SEQ ID NO: 4998697 - DNA, 23 bp, Homo sapiens
atctgccaatgccatgactgctc

SEQ ID NO: 4998698 - DNA, 19 bp, Homo sapiens
atctgtgttgtctctctaa

SEQ ID NO: 4998699 - DNA, 13 bp, Homo sapiens
atcttccccagcc

SEQ ID NO: 4998700 - DNA, 14 bp, Homo sapiens
atcttccccagccc

SEQ ID NO: 4998701 - DNA, 23 bp, Homo sapiens
atcttccccagccctccccacct

SEQ ID NO: 4998702 - DNA, 21 bp, Homo sapiens
atgaagactgttaaatgaaac

SEQ ID NO: 4998703 - DNA, 18 bp, Homo sapiens
atgaccttctaggaagct

SEQ ID NO: 4998704 - DNA, 24 bp, Homo sapiens
atgactctgcctaaccatgggctc

SEQ ID NO: 4998705 - DNA, 21 bp, Homo sapiens
atgagctggagctaaggccag

SEQ ID NO: 4998706 - DNA, 15 bp, Homo sapiens
atgaggaacctcaaa

SEQ ID NO: 4998707 - DNA, 16 bp, Homo sapiens
atgcaacaacatgtat

SEQ ID NO: 4998708 - DNA, 21 bp, Homo sapiens
atgcaacaacatgtataatat

SEQ ID NO: 4998709 - DNA, 20 bp, Homo sapiens
atgcaccctcatacacagaa

SEQ ID NO: 4998710 - DNA, 16 bp, Homo sapiens
atgccaaagcagacat

SEQ ID NO: 4998711 - DNA, 18 bp, Homo sapiens
atgccaaagcagacattt

SEQ ID NO: 4998712 - DNA, 16 bp, Homo sapiens
atgccatgactgctca

SEQ ID NO: 4998713 - DNA, 21 bp, Homo sapiens
atgccatgactgctcaggcct

SEQ ID NO: 4998714 - DNA, 23 bp, Homo sapiens
atgccatgactgctcaggcctca

SEQ ID NO: 4998715 - DNA, 19 bp, Homo sapiens
atgccatggacagaagaag

SEQ ID NO: 4998716 - DNA, 16 bp, Homo sapiens
atgccttatctcttct

SEQ ID NO: 4998717 - DNA, 23 bp, Homo sapiens
atgctaaaggttgtattgcatat

SEQ ID NO: 4998718 - DNA, 16 bp, Homo sapiens
atgctcattccatgac

SEQ ID NO: 4998719 - DNA, 23 bp, Homo sapiens
atgctcattccatgactctgcct

SEQ ID NO: 4998720 - DNA, 15 bp, Homo sapiens
atgctgccatgccca

SEQ ID NO: 4998721 - DNA, 19 bp, Homo sapiens
atgctgccatgcccaccat

SEQ ID NO: 4998722 - DNA, 23 bp, Homo sapiens
atgctttaggttgcttcagctga

SEQ ID NO: 4998723 - DNA, 14 bp, Homo sapiens
atggagaggcatgg

SEQ ID NO: 4998724 - DNA, 13 bp, Homo sapiens
atggcactgtcca

SEQ ID NO: 4998725 - DNA, 18 bp, Homo sapiens
atggcactgtccagggcc

SEQ ID NO: 4998726 - DNA, 15 bp, Homo sapiens
atggcagaaagatgg

SEQ ID NO: 4998727 - DNA, 16 bp, Homo sapiens
ccctgtgcctgctggg

SEQ ID NO: 4998728 - DNA, 18 bp, Homo sapiens
ccctgtgcctgctgggca

SEQ ID NO: 4998729 - DNA, 16 bp, Homo sapiens
cccttggcactgtgga

SEQ ID NO: 4998730 - DNA, 11 bp, Homo sapiens
ccgactcaggg

SEQ ID NO: 4998731 - DNA, 12 bp, Homo sapiens
ccgactcaggga

SEQ ID NO: 4998732 - DNA, 15 bp, Homo sapiens
cctaaccatgggctc

SEQ ID NO: 4998733 - DNA, 18 bp, Homo sapiens
cctaaccatgggctcagg

SEQ ID NO: 4998734 - DNA, 21 bp, Homo sapiens
cctaaccatgggctcagggcc

SEQ ID NO: 4998735 - DNA, 15 bp, Homo sapiens
cctaaccctgggctc

SEQ ID NO: 4998736 - DNA, 20 bp, Homo sapiens
cctaaccctgggctccctgg

SEQ ID NO: 4998737 - DNA, 20 bp, Homo sapiens
cctaagcaatcactgggccc

SEQ ID NO: 4998738 - DNA, 21 bp, Homo sapiens
cctaagcaatcactgggccca

SEQ ID NO: 4998739 - DNA, 22 bp, Homo sapiens
cctaagcaatcactgggcccag

SEQ ID NO: 4998740 - DNA, 16 bp, Homo sapiens
cctagggctcagaggg

SEQ ID NO: 4998741 - DNA, 18 bp, Homo sapiens
cctagggctcagaggggc

SEQ ID NO: 4998742 - DNA, 17 bp, Homo sapiens
cctcacacccacctgct

SEQ ID NO: 4998743 - DNA, 20 bp, Homo sapiens
cctcacacccacctgctgct

SEQ ID NO: 4998744 - DNA, 21 bp, Homo sapiens
cctcacacccacctgctgctg

SEQ ID NO: 4998745 - DNA, 12 bp, Homo sapiens
cctcacagcagt

SEQ ID NO: 4998746 - DNA, 16 bp, Homo sapiens
cctcacctcccagggc

SEQ ID NO: 4998747 - DNA, 18 bp, Homo sapiens
cctcacctcccagggcta

SEQ ID NO: 4998748 - DNA, 17 bp, Homo sapiens
cctcactgtcagtccca

SEQ ID NO: 4998749 - DNA, 19 bp, Homo sapiens
cctcagaaagtgcagcatg

SEQ ID NO: 4998750 - DNA, 23 bp, Homo sapiens
cctcagaaagtgcagcatggagg

SEQ ID NO: 4998751 - DNA, 14 bp, Homo sapiens
cctcagatcccagg

SEQ ID NO: 4998752 - DNA, 16 bp, Homo sapiens
cctcagatcccagggt

SEQ ID NO: 4998753 - DNA, 10 bp, Homo sapiens
cctccaccca

SEQ ID NO: 4998754 - DNA, 15 bp, Homo sapiens
cctccacccacttgc

SEQ ID NO: 4998755 - DNA, 13 bp, Homo sapiens
cctccagggccag

SEQ ID NO: 4998756 - DNA, 14 bp, Homo sapiens
cctccagggccagg

SEQ ID NO: 4998757 - DNA, 15 bp, Homo sapiens
cctccagggccagga

SEQ ID NO: 4998758 - DNA, 23 bp, Homo sapiens
cctccagggccaggattcaggcc

SEQ ID NO: 4998759 - DNA, 12 bp, Homo sapiens
cctcccagggct

SEQ ID NO: 4998760 - DNA, 23 bp, Homo sapiens
cctcccagggctacacagaccct

SEQ ID NO: 4998761 - DNA, 12 bp, Homo sapiens
cctcccctcctc

SEQ ID NO: 4998762 - DNA, 13 bp, Homo sapiens
cctcccctcctct

SEQ ID NO: 4998763 - DNA, 14 bp, Homo sapiens
cctcccctcctctg

SEQ ID NO: 4998764 - DNA, 17 bp, Homo sapiens
cctccctccacctccct

SEQ ID NO: 4998765 - DNA, 12 bp, Homo sapiens
cctccctgcaat

SEQ ID NO: 4998766 - DNA, 11 bp, Homo sapiens
cctcctctgct

SEQ ID NO: 4998767 - DNA, 21 bp, Homo sapiens
cctccttcctcagtcctggaa

SEQ ID NO: 4998768 - DNA, 20 bp, Homo sapiens
cctctactaggtctgctcct

SEQ ID NO: 4998769 - DNA, 21 bp, Homo sapiens
cctctactaggtctgctcctg

SEQ ID NO: 4998770 - DNA, 22 bp, Homo sapiens
cctctactaggtctgctcctga

SEQ ID NO: 4998771 - DNA, 12 bp, Homo sapiens
cctctcctgggc

SEQ ID NO: 4998772 - DNA, 16 bp, Homo sapiens
cctctcctgggcagct

SEQ ID NO: 4998773 - DNA, 21 bp, Homo sapiens
cctctcctgggcagctgcctc

SEQ ID NO: 4998774 - DNA, 15 bp, Homo sapiens
cctctccttgcctgg

SEQ ID NO: 4998775 - DNA, 23 bp, Homo sapiens
cctctgaggagcccacggggcaa

SEQ ID NO: 4998776 - DNA, 13 bp, Homo sapiens
cctctgcttgcca

SEQ ID NO: 4998777 - DNA, 18 bp, Homo sapiens
cctgaaccagtcctgctg

SEQ ID NO: 4998778 - DNA, 22 bp, Homo sapiens
cctgaaccagtcctgctgcctg

SEQ ID NO: 4998779 - DNA, 23 bp, Homo sapiens
cctgaaccagtcctgctgcctgg

SEQ ID NO: 4998780 - DNA, 23 bp, Homo sapiens
cctgaggcatgagaatcacttga

SEQ ID NO: 4998781 - DNA, 22 bp, Homo sapiens
cctgatcctaaccctgggctcc

SEQ ID NO: 4998782 - DNA, 21 bp, Homo sapiens
cctgcccaccccatccctggc

SEQ ID NO: 4998783 - DNA, 18 bp, Homo sapiens
cctgccccaactgcagga

SEQ ID NO: 4998784 - DNA, 23 bp, Homo sapiens
cctgccttggagtcgtctggcat

SEQ ID NO: 4998785 - DNA, 23 bp, Homo sapiens
cctgctcaccaattccacttcct

SEQ ID NO: 4998786 - DNA, 13 bp, Homo sapiens
cctgctgcctgga

SEQ ID NO: 4998787 - DNA, 16 bp, Homo sapiens
cctgctgcctggagtc

SEQ ID NO: 4998788 - DNA, 18 bp, Homo sapiens
cctgctgcctggagtcag

SEQ ID NO: 4998789 - DNA, 24 bp, Homo sapiens
cctgctgcctggagtcagtagcca

SEQ ID NO: 4998790 - DNA, 12 bp, Homo sapiens
cctgctgctgta

SEQ ID NO: 4998791 - DNA, 15 bp, Homo sapiens
cctgctgggcactgg

SEQ ID NO: 4998792 - DNA, 15 bp, Homo sapiens
cctggatgcacagtg

SEQ ID NO: 4998793 - DNA, 16 bp, Homo sapiens
cctggatgcacagtgc

SEQ ID NO: 4998794 - DNA, 16 bp, Homo sapiens
cctggctgacctgctg

SEQ ID NO: 4998795 - DNA, 14 bp, Homo sapiens
cctgggcagctgcc

SEQ ID NO: 4998796 - DNA, 20 bp, Homo sapiens
cctgggcagctgcctcccct

SEQ ID NO: 4998797 - DNA, 15 bp, Homo sapiens
cctgggctccctgga

SEQ ID NO: 4998798 - DNA, 21 bp, Homo sapiens
cctgggtcacgctcaaggaag

SEQ ID NO: 4998799 - DNA, 15 bp, Homo sapiens
cctgtaatcccagct

SEQ ID NO: 4998800 - DNA, 13 bp, Homo sapiens
ccttcaactctgt

SEQ ID NO: 4998801 - DNA, 16 bp, Homo sapiens
ccttgggtctgtgtca

SEQ ID NO: 4998802 - DNA, 21 bp, Homo sapiens
cgaccacttttcagttcagtg

SEQ ID NO: 4998803 - DNA, 14 bp, Homo sapiens
cgctcaaggaagga

SEQ ID NO: 4998804 - DNA, 13 bp, Homo sapiens
cggcaggcagaga

SEQ ID NO: 4998805 - DNA, 17 bp, Homo sapiens
cgggacatgcagctctg

SEQ ID NO: 4998806 - DNA, 20 bp, Homo sapiens
cggggcaaagctgctgggcc

SEQ ID NO: 4998807 - DNA, 21 bp, Homo sapiens
cggggcaaagctgctgggcca

SEQ ID NO: 4998808 - DNA, 22 bp, Homo sapiens
cggggcaaagctgctgggccag

SEQ ID NO: 4998809 - DNA, 16 bp, Homo sapiens
cgtgaaagcagatgag

SEQ ID NO: 4998810 - DNA, 19 bp, Homo sapiens
cgtgctcttctgttctcaa

SEQ ID NO: 4998811 - DNA, 18 bp, Homo sapiens
cgtggggaggggctgagg

SEQ ID NO: 4998812 - DNA, 14 bp, Homo sapiens
ctaaagacagaaaa

SEQ ID NO: 4998813 - DNA, 22 bp, Homo sapiens
ctaaagggtatgagctggagct

SEQ ID NO: 4998814 - DNA, 21 bp, Homo sapiens
ctaaatcaccagagaccaaac

SEQ ID NO: 4998815 - DNA, 17 bp, Homo sapiens
ctaaatgcaaacactgt

SEQ ID NO: 4998816 - DNA, 21 bp, Homo sapiens
ctaaatgcaaacactgtgtat

SEQ ID NO: 4998817 - DNA, 12 bp, Homo sapiens
ctaaccatgggc

SEQ ID NO: 4998818 - DNA, 20 bp, Homo sapiens
ctaaccatgggctcagggcc

SEQ ID NO: 4998819 - DNA, 21 bp, Homo sapiens
ctaaccatgggctcagggcca

SEQ ID NO: 4998820 - DNA, 17 bp, Homo sapiens
ctaagcaatcactgggc

SEQ ID NO: 4998821 - DNA, 21 bp, Homo sapiens
ctaagcaatcactgggcccag

SEQ ID NO: 4998822 - DNA, 14 bp, Homo sapiens
ctaaggccagctag

SEQ ID NO: 4998823 - DNA, 15 bp, Homo sapiens
ctaaggccagctaga

SEQ ID NO: 4998824 - DNA, 18 bp, Homo sapiens
ctaaggccagctagagct

SEQ ID NO: 4998825 - DNA, 22 bp, Homo sapiens
ctaaggccagctagagcttcca

SEQ ID NO: 4998826 - DNA, 16 bp, Homo sapiens
ctaagtagaataaaga

SEQ ID NO: 4998827 - DNA, 22 bp, Homo sapiens
ctaagtagaataaagaaaaacg

SEQ ID NO: 4998828 - DNA, 12 bp, Homo sapiens
ctaatacaccag

SEQ ID NO: 4998829 - DNA, 18 bp, Homo sapiens
ctaatccaatacctcttg

SEQ ID NO: 4998830 - DNA, 16 bp, Homo sapiens
ctacaaaataaagctg

SEQ ID NO: 4998831 - DNA, 19 bp, Homo sapiens
ctacacagaccctgcccac

SEQ ID NO: 4998832 - DNA, 18 bp, Homo sapiens
ctaccgttcccaaattgg

SEQ ID NO: 4998833 - DNA, 13 bp, Homo sapiens
ctaccttctttgg

SEQ ID NO: 4998834 - DNA, 12 bp, Homo sapiens
ctactaggtctg

SEQ ID NO: 4998835 - DNA, 23 bp, Homo sapiens
ctactctggaagtccccgggagc

SEQ ID NO: 4998836 - DNA, 17 bp, Homo sapiens
ctacttttgcatgaaaa

SEQ ID NO: 4998837 - DNA, 23 bp, Homo sapiens
ctagaagctcaggttccctgcca

SEQ ID NO: 4998838 - DNA, 13 bp, Homo sapiens
ctagaaggccagg

SEQ ID NO: 4998839 - DNA, 12 bp, Homo sapiens
ctagctctttga

SEQ ID NO: 4998840 - DNA, 14 bp, Homo sapiens
ctaggaagcaagat

SEQ ID NO: 4998841 - DNA, 14 bp, Homo sapiens
ctagggctcagagg

SEQ ID NO: 4998842 - DNA, 13 bp, Homo sapiens
ctaggtctgctcc

SEQ ID NO: 4998843 - DNA, 14 bp, Homo sapiens
ctatattaggcatg

SEQ ID NO: 4998844 - DNA, 19 bp, Homo sapiens
ctattctgccatgggagag

SEQ ID NO: 4998845 - DNA, 24 bp, Homo sapiens
ctcaaatgctaaatgcaaacactg

SEQ ID NO: 4998846 - DNA, 24 bp, Homo sapiens
ctcaacagcaggaggcacagcagt

SEQ ID NO: 4998847 - DNA, 18 bp, Homo sapiens
ctcaatattttccatgaa

SEQ ID NO: 4998848 - DNA, 19 bp, Homo sapiens
ctcaatattttccatgaaa

SEQ ID NO: 4998849 - DNA, 14 bp, Homo sapiens
ctcacacccacctg

SEQ ID NO: 4998850 - DNA, 15 bp, Homo sapiens
ctcacacccacctgc

SEQ ID NO: 4998851 - DNA, 18 bp, Homo sapiens
ctcacacccacctgctgc

SEQ ID NO: 4998852 - DNA, 20 bp, Homo sapiens
ctcacacccacctgctgctg

SEQ ID NO: 4998853 - DNA, 16 bp, Homo sapiens
gagtccaggcctgggt

SEQ ID NO: 4998854 - DNA, 18 bp, Homo sapiens
gagtggagcccagggtgc

SEQ ID NO: 4998855 - DNA, 14 bp, Homo sapiens
gagtgggacagaca

SEQ ID NO: 4998856 - DNA, 19 bp, Homo sapiens
gagtgggacagacagcagc

SEQ ID NO: 4998857 - DNA, 20 bp, Homo sapiens
gagtgggacagacagcagct

SEQ ID NO: 4998858 - DNA, 21 bp, Homo sapiens
gagtgggacagacagcagctg

SEQ ID NO: 4998859 - DNA, 14 bp, Homo sapiens
gagttgttctcagg

SEQ ID NO: 4998860 - DNA, 15 bp, Homo sapiens
gagttgttctcaggg

SEQ ID NO: 4998861 - DNA, 16 bp, Homo sapiens
gagttgttctcagggg

SEQ ID NO: 4998862 - DNA, 19 bp, Homo sapiens
gataatatatacaaacctt

SEQ ID NO: 4998863 - DNA, 20 bp, Homo sapiens
gataccccaaagtccaggct

SEQ ID NO: 4998864 - DNA, 19 bp, Homo sapiens
gatagaatttggcccagag

SEQ ID NO: 4998865 - DNA, 15 bp, Homo sapiens
gatcacacagctaat

SEQ ID NO: 4998866 - DNA, 13 bp, Homo sapiens
gatgcacagtgcc

SEQ ID NO: 4998867 - DNA, 17 bp, Homo sapiens
gatgccaaagcagacat

SEQ ID NO: 4998868 - DNA, 23 bp, Homo sapiens
gatgctttgtttctttcatatga

SEQ ID NO: 4998869 - DNA, 12 bp, Homo sapiens
gatggagaggca

SEQ ID NO: 4998870 - DNA, 14 bp, Homo sapiens
gatggagaggcatg

SEQ ID NO: 4998871 - DNA, 23 bp, Homo sapiens
gatggagaggcatgggggcccaa

SEQ ID NO: 4998872 - DNA, 19 bp, Homo sapiens
gatggctatattaggcatg

SEQ ID NO: 4998873 - DNA, 19 bp, Homo sapiens
gatgggagtaggctccaga

SEQ ID NO: 4998874 - DNA, 16 bp, Homo sapiens
gatgtcccacagggac

SEQ ID NO: 4998875 - DNA, 18 bp, Homo sapiens
gatgtcccacagggacca

SEQ ID NO: 4998876 - DNA, 19 bp, Homo sapiens
gatgtccctattctgccat

SEQ ID NO: 4998877 - DNA, 20 bp, Homo sapiens
gatgtccctattctgccatg

SEQ ID NO: 4998878 - DNA, 23 bp, Homo sapiens
gatgtccctattctgccatggga

SEQ ID NO: 4998879 - DNA, 19 bp, Homo sapiens
gatgtggcaggggcagtgg

SEQ ID NO: 4998880 - DNA, 21 bp, Homo sapiens
gattcaggcctctgaggagcc

SEQ ID NO: 4998881 - DNA, 22 bp, Homo sapiens
gattgcgtggaattgtgctgag

SEQ ID NO: 4998882 - DNA, 13 bp, Homo sapiens
gattgttcatcat

SEQ ID NO: 4998883 - DNA, 19 bp, Homo sapiens
gcaaacactgtgtatttat

SEQ ID NO: 4998884 - DNA, 20 bp, Homo sapiens
gcaacctgttcttcctacca

SEQ ID NO: 4998885 - DNA, 22 bp, Homo sapiens
gcaaggtgaacaccactttgtc

SEQ ID NO: 4998886 - DNA, 14 bp, Homo sapiens
gcaatcactgggcc

SEQ ID NO: 4998887 - DNA, 18 bp, Homo sapiens
gcaatcactgggcccaga

SEQ ID NO: 4998888 - DNA, 22 bp, Homo sapiens
gcacatcactgagaagatggca

SEQ ID NO: 4998889 - DNA, 23 bp, Homo sapiens
gcacatcactgagaagatggcac

SEQ ID NO: 4998890 - DNA, 13 bp, Homo sapiens
gcacatccctgga

SEQ ID NO: 4998891 - DNA, 13 bp, Homo sapiens
gcaccatctgcca

SEQ ID NO: 4998892 - DNA, 23 bp, Homo sapiens
gcacccatatctgtgtgccctag

SEQ ID NO: 4998893 - DNA, 18 bp, Homo sapiens
gcacccccctgtgcctgc

SEQ ID NO: 4998894 - DNA, 17 bp, Homo sapiens
gcaccctcatacacaga

SEQ ID NO: 4998895 - DNA, 13 bp, Homo sapiens
gcactctgtgtgg

SEQ ID NO: 4998896 - DNA, 22 bp, Homo sapiens
gcactctgtgtgggaaaatggc

SEQ ID NO: 4998897 - DNA, 13 bp, Homo sapiens
gcactgtccaggg

SEQ ID NO: 4998898 - DNA, 15 bp, Homo sapiens
gcactgtccagggcc

SEQ ID NO: 4998899 - DNA, 13 bp, Homo sapiens
gcagaaagatgga

SEQ ID NO: 4998900 - DNA, 19 bp, Homo sapiens
gcagaaagatggagaggca

SEQ ID NO: 4998901 - DNA, 18 bp, Homo sapiens
gcagaagactctccactg

SEQ ID NO: 4998902 - DNA, 22 bp, Homo sapiens
gcagacattttcctcacaccca

SEQ ID NO: 4998903 - DNA, 14 bp, Homo sapiens
gcagagtggagccc

SEQ ID NO: 4998904 - DNA, 16 bp, Homo sapiens
gcagagtggagcccag

SEQ ID NO: 4998905 - DNA, 17 bp, Homo sapiens
gcagagtggagcccagg

SEQ ID NO: 4998906 - DNA, 18 bp, Homo sapiens
gcagagtggagcccaggg

SEQ ID NO: 4998907 - DNA, 21 bp, Homo sapiens
gcagatagaatttggcccaga

SEQ ID NO: 4998908 - DNA, 20 bp, Homo sapiens
gcagcaggtggcagaatggg

SEQ ID NO: 4998909 - DNA, 14 bp, Homo sapiens
gcagcatggaggaa

SEQ ID NO: 4998910 - DNA, 11 bp, Homo sapiens
gcagctgcctc

SEQ ID NO: 4998911 - DNA, 12 bp, Homo sapiens
gcagctgcctcc

SEQ ID NO: 4998912 - DNA, 13 bp, Homo sapiens
gcagctgcctccc

SEQ ID NO: 4998913 - DNA, 22 bp, Homo sapiens
gcagctgcctcccctcctctgc

SEQ ID NO: 4998914 - DNA, 19 bp, Homo sapiens
gcaggacactgcagaacag

SEQ ID NO: 4998915 - DNA, 13 bp, Homo sapiens
gcaggaggcacag

SEQ ID NO: 4998916 - DNA, 13 bp, Homo sapiens
gcaggcagagaag

SEQ ID NO: 4998917 - DNA, 15 bp, Homo sapiens
gcaggggcagtggcc

SEQ ID NO: 4998918 - DNA, 17 bp, Homo sapiens
gcaggggcagtggcctg

SEQ ID NO: 4998919 - DNA, 14 bp, Homo sapiens
gcagtcacaggccc

SEQ ID NO: 4998920 - DNA, 17 bp, Homo sapiens
gcagtcacaggcccagg

SEQ ID NO: 4998921 - DNA, 22 bp, Homo sapiens
gcagtcacaggcccaggaaggc

SEQ ID NO: 4998922 - DNA, 15 bp, Homo sapiens
gcatgggggcccaaa

SEQ ID NO: 4998923 - DNA, 12 bp, Homo sapiens
gcatgttcaggg

SEQ ID NO: 4998924 - DNA, 14 bp, Homo sapiens
gccaaagcagacat

SEQ ID NO: 4998925 - DNA, 22 bp, Homo sapiens
gccaaagcagacattttcctca

SEQ ID NO: 4998926 - DNA, 19 bp, Homo sapiens
gccactgcactccagtctg

SEQ ID NO: 4998927 - DNA, 19 bp, Homo sapiens
gccagagttgttctcaggg

SEQ ID NO: 4998928 - DNA, 20 bp, Homo sapiens
gccagagttgttctcagggg

SEQ ID NO: 4998929 - DNA, 21 bp, Homo sapiens
gccagagttgttctcaggggt

SEQ ID NO: 4998930 - DNA, 22 bp, Homo sapiens
gccagagttgttctcaggggtg

SEQ ID NO: 4998931 - DNA, 17 bp, Homo sapiens
gccagatcctcttctca

SEQ ID NO: 4998932 - DNA, 21 bp, Homo sapiens
gccagatgcacatccctggaa

SEQ ID NO: 4998933 - DNA, 19 bp, Homo sapiens
gccagcagttcagagctgc

SEQ ID NO: 4998934 - DNA, 21 bp, Homo sapiens
gccagcagttcagagctgccc

SEQ ID NO: 4998935 - DNA, 17 bp, Homo sapiens
gccaggattcaggcctc

SEQ ID NO: 4998936 - DNA, 19 bp, Homo sapiens
gccaggattcaggcctctg

SEQ ID NO: 4998937 - DNA, 18 bp, Homo sapiens
gccaggtcctcacagcag

SEQ ID NO: 4998938 - DNA, 14 bp, Homo sapiens
gccagtatttttta

SEQ ID NO: 4998939 - DNA, 14 bp, Homo sapiens
gccatgactgctca

SEQ ID NO: 4998940 - DNA, 19 bp, Homo sapiens
gccatgactgctcaggcct

SEQ ID NO: 4998941 - DNA, 11 bp, Homo sapiens
gccatgggaga

SEQ ID NO: 4998942 - DNA, 16 bp, Homo sapiens
gcccaccccatccctg

SEQ ID NO: 4998943 - DNA, 17 bp, Homo sapiens
gcccaccccatccctgg

SEQ ID NO: 4998944 - DNA, 19 bp, Homo sapiens
gcccacggggcaaagctgc

SEQ ID NO: 4998945 - DNA, 20 bp, Homo sapiens
gcccagaggagaggagacag

SEQ ID NO: 4998946 - DNA, 23 bp, Homo sapiens
gcccagaggagaggagacagaca

SEQ ID NO: 4998947 - DNA, 20 bp, Homo sapiens
gcccagggtgctgggatggc

SEQ ID NO: 4998948 - DNA, 13 bp, Homo sapiens
gcccatgtagctg

SEQ ID NO: 4998949 - DNA, 15 bp, Homo sapiens
gcccatgtagctggc

SEQ ID NO: 4998950 - DNA, 16 bp, Homo sapiens
gcccatgtagctggca

SEQ ID NO: 4998951 - DNA, 15 bp, Homo sapiens
gccccaactgcagga

SEQ ID NO: 4998952 - DNA, 13 bp, Homo sapiens
gccccactgccct

SEQ ID NO: 4998953 - DNA, 18 bp, Homo sapiens
gccccactgccctccagg

SEQ ID NO: 4998954 - DNA, 21 bp, Homo sapiens
gccccactgccctccagggcc

SEQ ID NO: 4998955 - DNA, 23 bp, Homo sapiens
gccccactgccctccagggccag

SEQ ID NO: 4998956 - DNA, 15 bp, Homo sapiens
gccctagggctcaga

SEQ ID NO: 4998957 - DNA, 16 bp, Homo sapiens
gccctcagatcccagg

SEQ ID NO: 4998958 - DNA, 17 bp, Homo sapiens
gccctcagatcccaggg

SEQ ID NO: 4998959 - DNA, 19 bp, Homo sapiens
gccctcagatcccagggta

SEQ ID NO: 4998960 - DNA, 18 bp, Homo sapiens
gccctccccacctgctca

SEQ ID NO: 4998961 - DNA, 13 bp, Homo sapiens
gccctctcctggg

SEQ ID NO: 4998962 - DNA, 16 bp, Homo sapiens
gccctctcctgggcag

SEQ ID NO: 4998963 - DNA, 23 bp, Homo sapiens
gccctctcctgggcagctgcctc

SEQ ID NO: 4998964 - DNA, 23 bp, Homo sapiens
gcctcaacagcaggaggcacagc

SEQ ID NO: 4998965 - DNA, 15 bp, Homo sapiens
gcctcacctcccagg

SEQ ID NO: 4998966 - DNA, 19 bp, Homo sapiens
gcctcacctcccagggcta

SEQ ID NO: 4998967 - DNA, 13 bp, Homo sapiens
gcctcatcttccc

SEQ ID NO: 4998968 - DNA, 17 bp, Homo sapiens
gcctcatcttccccagc

SEQ ID NO: 4998969 - DNA, 18 bp, Homo sapiens
gcctcatcttccccagcc

SEQ ID NO: 4998970 - DNA, 20 bp, Homo sapiens
gcctcatcttccccagccct

SEQ ID NO: 4998971 - DNA, 21 bp, Homo sapiens
gcctcatcttccccagccctc

SEQ ID NO: 4998972 - DNA, 22 bp, Homo sapiens
gcctcatcttccccagccctcc

SEQ ID NO: 4998973 - DNA, 16 bp, Homo sapiens
gcctcccctcctctgc

SEQ ID NO: 4998974 - DNA, 23 bp, Homo sapiens
gcctcccctcctctgcttgccat

SEQ ID NO: 4998975 - DNA, 15 bp, Homo sapiens
gcctctactaggtct

SEQ ID NO: 4998976 - DNA, 14 bp, Homo sapiens
gcctctgaggagcc

SEQ ID NO: 4998977 - DNA, 16 bp, Homo sapiens
gcctctgaggagccca

SEQ ID NO: 4998978 - DNA, 22 bp, Homo sapiens
tccactgacctggttgtccagg

SEQ ID NO: 4998979 - DNA, 21 bp, Homo sapiens
tccaggaaagatgtcccacag

SEQ ID NO: 4998980 - DNA, 11 bp, Homo sapiens
tccagggccag

SEQ ID NO: 4998981 - DNA, 22 bp, Homo sapiens
tccagggccaggattcaggcct

SEQ ID NO: 4998982 - DNA, 18 bp, Homo sapiens
tccaggtctagaaggcca

SEQ ID NO: 4998983 - DNA, 19 bp, Homo sapiens
tccaggtctagaaggccag

SEQ ID NO: 4998984 - DNA, 12 bp, Homo sapiens
tccatgaaaatg

SEQ ID NO: 4998985 - DNA, 11 bp, Homo sapiens
tcccacaggga

SEQ ID NO: 4998986 - DNA, 12 bp, Homo sapiens
tcccacagggac

SEQ ID NO: 4998987 - DNA, 20 bp, Homo sapiens
tcccagggctacacagaccc

SEQ ID NO: 4998988 - DNA, 21 bp, Homo sapiens
tcccagggctacacagaccct

SEQ ID NO: 4998989 - DNA, 16 bp, Homo sapiens
tccccagccctcccca

SEQ ID NO: 4998990 - DNA, 18 bp, Homo sapiens
tcccctcctctgcttgcc

SEQ ID NO: 4998991 - DNA, 24 bp, Homo sapiens
tcccctcctctgcttgccatccct

SEQ ID NO: 4998992 - DNA, 16 bp, Homo sapiens
tccctattctgccatg

SEQ ID NO: 4998993 - DNA, 19 bp, Homo sapiens
tccctccacccacttgcct

SEQ ID NO: 4998994 - DNA, 15 bp, Homo sapiens
tccctccacctccct

SEQ ID NO: 4998995 - DNA, 21 bp, Homo sapiens
tccctccacctccctgcaata

SEQ ID NO: 4998996 - DNA, 13 bp, Homo sapiens
tccctccctccac

SEQ ID NO: 4998997 - DNA, 11 bp, Homo sapiens
tccctggctga

SEQ ID NO: 4998998 - DNA, 14 bp, Homo sapiens
tccgaaatcagcag

SEQ ID NO: 4998999 - DNA, 20 bp, Homo sapiens
tcctcacacccacctgctgc

SEQ ID NO: 4999000 - DNA, 18 bp, Homo sapiens
tcctcacagcagtcacag

SEQ ID NO: 4999001 - DNA, 20 bp, Homo sapiens
tcctcacagcagtcacaggc

SEQ ID NO: 4999002 - DNA, 15 bp, Homo sapiens
tcctcagtcctggaa

SEQ ID NO: 4999003 - DNA, 14 bp, Homo sapiens
tcctctgcttgcca

SEQ ID NO: 4999004 - DNA, 19 bp, Homo sapiens
tcctgaaccagtcctgctg

SEQ ID NO: 4999005 - DNA, 22 bp, Homo sapiens
tcctgaaccagtcctgctgcct

SEQ ID NO: 4999006 - DNA, 17 bp, Homo sapiens
tcctgatcctaaccctg

SEQ ID NO: 4999007 - DNA, 16 bp, Homo sapiens
tcctgctgcctggagt

SEQ ID NO: 4999008 - DNA, 11 bp, Homo sapiens
tcctggaccta

SEQ ID NO: 4999009 - DNA, 17 bp, Homo sapiens
tcctgggcagctgcctc

SEQ ID NO: 4999010 - DNA, 18 bp, Homo sapiens
tccttaggttgtagcaga

SEQ ID NO: 4999011 - DNA, 13 bp, Homo sapiens
tccttcacctttc

SEQ ID NO: 4999012 - DNA, 23 bp, Homo sapiens
tccttcacctttcccactttctt

SEQ ID NO: 4999013 - DNA, 12 bp, Homo sapiens
tccttgcctggt

SEQ ID NO: 4999014 - DNA, 20 bp, Homo sapiens
tccttttagcacatcactga

SEQ ID NO: 4999015 - DNA, 22 bp, Homo sapiens
tccttttagcacatcactgaga

SEQ ID NO: 4999016 - DNA, 19 bp, Homo sapiens
tccttttcttgtctctgag

SEQ ID NO: 4999017 - DNA, 20 bp, Homo sapiens
tctaaacccaaataaatgtg

SEQ ID NO: 4999018 - DNA, 20 bp, Homo sapiens
tctaaatcaccagagaccaa

SEQ ID NO: 4999019 - DNA, 14 bp, Homo sapiens
tctagaagctcagg

SEQ ID NO: 4999020 - DNA, 14 bp, Homo sapiens
tctagaaggccagg

SEQ ID NO: 4999021 - DNA, 17 bp, Homo sapiens
tctagaaggccaggcct

SEQ ID NO: 4999022 - DNA, 19 bp, Homo sapiens
tctagaaggccaggcctct

SEQ ID NO: 4999023 - DNA, 16 bp, Homo sapiens
tctcaaatgctaaatg

SEQ ID NO: 4999024 - DNA, 17 bp, Homo sapiens
tctcaaatgctaaatgc

SEQ ID NO: 4999025 - DNA, 13 bp, Homo sapiens
tctccactgacct

SEQ ID NO: 4999026 - DNA, 17 bp, Homo sapiens
tctcctgggcagctgcc

SEQ ID NO: 4999027 - DNA, 19 bp, Homo sapiens
tctcctgggcagctgcctc

SEQ ID NO: 4999028 - DNA, 21 bp, Homo sapiens
tctcctgggcagctgcctccc

SEQ ID NO: 4999029 - DNA, 14 bp, Homo sapiens
tctctactctggaa

SEQ ID NO: 4999030 - DNA, 13 bp, Homo sapiens
tctctagagaaca

SEQ ID NO: 4999031 - DNA, 14 bp, Homo sapiens
tctctgaggctctc

SEQ ID NO: 4999032 - DNA, 22 bp, Homo sapiens
tctctttcttattttgtaataa

SEQ ID NO: 4999033 - DNA, 13 bp, Homo sapiens
tctgaactctaag

SEQ ID NO: 4999034 - DNA, 22 bp, Homo sapiens
tctgaccaaaaccagagggcag

SEQ ID NO: 4999035 - DNA, 16 bp, Homo sapiens
tctgaggctctccaaa

SEQ ID NO: 4999036 - DNA, 19 bp, Homo sapiens
tctgccaatgccatgactg

SEQ ID NO: 4999037 - DNA, 21 bp, Homo sapiens
tctgccatgggagagtccagg

SEQ ID NO: 4999038 - DNA, 22 bp, Homo sapiens
tctgccatgggagagtccaggc

SEQ ID NO: 4999039 - DNA, 14 bp, Homo sapiens
tctgctcctgaacc

SEQ ID NO: 4999040 - DNA, 13 bp, Homo sapiens
tctgctggtcact

SEQ ID NO: 4999041 - DNA, 12 bp, Homo sapiens
tctgcttgccat

SEQ ID NO: 4999042 - DNA, 14 bp, Homo sapiens
tctgcttgccatcc

SEQ ID NO: 4999043 - DNA, 16 bp, Homo sapiens
tctggacaagaagagt

SEQ ID NO: 4999044 - DNA, 16 bp, Homo sapiens
tctggcatctcccaca

SEQ ID NO: 4999045 - DNA, 18 bp, Homo sapiens
tctgggaggtcttggccg

SEQ ID NO: 4999046 - DNA, 17 bp, Homo sapiens
tctgtgtgccctagggc

SEQ ID NO: 4999047 - DNA, 21 bp, Homo sapiens
tctgtgtgccctagggctcag

SEQ ID NO: 4999048 - DNA, 12 bp, Homo sapiens
tctgttctcaaa

SEQ ID NO: 4999049 - DNA, 21 bp, Homo sapiens
tctgttctcaaatgctaaatg

SEQ ID NO: 4999050 - DNA, 14 bp, Homo sapiens
tcttgtctctgagg

SEQ ID NO: 4999051 - DNA, 18 bp, Homo sapiens
tctttcttattttgtaat

SEQ ID NO: 4999052 - DNA, 19 bp, Homo sapiens
tcttttccaaacacaggca

SEQ ID NO: 4999053 - DNA, 18 bp, Homo sapiens
tgaaaatgcaacaacatg

SEQ ID NO: 4999054 - DNA, 21 bp, Homo sapiens
tgaaaatgcaacaacatgtat

SEQ ID NO: 4999055 - DNA, 14 bp, Homo sapiens
tgaaaattaacact

SEQ ID NO: 4999056 - DNA, 16 bp, Homo sapiens
tgaaaattaacactgc

SEQ ID NO: 4999057 - DNA, 18 bp, Homo sapiens
tgaaaattaacactgctt

SEQ ID NO: 4999058 - DNA, 17 bp, Homo sapiens
tgaaccagtcctgctgc

SEQ ID NO: 4999059 - DNA, 12 bp, Homo sapiens
tgaacctgccct

SEQ ID NO: 4999060 - DNA, 13 bp, Homo sapiens
tgaaggtgctgcc

SEQ ID NO: 4999061 - DNA, 14 bp, Homo sapiens
tgaaggtgctgcca

SEQ ID NO: 4999062 - DNA, 13 bp, Homo sapiens
tgaaggtttctga

SEQ ID NO: 4999063 - DNA, 19 bp, Homo sapiens
tgaaggtttgatgccaaag

SEQ ID NO: 4999064 - DNA, 15 bp, Homo sapiens
tgaatataaacacta

SEQ ID NO: 4999065 - DNA, 22 bp, Homo sapiens
tgaatggctgtgccccacctgt

SEQ ID NO: 4999066 - DNA, 13 bp, Homo sapiens
tgacaatgctgcc

SEQ ID NO: 4999067 - DNA, 14 bp, Homo sapiens
tgacaatgctgcca

SEQ ID NO: 4999068 - DNA, 19 bp, Homo sapiens
tgacaatgctgccatgccc

SEQ ID NO: 4999069 - DNA, 14 bp, Homo sapiens
tgacagaacactgt

SEQ ID NO: 4999070 - DNA, 15 bp, Homo sapiens
tgacagaacactgtc

SEQ ID NO: 4999071 - DNA, 16 bp, Homo sapiens
tgacagaacactgtct

SEQ ID NO: 4999072 - DNA, 17 bp, Homo sapiens
tgaccaaaaccagaggg

SEQ ID NO: 4999073 - DNA, 19 bp, Homo sapiens
tgaccaaaaccagagggca

SEQ ID NO: 4999074 - DNA, 11 bp, Homo sapiens
tgacctgctgt

SEQ ID NO: 4999075 - DNA, 19 bp, Homo sapiens
tgacctggttgtccaggtc

SEQ ID NO: 4999076 - DNA, 22 bp, Homo sapiens
tgactcgggccttagaactttg

SEQ ID NO: 4999077 - DNA, 14 bp, Homo sapiens
tgactgctcaggcc

SEQ ID NO: 4999078 - DNA, 14 bp, Homo sapiens
tgagagagtgctga

SEQ ID NO: 4999079 - DNA, 11 bp, Homo sapiens
tgagctggagc

SEQ ID NO: 4999080 - DNA, 22 bp, Homo sapiens
tgagctggagctaaggccagct

SEQ ID NO: 4999081 - DNA, 18 bp, Homo sapiens
tgaggaacctcaaactgg

SEQ ID NO: 4999082 - DNA, 22 bp, Homo sapiens
tgaggagcccacggggcaaagc

SEQ ID NO: 4999083 - DNA, 21 bp, Homo sapiens
tgaggataccccaaagtccag

SEQ ID NO: 4999084 - DNA, 23 bp, Homo sapiens
tgagttgacttgacagaacactg

SEQ ID NO: 4999085 - DNA, 20 bp, Homo sapiens
tgataatatatacaaacctt

SEQ ID NO: 4999086 - DNA, 18 bp, Homo sapiens
tgatccaggaaagatgtc

SEQ ID NO: 4999087 - DNA, 16 bp, Homo sapiens
tgatcctaaccctggg

SEQ ID NO: 4999088 - DNA, 17 bp, Homo sapiens
tgatcctaaccctgggc

SEQ ID NO: 4999089 - DNA, 15 bp, Homo sapiens
tgatccttcaactct

SEQ ID NO: 4999090 - DNA, 21 bp, Homo sapiens
tgatccttcaactctgtgagg

SEQ ID NO: 4999091 - DNA, 20 bp, Homo sapiens
tgcaaggaagccacagctgg

SEQ ID NO: 4999092 - DNA, 17 bp, Homo sapiens
tgcaataaaatgggttt

SEQ ID NO: 4999093 - DNA, 21 bp, Homo sapiens
tgcaataaaatgggttttact

SEQ ID NO: 4999094 - DNA, 17 bp, Homo sapiens
tgcacccccctgtgcct

SEQ ID NO: 4999095 - DNA, 20 bp, Homo sapiens
tgcacgtgctcttctgttct

SEQ ID NO: 4999096 - DNA, 21 bp, Homo sapiens
tgcagatagaatttggcccag

SEQ ID NO: 4999097 - DNA, 22 bp, Homo sapiens
tgcagatagaatttggcccaga

SEQ ID NO: 4999098 - DNA, 16 bp, Homo sapiens
tgcaggaatgctgaca

SEQ ID NO: 4999099 - DNA, 14 bp, Homo sapiens
tgcatagcagctgc

SEQ ID NO: 4999100 - DNA, 16 bp, Homo sapiens
tgcatagcagctgcta

SEQ ID NO: 4999101 - DNA, 17 bp, Homo sapiens
tgcatatatacatatat

SEQ ID NO: 4999102 - DNA, 13 bp, Homo sapiens
tgcatgaaggttt

SEQ ID NO: 4999103 - DNA, 13 bp, Homo sapiens
tgccaaagcagac

SEQ ID NO: 4999104 - DNA, 19 bp, Homo sapiens
acacagaccctgcccaccc

SEQ ID NO: 4999105 - DNA, 20 bp, Homo sapiens
acacagctaataaaagtcag

SEQ ID NO: 4999106 - DNA, 11 bp, Homo sapiens
acacccacctg

SEQ ID NO: 4999107 - DNA, 19 bp, Homo sapiens
acacccacctgctgctgta

SEQ ID NO: 4999108 - DNA, 18 bp, Homo sapiens
acagaaaaaaataaaaac

SEQ ID NO: 4999109 - DNA, 22 bp, Homo sapiens
acagacacacactggctcctgg

SEQ ID NO: 4999110 - DNA, 12 bp, Homo sapiens
acagacagcagc

SEQ ID NO: 4999111 - DNA, 13 bp, Homo sapiens
acagacagcagct

SEQ ID NO: 4999112 - DNA, 14 bp, Homo sapiens
acagacagcagctg

SEQ ID NO: 4999113 - DNA, 16 bp, Homo sapiens
acagacagcagctgga

SEQ ID NO: 4999114 - DNA, 20 bp, Homo sapiens
acagaccctgcccaccccat

SEQ ID NO: 4999115 - DNA, 21 bp, Homo sapiens
acagagctgggatgtttctgt

SEQ ID NO: 4999116 - DNA, 15 bp, Homo sapiens
acagcaggaggcaca

SEQ ID NO: 4999117 - DNA, 19 bp, Homo sapiens
acagcaggaggcacagcag

SEQ ID NO: 4999118 - DNA, 16 bp, Homo sapiens
acagcagtcacaggcc

SEQ ID NO: 4999119 - DNA, 17 bp, Homo sapiens
acagcagtcacaggccc

SEQ ID NO: 4999120 - DNA, 20 bp, Homo sapiens
acagcagtcacaggcccagg

SEQ ID NO: 4999121 - DNA, 21 bp, Homo sapiens
acagcagtcacaggcccagga

SEQ ID NO: 4999122 - DNA, 18 bp, Homo sapiens
acagcagtttcaccatct

SEQ ID NO: 4999123 - DNA, 18 bp, Homo sapiens
acagcccaaagaaggaaa

SEQ ID NO: 4999124 - DNA, 23 bp, Homo sapiens
acagctaataaaagtcagagctc

SEQ ID NO: 4999125 - DNA, 22 bp, Homo sapiens
acaggaggagtgggacagacag

SEQ ID NO: 4999126 - DNA, 12 bp, Homo sapiens
acaggtgtaaat

SEQ ID NO: 4999127 - DNA, 13 bp, Homo sapiens
acaggtgtaaata

SEQ ID NO: 4999128 - DNA, 16 bp, Homo sapiens
acaggtgtaaatatag

SEQ ID NO: 4999129 - DNA, 23 bp, Homo sapiens
acatcactgagaagatggcactg

SEQ ID NO: 4999130 - DNA, 14 bp, Homo sapiens
acatggagctcagg

SEQ ID NO: 4999131 - DNA, 23 bp, Homo sapiens
acattccgaggggctcagttctg

SEQ ID NO: 4999132 - DNA, 12 bp, Homo sapiens
accaaatataaa

SEQ ID NO: 4999133 - DNA, 18 bp, Homo sapiens
accaattccacttcctgc

SEQ ID NO: 4999134 - DNA, 20 bp, Homo sapiens
accaattccacttcctgccc

SEQ ID NO: 4999135 - DNA, 12 bp, Homo sapiens
accacacatctg

SEQ ID NO: 4999136 - DNA, 15 bp, Homo sapiens
accacatccacccca

SEQ ID NO: 4999137 - DNA, 21 bp, Homo sapiens
accagactacttgggagcacc

SEQ ID NO: 4999138 - DNA, 22 bp, Homo sapiens
accagccatcatgtgcctggaa

SEQ ID NO: 4999139 - DNA, 14 bp, Homo sapiens
accagctgccaaaa

SEQ ID NO: 4999140 - DNA, 20 bp, Homo sapiens
accagctgccaaaatcgtag

SEQ ID NO: 4999141 - DNA, 14 bp, Homo sapiens
accagtcctgctgc

SEQ ID NO: 4999142 - DNA, 15 bp, Homo sapiens
accagtcctgctgcc

SEQ ID NO: 4999143 - DNA, 19 bp, Homo sapiens
accatgggctcagggccag

SEQ ID NO: 4999144 - DNA, 20 bp, Homo sapiens
accatgggctcagggccagg

SEQ ID NO: 4999145 - DNA, 15 bp, Homo sapiens
acccaaataaatgtg

SEQ ID NO: 4999146 - DNA, 16 bp, Homo sapiens
acccaaataaatgtgt

SEQ ID NO: 4999147 - DNA, 19 bp, Homo sapiens
acccaagtagctgctacct

SEQ ID NO: 4999148 - DNA, 14 bp, Homo sapiens
acccacctgctgct

SEQ ID NO: 4999149 - DNA, 13 bp, Homo sapiens
acccacttgcctg

SEQ ID NO: 4999150 - DNA, 21 bp, Homo sapiens
acccatatctgtgtgccctag

SEQ ID NO: 4999151 - DNA, 16 bp, Homo sapiens
accccaaagtccaggc

SEQ ID NO: 4999152 - DNA, 18 bp, Homo sapiens
accccagccccactgccc

SEQ ID NO: 4999153 - DNA, 20 bp, Homo sapiens
accccagccccactgccctc

SEQ ID NO: 4999154 - DNA, 14 bp, Homo sapiens
accccatccctggc

SEQ ID NO: 4999155 - DNA, 15 bp, Homo sapiens
accccatccctggct

SEQ ID NO: 4999156 - DNA, 17 bp, Homo sapiens
acccccctgtgcctgct

SEQ ID NO: 4999157 - DNA, 13 bp, Homo sapiens
accctgcccaccc

SEQ ID NO: 4999158 - DNA, 21 bp, Homo sapiens
accctgcccaccccatccctg

SEQ ID NO: 4999159 - DNA, 22 bp, Homo sapiens
acctaaagggtatgagctggag

SEQ ID NO: 4999160 - DNA, 14 bp, Homo sapiens
acctcaaactgggt

SEQ ID NO: 4999161 - DNA, 14 bp, Homo sapiens
acctcccagggcta

SEQ ID NO: 4999162 - DNA, 21 bp, Homo sapiens
acctccttcctcagtcctgga

SEQ ID NO: 4999163 - DNA, 12 bp, Homo sapiens
acctgctgctgt

SEQ ID NO: 4999164 - DNA, 12 bp, Homo sapiens
acctgctgtgga

SEQ ID NO: 4999165 - DNA, 17 bp, Homo sapiens
acctgctgtggatgtcc

SEQ ID NO: 4999166 - DNA, 16 bp, Homo sapiens
acctggttgtccaggt

SEQ ID NO: 4999167 - DNA, 18 bp, Homo sapiens
acctggttgtccaggtct

SEQ ID NO: 4999168 - DNA, 18 bp, Homo sapiens
acctgttgtcctgaactg

SEQ ID NO: 4999169 - DNA, 15 bp, Homo sapiens
accttgggtctgtgt

SEQ ID NO: 4999170 - DNA, 22 bp, Homo sapiens
acctttcccactttcttctacc

SEQ ID NO: 4999171 - DNA, 23 bp, Homo sapiens
acgactcttttccaaacacaggc

SEQ ID NO: 4999172 - DNA, 17 bp, Homo sapiens
acggggcaaagctgctg

SEQ ID NO: 4999173 - DNA, 22 bp, Homo sapiens
acgttaagtccaaggagaagaa

SEQ ID NO: 4999174 - DNA, 23 bp, Homo sapiens
acgttaagtccaaggagaagaag

SEQ ID NO: 4999175 - DNA, 18 bp, Homo sapiens
actaatccaatacctctt

SEQ ID NO: 4999176 - DNA, 17 bp, Homo sapiens
actacaatttaaagcaa

SEQ ID NO: 4999177 - DNA, 15 bp, Homo sapiens
actatattgtacaca

SEQ ID NO: 4999178 - DNA, 18 bp, Homo sapiens
actcctcggtactcccat

SEQ ID NO: 4999179 - DNA, 15 bp, Homo sapiens
actctaagcagaaga

SEQ ID NO: 4999180 - DNA, 15 bp, Homo sapiens
actctccactgacct

SEQ ID NO: 4999181 - DNA, 21 bp, Homo sapiens
actctgcctaaccatgggctc

SEQ ID NO: 4999182 - DNA, 23 bp, Homo sapiens
actctgcctaaccatgggctcag

SEQ ID NO: 4999183 - DNA, 17 bp, Homo sapiens
actgacctggttgtcca

SEQ ID NO: 4999184 - DNA, 15 bp, Homo sapiens
actgcacccccctgt

SEQ ID NO: 4999185 - DNA, 18 bp, Homo sapiens
actgcacccccctgtgcc

SEQ ID NO: 4999186 - DNA, 19 bp, Homo sapiens
actgcacccccctgtgcct

SEQ ID NO: 4999187 - DNA, 21 bp, Homo sapiens
actgcacccccctgtgcctgc

SEQ ID NO: 4999188 - DNA, 23 bp, Homo sapiens
actgcacccccctgtgcctgctg

SEQ ID NO: 4999189 - DNA, 13 bp, Homo sapiens
actgcaggaatgc

SEQ ID NO: 4999190 - DNA, 22 bp, Homo sapiens
actgccaccttgggtctgtgtc

SEQ ID NO: 4999191 - DNA, 14 bp, Homo sapiens
actgccctccaggg

SEQ ID NO: 4999192 - DNA, 19 bp, Homo sapiens
actgccctccagggccagg

SEQ ID NO: 4999193 - DNA, 18 bp, Homo sapiens
actgctcaggcctcacct

SEQ ID NO: 4999194 - DNA, 15 bp, Homo sapiens
actggctcctggacc

SEQ ID NO: 4999195 - DNA, 14 bp, Homo sapiens
actgggcccagagg

SEQ ID NO: 4999196 - DNA, 20 bp, Homo sapiens
actggtttatccacccacaa

SEQ ID NO: 4999197 - DNA, 21 bp, Homo sapiens
actgtcagtcccactgcaccc

SEQ ID NO: 4999198 - DNA, 17 bp, Homo sapiens
acttatttatgaacctg

SEQ ID NO: 4999199 - DNA, 13 bp, Homo sapiens
acttcctgcccca

SEQ ID NO: 4999200 - DNA, 21 bp, Homo sapiens
acttcctgccccaactgcagg

SEQ ID NO: 4999201 - DNA, 23 bp, Homo sapiens
acttctctttcttattttgtaat

SEQ ID NO: 4999202 - DNA, 20 bp, Homo sapiens
acttgaaggtttgatgccaa

SEQ ID NO: 4999203 - DNA, 17 bp, Homo sapiens
acttgacagaacactgt

SEQ ID NO: 4999204 - DNA, 22 bp, Homo sapiens
acttgtaggtttctctgcctcc

SEQ ID NO: 4999205 - DNA, 10 bp, Homo sapiens
actttccttt

SEQ ID NO: 4999206 - DNA, 20 bp, Homo sapiens
actttccttttcttgtctct

SEQ ID NO: 4999207 - DNA, 17 bp, Homo sapiens
actttgcatagcagctg

SEQ ID NO: 4999208 - DNA, 15 bp, Homo sapiens
agaaagacagagctg

SEQ ID NO: 4999209 - DNA, 18 bp, Homo sapiens
agaacagacgttaccaat

SEQ ID NO: 4999210 - DNA, 13 bp, Homo sapiens
agaagaaggcagc

SEQ ID NO: 4999211 - DNA, 14 bp, Homo sapiens
agaagaaggcagca

SEQ ID NO: 4999212 - DNA, 14 bp, Homo sapiens
agaagactctccac

SEQ ID NO: 4999213 - DNA, 18 bp, Homo sapiens
agaagactctccactgac

SEQ ID NO: 4999214 - DNA, 20 bp, Homo sapiens
agaagactctccactgacct

SEQ ID NO: 4999215 - DNA, 16 bp, Homo sapiens
agaagatggcactgtc

SEQ ID NO: 4999216 - DNA, 12 bp, Homo sapiens
agaagctcaggt

SEQ ID NO: 4999217 - DNA, 15 bp, Homo sapiens
agaagctcaggttcc

SEQ ID NO: 4999218 - DNA, 20 bp, Homo sapiens
agaagctcaggttccctgcc

SEQ ID NO: 4999219 - DNA, 20 bp, Homo sapiens
agaaggacacctccttcctc

SEQ ID NO: 4999220 - DNA, 19 bp, Homo sapiens
agaaggcacaggtgtaaat

SEQ ID NO: 4999221 - DNA, 22 bp, Homo sapiens
agaaggcacaggtgtaaatata

SEQ ID NO: 4999222 - DNA, 15 bp, Homo sapiens
agaatggggtgcatg

SEQ ID NO: 4999223 - DNA, 22 bp, Homo sapiens
agaattgtgcgacttcacaaaa

SEQ ID NO: 4999224 - DNA, 15 bp, Homo sapiens
agaatttggcccaga

SEQ ID NO: 4999225 - DNA, 16 bp, Homo sapiens
agaatttggcccagag

SEQ ID NO: 4999226 - DNA, 19 bp, Homo sapiens
agaatttggcccagagagg

SEQ ID NO: 4999227 - DNA, 19 bp, Homo sapiens
agacaccgttcattcaggc

SEQ ID NO: 4999228 - DNA, 13 bp, Homo sapiens
agacagcagctgg

SEQ ID NO: 4999229 - DNA, 20 bp, Homo sapiens
agacaggaggagtgggacag

SEQ ID NO: 4999230 - DNA, 14 bp, Homo sapiens
agggctcagagggg

SEQ ID NO: 4999231 - DNA, 16 bp, Homo sapiens
aggggacagcgccacc

SEQ ID NO: 4999232 - DNA, 14 bp, Homo sapiens
aggggcagtggcct

SEQ ID NO: 4999233 - DNA, 17 bp, Homo sapiens
aggggcctcatcttccc

SEQ ID NO: 4999234 - DNA, 21 bp, Homo sapiens
aggggcctcatcttccccagc

SEQ ID NO: 4999235 - DNA, 15 bp, Homo sapiens
aggggctcagttctg

SEQ ID NO: 4999236 - DNA, 23 bp, Homo sapiens
aggggtgctggggcagagtggag

SEQ ID NO: 4999237 - DNA, 16 bp, Homo sapiens
agggtacactcttctc

SEQ ID NO: 4999238 - DNA, 19 bp, Homo sapiens
agggtggggtgccccagct

SEQ ID NO: 4999239 - DNA, 17 bp, Homo sapiens
aggtctgaccaaaacca

SEQ ID NO: 4999240 - DNA, 20 bp, Homo sapiens
aggtctgaccaaaaccagag

SEQ ID NO: 4999241 - DNA, 21 bp, Homo sapiens
aggtctgaccaaaaccagagg

SEQ ID NO: 4999242 - DNA, 14 bp, Homo sapiens
aggtgtaaatatag

SEQ ID NO: 4999243 - DNA, 15 bp, Homo sapiens
aggttccctgccaca

SEQ ID NO: 4999244 - DNA, 19 bp, Homo sapiens
aggttgcctcaacagcagg

SEQ ID NO: 4999245 - DNA, 22 bp, Homo sapiens
aggttgcctcaacagcaggagg

SEQ ID NO: 4999246 - DNA, 20 bp, Homo sapiens
aggttgcttcagctgatcct

SEQ ID NO: 4999247 - DNA, 23 bp, Homo sapiens
aggttgcttcagctgatccttca

SEQ ID NO: 4999248 - DNA, 14 bp, Homo sapiens
aggtttctctgcct

SEQ ID NO: 4999249 - DNA, 20 bp, Homo sapiens
aggtttctctgcctccaggt

SEQ ID NO: 4999250 - DNA, 15 bp, Homo sapiens
aggtttctgaaaatt

SEQ ID NO: 4999251 - DNA, 23 bp, Homo sapiens
aggtttctgaaaattaacactgc

SEQ ID NO: 4999252 - DNA, 23 bp, Homo sapiens
aggtttgatgccaaagcagacat

SEQ ID NO: 4999253 - DNA, 18 bp, Homo sapiens
agtacatggagctcaggt

SEQ ID NO: 4999254 - DNA, 18 bp, Homo sapiens
agtagaataaagaaaaac

SEQ ID NO: 4999255 - DNA, 12 bp, Homo sapiens
agtaggctccag

SEQ ID NO: 4999256 - DNA, 13 bp, Homo sapiens
agtaggctccaga

SEQ ID NO: 4999257 - DNA, 13 bp, Homo sapiens
agtcacaggccca

SEQ ID NO: 4999258 - DNA, 14 bp, Homo sapiens
agtcatgtgcctct

SEQ ID NO: 4999259 - DNA, 23 bp, Homo sapiens
agtccatatttcaatttccaaga

SEQ ID NO: 4999260 - DNA, 22 bp, Homo sapiens
agtcccactgcacccccctgtg

SEQ ID NO: 4999261 - DNA, 12 bp, Homo sapiens
agtcctgctgcc

SEQ ID NO: 4999262 - DNA, 15 bp, Homo sapiens
agtcctgctgcctgg

SEQ ID NO: 4999263 - DNA, 16 bp, Homo sapiens
agtcctgctgcctgga

SEQ ID NO: 4999264 - DNA, 18 bp, Homo sapiens
agtcctgctgcctggagt

SEQ ID NO: 4999265 - DNA, 23 bp, Homo sapiens
agtccttttagcacatcactgag

SEQ ID NO: 4999266 - DNA, 15 bp, Homo sapiens
agtggcactctgtgt

SEQ ID NO: 4999267 - DNA, 16 bp, Homo sapiens
agtggcactctgtgtg

SEQ ID NO: 4999268 - DNA, 13 bp, Homo sapiens
agtggcctggatg

SEQ ID NO: 4999269 - DNA, 22 bp, Homo sapiens
agtggcctggatgcacagtgcc

SEQ ID NO: 4999270 - DNA, 15 bp, Homo sapiens
agtgggacagacagc

SEQ ID NO: 4999271 - DNA, 20 bp, Homo sapiens
agtgggacagacagcagctg

SEQ ID NO: 4999272 - DNA, 17 bp, Homo sapiens
agttagggaatggcaca

SEQ ID NO: 4999273 - DNA, 17 bp, Homo sapiens
agttaggtgtgccaaac

SEQ ID NO: 4999274 - DNA, 14 bp, Homo sapiens
agttcagagctgcc

SEQ ID NO: 4999275 - DNA, 17 bp, Homo sapiens
agttcagagctgccctc

SEQ ID NO: 4999276 - DNA, 15 bp, Homo sapiens
agttgttctcagggg

SEQ ID NO: 4999277 - DNA, 21 bp, Homo sapiens
agttgttctcaggggtgctgg

SEQ ID NO: 4999278 - DNA, 16 bp, Homo sapiens
ataaaaacataaaata

SEQ ID NO: 4999279 - DNA, 13 bp, Homo sapiens
ataaacttgtgta

SEQ ID NO: 4999280 - DNA, 14 bp, Homo sapiens
ataaagctgttctc

SEQ ID NO: 4999281 - DNA, 13 bp, Homo sapiens
ataaatgtgtaaa

SEQ ID NO: 4999282 - DNA, 15 bp, Homo sapiens
ataaatgtgtaaatg

SEQ ID NO: 4999283 - DNA, 16 bp, Homo sapiens
ataaatgtgtaaatgt

SEQ ID NO: 4999284 - DNA, 13 bp, Homo sapiens
ataatacattccg

SEQ ID NO: 4999285 - DNA, 16 bp, Homo sapiens
atacaaacatgtggca

SEQ ID NO: 4999286 - DNA, 19 bp, Homo sapiens
ataccccaaagtccaggct

SEQ ID NO: 4999287 - DNA, 17 bp, Homo sapiens
atagaatttggcccaga

SEQ ID NO: 4999288 - DNA, 12 bp, Homo sapiens
atataaacttgt

SEQ ID NO: 4999289 - DNA, 23 bp, Homo sapiens
atataaacttgtgtatgatccaa

SEQ ID NO: 4999290 - DNA, 21 bp, Homo sapiens
atatacaaacctttagctgtg

SEQ ID NO: 4999291 - DNA, 13 bp, Homo sapiens
atatattttaatt

SEQ ID NO: 4999292 - DNA, 18 bp, Homo sapiens
atatccatgatcacacag

SEQ ID NO: 4999293 - DNA, 22 bp, Homo sapiens
atatctgtgtgccctagggctc

SEQ ID NO: 4999294 - DNA, 19 bp, Homo sapiens
atattctattttgcagata

SEQ ID NO: 4999295 - DNA, 14 bp, Homo sapiens
atatttacgtatga

SEQ ID NO: 4999296 - DNA, 21 bp, Homo sapiens
atcactgagaagatggcactg

SEQ ID NO: 4999297 - DNA, 14 bp, Homo sapiens
atcactgggcccag

SEQ ID NO: 4999298 - DNA, 16 bp, Homo sapiens
atcactgggcccagag

SEQ ID NO: 4999299 - DNA, 17 bp, Homo sapiens
atcactgggcccagagg

SEQ ID NO: 4999300 - DNA, 13 bp, Homo sapiens
atccaccccagcc

SEQ ID NO: 4999301 - DNA, 14 bp, Homo sapiens
atccaccccagccc

SEQ ID NO: 4999302 - DNA, 21 bp, Homo sapiens
atccaccccagccccactgcc

SEQ ID NO: 4999303 - DNA, 22 bp, Homo sapiens
atccaccccagccccactgccc

SEQ ID NO: 4999304 - DNA, 16 bp, Homo sapiens
atccatgatcacacag

SEQ ID NO: 4999305 - DNA, 19 bp, Homo sapiens
atcccagctacatgggagc

SEQ ID NO: 4999306 - DNA, 13 bp, Homo sapiens
atccctccctcca

SEQ ID NO: 4999307 - DNA, 14 bp, Homo sapiens
atccctccctccac

SEQ ID NO: 4999308 - DNA, 12 bp, Homo sapiens
atccctggctga

SEQ ID NO: 4999309 - DNA, 18 bp, Homo sapiens
atcctaaccctgggctcc

SEQ ID NO: 4999310 - DNA, 18 bp, Homo sapiens
atcctcagaaagtgcagc

SEQ ID NO: 4999311 - DNA, 18 bp, Homo sapiens
atctgccaatgccatgac

SEQ ID NO: 4999312 - DNA, 16 bp, Homo sapiens
atctgtgtgccctagg

SEQ ID NO: 4999313 - DNA, 22 bp, Homo sapiens
atctgtgtgccctagggctcag

SEQ ID NO: 4999314 - DNA, 16 bp, Homo sapiens
atctgtgttgtctctc

SEQ ID NO: 4999315 - DNA, 21 bp, Homo sapiens
atcttccccagccctccccac

SEQ ID NO: 4999316 - DNA, 12 bp, Homo sapiens
atgactctgcct

SEQ ID NO: 4999317 - DNA, 12 bp, Homo sapiens
atgagctggagc

SEQ ID NO: 4999318 - DNA, 17 bp, Homo sapiens
atgatccaagtatttta

SEQ ID NO: 4999319 - DNA, 19 bp, Homo sapiens
atgatgtgggtcaaggaat

SEQ ID NO: 4999320 - DNA, 22 bp, Homo sapiens
atgcacagtgcctgatgggagt

SEQ ID NO: 4999321 - DNA, 17 bp, Homo sapiens
atgccatggacagaaga

SEQ ID NO: 4999322 - DNA, 23 bp, Homo sapiens
atgcccaggatttgactcgggcc

SEQ ID NO: 4999323 - DNA, 13 bp, Homo sapiens
atgctaaatgcaa

SEQ ID NO: 4999324 - DNA, 19 bp, Homo sapiens
atgctaaatgcaaacactg

SEQ ID NO: 4999325 - DNA, 20 bp, Homo sapiens
atgctaaatgcaaacactgt

SEQ ID NO: 4999326 - DNA, 19 bp, Homo sapiens
atggacagaagaaggcagc

SEQ ID NO: 4999327 - DNA, 20 bp, Homo sapiens
atggacagaagaaggcagca

SEQ ID NO: 4999328 - DNA, 16 bp, Homo sapiens
atggcactgtccaggg

SEQ ID NO: 4999329 - DNA, 17 bp, Homo sapiens
atggcactgtccagggc

SEQ ID NO: 4999330 - DNA, 19 bp, Homo sapiens
atggcactgtccagggccc

SEQ ID NO: 4999331 - DNA, 20 bp, Homo sapiens
atggcactgtccagggccca

SEQ ID NO: 4999332 - DNA, 16 bp, Homo sapiens
atggcagaaagatgga

SEQ ID NO: 4999333 - DNA, 16 bp, Homo sapiens
atggctgtgccccacc

SEQ ID NO: 4999334 - DNA, 15 bp, Homo sapiens
atgggagcctgaggc

SEQ ID NO: 4999335 - DNA, 12 bp, Homo sapiens
atgggctcaggg

SEQ ID NO: 4999336 - DNA, 16 bp, Homo sapiens
atgggctcagggccag

SEQ ID NO: 4999337 - DNA, 17 bp, Homo sapiens
atgggctcagggccagg

SEQ ID NO: 4999338 - DNA, 16 bp, Homo sapiens
atgggggcccaaaggg

SEQ ID NO: 4999339 - DNA, 20 bp, Homo sapiens
atgtaaattttgtatgaaaa

SEQ ID NO: 4999340 - DNA, 15 bp, Homo sapiens
atgtagctggcaagc

SEQ ID NO: 4999341 - DNA, 17 bp, Homo sapiens
atgtagctggcaagctg

SEQ ID NO: 4999342 - DNA, 16 bp, Homo sapiens
atgtcaagtaccaaaa

SEQ ID NO: 4999343 - DNA, 14 bp, Homo sapiens
atgtcccacaggga

SEQ ID NO: 4999344 - DNA, 17 bp, Homo sapiens
atgtcccacagggacca

SEQ ID NO: 4999345 - DNA, 22 bp, Homo sapiens
atgtcccacagggaccacatcc

SEQ ID NO: 4999346 - DNA, 19 bp, Homo sapiens
atgtccctattctgccatg

SEQ ID NO: 4999347 - DNA, 19 bp, Homo sapiens
atgtcgtagttactctcag

SEQ ID NO: 4999348 - DNA, 11 bp, Homo sapiens
atgtgcctgga

SEQ ID NO: 4999349 - DNA, 15 bp, Homo sapiens
atgtggcaggggcag

SEQ ID NO: 4999350 - DNA, 17 bp, Homo sapiens
atgtggcaggggcagtg

SEQ ID NO: 4999351 - DNA, 16 bp, Homo sapiens
atgtgggtcaaggaat

SEQ ID NO: 4999352 - DNA, 13 bp, Homo sapiens
atgttcagggatg

SEQ ID NO: 4999353 - DNA, 11 bp, Homo sapiens
attaacactgc

SEQ ID NO: 4999354 - DNA, 20 bp, Homo sapiens
attaatatggggatgcagca

SEQ ID NO: 4999355 - DNA, 18 bp, Homo sapiens
attagaggatgtggcagg

SEQ ID NO: 4999356 - DNA, 20 bp, Homo sapiens
attagttaggtgtgccaaac

SEQ ID NO: 4999357 - DNA, 16 bp, Homo sapiens
acacactggctcctgg

SEQ ID NO: 4999358 - DNA, 17 bp, Homo sapiens
acacactggctcctgga

SEQ ID NO: 4999359 - DNA, 14 bp, Homo sapiens
acacagaaaccaat

SEQ ID NO: 4999360 - DNA, 22 bp, Homo sapiens
acacagtgctgaccagacagcc

SEQ ID NO: 4999361 - DNA, 17 bp, Homo sapiens
acacatctgtggagatg

SEQ ID NO: 4999362 - DNA, 12 bp, Homo sapiens
acacccacctgc

SEQ ID NO: 4999363 - DNA, 14 bp, Homo sapiens
acacccacctgctg

SEQ ID NO: 4999364 - DNA, 18 bp, Homo sapiens
acaccgttcattcaggca

SEQ ID NO: 4999365 - DNA, 15 bp, Homo sapiens
acaccttatatttac

SEQ ID NO: 4999366 - DNA, 22 bp, Homo sapiens
acactatttgagttggccaaga

SEQ ID NO: 4999367 - DNA, 16 bp, Homo sapiens
acagaagaaggcagca

SEQ ID NO: 4999368 - DNA, 20 bp, Homo sapiens
acagaagaaggcagcaggtg

SEQ ID NO: 4999369 - DNA, 19 bp, Homo sapiens
acagacacacactggctcc

SEQ ID NO: 4999370 - DNA, 15 bp, Homo sapiens
acagacagcagctgg

SEQ ID NO: 4999371 - DNA, 14 bp, Homo sapiens
acagaccctgccca

SEQ ID NO: 4999372 - DNA, 10 bp, Homo sapiens
acagagctgg

SEQ ID NO: 4999373 - DNA, 14 bp, Homo sapiens
acagagctgggatg

SEQ ID NO: 4999374 - DNA, 17 bp, Homo sapiens
acagcaattcctcaggc

SEQ ID NO: 4999375 - DNA, 11 bp, Homo sapiens
acagcagctgg

SEQ ID NO: 4999376 - DNA, 12 bp, Homo sapiens
acagcaggaggc

SEQ ID NO: 4999377 - DNA, 17 bp, Homo sapiens
acagcaggaggcacagc

SEQ ID NO: 4999378 - DNA, 20 bp, Homo sapiens
acagcaggaggcacagcagt

SEQ ID NO: 4999379 - DNA, 13 bp, Homo sapiens
acagcagtcacag

SEQ ID NO: 4999380 - DNA, 18 bp, Homo sapiens
acagcagtcacaggccca

SEQ ID NO: 4999381 - DNA, 19 bp, Homo sapiens
acagcagtcacaggcccag

SEQ ID NO: 4999382 - DNA, 19 bp, Homo sapiens
acagcccaaagaaggaaaa

SEQ ID NO: 4999383 - DNA, 17 bp, Homo sapiens
acaggaggagtgggaca

SEQ ID NO: 4999384 - DNA, 18 bp, Homo sapiens
acaggaggagtgggacag

SEQ ID NO: 4999385 - DNA, 16 bp, Homo sapiens
acaggcccaggaaggc

SEQ ID NO: 4999386 - DNA, 21 bp, Homo sapiens
acaggcccaggaaggcggcag

SEQ ID NO: 4999387 - DNA, 22 bp, Homo sapiens
acagtgcctgatgggagtaggc

SEQ ID NO: 4999388 - DNA, 12 bp, Homo sapiens
acatccacccca

SEQ ID NO: 4999389 - DNA, 14 bp, Homo sapiens
acatccaccccagc

SEQ ID NO: 4999390 - DNA, 14 bp, Homo sapiens
acatgtataatatt

SEQ ID NO: 4999391 - DNA, 19 bp, Homo sapiens
acatgtataatatttttaa

SEQ ID NO: 4999392 - DNA, 20 bp, Homo sapiens
acatgtataatatttttaat

SEQ ID NO: 4999393 - DNA, 21 bp, Homo sapiens
accaaatataaacttgtgtat

SEQ ID NO: 4999394 - DNA, 23 bp, Homo sapiens
accaagttggaacatccttggaa

SEQ ID NO: 4999395 - DNA, 23 bp, Homo sapiens
accagactacttgggagcaccgc

SEQ ID NO: 4999396 - DNA, 13 bp, Homo sapiens
accagagggcagt

SEQ ID NO: 4999397 - DNA, 15 bp, Homo sapiens
accagccatcatgtg

SEQ ID NO: 4999398 - DNA, 16 bp, Homo sapiens
accagtcctgctgcct

SEQ ID NO: 4999399 - DNA, 17 bp, Homo sapiens
accagtcctgctgcctg

SEQ ID NO: 4999400 - DNA, 21 bp, Homo sapiens
accagtcctgctgcctggagt

SEQ ID NO: 4999401 - DNA, 22 bp, Homo sapiens
accagtcctgctgcctggagtc

SEQ ID NO: 4999402 - DNA, 23 bp, Homo sapiens
accatctgccaatgccatgactg

SEQ ID NO: 4999403 - DNA, 19 bp, Homo sapiens
accatgtcgtagttactct

SEQ ID NO: 4999404 - DNA, 13 bp, Homo sapiens
acccaaataaatg

SEQ ID NO: 4999405 - DNA, 13 bp, Homo sapiens
acccacctgctgc

SEQ ID NO: 4999406 - DNA, 12 bp, Homo sapiens
acccacttgcct

SEQ ID NO: 4999407 - DNA, 15 bp, Homo sapiens
acccatatctgtgtg

SEQ ID NO: 4999408 - DNA, 20 bp, Homo sapiens
accccaaagtccaggctaat

SEQ ID NO: 4999409 - DNA, 17 bp, Homo sapiens
accccagccccactgcc

SEQ ID NO: 4999410 - DNA, 13 bp, Homo sapiens
accccatccctgg

SEQ ID NO: 4999411 - DNA, 22 bp, Homo sapiens
accccatccctggctgacctgc

SEQ ID NO: 4999412 - DNA, 15 bp, Homo sapiens
acccccctgtgcctg

SEQ ID NO: 4999413 - DNA, 18 bp, Homo sapiens
accctcatacacagaaac

SEQ ID NO: 4999414 - DNA, 16 bp, Homo sapiens
accctgcccaccccat

SEQ ID NO: 4999415 - DNA, 23 bp, Homo sapiens
accctgcccaccccatccctggc

SEQ ID NO: 4999416 - DNA, 22 bp, Homo sapiens
acctaagcaatcactgggccca

SEQ ID NO: 4999417 - DNA, 23 bp, Homo sapiens
acctaagcaatcactgggcccag

SEQ ID NO: 4999418 - DNA, 12 bp, Homo sapiens
acctcaaactgg

SEQ ID NO: 4999419 - DNA, 11 bp, Homo sapiens
acctcccaggg

SEQ ID NO: 4999420 - DNA, 13 bp, Homo sapiens
acctcccagggct

SEQ ID NO: 4999421 - DNA, 19 bp, Homo sapiens
acctcccagggctacacag

SEQ ID NO: 4999422 - DNA, 23 bp, Homo sapiens
acctccttcctcagtcctggaag

SEQ ID NO: 4999423 - DNA, 13 bp, Homo sapiens
acctgctgctgta

SEQ ID NO: 4999424 - DNA, 20 bp, Homo sapiens
acctgctgtggatgtcccta

SEQ ID NO: 4999425 - DNA, 15 bp, Homo sapiens
acctggttgtccagg

SEQ ID NO: 4999426 - DNA, 22 bp, Homo sapiens
acctgttgtcctgaactgtgag

SEQ ID NO: 4999427 - DNA, 20 bp, Homo sapiens
accttctttggccccttgct

SEQ ID NO: 4999428 - DNA, 17 bp, Homo sapiens
acctttcccactttctt

SEQ ID NO: 4999429 - DNA, 21 bp, Homo sapiens
acgactcttttccaaacacag

SEQ ID NO: 4999430 - DNA, 11 bp, Homo sapiens
acgctcaagga

SEQ ID NO: 4999431 - DNA, 20 bp, Homo sapiens
acgtatgtttttgtgtattt

SEQ ID NO: 4999432 - DNA, 22 bp, Homo sapiens
actacaatttaaagcaaaggag

SEQ ID NO: 4999433 - DNA, 17 bp, Homo sapiens
actacttgggagcaccg

SEQ ID NO: 4999434 - DNA, 16 bp, Homo sapiens
actagctctttgagat

SEQ ID NO: 4999435 - DNA, 21 bp, Homo sapiens
actcaatattttccatgaaaa

SEQ ID NO: 4999436 - DNA, 16 bp, Homo sapiens
actcacatggctatgt

SEQ ID NO: 4999437 - DNA, 20 bp, Homo sapiens
actcacatggctatgtttta

SEQ ID NO: 4999438 - DNA, 16 bp, Homo sapiens
actcccacacccaaga

SEQ ID NO: 4999439 - DNA, 20 bp, Homo sapiens
actctagaagctcaggttcc

SEQ ID NO: 4999440 - DNA, 19 bp, Homo sapiens
actctgcctaaccatgggc

SEQ ID NO: 4999441 - DNA, 21 bp, Homo sapiens
actcttctccattccctccac

SEQ ID NO: 4999442 - DNA, 21 bp, Homo sapiens
actcttttccaaacacaggca

SEQ ID NO: 4999443 - DNA, 21 bp, Homo sapiens
actgacctggttgtccaggtc

SEQ ID NO: 4999444 - DNA, 15 bp, Homo sapiens
actgagaagatggca

SEQ ID NO: 4999445 - DNA, 21 bp, Homo sapiens
actgagaagatggcactgtcc

SEQ ID NO: 4999446 - DNA, 22 bp, Homo sapiens
actgagaagatggcactgtcca

SEQ ID NO: 4999447 - DNA, 17 bp, Homo sapiens
actgcacccccctgtgc

SEQ ID NO: 4999448 - DNA, 22 bp, Homo sapiens
actgcacccccctgtgcctgct

SEQ ID NO: 4999449 - DNA, 12 bp, Homo sapiens
actgcagaacag

SEQ ID NO: 4999450 - DNA, 15 bp, Homo sapiens
actgccctccagggc

SEQ ID NO: 4999451 - DNA, 12 bp, Homo sapiens
actgctcaggcc

SEQ ID NO: 4999452 - DNA, 13 bp, Homo sapiens
actgctcaggcct

SEQ ID NO: 4999453 - DNA, 15 bp, Homo sapiens
actgctcaggcctca

SEQ ID NO: 4999454 - DNA, 13 bp, Homo sapiens
actggagtagttg

SEQ ID NO: 4999455 - DNA, 16 bp, Homo sapiens
actggagtagttgcta

SEQ ID NO: 4999456 - DNA, 13 bp, Homo sapiens
actgggcccagag

SEQ ID NO: 4999457 - DNA, 21 bp, Homo sapiens
actgggcccagaggagaggag

SEQ ID NO: 4999458 - DNA, 15 bp, Homo sapiens
actgtcagtcccact

SEQ ID NO: 4999459 - DNA, 19 bp, Homo sapiens
actgtcagtcccactgcac

SEQ ID NO: 4999460 - DNA, 14 bp, Homo sapiens
actgtccagggccc

SEQ ID NO: 4999461 - DNA, 15 bp, Homo sapiens
actgtggaactgcca

SEQ ID NO: 4999462 - DNA, 18 bp, Homo sapiens
actgtggaactgccacct

SEQ ID NO: 4999463 - DNA, 17 bp, Homo sapiens
acttctctactctggaa

SEQ ID NO: 4999464 - DNA, 11 bp, Homo sapiens
acttctctaga

SEQ ID NO: 4999465 - DNA, 20 bp, Homo sapiens
acttgacagaacactgtctt

SEQ ID NO: 4999466 - DNA, 21 bp, Homo sapiens
acttgtaggtttctctgcctc

SEQ ID NO: 4999467 - DNA, 23 bp, Homo sapiens
acttgtgtatgatccaagtattt

SEQ ID NO: 4999468 - DNA, 23 bp, Homo sapiens
actttccttttcttgtctctgag

SEQ ID NO: 4999469 - DNA, 16 bp, Homo sapiens
actttcttctaccaga

SEQ ID NO: 4999470 - DNA, 23 bp, Homo sapiens
actttcttctaccagacccttct

SEQ ID NO: 4999471 - DNA, 23 bp, Homo sapiens
acttttttgctatccagctattt

SEQ ID NO: 4999472 - DNA, 22 bp, Homo sapiens
agaaacttcctttgagaattgt

SEQ ID NO: 4999473 - DNA, 18 bp, Homo sapiens
agaaagacagagctggga

SEQ ID NO: 4999474 - DNA, 20 bp, Homo sapiens
agaacacagcaattcctcag

SEQ ID NO: 4999475 - DNA, 21 bp, Homo sapiens
agaagatggcactgtccaggg

SEQ ID NO: 4999476 - DNA, 18 bp, Homo sapiens
agaagctcaggttccctg

SEQ ID NO: 4999477 - DNA, 13 bp, Homo sapiens
agaaggccaggcc

SEQ ID NO: 4999478 - DNA, 15 bp, Homo sapiens
agaaggccaggcctc

SEQ ID NO: 4999479 - DNA, 20 bp, Homo sapiens
agaaggggacagcgccacct

SEQ ID NO: 4999480 - DNA, 15 bp, Homo sapiens
agaagtggagtgact

SEQ ID NO: 4999481 - DNA, 21 bp, Homo sapiens
agaattgtgcgacttcacaaa

SEQ ID NO: 4999482 - DNA, 17 bp, Homo sapiens
agaatttggcccagaga

SEQ ID NO: 4999483 - DNA, 15 bp, Homo sapiens
cagacaggaggagtg

SEQ ID NO: 4999484 - DNA, 14 bp, Homo sapiens
cagaccctgcccac

SEQ ID NO: 4999485 - DNA, 16 bp, Homo sapiens
cagaccctgcccaccc

SEQ ID NO: 4999486 - DNA, 19 bp, Homo sapiens
cagaccctgcccaccccat

SEQ ID NO: 4999487 - DNA, 16 bp, Homo sapiens
cagacttctctttctt

SEQ ID NO: 4999488 - DNA, 18 bp, Homo sapiens
cagagaagtggagtgact

SEQ ID NO: 4999489 - DNA, 19 bp, Homo sapiens
cagagctgccctctcctgg

SEQ ID NO: 4999490 - DNA, 20 bp, Homo sapiens
cagagctgccctctcctggg

SEQ ID NO: 4999491 - DNA, 21 bp, Homo sapiens
cagagctgccctctcctgggc

SEQ ID NO: 4999492 - DNA, 23 bp, Homo sapiens
cagagctgccctctcctgggcag

SEQ ID NO: 4999493 - DNA, 17 bp, Homo sapiens
cagaggggcctcatctt

SEQ ID NO: 4999494 - DNA, 14 bp, Homo sapiens
cagagttgttctca

SEQ ID NO: 4999495 - DNA, 18 bp, Homo sapiens
cagatagaatttggccca

SEQ ID NO: 4999496 - DNA, 12 bp, Homo sapiens
cagatgagctgt

SEQ ID NO: 4999497 - DNA, 19 bp, Homo sapiens
cagcaggaggcacagcagt

SEQ ID NO: 4999498 - DNA, 14 bp, Homo sapiens
cagcagtcacaggc

SEQ ID NO: 4999499 - DNA, 18 bp, Homo sapiens
cagcagtcacaggcccag

SEQ ID NO: 4999500 - DNA, 19 bp, Homo sapiens
cagcagtcacaggcccagg

SEQ ID NO: 4999501 - DNA, 20 bp, Homo sapiens
cagcagtcacaggcccagga

SEQ ID NO: 4999502 - DNA, 21 bp, Homo sapiens
cagccagcagttcagagctgc

SEQ ID NO: 4999503 - DNA, 23 bp, Homo sapiens
cagccagcagttcagagctgccc

SEQ ID NO: 4999504 - DNA, 20 bp, Homo sapiens
cagccatcatgtgcctggaa

SEQ ID NO: 4999505 - DNA, 15 bp, Homo sapiens
cagccccactgccct

SEQ ID NO: 4999506 - DNA, 22 bp, Homo sapiens
cagccccactgccctccagggc

SEQ ID NO: 4999507 - DNA, 21 bp, Homo sapiens
cagccctcactgtcagtccca

SEQ ID NO: 4999508 - DNA, 17 bp, Homo sapiens
cagccctccccacctgc

SEQ ID NO: 4999509 - DNA, 17 bp, Homo sapiens
cagctaataaaagtcag

SEQ ID NO: 4999510 - DNA, 20 bp, Homo sapiens
cagctaataaaagtcagagc

SEQ ID NO: 4999511 - DNA, 21 bp, Homo sapiens
cagctaataaaagtcagagct

SEQ ID NO: 4999512 - DNA, 15 bp, Homo sapiens
cagctaggaagcaag

SEQ ID NO: 4999513 - DNA, 21 bp, Homo sapiens
cagctaggaagcaagatcgct

SEQ ID NO: 4999514 - DNA, 15 bp, Homo sapiens
cagctgcctcccctc

SEQ ID NO: 4999515 - DNA, 16 bp, Homo sapiens
cagctgcctcccctcc

SEQ ID NO: 4999516 - DNA, 22 bp, Homo sapiens
cagctgcctcccctcctctgct

SEQ ID NO: 4999517 - DNA, 23 bp, Homo sapiens
cagctgcctcccctcctctgctt

SEQ ID NO: 4999518 - DNA, 19 bp, Homo sapiens
cagctggtggtatctgagt

SEQ ID NO: 4999519 - DNA, 14 bp, Homo sapiens
caggaaggcggcag

SEQ ID NO: 4999520 - DNA, 20 bp, Homo sapiens
caggaaggcggcaggcagag

SEQ ID NO: 4999521 - DNA, 23 bp, Homo sapiens
caggaaggcggcaggcagagaag

SEQ ID NO: 4999522 - DNA, 20 bp, Homo sapiens
caggaatgctgacaatgctg

SEQ ID NO: 4999523 - DNA, 22 bp, Homo sapiens
caggaatgctgacaatgctgcc

SEQ ID NO: 4999524 - DNA, 23 bp, Homo sapiens
caggacgactgttttcccaacac

SEQ ID NO: 4999525 - DNA, 17 bp, Homo sapiens
caggaggagtgggacag

SEQ ID NO: 4999526 - DNA, 13 bp, Homo sapiens
caggattcaggcc

SEQ ID NO: 4999527 - DNA, 15 bp, Homo sapiens
caggattcaggcctc

SEQ ID NO: 4999528 - DNA, 16 bp, Homo sapiens
caggattcaggcctct

SEQ ID NO: 4999529 - DNA, 22 bp, Homo sapiens
caggattcaggcctctgaggag

SEQ ID NO: 4999530 - DNA, 22 bp, Homo sapiens
caggcctcacctcccagggcta

SEQ ID NO: 4999531 - DNA, 19 bp, Homo sapiens
caggcctctactaggtctg

SEQ ID NO: 4999532 - DNA, 21 bp, Homo sapiens
caggcctctactaggtctgct

SEQ ID NO: 4999533 - DNA, 15 bp, Homo sapiens
cagggcaaggccatt

SEQ ID NO: 4999534 - DNA, 22 bp, Homo sapiens
cagggccaggtcctcacagcag

SEQ ID NO: 4999535 - DNA, 17 bp, Homo sapiens
cagggcccatgtagctg

SEQ ID NO: 4999536 - DNA, 15 bp, Homo sapiens
caggggcagtggcct

SEQ ID NO: 4999537 - DNA, 17 bp, Homo sapiens
caggggcagtggcctgg

SEQ ID NO: 4999538 - DNA, 18 bp, Homo sapiens
caggggtgctggggcaga

SEQ ID NO: 4999539 - DNA, 20 bp, Homo sapiens
caggggtgctggggcagagt

SEQ ID NO: 4999540 - DNA, 21 bp, Homo sapiens
caggggtgctggggcagagtg

SEQ ID NO: 4999541 - DNA, 23 bp, Homo sapiens
caggggtgctggggcagagtgga

SEQ ID NO: 4999542 - DNA, 13 bp, Homo sapiens
caggtcctcacag

SEQ ID NO: 4999543 - DNA, 21 bp, Homo sapiens
caggtctagaaggccaggcct

SEQ ID NO: 4999544 - DNA, 14 bp, Homo sapiens
caggtgtaaatata

SEQ ID NO: 4999545 - DNA, 14 bp, Homo sapiens
caggttccctgcca

SEQ ID NO: 4999546 - DNA, 16 bp, Homo sapiens
caggttccctgccaca

SEQ ID NO: 4999547 - DNA, 14 bp, Homo sapiens
caggttgcctcaac

SEQ ID NO: 4999548 - DNA, 20 bp, Homo sapiens
caggttgcctcaacagcagg

SEQ ID NO: 4999549 - DNA, 22 bp, Homo sapiens
caggttgcctcaacagcaggag

SEQ ID NO: 4999550 - DNA, 13 bp, Homo sapiens
cagtagccagagt

SEQ ID NO: 4999551 - DNA, 13 bp, Homo sapiens
cagtcacaggccc

SEQ ID NO: 4999552 - DNA, 14 bp, Homo sapiens
cagtcacaggccca

SEQ ID NO: 4999553 - DNA, 23 bp, Homo sapiens
cagtcacctaagcaatcactggg

SEQ ID NO: 4999554 - DNA, 12 bp, Homo sapiens
cagtcctggaag

SEQ ID NO: 4999555 - DNA, 15 bp, Homo sapiens
cagtggcactctgtg

SEQ ID NO: 4999556 - DNA, 17 bp, Homo sapiens
cagtggcactctgtgtg

SEQ ID NO: 4999557 - DNA, 12 bp, Homo sapiens
cagtggcctgga

SEQ ID NO: 4999558 - DNA, 13 bp, Homo sapiens
cagtggcctggat

SEQ ID NO: 4999559 - DNA, 22 bp, Homo sapiens
cagtggcctggatgcacagtgc

SEQ ID NO: 4999560 - DNA, 23 bp, Homo sapiens
cagtggcctggatgcacagtgcc

SEQ ID NO: 4999561 - DNA, 24 bp, Homo sapiens
cagttcagagctgccctctcctgg

SEQ ID NO: 4999562 - DNA, 20 bp, Homo sapiens
cagtttcaccatctttgagg

SEQ ID NO: 4999563 - DNA, 24 bp, Homo sapiens
cagtttcaccatctttgaggtgag

SEQ ID NO: 4999564 - DNA, 14 bp, Homo sapiens
catatctgtgtgcc

SEQ ID NO: 4999565 - DNA, 21 bp, Homo sapiens
catatctgtgtgccctagggc

SEQ ID NO: 4999566 - DNA, 12 bp, Homo sapiens
catatttcaatt

SEQ ID NO: 4999567 - DNA, 15 bp, Homo sapiens
catccaccccagccc

SEQ ID NO: 4999568 - DNA, 18 bp, Homo sapiens
catccatgttccgagaag

SEQ ID NO: 4999569 - DNA, 23 bp, Homo sapiens
catccctccctccacctccctgc

SEQ ID NO: 4999570 - DNA, 10 bp, Homo sapiens
catccctggc

SEQ ID NO: 4999571 - DNA, 20 bp, Homo sapiens
catccctggctgacctgctg

SEQ ID NO: 4999572 - DNA, 22 bp, Homo sapiens
catccctggctgacctgctgtg

SEQ ID NO: 4999573 - DNA, 19 bp, Homo sapiens
catcctcagaaagtgcagc

SEQ ID NO: 4999574 - DNA, 23 bp, Homo sapiens
catcctcagaaagtgcagcatgg

SEQ ID NO: 4999575 - DNA, 23 bp, Homo sapiens
catcgggtgtaggtgaaaggcat

SEQ ID NO: 4999576 - DNA, 14 bp, Homo sapiens
catctctctttaat

SEQ ID NO: 4999577 - DNA, 17 bp, Homo sapiens
catctgtggagatgccc

SEQ ID NO: 4999578 - DNA, 15 bp, Homo sapiens
catgaaaatgcaaca

SEQ ID NO: 4999579 - DNA, 15 bp, Homo sapiens
catgaaggtttctga

SEQ ID NO: 4999580 - DNA, 24 bp, Homo sapiens
catgactctgcctaaccatgggct

SEQ ID NO: 4999581 - DNA, 17 bp, Homo sapiens
catgactgctcaggcct

SEQ ID NO: 4999582 - DNA, 18 bp, Homo sapiens
catgactgctcaggcctc

SEQ ID NO: 4999583 - DNA, 12 bp, Homo sapiens
catgcagctctg

SEQ ID NO: 4999584 - DNA, 15 bp, Homo sapiens
catgggagagtccag

SEQ ID NO: 4999585 - DNA, 17 bp, Homo sapiens
catgggagagtccaggc

SEQ ID NO: 4999586 - DNA, 18 bp, Homo sapiens
catgggagagtccaggcc

SEQ ID NO: 4999587 - DNA, 22 bp, Homo sapiens
catgggagagtccaggcctggg

SEQ ID NO: 4999588 - DNA, 14 bp, Homo sapiens
catgggctcagggc

SEQ ID NO: 4999589 - DNA, 15 bp, Homo sapiens
catgggctcagggcc

SEQ ID NO: 4999590 - DNA, 17 bp, Homo sapiens
catgggctcagggccag

SEQ ID NO: 4999591 - DNA, 14 bp, Homo sapiens
catgggggcccaaa

SEQ ID NO: 4999592 - DNA, 16 bp, Homo sapiens
catgggggcccaaagg

SEQ ID NO: 4999593 - DNA, 15 bp, Homo sapiens
catgtagctggcaag

SEQ ID NO: 4999594 - DNA, 18 bp, Homo sapiens
catgtagctggcaagctg

SEQ ID NO: 4999595 - DNA, 15 bp, Homo sapiens
catgtataatatttt

SEQ ID NO: 4999596 - DNA, 18 bp, Homo sapiens
catgtgcctctgtcctta

SEQ ID NO: 4999597 - DNA, 15 bp, Homo sapiens
catgtggcaacctgt

SEQ ID NO: 4999598 - DNA, 17 bp, Homo sapiens
catgttcagggatgctc

SEQ ID NO: 4999599 - DNA, 23 bp, Homo sapiens
cattatgatgtgggtcaaggaat

SEQ ID NO: 4999600 - DNA, 15 bp, Homo sapiens
cattccatgactctg

SEQ ID NO: 4999601 - DNA, 16 bp, Homo sapiens
cattccatgactctgc

SEQ ID NO: 4999602 - DNA, 19 bp, Homo sapiens
cattccatgactctgccta

SEQ ID NO: 4999603 - DNA, 13 bp, Homo sapiens
cattcctgttctt

SEQ ID NO: 4999604 - DNA, 16 bp, Homo sapiens
cattcctgttctttct

SEQ ID NO: 4999605 - DNA, 22 bp, Homo sapiens
cattctcttgaaggtgctgcca

SEQ ID NO: 4999606 - DNA, 12 bp, Homo sapiens
ccaaagcagaca

SEQ ID NO: 4999607 - DNA, 13 bp, Homo sapiens
ccaaagtccaggc

SEQ ID NO: 4999608 - DNA, 22 bp, Homo sapiens
ctcacacccacctgctgctgta

SEQ ID NO: 4999609 - DNA, 20 bp, Homo sapiens
ctcacagcagtcacaggccc

SEQ ID NO: 4999610 - DNA, 21 bp, Homo sapiens
ctcacagcagtcacaggccca

SEQ ID NO: 4999611 - DNA, 22 bp, Homo sapiens
ctcacagcagtcacaggcccag

SEQ ID NO: 4999612 - DNA, 16 bp, Homo sapiens
ctcacctcccagggct

SEQ ID NO: 4999613 - DNA, 17 bp, Homo sapiens
ctcactgtcagtcccac

SEQ ID NO: 4999614 - DNA, 19 bp, Homo sapiens
ctcagaaagtgcagcatgg

SEQ ID NO: 4999615 - DNA, 22 bp, Homo sapiens
ctcaggcatggatgaataaatg

SEQ ID NO: 4999616 - DNA, 17 bp, Homo sapiens
ctcaggcctcacctccc

SEQ ID NO: 4999617 - DNA, 22 bp, Homo sapiens
ctcaggcctcacctcccagggc

SEQ ID NO: 4999618 - DNA, 13 bp, Homo sapiens
ctcagggccaggt

SEQ ID NO: 4999619 - DNA, 22 bp, Homo sapiens
ctcaggggtgctggggcagagt

SEQ ID NO: 4999620 - DNA, 16 bp, Homo sapiens
ctcaggttccctgcca

SEQ ID NO: 4999621 - DNA, 17 bp, Homo sapiens
ctcaggttccctgccac

SEQ ID NO: 4999622 - DNA, 12 bp, Homo sapiens
ctcagtcctgga

SEQ ID NO: 4999623 - DNA, 19 bp, Homo sapiens
ctcatcttccccagccctc

SEQ ID NO: 4999624 - DNA, 14 bp, Homo sapiens
ctccacctccctgc

SEQ ID NO: 4999625 - DNA, 23 bp, Homo sapiens
ctccacctccctgcaataaaatg

SEQ ID NO: 4999626 - DNA, 22 bp, Homo sapiens
ctccactgacctggttgtccag

SEQ ID NO: 4999627 - DNA, 14 bp, Homo sapiens
ctccagacaggagg

SEQ ID NO: 4999628 - DNA, 17 bp, Homo sapiens
ctccagacaggaggagt

SEQ ID NO: 4999629 - DNA, 11 bp, Homo sapiens
ctccagggcca

SEQ ID NO: 4999630 - DNA, 13 bp, Homo sapiens
ctccagggccagg

SEQ ID NO: 4999631 - DNA, 14 bp, Homo sapiens
ctcccagggctaca

SEQ ID NO: 4999632 - DNA, 18 bp, Homo sapiens
ctcccagggctacacaga

SEQ ID NO: 4999633 - DNA, 18 bp, Homo sapiens
ctccccacctgctcacca

SEQ ID NO: 4999634 - DNA, 20 bp, Homo sapiens
ctcccctcctctgcttgcca

SEQ ID NO: 4999635 - DNA, 20 bp, Homo sapiens
ctccctccacctccctgcaa

SEQ ID NO: 4999636 - DNA, 16 bp, Homo sapiens
ctccctgcaataaaat

SEQ ID NO: 4999637 - DNA, 20 bp, Homo sapiens
ctcctctgcttgccatccct

SEQ ID NO: 4999638 - DNA, 22 bp, Homo sapiens
ctcctctgcttgccatccctcc

SEQ ID NO: 4999639 - DNA, 19 bp, Homo sapiens
ctcctgggcagctgcctcc

SEQ ID NO: 4999640 - DNA, 22 bp, Homo sapiens
ctcctgggcagctgcctcccct

SEQ ID NO: 4999641 - DNA, 20 bp, Homo sapiens
ctccttcctcagtcctggaa

SEQ ID NO: 4999642 - DNA, 20 bp, Homo sapiens
ctcggctgtaaacagctctg

SEQ ID NO: 4999643 - DNA, 12 bp, Homo sapiens
ctctaagcagaa

SEQ ID NO: 4999644 - DNA, 20 bp, Homo sapiens
ctctactaggtctgctcctg

SEQ ID NO: 4999645 - DNA, 20 bp, Homo sapiens
ctctccaaattttgctttag

SEQ ID NO: 4999646 - DNA, 16 bp, Homo sapiens
ctctcctgggcagctg

SEQ ID NO: 4999647 - DNA, 18 bp, Homo sapiens
ctctcctgggcagctgcc

SEQ ID NO: 4999648 - DNA, 14 bp, Homo sapiens
ctctccttgcctgg

SEQ ID NO: 4999649 - DNA, 16 bp, Homo sapiens
ctctccttgcctggtg

SEQ ID NO: 4999650 - DNA, 15 bp, Homo sapiens
ctctgaggagcccac

SEQ ID NO: 4999651 - DNA, 18 bp, Homo sapiens
ctctgaggagcccacggg

SEQ ID NO: 4999652 - DNA, 17 bp, Homo sapiens
ctctgatccttcttcct

SEQ ID NO: 4999653 - DNA, 13 bp, Homo sapiens
ctctgcctccagg

SEQ ID NO: 4999654 - DNA, 16 bp, Homo sapiens
ctctgcctccaggttg

SEQ ID NO: 4999655 - DNA, 14 bp, Homo sapiens
ctctgcttgccatc

SEQ ID NO: 4999656 - DNA, 17 bp, Homo sapiens
ctctgcttgccatccct

SEQ ID NO: 4999657 - DNA, 20 bp, Homo sapiens
ctctgcttgccatccctccc

SEQ ID NO: 4999658 - DNA, 16 bp, Homo sapiens
ctcttctcactttcct

SEQ ID NO: 4999659 - DNA, 20 bp, Homo sapiens
ctctttcttattttgtaata

SEQ ID NO: 4999660 - DNA, 16 bp, Homo sapiens
ctgaaaattaacactg

SEQ ID NO: 4999661 - DNA, 17 bp, Homo sapiens
ctgaaccagtcctgctg

SEQ ID NO: 4999662 - DNA, 18 bp, Homo sapiens
ctgaaccagtcctgctgc

SEQ ID NO: 4999663 - DNA, 19 bp, Homo sapiens
ctgaaccagtcctgctgcc

SEQ ID NO: 4999664 - DNA, 20 bp, Homo sapiens
ctgaaccagtcctgctgcct

SEQ ID NO: 4999665 - DNA, 21 bp, Homo sapiens
ctgaaccagtcctgctgcctg

SEQ ID NO: 4999666 - DNA, 16 bp, Homo sapiens
ctgaactgtgagtcct

SEQ ID NO: 4999667 - DNA, 19 bp, Homo sapiens
ctgaatttcattctcttga

SEQ ID NO: 4999668 - DNA, 17 bp, Homo sapiens
ctgaccaaaaccagagg

SEQ ID NO: 4999669 - DNA, 21 bp, Homo sapiens
ctgaccaaaaccagagggcag

SEQ ID NO: 4999670 - DNA, 15 bp, Homo sapiens
ctgacctgctgtgga

SEQ ID NO: 4999671 - DNA, 21 bp, Homo sapiens
ctgacctggttgtccaggtct

SEQ ID NO: 4999672 - DNA, 21 bp, Homo sapiens
ctgagaagatggcactgtcca

SEQ ID NO: 4999673 - DNA, 23 bp, Homo sapiens
ctgagaagatggcactgtccagg

SEQ ID NO: 4999674 - DNA, 19 bp, Homo sapiens
ctgaggagcccacggggca

SEQ ID NO: 4999675 - DNA, 15 bp, Homo sapiens
ctgaggataccccaa

SEQ ID NO: 4999676 - DNA, 18 bp, Homo sapiens
ctgaggataccccaaagt

SEQ ID NO: 4999677 - DNA, 16 bp, Homo sapiens
ctgaggctctccaaat

SEQ ID NO: 4999678 - DNA, 19 bp, Homo sapiens
ctgatcctaaccctgggct

SEQ ID NO: 4999679 - DNA, 21 bp, Homo sapiens
ctgatgggagtaggctccaga

SEQ ID NO: 4999680 - DNA, 22 bp, Homo sapiens
ctgcaataaaatgggttttact

SEQ ID NO: 4999681 - DNA, 19 bp, Homo sapiens
ctgcacccccctgtgcctg

SEQ ID NO: 4999682 - DNA, 22 bp, Homo sapiens
ctgccaatgccatgactgctca

SEQ ID NO: 4999683 - DNA, 15 bp, Homo sapiens
ctgccaggcaccatc

SEQ ID NO: 4999684 - DNA, 18 bp, Homo sapiens
ctgccaggcaccatctgc

SEQ ID NO: 4999685 - DNA, 21 bp, Homo sapiens
ctgccaggcaccatctgccaa

SEQ ID NO: 4999686 - DNA, 15 bp, Homo sapiens
ctgccatgcccacca

SEQ ID NO: 4999687 - DNA, 20 bp, Homo sapiens
ctgcccaccccatccctggc

SEQ ID NO: 4999688 - DNA, 18 bp, Homo sapiens
ctgccctccagggccagg

SEQ ID NO: 4999689 - DNA, 20 bp, Homo sapiens
ctgccctccagggccaggat

SEQ ID NO: 4999690 - DNA, 14 bp, Homo sapiens
ctgccctctcctgg

SEQ ID NO: 4999691 - DNA, 18 bp, Homo sapiens
ctgccctctcctgggcag

SEQ ID NO: 4999692 - DNA, 17 bp, Homo sapiens
ctgcctaaccatgggct

SEQ ID NO: 4999693 - DNA, 21 bp, Homo sapiens
ctgcctaaccatgggctcagg

SEQ ID NO: 4999694 - DNA, 22 bp, Homo sapiens
ctgcctaaccatgggctcaggg

SEQ ID NO: 4999695 - DNA, 18 bp, Homo sapiens
ctgcctcccctcctctgc

SEQ ID NO: 4999696 - DNA, 19 bp, Homo sapiens
ctgcctggagtcagtagcc

SEQ ID NO: 4999697 - DNA, 21 bp, Homo sapiens
ctgcctggagtcagtagccag

SEQ ID NO: 4999698 - DNA, 22 bp, Homo sapiens
ctgccttatctaaatcaccaga

SEQ ID NO: 4999699 - DNA, 15 bp, Homo sapiens
ctgctactagctctt

SEQ ID NO: 4999700 - DNA, 22 bp, Homo sapiens
ctgctcaccaattccacttcct

SEQ ID NO: 4999701 - DNA, 12 bp, Homo sapiens
ctgctcaggcct

SEQ ID NO: 4999702 - DNA, 13 bp, Homo sapiens
ctgctcaggcctc

SEQ ID NO: 4999703 - DNA, 17 bp, Homo sapiens
ctgctcaggcctcacct

SEQ ID NO: 4999704 - DNA, 19 bp, Homo sapiens
ctgctcaggcctcacctcc

SEQ ID NO: 4999705 - DNA, 14 bp, Homo sapiens
ctgctgcctggagt

SEQ ID NO: 4999706 - DNA, 14 bp, Homo sapiens
ctgctgggcactgg

SEQ ID NO: 4999707 - DNA, 11 bp, Homo sapiens
ctgctgggcca

SEQ ID NO: 4999708 - DNA, 14 bp, Homo sapiens
ctgctgggccagtg

SEQ ID NO: 4999709 - DNA, 19 bp, Homo sapiens
ctgctgggccagtggcact

SEQ ID NO: 4999710 - DNA, 23 bp, Homo sapiens
ctgctgggccagtggcactctgt

SEQ ID NO: 4999711 - DNA, 20 bp, Homo sapiens
ctgcttgccatccctccctc

SEQ ID NO: 4999712 - DNA, 22 bp, Homo sapiens
ctggagctaaggccagctagag

SEQ ID NO: 4999713 - DNA, 20 bp, Homo sapiens
ctggaggactctagaagctc

SEQ ID NO: 4999714 - DNA, 23 bp, Homo sapiens
ctggaggactctagaagctcagg

SEQ ID NO: 4999715 - DNA, 15 bp, Homo sapiens
ctggagtcagtagcc

SEQ ID NO: 4999716 - DNA, 24 bp, Homo sapiens
ctggatgcacagtgcctgatggga

SEQ ID NO: 4999717 - DNA, 15 bp, Homo sapiens
ctggctcctggacct

SEQ ID NO: 4999718 - DNA, 19 bp, Homo sapiens
ctgggatgtttctgtcaca

SEQ ID NO: 4999719 - DNA, 17 bp, Homo sapiens
ctgggcactagctagat

SEQ ID NO: 4999720 - DNA, 14 bp, Homo sapiens
ctgggcactgggca

SEQ ID NO: 4999721 - DNA, 14 bp, Homo sapiens
ctgggcagctgcct

SEQ ID NO: 4999722 - DNA, 14 bp, Homo sapiens
ctgggcccagagga

SEQ ID NO: 4999723 - DNA, 18 bp, Homo sapiens
ctgggcccagaggagagg

SEQ ID NO: 4999724 - DNA, 19 bp, Homo sapiens
ctgggcccagaggagagga

SEQ ID NO: 4999725 - DNA, 18 bp, Homo sapiens
ctgggctccctggaggac

SEQ ID NO: 4999726 - DNA, 12 bp, Homo sapiens
ctggggcagagt

SEQ ID NO: 4999727 - DNA, 14 bp, Homo sapiens
ctggttgtccaggt

SEQ ID NO: 4999728 - DNA, 16 bp, Homo sapiens
ctggttgtccaggtct

SEQ ID NO: 4999729 - DNA, 17 bp, Homo sapiens
ctggttgtccaggtcta

SEQ ID NO: 4999730 - DNA, 19 bp, Homo sapiens
ctgtcagccctcactgtca

SEQ ID NO: 4999731 - DNA, 18 bp, Homo sapiens
ctgtcagtcccactgcac

SEQ ID NO: 4999732 - DNA, 16 bp, Homo sapiens
ctgtgatccaggaaag

SEQ ID NO: 4999733 - DNA, 22 bp, Homo sapiens
gcctctgaggagcccacggggc

SEQ ID NO: 4999734 - DNA, 20 bp, Homo sapiens
gcctgatgggagtaggctcc

SEQ ID NO: 4999735 - DNA, 23 bp, Homo sapiens
gcctgatgggagtaggctccaga

SEQ ID NO: 4999736 - DNA, 24 bp, Homo sapiens
gcctgatgggagtaggctccagac

SEQ ID NO: 4999737 - DNA, 16 bp, Homo sapiens
gcctgatttgttcctt

SEQ ID NO: 4999738 - DNA, 14 bp, Homo sapiens
gcctgctgggcact

SEQ ID NO: 4999739 - DNA, 18 bp, Homo sapiens
gcctgctgggcactgggc

SEQ ID NO: 4999740 - DNA, 18 bp, Homo sapiens
gcctggagtcagtagcca

SEQ ID NO: 4999741 - DNA, 22 bp, Homo sapiens
gcctggagtcagtagccagagt

SEQ ID NO: 4999742 - DNA, 17 bp, Homo sapiens
gcctggatgcacagtgc

SEQ ID NO: 4999743 - DNA, 21 bp, Homo sapiens
gcctggatgcacagtgcctga

SEQ ID NO: 4999744 - DNA, 14 bp, Homo sapiens
gcctgtcaccccag

SEQ ID NO: 4999745 - DNA, 22 bp, Homo sapiens
gccttatctaaatcaccagaga

SEQ ID NO: 4999746 - DNA, 18 bp, Homo sapiens
gcgtggggaggggctgag

SEQ ID NO: 4999747 - DNA, 13 bp, Homo sapiens
gctaaggccagct

SEQ ID NO: 4999748 - DNA, 17 bp, Homo sapiens
gctaataaaagtcagag

SEQ ID NO: 4999749 - DNA, 18 bp, Homo sapiens
gctaataaaagtcagagc

SEQ ID NO: 4999750 - DNA, 23 bp, Homo sapiens
gctaataaaagtcagagctcagg

SEQ ID NO: 4999751 - DNA, 22 bp, Homo sapiens
gctacaaaataaagctgttctc

SEQ ID NO: 4999752 - DNA, 21 bp, Homo sapiens
gctatattaggcatgttcagg

SEQ ID NO: 4999753 - DNA, 19 bp, Homo sapiens
gctatccagctatttttat

SEQ ID NO: 4999754 - DNA, 22 bp, Homo sapiens
gctatttttatttgtttgtgca

SEQ ID NO: 4999755 - DNA, 13 bp, Homo sapiens
gctcaaggaagga

SEQ ID NO: 4999756 - DNA, 16 bp, Homo sapiens
gctcagaggggcctca

SEQ ID NO: 4999757 - DNA, 21 bp, Homo sapiens
gctcaggcctcacctcccagg

SEQ ID NO: 4999758 - DNA, 22 bp, Homo sapiens
gctcaggcctcacctcccaggg

SEQ ID NO: 4999759 - DNA, 16 bp, Homo sapiens
gctcaggttccctgcc

SEQ ID NO: 4999760 - DNA, 17 bp, Homo sapiens
gctcaggttccctgcca

SEQ ID NO: 4999761 - DNA, 19 bp, Homo sapiens
gctcaggttccctgccaca

SEQ ID NO: 4999762 - DNA, 16 bp, Homo sapiens
gctcagttctgcctta

SEQ ID NO: 4999763 - DNA, 17 bp, Homo sapiens
gctccagacaggaggag

SEQ ID NO: 4999764 - DNA, 20 bp, Homo sapiens
gctccagacaggaggagtgg

SEQ ID NO: 4999765 - DNA, 13 bp, Homo sapiens
gctccctggagga

SEQ ID NO: 4999766 - DNA, 23 bp, Homo sapiens
gctcctgaaccagtcctgctgcc

SEQ ID NO: 4999767 - DNA, 18 bp, Homo sapiens
gctcctggacctaaaggg

SEQ ID NO: 4999768 - DNA, 12 bp, Homo sapiens
gctgacctgctg

SEQ ID NO: 4999769 - DNA, 22 bp, Homo sapiens
gctgagattgcgccactgcact

SEQ ID NO: 4999770 - DNA, 13 bp, Homo sapiens
gctgagttggtgt

SEQ ID NO: 4999771 - DNA, 12 bp, Homo sapiens
gctgccacccct

SEQ ID NO: 4999772 - DNA, 16 bp, Homo sapiens
gctgccaccccttggc

SEQ ID NO: 4999773 - DNA, 12 bp, Homo sapiens
gctgccctctcc

SEQ ID NO: 4999774 - DNA, 18 bp, Homo sapiens
gctgccctctcctgggca

SEQ ID NO: 4999775 - DNA, 17 bp, Homo sapiens
gctgcctcccctcctct

SEQ ID NO: 4999776 - DNA, 20 bp, Homo sapiens
gctgcctggagtcagtagcc

SEQ ID NO: 4999777 - DNA, 12 bp, Homo sapiens
gctgctgggcca

SEQ ID NO: 4999778 - DNA, 13 bp, Homo sapiens
gctgctgggccag

SEQ ID NO: 4999779 - DNA, 15 bp, Homo sapiens
gctgctgggccagtg

SEQ ID NO: 4999780 - DNA, 17 bp, Homo sapiens
gctggagctaaggccag

SEQ ID NO: 4999781 - DNA, 18 bp, Homo sapiens
gctggagctaaggccagc

SEQ ID NO: 4999782 - DNA, 22 bp, Homo sapiens
gctggagctaaggccagctaga

SEQ ID NO: 4999783 - DNA, 20 bp, Homo sapiens
gctggcaagctgcaaaaggc

SEQ ID NO: 4999784 - DNA, 15 bp, Homo sapiens
gctgggccagtggca

SEQ ID NO: 4999785 - DNA, 16 bp, Homo sapiens
gctgggccagtggcac

SEQ ID NO: 4999786 - DNA, 22 bp, Homo sapiens
gctggggcagagtggagcccag

SEQ ID NO: 4999787 - DNA, 14 bp, Homo sapiens
gctgtgaatggctg

SEQ ID NO: 4999788 - DNA, 16 bp, Homo sapiens
gctgttctcattcctg

SEQ ID NO: 4999789 - DNA, 12 bp, Homo sapiens
ggaaaaccagac

SEQ ID NO: 4999790 - DNA, 22 bp, Homo sapiens
ggaaaaccagactacttgggag

SEQ ID NO: 4999791 - DNA, 16 bp, Homo sapiens
ggaaaatggcagaaag

SEQ ID NO: 4999792 - DNA, 17 bp, Homo sapiens
ggaaactggatgaggtc

SEQ ID NO: 4999793 - DNA, 12 bp, Homo sapiens
ggaaagatgtcc

SEQ ID NO: 4999794 - DNA, 18 bp, Homo sapiens
ggaacctcaaactgggta

SEQ ID NO: 4999795 - DNA, 15 bp, Homo sapiens
ggaaggcggcaggca

SEQ ID NO: 4999796 - DNA, 16 bp, Homo sapiens
ggaaggcggcaggcag

SEQ ID NO: 4999797 - DNA, 16 bp, Homo sapiens
ggacagacagcagctg

SEQ ID NO: 4999798 - DNA, 23 bp, Homo sapiens
ggaccacatccaccccagcccca

SEQ ID NO: 4999799 - DNA, 16 bp, Homo sapiens
ggacctaaagggtatg

SEQ ID NO: 4999800 - DNA, 20 bp, Homo sapiens
ggactaatccaatacctctt

SEQ ID NO: 4999801 - DNA, 13 bp, Homo sapiens
ggagaggagacag

SEQ ID NO: 4999802 - DNA, 12 bp, Homo sapiens
ggagcccagggt

SEQ ID NO: 4999803 - DNA, 13 bp, Homo sapiens
ggagcccagggtg

SEQ ID NO: 4999804 - DNA, 17 bp, Homo sapiens
ggagcccagggtgctgg

SEQ ID NO: 4999805 - DNA, 22 bp, Homo sapiens
ggagcgtggggaggggctgagg

SEQ ID NO: 4999806 - DNA, 13 bp, Homo sapiens
ggagctcaggttt

SEQ ID NO: 4999807 - DNA, 22 bp, Homo sapiens
ggagctcaggtttctggacaag

SEQ ID NO: 4999808 - DNA, 22 bp, Homo sapiens
ggaggactctagaagctcaggt

SEQ ID NO: 4999809 - DNA, 16 bp, Homo sapiens
ggaggagtgggacaga

SEQ ID NO: 4999810 - DNA, 18 bp, Homo sapiens
ggaggagtgggacagaca

SEQ ID NO: 4999811 - DNA, 14 bp, Homo sapiens
ggaggcacagcagt

SEQ ID NO: 4999812 - DNA, 15 bp, Homo sapiens
ggaggcacagcagtt

SEQ ID NO: 4999813 - DNA, 20 bp, Homo sapiens
ggaggtggaggttgcagtga

SEQ ID NO: 4999814 - DNA, 21 bp, Homo sapiens
ggaggttgcagtgagctgaga

SEQ ID NO: 4999815 - DNA, 19 bp, Homo sapiens
ggagtaggctccagacagg

SEQ ID NO: 4999816 - DNA, 12 bp, Homo sapiens
ggagtgggacag

SEQ ID NO: 4999817 - DNA, 19 bp, Homo sapiens
ggataccccaaagtccagg

SEQ ID NO: 4999818 - DNA, 20 bp, Homo sapiens
ggataccccaaagtccaggc

SEQ ID NO: 4999819 - DNA, 17 bp, Homo sapiens
ggatgtggcaggggcag

SEQ ID NO: 4999820 - DNA, 20 bp, Homo sapiens
ggatgtggcaggggcagtgg

SEQ ID NO: 4999821 - DNA, 24 bp, Homo sapiens
ggatgtggcaggggcagtggcctg

SEQ ID NO: 4999822 - DNA, 18 bp, Homo sapiens
ggattcaggcctctgagg

SEQ ID NO: 4999823 - DNA, 13 bp, Homo sapiens
ggcaaagctgctg

SEQ ID NO: 4999824 - DNA, 20 bp, Homo sapiens
ggcaaagctgctgggccagt

SEQ ID NO: 4999825 - DNA, 21 bp, Homo sapiens
ggcaaagctgctgggccagtg

SEQ ID NO: 4999826 - DNA, 23 bp, Homo sapiens
ggcaaagctgctgggccagtggc

SEQ ID NO: 4999827 - DNA, 17 bp, Homo sapiens
ggcaaatccgaaatcag

SEQ ID NO: 4999828 - DNA, 14 bp, Homo sapiens
ggcaagagtgagac

SEQ ID NO: 4999829 - DNA, 18 bp, Homo sapiens
ggcaagagtgagactccg

SEQ ID NO: 4999830 - DNA, 20 bp, Homo sapiens
ggcaagctgcaaaaggcctg

SEQ ID NO: 4999831 - DNA, 16 bp, Homo sapiens
ggcacaggtgtaaata

SEQ ID NO: 4999832 - DNA, 19 bp, Homo sapiens
ggcactgtggaactgccac

SEQ ID NO: 4999833 - DNA, 21 bp, Homo sapiens
ggcactgtggaactgccacct

SEQ ID NO: 4999834 - DNA, 18 bp, Homo sapiens
ggcagaaagatggagagg

SEQ ID NO: 4999835 - DNA, 20 bp, Homo sapiens
ggcagaaagatggagaggca

SEQ ID NO: 4999836 - DNA, 21 bp, Homo sapiens
ggcagaaagatggagaggcat

SEQ ID NO: 4999837 - DNA, 17 bp, Homo sapiens
ggcagagtggagcccag

SEQ ID NO: 4999838 - DNA, 18 bp, Homo sapiens
ggcagagtggagcccagg

SEQ ID NO: 4999839 - DNA, 20 bp, Homo sapiens
ggcagagtggagcccagggt

SEQ ID NO: 4999840 - DNA, 21 bp, Homo sapiens
ggcagagtggagcccagggtg

SEQ ID NO: 4999841 - DNA, 23 bp, Homo sapiens
ggcagagtggagcccagggtgct

SEQ ID NO: 4999842 - DNA, 13 bp, Homo sapiens
ggcagctgcctcc

SEQ ID NO: 4999843 - DNA, 16 bp, Homo sapiens
ggcagctgcctcccct

SEQ ID NO: 4999844 - DNA, 22 bp, Homo sapiens
ggcagctgcctcccctcctctg

SEQ ID NO: 4999845 - DNA, 12 bp, Homo sapiens
ggcaggcagaga

SEQ ID NO: 4999846 - DNA, 14 bp, Homo sapiens
ggcaggggcagtgg

SEQ ID NO: 4999847 - DNA, 15 bp, Homo sapiens
ggcaggggcagtggc

SEQ ID NO: 4999848 - DNA, 17 bp, Homo sapiens
ggcaggggcagtggcct

SEQ ID NO: 4999849 - DNA, 16 bp, Homo sapiens
ggcagtctagtcctgg

SEQ ID NO: 4999850 - DNA, 17 bp, Homo sapiens
ggcagtctagtcctggg

SEQ ID NO: 4999851 - DNA, 22 bp, Homo sapiens
ggcagtggcctggatgcacagt

SEQ ID NO: 4999852 - DNA, 20 bp, Homo sapiens
ggccagatgcacatccctgg

SEQ ID NO: 4999853 - DNA, 23 bp, Homo sapiens
ggccaggattcaggcctctgagg

SEQ ID NO: 4999854 - DNA, 19 bp, Homo sapiens
ggccaggtcctcacagcag

SEQ ID NO: 4999855 - DNA, 20 bp, Homo sapiens
ggccaggtcctcacagcagt

SEQ ID NO: 4999856 - DNA, 14 bp, Homo sapiens
ggccagtggcactc

SEQ ID NO: 4999857 - DNA, 10 bp, Homo sapiens
ggcccagaga

SEQ ID NO: 4999858 - DNA, 16 bp, Homo sapiens
tgccaatgccatgact

SEQ ID NO: 4999859 - DNA, 20 bp, Homo sapiens
tgccaccccttggcactgtg

SEQ ID NO: 4999860 - DNA, 16 bp, Homo sapiens
tgccagatcctcttct

SEQ ID NO: 4999861 - DNA, 20 bp, Homo sapiens
tgccaggcaccatctgccaa

SEQ ID NO: 4999862 - DNA, 14 bp, Homo sapiens
tgccatccctccct

SEQ ID NO: 4999863 - DNA, 16 bp, Homo sapiens
tgccatgactgctcag

SEQ ID NO: 4999864 - DNA, 18 bp, Homo sapiens
tgccatgactgctcaggc

SEQ ID NO: 4999865 - DNA, 14 bp, Homo sapiens
tgccatgcccacca

SEQ ID NO: 4999866 - DNA, 16 bp, Homo sapiens
tgccatgcccaccatc

SEQ ID NO: 4999867 - DNA, 20 bp, Homo sapiens
tgccccacctgttgtcctga

SEQ ID NO: 4999868 - DNA, 17 bp, Homo sapiens
tgccctagggctcagag

SEQ ID NO: 4999869 - DNA, 15 bp, Homo sapiens
tgccctccagggcca

SEQ ID NO: 4999870 - DNA, 16 bp, Homo sapiens
tgccctccagggccag

SEQ ID NO: 4999871 - DNA, 14 bp, Homo sapiens
tgccctctcctggg

SEQ ID NO: 4999872 - DNA, 15 bp, Homo sapiens
tgccctctcctgggc

SEQ ID NO: 4999873 - DNA, 15 bp, Homo sapiens
tgcctaaccatgggc

SEQ ID NO: 4999874 - DNA, 19 bp, Homo sapiens
tgcctaaccatgggctcag

SEQ ID NO: 4999875 - DNA, 21 bp, Homo sapiens
tgcctaaccatgggctcaggg

SEQ ID NO: 4999876 - DNA, 18 bp, Homo sapiens
tgcctcaacagcaggagg

SEQ ID NO: 4999877 - DNA, 20 bp, Homo sapiens
tgcctcaacagcaggaggca

SEQ ID NO: 4999878 - DNA, 11 bp, Homo sapiens
tgcctccaggt

SEQ ID NO: 4999879 - DNA, 14 bp, Homo sapiens
tgcctccaggttgc

SEQ ID NO: 4999880 - DNA, 18 bp, Homo sapiens
tgcctccaggttgcctca

SEQ ID NO: 4999881 - DNA, 14 bp, Homo sapiens
tgcctcccctcctc

SEQ ID NO: 4999882 - DNA, 16 bp, Homo sapiens
tgcctcccctcctctg

SEQ ID NO: 4999883 - DNA, 16 bp, Homo sapiens
tgcctgatgggagtag

SEQ ID NO: 4999884 - DNA, 12 bp, Homo sapiens
tgcctgctgggc

SEQ ID NO: 4999885 - DNA, 13 bp, Homo sapiens
tgcctgctgggca

SEQ ID NO: 4999886 - DNA, 14 bp, Homo sapiens
tgcctggagtcagt

SEQ ID NO: 4999887 - DNA, 17 bp, Homo sapiens
tgcctggagtcagtagc

SEQ ID NO: 4999888 - DNA, 23 bp, Homo sapiens
tgcctggagtcagtagccagagt

SEQ ID NO: 4999889 - DNA, 17 bp, Homo sapiens
tgccttatctcttctca

SEQ ID NO: 4999890 - DNA, 14 bp, Homo sapiens
tgctactagctctt

SEQ ID NO: 4999891 - DNA, 18 bp, Homo sapiens
tgctactagctctttgag

SEQ ID NO: 4999892 - DNA, 23 bp, Homo sapiens
tgctcaggcctcacctcccaggg

SEQ ID NO: 4999893 - DNA, 18 bp, Homo sapiens
tgctcctgaaccagtcct

SEQ ID NO: 4999894 - DNA, 15 bp, Homo sapiens
tgctcttctgttctc

SEQ ID NO: 4999895 - DNA, 14 bp, Homo sapiens
tgctgacaatgctg

SEQ ID NO: 4999896 - DNA, 16 bp, Homo sapiens
tgctgacaatgctgcc

SEQ ID NO: 4999897 - DNA, 17 bp, Homo sapiens
tgctgacaatgctgcca

SEQ ID NO: 4999898 - DNA, 18 bp, Homo sapiens
tgctgacaatgctgccat

SEQ ID NO: 4999899 - DNA, 19 bp, Homo sapiens
tgctgacaatgctgccatg

SEQ ID NO: 4999900 - DNA, 15 bp, Homo sapiens
tgctgagttggtgtt

SEQ ID NO: 4999901 - DNA, 20 bp, Homo sapiens
tgctgccaccccttggcact

SEQ ID NO: 4999902 - DNA, 19 bp, Homo sapiens
tgctgggcattttcccaga

SEQ ID NO: 4999903 - DNA, 12 bp, Homo sapiens
tgctgggccagt

SEQ ID NO: 4999904 - DNA, 15 bp, Homo sapiens
tgctgggccagtggc

SEQ ID NO: 4999905 - DNA, 16 bp, Homo sapiens
tgctgggccagtggca

SEQ ID NO: 4999906 - DNA, 19 bp, Homo sapiens
tgctgggccagtggcactc

SEQ ID NO: 4999907 - DNA, 16 bp, Homo sapiens
tgctgtggatgtccct

SEQ ID NO: 4999908 - DNA, 21 bp, Homo sapiens
tggaaactggatgaggtcata

SEQ ID NO: 4999909 - DNA, 16 bp, Homo sapiens
tggaaattggaagagc

SEQ ID NO: 4999910 - DNA, 12 bp, Homo sapiens
tggaactgccac

SEQ ID NO: 4999911 - DNA, 14 bp, Homo sapiens
tggaactgccacct

SEQ ID NO: 4999912 - DNA, 17 bp, Homo sapiens
tggaactgccaccttgg

SEQ ID NO: 4999913 - DNA, 14 bp, Homo sapiens
tggacaagaagagt

SEQ ID NO: 4999914 - DNA, 18 bp, Homo sapiens
tggacctaaagggtatga

SEQ ID NO: 4999915 - DNA, 22 bp, Homo sapiens
tggacttgaaggtttgatgcca

SEQ ID NO: 4999916 - DNA, 12 bp, Homo sapiens
tggagcccaggg

SEQ ID NO: 4999917 - DNA, 19 bp, Homo sapiens
tggagcccagggtgctggg

SEQ ID NO: 4999918 - DNA, 15 bp, Homo sapiens
tggagctaaggccag

SEQ ID NO: 4999919 - DNA, 16 bp, Homo sapiens
tggagctaaggccagc

SEQ ID NO: 4999920 - DNA, 12 bp, Homo sapiens
tggagctcaggt

SEQ ID NO: 4999921 - DNA, 16 bp, Homo sapiens
tggagctcaggtttct

SEQ ID NO: 4999922 - DNA, 21 bp, Homo sapiens
tggagctcaggtttctggaca

SEQ ID NO: 4999923 - DNA, 18 bp, Homo sapiens
tggaggactctagaagct

SEQ ID NO: 4999924 - DNA, 21 bp, Homo sapiens
tggaggactctagaagctcag

SEQ ID NO: 4999925 - DNA, 22 bp, Homo sapiens
tggaggagctcaggacactaat

SEQ ID NO: 4999926 - DNA, 16 bp, Homo sapiens
tggatgcacagtgcct

SEQ ID NO: 4999927 - DNA, 17 bp, Homo sapiens
tggatgcacagtgcctg

SEQ ID NO: 4999928 - DNA, 23 bp, Homo sapiens
tggatgcggaacccaaattacgt

SEQ ID NO: 4999929 - DNA, 24 bp, Homo sapiens
tggatgtccctattctgccatggg

SEQ ID NO: 4999930 - DNA, 17 bp, Homo sapiens
tggcactgtccagggcc

SEQ ID NO: 4999931 - DNA, 18 bp, Homo sapiens
tggcactgtccagggccc

SEQ ID NO: 4999932 - DNA, 21 bp, Homo sapiens
tggcactgtggaactgccacc

SEQ ID NO: 4999933 - DNA, 19 bp, Homo sapiens
tggcagaaagatggagagg

SEQ ID NO: 4999934 - DNA, 21 bp, Homo sapiens
tggcagaaagatggagaggca

SEQ ID NO: 4999935 - DNA, 17 bp, Homo sapiens
tggcaggggcagtggcc

SEQ ID NO: 4999936 - DNA, 15 bp, Homo sapiens
tggcatctcccacac

SEQ ID NO: 4999937 - DNA, 13 bp, Homo sapiens
tggcccagagagg

SEQ ID NO: 4999938 - DNA, 21 bp, Homo sapiens
tggccgactcagggacctaag

SEQ ID NO: 4999939 - DNA, 14 bp, Homo sapiens
tggctgacctgctg

SEQ ID NO: 4999940 - DNA, 19 bp, Homo sapiens
tgggaaaatggcagaaaga

SEQ ID NO: 4999941 - DNA, 13 bp, Homo sapiens
tgggagagtccag

SEQ ID NO: 4999942 - DNA, 17 bp, Homo sapiens
tgggagagtccaggcct

SEQ ID NO: 4999943 - DNA, 18 bp, Homo sapiens
tgggagagtccaggcctg

SEQ ID NO: 4999944 - DNA, 18 bp, Homo sapiens
tgggagcctgaggcatga

SEQ ID NO: 4999945 - DNA, 19 bp, Homo sapiens
tgggagcctgaggcatgag

SEQ ID NO: 4999946 - DNA, 23 bp, Homo sapiens
tgggaggtcttggccgactcagg

SEQ ID NO: 4999947 - DNA, 20 bp, Homo sapiens
tgggatataagaggcagcgt

SEQ ID NO: 4999948 - DNA, 12 bp, Homo sapiens
tgggcagctgcc

SEQ ID NO: 4999949 - DNA, 13 bp, Homo sapiens
tgggcagctgcct

SEQ ID NO: 4999950 - DNA, 14 bp, Homo sapiens
tgggccagtggcac

SEQ ID NO: 4999951 - DNA, 11 bp, Homo sapiens
tgggcccagag

SEQ ID NO: 4999952 - DNA, 14 bp, Homo sapiens
tgggctcagggcca

SEQ ID NO: 4999953 - DNA, 15 bp, Homo sapiens
tgggctcagggccag

SEQ ID NO: 4999954 - DNA, 23 bp, Homo sapiens
tggggcagagtggagcccagggt

SEQ ID NO: 4999955 - DNA, 23 bp, Homo sapiens
tgggggtaaagccctcagatccc

SEQ ID NO: 4999956 - DNA, 21 bp, Homo sapiens
tgggtagaaagagatacagag

SEQ ID NO: 4999957 - DNA, 13 bp, Homo sapiens
tgggtcaaggaat

SEQ ID NO: 4999958 - DNA, 20 bp, Homo sapiens
tggtgccagatcctcttctc

SEQ ID NO: 4999959 - DNA, 21 bp, Homo sapiens
tggtgccagatcctcttctca

SEQ ID NO: 4999960 - DNA, 15 bp, Homo sapiens
tggtttgcaaggaag

SEQ ID NO: 4999961 - DNA, 11 bp, Homo sapiens
tgtaataaact

SEQ ID NO: 4999962 - DNA, 13 bp, Homo sapiens
tgtaataaactct

SEQ ID NO: 4999963 - DNA, 14 bp, Homo sapiens
tgtaataaactctc

SEQ ID NO: 4999964 - DNA, 19 bp, Homo sapiens
tgtagctggcaagctgcaa

SEQ ID NO: 4999965 - DNA, 22 bp, Homo sapiens
tgtagctggcaagctgcaaaag

SEQ ID NO: 4999966 - DNA, 19 bp, Homo sapiens
tgtattgcatatatacata

SEQ ID NO: 4999967 - DNA, 22 bp, Homo sapiens
tgtcacttgtaggtttctctgc

SEQ ID NO: 4999968 - DNA, 18 bp, Homo sapiens
tgtcagtcccactgcacc

SEQ ID NO: 4999969 - DNA, 20 bp, Homo sapiens
tgtccaggtctagaaggcca

SEQ ID NO: 4999970 - DNA, 12 bp, Homo sapiens
tgtcccacaggg

SEQ ID NO: 4999971 - DNA, 18 bp, Homo sapiens
tgtcccacagggaccaca

SEQ ID NO: 4999972 - DNA, 18 bp, Homo sapiens
tgtccctattctgccatg

SEQ ID NO: 4999973 - DNA, 18 bp, Homo sapiens
tgtctctgaggctctcca

SEQ ID NO: 4999974 - DNA, 12 bp, Homo sapiens
tgtgccaaacta

SEQ ID NO: 4999975 - DNA, 16 bp, Homo sapiens
tgtgccctagggctca

SEQ ID NO: 4999976 - DNA, 13 bp, Homo sapiens
tgtggcaggggca

SEQ ID NO: 4999977 - DNA, 15 bp, Homo sapiens
tgtggcaggggcagt

SEQ ID NO: 4999978 - DNA, 17 bp, Homo sapiens
tgtggcaggggcagtgg

SEQ ID NO: 4999979 - DNA, 23 bp, Homo sapiens
tgtggcaggggcagtggcctgga

SEQ ID NO: 4999980 - DNA, 15 bp, Homo sapiens
tgtgggtcaaggaat

SEQ ID NO: 4999981 - DNA, 13 bp, Homo sapiens
tgtggtgatgaaa

SEQ ID NO: 4999982 - DNA, 14 bp, Homo sapiens
tgtggttaatgcca

SEQ ID NO: 4999983 - DNA, 10 bp, Homo sapiens
tgtgtaaatg

SEQ ID NO: 4999984 - DNA, 14 bp, Homo sapiens
tgttctcaggggtg

SEQ ID NO: 4999985 - DNA, 14 bp, Homo sapiens
aagccacagctggt

SEQ ID NO: 4999986 - DNA, 12 bp, Homo sapiens
aagccctcagat

SEQ ID NO: 4999987 - DNA, 16 bp, Homo sapiens
aagctcaggttccctg

SEQ ID NO: 4999988 - DNA, 19 bp, Homo sapiens
aagctcaggttccctgcca

SEQ ID NO: 4999989 - DNA, 21 bp, Homo sapiens
aagctcaggttccctgccaca

SEQ ID NO: 4999990 - DNA, 19 bp, Homo sapiens
aagctgctgggccagtggc

SEQ ID NO: 4999991 - DNA, 12 bp, Homo sapiens
aagctgttccac

SEQ ID NO: 4999992 - DNA, 23 bp, Homo sapiens
aagctgttctcattcctgttctt

SEQ ID NO: 4999993 - DNA, 12 bp, Homo sapiens
aaggaaggatgc

SEQ ID NO: 4999994 - DNA, 13 bp, Homo sapiens
aaggaaggatgcc

SEQ ID NO: 4999995 - DNA, 13 bp, Homo sapiens
aaggcggcaggca

SEQ ID NO: 4999996 - DNA, 16 bp, Homo sapiens
aaggcggcaggcagag

SEQ ID NO: 4999997 - DNA, 19 bp, Homo sapiens
aaggcggcaggcagagaag

SEQ ID NO: 4999998 - DNA, 19 bp, Homo sapiens
aagggtatgagctggagct

SEQ ID NO: 4999999 - DNA, 12 bp, Homo sapiens
aaggtgctgcca

SEQ ID NO: 5000000 - DNA, 14 bp, Homo sapiens
aaggtgctgccacc

SEQ ID NO: 5000001 - DNA, 15 bp, Homo sapiens
aaggtgctgccaccc

SEQ ID NO: 5000002 - DNA, 17 bp, Homo sapiens
aaggtgctgccacccct

SEQ ID NO: 5000003 - DNA, 13 bp, Homo sapiens
aaggttgtattgc

SEQ ID NO: 5000004 - DNA, 20 bp, Homo sapiens
aagtattttatctgtgttgt

SEQ ID NO: 5000005 - DNA, 16 bp, Homo sapiens
aagtcttttttgatca

SEQ ID NO: 5000006 - DNA, 17 bp, Homo sapiens
aagtgatttttttgtcc

SEQ ID NO: 5000007 - DNA, 14 bp, Homo sapiens
aataaaatgggttt

SEQ ID NO: 5000008 - DNA, 15 bp, Homo sapiens
aataaagctgttctc

SEQ ID NO: 5000009 - DNA, 14 bp, Homo sapiens
aataaatgtgtaaa

SEQ ID NO: 5000010 - DNA, 18 bp, Homo sapiens
aatagctgtgtatctgtt

SEQ ID NO: 5000011 - DNA, 14 bp, Homo sapiens
aatatacaaacatg

SEQ ID NO: 5000012 - DNA, 19 bp, Homo sapiens
aatattctattttgcagat

SEQ ID NO: 5000013 - DNA, 13 bp, Homo sapiens
aatcactgggccc

SEQ ID NO: 5000014 - DNA, 17 bp, Homo sapiens
aatcactgggcccagag

SEQ ID NO: 5000015 - DNA, 15 bp, Homo sapiens
aatccaatacctctt

SEQ ID NO: 5000016 - DNA, 19 bp, Homo sapiens
aatctgaactctaagcaga

SEQ ID NO: 5000017 - DNA, 18 bp, Homo sapiens
aatgcaacaacatgtata

SEQ ID NO: 5000018 - DNA, 22 bp, Homo sapiens
aatgccatgactgctcaggcct

SEQ ID NO: 5000019 - DNA, 21 bp, Homo sapiens
aatgccatggacagaagaagg

SEQ ID NO: 5000020 - DNA, 17 bp, Homo sapiens
aatgctgccatgcccac

SEQ ID NO: 5000021 - DNA, 15 bp, Homo sapiens
aatgctttccaaaac

SEQ ID NO: 5000022 - DNA, 17 bp, Homo sapiens
aatggcacagcccaaag

SEQ ID NO: 5000023 - DNA, 12 bp, Homo sapiens
aatggctgtgcc

SEQ ID NO: 5000024 - DNA, 19 bp, Homo sapiens
aatggctgtgccccacctg

SEQ ID NO: 5000025 - DNA, 12 bp, Homo sapiens
aattaacactgc

SEQ ID NO: 5000026 - DNA, 21 bp, Homo sapiens
aatttcattctcttgaaggtg

SEQ ID NO: 5000027 - DNA, 15 bp, Homo sapiens
aatttggcccagaga

SEQ ID NO: 5000028 - DNA, 16 bp, Homo sapiens
acacagaccctgccca

SEQ ID NO: 5000029 - DNA, 18 bp, Homo sapiens
acaccactttgtctctga

SEQ ID NO: 5000030 - DNA, 23 bp, Homo sapiens
acaccagccatcatgtgcctgga

SEQ ID NO: 5000031 - DNA, 16 bp, Homo sapiens
acacccacctgctgct

SEQ ID NO: 5000032 - DNA, 18 bp, Homo sapiens
acacccacctgctgctgt

SEQ ID NO: 5000033 - DNA, 21 bp, Homo sapiens
acactatttgagttggccaag

SEQ ID NO: 5000034 - DNA, 23 bp, Homo sapiens
acactcttctccattccctccac

SEQ ID NO: 5000035 - DNA, 14 bp, Homo sapiens
acactggctcctgg

SEQ ID NO: 5000036 - DNA, 13 bp, Homo sapiens
acactgtcttgaa

SEQ ID NO: 5000037 - DNA, 16 bp, Homo sapiens
acagacacacactggc

SEQ ID NO: 5000038 - DNA, 17 bp, Homo sapiens
acagacacacactggct

SEQ ID NO: 5000039 - DNA, 23 bp, Homo sapiens
acagacacacactggctcctgga

SEQ ID NO: 5000040 - DNA, 13 bp, Homo sapiens
acagaccctgccc

SEQ ID NO: 5000041 - DNA, 18 bp, Homo sapiens
acagagctgggatgtttc

SEQ ID NO: 5000042 - DNA, 13 bp, Homo sapiens
acagcagctggac

SEQ ID NO: 5000043 - DNA, 14 bp, Homo sapiens
acagcagctggact

SEQ ID NO: 5000044 - DNA, 13 bp, Homo sapiens
acagcaggaggca

SEQ ID NO: 5000045 - DNA, 16 bp, Homo sapiens
acagcaggaggcacag

SEQ ID NO: 5000046 - DNA, 17 bp, Homo sapiens
acagcccaaagaaggaa

SEQ ID NO: 5000047 - DNA, 19 bp, Homo sapiens
acagctaataaaagtcaga

SEQ ID NO: 5000048 - DNA, 21 bp, Homo sapiens
acagctaataaaagtcagagc

SEQ ID NO: 5000049 - DNA, 22 bp, Homo sapiens
acagctaataaaagtcagagct

SEQ ID NO: 5000050 - DNA, 24 bp, Homo sapiens
acagctaataaaagtcagagctca

SEQ ID NO: 5000051 - DNA, 20 bp, Homo sapiens
acaggaggagtgggacagac

SEQ ID NO: 5000052 - DNA, 23 bp, Homo sapiens
acaggcaaatccgaaatcagcag

SEQ ID NO: 5000053 - DNA, 21 bp, Homo sapiens
acagggaccacatccacccca

SEQ ID NO: 5000054 - DNA, 24 bp, Homo sapiens
acagtgcctgatgggagtaggctc

SEQ ID NO: 5000055 - DNA, 20 bp, Homo sapiens
acagtgctgaccagacagcc

SEQ ID NO: 5000056 - DNA, 13 bp, Homo sapiens
acataaaatatac

SEQ ID NO: 5000057 - DNA, 19 bp, Homo sapiens
acataaaatatacaaacat

SEQ ID NO: 5000058 - DNA, 13 bp, Homo sapiens
acatcaacattcc

SEQ ID NO: 5000059 - DNA, 14 bp, Homo sapiens
acatcactgagaag

SEQ ID NO: 5000060 - DNA, 13 bp, Homo sapiens
acatccaccccag

SEQ ID NO: 5000061 - DNA, 16 bp, Homo sapiens
acatgcagctctgatg

SEQ ID NO: 5000062 - DNA, 11 bp, Homo sapiens
acatggagctc

SEQ ID NO: 5000063 - DNA, 22 bp, Homo sapiens
acattccgaggggctcagttct

SEQ ID NO: 5000064 - DNA, 17 bp, Homo sapiens
accaaatataaacttgt

SEQ ID NO: 5000065 - DNA, 16 bp, Homo sapiens
accaattccacttcct

SEQ ID NO: 5000066 - DNA, 22 bp, Homo sapiens
accaattccacttcctgcccca

SEQ ID NO: 5000067 - DNA, 23 bp, Homo sapiens
accaattccacttcctgccccaa

SEQ ID NO: 5000068 - DNA, 16 bp, Homo sapiens
accacacatctgtgga

SEQ ID NO: 5000069 - DNA, 19 bp, Homo sapiens
accacatccaccccagccc

SEQ ID NO: 5000070 - DNA, 13 bp, Homo sapiens
accagacccttct

SEQ ID NO: 5000071 - DNA, 19 bp, Homo sapiens
accagtcctgctgcctgga

SEQ ID NO: 5000072 - DNA, 14 bp, Homo sapiens
accatgggctcagg

SEQ ID NO: 5000073 - DNA, 15 bp, Homo sapiens
accatgggctcaggg

SEQ ID NO: 5000074 - DNA, 16 bp, Homo sapiens
accatgggctcagggc

SEQ ID NO: 5000075 - DNA, 18 bp, Homo sapiens
accatgggctcagggcca

SEQ ID NO: 5000076 - DNA, 23 bp, Homo sapiens
accatgggctcagggccaggtcc

SEQ ID NO: 5000077 - DNA, 21 bp, Homo sapiens
acccaaataaatgtgtaaatg

SEQ ID NO: 5000078 - DNA, 17 bp, Homo sapiens
acccaagtagctgctac

SEQ ID NO: 5000079 - DNA, 16 bp, Homo sapiens
acccacctgctgctgt

SEQ ID NO: 5000080 - DNA, 17 bp, Homo sapiens
acccacttgcctgtcac

SEQ ID NO: 5000081 - DNA, 18 bp, Homo sapiens
acccacttgcctgtcacc

SEQ ID NO: 5000082 - DNA, 15 bp, Homo sapiens
accccaaagtccagg

SEQ ID NO: 5000083 - DNA, 14 bp, Homo sapiens
accccagccccact

SEQ ID NO: 5000084 - DNA, 17 bp, Homo sapiens
accccatccctggctga

SEQ ID NO: 5000085 - DNA, 18 bp, Homo sapiens
acccccctgtgcctgctg

SEQ ID NO: 5000086 - DNA, 21 bp, Homo sapiens
acccccctgtgcctgctgggc

SEQ ID NO: 5000087 - DNA, 22 bp, Homo sapiens
accctgcccaccccatccctgg

SEQ ID NO: 5000088 - DNA, 17 bp, Homo sapiens
accctgggctccctgga

SEQ ID NO: 5000089 - DNA, 21 bp, Homo sapiens
accctgggctccctggaggac

SEQ ID NO: 5000090 - DNA, 20 bp, Homo sapiens
acctaaagggtatgagctgg

SEQ ID NO: 5000091 - DNA, 12 bp, Homo sapiens
acctccctgcaa

SEQ ID NO: 5000092 - DNA, 13 bp, Homo sapiens
acctccctgcaat

SEQ ID NO: 5000093 - DNA, 22 bp, Homo sapiens
acctccttcctcagtcctggaa

SEQ ID NO: 5000094 - DNA, 14 bp, Homo sapiens
acctggttgtccag

SEQ ID NO: 5000095 - DNA, 17 bp, Homo sapiens
acctggttgtccaggtc

SEQ ID NO: 5000096 - DNA, 16 bp, Homo sapiens
accttgggtctgtgtc

SEQ ID NO: 5000097 - DNA, 19 bp, Homo sapiens
accttgggtctgtgtcact

SEQ ID NO: 5000098 - DNA, 19 bp, Homo sapiens
acgctcaaggaaggatgcc

SEQ ID NO: 5000099 - DNA, 22 bp, Homo sapiens
acgctcaaggaaggatgcctta

SEQ ID NO: 5000100 - DNA, 22 bp, Homo sapiens
acgtgctcttctgttctcaaat

SEQ ID NO: 5000101 - DNA, 18 bp, Homo sapiens
acgtgtactacaatttaa

SEQ ID NO: 5000102 - DNA, 18 bp, Homo sapiens
actaagtagaataaagaa

SEQ ID NO: 5000103 - DNA, 21 bp, Homo sapiens
actaatccaatacctcttgga

SEQ ID NO: 5000104 - DNA, 12 bp, Homo sapiens
actcaatatttt

SEQ ID NO: 5000105 - DNA, 15 bp, Homo sapiens
actcaatattttcca

SEQ ID NO: 5000106 - DNA, 18 bp, Homo sapiens
actcaatattttccatga

SEQ ID NO: 5000107 - DNA, 18 bp, Homo sapiens
actccattactaaagaca

SEQ ID NO: 5000108 - DNA, 21 bp, Homo sapiens
actccattactaaagacagaa

SEQ ID NO: 5000109 - DNA, 16 bp, Homo sapiens
actctccactgacctg

SEQ ID NO: 5000110 - DNA, 14 bp, Homo sapiens
actctgcctaacca

SEQ ID NO: 5000111 - DNA, 18 bp, Homo sapiens
gtaggctccagacaggag

SEQ ID NO: 5000112 - DNA, 19 bp, Homo sapiens
gtaggctccagacaggagg

SEQ ID NO: 5000113 - DNA, 21 bp, Homo sapiens
gtatcattttgcacgtgctct

SEQ ID NO: 5000114 - DNA, 23 bp, Homo sapiens
gtatgtttttgtgtatttgttaa

SEQ ID NO: 5000115 - DNA, 22 bp, Homo sapiens
gtattttatctgtgttgtctct

SEQ ID NO: 5000116 - DNA, 22 bp, Homo sapiens
gtcacctaagcaatcactgggc

SEQ ID NO: 5000117 - DNA, 21 bp, Homo sapiens
gtcacttgtaggtttctctgc

SEQ ID NO: 5000118 - DNA, 13 bp, Homo sapiens
gtcagagctcagg

SEQ ID NO: 5000119 - DNA, 21 bp, Homo sapiens
gtcagccctcactgtcagtcc

SEQ ID NO: 5000120 - DNA, 13 bp, Homo sapiens
gtcagtagccaga

SEQ ID NO: 5000121 - DNA, 17 bp, Homo sapiens
gtcagtcccactgcacc

SEQ ID NO: 5000122 - DNA, 18 bp, Homo sapiens
gtcagtcccactgcaccc

SEQ ID NO: 5000123 - DNA, 15 bp, Homo sapiens
gtcatgtgcctctgt

SEQ ID NO: 5000124 - DNA, 18 bp, Homo sapiens
gtcatgtgcctctgtcct

SEQ ID NO: 5000125 - DNA, 13 bp, Homo sapiens
gtccaggcctggg

SEQ ID NO: 5000126 - DNA, 20 bp, Homo sapiens
gtccaggtctagaaggccag

SEQ ID NO: 5000127 - DNA, 21 bp, Homo sapiens
gtccaggtctagaaggccagg

SEQ ID NO: 5000128 - DNA, 15 bp, Homo sapiens
gtcccacagggacca

SEQ ID NO: 5000129 - DNA, 16 bp, Homo sapiens
gtcccacagggaccac

SEQ ID NO: 5000130 - DNA, 23 bp, Homo sapiens
gtcccacagggaccacatccacc

SEQ ID NO: 5000131 - DNA, 20 bp, Homo sapiens
gtccctattctgccatggga

SEQ ID NO: 5000132 - DNA, 14 bp, Homo sapiens
gtcctgctgcctgg

SEQ ID NO: 5000133 - DNA, 18 bp, Homo sapiens
gtcctgctgcctggagtc

SEQ ID NO: 5000134 - DNA, 19 bp, Homo sapiens
gtcctgctgcctggagtca

SEQ ID NO: 5000135 - DNA, 22 bp, Homo sapiens
gtcctgctgcctggagtcagta

SEQ ID NO: 5000136 - DNA, 13 bp, Homo sapiens
gtccttcaaaggc

SEQ ID NO: 5000137 - DNA, 20 bp, Homo sapiens
gtccttttagcacatcactg

SEQ ID NO: 5000138 - DNA, 15 bp, Homo sapiens
gtcgtagttactctc

SEQ ID NO: 5000139 - DNA, 16 bp, Homo sapiens
gtctagaaggccaggc

SEQ ID NO: 5000140 - DNA, 13 bp, Homo sapiens
gtctagtcctggg

SEQ ID NO: 5000141 - DNA, 10 bp, Homo sapiens
gtctctgagg

SEQ ID NO: 5000142 - DNA, 17 bp, Homo sapiens
gtctctgaggctctcca

SEQ ID NO: 5000143 - DNA, 19 bp, Homo sapiens
gtctgaccaaaaccagagg

SEQ ID NO: 5000144 - DNA, 22 bp, Homo sapiens
gtcttggccgactcagggacct

SEQ ID NO: 5000145 - DNA, 18 bp, Homo sapiens
gtgaatggctgtgcccca

SEQ ID NO: 5000146 - DNA, 22 bp, Homo sapiens
gtgccaaactaccgttcccaaa

SEQ ID NO: 5000147 - DNA, 15 bp, Homo sapiens
gtgccagatcctctt

SEQ ID NO: 5000148 - DNA, 17 bp, Homo sapiens
gtgccccagctaggaag

SEQ ID NO: 5000149 - DNA, 24 bp, Homo sapiens
gtgcctgatgggagtaggctccag

SEQ ID NO: 5000150 - DNA, 18 bp, Homo sapiens
gtgctcttctgttctcaa

SEQ ID NO: 5000151 - DNA, 12 bp, Homo sapiens
gtgctggggcag

SEQ ID NO: 5000152 - DNA, 24 bp, Homo sapiens
gtgctggggcagagtggagcccag

SEQ ID NO: 5000153 - DNA, 23 bp, Homo sapiens
gtggaactgccaccttgggtctg

SEQ ID NO: 5000154 - DNA, 17 bp, Homo sapiens
gtggcaggacactgcag

SEQ ID NO: 5000155 - DNA, 17 bp, Homo sapiens
gtgggacagacagcagc

SEQ ID NO: 5000156 - DNA, 19 bp, Homo sapiens
gtgggacagacagcagctg

SEQ ID NO: 5000157 - DNA, 14 bp, Homo sapiens
gtggggaggggctg

SEQ ID NO: 5000158 - DNA, 14 bp, Homo sapiens
gtgggtcaaggaat

SEQ ID NO: 5000159 - DNA, 17 bp, Homo sapiens
gtgtgccctagggctca

SEQ ID NO: 5000160 - DNA, 21 bp, Homo sapiens
gtgtgccctagggctcagagg

SEQ ID NO: 5000161 - DNA, 13 bp, Homo sapiens
gttcagagctgcc

SEQ ID NO: 5000162 - DNA, 17 bp, Homo sapiens
gttcagagctgccctct

SEQ ID NO: 5000163 - DNA, 14 bp, Homo sapiens
gttcagggatgctc

SEQ ID NO: 5000164 - DNA, 14 bp, Homo sapiens
gttccacttctcta

SEQ ID NO: 5000165 - DNA, 14 bp, Homo sapiens
gttctcaaatgcta

SEQ ID NO: 5000166 - DNA, 21 bp, Homo sapiens
gttctcattcctgttctttct

SEQ ID NO: 5000167 - DNA, 11 bp, Homo sapiens
gttctgcctta

SEQ ID NO: 5000168 - DNA, 19 bp, Homo sapiens
gttgacttgacagaacact

SEQ ID NO: 5000169 - DNA, 23 bp, Homo sapiens
gttgtccaggtctagaaggccag

SEQ ID NO: 5000170 - DNA, 13 bp, Homo sapiens
gttgtctctctaa

SEQ ID NO: 5000171 - DNA, 13 bp, Homo sapiens
gtttctctgcctc

SEQ ID NO: 5000172 - DNA, 18 bp, Homo sapiens
gtttctgaatgacatcaa

SEQ ID NO: 5000173 - DNA, 15 bp, Homo sapiens
gtttttaactcaata

SEQ ID NO: 5000174 - DNA, 13 bp, Homo sapiens
taaaaacataaaa

SEQ ID NO: 5000175 - DNA, 17 bp, Homo sapiens
taaaaacataaaatata

SEQ ID NO: 5000176 - DNA, 18 bp, Homo sapiens
taaaagtcagagctcagg

SEQ ID NO: 5000177 - DNA, 20 bp, Homo sapiens
taaagccctcagatcccagg

SEQ ID NO: 5000178 - DNA, 14 bp, Homo sapiens
taaagctgttctca

SEQ ID NO: 5000179 - DNA, 20 bp, Homo sapiens
taaatgcaaacactgtgtat

SEQ ID NO: 5000180 - DNA, 18 bp, Homo sapiens
taaatgttatagctgcat

SEQ ID NO: 5000181 - DNA, 15 bp, Homo sapiens
taactagcttggaaa

SEQ ID NO: 5000182 - DNA, 15 bp, Homo sapiens
taagaggcagcgtga

SEQ ID NO: 5000183 - DNA, 15 bp, Homo sapiens
taagcaatcactggg

SEQ ID NO: 5000184 - DNA, 20 bp, Homo sapiens
taagcaatcactgggcccag

SEQ ID NO: 5000185 - DNA, 18 bp, Homo sapiens
taagcagaagactctcca

SEQ ID NO: 5000186 - DNA, 15 bp, Homo sapiens
taataaaagtcagag

SEQ ID NO: 5000187 - DNA, 14 bp, Homo sapiens
taataaactctcta

SEQ ID NO: 5000188 - DNA, 17 bp, Homo sapiens
taatatatacaaacctt

SEQ ID NO: 5000189 - DNA, 21 bp, Homo sapiens
taattaaataaaaatctgtgg

SEQ ID NO: 5000190 - DNA, 16 bp, Homo sapiens
tacacaagagctggag

SEQ ID NO: 5000191 - DNA, 12 bp, Homo sapiens
tacacagaccct

SEQ ID NO: 5000192 - DNA, 18 bp, Homo sapiens
tacacagaccctgcccac

SEQ ID NO: 5000193 - DNA, 20 bp, Homo sapiens
tacacagaccctgcccaccc

SEQ ID NO: 5000194 - DNA, 20 bp, Homo sapiens
tacatcttttcaacaagtaa

SEQ ID NO: 5000195 - DNA, 16 bp, Homo sapiens
tacatggagctcaggt

SEQ ID NO: 5000196 - DNA, 21 bp, Homo sapiens
tacatggagctcaggtttctg

SEQ ID NO: 5000197 - DNA, 14 bp, Homo sapiens
taccaaatataaac

SEQ ID NO: 5000198 - DNA, 20 bp, Homo sapiens
taccacacatctgtggagat

SEQ ID NO: 5000199 - DNA, 16 bp, Homo sapiens
taccccaaagtccagg

SEQ ID NO: 5000200 - DNA, 14 bp, Homo sapiens
tactagctctttga

SEQ ID NO: 5000201 - DNA, 21 bp, Homo sapiens
tactaggtctgctcctgaacc

SEQ ID NO: 5000202 - DNA, 22 bp, Homo sapiens
tactcttcagaatatggacaaa

SEQ ID NO: 5000203 - DNA, 17 bp, Homo sapiens
tagaaagacagagctgg

SEQ ID NO: 5000204 - DNA, 15 bp, Homo sapiens
tagaataaagaaaaa

SEQ ID NO: 5000205 - DNA, 16 bp, Homo sapiens
tagaataaagaaaaac

SEQ ID NO: 5000206 - DNA, 15 bp, Homo sapiens
tagaatttggcccag

SEQ ID NO: 5000207 - DNA, 22 bp, Homo sapiens
tagagcttccactgtcagccct

SEQ ID NO: 5000208 - DNA, 21 bp, Homo sapiens
tagaggatgtggcaggggcag

SEQ ID NO: 5000209 - DNA, 15 bp, Homo sapiens
tagcacatcactgag

SEQ ID NO: 5000210 - DNA, 23 bp, Homo sapiens
tagcacatcactgagaagatggc

SEQ ID NO: 5000211 - DNA, 14 bp, Homo sapiens
tagcagctgctact

SEQ ID NO: 5000212 - DNA, 22 bp, Homo sapiens
tagccagagttgttctcagggg

SEQ ID NO: 5000213 - DNA, 20 bp, Homo sapiens
tagctgcatttgtctggcct

SEQ ID NO: 5000214 - DNA, 20 bp, Homo sapiens
tagctgtgaatggctgtgcc

SEQ ID NO: 5000215 - DNA, 14 bp, Homo sapiens
taggctccagacag

SEQ ID NO: 5000216 - DNA, 15 bp, Homo sapiens
taggctccagacagg

SEQ ID NO: 5000217 - DNA, 21 bp, Homo sapiens
tagggaatggcacagcccaaa

SEQ ID NO: 5000218 - DNA, 13 bp, Homo sapiens
tagggctcagagg

SEQ ID NO: 5000219 - DNA, 14 bp, Homo sapiens
tagggctcagaggg

SEQ ID NO: 5000220 - DNA, 23 bp, Homo sapiens
taggtctgaccaaaaccagaggg

SEQ ID NO: 5000221 - DNA, 14 bp, Homo sapiens
taggttgtagcaga

SEQ ID NO: 5000222 - DNA, 21 bp, Homo sapiens
taggtttctctgcctccaggt

SEQ ID NO: 5000223 - DNA, 15 bp, Homo sapiens
tagttaggtgtgcca

SEQ ID NO: 5000224 - DNA, 21 bp, Homo sapiens
tagttaggtgtgccaaactac

SEQ ID NO: 5000225 - DNA, 18 bp, Homo sapiens
tatctgtgtgccctaggg

SEQ ID NO: 5000226 - DNA, 20 bp, Homo sapiens
tatctgtgtgccctagggct

SEQ ID NO: 5000227 - DNA, 16 bp, Homo sapiens
tatctgtttttccata

SEQ ID NO: 5000228 - DNA, 18 bp, Homo sapiens
tatctgtttttccataag

SEQ ID NO: 5000229 - DNA, 14 bp, Homo sapiens
tatgaatagctgtg

SEQ ID NO: 5000230 - DNA, 16 bp, Homo sapiens
tatgaccttctaggaa

SEQ ID NO: 5000231 - DNA, 18 bp, Homo sapiens
tatgaccttctaggaagc

SEQ ID NO: 5000232 - DNA, 13 bp, Homo sapiens
tatgatccaagta

SEQ ID NO: 5000233 - DNA, 18 bp, Homo sapiens
tatgatgtgggtcaagga

SEQ ID NO: 5000234 - DNA, 22 bp, Homo sapiens
tatttcaatttccaagagctga

SEQ ID NO: 5000235 - DNA, 20 bp, Homo sapiens
tatttcttaaacaaatgtat

SEQ ID NO: 5000236 - DNA, 22 bp, Homo sapiens
tatttgttaatggtttgaatat

SEQ ID NO: 5000237 - DNA, 19 bp, Homo sapiens
tggcactgtccagggccca

SEQ ID NO: 5000238 - DNA, 20 bp, Homo sapiens
tggcactgtccagggcccat

SEQ ID NO: 5000239 - DNA, 21 bp, Homo sapiens
tggcaggacactgcagaacag

SEQ ID NO: 5000240 - DNA, 15 bp, Homo sapiens
tggcaggggcagtgg

SEQ ID NO: 5000241 - DNA, 20 bp, Homo sapiens
tggcaggggcagtggcctgg

SEQ ID NO: 5000242 - DNA, 24 bp, Homo sapiens
tggcaggggcagtggcctggatgc

SEQ ID NO: 5000243 - DNA, 12 bp, Homo sapiens
tggcccagagag

SEQ ID NO: 5000244 - DNA, 13 bp, Homo sapiens
tggccgactcagg

SEQ ID NO: 5000245 - DNA, 15 bp, Homo sapiens
tggccgactcaggga

SEQ ID NO: 5000246 - DNA, 20 bp, Homo sapiens
tggcctggatgcacagtgcc

SEQ ID NO: 5000247 - DNA, 23 bp, Homo sapiens
tggcctggatgcacagtgcctga

SEQ ID NO: 5000248 - DNA, 18 bp, Homo sapiens
tggctatattaggcatgt

SEQ ID NO: 5000249 - DNA, 13 bp, Homo sapiens
tggctcctggacc

SEQ ID NO: 5000250 - DNA, 15 bp, Homo sapiens
tggctgacctgctgt

SEQ ID NO: 5000251 - DNA, 15 bp, Homo sapiens
tgggaaaatggcaga

SEQ ID NO: 5000252 - DNA, 16 bp, Homo sapiens
tgggaaaatggcagaa

SEQ ID NO: 5000253 - DNA, 14 bp, Homo sapiens
tgggagagtccagg

SEQ ID NO: 5000254 - DNA, 16 bp, Homo sapiens
tgggagtaggctccag

SEQ ID NO: 5000255 - DNA, 20 bp, Homo sapiens
tgggagtaggctccagacag

SEQ ID NO: 5000256 - DNA, 23 bp, Homo sapiens
tgggatggctatattaggcatgt

SEQ ID NO: 5000257 - DNA, 20 bp, Homo sapiens
tgggcactagctagatgctt

SEQ ID NO: 5000258 - DNA, 14 bp, Homo sapiens
tgggcagctgcctc

SEQ ID NO: 5000259 - DNA, 17 bp, Homo sapiens
tgggcagctgcctcccc

SEQ ID NO: 5000260 - DNA, 19 bp, Homo sapiens
tgggcagctgcctcccctc

SEQ ID NO: 5000261 - DNA, 22 bp, Homo sapiens
tgggcagctgcctcccctcctc

SEQ ID NO: 5000262 - DNA, 23 bp, Homo sapiens
tgggcagctgcctcccctcctct

SEQ ID NO: 5000263 - DNA, 21 bp, Homo sapiens
tgggcaggtctcctctgggag

SEQ ID NO: 5000264 - DNA, 12 bp, Homo sapiens
tgggccagtggc

SEQ ID NO: 5000265 - DNA, 13 bp, Homo sapiens
tgggccagtggca

SEQ ID NO: 5000266 - DNA, 23 bp, Homo sapiens
tgggccagtggcactctgtgtgg

SEQ ID NO: 5000267 - DNA, 12 bp, Homo sapiens
tgggcccagagg

SEQ ID NO: 5000268 - DNA, 13 bp, Homo sapiens
tgggcccagagga

SEQ ID NO: 5000269 - DNA, 11 bp, Homo sapiens
tgggctcaggg

SEQ ID NO: 5000270 - DNA, 17 bp, Homo sapiens
tgggctcagggccaggt

SEQ ID NO: 5000271 - DNA, 19 bp, Homo sapiens
tgggctcagggccaggtcc

SEQ ID NO: 5000272 - DNA, 22 bp, Homo sapiens
tgggctcagggccaggtcctca

SEQ ID NO: 5000273 - DNA, 15 bp, Homo sapiens
tgggctccctggagg

SEQ ID NO: 5000274 - DNA, 16 bp, Homo sapiens
tgggctccctggagga

SEQ ID NO: 5000275 - DNA, 15 bp, Homo sapiens
tggggaggggctgag

SEQ ID NO: 5000276 - DNA, 16 bp, Homo sapiens
tggggaggggctgagg

SEQ ID NO: 5000277 - DNA, 17 bp, Homo sapiens
tggggcagagtggagcc

SEQ ID NO: 5000278 - DNA, 22 bp, Homo sapiens
tggggcagagtggagcccaggg

SEQ ID NO: 5000279 - DNA, 15 bp, Homo sapiens
tgggggcccaaaggg

SEQ ID NO: 5000280 - DNA, 17 bp, Homo sapiens
tgggtcacgctcaagga

SEQ ID NO: 5000281 - DNA, 14 bp, Homo sapiens
tggtcaccatgaaa

SEQ ID NO: 5000282 - DNA, 16 bp, Homo sapiens
tggtcccagccagcag

SEQ ID NO: 5000283 - DNA, 17 bp, Homo sapiens
tggtggcagctgggcag

SEQ ID NO: 5000284 - DNA, 12 bp, Homo sapiens
tgtaataaactc

SEQ ID NO: 5000285 - DNA, 15 bp, Homo sapiens
tgtaataaactctct

SEQ ID NO: 5000286 - DNA, 12 bp, Homo sapiens
tgtactacaatt

SEQ ID NO: 5000287 - DNA, 14 bp, Homo sapiens
tgtagctggcaagc

SEQ ID NO: 5000288 - DNA, 22 bp, Homo sapiens
tgtaggtgaaaggcatctttct

SEQ ID NO: 5000289 - DNA, 18 bp, Homo sapiens
tgtatttgttaatggttt

SEQ ID NO: 5000290 - DNA, 15 bp, Homo sapiens
tgtcagtcccactgc

SEQ ID NO: 5000291 - DNA, 16 bp, Homo sapiens
tgtccagggcccatgt

SEQ ID NO: 5000292 - DNA, 21 bp, Homo sapiens
tgtccctattctgccatggga

SEQ ID NO: 5000293 - DNA, 17 bp, Homo sapiens
tgtctctgaggctctcc

SEQ ID NO: 5000294 - DNA, 19 bp, Homo sapiens
tgtgcatagagccacgtat

SEQ ID NO: 5000295 - DNA, 19 bp, Homo sapiens
tgtgccctagggctcagag

SEQ ID NO: 5000296 - DNA, 20 bp, Homo sapiens
tgtgccctagggctcagagg

SEQ ID NO: 5000297 - DNA, 18 bp, Homo sapiens
tgtgcctgctgggcactg

SEQ ID NO: 5000298 - DNA, 12 bp, Homo sapiens
tgtgcctggaaa

SEQ ID NO: 5000299 - DNA, 18 bp, Homo sapiens
tgtgctaggtctgaccaa

SEQ ID NO: 5000300 - DNA, 15 bp, Homo sapiens
tgtggaactgccacc

SEQ ID NO: 5000301 - DNA, 22 bp, Homo sapiens
tgtggagatgcccaggatttga

SEQ ID NO: 5000302 - DNA, 17 bp, Homo sapiens
tgtgggaaaatggcaga

SEQ ID NO: 5000303 - DNA, 18 bp, Homo sapiens
tgtggtttactagcagga

SEQ ID NO: 5000304 - DNA, 14 bp, Homo sapiens
tgttaaatgaaacc

SEQ ID NO: 5000305 - DNA, 17 bp, Homo sapiens
tgttaatggtttgaata

SEQ ID NO: 5000306 - DNA, 11 bp, Homo sapiens
tgttctcaggg

SEQ ID NO: 5000307 - DNA, 12 bp, Homo sapiens
tgttctcagggg

SEQ ID NO: 5000308 - DNA, 14 bp, Homo sapiens
tgttctcattcctg

SEQ ID NO: 5000309 - DNA, 22 bp, Homo sapiens
tgttctcattcctgttctttct

SEQ ID NO: 5000310 - DNA, 15 bp, Homo sapiens
tgttgtcctgaactg

SEQ ID NO: 5000311 - DNA, 12 bp, Homo sapiens
tgtttttaactc

SEQ ID NO: 5000312 - DNA, 18 bp, Homo sapiens
ttaagttagggaatggca

SEQ ID NO: 5000313 - DNA, 15 bp, Homo sapiens
ttacaaacatgtggt

SEQ ID NO: 5000314 - DNA, 19 bp, Homo sapiens
ttagctgtgaatggctgtg

SEQ ID NO: 5000315 - DNA, 21 bp, Homo sapiens
ttagctgtgaatggctgtgcc

SEQ ID NO: 5000316 - DNA, 20 bp, Homo sapiens
ttagtacatggagctcaggt

SEQ ID NO: 5000317 - DNA, 15 bp, Homo sapiens
ttatctgtgttgtct

SEQ ID NO: 5000318 - DNA, 13 bp, Homo sapiens
ttattttgtaata

SEQ ID NO: 5000319 - DNA, 14 bp, Homo sapiens
ttattttgtaataa

SEQ ID NO: 5000320 - DNA, 17 bp, Homo sapiens
ttcaatttccaagagct

SEQ ID NO: 5000321 - DNA, 14 bp, Homo sapiens
ttcacaaaatgcaa

SEQ ID NO: 5000322 - DNA, 22 bp, Homo sapiens
ttcacatcctcagaaagtgcag

SEQ ID NO: 5000323 - DNA, 12 bp, Homo sapiens
ttccaagagctg

SEQ ID NO: 5000324 - DNA, 16 bp, Homo sapiens
ttccacttcctgcccc

SEQ ID NO: 5000325 - DNA, 24 bp, Homo sapiens
ttccatgaaaatgcaacaacatgt

SEQ ID NO: 5000326 - DNA, 18 bp, Homo sapiens
ttcctcacacccacctgc

SEQ ID NO: 5000327 - DNA, 20 bp, Homo sapiens
ttcctcacacccacctgctg

SEQ ID NO: 5000328 - DNA, 17 bp, Homo sapiens
ttcctcagtcctggaag

SEQ ID NO: 5000329 - DNA, 18 bp, Homo sapiens
ttccttttcttgtctctg

SEQ ID NO: 5000330 - DNA, 19 bp, Homo sapiens
ttccttttcttgtctctga

SEQ ID NO: 5000331 - DNA, 20 bp, Homo sapiens
ttccttttcttgtctctgag

SEQ ID NO: 5000332 - DNA, 16 bp, Homo sapiens
ttctattttgcagata

SEQ ID NO: 5000333 - DNA, 18 bp, Homo sapiens
ttctattttgcagataga

SEQ ID NO: 5000334 - DNA, 11 bp, Homo sapiens
ttctctgcctc

SEQ ID NO: 5000335 - DNA, 19 bp, Homo sapiens
ttctcttgaaggtgctgcc

SEQ ID NO: 5000336 - DNA, 20 bp, Homo sapiens
ttctcttgaaggtgctgcca

SEQ ID NO: 5000337 - DNA, 21 bp, Homo sapiens
ttctctttcttattttgtaat

SEQ ID NO: 5000338 - DNA, 15 bp, Homo sapiens
ttctcttttcctttg

SEQ ID NO: 5000339 - DNA, 15 bp, Homo sapiens
ttcttacaaacatgt

SEQ ID NO: 5000340 - DNA, 17 bp, Homo sapiens
ttcttattttgtaataa

SEQ ID NO: 5000341 - DNA, 19 bp, Homo sapiens
ttcttattttgtaataaac

SEQ ID NO: 5000342 - DNA, 14 bp, Homo sapiens
ttcttgtctctgag

SEQ ID NO: 5000343 - DNA, 14 bp, Homo sapiens
ttgacagaacactg

SEQ ID NO: 5000344 - DNA, 13 bp, Homo sapiens
ttgcaaggaagcc

SEQ ID NO: 5000345 - DNA, 22 bp, Homo sapiens
ttgcagatagaatttggcccag

SEQ ID NO: 5000346 - DNA, 18 bp, Homo sapiens
ttgccatccctccctcca

SEQ ID NO: 5000347 - DNA, 22 bp, Homo sapiens
ttgccatccctccctccacctc

SEQ ID NO: 5000348 - DNA, 23 bp, Homo sapiens
ttgccatccctccctccacctcc

SEQ ID NO: 5000349 - DNA, 13 bp, Homo sapiens
ttgcctcaacagc

SEQ ID NO: 5000350 - DNA, 20 bp, Homo sapiens
ttgctcaccaagctgttcca

SEQ ID NO: 5000351 - DNA, 21 bp, Homo sapiens
ttggcactgtggaactgccac

SEQ ID NO: 5000352 - DNA, 22 bp, Homo sapiens
ttggcactgtggaactgccacc

SEQ ID NO: 5000353 - DNA, 11 bp, Homo sapiens
ttggcccagag

SEQ ID NO: 5000354 - DNA, 14 bp, Homo sapiens
ttgggtctgtgtca

SEQ ID NO: 5000355 - DNA, 12 bp, Homo sapiens
ttgtaataaact

SEQ ID NO: 5000356 - DNA, 14 bp, Homo sapiens
ttgtaataaactct

SEQ ID NO: 5000357 - DNA, 15 bp, Homo sapiens
ttgtaataaactctc

SEQ ID NO: 5000358 - DNA, 11 bp, Homo sapiens
ttgtgcagaga

SEQ ID NO: 5000359 - DNA, 16 bp, Homo sapiens
ttgttttgtgcagaga

SEQ ID NO: 5000360 - DNA, 24 bp, Homo sapiens
tttaactcaatattttccatgaaa

SEQ ID NO: 5000361 - DNA, 18 bp, Homo sapiens
tttagcacatcactgaga

SEQ ID NO: 5000362 - DNA, 20 bp, Homo sapiens
tttagtacatggagctcagg

SEQ ID NO: 5000363 - DNA, 22 bp, Homo sapiens
tttatctgtgttgtctctctaa

SEQ ID NO: 5000364 - DNA, 14 bp, Homo sapiens
agctgccctctcct

SEQ ID NO: 5000365 - DNA, 15 bp, Homo sapiens
agctgccctctcctg

SEQ ID NO: 5000366 - DNA, 16 bp, Homo sapiens
agctgccctctcctgg

SEQ ID NO: 5000367 - DNA, 22 bp, Homo sapiens
agctgccctctcctgggcagct

SEQ ID NO: 5000368 - DNA, 16 bp, Homo sapiens
agctgcctcccctcct

SEQ ID NO: 5000369 - DNA, 20 bp, Homo sapiens
agctgctactagctctttga

SEQ ID NO: 5000370 - DNA, 15 bp, Homo sapiens
agctgctgggccagt

SEQ ID NO: 5000371 - DNA, 20 bp, Homo sapiens
cacaagacccaagtagctgc

SEQ ID NO: 5000372 - DNA, 14 bp, Homo sapiens
cacacccacctgct

SEQ ID NO: 5000373 - DNA, 19 bp, Homo sapiens
cacacccacctgctgctgt

SEQ ID NO: 5000374 - DNA, 18 bp, Homo sapiens
cacactggctcctggacc

SEQ ID NO: 5000375 - DNA, 15 bp, Homo sapiens
cacagaccctgccca

SEQ ID NO: 5000376 - DNA, 14 bp, Homo sapiens
cacagcagtcacag

SEQ ID NO: 5000377 - DNA, 16 bp, Homo sapiens
cacagcagtcacaggc

SEQ ID NO: 5000378 - DNA, 17 bp, Homo sapiens
cacagcagtcacaggcc

SEQ ID NO: 5000379 - DNA, 19 bp, Homo sapiens
cacagcagtcacaggccca

SEQ ID NO: 5000380 - DNA, 13 bp, Homo sapiens
cacaggcccagga

SEQ ID NO: 5000381 - DNA, 12 bp, Homo sapiens
cacagggaccac

SEQ ID NO: 5000382 - DNA, 12 bp, Homo sapiens
cacatccacccc

SEQ ID NO: 5000383 - DNA, 15 bp, Homo sapiens
cacatctgtggagat

SEQ ID NO: 5000384 - DNA, 22 bp, Homo sapiens
caccaagttggaacatccttgg

SEQ ID NO: 5000385 - DNA, 20 bp, Homo sapiens
caccagctgccaaaatcgta

SEQ ID NO: 5000386 - DNA, 16 bp, Homo sapiens
cacccacctgctgctg

SEQ ID NO: 5000387 - DNA, 18 bp, Homo sapiens
cacccacctgctgctgta

SEQ ID NO: 5000388 - DNA, 13 bp, Homo sapiens
cacccatatctgt

SEQ ID NO: 5000389 - DNA, 14 bp, Homo sapiens
caccccatccctgg

SEQ ID NO: 5000390 - DNA, 18 bp, Homo sapiens
caccccatccctggctga

SEQ ID NO: 5000391 - DNA, 13 bp, Homo sapiens
cacccccctgtgc

SEQ ID NO: 5000392 - DNA, 20 bp, Homo sapiens
cacccccctgtgcctgctgg

SEQ ID NO: 5000393 - DNA, 18 bp, Homo sapiens
cacctaagcaatcactgg

SEQ ID NO: 5000394 - DNA, 19 bp, Homo sapiens
cacctaagcaatcactggg

SEQ ID NO: 5000395 - DNA, 14 bp, Homo sapiens
cacctcccagggct

SEQ ID NO: 5000396 - DNA, 13 bp, Homo sapiens
cacctccctgcaa

SEQ ID NO: 5000397 - DNA, 21 bp, Homo sapiens
cacctccttcctcagtcctgg

SEQ ID NO: 5000398 - DNA, 18 bp, Homo sapiens
caccttgggtctgtgtca

SEQ ID NO: 5000399 - DNA, 15 bp, Homo sapiens
cacggggcaaagctg

SEQ ID NO: 5000400 - DNA, 16 bp, Homo sapiens
cacggggcaaagctgc

SEQ ID NO: 5000401 - DNA, 20 bp, Homo sapiens
cacggggcaaagctgctggg

SEQ ID NO: 5000402 - DNA, 17 bp, Homo sapiens
cactcttctccattccc

SEQ ID NO: 5000403 - DNA, 15 bp, Homo sapiens
cactgagaagatggc

SEQ ID NO: 5000404 - DNA, 20 bp, Homo sapiens
cactgcacccccctgtgcct

SEQ ID NO: 5000405 - DNA, 21 bp, Homo sapiens
cactgcacccccctgtgcctg

SEQ ID NO: 5000406 - DNA, 15 bp, Homo sapiens
cactgccctccaggg

SEQ ID NO: 5000407 - DNA, 17 bp, Homo sapiens
cactgccctccagggcc

SEQ ID NO: 5000408 - DNA, 18 bp, Homo sapiens
cactgccctccagggcca

SEQ ID NO: 5000409 - DNA, 19 bp, Homo sapiens
cactgccctccagggccag

SEQ ID NO: 5000410 - DNA, 20 bp, Homo sapiens
cactgccctccagggccagg

SEQ ID NO: 5000411 - DNA, 21 bp, Homo sapiens
cactgccctccagggccagga

SEQ ID NO: 5000412 - DNA, 23 bp, Homo sapiens
cactggcgcatcatatgcagtga

SEQ ID NO: 5000413 - DNA, 18 bp, Homo sapiens
cactggctcctggaccta

SEQ ID NO: 5000414 - DNA, 22 bp, Homo sapiens
cactggctcctggacctaaagg

SEQ ID NO: 5000415 - DNA, 13 bp, Homo sapiens
cactgggcccaga

SEQ ID NO: 5000416 - DNA, 14 bp, Homo sapiens
cactgggcccagag

SEQ ID NO: 5000417 - DNA, 22 bp, Homo sapiens
cactgtcagccctcactgtcag

SEQ ID NO: 5000418 - DNA, 14 bp, Homo sapiens
cactgtcagtccca

SEQ ID NO: 5000419 - DNA, 20 bp, Homo sapiens
cactgtcagtcccactgcac

SEQ ID NO: 5000420 - DNA, 13 bp, Homo sapiens
cactgtccagggc

SEQ ID NO: 5000421 - DNA, 16 bp, Homo sapiens
cactgtccagggccca

SEQ ID NO: 5000422 - DNA, 16 bp, Homo sapiens
cacttgcctgtcaccc

SEQ ID NO: 5000423 - DNA, 18 bp, Homo sapiens
cactttcagtgaaagcat

SEQ ID NO: 5000424 - DNA, 22 bp, Homo sapiens
cactttccttttcttgtctctg

SEQ ID NO: 5000425 - DNA, 18 bp, Homo sapiens
cagaaagatggagaggca

SEQ ID NO: 5000426 - DNA, 18 bp, Homo sapiens
cagaaagtgcagcatgga

SEQ ID NO: 5000427 - DNA, 21 bp, Homo sapiens
cagaaagtgcagcatggagga

SEQ ID NO: 5000428 - DNA, 15 bp, Homo sapiens
cagaagaaggcagca

SEQ ID NO: 5000429 - DNA, 15 bp, Homo sapiens
cagaagactctccac

SEQ ID NO: 5000430 - DNA, 22 bp, Homo sapiens
cagaatatggacaaagaaggca

SEQ ID NO: 5000431 - DNA, 18 bp, Homo sapiens
cagaatggggtgcatgaa

SEQ ID NO: 5000432 - DNA, 13 bp, Homo sapiens
cagacagcagctg

SEQ ID NO: 5000433 - DNA, 19 bp, Homo sapiens
cagacagcagctggacttg

SEQ ID NO: 5000434 - DNA, 12 bp, Homo sapiens
cagacaggagga

SEQ ID NO: 5000435 - DNA, 22 bp, Homo sapiens
cagacaggaggagtgggacaga

SEQ ID NO: 5000436 - DNA, 18 bp, Homo sapiens
cagacattttcctcacac

SEQ ID NO: 5000437 - DNA, 20 bp, Homo sapiens
cagacattttcctcacaccc

SEQ ID NO: 5000438 - DNA, 20 bp, Homo sapiens
cagaccctgcccaccccatc

SEQ ID NO: 5000439 - DNA, 17 bp, Homo sapiens
cagagaccaaacaagga

SEQ ID NO: 5000440 - DNA, 15 bp, Homo sapiens
cagagctgccctctc

SEQ ID NO: 5000441 - DNA, 15 bp, Homo sapiens
cagaggagaggagac

SEQ ID NO: 5000442 - DNA, 18 bp, Homo sapiens
cagaggagaggagacaga

SEQ ID NO: 5000443 - DNA, 21 bp, Homo sapiens
cagagggcagtctagtcctgg

SEQ ID NO: 5000444 - DNA, 14 bp, Homo sapiens
cagagtggagccca

SEQ ID NO: 5000445 - DNA, 21 bp, Homo sapiens
cagagtggagcccagggtgct

SEQ ID NO: 5000446 - DNA, 21 bp, Homo sapiens
cagatagaatttggcccagag

SEQ ID NO: 5000447 - DNA, 14 bp, Homo sapiens
cagatcccagggta

SEQ ID NO: 5000448 - DNA, 20 bp, Homo sapiens
cagatcccagggtacactct

SEQ ID NO: 5000449 - DNA, 14 bp, Homo sapiens
cagatcctcttctc

SEQ ID NO: 5000450 - DNA, 15 bp, Homo sapiens
cagcaggaggcacag

SEQ ID NO: 5000451 - DNA, 18 bp, Homo sapiens
cagcaggaggcacagcag

SEQ ID NO: 5000452 - DNA, 22 bp, Homo sapiens
cagcagtcacaggcccaggaag

SEQ ID NO: 5000453 - DNA, 18 bp, Homo sapiens
cagcagttcagagctgcc

SEQ ID NO: 5000454 - DNA, 20 bp, Homo sapiens
cagccagaggaggccggtga

SEQ ID NO: 5000455 - DNA, 22 bp, Homo sapiens
cagccagcagttcagagctgcc

SEQ ID NO: 5000456 - DNA, 15 bp, Homo sapiens
cagccctccccacct

SEQ ID NO: 5000457 - DNA, 18 bp, Homo sapiens
cagccctccccacctgct

SEQ ID NO: 5000458 - DNA, 20 bp, Homo sapiens
cagccctccccacctgctca

SEQ ID NO: 5000459 - DNA, 22 bp, Homo sapiens
cagctaataaaagtcagagctc

SEQ ID NO: 5000460 - DNA, 24 bp, Homo sapiens
cagctaataaaagtcagagctcag

SEQ ID NO: 5000461 - DNA, 22 bp, Homo sapiens
cagctagagcttccactgtcag

SEQ ID NO: 5000462 - DNA, 12 bp, Homo sapiens
cagctaggaagc

SEQ ID NO: 5000463 - DNA, 9 bp, Homo sapiens
cagctgcct

SEQ ID NO: 5000464 - DNA, 11 bp, Homo sapiens
cagctgcctcc

SEQ ID NO: 5000465 - DNA, 20 bp, Homo sapiens
cagctgcctcccctcctctg

SEQ ID NO: 5000466 - DNA, 22 bp, Homo sapiens
caggaaagatgtcccacaggga

SEQ ID NO: 5000467 - DNA, 15 bp, Homo sapiens
caggaaggcggcagg

SEQ ID NO: 5000468 - DNA, 21 bp, Homo sapiens
caggaggagtgggacagacag

SEQ ID NO: 5000469 - DNA, 23 bp, Homo sapiens
caggaggagtgggacagacagca

SEQ ID NO: 5000470 - DNA, 12 bp, Homo sapiens
caggaggcacag

SEQ ID NO: 5000471 - DNA, 13 bp, Homo sapiens
caggaggcacagc

SEQ ID NO: 5000472 - DNA, 14 bp, Homo sapiens
caggaggcacagca

SEQ ID NO: 5000473 - DNA, 19 bp, Homo sapiens
caggattcaggcctctgag

SEQ ID NO: 5000474 - DNA, 20 bp, Homo sapiens
caggattcaggcctctgagg

SEQ ID NO: 5000475 - DNA, 21 bp, Homo sapiens
caggattcaggcctctgagga

SEQ ID NO: 5000476 - DNA, 12 bp, Homo sapiens
caggcaccatct

SEQ ID NO: 5000477 - DNA, 15 bp, Homo sapiens
caggcccaggaaggc

SEQ ID NO: 5000478 - DNA, 20 bp, Homo sapiens
caggcccaggaaggcggcag

SEQ ID NO: 5000479 - DNA, 19 bp, Homo sapiens
caggcctcacctcccaggg

SEQ ID NO: 5000480 - DNA, 14 bp, Homo sapiens
caggcctctgagga

SEQ ID NO: 5000481 - DNA, 15 bp, Homo sapiens
caggcctctgaggag

SEQ ID NO: 5000482 - DNA, 19 bp, Homo sapiens
caggcctctgaggagccca

SEQ ID NO: 5000483 - DNA, 20 bp, Homo sapiens
caggcctctgaggagcccac

SEQ ID NO: 5000484 - DNA, 13 bp, Homo sapiens
caggcctgggtca

SEQ ID NO: 5000485 - DNA, 23 bp, Homo sapiens
caggcctgggtcacgctcaagga

SEQ ID NO: 5000486 - DNA, 17 bp, Homo sapiens
caggctaattagaggat

SEQ ID NO: 5000487 - DNA, 18 bp, Homo sapiens
cagggaccacatccaccc

SEQ ID NO: 5000488 - DNA, 20 bp, Homo sapiens
cagggccaggattcaggcct

SEQ ID NO: 5000489 - DNA, 19 bp, Homo sapiens
cagggcccatgtagctggc

SEQ ID NO: 5000490 - DNA, 15 bp, Homo sapiens
cagggctacacagac

SEQ ID NO: 5000491 - DNA, 18 bp, Homo sapiens
cagggctacacagaccct

SEQ ID NO: 5000492 - DNA, 12 bp, Homo sapiens
caggggtgctgg

SEQ ID NO: 5000493 - DNA, 14 bp, Homo sapiens
caggggtgctgggg

SEQ ID NO: 5000494 - DNA, 15 bp, Homo sapiens
caggggtgctggggc

SEQ ID NO: 5000495 - DNA, 17 bp, Homo sapiens
cagggtgctgggatggc

SEQ ID NO: 5000496 - DNA, 15 bp, Homo sapiens
caggtcctcacagca

SEQ ID NO: 5000497 - DNA, 13 bp, Homo sapiens
ccatgactgctca

SEQ ID NO: 5000498 - DNA, 16 bp, Homo sapiens
ccatgactgctcaggc

SEQ ID NO: 5000499 - DNA, 17 bp, Homo sapiens
ccatgactgctcaggcc

SEQ ID NO: 5000500 - DNA, 20 bp, Homo sapiens
ccatgactgctcaggcctca

SEQ ID NO: 5000501 - DNA, 14 bp, Homo sapiens
ccatgatcacacag

SEQ ID NO: 5000502 - DNA, 21 bp, Homo sapiens
ccatgcaccctcatacacaga

SEQ ID NO: 5000503 - DNA, 17 bp, Homo sapiens
ccatgggagagtccagg

SEQ ID NO: 5000504 - DNA, 19 bp, Homo sapiens
ccatgggagagtccaggcc

SEQ ID NO: 5000505 - DNA, 20 bp, Homo sapiens
ccatgggagagtccaggcct

SEQ ID NO: 5000506 - DNA, 21 bp, Homo sapiens
ccatgggagagtccaggcctg

SEQ ID NO: 5000507 - DNA, 22 bp, Homo sapiens
ccatgggagagtccaggcctgg

SEQ ID NO: 5000508 - DNA, 22 bp, Homo sapiens
ccatgggctcagggccaggtcc

SEQ ID NO: 5000509 - DNA, 14 bp, Homo sapiens
ccatgtagctggca

SEQ ID NO: 5000510 - DNA, 18 bp, Homo sapiens
ccattactaaagacagaa

SEQ ID NO: 5000511 - DNA, 17 bp, Homo sapiens
ccattatgaagaagaga

SEQ ID NO: 5000512 - DNA, 17 bp, Homo sapiens
cccaaattggtgtttct

SEQ ID NO: 5000513 - DNA, 21 bp, Homo sapiens
cccaattcttacaaacatgtg

SEQ ID NO: 5000514 - DNA, 12 bp, Homo sapiens
cccacctgctgc

SEQ ID NO: 5000515 - DNA, 19 bp, Homo sapiens
cccacggggcaaagctgct

SEQ ID NO: 5000516 - DNA, 23 bp, Homo sapiens
cccacggggcaaagctgctgggc

SEQ ID NO: 5000517 - DNA, 23 bp, Homo sapiens
cccactgcacccccctgtgcctg

SEQ ID NO: 5000518 - DNA, 16 bp, Homo sapiens
cccactgccctccagg

SEQ ID NO: 5000519 - DNA, 21 bp, Homo sapiens
cccactgccctccagggccag

SEQ ID NO: 5000520 - DNA, 16 bp, Homo sapiens
cccactttcttctacc

SEQ ID NO: 5000521 - DNA, 22 bp, Homo sapiens
cccagacttctctttcttattt

SEQ ID NO: 5000522 - DNA, 15 bp, Homo sapiens
cccagaggagaggag

SEQ ID NO: 5000523 - DNA, 19 bp, Homo sapiens
cccagaggagaggagacag

SEQ ID NO: 5000524 - DNA, 20 bp, Homo sapiens
cccagccagcagttcagagc

SEQ ID NO: 5000525 - DNA, 14 bp, Homo sapiens
cccagccccactgc

SEQ ID NO: 5000526 - DNA, 16 bp, Homo sapiens
cccagccccactgccc

SEQ ID NO: 5000527 - DNA, 17 bp, Homo sapiens
cccagccccactgccct

SEQ ID NO: 5000528 - DNA, 18 bp, Homo sapiens
cccagccccactgccctc

SEQ ID NO: 5000529 - DNA, 22 bp, Homo sapiens
cccagccccactgccctccagg

SEQ ID NO: 5000530 - DNA, 24 bp, Homo sapiens
cccagccctccccacctgctcacc

SEQ ID NO: 5000531 - DNA, 12 bp, Homo sapiens
cccaggaaggcg

SEQ ID NO: 5000532 - DNA, 18 bp, Homo sapiens
cccaggaaggcggcaggc

SEQ ID NO: 5000533 - DNA, 21 bp, Homo sapiens
cccaggaaggcggcaggcaga

SEQ ID NO: 5000534 - DNA, 23 bp, Homo sapiens
cccaggaaggcggcaggcagaga

SEQ ID NO: 5000535 - DNA, 14 bp, Homo sapiens
cccaggatttgact

SEQ ID NO: 5000536 - DNA, 13 bp, Homo sapiens
cccagggtgctgg

SEQ ID NO: 5000537 - DNA, 15 bp, Homo sapiens
cccagggtgctggga

SEQ ID NO: 5000538 - DNA, 18 bp, Homo sapiens
cccatatctgtgtgccct

SEQ ID NO: 5000539 - DNA, 23 bp, Homo sapiens
cccatatctgtgtgccctagggc

SEQ ID NO: 5000540 - DNA, 18 bp, Homo sapiens
cccatgtagctggcaagc

SEQ ID NO: 5000541 - DNA, 15 bp, Homo sapiens
ccccaaagtccaggc

SEQ ID NO: 5000542 - DNA, 14 bp, Homo sapiens
ccccaactgcagga

SEQ ID NO: 5000543 - DNA, 13 bp, Homo sapiens
ccccacctgctca

SEQ ID NO: 5000544 - DNA, 19 bp, Homo sapiens
ccccactgccctccagggc

SEQ ID NO: 5000545 - DNA, 21 bp, Homo sapiens
ccccactgccctccagggcca

SEQ ID NO: 5000546 - DNA, 22 bp, Homo sapiens
ccccactgccctccagggccag

SEQ ID NO: 5000547 - DNA, 13 bp, Homo sapiens
ccccagacttctc

SEQ ID NO: 5000548 - DNA, 14 bp, Homo sapiens
ccccatccctggct

SEQ ID NO: 5000549 - DNA, 18 bp, Homo sapiens
cccccctgtgcctgctgg

SEQ ID NO: 5000550 - DNA, 13 bp, Homo sapiens
ccccctgtgcctg

SEQ ID NO: 5000551 - DNA, 14 bp, Homo sapiens
cccctcctctgctt

SEQ ID NO: 5000552 - DNA, 17 bp, Homo sapiens
ccccttggcactgtgga

SEQ ID NO: 5000553 - DNA, 15 bp, Homo sapiens
ccctcagatcccagg

SEQ ID NO: 5000554 - DNA, 16 bp, Homo sapiens
ccctcagatcccaggg

SEQ ID NO: 5000555 - DNA, 17 bp, Homo sapiens
ccctcagatcccagggt

SEQ ID NO: 5000556 - DNA, 19 bp, Homo sapiens
ccctccacctccctgcaat

SEQ ID NO: 5000557 - DNA, 15 bp, Homo sapiens
ccctccagggccagg
